United States Patent 12,031,154 (UNIVERSAL DONOR STEM CELLS AND RELATED METHODS) - sequence listing, part 2

SEQ ID NO: 18047 - DNA, 20 bp, synthetic construct
  misc_feature 1..20: note = CRISPR gRNA sequence
  source 1..20: mol_type = other DNA
ttgcttgaacctgggaggcg

SEQ ID NO: 18048 - DNA, 20 bp, synthetic construct
  misc_feature 1..20: note = CRISPR gRNA sequence
  source 1..20: mol_type = other DNA
tgcttgaacctgggaggcgg

SEQ ID NO: 18049 - DNA, 20 bp, synthetic construct
  misc_feature 1..20: note = CRISPR gRNA sequence
  source 1..20: mol_type = other DNA
aacctgggaggcggaggttg

SEQ ID NO: 18050 - DNA, 20 bp, synthetic construct
  misc_feature 1..20: note = CRISPR gRNA sequence
  source 1..20: mol_type = other DNA
tgggaggcggaggttgcagt

SEQ ID NO: 18051 - DNA, 20 bp, synthetic construct
  misc_feature 1..20: note = CRISPR gRNA sequence
  source 1..20: mol_type = other DNA
ggcggaggttgcagtgagcc

SEQ ID NO: 18052 - DNA, 20 bp, synthetic construct
  misc_feature 1..20: note = CRISPR gRNA sequence
  source 1..20: mol_type = other DNA
gagatcacgccactgcactc

SEQ ID NO: 18053 - DNA, 20 bp, synthetic construct
  misc_feature 1..20: note = CRISPR gRNA sequence
  source 1..20: mol_type = other DNA
acgccactgcactccagcct

SEQ ID NO: 18054 - DNA, 20 bp, synthetic construct
  misc_feature 1..20: note = CRISPR gRNA sequence
  source 1..20: mol_type = other DNA
ctgcactccagcctcggtga

SEQ ID NO: 18055 - DNA, 20 bp, synthetic construct
  misc_feature 1..20: note = CRISPR gRNA sequence
  source 1..20: mol_type = other DNA
gcactccagcctcggtgaca

SEQ ID NO: 18056 - DNA, 20 bp, synthetic construct
  misc_feature 1..20: note = CRISPR gRNA sequence
  source 1..20: mol_type = other DNA
tccagcctcggtgacagagc

SEQ ID NO: 18057 - DNA, 20 bp, synthetic construct
  misc_feature 1..20: note = CRISPR gRNA sequence
  source 1..20: mol_type = other DNA
gacagagcaagactctgtct

SEQ ID NO: 18058 - DNA, 20 bp, synthetic construct
  misc_feature 1..20: note = CRISPR gRNA sequence
  source 1..20: mol_type = other DNA
gtctcagacaaaaaaaaaaa

SEQ ID NO: 18059 - DNA, 20 bp, synthetic construct
  misc_feature 1..20: note = CRISPR gRNA sequence
  source 1..20: mol_type = other DNA
gacaaaaaaaaaaaaagctt

SEQ ID NO: 18060 - DNA, 20 bp, synthetic construct
  misc_feature 1..20: note = CRISPR gRNA sequence
  source 1..20: mol_type = other DNA
aaaaaaaaaaaaagcttgag

SEQ ID NO: 18061 - DNA, 20 bp, synthetic construct
  misc_feature 1..20: note = CRISPR gRNA sequence
  source 1..20: mol_type = other DNA
aaaaaaaaaaaagcttgaga

SEQ ID NO: 18062 - DNA, 20 bp, synthetic construct
  misc_feature 1..20: note = CRISPR gRNA sequence
  source 1..20: mol_type = other DNA
gaccatgaacttctcctcct

SEQ ID NO: 18063 - DNA, 20 bp, synthetic construct
  misc_feature 1..20: note = CRISPR gRNA sequence
  source 1..20: mol_type = other DNA
accatgaacttctcctcctg

SEQ ID NO: 18064 - DNA, 20 bp, synthetic construct
  misc_feature 1..20: note = CRISPR gRNA sequence
  source 1..20: mol_type = other DNA
cttctcctcctgaggaataa

SEQ ID NO: 18065 - DNA, 20 bp, synthetic construct
  misc_feature 1..20: note = CRISPR gRNA sequence
  source 1..20: mol_type = other DNA
ttctcctcctgaggaataat

SEQ ID NO: 18066 - DNA, 20 bp, synthetic construct
  misc_feature 1..20: note = CRISPR gRNA sequence
  source 1..20: mol_type = other DNA
tcctcctgaggaataatggg

SEQ ID NO: 18067 - DNA, 20 bp, synthetic construct
  misc_feature 1..20: note = CRISPR gRNA sequence
  source 1..20: mol_type = other DNA
agacctctgaactgtgtgcc

SEQ ID NO: 18068 - DNA, 20 bp, synthetic construct
  misc_feature 1..20: note = CRISPR gRNA sequence
  source 1..20: mol_type = other DNA
acctctgaactgtgtgccta

SEQ ID NO: 18069 - DNA, 20 bp, synthetic construct
  misc_feature 1..20: note = CRISPR gRNA sequence
  source 1..20: mol_type = other DNA
gaactgtgtgcctagagaca

SEQ ID NO: 18070 - DNA, 20 bp, synthetic construct
  misc_feature 1..20: note = CRISPR gRNA sequence
  source 1..20: mol_type = other DNA
tgtgcctagagacatggttt

SEQ ID NO: 18071 - DNA, 20 bp, synthetic construct
  misc_feature 1..20: note = CRISPR gRNA sequence
  source 1..20: mol_type = other DNA
tctgctctgcctttgatcct

SEQ ID NO: 18072 - DNA, 20 bp, synthetic construct
  misc_feature 1..20: note = CRISPR gRNA sequence
  source 1..20: mol_type = other DNA
tgatcctgagtacattacct

SEQ ID NO: 18073 - DNA, 20 bp, synthetic construct
  misc_feature 1..20: note = CRISPR gRNA sequence
  source 1..20: mol_type = other DNA
gtacattaccttagccctct

SEQ ID NO: 18074 - DNA, 20 bp, synthetic construct
  misc_feature 1..20: note = CRISPR gRNA sequence
  source 1..20: mol_type = other DNA
ctctgagcctccgtttcaac

SEQ ID NO: 18075 - DNA, 20 bp, synthetic construct
  misc_feature 1..20: note = CRISPR gRNA sequence
  source 1..20: mol_type = other DNA
gcctccgtttcaacgagtgt

SEQ ID NO: 18076 - DNA, 20 bp, synthetic construct
  misc_feature 1..20: note = CRISPR gRNA sequence
  source 1..20: mol_type = other DNA
ctccgtttcaacgagtgttg

SEQ ID NO: 18077 - DNA, 20 bp, synthetic construct
  misc_feature 1..20: note = CRISPR gRNA sequence
  source 1..20: mol_type = other DNA
gtgttggagccccttcaatt

SEQ ID NO: 18078 - DNA, 20 bp, synthetic construct
  misc_feature 1..20: note = CRISPR gRNA sequence
  source 1..20: mol_type = other DNA
cccttcaattgagtcttttt

SEQ ID NO: 18079 - DNA, 20 bp, synthetic construct
  misc_feature 1..20: note = CRISPR gRNA sequence
  source 1..20: mol_type = other DNA
gattctgattcctcgttgcc

SEQ ID NO: 18080 - DNA, 20 bp, synthetic construct
  misc_feature 1..20: note = CRISPR gRNA sequence
  source 1..20: mol_type = other DNA
tctgattcctcgttgcctgg

SEQ ID NO: 18081 - DNA, 20 bp, synthetic construct
  misc_feature 1..20: note = CRISPR gRNA sequence
  source 1..20: mol_type = other DNA
ttctccttttcctttccccc

SEQ ID NO: 18082 - DNA, 20 bp, synthetic construct
  misc_feature 1..20: note = CRISPR gRNA sequence
  source 1..20: mol_type = other DNA
tctccttttcctttccccca

SEQ ID NO: 18083 - DNA, 20 bp, synthetic construct
  misc_feature 1..20: note = CRISPR gRNA sequence
  source 1..20: mol_type = other DNA
ctgctccccaacctcatgac

SEQ ID NO: 18084 - DNA, 20 bp, synthetic construct
  misc_feature 1..20: note = CRISPR gRNA sequence
  source 1..20: mol_type = other DNA
acctcatgacaagctgcttc

SEQ ID NO: 18085 - DNA, 20 bp, synthetic construct
  misc_feature 1..20: note = CRISPR gRNA sequence
  source 1..20: mol_type = other DNA
cctcatgacaagctgcttcc

SEQ ID NO: 18086 - DNA, 20 bp, synthetic construct
  misc_feature 1..20: note = CRISPR gRNA sequence
  source 1..20: mol_type = other DNA
ctcatgacaagctgcttccg

SEQ ID NO: 18087 - DNA, 20 bp, synthetic construct
  misc_feature 1..20: note = CRISPR gRNA sequence
  source 1..20: mol_type = other DNA
tcatgacaagctgcttccgg

SEQ ID NO: 18088 - DNA, 20 bp, synthetic construct
  misc_feature 1..20: note = CRISPR gRNA sequence
  source 1..20: mol_type = other DNA
agctgcttccgggggccaaa

SEQ ID NO: 18089 - DNA, 20 bp, synthetic construct
  misc_feature 1..20: note = CRISPR gRNA sequence
  source 1..20: mol_type = other DNA
ttccgggggccaaatggtgt

SEQ ID NO: 18090 - DNA, 20 bp, synthetic construct
  misc_feature 1..20: note = CRISPR gRNA sequence
  source 1..20: mol_type = other DNA
tccgggggccaaatggtgtt

SEQ ID NO: 18091 - DNA, 20 bp, synthetic construct
  misc_feature 1..20: note = CRISPR gRNA sequence
  source 1..20: mol_type = other DNA
gggggccaaatggtgttggg

SEQ ID NO: 18092 - DNA, 20 bp, synthetic construct
  misc_feature 1..20: note = CRISPR gRNA sequence
  source 1..20: mol_type = other DNA
gccaaatggtgttgggaagc

SEQ ID NO: 18093 - DNA, 20 bp, synthetic construct
  misc_feature 1..20: note = CRISPR gRNA sequence
  source 1..20: mol_type = other DNA
ccaaatggtgttgggaagcc

SEQ ID NO: 18094 - DNA, 20 bp, synthetic construct
  misc_feature 1..20: note = CRISPR gRNA sequence
  source 1..20: mol_type = other DNA
caaatggtgttgggaagcca

SEQ ID NO: 18095 - DNA, 20 bp, synthetic construct
  misc_feature 1..20: note = CRISPR gRNA sequence
  source 1..20: mol_type = other DNA
aaatggtgttgggaagccag

SEQ ID NO: 18096 - DNA, 20 bp, synthetic construct
  misc_feature 1..20: note = CRISPR gRNA sequence
  source 1..20: mol_type = other DNA
gtgttgggaagccaggggcc

SEQ ID NO: 18097 - DNA, 20 bp, synthetic construct
  misc_feature 1..20: note = CRISPR gRNA sequence
  source 1..20: mol_type = other DNA
tgttgggaagccaggggcct

SEQ ID NO: 18098 - DNA, 20 bp, synthetic construct
  misc_feature 1..20: note = CRISPR gRNA sequence
  source 1..20: mol_type = other DNA
gaatgcctatctaccatgac

SEQ ID NO: 18099 - DNA, 20 bp, synthetic construct
  misc_feature 1..20: note = CRISPR gRNA sequence
  source 1..20: mol_type = other DNA
taccatgaccagaccccaaa

SEQ ID NO: 18100 - DNA, 20 bp, synthetic construct
  misc_feature 1..20: note = CRISPR gRNA sequence
  source 1..20: mol_type = other DNA
gaccccaaacagcttctttg

SEQ ID NO: 18101 - DNA, 20 bp, synthetic construct
  misc_feature 1..20: note = CRISPR gRNA sequence
  source 1..20: mol_type = other DNA
accccaaacagcttctttgt

SEQ ID NO: 18102 - DNA, 20 bp, synthetic construct
  misc_feature 1..20: note = CRISPR gRNA sequence
  source 1..20: mol_type = other DNA
ccccaaacagcttctttgtg

SEQ ID NO: 18103 - DNA, 20 bp, synthetic construct
  misc_feature 1..20: note = CRISPR gRNA sequence
  source 1..20: mol_type = other DNA
cccaaacagcttctttgtgg

SEQ ID NO: 18104 - DNA, 20 bp, synthetic construct
  misc_feature 1..20: note = CRISPR gRNA sequence
  source 1..20: mol_type = other DNA
aaacagcttctttgtggggg

SEQ ID NO: 18105 - DNA, 20 bp, synthetic construct
  misc_feature 1..20: note = CRISPR gRNA sequence
  source 1..20: mol_type = other DNA
cagcttctttgtgggggtag

SEQ ID NO: 18106 - DNA, 20 bp, synthetic construct
  misc_feature 1..20: note = CRISPR gRNA sequence
  source 1..20: mol_type = other DNA
gtgggggtagtagctcaaat

SEQ ID NO: 18107 - DNA, 20 bp, synthetic construct
  misc_feature 1..20: note = CRISPR gRNA sequence
  source 1..20: mol_type = other DNA
gcttttgctcatgcaccctg

SEQ ID NO: 18108 - DNA, 20 bp, synthetic construct
  misc_feature 1..20: note = CRISPR gRNA sequence
  source 1..20: mol_type = other DNA
tcatgcaccctgtagtcctc

SEQ ID NO: 18109 - DNA, 20 bp, synthetic construct
  misc_feature 1..20: note = CRISPR gRNA sequence
  source 1..20: mol_type = other DNA
tagtcctccagataaactct

SEQ ID NO: 18110 - DNA, 20 bp, synthetic construct
  misc_feature 1..20: note = CRISPR gRNA sequence
  source 1..20: mol_type = other DNA
tctctcacttttcccctcta

SEQ ID NO: 18111 - DNA, 20 bp, synthetic construct
  misc_feature 1..20: note = CRISPR gRNA sequence
  source 1..20: mol_type = other DNA
ctgtaaaacaatgattcact

SEQ ID NO: 18112 - DNA, 20 bp, synthetic construct
  misc_feature 1..20: note = CRISPR gRNA sequence
  source 1..20: mol_type = other DNA
tgattcactgagcaccccgt

SEQ ID NO: 18113 - DNA, 20 bp, synthetic construct
  misc_feature 1..20: note = CRISPR gRNA sequence
  source 1..20: mol_type = other DNA
tcactgagcaccccgtaaga

SEQ ID NO: 18114 - DNA, 20 bp, synthetic construct
  misc_feature 1..20: note = CRISPR gRNA sequence
  source 1..20: mol_type = other DNA
caccccgtaagaaagtcact

SEQ ID NO: 18115 - DNA, 20 bp, synthetic construct
  misc_feature 1..20: note = CRISPR gRNA sequence
  source 1..20: mol_type = other DNA
cgtaagaaagtcactgagct

SEQ ID NO: 18116 - DNA, 20 bp, synthetic construct
  misc_feature 1..20: note = CRISPR gRNA sequence
  source 1..20: mol_type = other DNA
cactgagctcagttccttac

SEQ ID NO: 18117 - DNA, 20 bp, synthetic construct
  misc_feature 1..20: note = CRISPR gRNA sequence
  source 1..20: mol_type = other DNA
tcagttccttactggcccca

SEQ ID NO: 18118 - DNA, 20 bp, synthetic construct
  misc_feature 1..20: note = CRISPR gRNA sequence
  source 1..20: mol_type = other DNA
agttccttactggccccaaa

SEQ ID NO: 18119 - DNA, 20 bp, synthetic construct
  misc_feature 1..20: note = CRISPR gRNA sequence
  source 1..20: mol_type = other DNA
gttccttactggccccaaag

SEQ ID NO: 18120 - DNA, 20 bp, synthetic construct
  misc_feature 1..20: note = CRISPR gRNA sequence
  source 1..20: mol_type = other DNA
ccccaaagaggtttaccaca

SEQ ID NO: 18121 - DNA, 20 bp, synthetic construct
  misc_feature 1..20: note = CRISPR gRNA sequence
  source 1..20: mol_type = other DNA
ttaccacacagtccctgcca

SEQ ID NO: 18122 - DNA, 20 bp, synthetic construct
  misc_feature 1..20: note = CRISPR gRNA sequence
  source 1..20: mol_type = other DNA
accacacagtccctgccaaa

SEQ ID NO: 18123 - DNA, 20 bp, synthetic construct
  misc_feature 1..20: note = CRISPR gRNA sequence
  source 1..20: mol_type = other DNA
ccacacagtccctgccaaag

SEQ ID NO: 18124 - DNA, 20 bp, synthetic construct
  misc_feature 1..20: note = CRISPR gRNA sequence
  source 1..20: mol_type = other DNA
tgccaaagaggcttgcaatg

SEQ ID NO: 18125 - DNA, 20 bp, synthetic construct
  misc_feature 1..20: note = CRISPR gRNA sequence
  source 1..20: mol_type = other DNA
agaggcttgcaatgtagacc

SEQ ID NO: 18126 - DNA, 20 bp, synthetic construct
  misc_feature 1..20: note = CRISPR gRNA sequence
  source 1..20: mol_type = other DNA
tgtagacccagatgatattt

SEQ ID NO: 18127 - DNA, 20 bp, synthetic construct
  misc_feature 1..20: note = CRISPR gRNA sequence
  source 1..20: mol_type = other DNA
gtagacccagatgatatttt

SEQ ID NO: 18128 - DNA, 20 bp, synthetic construct
  misc_feature 1..20: note = CRISPR gRNA sequence
  source 1..20: mol_type = other DNA
agacccagatgatattttag

SEQ ID NO: 18129 - DNA, 20 bp, synthetic construct
  misc_feature 1..20: note = CRISPR gRNA sequence
  source 1..20: mol_type = other DNA
acccagatgatattttagga

SEQ ID NO: 18130 - DNA, 20 bp, synthetic construct
  misc_feature 1..20: note = CRISPR gRNA sequence
  source 1..20: mol_type = other DNA
ccagatgatattttaggaga

SEQ ID NO: 18131 - DNA, 20 bp, synthetic construct
  misc_feature 1..20: note = CRISPR gRNA sequence
  source 1..20: mol_type = other DNA
agagagacaaaacataataa

SEQ ID NO: 18132 - DNA, 20 bp, synthetic construct
  misc_feature 1..20: note = CRISPR gRNA sequence
  source 1..20: mol_type = other DNA
gacaaaacataataatagca

SEQ ID NO: 18133 - DNA, 20 bp, synthetic construct
  misc_feature 1..20: note = CRISPR gRNA sequence
  source 1..20: mol_type = other DNA
aaaacataataatagcatag

SEQ ID NO: 18134 - DNA, 20 bp, synthetic construct
  misc_feature 1..20: note = CRISPR gRNA sequence
  source 1..20: mol_type = other DNA
ataataatagcatagtggtt

SEQ ID NO: 18135 - DNA, 20 bp, synthetic construct
  misc_feature 1..20: note = CRISPR gRNA sequence
  source 1..20: mol_type = other DNA
taataatagcatagtggtta

SEQ ID NO: 18136 - DNA, 20 bp, synthetic construct
  misc_feature 1..20: note = CRISPR gRNA sequence
  source 1..20: mol_type = other DNA
aataatagcatagtggttaa

SEQ ID NO: 18137 - DNA, 20 bp, synthetic construct
  misc_feature 1..20: note = CRISPR gRNA sequence
  source 1..20: mol_type = other DNA
tagcatagtggttaagggtg

SEQ ID NO: 18138 - DNA, 20 bp, synthetic construct
  misc_feature 1..20: note = CRISPR gRNA sequence
  source 1..20: mol_type = other DNA
agcatagtggttaagggtgc

SEQ ID NO: 18139 - DNA, 20 bp, synthetic construct
  misc_feature 1..20: note = CRISPR gRNA sequence
  source 1..20: mol_type = other DNA
gtggttaagggtgcaggctc

SEQ ID NO: 18140 - DNA, 20 bp, synthetic construct
  misc_feature 1..20: note = CRISPR gRNA sequence
  source 1..20: mol_type = other DNA
tggttaagggtgcaggctct

SEQ ID NO: 18141 - DNA, 20 bp, synthetic construct
  misc_feature 1..20: note = CRISPR gRNA sequence
  source 1..20: mol_type = other DNA
caggctctgggttcaaatct

SEQ ID NO: 18142 - DNA, 20 bp, synthetic construct
  misc_feature 1..20: note = CRISPR gRNA sequence
  source 1..20: mol_type = other DNA
aaatgttactcaacctctct

SEQ ID NO: 18143 - DNA, 20 bp, synthetic construct
  misc_feature 1..20: note = CRISPR gRNA sequence
  source 1..20: mol_type = other DNA
tactcaacctctctgagtca

SEQ ID NO: 18144 - DNA, 20 bp, synthetic construct
  misc_feature 1..20: note = CRISPR gRNA sequence
  source 1..20: mol_type = other DNA
cagaatcgactgcattttgt

SEQ ID NO: 18145 - DNA, 20 bp, synthetic construct
  misc_feature 1..20: note = CRISPR gRNA sequence
  source 1..20: mol_type = other DNA
tcgactgcattttgttggca

SEQ ID NO: 18146 - DNA, 20 bp, synthetic construct
  misc_feature 1..20: note = CRISPR gRNA sequence
  source 1..20: mol_type = other DNA
tggcacagtgcttatgtcac

SEQ ID NO: 18147 - DNA, 20 bp, synthetic construct
  misc_feature 1..20: note = CRISPR gRNA sequence
  source 1..20: mol_type = other DNA
ggcacagtgcttatgtcact

SEQ ID NO: 18148 - DNA, 20 bp, synthetic construct
  misc_feature 1..20: note = CRISPR gRNA sequence
  source 1..20: mol_type = other DNA
gggttgttgtgacttaccta

SEQ ID NO: 18149 - DNA, 20 bp, synthetic construct
  misc_feature 1..20: note = CRISPR gRNA sequence
  source 1..20: mol_type = other DNA
gtgacttacctaaagtgact

SEQ ID NO: 18150 - DNA, 20 bp, synthetic construct
  misc_feature 1..20: note = CRISPR gRNA sequence
  source 1..20: mol_type = other DNA
cttacctaaagtgacttagc

SEQ ID NO: 18151 - DNA, 20 bp, synthetic construct
  misc_feature 1..20: note = CRISPR gRNA sequence
  source 1..20: mol_type = other DNA
cctaaagtgacttagcgagt

SEQ ID NO: 18152 - DNA, 20 bp, synthetic construct
  misc_feature 1..20: note = CRISPR gRNA sequence
  source 1..20: mol_type = other DNA
aaagtgacttagcgagtaag

SEQ ID NO: 18153 - DNA, 20 bp, synthetic construct
  misc_feature 1..20: note = CRISPR gRNA sequence
  source 1..20: mol_type = other DNA
cttagcgagtaagtggtact

SEQ ID NO: 18154 - DNA, 20 bp, synthetic construct
  misc_feature 1..20: note = CRISPR gRNA sequence
  source 1..20: mol_type = other DNA
tgtaaactccaaaaataaaa

SEQ ID NO: 18155 - DNA, 20 bp, synthetic construct
  misc_feature 1..20: note = CRISPR gRNA sequence
  source 1..20: mol_type = other DNA
actccaaaaataaaacagca

SEQ ID NO: 18156 - DNA, 20 bp, synthetic construct
  misc_feature 1..20: note = CRISPR gRNA sequence
  source 1..20: mol_type = other DNA
gacacttgatactgtacaac

SEQ ID NO: 18157 - DNA, 20 bp, synthetic construct
  misc_feature 1..20: note = CRISPR gRNA sequence
  source 1..20: mol_type = other DNA
tgatactgtacaactggcaa

SEQ ID NO: 18158 - DNA, 20 bp, synthetic construct
  misc_feature 1..20: note = CRISPR gRNA sequence
  source 1..20: mol_type = other DNA
actgtacaactggcaaaagt

SEQ ID NO: 18159 - DNA, 20 bp, synthetic construct
  misc_feature 1..20: note = CRISPR gRNA sequence
  source 1..20: mol_type = other DNA
actggcaaaagttagacatc

SEQ ID NO: 18160 - DNA, 20 bp, synthetic construct
  misc_feature 1..20: note = CRISPR gRNA sequence
  source 1..20: mol_type = other DNA
ctggcaaaagttagacatct

SEQ ID NO: 18161 - DNA, 20 bp, synthetic construct
  misc_feature 1..20: note = CRISPR gRNA sequence
  source 1..20: mol_type = other DNA
ttagacatctgggaaatgcc

SEQ ID NO: 18162 - DNA, 20 bp, synthetic construct
  misc_feature 1..20: note = CRISPR gRNA sequence
  source 1..20: mol_type = other DNA
atctgggaaatgccaagtgt

SEQ ID NO: 18163 - DNA, 20 bp, synthetic construct
  misc_feature 1..20: note = CRISPR gRNA sequence
  source 1..20: mol_type = other DNA
aatgccaagtgttggttaca

SEQ ID NO: 18164 - DNA, 20 bp, synthetic construct
  misc_feature 1..20: note = CRISPR gRNA sequence
  source 1..20: mol_type = other DNA
atgccaagtgttggttacac

SEQ ID NO: 18165 - DNA, 20 bp, synthetic construct
  misc_feature 1..20: note = CRISPR gRNA sequence
  source 1..20: mol_type = other DNA
gtgttggttacacgggtttg

SEQ ID NO: 18166 - DNA, 20 bp, synthetic construct
  misc_feature 1..20: note = CRISPR gRNA sequence
  source 1..20: mol_type = other DNA
tgttggttacacgggtttgt

SEQ ID NO: 18167 - DNA, 20 bp, synthetic construct
  misc_feature 1..20: note = CRISPR gRNA sequence
  source 1..20: mol_type = other DNA
tacacgggtttgtgggaatg

SEQ ID NO: 18168 - DNA, 20 bp, synthetic construct
  misc_feature 1..20: note = CRISPR gRNA sequence
  source 1..20: mol_type = other DNA
cgggtttgtgggaatgtaga

SEQ ID NO: 18169 - DNA, 20 bp, synthetic construct
  misc_feature 1..20: note = CRISPR gRNA sequence
  source 1..20: mol_type = other DNA
tttgtgggaatgtagatgga

SEQ ID NO: 18170 - DNA, 20 bp, synthetic construct
  misc_feature 1..20: note = CRISPR gRNA sequence
  source 1..20: mol_type = other DNA
ttgtgggaatgtagatggat

SEQ ID NO: 18171 - DNA, 20 bp, synthetic construct
  misc_feature 1..20: note = CRISPR gRNA sequence
  source 1..20: mol_type = other DNA
tgtgggaatgtagatggatg

SEQ ID NO: 18172 - DNA, 20 bp, synthetic construct
  misc_feature 1..20: note = CRISPR gRNA sequence
  source 1..20: mol_type = other DNA
gtagatggatggggccgctc

SEQ ID NO: 18173 - DNA, 20 bp, synthetic construct
  misc_feature 1..20: note = CRISPR gRNA sequence
  source 1..20: mol_type = other DNA
agatggatggggccgctctg

SEQ ID NO: 18174 - DNA, 20 bp, synthetic construct
  misc_feature 1..20: note = CRISPR gRNA sequence
  source 1..20: mol_type = other DNA
ggccgctctggagaacgacc

SEQ ID NO: 18175 - DNA, 20 bp, synthetic construct
  misc_feature 1..20: note = CRISPR gRNA sequence
  source 1..20: mol_type = other DNA
gagaacgacctggcatcatg

SEQ ID NO: 18176 - DNA, 20 bp, synthetic construct
  misc_feature 1..20: note = CRISPR gRNA sequence
  source 1..20: mol_type = other DNA
tggcatcatgtagaatatct

SEQ ID NO: 18177 - DNA, 20 bp, synthetic construct
  misc_feature 1..20: note = CRISPR gRNA sequence
  source 1..20: mol_type = other DNA
ggcatcatgtagaatatcta

SEQ ID NO: 18178 - DNA, 20 bp, synthetic construct
  misc_feature 1..20: note = CRISPR gRNA sequence
  source 1..20: mol_type = other DNA
gtagaatatctaaggatatg

SEQ ID NO: 18179 - DNA, 20 bp, synthetic construct
  misc_feature 1..20: note = CRISPR gRNA sequence
  source 1..20: mol_type = other DNA
gatatgtagatcctaccacc

SEQ ID NO: 18180 - DNA, 20 bp, synthetic construct
  misc_feature 1..20: note = CRISPR gRNA sequence
  source 1..20: mol_type = other DNA
gatcctaccacctggcaatt

SEQ ID NO: 18181 - DNA, 20 bp, synthetic construct
  misc_feature 1..20: note = CRISPR gRNA sequence
  source 1..20: mol_type = other DNA
ccacctggcaattcagctct

SEQ ID NO: 18182 - DNA, 20 bp, synthetic construct
  misc_feature 1..20: note = CRISPR gRNA sequence
  source 1..20: mol_type = other DNA
cacctggcaattcagctctt

SEQ ID NO: 18183 - DNA, 20 bp, synthetic construct
  misc_feature 1..20: note = CRISPR gRNA sequence
  source 1..20: mol_type = other DNA
tcttgggtctatatatcctg

SEQ ID NO: 18184 - DNA, 20 bp, synthetic construct
  misc_feature 1..20: note = CRISPR gRNA sequence
  source 1..20: mol_type = other DNA
gaaatgttcccacaactccc

SEQ ID NO: 18185 - DNA, 20 bp, synthetic construct
  misc_feature 1..20: note = CRISPR gRNA sequence
  source 1..20: mol_type = other DNA
aaatgttcccacaactcccc

SEQ ID NO: 18186 - DNA, 20 bp, synthetic construct
  misc_feature 1..20: note = CRISPR gRNA sequence
  source 1..20: mol_type = other DNA
atgttcccacaactccccag

SEQ ID NO: 18187 - DNA, 20 bp, synthetic construct
  misc_feature 1..20: note = CRISPR gRNA sequence
  source 1..20: mol_type = other DNA
ctccccaggagaacccatct

SEQ ID NO: 18188 - DNA, 20 bp, synthetic construct
  misc_feature 1..20: note = CRISPR gRNA sequence
  source 1..20: mol_type = other DNA
tccccaggagaacccatctg

SEQ ID NO: 18189 - DNA, 20 bp, synthetic construct
  misc_feature 1..20: note = CRISPR gRNA sequence
  source 1..20: mol_type = other DNA
caggagaacccatctgagga

SEQ ID NO: 18190 - DNA, 20 bp, synthetic construct
  misc_feature 1..20: note = CRISPR gRNA sequence
  source 1..20: mol_type = other DNA
ggttactgctgtgttatttg

SEQ ID NO: 18191 - DNA, 20 bp, synthetic construct
  misc_feature 1..20: note = CRISPR gRNA sequence
  source 1..20: mol_type = other DNA
tgctgtgttatttgtggtga

SEQ ID NO: 18192 - DNA, 20 bp, synthetic construct
  misc_feature 1..20: note = CRISPR gRNA sequence
  source 1..20: mol_type = other DNA
ctgtgttatttgtggtgaca

SEQ ID NO: 18193 - DNA, 20 bp, synthetic construct
  misc_feature 1..20: note = CRISPR gRNA sequence
  source 1..20: mol_type = other DNA
gtgttatttgtggtgacaga

SEQ ID NO: 18194 - DNA, 20 bp, synthetic construct
  misc_feature 1..20: note = CRISPR gRNA sequence
  source 1..20: mol_type = other DNA
tatttgtggtgacagagagt

SEQ ID NO: 18195 - DNA, 20 bp, synthetic construct
  misc_feature 1..20: note = CRISPR gRNA sequence
  source 1..20: mol_type = other DNA
tttgtggtgacagagagttg

SEQ ID NO: 18196 - DNA, 20 bp, synthetic construct
  misc_feature 1..20: note = CRISPR gRNA sequence
  source 1..20: mol_type = other DNA
ttgtggtgacagagagttgg

SEQ ID NO: 18197 - DNA, 20 bp, synthetic construct
  misc_feature 1..20: note = CRISPR gRNA sequence
  source 1..20: mol_type = other DNA
acagagagttggaggtcacc

SEQ ID NO: 18198 - DNA, 20 bp, synthetic construct
  misc_feature 1..20: note = CRISPR gRNA sequence
  source 1..20: mol_type = other DNA
cagagagttggaggtcacct

SEQ ID NO: 18199 - DNA, 20 bp, synthetic construct
  misc_feature 1..20: note = CRISPR gRNA sequence
  source 1..20: mol_type = other DNA
gtcacctaggtgtccatcac

SEQ ID NO: 18200 - DNA, 20 bp, synthetic construct
  misc_feature 1..20: note = CRISPR gRNA sequence
  source 1..20: mol_type = other DNA
tcacctaggtgtccatcact

SEQ ID NO: 18201 - DNA, 20 bp, synthetic construct
  misc_feature 1..20: note = CRISPR gRNA sequence
  source 1..20: mol_type = other DNA
cacctaggtgtccatcactg

SEQ ID NO: 18202 - DNA, 20 bp, synthetic construct
  misc_feature 1..20: note = CRISPR gRNA sequence
  source 1..20: mol_type = other DNA
acctaggtgtccatcactgg

SEQ ID NO: 18203 - DNA, 20 bp, synthetic construct
  misc_feature 1..20: note = CRISPR gRNA sequence
  source 1..20: mol_type = other DNA
ggtgtccatcactgggggtg

SEQ ID NO: 18204 - DNA, 20 bp, synthetic construct
  misc_feature 1..20: note = CRISPR gRNA sequence
  source 1..20: mol_type = other DNA
tccatcactgggggtgtgga

SEQ ID NO: 18205 - DNA, 20 bp, synthetic construct
  misc_feature 1..20: note = CRISPR gRNA sequence
  source 1..20: mol_type = other DNA
ccatcactgggggtgtggac

SEQ ID NO: 18206 - DNA, 20 bp, synthetic construct
  misc_feature 1..20: note = CRISPR gRNA sequence
  source 1..20: mol_type = other DNA
tgggggtgtggacaggtgaa

SEQ ID NO: 18207 - DNA, 20 bp, synthetic construct
  misc_feature 1..20: note = CRISPR gRNA sequence
  source 1..20: mol_type = other DNA
aaagtaacccctgcactcca

SEQ ID NO: 18208 - DNA, 20 bp, synthetic construct
  misc_feature 1..20: note = CRISPR gRNA sequence
  source 1..20: mol_type = other DNA
agtaacccctgcactccata

SEQ ID NO: 18209 - DNA, 20 bp, synthetic construct
  misc_feature 1..20: note = CRISPR gRNA sequence
  source 1..20: mol_type = other DNA
tagagaacaatgtccgtgat

SEQ ID NO: 18210 - DNA, 20 bp, synthetic construct
  misc_feature 1..20: note = CRISPR gRNA sequence
  source 1..20: mol_type = other DNA
agaacaatgtccgtgattag

SEQ ID NO: 18211 - DNA, 20 bp, synthetic construct
  misc_feature 1..20: note = CRISPR gRNA sequence
  source 1..20: mol_type = other DNA
aatgtccgtgattagaagca

SEQ ID NO: 18212 - DNA, 20 bp, synthetic construct
  misc_feature 1..20: note = CRISPR gRNA sequence
  source 1..20: mol_type = other DNA
gaagcaaagatcaaatgcat

SEQ ID NO: 18213 - DNA, 20 bp, synthetic construct
  misc_feature 1..20: note = CRISPR gRNA sequence
  source 1..20: mol_type = other DNA
gcaaagatcaaatgcatcag

SEQ ID NO: 18214 - DNA, 20 bp, synthetic construct
  misc_feature 1..20: note = CRISPR gRNA sequence
  source 1..20: mol_type = other DNA
agatcaaatgcatcagaagc

SEQ ID NO: 18215 - DNA, 20 bp, synthetic construct
  misc_feature 1..20: note = CRISPR gRNA sequence
  source 1..20: mol_type = other DNA
gatcaaatgcatcagaagca

SEQ ID NO: 18216 - DNA, 20 bp, synthetic construct
  misc_feature 1..20: note = CRISPR gRNA sequence
  source 1..20: mol_type = other DNA
aaatgcatcagaagcaaggc

SEQ ID NO: 18217 - DNA, 20 bp, synthetic construct
  misc_feature 1..20: note = CRISPR gRNA sequence
  source 1..20: mol_type = other DNA
tgcatcagaagcaaggcaag

SEQ ID NO: 18218 - DNA, 20 bp, synthetic construct
  misc_feature 1..20: note = CRISPR gRNA sequence
  source 1..20: mol_type = other DNA
gcaagtagatcctaaaaaca

SEQ ID NO: 18219 - DNA, 20 bp, synthetic construct
  misc_feature 1..20: note = CRISPR gRNA sequence
  source 1..20: mol_type = other DNA
tagatcctaaaaacatagta

SEQ ID NO: 18220 - DNA, 20 bp, synthetic construct
  misc_feature 1..20: note = CRISPR gRNA sequence
  source 1..20: mol_type = other DNA
aaacatagtacagaatgcaa

SEQ ID NO: 18221 - DNA, 20 bp, synthetic construct
  misc_feature 1..20: note = CRISPR gRNA sequence
  source 1..20: mol_type = other DNA
atagtacagaatgcaaaagt

SEQ ID NO: 18222 - DNA, 20 bp, synthetic construct
  misc_feature 1..20: note = CRISPR gRNA sequence
  source 1..20: mol_type = other DNA
aatgcaaaagtaagaaactg

SEQ ID NO: 18223 - DNA, 20 bp, synthetic construct
  misc_feature 1..20: note = CRISPR gRNA sequence
  source 1..20: mol_type = other DNA
caaaagtaagaaactgtggc

SEQ ID NO: 18224 - DNA, 20 bp, synthetic construct
  misc_feature 1..20: note = CRISPR gRNA sequence
  source 1..20: mol_type = other DNA
aaaagtaagaaactgtggcc

SEQ ID NO: 18225 - DNA, 20 bp, synthetic construct
  misc_feature 1..20: note = CRISPR gRNA sequence
  source 1..20: mol_type = other DNA
taagaaactgtggccaggcg

SEQ ID NO: 18226 - DNA, 20 bp, synthetic construct
  misc_feature 1..20: note = CRISPR gRNA sequence
  source 1..20: mol_type = other DNA
gtgactcgcacctgtaattc

SEQ ID NO: 18227 - DNA, 20 bp, synthetic construct
  misc_feature 1..20: note = CRISPR gRNA sequence
  source 1..20: mol_type = other DNA
cacctgtaattccagcactt

SEQ ID NO: 18228 - DNA, 20 bp, synthetic construct
  misc_feature 1..20: note = CRISPR gRNA sequence
  source 1..20: mol_type = other DNA
acctgtaattccagcacttt

SEQ ID NO: 18229 - DNA, 20 bp, synthetic construct
  misc_feature 1..20: note = CRISPR gRNA sequence
  source 1..20: mol_type = other DNA
ctgtaattccagcactttgg

SEQ ID NO: 18230 - DNA, 20 bp, synthetic construct
  misc_feature 1..20: note = CRISPR gRNA sequence
  source 1..20: mol_type = other DNA
tgtaattccagcactttggg

SEQ ID NO: 18231 - DNA, 20 bp, synthetic construct
  misc_feature 1..20: note = CRISPR gRNA sequence
  source 1..20: mol_type = other DNA
ttccagcactttgggaggcc

SEQ ID NO: 18232 - DNA, 20 bp, synthetic construct
  misc_feature 1..20: note = CRISPR gRNA sequence
  source 1..20: mol_type = other DNA
tccagcactttgggaggccg

SEQ ID NO: 18233 - DNA, 20 bp, synthetic construct
  misc_feature 1..20: note = CRISPR gRNA sequence
  source 1..20: mol_type = other DNA
agcactttgggaggccgagg

SEQ ID NO: 18234 - DNA, 20 bp, synthetic construct
  misc_feature 1..20: note = CRISPR gRNA sequence
  source 1..20: mol_type = other DNA
gcactttgggaggccgaggc

SEQ ID NO: 18235 - DNA, 20 bp, synthetic construct
  misc_feature 1..20: note = CRISPR gRNA sequence
  source 1..20: mol_type = other DNA
ctttgggaggccgaggcggg

SEQ ID NO: 18236 - DNA, 20 bp, synthetic construct
  misc_feature 1..20: note = CRISPR gRNA sequence
  source 1..20: mol_type = other DNA
ccgaggcgggtggatcacct

SEQ ID NO: 18237 - DNA, 20 bp, synthetic construct
  misc_feature 1..20: note = CRISPR gRNA sequence
  source 1..20: mol_type = other DNA
cgaggcgggtggatcacctg

SEQ ID NO: 18238 - DNA, 20 bp, synthetic construct
  misc_feature 1..20: note = CRISPR gRNA sequence
  source 1..20: mol_type = other DNA
gcgggtggatcacctgaggt

SEQ ID NO: 18239 - DNA, 20 bp, synthetic construct
  misc_feature 1..20: note = CRISPR gRNA sequence
  source 1..20: mol_type = other DNA
cgggtggatcacctgaggtc

SEQ ID NO: 18240 - DNA, 20 bp, synthetic construct
  misc_feature 1..20: note = CRISPR gRNA sequence
  source 1..20: mol_type = other DNA
ggtggatcacctgaggtcag

SEQ ID NO: 18241 - DNA, 20 bp, synthetic construct
  misc_feature 1..20: note = CRISPR gRNA sequence
  source 1..20: mol_type = other DNA
tcacctgaggtcaggagttt

SEQ ID NO: 18242 - DNA, 20 bp, synthetic construct
  misc_feature 1..20: note = CRISPR gRNA sequence
  source 1..20: mol_type = other DNA
tgaggtcaggagtttgagac

SEQ ID NO: 18243 - DNA, 20 bp, synthetic construct
  misc_feature 1..20: note = CRISPR gRNA sequence
  source 1..20: mol_type = other DNA
tcaggagtttgagaccagcc

SEQ ID NO: 18244 - DNA, 20 bp, synthetic construct
  misc_feature 1..20: note = CRISPR gRNA sequence
  source 1..20: mol_type = other DNA
agtttgagaccagcctggcc

SEQ ID NO: 18245 - DNA, 20 bp, synthetic construct
  misc_feature 1..20: note = CRISPR gRNA sequence
  source 1..20: mol_type = other DNA
gtttgagaccagcctggcca

SEQ ID NO: 18246 - DNA, 20 bp, synthetic construct
  misc_feature 1..20: note = CRISPR gRNA sequence
  source 1..20: mol_type = other DNA
tgagaccagcctggccaagg

SEQ ID NO: 18247 - DNA, 20 bp, synthetic construct
  misc_feature 1..20: note = CRISPR gRNA sequence
  source 1..20: mol_type = other DNA
aaccccatctctactaaaaa

SEQ ID NO: 18248 - DNA, 20 bp, synthetic construct
  misc_feature 1..20: note = CRISPR gRNA sequence
  source 1..20: mol_type = other DNA
tctactaaaaatagaaaact

SEQ ID NO: 18249 - DNA, 20 bp, synthetic construct
  misc_feature 1..20: note = CRISPR gRNA sequence
  source 1..20: mol_type = other DNA
taaaaatagaaaactcagcc

SEQ ID NO: 18250 - DNA, 20 bp, synthetic construct
  misc_feature 1..20: note = CRISPR gRNA sequence
  source 1..20: mol_type = other DNA
aaaaatagaaaactcagcct

SEQ ID NO: 18251 - DNA, 20 bp, synthetic construct
  misc_feature 1..20: note = CRISPR gRNA sequence
  source 1..20: mol_type = other DNA
agaaaactcagcctgggtga

SEQ ID NO: 18252 - DNA, 20 bp, synthetic construct
  misc_feature 1..20: note = CRISPR gRNA sequence
  source 1..20: mol_type = other DNA
aaaactcagcctgggtgaca

SEQ ID NO: 18253 - DNA, 20 bp, synthetic construct
  misc_feature 1..20: note = CRISPR gRNA sequence
  source 1..20: mol_type = other DNA
ctcagcctgggtgacagagt

SEQ ID NO: 18254 - DNA, 20 bp, synthetic construct
  misc_feature 1..20: note = CRISPR gRNA sequence
  source 1..20: mol_type = other DNA
ccatctaaaaaaaaaaaaaa

SEQ ID NO: 18255 - DNA, 20 bp, synthetic construct
  misc_feature 1..20: note = CRISPR gRNA sequence
  source 1..20: mol_type = other DNA
catctaaaaaaaaaaaaaaa

SEQ ID NO: 18256 - DNA, 20 bp, synthetic construct
  misc_feature 1..20: note = CRISPR gRNA sequence
  source 1..20: mol_type = other DNA
aaaggcaaaacatgttttat

SEQ ID NO: 18257 - DNA, 20 bp, synthetic construct
  misc_feature 1..20: note = CRISPR gRNA sequence
  source 1..20: mol_type = other DNA
aggcaaaacatgttttataa

SEQ ID NO: 18258 - DNA, 20 bp, synthetic construct
  misc_feature 1..20: note = CRISPR gRNA sequence
  source 1..20: mol_type = other DNA
tttataagagcacatacaaa

SEQ ID NO: 18259 - DNA, 20 bp, synthetic construct
  misc_feature 1..20: note = CRISPR gRNA sequence
  source 1..20: mol_type = other DNA
taagagcacatacaaacaga

SEQ ID NO: 18260 - DNA, 20 bp, synthetic construct
  misc_feature 1..20: note = CRISPR gRNA sequence
  source 1..20: mol_type = other DNA
aagatacacctgaaatgcat

SEQ ID NO: 18261 - DNA, 20 bp, synthetic construct
  misc_feature 1..20: note = CRISPR gRNA sequence
  source 1..20: mol_type = other DNA
acacctgaaatgcattagaa

SEQ ID NO: 18262 - DNA, 20 bp, synthetic construct
  misc_feature 1..20: note = CRISPR gRNA sequence
  source 1..20: mol_type = other DNA
cacctgaaatgcattagaat

SEQ ID NO: 18263 - DNA, 20 bp, synthetic construct
  misc_feature 1..20: note = CRISPR gRNA sequence
  source 1..20: mol_type = other DNA
aatgcattagaatgggcacc

SEQ ID NO: 18264 - DNA, 20 bp, synthetic construct
  misc_feature 1..20: note = CRISPR gRNA sequence
  source 1..20: mol_type = other DNA
attagaatgggcacccagta

SEQ ID NO: 18265 - DNA, 20 bp, synthetic construct
  misc_feature 1..20: note = CRISPR gRNA sequence
  source 1..20: mol_type = other DNA
ttagaatgggcacccagtat

SEQ ID NO: 18266 - DNA, 20 bp, synthetic construct
  misc_feature 1..20: note = CRISPR gRNA sequence
  source 1..20: mol_type = other DNA
tgggcacccagtatgggaaa

SEQ ID NO: 18267 - DNA, 20 bp, synthetic construct
  misc_feature 1..20: note = CRISPR gRNA sequence
  source 1..20: mol_type = other DNA
gggcacccagtatgggaaat

SEQ ID NO: 18268 - DNA, 20 bp, synthetic construct
  misc_feature 1..20: note = CRISPR gRNA sequence
  source 1..20: mol_type = other DNA
ggcacccagtatgggaaata

SEQ ID NO: 18269 - DNA, 20 bp, synthetic construct
  misc_feature 1..20: note = CRISPR gRNA sequence
  source 1..20: mol_type = other DNA
gggaaatagggacattaatg

SEQ ID NO: 18270 - DNA, 20 bp, synthetic construct
  misc_feature 1..20: note = CRISPR gRNA sequence
  source 1..20: mol_type = other DNA
gaaatagggacattaatgaa

SEQ ID NO: 18271 - DNA, 20 bp, synthetic construct
  misc_feature 1..20: note = CRISPR gRNA sequence
  source 1..20: mol_type = other DNA
gaaaaccctcatgtgaacca

SEQ ID NO: 18272 - DNA, 20 bp, synthetic construct
  misc_feature 1..20: note = CRISPR gRNA sequence
  source 1..20: mol_type = other DNA
ctcatgtgaaccaaagatca

SEQ ID NO: 18273 - DNA, 20 bp, synthetic construct
  misc_feature 1..20: note = CRISPR gRNA sequence
  source 1..20: mol_type = other DNA
gatcatagtgtaccatgacc

SEQ ID NO: 18274 - DNA, 20 bp, synthetic construct
  misc_feature 1..20: note = CRISPR gRNA sequence
  source 1..20: mol_type = other DNA
atcatagtgtaccatgacct

SEQ ID NO: 18275 - DNA, 20 bp, synthetic construct
  misc_feature 1..20: note = CRISPR gRNA sequence
  source 1..20: mol_type = other DNA
taccatgacctgggctgcac

SEQ ID NO: 18276 - DNA, 20 bp, synthetic construct
  misc_feature 1..20: note = CRISPR gRNA sequence
  source 1..20: mol_type = other DNA
accatgacctgggctgcact

SEQ ID NO: 18277 - DNA, 20 bp, synthetic construct
  misc_feature 1..20: note = CRISPR gRNA sequence
  source 1..20: mol_type = other DNA
atgacctgggctgcactggg

SEQ ID NO: 18278 - DNA, 20 bp, synthetic construct
  misc_feature 1..20: note = CRISPR gRNA sequence
  source 1..20: mol_type = other DNA
ctgcactgggcagttaatcg

SEQ ID NO: 18279 - DNA, 20 bp, synthetic construct
  misc_feature 1..20: note = CRISPR gRNA sequence
  source 1..20: mol_type = other DNA
tgcactgggcagttaatcga

SEQ ID NO: 18280 - DNA, 20 bp, synthetic construct
  misc_feature 1..20: note = CRISPR gRNA sequence
  source 1..20: mol_type = other DNA
ggcagttaatcgaaggttta

SEQ ID NO: 18281 - DNA, 20 bp, synthetic construct
  misc_feature 1..20: note = CRISPR gRNA sequence
  source 1..20: mol_type = other DNA
gcagttaatcgaaggtttaa

SEQ ID NO: 18282 - DNA, 20 bp, synthetic construct
  misc_feature 1..20: note = CRISPR gRNA sequence
  source 1..20: mol_type = other DNA
taatcgaaggtttaaaggcc

SEQ ID NO: 18283 - DNA, 20 bp, synthetic construct
  misc_feature 1..20: note = CRISPR gRNA sequence
  source 1..20: mol_type = other DNA
aatcgaaggtttaaaggccc

SEQ ID NO: 18284 - DNA, 20 bp, synthetic construct
  misc_feature 1..20: note = CRISPR gRNA sequence
  source 1..20: mol_type = other DNA
atcgaaggtttaaaggccca

SEQ ID NO: 18285 - DNA, 20 bp, synthetic construct
  misc_feature 1..20: note = CRISPR gRNA sequence
  source 1..20: mol_type = other DNA
tcgaaggtttaaaggcccag

SEQ ID NO: 18286 - DNA, 20 bp, synthetic construct
  misc_feature 1..20: note = CRISPR gRNA sequence
  source 1..20: mol_type = other DNA
ttaaaggcccaggggttgaa

SEQ ID NO: 18287 - DNA, 20 bp, synthetic construct
  misc_feature 1..20: note = CRISPR gRNA sequence
  source 1..20: mol_type = other DNA
ggcccaggggttgaaaagaa

SEQ ID NO: 18288 - DNA, 20 bp, synthetic construct
  misc_feature 1..20: note = CRISPR gRNA sequence
  source 1..20: mol_type = other DNA
ggttgaaaagaaaagaaaca

SEQ ID NO: 18289 - DNA, 20 bp, synthetic construct
  misc_feature 1..20: note = CRISPR gRNA sequence
  source 1..20: mol_type = other DNA
gttgaaaagaaaagaaacaa

SEQ ID NO: 18290 - DNA, 20 bp, synthetic construct
  misc_feature 1..20: note = CRISPR gRNA sequence
  source 1..20: mol_type = other DNA
tgaaaagaaaagaaacaaag

SEQ ID NO: 18291 - DNA, 20 bp, synthetic construct
  misc_feature 1..20: note = CRISPR gRNA sequence
  source 1..20: mol_type = other DNA
gaaaagaaaagaaacaaagg

SEQ ID NO: 18292 - DNA, 20 bp, synthetic construct
  misc_feature 1..20: note = CRISPR gRNA sequence
  source 1..20: mol_type = other DNA
aagaaacaaaggaggattca

SEQ ID NO: 18293 - DNA, 20 bp, synthetic construct
  misc_feature 1..20: note = CRISPR gRNA sequence
  source 1..20: mol_type = other DNA
agaaacaaaggaggattcat

SEQ ID NO: 18294 - DNA, 20 bp, synthetic construct
  misc_feature 1..20: note = CRISPR gRNA sequence
  source 1..20: mol_type = other DNA
gaaacaaaggaggattcatg

SEQ ID NO: 18295 - DNA, 20 bp, synthetic construct
  misc_feature 1..20: note = CRISPR gRNA sequence
  source 1..20: mol_type = other DNA
caaaggaggattcatggggt

SEQ ID NO: 18296 - DNA, 20 bp, synthetic construct
  misc_feature 1..20: note = CRISPR gRNA sequence
  source 1..20: mol_type = other DNA
aaaggaggattcatggggtg

SEQ ID NO: 18297 - DNA, 20 bp, synthetic construct
  misc_feature 1..20: note = CRISPR gRNA sequence
  source 1..20: mol_type = other DNA
gaggattcatggggtgaggt

SEQ ID NO: 18298 - DNA, 20 bp, synthetic construct
  misc_feature 1..20: note = CRISPR gRNA sequence
  source 1..20: mol_type = other DNA
gggtgaggttggtacctcta

SEQ ID NO: 18299 - DNA, 20 bp, synthetic construct
  misc_feature 1..20: note = CRISPR gRNA sequence
  source 1..20: mol_type = other DNA
cctctatggctcaccaacaa

SEQ ID NO: 18300 - DNA, 20 bp, synthetic construct
  misc_feature 1..20: note = CRISPR gRNA sequence
  source 1..20: mol_type = other DNA
ctctatggctcaccaacaat

SEQ ID NO: 18301 - DNA, 20 bp, synthetic construct
  misc_feature 1..20: note = CRISPR gRNA sequence
  source 1..20: mol_type = other DNA
tctatggctcaccaacaata

SEQ ID NO: 18302 - DNA, 20 bp, synthetic construct
  misc_feature 1..20: note = CRISPR gRNA sequence
  source 1..20: mol_type = other DNA
caccaacaatagggcctgca

SEQ ID NO: 18303 - DNA, 20 bp, synthetic construct
  misc_feature 1..20: note = CRISPR gRNA sequence
  source 1..20: mol_type = other DNA
ccaacaatagggcctgcaca

SEQ ID NO: 18304 - DNA, 20 bp, synthetic construct
  misc_feature 1..20: note = CRISPR gRNA sequence
  source 1..20: mol_type = other DNA
aatagggcctgcacagagcc

SEQ ID NO: 18305 - DNA, 20 bp, synthetic construct
  misc_feature 1..20: note = CRISPR gRNA sequence
  source 1..20: mol_type = other DNA
tgcacagagcctggtaccta

SEQ ID NO: 18306 - DNA, 20 bp, synthetic construct
  misc_feature 1..20: note = CRISPR gRNA sequence
  source 1..20: mol_type = other DNA
ggtacctatagatgttcaca

SEQ ID NO: 18307 - DNA, 20 bp, synthetic construct
  misc_feature 1..20: note = CRISPR gRNA sequence
  source 1..20: mol_type = other DNA
cctctgctcttgccacccca

SEQ ID NO: 18308 - DNA, 20 bp, synthetic construct
  misc_feature 1..20: note = CRISPR gRNA sequence
  source 1..20: mol_type = other DNA
ctctgctcttgccaccccac

SEQ ID NO: 18309 - DNA, 20 bp, synthetic construct
  misc_feature 1..20: note = CRISPR gRNA sequence
  source 1..20: mol_type = other DNA
ttgccaccccacaggctgtc

SEQ ID NO: 18310 - DNA, 20 bp, synthetic construct
  misc_feature 1..20: note = CRISPR gRNA sequence
  source 1..20: mol_type = other DNA
ccccacaggctgtctggtga

SEQ ID NO: 18311 - DNA, 20 bp, synthetic construct
  misc_feature 1..20: note = CRISPR gRNA sequence
  source 1..20: mol_type = other DNA
tgatggcttgatttgtgccc

SEQ ID NO: 18312 - DNA, 20 bp, synthetic construct
  misc_feature 1..20: note = CRISPR gRNA sequence
  source 1..20: mol_type = other DNA
atggcttgatttgtgcccaa

SEQ ID NO: 18313 - DNA, 20 bp, synthetic construct
  misc_feature 1..20: note = CRISPR gRNA sequence
  source 1..20: mol_type = other DNA
ttgatttgtgcccaagagcc

SEQ ID NO: 18314 - DNA, 20 bp, synthetic construct
  misc_feature 1..20: note = CRISPR gRNA sequence
  source 1..20: mol_type = other DNA
tgatttgtgcccaagagccc

SEQ ID NO: 18315 - DNA, 20 bp, synthetic construct
  misc_feature 1..20: note = CRISPR gRNA sequence
  source 1..20: mol_type = other DNA
gatttgtgcccaagagccca

SEQ ID NO: 18316 - DNA, 20 bp, synthetic construct
  misc_feature 1..20: note = CRISPR gRNA sequence
  source 1..20: mol_type = other DNA
tgcccaagagcccagggtcc

SEQ ID NO: 18317 - DNA, 20 bp, synthetic construct
  misc_feature 1..20: note = CRISPR gRNA sequence
  source 1..20: mol_type = other DNA
gcccaagagcccagggtcct

SEQ ID NO: 18318 - DNA, 20 bp, synthetic construct
  misc_feature 1..20: note = CRISPR gRNA sequence
  source 1..20: mol_type = other DNA
cccaagagcccagggtcctg

SEQ ID NO: 18319 - DNA, 20 bp, synthetic construct
  misc_feature 1..20: note = CRISPR gRNA sequence
  source 1..20: mol_type = other DNA
aagagcccagggtcctgggg

SEQ ID NO: 18320 - DNA, 20 bp, synthetic construct
  misc_feature 1..20: note = CRISPR gRNA sequence
  source 1..20: mol_type = other DNA
gagcccagggtcctggggaa

SEQ ID NO: 18321 - DNA, 20 bp, synthetic construct
  misc_feature 1..20: note = CRISPR gRNA sequence
  source 1..20: mol_type = other DNA
ccagggtcctggggaagaga

SEQ ID NO: 18322 - DNA, 20 bp, synthetic construct
  misc_feature 1..20: note = CRISPR gRNA sequence
  source 1..20: mol_type = other DNA
cagggtcctggggaagagat

SEQ ID NO: 18323 - DNA, 20 bp, synthetic construct
  misc_feature 1..20: note = CRISPR gRNA sequence
  source 1..20: mol_type = other DNA
gggaagagataggaacatgc

SEQ ID NO: 18324 - DNA, 20 bp, synthetic construct
  misc_feature 1..20: note = CRISPR gRNA sequence
  source 1..20: mol_type = other DNA
agataggaacatgctggact

SEQ ID NO: 18325 - DNA, 20 bp, synthetic construct
  misc_feature 1..20: note = CRISPR gRNA sequence
  source 1..20: mol_type = other DNA
ataggaacatgctggacttg

SEQ ID NO: 18326 - DNA, 20 bp, synthetic construct
  misc_feature 1..20: note = CRISPR gRNA sequence
  source 1..20: mol_type = other DNA
ggaacatgctggacttggag

SEQ ID NO: 18327 - DNA, 20 bp, synthetic construct
  misc_feature 1..20: note = CRISPR gRNA sequence
  source 1..20: mol_type = other DNA
gaacatgctggacttggagc

SEQ ID NO: 18328 - DNA, 20 bp, synthetic construct
  misc_feature 1..20: note = CRISPR gRNA sequence
  source 1..20: mol_type = other DNA
atgctggacttggagcagga

SEQ ID NO: 18329 - DNA, 20 bp, synthetic construct
  misc_feature 1..20: note = CRISPR gRNA sequence
  source 1..20: mol_type = other DNA
tgctggacttggagcaggat

SEQ ID NO: 18330 - DNA, 20 bp, synthetic construct
  misc_feature 1..20: note = CRISPR gRNA sequence
  source 1..20: mol_type = other DNA
gctggacttggagcaggatg

SEQ ID NO: 18331 - DNA, 20 bp, synthetic construct
  misc_feature 1..20: note = CRISPR gRNA sequence
  source 1..20: mol_type = other DNA
ctggacttggagcaggatgg

SEQ ID NO: 18332 - DNA, 20 bp, synthetic construct
  misc_feature 1..20: note = CRISPR gRNA sequence
  source 1..20: mol_type = other DNA
ggacttggagcaggatgggg

SEQ ID NO: 18333 - DNA, 20 bp, synthetic construct
  misc_feature 1..20: note = CRISPR gRNA sequence
  source 1..20: mol_type = other DNA
gacttggagcaggatggggg

SEQ ID NO: 18334 - DNA, 20 bp, synthetic construct
  misc_feature 1..20: note = CRISPR gRNA sequence
  source 1..20: mol_type = other DNA
cttggagcaggatgggggag

SEQ ID NO: 18335 - DNA, 20 bp, synthetic construct
  misc_feature 1..20: note = CRISPR gRNA sequence
  source 1..20: mol_type = other DNA
gagcaggatgggggaggagc

SEQ ID NO: 18336 - DNA, 20 bp, synthetic construct
  misc_feature 1..20: note = CRISPR gRNA sequence
  source 1..20: mol_type = other DNA
gatgggggaggagctggatg

SEQ ID NO: 18337 - DNA, 20 bp, synthetic construct
  misc_feature 1..20: note = CRISPR gRNA sequence
  source 1..20: mol_type = other DNA
tgggggaggagctggatgta

SEQ ID NO: 18338 - DNA, 20 bp, synthetic construct
  misc_feature 1..20: note = CRISPR gRNA sequence
  source 1..20: mol_type = other DNA
gggggaggagctggatgtag

SEQ ID NO: 18339 - DNA, 20 bp, synthetic construct
  misc_feature 1..20: note = CRISPR gRNA sequence
  source 1..20: mol_type = other DNA
ggaggagctggatgtagagg

SEQ ID NO: 18340 - DNA, 20 bp, synthetic construct
  misc_feature 1..20: note = CRISPR gRNA sequence
  source 1..20: mol_type = other DNA
ggagctggatgtagaggaag

SEQ ID NO: 18341 - DNA, 20 bp, synthetic construct
  misc_feature 1..20: note = CRISPR gRNA sequence
  source 1..20: mol_type = other DNA
ggaagaagcccctcactctc

SEQ ID NO: 18342 - DNA, 20 bp, synthetic construct
  misc_feature 1..20: note = CRISPR gRNA sequence
  source 1..20: mol_type = other DNA
cagcctgctgtttgcaaacc

SEQ ID NO: 18343 - DNA, 20 bp, synthetic construct
  misc_feature 1..20: note = CRISPR gRNA sequence
  source 1..20: mol_type = other DNA
tgctgtttgcaaaccaagtg

SEQ ID NO: 18344 - DNA, 20 bp, synthetic construct
  misc_feature 1..20: note = CRISPR gRNA sequence
  source 1..20: mol_type = other DNA
caaaccaagtgtagatatcc

SEQ ID NO: 18345 - DNA, 20 bp, synthetic construct
  misc_feature 1..20: note = CRISPR gRNA sequence
  source 1..20: mol_type = other DNA
aaaccaagtgtagatatccc

SEQ ID NO: 18346 - DNA, 20 bp, synthetic construct
  misc_feature 1..20: note = CRISPR gRNA sequence
  source 1..20: mol_type = other DNA
accaagtgtagatatcccag

SEQ ID NO: 18347 - DNA, 20 bp, synthetic construct
  misc_feature 1..20: note = CRISPR gRNA sequence
  source 1..20: mol_type = other DNA
tgtagatatcccaggagaac

SEQ ID NO: 18348 - DNA, 20 bp, synthetic construct
  misc_feature 1..20: note = CRISPR gRNA sequence
  source 1..20: mol_type = other DNA
gatatcccaggagaacgaga

SEQ ID NO: 18349 - DNA, 20 bp, synthetic construct
  misc_feature 1..20: note = CRISPR gRNA sequence
  source 1..20: mol_type = other DNA
tatcccaggagaacgagaca

SEQ ID NO: 18350 - DNA, 20 bp, synthetic construct
  misc_feature 1..20: note = CRISPR gRNA sequence
  source 1..20: mol_type = other DNA
tcccaggagaacgagacaga

SEQ ID NO: 18351 - DNA, 20 bp, synthetic construct
  misc_feature 1..20: note = CRISPR gRNA sequence
  source 1..20: mol_type = other DNA
ccaggagaacgagacagaga

SEQ ID NO: 18352 - DNA, 20 bp, synthetic construct
  misc_feature 1..20: note = CRISPR gRNA sequence
  source 1..20: mol_type = other DNA
caggagaacgagacagagag

SEQ ID NO: 18353 - DNA, 20 bp, synthetic construct
  misc_feature 1..20: note = CRISPR gRNA sequence
  source 1..20: mol_type = other DNA
acgagacagagagaggactt

SEQ ID NO: 18354 - DNA, 20 bp, synthetic construct
  misc_feature 1..20: note = CRISPR gRNA sequence
  source 1..20: mol_type = other DNA
gagacagagagaggacttaa

SEQ ID NO: 18355 - DNA, 20 bp, synthetic construct
  misc_feature 1..20: note = CRISPR gRNA sequence
  source 1..20: mol_type = other DNA
gaggacttaagagaaactac

SEQ ID NO: 18356 - DNA, 20 bp, synthetic construct
  misc_feature 1..20: note = CRISPR gRNA sequence
  source 1..20: mol_type = other DNA
agaaactactggtctcactc

SEQ ID NO: 18357 - DNA, 20 bp, synthetic construct
  misc_feature 1..20: note = CRISPR gRNA sequence
  source 1..20: mol_type = other DNA
cactcaagactttcacttcc

SEQ ID NO: 18358 - DNA, 20 bp, synthetic construct
  misc_feature 1..20: note = CRISPR gRNA sequence
  source 1..20: mol_type = other DNA
ctcaagactttcacttcctg

SEQ ID NO: 18359 - DNA, 20 bp, synthetic construct
  misc_feature 1..20: note = CRISPR gRNA sequence
  source 1..20: mol_type = other DNA
aagactttcacttcctggag

SEQ ID NO: 18360 - DNA, 20 bp, synthetic construct
  misc_feature 1..20: note = CRISPR gRNA sequence
  source 1..20: mol_type = other DNA
ttcacttcctggagtggcac

SEQ ID NO: 18361 - DNA, 20 bp, synthetic construct
  misc_feature 1..20: note = CRISPR gRNA sequence
  source 1..20: mol_type = other DNA
tcacttcctggagtggcacg

SEQ ID NO: 18362 - DNA, 20 bp, synthetic construct
  misc_feature 1..20: note = CRISPR gRNA sequence
  source 1..20: mol_type = other DNA
acttcctggagtggcacgag

SEQ ID NO: 18363 - DNA, 20 bp, synthetic construct
  misc_feature 1..20: note = CRISPR gRNA sequence
  source 1..20: mol_type = other DNA
cttcctggagtggcacgagg

SEQ ID NO: 18364 - DNA, 20 bp, synthetic construct
  misc_feature 1..20: note = CRISPR gRNA sequence
  source 1..20: mol_type = other DNA
ggagtggcacgaggaggtca

SEQ ID NO: 18365 - DNA, 20 bp, synthetic construct
  misc_feature 1..20: note = CRISPR gRNA sequence
  source 1..20: mol_type = other DNA
gagtggcacgaggaggtcac

SEQ ID NO: 18366 - DNA, 20 bp, synthetic construct
  misc_feature 1..20: note = CRISPR gRNA sequence
  source 1..20: mol_type = other DNA
gtggcacgaggaggtcacag

SEQ ID NO: 18367 - DNA, 20 bp, synthetic construct
  misc_feature 1..20: note = CRISPR gRNA sequence
  source 1..20: mol_type = other DNA
cacgaggaggtcacaggaga

SEQ ID NO: 18368 - DNA, 20 bp, synthetic construct
  misc_feature 1..20: note = CRISPR gRNA sequence
  source 1..20: mol_type = other DNA
cgaggaggtcacaggagacg

SEQ ID NO: 18369 - DNA, 20 bp, synthetic construct
  misc_feature 1..20: note = CRISPR gRNA sequence
  source 1..20: mol_type = other DNA
aggaggtcacaggagacgga

SEQ ID NO: 18370 - DNA, 20 bp, synthetic construct
  misc_feature 1..20: note = CRISPR gRNA sequence
  source 1..20: mol_type = other DNA
ggaggtcacaggagacggag

SEQ ID NO: 18371 - DNA, 20 bp, synthetic construct
  misc_feature 1..20: note = CRISPR gRNA sequence
  source 1..20: mol_type = other DNA
caggagacggagaggaaact

SEQ ID NO: 18372 - DNA, 20 bp, synthetic construct
  misc_feature 1..20: note = CRISPR gRNA sequence
  source 1..20: mol_type = other DNA
aggagacggagaggaaacta

SEQ ID NO: 18373 - DNA, 20 bp, synthetic construct
  misc_feature 1..20: note = CRISPR gRNA sequence
  source 1..20: mol_type = other DNA
ggagaggaaactaaggcatg

SEQ ID NO: 18374 - DNA, 20 bp, synthetic construct
  misc_feature 1..20: note = CRISPR gRNA sequence
  source 1..20: mol_type = other DNA
tgtagcaacactgcaatgct

SEQ ID NO: 18375 - DNA, 20 bp, synthetic construct
  misc_feature 1..20: note = CRISPR gRNA sequence
  source 1..20: mol_type = other DNA
gtagcaacactgcaatgctc

SEQ ID NO: 18376 - DNA, 20 bp, synthetic construct
  misc_feature 1..20: note = CRISPR gRNA sequence
  source 1..20: mol_type = other DNA
tagcaacactgcaatgctca

SEQ ID NO: 18377 - DNA, 20 bp, synthetic construct
  misc_feature 1..20: note = CRISPR gRNA sequence
  source 1..20: mol_type = other DNA
agcaacactgcaatgctcag

SEQ ID NO: 18378 - DNA, 20 bp, synthetic construct
  misc_feature 1..20: note = CRISPR gRNA sequence
  source 1..20: mol_type = other DNA
ctgcaatgctcaggggctta

SEQ ID NO: 18379 - DNA, 20 bp, synthetic construct
  misc_feature 1..20: note = CRISPR gRNA sequence
  source 1..20: mol_type = other DNA
tgcaatgctcaggggcttat

SEQ ID NO: 18380 - DNA, 20 bp, synthetic construct
  misc_feature 1..20: note = CRISPR gRNA sequence
  source 1..20: mol_type = other DNA
tgctcaggggcttatgggcc

SEQ ID NO: 18381 - DNA, 20 bp, synthetic construct
  misc_feature 1..20: note = CRISPR gRNA sequence
  source 1..20: mol_type = other DNA
ggggcttatgggcctggaaa

SEQ ID NO: 18382 - DNA, 20 bp, synthetic construct
  misc_feature 1..20: note = CRISPR gRNA sequence
  source 1..20: mol_type = other DNA
tatgggcctggaaacagttg

SEQ ID NO: 18383 - DNA, 20 bp, synthetic construct
  misc_feature 1..20: note = CRISPR gRNA sequence
  source 1..20: mol_type = other DNA
atgggcctggaaacagttgc

SEQ ID NO: 18384 - DNA, 20 bp, synthetic construct
  misc_feature 1..20: note = CRISPR gRNA sequence
  source 1..20: mol_type = other DNA
ggatctgatcatttgtcctc

SEQ ID NO: 18385 - DNA, 20 bp, synthetic construct
  misc_feature 1..20: note = CRISPR gRNA sequence
  source 1..20: mol_type = other DNA
gatctgatcatttgtcctca

SEQ ID NO: 18386 - DNA, 20 bp, synthetic construct
  misc_feature 1..20: note = CRISPR gRNA sequence
  source 1..20: mol_type = other DNA
ctgatcatttgtcctcaagg

SEQ ID NO: 18387 - DNA, 20 bp, synthetic construct
  misc_feature 1..20: note = CRISPR gRNA sequence
  source 1..20: mol_type = other DNA
tgatcatttgtcctcaaggc

SEQ ID NO: 18388 - DNA, 20 bp, synthetic construct
  misc_feature 1..20: note = CRISPR gRNA sequence
  source 1..20: mol_type = other DNA
gatcatttgtcctcaaggca

SEQ ID NO: 18389 - DNA, 20 bp, synthetic construct
  misc_feature 1..20: note = CRISPR gRNA sequence
  source 1..20: mol_type = other DNA
tcatttgtcctcaaggcagg

SEQ ID NO: 18390 - DNA, 20 bp, synthetic construct
  misc_feature 1..20: note = CRISPR gRNA sequence
  source 1..20: mol_type = other DNA
tgtcctcaaggcagggagac

SEQ ID NO: 18391 - DNA, 20 bp, synthetic construct
  misc_feature 1..20: note = CRISPR gRNA sequence
  source 1..20: mol_type = other DNA
cctcaaggcagggagactag

SEQ ID NO: 18392 - DNA, 20 bp, synthetic construct
  misc_feature 1..20: note = CRISPR gRNA sequence
  source 1..20: mol_type = other DNA
gtgcatgtgtatgtgtgtaa

SEQ ID NO: 18393 - DNA, 20 bp, synthetic construct
  misc_feature 1..20: note = CRISPR gRNA sequence
  source 1..20: mol_type = other DNA
tgcatgtgtatgtgtgtaat

SEQ ID NO: 18394 - DNA, 20 bp, synthetic construct
  misc_feature 1..20: note = CRISPR gRNA sequence
  source 1..20: mol_type = other DNA
gcatgtgtatgtgtgtaatg

SEQ ID NO: 18395 - DNA, 20 bp, synthetic construct
  misc_feature 1..20: note = CRISPR gRNA sequence
  source 1..20: mol_type = other DNA
catgtgtatgtgtgtaatgg

SEQ ID NO: 18396 - DNA, 20 bp, synthetic construct
  misc_feature 1..20: note = CRISPR gRNA sequence
  source 1..20: mol_type = other DNA
gtgtatgtgtgtaatggggg

SEQ ID NO: 18397 - DNA, 20 bp, synthetic construct
  misc_feature 1..20: note = CRISPR gRNA sequence
  source 1..20: mol_type = other DNA
tgtatgtgtgtaatgggggc

SEQ ID NO: 18398 - DNA, 20 bp, synthetic construct
  misc_feature 1..20: note = CRISPR gRNA sequence
  source 1..20: mol_type = other DNA
tatgtgtgtaatgggggcag

SEQ ID NO: 18399 - DNA, 20 bp, synthetic construct
  misc_feature 1..20: note = CRISPR gRNA sequence
  source 1..20: mol_type = other DNA
atgtgtgtaatgggggcagg

SEQ ID NO: 18400 - DNA, 20 bp, synthetic construct
  misc_feature 1..20: note = CRISPR gRNA sequence
  source 1..20: mol_type = other DNA
gtgtaatgggggcaggaggt

SEQ ID NO: 18401 - DNA, 20 bp, synthetic construct
  misc_feature 1..20: note = CRISPR gRNA sequence
  source 1..20: mol_type = other DNA
atgggggcaggaggtcagat

SEQ ID NO: 18402 - DNA, 20 bp, synthetic construct
  misc_feature 1..20: note = CRISPR gRNA sequence
  source 1..20: mol_type = other DNA
aggtcagatgagcttcgtgt

SEQ ID NO: 18403 - DNA, 20 bp, synthetic construct
  misc_feature 1..20: note = CRISPR gRNA sequence
  source 1..20: mol_type = other DNA
ggtcagatgagcttcgtgtc

SEQ ID NO: 18404 - DNA, 20 bp, synthetic construct
  misc_feature 1..20: note = CRISPR gRNA sequence
  source 1..20: mol_type = other DNA
tcagatgagcttcgtgtcag

SEQ ID NO: 18405 - DNA, 20 bp, synthetic construct
  misc_feature 1..20: note = CRISPR gRNA sequence
  source 1..20: mol_type = other DNA
agatgagcttcgtgtcagga

SEQ ID NO: 18406 - DNA, 20 bp, synthetic construct
  misc_feature 1..20: note = CRISPR gRNA sequence
  source 1..20: mol_type = other DNA
gatgagcttcgtgtcaggag

SEQ ID NO: 18407 - DNA, 20 bp, synthetic construct
  misc_feature 1..20: note = CRISPR gRNA sequence
  source 1..20: mol_type = other DNA
gcttcgtgtcaggagaggtc

SEQ ID NO: 18408 - DNA, 20 bp, synthetic construct
  misc_feature 1..20: note = CRISPR gRNA sequence
  source 1..20: mol_type = other DNA
ttcgtgtcaggagaggtctg

SEQ ID NO: 18409 - DNA, 20 bp, synthetic construct
  misc_feature 1..20: note = CRISPR gRNA sequence
  source 1..20: mol_type = other DNA
aggtctggagatattgctat

SEQ ID NO: 18410 - DNA, 20 bp, synthetic construct
  misc_feature 1..20: note = CRISPR gRNA sequence
  source 1..20: mol_type = other DNA
ctggagatattgctattggt

SEQ ID NO: 18411 - DNA, 20 bp, synthetic construct
  misc_feature 1..20: note = CRISPR gRNA sequence
  source 1..20: mol_type = other DNA
aaatcccctttctgacctgc

SEQ ID NO: 18412 - DNA, 20 bp, synthetic construct
  misc_feature 1..20: note = CRISPR gRNA sequence
  source 1..20: mol_type = other DNA
tttctgacctgcaagctcct

SEQ ID NO: 18413 - DNA, 20 bp, synthetic construct
  misc_feature 1..20: note = CRISPR gRNA sequence
  source 1..20: mol_type = other DNA
caagctcctcagctgtgcca

SEQ ID NO: 18414 - DNA, 20 bp, synthetic construct
  misc_feature 1..20: note = CRISPR gRNA sequence
  source 1..20: mol_type = other DNA
aagctcctcagctgtgccac

SEQ ID NO: 18415 - DNA, 20 bp, synthetic construct
  misc_feature 1..20: note = CRISPR gRNA sequence
  source 1..20: mol_type = other DNA
agctcctcagctgtgccaca

SEQ ID NO: 18416 - DNA, 20 bp, synthetic construct
  misc_feature 1..20: note = CRISPR gRNA sequence
  source 1..20: mol_type = other DNA
gctcctcagctgtgccacag

SEQ ID NO: 18417 - DNA, 20 bp, synthetic construct
  misc_feature 1..20: note = CRISPR gRNA sequence
  source 1..20: mol_type = other DNA
tcagctgtgccacaggggct

SEQ ID NO: 18418 - DNA, 20 bp, synthetic construct
  misc_feature 1..20: note = CRISPR gRNA sequence
  source 1..20: mol_type = other DNA
gggcttggctgcaaaatcaa

SEQ ID NO: 18419 - DNA, 20 bp, synthetic construct
  misc_feature 1..20: note = CRISPR gRNA sequence
  source 1..20: mol_type = other DNA
gcaaaatcaaaagttgaatc

SEQ ID NO: 18420 - DNA, 20 bp, synthetic construct
  misc_feature 1..20: note = CRISPR gRNA sequence
  source 1..20: mol_type = other DNA
caaaagttgaatccagtcga

SEQ ID NO: 18421 - DNA, 20 bp, synthetic construct
  misc_feature 1..20: note = CRISPR gRNA sequence
  source 1..20: mol_type = other DNA
aaaagttgaatccagtcgat

SEQ ID NO: 18422 - DNA, 20 bp, synthetic construct
  misc_feature 1..20: note = CRISPR gRNA sequence
  source 1..20: mol_type = other DNA
gcctatttgttttgtttccc

SEQ ID NO: 18423 - DNA, 20 bp, synthetic construct
  misc_feature 1..20: note = CRISPR gRNA sequence
  source 1..20: mol_type = other DNA
tttgtttcccaagccaatat

SEQ ID NO: 18424 - DNA, 20 bp, synthetic construct
  misc_feature 1..20: note = CRISPR gRNA sequence
  source 1..20: mol_type = other DNA
accatcacaatgtctctata

SEQ ID NO: 18425 - DNA, 20 bp, synthetic construct
  misc_feature 1..20: note = CRISPR gRNA sequence
  source 1..20: mol_type = other DNA
catcacaatgtctctatata

SEQ ID NO: 18426 - DNA, 20 bp, synthetic construct
  misc_feature 1..20: note = CRISPR gRNA sequence
  source 1..20: mol_type = other DNA
agagtacacacaattgttac

SEQ ID NO: 18427 - DNA, 20 bp, synthetic construct
  misc_feature 1..20: note = CRISPR gRNA sequence
  source 1..20: mol_type = other DNA
agtacacacaattgttacca

SEQ ID NO: 18428 - DNA, 20 bp, synthetic construct
  misc_feature 1..20: note = CRISPR gRNA sequence
  source 1..20: mol_type = other DNA
gtacacacaattgttaccag

SEQ ID NO: 18429 - DNA, 20 bp, synthetic construct
  misc_feature 1..20: note = CRISPR gRNA sequence
  source 1..20: mol_type = other DNA
actccctattgccttctgcc

SEQ ID NO: 18430 - DNA, 20 bp, synthetic construct
  misc_feature 1..20: note = CRISPR gRNA sequence
  source 1..20: mol_type = other DNA
ggacacattttacatcatta

SEQ ID NO: 18431 - DNA, 20 bp, synthetic construct
  misc_feature 1..20: note = CRISPR gRNA sequence
  source 1..20: mol_type = other DNA
ttacatcattatggcccctt

SEQ ID NO: 18432 - DNA, 20 bp, synthetic construct
  misc_feature 1..20: note = CRISPR gRNA sequence
  source 1..20: mol_type = other DNA
attatggcccctttggtatt

SEQ ID NO: 18433 - DNA, 20 bp, synthetic construct
  misc_feature 1..20: note = CRISPR gRNA sequence
  source 1..20: mol_type = other DNA
gtatttggatttgccaccct

SEQ ID NO: 18434 - DNA, 20 bp, synthetic construct
  misc_feature 1..20: note = CRISPR gRNA sequence
  source 1..20: mol_type = other DNA
tggatttgccacccttggct

SEQ ID NO: 18435 - DNA, 20 bp, synthetic construct
  misc_feature 1..20: note = CRISPR gRNA sequence
  source 1..20: mol_type = other DNA
gatttgccacccttggcttg

SEQ ID NO: 18436 - DNA, 20 bp, synthetic construct
  misc_feature 1..20: note = CRISPR gRNA sequence
  source 1..20: mol_type = other DNA
atttgccacccttggcttgg

SEQ ID NO: 18437 - DNA, 20 bp, synthetic construct
  misc_feature 1..20: note = CRISPR gRNA sequence
  source 1..20: mol_type = other DNA
ccttggcttggaggcccttg

SEQ ID NO: 18438 - DNA, 20 bp, synthetic construct
  misc_feature 1..20: note = CRISPR gRNA sequence
  source 1..20: mol_type = other DNA
cttggcttggaggcccttgc

SEQ ID NO: 18439 - DNA, 20 bp, synthetic construct
  misc_feature 1..20: note = CRISPR gRNA sequence
  source 1..20: mol_type = other DNA
tggaggcccttgcaggtccc

SEQ ID NO: 18440 - DNA, 20 bp, synthetic construct
  misc_feature 1..20: note = CRISPR gRNA sequence
  source 1..20: mol_type = other DNA
ccttgcaggtcccaagataa

SEQ ID NO: 18441 - DNA, 20 bp, synthetic construct
  misc_feature 1..20: note = CRISPR gRNA sequence
  source 1..20: mol_type = other DNA
caggtcccaagataatggct

SEQ ID NO: 18442 - DNA, 20 bp, synthetic construct
  misc_feature 1..20: note = CRISPR gRNA sequence
  source 1..20: mol_type = other DNA
aggtcccaagataatggctt

SEQ ID NO: 18443 - DNA, 20 bp, synthetic construct
  misc_feature 1..20: note = CRISPR gRNA sequence
  source 1..20: mol_type = other DNA
gtcccaagataatggcttgg

SEQ ID NO: 18444 - DNA, 20 bp, synthetic construct
  misc_feature 1..20: note = CRISPR gRNA sequence
  source 1..20: mol_type = other DNA
tcccaagataatggcttggg

SEQ ID NO: 18445 - DNA, 20 bp, synthetic construct
  misc_feature 1..20: note = CRISPR gRNA sequence
  source 1..20: mol_type = other DNA
cccaagataatggcttggga

SEQ ID NO: 18446 - DNA, 20 bp, synthetic construct
  misc_feature 1..20: note = CRISPR gRNA sequence
  source 1..20: mol_type = other DNA
agataatggcttgggaggga

SEQ ID NO: 18447 - DNA, 20 bp, synthetic construct
  misc_feature 1..20: note = CRISPR gRNA sequence
  source 1..20: mol_type = other DNA
gataatggcttgggagggat

SEQ ID NO: 18448 - DNA, 20 bp, synthetic construct
  misc_feature 1..20: note = CRISPR gRNA sequence
  source 1..20: mol_type = other DNA
gcttgggagggatgggtgac

SEQ ID NO: 18449 - DNA, 20 bp, synthetic construct
  misc_feature 1..20: note = CRISPR gRNA sequence
  source 1..20: mol_type = other DNA
cttgggagggatgggtgact

SEQ ID NO: 18450 - DNA, 20 bp, synthetic construct
  misc_feature 1..20: note = CRISPR gRNA sequence
  source 1..20: mol_type = other DNA
ttgggagggatgggtgactg

SEQ ID NO: 18451 - DNA, 20 bp, synthetic construct
  misc_feature 1..20: note = CRISPR gRNA sequence
  source 1..20: mol_type = other DNA
ggagggatgggtgactgggg

SEQ ID NO: 18452 - DNA, 20 bp, synthetic construct
  misc_feature 1..20: note = CRISPR gRNA sequence
  source 1..20: mol_type = other DNA
gagggatgggtgactggggc

SEQ ID NO: 18453 - DNA, 20 bp, synthetic construct
  misc_feature 1..20: note = CRISPR gRNA sequence
  source 1..20: mol_type = other DNA
agggatgggtgactggggca

SEQ ID NO: 18454 - DNA, 20 bp, synthetic construct
  misc_feature 1..20: note = CRISPR gRNA sequence
  source 1..20: mol_type = other DNA
ggatgggtgactggggcagg

SEQ ID NO: 18455 - DNA, 20 bp, synthetic construct
  misc_feature 1..20: note = CRISPR gRNA sequence
  source 1..20: mol_type = other DNA
atgggtgactggggcaggga

SEQ ID NO: 18456 - DNA, 20 bp, synthetic construct
  misc_feature 1..20: note = CRISPR gRNA sequence
  source 1..20: mol_type = other DNA
tgggtgactggggcagggag

SEQ ID NO: 18457 - DNA, 20 bp, synthetic construct
  misc_feature 1..20: note = CRISPR gRNA sequence
  source 1..20: mol_type = other DNA
gtgactggggcagggagagg

SEQ ID NO: 18458 - DNA, 20 bp, synthetic construct
  misc_feature 1..20: note = CRISPR gRNA sequence
  source 1..20: mol_type = other DNA
tgactggggcagggagaggc

SEQ ID NO: 18459 - DNA, 20 bp, synthetic construct
  misc_feature 1..20: note = CRISPR gRNA sequence
  source 1..20: mol_type = other DNA
aattatgtcctgtcctgcaa

SEQ ID NO: 18460 - DNA, 20 bp, synthetic construct
  misc_feature 1..20: note = CRISPR gRNA sequence
  source 1..20: mol_type = other DNA
tcctgtcctgcaatggaatt

SEQ ID NO: 18461 - DNA, 20 bp, synthetic construct
  misc_feature 1..20: note = CRISPR gRNA sequence
  source 1..20: mol_type = other DNA
cctgtcctgcaatggaattg

SEQ ID NO: 18462 - DNA, 20 bp, synthetic construct
  misc_feature 1..20: note = CRISPR gRNA sequence
  source 1..20: mol_type = other DNA
tgcaatggaattgaggtgta

SEQ ID NO: 18463 - DNA, 20 bp, synthetic construct
  misc_feature 1..20: note = CRISPR gRNA sequence
  source 1..20: mol_type = other DNA
aatggaattgaggtgtacag

SEQ ID NO: 18464 - DNA, 20 bp, synthetic construct
  misc_feature 1..20: note = CRISPR gRNA sequence
  source 1..20: mol_type = other DNA
atggaattgaggtgtacagt

SEQ ID NO: 18465 - DNA, 20 bp, synthetic construct
  misc_feature 1..20: note = CRISPR gRNA sequence
  source 1..20: mol_type = other DNA
tggaattgaggtgtacagta

SEQ ID NO: 18466 - DNA, 20 bp, synthetic construct
  misc_feature 1..20: note = CRISPR gRNA sequence
  source 1..20: mol_type = other DNA
tacagtagggtctttttcta

SEQ ID NO: 18467 - DNA, 20 bp, synthetic construct
  misc_feature 1..20: note = CRISPR gRNA sequence
  source 1..20: mol_type = other DNA
cagtagggtctttttctaca

SEQ ID NO: 18468 - DNA, 20 bp, synthetic construct
  misc_feature 1..20: note = CRISPR gRNA sequence
  source 1..20: mol_type = other DNA
agtagggtctttttctacag

SEQ ID NO: 18469 - DNA, 20 bp, synthetic construct
  misc_feature 1..20: note = CRISPR gRNA sequence
  source 1..20: mol_type = other DNA
gtagggtctttttctacaga

SEQ ID NO: 18470 - DNA, 20 bp, synthetic construct
  misc_feature 1..20: note = CRISPR gRNA sequence
  source 1..20: mol_type = other DNA
tctttttctacagagggtct

SEQ ID NO: 18471 - DNA, 20 bp, synthetic construct
  misc_feature 1..20: note = CRISPR gRNA sequence
  source 1..20: mol_type = other DNA
tttttctacagagggtcttg

SEQ ID NO: 18472 - DNA, 20 bp, synthetic construct
  misc_feature 1..20: note = CRISPR gRNA sequence
  source 1..20: mol_type = other DNA
ttttctacagagggtcttgg

SEQ ID NO: 18473 - DNA, 20 bp, synthetic construct
  misc_feature 1..20: note = CRISPR gRNA sequence
  source 1..20: mol_type = other DNA
tttctacagagggtcttgga

SEQ ID NO: 18474 - DNA, 20 bp, synthetic construct
  misc_feature 1..20: note = CRISPR gRNA sequence
  source 1..20: mol_type = other DNA
ttctacagagggtcttggag

SEQ ID NO: 18475 - DNA, 20 bp, synthetic construct
  misc_feature 1..20: note = CRISPR gRNA sequence
  source 1..20: mol_type = other DNA
cagagggtcttggaggggac

SEQ ID NO: 18476 - DNA, 20 bp, synthetic construct
  misc_feature 1..20: note = CRISPR gRNA sequence
  source 1..20: mol_type = other DNA
gtcttggaggggactggccc

SEQ ID NO: 18477 - DNA, 20 bp, synthetic construct
  misc_feature 1..20: note = CRISPR gRNA sequence
  source 1..20: mol_type = other DNA
tcttggaggggactggccct

SEQ ID NO: 18478 - DNA, 20 bp, synthetic construct
  misc_feature 1..20: note = CRISPR gRNA sequence
  source 1..20: mol_type = other DNA
actggccctgggtacccaaa

SEQ ID NO: 18479 - DNA, 20 bp, synthetic construct
  misc_feature 1..20: note = CRISPR gRNA sequence
  source 1..20: mol_type = other DNA
ctggccctgggtacccaaac

SEQ ID NO: 18480 - DNA, 20 bp, synthetic construct
  misc_feature 1..20: note = CRISPR gRNA sequence
  source 1..20: mol_type = other DNA
ccctgggtacccaaacaggc

SEQ ID NO: 18481 - DNA, 20 bp, synthetic construct
  misc_feature 1..20: note = CRISPR gRNA sequence
  source 1..20: mol_type = other DNA
ccaaacaggccagttccaca

SEQ ID NO: 18482 - DNA, 20 bp, synthetic construct
  misc_feature 1..20: note = CRISPR gRNA sequence
  source 1..20: mol_type = other DNA
aaacaggccagttccacaca

SEQ ID NO: 18483 - DNA, 20 bp, synthetic construct
  misc_feature 1..20: note = CRISPR gRNA sequence
  source 1..20: mol_type = other DNA
caggccagttccacacagag

SEQ ID NO: 18484 - DNA, 20 bp, synthetic construct
  misc_feature 1..20: note = CRISPR gRNA sequence
  source 1..20: mol_type = other DNA
aggccagttccacacagaga

SEQ ID NO: 18485 - DNA, 20 bp, synthetic construct
  misc_feature 1..20: note = CRISPR gRNA sequence
  source 1..20: mol_type = other DNA
gccagttccacacagagaag

SEQ ID NO: 18486 - DNA, 20 bp, synthetic construct
  misc_feature 1..20: note = CRISPR gRNA sequence
  source 1..20: mol_type = other DNA
agttccacacagagaaggag

SEQ ID NO: 18487 - DNA, 20 bp, synthetic construct
  misc_feature 1..20: note = CRISPR gRNA sequence
  source 1..20: mol_type = other DNA
gttccacacagagaaggagc

SEQ ID NO: 18488 - DNA, 20 bp, synthetic construct
  misc_feature 1..20: note = CRISPR gRNA sequence
  source 1..20: mol_type = other DNA
ccacacagagaaggagcagg

SEQ ID NO: 18489 - DNA, 20 bp, synthetic construct
  misc_feature 1..20: note = CRISPR gRNA sequence
  source 1..20: mol_type = other DNA
agaaggagcaggaagcacta

SEQ ID NO: 18490 - DNA, 20 bp, synthetic construct
  misc_feature 1..20: note = CRISPR gRNA sequence
  source 1..20: mol_type = other DNA
agcaggaagcactaaagttg

SEQ ID NO: 18491 - DNA, 20 bp, synthetic construct
  misc_feature 1..20: note = CRISPR gRNA sequence
  source 1..20: mol_type = other DNA
agcactaaagttgcagcatc

SEQ ID NO: 18492 - DNA, 20 bp, synthetic construct
  misc_feature 1..20: note = CRISPR gRNA sequence
  source 1..20: mol_type = other DNA
gcactaaagttgcagcatct

SEQ ID NO: 18493 - DNA, 20 bp, synthetic construct
  misc_feature 1..20: note = CRISPR gRNA sequence
  source 1..20: mol_type = other DNA
cactaaagttgcagcatctg

SEQ ID NO: 18494 - DNA, 20 bp, synthetic construct
  misc_feature 1..20: note = CRISPR gRNA sequence
  source 1..20: mol_type = other DNA
agttgcagcatctggggtgt

SEQ ID NO: 18495 - DNA, 20 bp, synthetic construct
  misc_feature 1..20: note = CRISPR gRNA sequence
  source 1..20: mol_type = other DNA
gttgcagcatctggggtgtt

SEQ ID NO: 18496 - DNA, 20 bp, synthetic construct
  misc_feature 1..20: note = CRISPR gRNA sequence
  source 1..20: mol_type = other DNA
gggtgttgggtgcactttcc

SEQ ID NO: 18497 - DNA, 20 bp, synthetic construct
  misc_feature 1..20: note = CRISPR gRNA sequence
  source 1..20: mol_type = other DNA
cactttcccagctctgctgc

SEQ ID NO: 18498 - DNA, 20 bp, synthetic construct
  misc_feature 1..20: note = CRISPR gRNA sequence
  source 1..20: mol_type = other DNA
tcccagctctgctgccagct

SEQ ID NO: 18499 - DNA, 20 bp, synthetic construct
  misc_feature 1..20: note = CRISPR gRNA sequence
  source 1..20: mol_type = other DNA
agctctgctgccagctcaga

SEQ ID NO: 18500 - DNA, 20 bp, synthetic construct
  misc_feature 1..20: note = CRISPR gRNA sequence
  source 1..20: mol_type = other DNA
ctgctgccagctcagatgga

SEQ ID NO: 18501 - DNA, 20 bp, synthetic construct
  misc_feature 1..20: note = CRISPR gRNA sequence
  source 1..20: mol_type = other DNA
tgctgccagctcagatggaa

SEQ ID NO: 18502 - DNA, 20 bp, synthetic construct
  misc_feature 1..20: note = CRISPR gRNA sequence
  source 1..20: mol_type = other DNA
gctcagatggaaaggtgatt

SEQ ID NO: 18503 - DNA, 20 bp, synthetic construct
  misc_feature 1..20: note = CRISPR gRNA sequence
  source 1..20: mol_type = other DNA
tcagatggaaaggtgattaa

SEQ ID NO: 18504 - DNA, 20 bp, synthetic construct
  misc_feature 1..20: note = CRISPR gRNA sequence
  source 1..20: mol_type = other DNA
cagatggaaaggtgattaag

SEQ ID NO: 18505 - DNA, 20 bp, synthetic construct
  misc_feature 1..20: note = CRISPR gRNA sequence
  source 1..20: mol_type = other DNA
tggaaaggtgattaagaggt

SEQ ID NO: 18506 - DNA, 20 bp, synthetic construct
  misc_feature 1..20: note = CRISPR gRNA sequence
  source 1..20: mol_type = other DNA
gattaagaggtaagctgtct

SEQ ID NO: 18507 - DNA, 20 bp, synthetic construct
  misc_feature 1..20: note = CRISPR gRNA sequence
  source 1..20: mol_type = other DNA
tgagatcacacctgtaatcc

SEQ ID NO: 18508 - DNA, 20 bp, synthetic construct
  misc_feature 1..20: note = CRISPR gRNA sequence
  source 1..20: mol_type = other DNA
cacctgtaatcccagcactt

SEQ ID NO: 18509 - DNA, 20 bp, synthetic construct
  misc_feature 1..20: note = CRISPR gRNA sequence
  source 1..20: mol_type = other DNA
acctgtaatcccagcacttt

SEQ ID NO: 18510 - DNA, 20 bp, synthetic construct
  misc_feature 1..20: note = CRISPR gRNA sequence
  source 1..20: mol_type = other DNA
ctgtaatcccagcactttgg

SEQ ID NO: 18511 - DNA, 20 bp, synthetic construct
  misc_feature 1..20: note = CRISPR gRNA sequence
  source 1..20: mol_type = other DNA
tgtaatcccagcactttggg

SEQ ID NO: 18512 - DNA, 20 bp, synthetic construct
  misc_feature 1..20: note = CRISPR gRNA sequence
  source 1..20: mol_type = other DNA
tcccagcactttgggaggct

SEQ ID NO: 18513 - DNA, 20 bp, synthetic construct
  misc_feature 1..20: note = CRISPR gRNA sequence
  source 1..20: mol_type = other DNA
cccagcactttgggaggctg

SEQ ID NO: 18514 - DNA, 20 bp, synthetic construct
  misc_feature 1..20: note = CRISPR gRNA sequence
  source 1..20: mol_type = other DNA
cagcactttgggaggctgag

SEQ ID NO: 18515 - DNA, 20 bp, synthetic construct
  misc_feature 1..20: note = CRISPR gRNA sequence
  source 1..20: mol_type = other DNA
agcactttgggaggctgagg

SEQ ID NO: 18516 - DNA, 20 bp, synthetic construct
  misc_feature 1..20: note = CRISPR gRNA sequence
  source 1..20: mol_type = other DNA
gcactttgggaggctgagga

SEQ ID NO: 18517 - DNA, 20 bp, synthetic construct
  misc_feature 1..20: note = CRISPR gRNA sequence
  source 1..20: mol_type = other DNA
actttgggaggctgaggagg

SEQ ID NO: 18518 - DNA, 20 bp, synthetic construct
  misc_feature 1..20: note = CRISPR gRNA sequence
  source 1..20: mol_type = other DNA
ctttgggaggctgaggaggg

SEQ ID NO: 18519 - DNA, 20 bp, synthetic construct
  misc_feature 1..20: note = CRISPR gRNA sequence
  source 1..20: mol_type = other DNA
ctgaggagggaggatgactt

SEQ ID NO: 18520 - DNA, 20 bp, synthetic construct
  misc_feature 1..20: note = CRISPR gRNA sequence
  source 1..20: mol_type = other DNA
tgaggagggaggatgacttg

SEQ ID NO: 18521 - DNA, 20 bp, synthetic construct
  misc_feature 1..20: note = CRISPR gRNA sequence
  source 1..20: mol_type = other DNA
gagggaggatgacttgaggc

SEQ ID NO: 18522 - DNA, 20 bp, synthetic construct
  misc_feature 1..20: note = CRISPR gRNA sequence
  source 1..20: mol_type = other DNA
agggaggatgacttgaggcc

SEQ ID NO: 18523 - DNA, 20 bp, synthetic construct
  misc_feature 1..20: note = CRISPR gRNA sequence
  source 1..20: mol_type = other DNA
ggaggatgacttgaggccag

SEQ ID NO: 18524 - DNA, 20 bp, synthetic construct
  misc_feature 1..20: note = CRISPR gRNA sequence
  source 1..20: mol_type = other DNA
tgacttgaggccaggagttt

SEQ ID NO: 18525 - DNA, 20 bp, synthetic construct
  misc_feature 1..20: note = CRISPR gRNA sequence
  source 1..20: mol_type = other DNA
tgaggccaggagtttgagac

SEQ ID NO: 18526 - DNA, 20 bp, synthetic construct
  misc_feature 1..20: note = CRISPR gRNA sequence
  source 1..20: mol_type = other DNA
ccaggagtttgagaccagcc

SEQ ID NO: 18527 - DNA, 20 bp, synthetic construct
  misc_feature 1..20: note = CRISPR gRNA sequence
  source 1..20: mol_type = other DNA
caggagtttgagaccagcct

SEQ ID NO: 18528 - DNA, 20 bp, synthetic construct
  misc_feature 1..20: note = CRISPR gRNA sequence
  source 1..20: mol_type = other DNA
tgagaccagcctgggcaaca

SEQ ID NO: 18529 - DNA, 20 bp, synthetic construct
  misc_feature 1..20: note = CRISPR gRNA sequence
  source 1..20: mol_type = other DNA
atagtgaaaccccatctctt

SEQ ID NO: 18530 - DNA, 20 bp, synthetic construct
  misc_feature 1..20: note = CRISPR gRNA sequence
  source 1..20: mol_type = other DNA
ccccatctcttcagaaataa

SEQ ID NO: 18531 - DNA, 20 bp, synthetic construct
  misc_feature 1..20: note = CRISPR gRNA sequence
  source 1..20: mol_type = other DNA
gaaataaaagatacaaaaat

SEQ ID NO: 18532 - DNA, 20 bp, synthetic construct
  misc_feature 1..20: note = CRISPR gRNA sequence
  source 1..20: mol_type = other DNA
taaaagatacaaaaattagc

SEQ ID NO: 18533 - DNA, 20 bp, synthetic construct
  misc_feature 1..20: note = CRISPR gRNA sequence
  source 1..20: mol_type = other DNA
aaaagatacaaaaattagct

SEQ ID NO: 18534 - DNA, 20 bp, synthetic construct
  misc_feature 1..20: note = CRISPR gRNA sequence
  source 1..20: mol_type = other DNA
atacaaaaattagctgggtg

SEQ ID NO: 18535 - DNA, 20 bp, synthetic construct
  misc_feature 1..20: note = CRISPR gRNA sequence
  source 1..20: mol_type = other DNA
caaaaattagctgggtgtgg

SEQ ID NO: 18536 - DNA, 20 bp, synthetic construct
  misc_feature 1..20: note = CRISPR gRNA sequence
  source 1..20: mol_type = other DNA
aaaattagctgggtgtggtg

SEQ ID NO: 18537 - DNA, 20 bp, synthetic construct
  misc_feature 1..20: note = CRISPR gRNA sequence
  source 1..20: mol_type = other DNA
ggtgtggtggagtgcccttg

SEQ ID NO: 18538 - DNA, 20 bp, synthetic construct
  misc_feature 1..20: note = CRISPR gRNA sequence
  source 1..20: mol_type = other DNA
gtggagtgcccttgtagtct

SEQ ID NO: 18539 - DNA, 20 bp, synthetic construct
  misc_feature 1..20: note = CRISPR gRNA sequence
  source 1..20: mol_type = other DNA
cccttgtagtctcggctact

SEQ ID NO: 18540 - DNA, 20 bp, synthetic construct
  misc_feature 1..20: note = CRISPR gRNA sequence
  source 1..20: mol_type = other DNA
ccttgtagtctcggctactt

SEQ ID NO: 18541 - DNA, 20 bp, synthetic construct
  misc_feature 1..20: note = CRISPR gRNA sequence
  source 1..20: mol_type = other DNA
ttgtagtctcggctacttgg

SEQ ID NO: 18542 - DNA, 20 bp, synthetic construct
  misc_feature 1..20: note = CRISPR gRNA sequence
  source 1..20: mol_type = other DNA
tgtagtctcggctacttggg

SEQ ID NO: 18543 - DNA, 20 bp, synthetic construct
  misc_feature 1..20: note = CRISPR gRNA sequence
  source 1..20: mol_type = other DNA
tctcggctacttgggaggct

SEQ ID NO: 18544 - DNA, 20 bp, synthetic construct
  misc_feature 1..20: note = CRISPR gRNA sequence
  source 1..20: mol_type = other DNA
ctcggctacttgggaggctg

SEQ ID NO: 18545 - DNA, 20 bp, synthetic construct
  misc_feature 1..20: note = CRISPR gRNA sequence
  source 1..20: mol_type = other DNA
ggctacttgggaggctgagg

SEQ ID NO: 18546 - DNA, 20 bp, synthetic construct
  misc_feature 1..20: note = CRISPR gRNA sequence
  source 1..20: mol_type = other DNA
gctacttgggaggctgaggc

SEQ ID NO: 18547 - DNA, 20 bp, synthetic construct
  misc_feature 1..20: note = CRISPR gRNA sequence
  source 1..20: mol_type = other DNA
tacttgggaggctgaggcag

SEQ ID NO: 18548 - DNA, 20 bp, synthetic construct
  misc_feature 1..20: note = CRISPR gRNA sequence
  source 1..20: mol_type = other DNA
acttgggaggctgaggcagg

SEQ ID NO: 18549 - DNA, 20 bp, synthetic construct
  misc_feature 1..20: note = CRISPR gRNA sequence
  source 1..20: mol_type = other DNA
gggaggctgaggcaggagga

SEQ ID NO: 18550 - DNA, 20 bp, synthetic construct
  misc_feature 1..20: note = CRISPR gRNA sequence
  source 1..20: mol_type = other DNA
ctgaggcaggaggatggctt

SEQ ID NO: 18551 - DNA, 20 bp, synthetic construct
  misc_feature 1..20: note = CRISPR gRNA sequence
  source 1..20: mol_type = other DNA
gcaggaggatggcttgagct

SEQ ID NO: 18552 - DNA, 20 bp, synthetic construct
  misc_feature 1..20: note = CRISPR gRNA sequence
  source 1..20: mol_type = other DNA
caggaggatggcttgagctc

SEQ ID NO: 18553 - DNA, 20 bp, synthetic construct
  misc_feature 1..20: note = CRISPR gRNA sequence
  source 1..20: mol_type = other DNA
ggaggatggcttgagctcag

SEQ ID NO: 18554 - DNA, 20 bp, synthetic construct
  misc_feature 1..20: note = CRISPR gRNA sequence
  source 1..20: mol_type = other DNA
tggcttgagctcaggagctt

SEQ ID NO: 18555 - DNA, 20 bp, synthetic construct
  misc_feature 1..20: note = CRISPR gRNA sequence
  source 1..20: mol_type = other DNA
ggcttgagctcaggagcttg

SEQ ID NO: 18556 - DNA, 20 bp, synthetic construct
  misc_feature 1..20: note = CRISPR gRNA sequence
  source 1..20: mol_type = other DNA
agctcaggagcttgaggctg

SEQ ID NO: 18557 - DNA, 20 bp, synthetic construct
  misc_feature 1..20: note = CRISPR gRNA sequence
  source 1..20: mol_type = other DNA
caggagcttgaggctgcagt

SEQ ID NO: 18558 - DNA, 20 bp, synthetic construct
  misc_feature 1..20: note = CRISPR gRNA sequence
  source 1..20: mol_type = other DNA
tgtgccactgcactccaacc

SEQ ID NO: 18559 - DNA, 20 bp, synthetic construct
  misc_feature 1..20: note = CRISPR gRNA sequence
  source 1..20: mol_type = other DNA
gtgccactgcactccaacct

SEQ ID NO: 18560 - DNA, 20 bp, synthetic construct
  misc_feature 1..20: note = CRISPR gRNA sequence
  source 1..20: mol_type = other DNA
ctgcactccaacctgggcaa

SEQ ID NO: 18561 - DNA, 20 bp, synthetic construct
  misc_feature 1..20: note = CRISPR gRNA sequence
  source 1..20: mol_type = other DNA
gcactccaacctgggcaaca

SEQ ID NO: 18562 - DNA, 20 bp, synthetic construct
  misc_feature 1..20: note = CRISPR gRNA sequence
  source 1..20: mol_type = other DNA
tccaacctgggcaacagagt

SEQ ID NO: 18563 - DNA, 20 bp, synthetic construct
  misc_feature 1..20: note = CRISPR gRNA sequence
  source 1..20: mol_type = other DNA
agactttgtctcataaatga

SEQ ID NO: 18564 - DNA, 20 bp, synthetic construct
  misc_feature 1..20: note = CRISPR gRNA sequence
  source 1..20: mol_type = other DNA
gactttgtctcataaatgaa

SEQ ID NO: 18565 - DNA, 20 bp, synthetic construct
  misc_feature 1..20: note = CRISPR gRNA sequence
  source 1..20: mol_type = other DNA
aaggatgaatgaatgaatga

SEQ ID NO: 18566 - DNA, 20 bp, synthetic construct
  misc_feature 1..20: note = CRISPR gRNA sequence
  source 1..20: mol_type = other DNA
tgaatgaatgaatgaaagaa

SEQ ID NO: 18567 - DNA, 20 bp, synthetic construct
  misc_feature 1..20: note = CRISPR gRNA sequence
  source 1..20: mol_type = other DNA
tgaatgaatgaaagaatggt

SEQ ID NO: 18568 - DNA, 20 bp, synthetic construct
  misc_feature 1..20: note = CRISPR gRNA sequence
  source 1..20: mol_type = other DNA
tgaaagaatggtaagctccc

SEQ ID NO: 18569 - DNA, 20 bp, synthetic construct
  misc_feature 1..20: note = CRISPR gRNA sequence
  source 1..20: mol_type = other DNA
gaaagaatggtaagctccct

SEQ ID NO: 18570 - DNA, 20 bp, synthetic construct
  misc_feature 1..20: note = CRISPR gRNA sequence
  source 1..20: mol_type = other DNA
ggtaagctccctgggaactg

SEQ ID NO: 18571 - DNA, 20 bp, synthetic construct
  misc_feature 1..20: note = CRISPR gRNA sequence
  source 1..20: mol_type = other DNA
gtaagctccctgggaactgt

SEQ ID NO: 18572 - DNA, 20 bp, synthetic construct
  misc_feature 1..20: note = CRISPR gRNA sequence
  source 1..20: mol_type = other DNA
cctgggaactgtgggatgca

SEQ ID NO: 18573 - DNA, 20 bp, synthetic construct
  misc_feature 1..20: note = CRISPR gRNA sequence
  source 1..20: mol_type = other DNA
tgggaactgtgggatgcaaa

SEQ ID NO: 18574 - DNA, 20 bp, synthetic construct
  misc_feature 1..20: note = CRISPR gRNA sequence
  source 1..20: mol_type = other DNA
cctttttgccatcccaattc

SEQ ID NO: 18575 - DNA, 20 bp, synthetic construct
  misc_feature 1..20: note = CRISPR gRNA sequence
  source 1..20: mol_type = other DNA
ccaattccagcaccgttgaa

SEQ ID NO: 18576 - DNA, 20 bp, synthetic construct
  misc_feature 1..20: note = CRISPR gRNA sequence
  source 1..20: mol_type = other DNA
cgttgaatggatttccattg

SEQ ID NO: 18577 - DNA, 20 bp, synthetic construct
  misc_feature 1..20: note = CRISPR gRNA sequence
  source 1..20: mol_type = other DNA
cattgcagctccctgccctt

SEQ ID NO: 18578 - DNA, 20 bp, synthetic construct
  misc_feature 1..20: note = CRISPR gRNA sequence
  source 1..20: mol_type = other DNA
attgcagctccctgcccttt

SEQ ID NO: 18579 - DNA, 20 bp, synthetic construct
  misc_feature 1..20: note = CRISPR gRNA sequence
  source 1..20: mol_type = other DNA
ccctttgggtttgaaccaac

SEQ ID NO: 18580 - DNA, 20 bp, synthetic construct
  misc_feature 1..20: note = CRISPR gRNA sequence
  source 1..20: mol_type = other DNA
ggtttgaaccaaccagcctc

SEQ ID NO: 18581 - DNA, 20 bp, synthetic construct
  misc_feature 1..20: note = CRISPR gRNA sequence
  source 1..20: mol_type = other DNA
caaccagcctctggcaaaca

SEQ ID NO: 18582 - DNA, 20 bp, synthetic construct
  misc_feature 1..20: note = CRISPR gRNA sequence
  source 1..20: mol_type = other DNA
tctggcaaacaaagtaactt

SEQ ID NO: 18583 - DNA, 20 bp, synthetic construct
  misc_feature 1..20: note = CRISPR gRNA sequence
  source 1..20: mol_type = other DNA
tggcaaacaaagtaacttca

SEQ ID NO: 18584 - DNA, 20 bp, synthetic construct
  misc_feature 1..20: note = CRISPR gRNA sequence
  source 1..20: mol_type = other DNA
caaacaaagtaacttcagag

SEQ ID NO: 18585 - DNA, 20 bp, synthetic construct
  misc_feature 1..20: note = CRISPR gRNA sequence
  source 1..20: mol_type = other DNA
aaacaaagtaacttcagagc

SEQ ID NO: 18586 - DNA, 20 bp, synthetic construct
  misc_feature 1..20: note = CRISPR gRNA sequence
  source 1..20: mol_type = other DNA
aaagtaacttcagagcagga

SEQ ID NO: 18587 - DNA, 20 bp, synthetic construct
  misc_feature 1..20: note = CRISPR gRNA sequence
  source 1..20: mol_type = other DNA
gtaacttcagagcaggaaag

SEQ ID NO: 18588 - DNA, 20 bp, synthetic construct
  misc_feature 1..20: note = CRISPR gRNA sequence
  source 1..20: mol_type = other DNA
agtggaaaacaaattaaaat

SEQ ID NO: 18589 - DNA, 20 bp, synthetic construct
  misc_feature 1..20: note = CRISPR gRNA sequence
  source 1..20: mol_type = other DNA
ttaaaattggctgcaatccc

SEQ ID NO: 18590 - DNA, 20 bp, synthetic construct
  misc_feature 1..20: note = CRISPR gRNA sequence
  source 1..20: mol_type = other DNA
ttggctgcaatccctagcca

SEQ ID NO: 18591 - DNA, 20 bp, synthetic construct
  misc_feature 1..20: note = CRISPR gRNA sequence
  source 1..20: mol_type = other DNA
tggctgcaatccctagccaa

SEQ ID NO: 18592 - DNA, 20 bp, synthetic construct
  misc_feature 1..20: note = CRISPR gRNA sequence
  source 1..20: mol_type = other DNA
ggctgcaatccctagccaaa

SEQ ID NO: 18593 - DNA, 20 bp, synthetic construct
  misc_feature 1..20: note = CRISPR gRNA sequence
  source 1..20: mol_type = other DNA
tccctagccaaagggcttct

SEQ ID NO: 18594 - DNA, 20 bp, synthetic construct
  misc_feature 1..20: note = CRISPR gRNA sequence
  source 1..20: mol_type = other DNA
ctagccaaagggcttctcag

SEQ ID NO: 18595 - DNA, 20 bp, synthetic construct
  misc_feature 1..20: note = CRISPR gRNA sequence
  source 1..20: mol_type = other DNA
ccaaagggcttctcagcagt

SEQ ID NO: 18596 - DNA, 20 bp, synthetic construct
  misc_feature 1..20: note = CRISPR gRNA sequence
  source 1..20: mol_type = other DNA
aaagggcttctcagcagttg

SEQ ID NO: 18597 - DNA, 20 bp, synthetic construct
  misc_feature 1..20: note = CRISPR gRNA sequence
  source 1..20: mol_type = other DNA
aagggcttctcagcagttgg

SEQ ID NO: 18598 - DNA, 20 bp, synthetic construct
  misc_feature 1..20: note = CRISPR gRNA sequence
  source 1..20: mol_type = other DNA
ggcttctcagcagttggagg

SEQ ID NO: 18599 - DNA, 20 bp, synthetic construct
  misc_feature 1..20: note = CRISPR gRNA sequence
  source 1..20: mol_type = other DNA
gcttctcagcagttggaggc

SEQ ID NO: 18600 - DNA, 20 bp, synthetic construct
  misc_feature 1..20: note = CRISPR gRNA sequence
  source 1..20: mol_type = other DNA
cagcagttggaggcaggtta

SEQ ID NO: 18601 - DNA, 20 bp, synthetic construct
  misc_feature 1..20: note = CRISPR gRNA sequence
  source 1..20: mol_type = other DNA
agttggaggcaggttaaaga

SEQ ID NO: 18602 - DNA, 20 bp, synthetic construct
  misc_feature 1..20: note = CRISPR gRNA sequence
  source 1..20: mol_type = other DNA
tggaggcaggttaaagaaag

SEQ ID NO: 18603 - DNA, 20 bp, synthetic construct
  misc_feature 1..20: note = CRISPR gRNA sequence
  source 1..20: mol_type = other DNA
ggaggcaggttaaagaaaga

SEQ ID NO: 18604 - DNA, 20 bp, synthetic construct
  misc_feature 1..20: note = CRISPR gRNA sequence
  source 1..20: mol_type = other DNA
caggttaaagaaagaaggac

SEQ ID NO: 18605 - DNA, 20 bp, synthetic construct
  misc_feature 1..20: note = CRISPR gRNA sequence
  source 1..20: mol_type = other DNA
taaagaaagaaggacaagct

SEQ ID NO: 18606 - DNA, 20 bp, synthetic construct
  misc_feature 1..20: note = CRISPR gRNA sequence
  source 1..20: mol_type = other DNA
agaaggacaagctcagtcac

SEQ ID NO: 18607 - DNA, 20 bp, synthetic construct
  misc_feature 1..20: note = CRISPR gRNA sequence
  source 1..20: mol_type = other DNA
agctcagtcacaagtgaaat

SEQ ID NO: 18608 - DNA, 20 bp, synthetic construct
  misc_feature 1..20: note = CRISPR gRNA sequence
  source 1..20: mol_type = other DNA
catgtatctgtccaaaccca

SEQ ID NO: 18609 - DNA, 20 bp, synthetic construct
  misc_feature 1..20: note = CRISPR gRNA sequence
  source 1..20: mol_type = other DNA
cccacagaatgtacaacacc

SEQ ID NO: 18610 - DNA, 20 bp, synthetic construct
  misc_feature 1..20: note = CRISPR gRNA sequence
  source 1..20: mol_type = other DNA
cacagaatgtacaacaccaa

SEQ ID NO: 18611 - DNA, 20 bp, synthetic construct
  misc_feature 1..20: note = CRISPR gRNA sequence
  source 1..20: mol_type = other DNA
accctcatgtaaacaaacca

SEQ ID NO: 18612 - DNA, 20 bp, synthetic construct
  misc_feature 1..20: note = CRISPR gRNA sequence
  source 1..20: mol_type = other DNA
tgtaaacaaaccatggacct

SEQ ID NO: 18613 - DNA, 20 bp, synthetic construct
  misc_feature 1..20: note = CRISPR gRNA sequence
  source 1..20: mol_type = other DNA
gtaaacaaaccatggacctt

SEQ ID NO: 18614 - DNA, 20 bp, synthetic construct
  misc_feature 1..20: note = CRISPR gRNA sequence
  source 1..20: mol_type = other DNA
gtaataatgatgcatcaatg

SEQ ID NO: 18615 - DNA, 20 bp, synthetic construct
  misc_feature 1..20: note = CRISPR gRNA sequence
  source 1..20: mol_type = other DNA
taataatgatgcatcaatgt

SEQ ID NO: 18616 - DNA, 20 bp, synthetic construct
  misc_feature 1..20: note = CRISPR gRNA sequence
  source 1..20: mol_type = other DNA
attgattataacaaatgtat

SEQ ID NO: 18617 - DNA, 20 bp, synthetic construct
  misc_feature 1..20: note = CRISPR gRNA sequence
  source 1..20: mol_type = other DNA
ttataacaaatgtatcagtc

SEQ ID NO: 18618 - DNA, 20 bp, synthetic construct
  misc_feature 1..20: note = CRISPR gRNA sequence
  source 1..20: mol_type = other DNA
aaatgtatcagtctggtgct

SEQ ID NO: 18619 - DNA, 20 bp, synthetic construct
  misc_feature 1..20: note = CRISPR gRNA sequence
  source 1..20: mol_type = other DNA
ctggtgctgagtgttcatca

SEQ ID NO: 18620 - DNA, 20 bp, synthetic construct
  misc_feature 1..20: note = CRISPR gRNA sequence
  source 1..20: mol_type = other DNA
tggtgctgagtgttcatcat

SEQ ID NO: 18621 - DNA, 20 bp, synthetic construct
  misc_feature 1..20: note = CRISPR gRNA sequence
  source 1..20: mol_type = other DNA
ggtgctgagtgttcatcatg

SEQ ID NO: 18622 - DNA, 20 bp, synthetic construct
  misc_feature 1..20: note = CRISPR gRNA sequence
  source 1..20: mol_type = other DNA
gtgctgagtgttcatcatgg

SEQ ID NO: 18623 - DNA, 20 bp, synthetic construct
  misc_feature 1..20: note = CRISPR gRNA sequence
  source 1..20: mol_type = other DNA
gctgagtgttcatcatgggg

SEQ ID NO: 18624 - DNA, 20 bp, synthetic construct
  misc_feature 1..20: note = CRISPR gRNA sequence
  source 1..20: mol_type = other DNA
ctgagtgttcatcatggggg

SEQ ID NO: 18625 - DNA, 20 bp, synthetic construct
  misc_feature 1..20: note = CRISPR gRNA sequence
  source 1..20: mol_type = other DNA
tgggggaggctatgcctgta

SEQ ID NO: 18626 - DNA, 20 bp, synthetic construct
  misc_feature 1..20: note = CRISPR gRNA sequence
  source 1..20: mol_type = other DNA
gggggaggctatgcctgtat

SEQ ID NO: 18627 - DNA, 20 bp, synthetic construct
  misc_feature 1..20: note = CRISPR gRNA sequence
  source 1..20: mol_type = other DNA
gggaggctatgcctgtatgg

SEQ ID NO: 18628 - DNA, 20 bp, synthetic construct
  misc_feature 1..20: note = CRISPR gRNA sequence
  source 1..20: mol_type = other DNA
ggaggctatgcctgtatggg

SEQ ID NO: 18629 - DNA, 20 bp, synthetic construct
  misc_feature 1..20: note = CRISPR gRNA sequence
  source 1..20: mol_type = other DNA
gctatgcctgtatgggagga

SEQ ID NO: 18630 - DNA, 20 bp, synthetic construct
  misc_feature 1..20: note = CRISPR gRNA sequence
  source 1..20: mol_type = other DNA
tatgcctgtatgggaggacg

SEQ ID NO: 18631 - DNA, 20 bp, synthetic construct
  misc_feature 1..20: note = CRISPR gRNA sequence
  source 1..20: mol_type = other DNA
atgcctgtatgggaggacgg

SEQ ID NO: 18632 - DNA, 20 bp, synthetic construct
  misc_feature 1..20: note = CRISPR gRNA sequence
  source 1..20: mol_type = other DNA
cctgtatgggaggacggagg

SEQ ID NO: 18633 - DNA, 20 bp, synthetic construct
  misc_feature 1..20: note = CRISPR gRNA sequence
  source 1..20: mol_type = other DNA
atgggaggacggaggtagat

SEQ ID NO: 18634 - DNA, 20 bp, synthetic construct
  misc_feature 1..20: note = CRISPR gRNA sequence
  source 1..20: mol_type = other DNA
tgggaggacggaggtagatg

SEQ ID NO: 18635 - DNA, 20 bp, synthetic construct
  misc_feature 1..20: note = CRISPR gRNA sequence
  source 1..20: mol_type = other DNA
gggaggacggaggtagatga

SEQ ID NO: 18636 - DNA, 20 bp, synthetic construct
  misc_feature 1..20: note = CRISPR gRNA sequence
  source 1..20: mol_type = other DNA
ggaggtagatgagggatgtg

SEQ ID NO: 18637 - DNA, 20 bp, synthetic construct
  misc_feature 1..20: note = CRISPR gRNA sequence
  source 1..20: mol_type = other DNA
gaggtagatgagggatgtga

SEQ ID NO: 18638 - DNA, 20 bp, synthetic construct
  misc_feature 1..20: note = CRISPR gRNA sequence
  source 1..20: mol_type = other DNA
agatgagggatgtgaaggtc

SEQ ID NO: 18639 - DNA, 20 bp, synthetic construct
  misc_feature 1..20: note = CRISPR gRNA sequence
  source 1..20: mol_type = other DNA
gtctagcttccttgctgtcc

SEQ ID NO: 18640 - DNA, 20 bp, synthetic construct
  misc_feature 1..20: note = CRISPR gRNA sequence
  source 1..20: mol_type = other DNA
cttccttgctgtcccagctt

SEQ ID NO: 18641 - DNA, 20 bp, synthetic construct
  misc_feature 1..20: note = CRISPR gRNA sequence
  source 1..20: mol_type = other DNA
cccagcttgagtgctcccta

SEQ ID NO: 18642 - DNA, 20 bp, synthetic construct
  misc_feature 1..20: note = CRISPR gRNA sequence
  source 1..20: mol_type = other DNA
ccagcttgagtgctccctat

SEQ ID NO: 18643 - DNA, 20 bp, synthetic construct
  misc_feature 1..20: note = CRISPR gRNA sequence
  source 1..20: mol_type = other DNA
ttgagtgctccctatgggat

SEQ ID NO: 18644 - DNA, 20 bp, synthetic construct
  misc_feature 1..20: note = CRISPR gRNA sequence
  source 1..20: mol_type = other DNA
tgctccctatgggattggct

SEQ ID NO: 18645 - DNA, 20 bp, synthetic construct
  misc_feature 1..20: note = CRISPR gRNA sequence
  source 1..20: mol_type = other DNA
tgctttcttcccttttcctt

SEQ ID NO: 18646 - DNA, 20 bp, synthetic construct
  misc_feature 1..20: note = CRISPR gRNA sequence
  source 1..20: mol_type = other DNA
gctttcttcccttttccttc

SEQ ID NO: 18647 - DNA, 20 bp, synthetic construct
  misc_feature 1..20: note = CRISPR gRNA sequence
  source 1..20: mol_type = other DNA
ttccctcctgtgaatgtccc

SEQ ID NO: 18648 - DNA, 20 bp, synthetic construct
  misc_feature 1..20: note = CRISPR gRNA sequence
  source 1..20: mol_type = other DNA
gcaaatctccatctcctact

SEQ ID NO: 18649 - DNA, 20 bp, synthetic construct
  misc_feature 1..20: note = CRISPR gRNA sequence
  source 1..20: mol_type = other DNA
ccatctcctacttggcttcc

SEQ ID NO: 18650 - DNA, 20 bp, synthetic construct
  misc_feature 1..20: note = CRISPR gRNA sequence
  source 1..20: mol_type = other DNA
cttcccagacaatctgacct

SEQ ID NO: 18651 - DNA, 20 bp, synthetic construct
  misc_feature 1..20: note = CRISPR gRNA sequence
  source 1..20: mol_type = other DNA
cttacttctatttttcctcc

SEQ ID NO: 18652 - DNA, 20 bp, synthetic construct
  misc_feature 1..20: note = CRISPR gRNA sequence
  source 1..20: mol_type = other DNA
tacttctatttttcctccaa

SEQ ID NO: 18653 - DNA, 20 bp, synthetic construct
  misc_feature 1..20: note = CRISPR gRNA sequence
  source 1..20: mol_type = other DNA
acttctatttttcctccaag

SEQ ID NO: 18654 - DNA, 20 bp, synthetic construct
  misc_feature 1..20: note = CRISPR gRNA sequence
  source 1..20: mol_type = other DNA
cttctatttttcctccaaga

SEQ ID NO: 18655 - DNA, 20 bp, synthetic construct
  misc_feature 1..20: note = CRISPR gRNA sequence
  source 1..20: mol_type = other DNA
tttttcctccaagagggacg

SEQ ID NO: 18656 - DNA, 20 bp, synthetic construct
  misc_feature 1..20: note = CRISPR gRNA sequence
  source 1..20: mol_type = other DNA
agagggacgtggaaatccta

SEQ ID NO: 18657 - DNA, 20 bp, synthetic construct
  misc_feature 1..20: note = CRISPR gRNA sequence
  source 1..20: mol_type = other DNA
gagggacgtggaaatcctac

SEQ ID NO: 18658 - DNA, 20 bp, synthetic construct
  misc_feature 1..20: note = CRISPR gRNA sequence
  source 1..20: mol_type = other DNA
aatcctacaggaccccacaa

SEQ ID NO: 18659 - DNA, 20 bp, synthetic construct
  misc_feature 1..20: note = CRISPR gRNA sequence
  source 1..20: mol_type = other DNA
ggaccccacaaaagacacca

SEQ ID NO: 18660 - DNA, 20 bp, synthetic construct
  misc_feature 1..20: note = CRISPR gRNA sequence
  source 1..20: mol_type = other DNA
accacagatgccccctctga

SEQ ID NO: 18661 - DNA, 20 bp, synthetic construct
  misc_feature 1..20: note = CRISPR gRNA sequence
  source 1..20: mol_type = other DNA
agatgccccctctgaaagtt

SEQ ID NO: 18662 - DNA, 20 bp, synthetic construct
  misc_feature 1..20: note = CRISPR gRNA sequence
  source 1..20: mol_type = other DNA
gatgccccctctgaaagttc

SEQ ID NO: 18663 - DNA, 20 bp, synthetic construct
  misc_feature 1..20: note = CRISPR gRNA sequence
  source 1..20: mol_type = other DNA
ccccctctgaaagttcaggc

SEQ ID NO: 18664 - DNA, 20 bp, synthetic construct
  misc_feature 1..20: note = CRISPR gRNA sequence
  source 1..20: mol_type = other DNA
ggcaagccacctatcttctc

SEQ ID NO: 18665 - DNA, 20 bp, synthetic construct
  misc_feature 1..20: note = CRISPR gRNA sequence
  source 1..20: mol_type = other DNA
gcaagccacctatcttctct

SEQ ID NO: 18666 - DNA, 20 bp, synthetic construct
  misc_feature 1..20: note = CRISPR gRNA sequence
  source 1..20: mol_type = other DNA
atcttctctgggtcccgatt

SEQ ID NO: 18667 - DNA, 20 bp, synthetic construct
  misc_feature 1..20: note = CRISPR gRNA sequence
  source 1..20: mol_type = other DNA
tcttctctgggtcccgattg

SEQ ID NO: 18668 - DNA, 20 bp, synthetic construct
  misc_feature 1..20: note = CRISPR gRNA sequence
  source 1..20: mol_type = other DNA
acactgacctcataacaact

SEQ ID NO: 18669 - DNA, 20 bp, synthetic construct
  misc_feature 1..20: note = CRISPR gRNA sequence
  source 1..20: mol_type = other DNA
ggaaaatcttaaaactcgaa

SEQ ID NO: 18670 - DNA, 20 bp, synthetic construct
  misc_feature 1..20: note = CRISPR gRNA sequence
  source 1..20: mol_type = other DNA
gaaaatcttaaaactcgaat

SEQ ID NO: 18671 - DNA, 20 bp, synthetic construct
  misc_feature 1..20: note = CRISPR gRNA sequence
  source 1..20: mol_type = other DNA
ctcgaatgggccatcatctc

SEQ ID NO: 18672 - DNA, 20 bp, synthetic construct
  misc_feature 1..20: note = CRISPR gRNA sequence
  source 1..20: mol_type = other DNA
tctccagcttgtgcatttgc

SEQ ID NO: 18673 - DNA, 20 bp, synthetic construct
  misc_feature 1..20: note = CRISPR gRNA sequence
  source 1..20: mol_type = other DNA
agcttgtgcatttgccagta

SEQ ID NO: 18674 - DNA, 20 bp, synthetic construct
  misc_feature 1..20: note = CRISPR gRNA sequence
  source 1..20: mol_type = other DNA
gcttgtgcatttgccagtaa

SEQ ID NO: 18675 - DNA, 20 bp, synthetic construct
  misc_feature 1..20: note = CRISPR gRNA sequence
  source 1..20: mol_type = other DNA
cttgtgcatttgccagtaaa

SEQ ID NO: 18676 - DNA, 20 bp, synthetic construct
  misc_feature 1..20: note = CRISPR gRNA sequence
  source 1..20: mol_type = other DNA
gcatttgccagtaaagggta

SEQ ID NO: 18677 - DNA, 20 bp, synthetic construct
  misc_feature 1..20: note = CRISPR gRNA sequence
  source 1..20: mol_type = other DNA
agtaaagggtaaagttattg

SEQ ID NO: 18678 - DNA, 20 bp, synthetic construct
  misc_feature 1..20: note = CRISPR gRNA sequence
  source 1..20: mol_type = other DNA
gtaaagggtaaagttattgt

SEQ ID NO: 18679 - DNA, 20 bp, synthetic construct
  misc_feature 1..20: note = CRISPR gRNA sequence
  source 1..20: mol_type = other DNA
agggtaaagttattgtgggt

SEQ ID NO: 18680 - DNA, 20 bp, synthetic construct
  misc_feature 1..20: note = CRISPR gRNA sequence
  source 1..20: mol_type = other DNA
gggtaaagttattgtgggtg

SEQ ID NO: 18681 - DNA, 20 bp, synthetic construct
  misc_feature 1..20: note = CRISPR gRNA sequence
  source 1..20: mol_type = other DNA
ggtaaagttattgtgggtga

SEQ ID NO: 18682 - DNA, 20 bp, synthetic construct
  misc_feature 1..20: note = CRISPR gRNA sequence
  source 1..20: mol_type = other DNA
gtaaagttattgtgggtgag

SEQ ID NO: 18683 - DNA, 20 bp, synthetic construct
  misc_feature 1..20: note = CRISPR gRNA sequence
  source 1..20: mol_type = other DNA
gttattgtgggtgaggggcc

SEQ ID NO: 18684 - DNA, 20 bp, synthetic construct
  misc_feature 1..20: note = CRISPR gRNA sequence
  source 1..20: mol_type = other DNA
attgtgggtgaggggcctgg

SEQ ID NO: 18685 - DNA, 20 bp, synthetic construct
  misc_feature 1..20: note = CRISPR gRNA sequence
  source 1..20: mol_type = other DNA
ggtgaggggcctggtggtcc

SEQ ID NO: 18686 - DNA, 20 bp, synthetic construct
  misc_feature 1..20: note = CRISPR gRNA sequence
  source 1..20: mol_type = other DNA
gtgaggggcctggtggtccc

SEQ ID NO: 18687 - DNA, 20 bp, synthetic construct
  misc_feature 1..20: note = CRISPR gRNA sequence
  source 1..20: mol_type = other DNA
gggcctggtggtcccaggat

SEQ ID NO: 18688 - DNA, 20 bp, synthetic construct
  misc_feature 1..20: note = CRISPR gRNA sequence
  source 1..20: mol_type = other DNA
gtggtcccaggatgagaatg

SEQ ID NO: 18689 - DNA, 20 bp, synthetic construct
  misc_feature 1..20: note = CRISPR gRNA sequence
  source 1..20: mol_type = other DNA
cccaggatgagaatgaagat

SEQ ID NO: 18690 - DNA, 20 bp, synthetic construct
  misc_feature 1..20: note = CRISPR gRNA sequence
  source 1..20: mol_type = other DNA
agaatgaagatgagctgtat

SEQ ID NO: 18691 - DNA, 20 bp, synthetic construct
  misc_feature 1..20: note = CRISPR gRNA sequence
  source 1..20: mol_type = other DNA
aagatgagctgtatgagctg

SEQ ID NO: 18692 - DNA, 20 bp, synthetic construct
  misc_feature 1..20: note = CRISPR gRNA sequence
  source 1..20: mol_type = other DNA
tgagctgtatgagctgcagc

SEQ ID NO: 18693 - DNA, 20 bp, synthetic construct
  misc_feature 1..20: note = CRISPR gRNA sequence
  source 1..20: mol_type = other DNA
gagctgtatgagctgcagcc

SEQ ID NO: 18694 - DNA, 20 bp, synthetic construct
  misc_feature 1..20: note = CRISPR gRNA sequence
  source 1..20: mol_type = other DNA
gctgtatgagctgcagccag

SEQ ID NO: 18695 - DNA, 20 bp, synthetic construct
  misc_feature 1..20: note = CRISPR gRNA sequence
  source 1..20: mol_type = other DNA
agctgcagccaggagacctt

SEQ ID NO: 18696 - DNA, 20 bp, synthetic construct
  misc_feature 1..20: note = CRISPR gRNA sequence
  source 1..20: mol_type = other DNA
ggagaccttcggtccctgtc

SEQ ID NO: 18697 - DNA, 20 bp, synthetic construct
  misc_feature 1..20: note = CRISPR gRNA sequence
  source 1..20: mol_type = other DNA
ttcggtccctgtccagaatg

SEQ ID NO: 18698 - DNA, 20 bp, synthetic construct
  misc_feature 1..20: note = CRISPR gRNA sequence
  source 1..20: mol_type = other DNA
tcggtccctgtccagaatgc

SEQ ID NO: 18699 - DNA, 20 bp, synthetic construct
  misc_feature 1..20: note = CRISPR gRNA sequence
  source 1..20: mol_type = other DNA
cggtccctgtccagaatgca

SEQ ID NO: 18700 - DNA, 20 bp, synthetic construct
  misc_feature 1..20: note = CRISPR gRNA sequence
  source 1..20: mol_type = other DNA
ccctgtccagaatgcagggt

SEQ ID NO: 18701 - DNA, 20 bp, synthetic construct
  misc_feature 1..20: note = CRISPR gRNA sequence
  source 1..20: mol_type = other DNA
cctgtccagaatgcagggtt

SEQ ID NO: 18702 - DNA, 20 bp, synthetic construct
  misc_feature 1..20: note = CRISPR gRNA sequence
  source 1..20: mol_type = other DNA
ccagaatgcagggttgggat

SEQ ID NO: 18703 - DNA, 20 bp, synthetic construct
  misc_feature 1..20: note = CRISPR gRNA sequence
  source 1..20: mol_type = other DNA
agaatgcagggttgggataa

SEQ ID NO: 18704 - DNA, 20 bp, synthetic construct
  misc_feature 1..20: note = CRISPR gRNA sequence
  source 1..20: mol_type = other DNA
agttcccttccccgcttgcc

SEQ ID NO: 18705 - DNA, 20 bp, synthetic construct
  misc_feature 1..20: note = CRISPR gRNA sequence
  source 1..20: mol_type = other DNA
cccgcttgcctggtctgtcc

SEQ ID NO: 18706 - DNA, 20 bp, synthetic construct
  misc_feature 1..20: note = CRISPR gRNA sequence
  source 1..20: mol_type = other DNA
tgcctggtctgtcccagctc

SEQ ID NO: 18707 - DNA, 20 bp, synthetic construct
  misc_feature 1..20: note = CRISPR gRNA sequence
  source 1..20: mol_type = other DNA
tggtctgtcccagctccaga

SEQ ID NO: 18708 - DNA, 20 bp, synthetic construct
  misc_feature 1..20: note = CRISPR gRNA sequence
  source 1..20: mol_type = other DNA
ctgcatgccactcctaactg

SEQ ID NO: 18709 - DNA, 20 bp, synthetic construct
  misc_feature 1..20: note = CRISPR gRNA sequence
  source 1..20: mol_type = other DNA
cctaactgcagtcaatgacc

SEQ ID NO: 18710 - DNA, 20 bp, synthetic construct
  misc_feature 1..20: note = CRISPR gRNA sequence
  source 1..20: mol_type = other DNA
actgcagtcaatgacctgga

SEQ ID NO: 18711 - DNA, 20 bp, synthetic construct
  misc_feature 1..20: note = CRISPR gRNA sequence
  source 1..20: mol_type = other DNA
ctgcagtcaatgacctggaa

SEQ ID NO: 18712 - DNA, 20 bp, synthetic construct
  misc_feature 1..20: note = CRISPR gRNA sequence
  source 1..20: mol_type = other DNA
gcagtcaatgacctggaaag

SEQ ID NO: 18713 - DNA, 20 bp, synthetic construct
  misc_feature 1..20: note = CRISPR gRNA sequence
  source 1..20: mol_type = other DNA
gacctggaaaggagtccaac

SEQ ID NO: 18714 - DNA, 20 bp, synthetic construct
  misc_feature 1..20: note = CRISPR gRNA sequence
  source 1..20: mol_type = other DNA
ggagtccaacaagtttttcc

SEQ ID NO: 18715 - DNA, 20 bp, synthetic construct
  misc_feature 1..20: note = CRISPR gRNA sequence
  source 1..20: mol_type = other DNA
gtccaacaagtttttcctgg

SEQ ID NO: 18716 - DNA, 20 bp, synthetic construct
  misc_feature 1..20: note = CRISPR gRNA sequence
  source 1..20: mol_type = other DNA
tccaacaagtttttcctgga

SEQ ID NO: 18717 - DNA, 20 bp, synthetic construct
  misc_feature 1..20: note = CRISPR gRNA sequence
  source 1..20: mol_type = other DNA
ccaacaagtttttcctggaa

SEQ ID NO: 18718 - DNA, 20 bp, synthetic construct
  misc_feature 1..20: note = CRISPR gRNA sequence
  source 1..20: mol_type = other DNA
cctggaagggaacctgaccc

SEQ ID NO: 18719 - DNA, 20 bp, synthetic construct
  misc_feature 1..20: note = CRISPR gRNA sequence
  source 1..20: mol_type = other DNA
agggaacctgaccctggtgc

SEQ ID NO: 18720 - DNA, 20 bp, synthetic construct
  misc_feature 1..20: note = CRISPR gRNA sequence
  source 1..20: mol_type = other DNA
gggaacctgaccctggtgct

SEQ ID NO: 18721 - DNA, 20 bp, synthetic construct
  misc_feature 1..20: note = CRISPR gRNA sequence
  source 1..20: mol_type = other DNA
ggaacctgaccctggtgctg

SEQ ID NO: 18722 - DNA, 20 bp, synthetic construct
  misc_feature 1..20: note = CRISPR gRNA sequence
  source 1..20: mol_type = other DNA
acctgaccctggtgctgggg

SEQ ID NO: 18723 - DNA, 20 bp, synthetic construct
  misc_feature 1..20: note = CRISPR gRNA sequence
  source 1..20: mol_type = other DNA
cctgaccctggtgctggggt

SEQ ID NO: 18724 - DNA, 20 bp, synthetic construct
  misc_feature 1..20: note = CRISPR gRNA sequence
  source 1..20: mol_type = other DNA
ctgaccctggtgctggggta

SEQ ID NO: 18725 - DNA, 20 bp, synthetic construct
  misc_feature 1..20: note = CRISPR gRNA sequence
  source 1..20: mol_type = other DNA
tgaccctggtgctggggtag

SEQ ID NO: 18726 - DNA, 20 bp, synthetic construct
  misc_feature 1..20: note = CRISPR gRNA sequence
  source 1..20: mol_type = other DNA
gaccctggtgctggggtagg

SEQ ID NO: 18727 - DNA, 20 bp, synthetic construct
  misc_feature 1..20: note = CRISPR gRNA sequence
  source 1..20: mol_type = other DNA
cctggtgctggggtaggggg

SEQ ID NO: 18728 - DNA, 20 bp, synthetic construct
  misc_feature 1..20: note = CRISPR gRNA sequence
  source 1..20: mol_type = other DNA
tggtgctggggtagggggtg

SEQ ID NO: 18729 - DNA, 20 bp, synthetic construct
  misc_feature 1..20: note = CRISPR gRNA sequence
  source 1..20: mol_type = other DNA
ggggtagggggtggagtgat

SEQ ID NO: 18730 - DNA, 20 bp, synthetic construct
  misc_feature 1..20: note = CRISPR gRNA sequence
  source 1..20: mol_type = other DNA
gggtagggggtggagtgatg

SEQ ID NO: 18731 - DNA, 20 bp, synthetic construct
  misc_feature 1..20: note = CRISPR gRNA sequence
  source 1..20: mol_type = other DNA
tgatgaggatcttgtgactg

SEQ ID NO: 18732 - DNA, 20 bp, synthetic construct
  misc_feature 1..20: note = CRISPR gRNA sequence
  source 1..20: mol_type = other DNA
gaggatcttgtgactgcagt

SEQ ID NO: 18733 - DNA, 20 bp, synthetic construct
  misc_feature 1..20: note = CRISPR gRNA sequence
  source 1..20: mol_type = other DNA
tcttgtgactgcagttagca

SEQ ID NO: 18734 - DNA, 20 bp, synthetic construct
  misc_feature 1..20: note = CRISPR gRNA sequence
  source 1..20: mol_type = other DNA
gtgactgcagttagcaaagc

SEQ ID NO: 18735 - DNA, 20 bp, synthetic construct
  misc_feature 1..20: note = CRISPR gRNA sequence
  source 1..20: mol_type = other DNA
tgactgcagttagcaaagcc

SEQ ID NO: 18736 - DNA, 20 bp, synthetic construct
  misc_feature 1..20: note = CRISPR gRNA sequence
  source 1..20: mol_type = other DNA
caaagccaggccccacactc

SEQ ID NO: 18737 - DNA, 20 bp, synthetic construct
  misc_feature 1..20: note = CRISPR gRNA sequence
  source 1..20: mol_type = other DNA
cactccagtcctgacccatc

SEQ ID NO: 18738 - DNA, 20 bp, synthetic construct
  misc_feature 1..20: note = CRISPR gRNA sequence
  source 1..20: mol_type = other DNA
ccatccggctctacttaaca

SEQ ID NO: 18739 - DNA, 20 bp, synthetic construct
  misc_feature 1..20: note = CRISPR gRNA sequence
  source 1..20: mol_type = other DNA
acttaacacagtccccccgc

SEQ ID NO: 18740 - DNA, 20 bp, synthetic construct
  misc_feature 1..20: note = CRISPR gRNA sequence
  source 1..20: mol_type = other DNA
tccccccgccagcactctgc

SEQ ID NO: 18741 - DNA, 20 bp, synthetic construct
  misc_feature 1..20: note = CRISPR gRNA sequence
  source 1..20: mol_type = other DNA
ccccccgccagcactctgct

SEQ ID NO: 18742 - DNA, 20 bp, synthetic construct
  misc_feature 1..20: note = CRISPR gRNA sequence
  source 1..20: mol_type = other DNA
gccagcactctgctgggtgc

SEQ ID NO: 18743 - DNA, 20 bp, synthetic construct
  misc_feature 1..20: note = CRISPR gRNA sequence
  source 1..20: mol_type = other DNA
cagcactctgctgggtgctg

SEQ ID NO: 18744 - DNA, 20 bp, synthetic construct
  misc_feature 1..20: note = CRISPR gRNA sequence
  source 1..20: mol_type = other DNA
tgctgggtgctggagacccc

SEQ ID NO: 18745 - DNA, 20 bp, synthetic construct
  misc_feature 1..20: note = CRISPR gRNA sequence
  source 1..20: mol_type = other DNA
gagaccccaagatgaaccac

SEQ ID NO: 18746 - DNA, 20 bp, synthetic construct
  misc_feature 1..20: note = CRISPR gRNA sequence
  source 1..20: mol_type = other DNA
ccccaagatgaaccacgagc

SEQ ID NO: 18747 - DNA, 20 bp, synthetic construct
  misc_feature 1..20: note = CRISPR gRNA sequence
  source 1..20: mol_type = other DNA
acgagccagtcctgcttgct

SEQ ID NO: 18748 - DNA, 20 bp, synthetic construct
  misc_feature 1..20: note = CRISPR gRNA sequence
  source 1..20: mol_type = other DNA
tgcttgctgagatctgacta

SEQ ID NO: 18749 - DNA, 20 bp, synthetic construct
  misc_feature 1..20: note = CRISPR gRNA sequence
  source 1..20: mol_type = other DNA
cttgctgagatctgactacg

SEQ ID NO: 18750 - DNA, 20 bp, synthetic construct
  misc_feature 1..20: note = CRISPR gRNA sequence
  source 1..20: mol_type = other DNA
tgagatctgactacggagtc

SEQ ID NO: 18751 - DNA, 20 bp, synthetic construct
  misc_feature 1..20: note = CRISPR gRNA sequence
  source 1..20: mol_type = other DNA
tgactacggagtccagccat

SEQ ID NO: 18752 - DNA, 20 bp, synthetic construct
  misc_feature 1..20: note = CRISPR gRNA sequence
  source 1..20: mol_type = other DNA
ctacggagtccagccatcgg

SEQ ID NO: 18753 - DNA, 20 bp, synthetic construct
  misc_feature 1..20: note = CRISPR gRNA sequence
  source 1..20: mol_type = other DNA
tacggagtccagccatcggc

SEQ ID NO: 18754 - DNA, 20 bp, synthetic construct
  misc_feature 1..20: note = CRISPR gRNA sequence
  source 1..20: mol_type = other DNA
agtccagccatcggcaggct

SEQ ID NO: 18755 - DNA, 20 bp, synthetic construct
  misc_feature 1..20: note = CRISPR gRNA sequence
  source 1..20: mol_type = other DNA
ccatcggcaggcttggctgt

SEQ ID NO: 18756 - DNA, 20 bp, synthetic construct
  misc_feature 1..20: note = CRISPR gRNA sequence
  source 1..20: mol_type = other DNA
cggcaggcttggctgtgagt

SEQ ID NO: 18757 - DNA, 20 bp, synthetic construct
  misc_feature 1..20: note = CRISPR gRNA sequence
  source 1..20: mol_type = other DNA
ggctgtgagtgagaattacc

SEQ ID NO: 18758 - DNA, 20 bp, synthetic construct
  misc_feature 1..20: note = CRISPR gRNA sequence
  source 1..20: mol_type = other DNA
gctgtgagtgagaattacct

SEQ ID NO: 18759 - DNA, 20 bp, synthetic construct
  misc_feature 1..20: note = CRISPR gRNA sequence
  source 1..20: mol_type = other DNA
gtgagtgagaattacctggg

SEQ ID NO: 18760 - DNA, 20 bp, synthetic construct
  misc_feature 1..20: note = CRISPR gRNA sequence
  source 1..20: mol_type = other DNA
tgagtgagaattacctggga

SEQ ID NO: 18761 - DNA, 20 bp, synthetic construct
  misc_feature 1..20: note = CRISPR gRNA sequence
  source 1..20: mol_type = other DNA
gagtgagaattacctgggaa

SEQ ID NO: 18762 - DNA, 20 bp, synthetic construct
  misc_feature 1..20: note = CRISPR gRNA sequence
  source 1..20: mol_type = other DNA
tgggaagggtgttaaaaaca

SEQ ID NO: 18763 - DNA, 20 bp, synthetic construct
  misc_feature 1..20: note = CRISPR gRNA sequence
  source 1..20: mol_type = other DNA
gtgttaaaaacacagcgtcc

SEQ ID NO: 18764 - DNA, 20 bp, synthetic construct
  misc_feature 1..20: note = CRISPR gRNA sequence
  source 1..20: mol_type = other DNA
tgttaaaaacacagcgtcct

SEQ ID NO: 18765 - DNA, 20 bp, synthetic construct
  misc_feature 1..20: note = CRISPR gRNA sequence
  source 1..20: mol_type = other DNA
agcgtcctgggcctcacccc

SEQ ID NO: 18766 - DNA, 20 bp, synthetic construct
  misc_feature 1..20: note = CRISPR gRNA sequence
  source 1..20: mol_type = other DNA
tcacccccagtgattctatt

SEQ ID NO: 18767 - DNA, 20 bp, synthetic construct
  misc_feature 1..20: note = CRISPR gRNA sequence
  source 1..20: mol_type = other DNA
cacccccagtgattctattc

SEQ ID NO: 18768 - DNA, 20 bp, synthetic construct
  misc_feature 1..20: note = CRISPR gRNA sequence
  source 1..20: mol_type = other DNA
acccccagtgattctattca

SEQ ID NO: 18769 - DNA, 20 bp, synthetic construct
  misc_feature 1..20: note = CRISPR gRNA sequence
  source 1..20: mol_type = other DNA
ccccagtgattctattcagg

SEQ ID NO: 18770 - DNA, 20 bp, synthetic construct
  misc_feature 1..20: note = CRISPR gRNA sequence
  source 1..20: mol_type = other DNA
gattctattcagggagtctg

SEQ ID NO: 18771 - DNA, 20 bp, synthetic construct
  misc_feature 1..20: note = CRISPR gRNA sequence
  source 1..20: mol_type = other DNA
ctattcagggagtctgcagc

SEQ ID NO: 18772 - DNA, 20 bp, synthetic construct
  misc_feature 1..20: note = CRISPR gRNA sequence
  source 1..20: mol_type = other DNA
tattcagggagtctgcagcc

SEQ ID NO: 18773 - DNA, 20 bp, synthetic construct
  misc_feature 1..20: note = CRISPR gRNA sequence
  source 1..20: mol_type = other DNA
agggagtctgcagccgggcc

SEQ ID NO: 18774 - DNA, 20 bp, synthetic construct
  misc_feature 1..20: note = CRISPR gRNA sequence
  source 1..20: mol_type = other DNA
gggagtctgcagccgggccc

SEQ ID NO: 18775 - DNA, 20 bp, synthetic construct
  misc_feature 1..20: note = CRISPR gRNA sequence
  source 1..20: mol_type = other DNA
tattttctttcatttttttt

SEQ ID NO: 18776 - DNA, 20 bp, synthetic construct
  misc_feature 1..20: note = CRISPR gRNA sequence
  source 1..20: mol_type = other DNA
ttctttcattttttttgaga

SEQ ID NO: 18777 - DNA, 20 bp, synthetic construct
  misc_feature 1..20: note = CRISPR gRNA sequence
  source 1..20: mol_type = other DNA
ctttcattttttttgagacg

SEQ ID NO: 18778 - DNA, 20 bp, synthetic construct
  misc_feature 1..20: note = CRISPR gRNA sequence
  source 1..20: mol_type = other DNA
ggagtttcactcttgttgcc

SEQ ID NO: 18779 - DNA, 20 bp, synthetic construct
  misc_feature 1..20: note = CRISPR gRNA sequence
  source 1..20: mol_type = other DNA
gagtttcactcttgttgccc

SEQ ID NO: 18780 - DNA, 20 bp, synthetic construct
  misc_feature 1..20: note = CRISPR gRNA sequence
  source 1..20: mol_type = other DNA
ttcactcttgttgcccaggc

SEQ ID NO: 18781 - DNA, 20 bp, synthetic construct
  misc_feature 1..20: note = CRISPR gRNA sequence
  source 1..20: mol_type = other DNA
cactcttgttgcccaggctg

SEQ ID NO: 18782 - DNA, 20 bp, synthetic construct
  misc_feature 1..20: note = CRISPR gRNA sequence
  source 1..20: mol_type = other DNA
ttgcccaggctggagtgcaa

SEQ ID NO: 18783 - DNA, 20 bp, synthetic construct
  misc_feature 1..20: note = CRISPR gRNA sequence
  source 1..20: mol_type = other DNA
ggagtgcaatggtgtgatct

SEQ ID NO: 18784 - DNA, 20 bp, synthetic construct
  misc_feature 1..20: note = CRISPR gRNA sequence
  source 1..20: mol_type = other DNA
tcaccgcaatctccgcctcc

SEQ ID NO: 18785 - DNA, 20 bp, synthetic construct
  misc_feature 1..20: note = CRISPR gRNA sequence
  source 1..20: mol_type = other DNA
caccgcaatctccgcctcct

SEQ ID NO: 18786 - DNA, 20 bp, synthetic construct
  misc_feature 1..20: note = CRISPR gRNA sequence
  source 1..20: mol_type = other DNA
caatctccgcctcctgggtt

SEQ ID NO: 18787 - DNA, 20 bp, synthetic construct
  misc_feature 1..20: note = CRISPR gRNA sequence
  source 1..20: mol_type = other DNA
aatctccgcctcctgggttc

SEQ ID NO: 18788 - DNA, 20 bp, synthetic construct
  misc_feature 1..20: note = CRISPR gRNA sequence
  source 1..20: mol_type = other DNA
ttcaggcgattctcctccac

SEQ ID NO: 18789 - DNA, 20 bp, synthetic construct
  misc_feature 1..20: note = CRISPR gRNA sequence
  source 1..20: mol_type = other DNA
ttctcctccaccagcctacc

SEQ ID NO: 18790 - DNA, 20 bp, synthetic construct
  misc_feature 1..20: note = CRISPR gRNA sequence
  source 1..20: mol_type = other DNA
tcctccaccagcctaccgag

SEQ ID NO: 18791 - DNA, 20 bp, synthetic construct
  misc_feature 1..20: note = CRISPR gRNA sequence
  source 1..20: mol_type = other DNA
ccaccagcctaccgagtagc

SEQ ID NO: 18792 - DNA, 20 bp, synthetic construct
  misc_feature 1..20: note = CRISPR gRNA sequence
  source 1..20: mol_type = other DNA
caccagcctaccgagtagct

SEQ ID NO: 18793 - DNA, 20 bp, synthetic construct
  misc_feature 1..20: note = CRISPR gRNA sequence
  source 1..20: mol_type = other DNA
ctaccgagtagctgggatta

SEQ ID NO: 18794 - DNA, 20 bp, synthetic construct
  misc_feature 1..20: note = CRISPR gRNA sequence
  source 1..20: mol_type = other DNA
taccgagtagctgggattac

SEQ ID NO: 18795 - DNA, 20 bp, synthetic construct
  misc_feature 1..20: note = CRISPR gRNA sequence
  source 1..20: mol_type = other DNA
caggcatgcaccactacacc

SEQ ID NO: 18796 - DNA, 20 bp, synthetic construct
  misc_feature 1..20: note = CRISPR gRNA sequence
  source 1..20: mol_type = other DNA
cccggctaattttgtatttt

SEQ ID NO: 18797 - DNA, 20 bp, synthetic construct
  misc_feature 1..20: note = CRISPR gRNA sequence
  source 1..20: mol_type = other DNA
ccggctaattttgtattttt

SEQ ID NO: 18798 - DNA, 20 bp, synthetic construct
  misc_feature 1..20: note = CRISPR gRNA sequence
  source 1..20: mol_type = other DNA
ggctaattttgtatttttag

SEQ ID NO: 18799 - DNA, 20 bp, synthetic construct
  misc_feature 1..20: note = CRISPR gRNA sequence
  source 1..20: mol_type = other DNA
ctaattttgtatttttagga

SEQ ID NO: 18800 - DNA, 20 bp, synthetic construct
  misc_feature 1..20: note = CRISPR gRNA sequence
  source 1..20: mol_type = other DNA
ttttgtatttttaggagaga

SEQ ID NO: 18801 - DNA, 20 bp, synthetic construct
  misc_feature 1..20: note = CRISPR gRNA sequence
  source 1..20: mol_type = other DNA
cggtgtttcaccatgttgcc

SEQ ID NO: 18802 - DNA, 20 bp, synthetic construct
  misc_feature 1..20: note = CRISPR gRNA sequence
  source 1..20: mol_type = other DNA
ggtgtttcaccatgttgccc

SEQ ID NO: 18803 - DNA, 20 bp, synthetic construct
  misc_feature 1..20: note = CRISPR gRNA sequence
  source 1..20: mol_type = other DNA
tttcaccatgttgcccaggc

SEQ ID NO: 18804 - DNA, 20 bp, synthetic construct
  misc_feature 1..20: note = CRISPR gRNA sequence
  source 1..20: mol_type = other DNA
tggtctcgaactcctgatcc

SEQ ID NO: 18805 - DNA, 20 bp, synthetic construct
  misc_feature 1..20: note = CRISPR gRNA sequence
  source 1..20: mol_type = other DNA
ggtctcgaactcctgatccc

SEQ ID NO: 18806 - DNA, 20 bp, synthetic construct
  misc_feature 1..20: note = CRISPR gRNA sequence
  source 1..20: mol_type = other DNA
cctgatcccaggtgatccac

SEQ ID NO: 18807 - DNA, 20 bp, synthetic construct
  misc_feature 1..20: note = CRISPR gRNA sequence
  source 1..20: mol_type = other DNA
cccaggtgatccaccggcct

SEQ ID NO: 18808 - DNA, 20 bp, synthetic construct
  misc_feature 1..20: note = CRISPR gRNA sequence
  source 1..20: mol_type = other DNA
ccaccggcctcagcctccca

SEQ ID NO: 18809 - DNA, 20 bp, synthetic construct
  misc_feature 1..20: note = CRISPR gRNA sequence
  source 1..20: mol_type = other DNA
gcctcagcctcccaaagtgc

SEQ ID NO: 18810 - DNA, 20 bp, synthetic construct
  misc_feature 1..20: note = CRISPR gRNA sequence
  source 1..20: mol_type = other DNA
cctcagcctcccaaagtgct

SEQ ID NO: 18811 - DNA, 20 bp, synthetic construct
  misc_feature 1..20: note = CRISPR gRNA sequence
  source 1..20: mol_type = other DNA
ctcagcctcccaaagtgctg

SEQ ID NO: 18812 - DNA, 20 bp, synthetic construct
  misc_feature 1..20: note = CRISPR gRNA sequence
  source 1..20: mol_type = other DNA
ctcccaaagtgctggggtta

SEQ ID NO: 18813 - DNA, 20 bp, synthetic construct
  misc_feature 1..20: note = CRISPR gRNA sequence
  source 1..20: mol_type = other DNA
tcccaaagtgctggggttac

SEQ ID NO: 18814 - DNA, 20 bp, synthetic construct
  misc_feature 1..20: note = CRISPR gRNA sequence
  source 1..20: mol_type = other DNA
agtgctggggttacaggtgt

SEQ ID NO: 18815 - DNA, 20 bp, synthetic construct
  misc_feature 1..20: note = CRISPR gRNA sequence
  source 1..20: mol_type = other DNA
caggtgtgagccaccatgcc

SEQ ID NO: 18816 - DNA, 20 bp, synthetic construct
  misc_feature 1..20: note = CRISPR gRNA sequence
  source 1..20: mol_type = other DNA
gtgagccaccatgcccggcc

SEQ ID NO: 18817 - DNA, 20 bp, synthetic construct
  misc_feature 1..20: note = CRISPR gRNA sequence
  source 1..20: mol_type = other DNA
atatatttttttcctaaaaa

SEQ ID NO: 18818 - DNA, 20 bp, synthetic construct
  misc_feature 1..20: note = CRISPR gRNA sequence
  source 1..20: mol_type = other DNA
tatatttttttcctaaaaaa

SEQ ID NO: 18819 - DNA, 20 bp, synthetic construct
  misc_feature 1..20: note = CRISPR gRNA sequence
  source 1..20: mol_type = other DNA
aaaggtcttgctctgttgcc

SEQ ID NO: 18820 - DNA, 20 bp, synthetic construct
  misc_feature 1..20: note = CRISPR gRNA sequence
  source 1..20: mol_type = other DNA
aaggtcttgctctgttgccc

SEQ ID NO: 18821 - DNA, 20 bp, synthetic construct
  misc_feature 1..20: note = CRISPR gRNA sequence
  source 1..20: mol_type = other DNA
tcttgctctgttgcccaggc

SEQ ID NO: 18822 - DNA, 20 bp, synthetic construct
  misc_feature 1..20: note = CRISPR gRNA sequence
  source 1..20: mol_type = other DNA
ccaggctggtcttgaactcc

SEQ ID NO: 18823 - DNA, 20 bp, synthetic construct
  misc_feature 1..20: note = CRISPR gRNA sequence
  source 1..20: mol_type = other DNA
ggtcttgaactcctggtctc

SEQ ID NO: 18824 - DNA, 20 bp, synthetic construct
  misc_feature 1..20: note = CRISPR gRNA sequence
  source 1..20: mol_type = other DNA
tcatcctgccttgacctccc

SEQ ID NO: 18825 - DNA, 20 bp, synthetic construct
  misc_feature 1..20: note = CRISPR gRNA sequence
  source 1..20: mol_type = other DNA
catcctgccttgacctccca

SEQ ID NO: 18826 - DNA, 20 bp, synthetic construct
  misc_feature 1..20: note = CRISPR gRNA sequence
  source 1..20: mol_type = other DNA
gccttgacctcccaaggtga

SEQ ID NO: 18827 - DNA, 20 bp, synthetic construct
  misc_feature 1..20: note = CRISPR gRNA sequence
  source 1..20: mol_type = other DNA
ctcccaaggtgatggaatta

SEQ ID NO: 18828 - DNA, 20 bp, synthetic construct
  misc_feature 1..20: note = CRISPR gRNA sequence
  source 1..20: mol_type = other DNA
tcccaaggtgatggaattac

SEQ ID NO: 18829 - DNA, 20 bp, synthetic construct
  misc_feature 1..20: note = CRISPR gRNA sequence
  source 1..20: mol_type = other DNA
ggtgatggaattacaggcat

SEQ ID NO: 18830 - DNA, 20 bp, synthetic construct
  misc_feature 1..20: note = CRISPR gRNA sequence
  source 1..20: mol_type = other DNA
acaggcatgagccactgcac

SEQ ID NO: 18831 - DNA, 20 bp, synthetic construct
  misc_feature 1..20: note = CRISPR gRNA sequence
  source 1..20: mol_type = other DNA
caggcatgagccactgcacc

SEQ ID NO: 18832 - DNA, 20 bp, synthetic construct
  misc_feature 1..20: note = CRISPR gRNA sequence
  source 1..20: mol_type = other DNA
tcttatatctttccttcctg

SEQ ID NO: 18833 - DNA, 20 bp, synthetic construct
  misc_feature 1..20: note = CRISPR gRNA sequence
  source 1..20: mol_type = other DNA
ctttccttcctgaagtcttt

SEQ ID NO: 18834 - DNA, 20 bp, synthetic construct
  misc_feature 1..20: note = CRISPR gRNA sequence
  source 1..20: mol_type = other DNA
gccctctgctgccatgccct

SEQ ID NO: 18835 - DNA, 20 bp, synthetic construct
  misc_feature 1..20: note = CRISPR gRNA sequence
  source 1..20: mol_type = other DNA
ctgctgccatgcccttggtc

SEQ ID NO: 18836 - DNA, 20 bp, synthetic construct
  misc_feature 1..20: note = CRISPR gRNA sequence
  source 1..20: mol_type = other DNA
ctgccatgcccttggtctag

SEQ ID NO: 18837 - DNA, 20 bp, synthetic construct
  misc_feature 1..20: note = CRISPR gRNA sequence
  source 1..20: mol_type = other DNA
gcccttggtctagtagtcac

SEQ ID NO: 18838 - DNA, 20 bp, synthetic construct
  misc_feature 1..20: note = CRISPR gRNA sequence
  source 1..20: mol_type = other DNA
tctagtagtcaccagaccct

SEQ ID NO: 18839 - DNA, 20 bp, synthetic construct
  misc_feature 1..20: note = CRISPR gRNA sequence
  source 1..20: mol_type = other DNA
tagtcaccagaccctcagca

SEQ ID NO: 18840 - DNA, 20 bp, synthetic construct
  misc_feature 1..20: note = CRISPR gRNA sequence
  source 1..20: mol_type = other DNA
cctcagcatagattttacaa

SEQ ID NO: 18841 - DNA, 20 bp, synthetic construct
  misc_feature 1..20: note = CRISPR gRNA sequence
  source 1..20: mol_type = other DNA
atagattttacaatagcttc

SEQ ID NO: 18842 - DNA, 20 bp, synthetic construct
  misc_feature 1..20: note = CRISPR gRNA sequence
  source 1..20: mol_type = other DNA
tagattttacaatagcttcc

SEQ ID NO: 18843 - DNA, 20 bp, synthetic construct
  misc_feature 1..20: note = CRISPR gRNA sequence
  source 1..20: mol_type = other DNA
tccaggtctttcctctcatc

SEQ ID NO: 18844 - DNA, 20 bp, synthetic construct
  misc_feature 1..20: note = CRISPR gRNA sequence
  source 1..20: mol_type = other DNA
tcatccggtttcccaaactg

SEQ ID NO: 18845 - DNA, 20 bp, synthetic construct
  misc_feature 1..20: note = CRISPR gRNA sequence
  source 1..20: mol_type = other DNA
catccggtttcccaaactgc

SEQ ID NO: 18846 - DNA, 20 bp, synthetic construct
  misc_feature 1..20: note = CRISPR gRNA sequence
  source 1..20: mol_type = other DNA
tcttccatctttacaatttt

SEQ ID NO: 18847 - DNA, 20 bp, synthetic construct
  misc_feature 1..20: note = CRISPR gRNA sequence
  source 1..20: mol_type = other DNA
cttccatctttacaattttt

SEQ ID NO: 18848 - DNA, 20 bp, synthetic construct
  misc_feature 1..20: note = CRISPR gRNA sequence
  source 1..20: mol_type = other DNA
ttccatctttacaatttttg

SEQ ID NO: 18849 - DNA, 20 bp, synthetic construct
  misc_feature 1..20: note = CRISPR gRNA sequence
  source 1..20: mol_type = other DNA
acctgttctacaatttacct

SEQ ID NO: 18850 - DNA, 20 bp, synthetic construct
  misc_feature 1..20: note = CRISPR gRNA sequence
  source 1..20: mol_type = other DNA
tttcttaaattaacttttta

SEQ ID NO: 18851 - DNA, 20 bp, synthetic construct
  misc_feature 1..20: note = CRISPR gRNA sequence
  source 1..20: mol_type = other DNA
actttttaaagaaacttaaa

SEQ ID NO: 18852 - DNA, 20 bp, synthetic construct
  misc_feature 1..20: note = CRISPR gRNA sequence
  source 1..20: mol_type = other DNA
cttaaatagaccgattttaa

SEQ ID NO: 18853 - DNA, 20 bp, synthetic construct
  misc_feature 1..20: note = CRISPR gRNA sequence
  source 1..20: mol_type = other DNA
aatagaccgattttaaaaga

SEQ ID NO: 18854 - DNA, 20 bp, synthetic construct
  misc_feature 1..20: note = CRISPR gRNA sequence
  source 1..20: mol_type = other DNA
gattttaaaagaaagctttc

SEQ ID NO: 18855 - DNA, 20 bp, synthetic construct
  misc_feature 1..20: note = CRISPR gRNA sequence
  source 1..20: mol_type = other DNA
ttttaaaagaaagctttcta

SEQ ID NO: 18856 - DNA, 20 bp, synthetic construct
  misc_feature 1..20: note = CRISPR gRNA sequence
  source 1..20: mol_type = other DNA
agaaagctttctagagttga

SEQ ID NO: 18857 - DNA, 20 bp, synthetic construct
  misc_feature 1..20: note = CRISPR gRNA sequence
  source 1..20: mol_type = other DNA
aagctttctagagttgaaag

SEQ ID NO: 18858 - DNA, 20 bp, synthetic construct
  misc_feature 1..20: note = CRISPR gRNA sequence
  source 1..20: mol_type = other DNA
agctttctagagttgaaagc

SEQ ID NO: 18859 - DNA, 20 bp, synthetic construct
  misc_feature 1..20: note = CRISPR gRNA sequence
  source 1..20: mol_type = other DNA
gctttctagagttgaaagcg

SEQ ID NO: 18860 - DNA, 20 bp, synthetic construct
  misc_feature 1..20: note = CRISPR gRNA sequence
  source 1..20: mol_type = other DNA
tttctagagttgaaagcggg

SEQ ID NO: 18861 - DNA, 20 bp, synthetic construct
  misc_feature 1..20: note = CRISPR gRNA sequence
  source 1..20: mol_type = other DNA
tagagttgaaagcggggagt

SEQ ID NO: 18862 - DNA, 20 bp, synthetic construct
  misc_feature 1..20: note = CRISPR gRNA sequence
  source 1..20: mol_type = other DNA
gttgaaagcggggagtcaga

SEQ ID NO: 18863 - DNA, 20 bp, synthetic construct
  misc_feature 1..20: note = CRISPR gRNA sequence
  source 1..20: mol_type = other DNA
tatttgtccacccatgtacc

SEQ ID NO: 18864 - DNA, 20 bp, synthetic construct
  misc_feature 1..20: note = CRISPR gRNA sequence
  source 1..20: mol_type = other DNA
tgtccacccatgtacctagc

SEQ ID NO: 18865 - DNA, 20 bp, synthetic construct
  misc_feature 1..20: note = CRISPR gRNA sequence
  source 1..20: mol_type = other DNA
cctagcaagattattcacaa

SEQ ID NO: 18866 - DNA, 20 bp, synthetic construct
  misc_feature 1..20: note = CRISPR gRNA sequence
  source 1..20: mol_type = other DNA
caagattattcacaatagtc

SEQ ID NO: 18867 - DNA, 20 bp, synthetic construct
  misc_feature 1..20: note = CRISPR gRNA sequence
  source 1..20: mol_type = other DNA
agattattcacaatagtcaa

SEQ ID NO: 18868 - DNA, 20 bp, synthetic construct
  misc_feature 1..20: note = CRISPR gRNA sequence
  source 1..20: mol_type = other DNA
gattattcacaatagtcaag

SEQ ID NO: 18869 - DNA, 20 bp, synthetic construct
  misc_feature 1..20: note = CRISPR gRNA sequence
  source 1..20: mol_type = other DNA
tattcacaatagtcaagagg

SEQ ID NO: 18870 - DNA, 20 bp, synthetic construct
  misc_feature 1..20: note = CRISPR gRNA sequence
  source 1..20: mol_type = other DNA
attcacaatagtcaagaggt

SEQ ID NO: 18871 - DNA, 20 bp, synthetic construct
  misc_feature 1..20: note = CRISPR gRNA sequence
  source 1..20: mol_type = other DNA
tcaagaggtaggaacaaccc

SEQ ID NO: 18872 - DNA, 20 bp, synthetic construct
  misc_feature 1..20: note = CRISPR gRNA sequence
  source 1..20: mol_type = other DNA
agtgtctatcaacaaatgaa

SEQ ID NO: 18873 - DNA, 20 bp, synthetic construct
  misc_feature 1..20: note = CRISPR gRNA sequence
  source 1..20: mol_type = other DNA
atgaatggatgaacaaaata

SEQ ID NO: 18874 - DNA, 20 bp, synthetic construct
  misc_feature 1..20: note = CRISPR gRNA sequence
  source 1..20: mol_type = other DNA
tgaatggatgaacaaaatat

SEQ ID NO: 18875 - DNA, 20 bp, synthetic construct
  misc_feature 1..20: note = CRISPR gRNA sequence
  source 1..20: mol_type = other DNA
aatatgggatatccacatat

SEQ ID NO: 18876 - DNA, 20 bp, synthetic construct
  misc_feature 1..20: note = CRISPR gRNA sequence
  source 1..20: mol_type = other DNA
attagaatactattccgcca

SEQ ID NO: 18877 - DNA, 20 bp, synthetic construct
  misc_feature 1..20: note = CRISPR gRNA sequence
  source 1..20: mol_type = other DNA
gaatactattccgccataga

SEQ ID NO: 18878 - DNA, 20 bp, synthetic construct
  misc_feature 1..20: note = CRISPR gRNA sequence
  source 1..20: mol_type = other DNA
aatactattccgccatagaa

SEQ ID NO: 18879 - DNA, 20 bp, synthetic construct
  misc_feature 1..20: note = CRISPR gRNA sequence
  source 1..20: mol_type = other DNA
ccatagaaaggaattacaca

SEQ ID NO: 18880 - DNA, 20 bp, synthetic construct
  misc_feature 1..20: note = CRISPR gRNA sequence
  source 1..20: mol_type = other DNA
gaattacacatggcacgaca

SEQ ID NO: 18881 - DNA, 20 bp, synthetic construct
  misc_feature 1..20: note = CRISPR gRNA sequence
  source 1..20: mol_type = other DNA
tggcacgacatggatgaacc

SEQ ID NO: 18882 - DNA, 20 bp, synthetic construct
  misc_feature 1..20: note = CRISPR gRNA sequence
  source 1..20: mol_type = other DNA
cacgacatggatgaacctgg

SEQ ID NO: 18883 - DNA, 20 bp, synthetic construct
  misc_feature 1..20: note = CRISPR gRNA sequence
  source 1..20: mol_type = other DNA
aacctggaagacattatgct

SEQ ID NO: 18884 - DNA, 20 bp, synthetic construct
  misc_feature 1..20: note = CRISPR gRNA sequence
  source 1..20: mol_type = other DNA
gaagacattatgctaagtga

SEQ ID NO: 18885 - DNA, 20 bp, synthetic construct
  misc_feature 1..20: note = CRISPR gRNA sequence
  source 1..20: mol_type = other DNA
gacattatgctaagtgaaag

SEQ ID NO: 18886 - DNA, 20 bp, synthetic construct
  misc_feature 1..20: note = CRISPR gRNA sequence
  source 1..20: mol_type = other DNA
ttatgctaagtgaaagaagc

SEQ ID NO: 18887 - DNA, 20 bp, synthetic construct
  misc_feature 1..20: note = CRISPR gRNA sequence
  source 1..20: mol_type = other DNA
tatgctaagtgaaagaagcc

SEQ ID NO: 18888 - DNA, 20 bp, synthetic construct
  misc_feature 1..20: note = CRISPR gRNA sequence
  source 1..20: mol_type = other DNA
tgaaagaagccaggcacaaa

SEQ ID NO: 18889 - DNA, 20 bp, synthetic construct
  misc_feature 1..20: note = CRISPR gRNA sequence
  source 1..20: mol_type = other DNA
atatcacgtaattctattta

SEQ ID NO: 18890 - DNA, 20 bp, synthetic construct
  misc_feature 1..20: note = CRISPR gRNA sequence
  source 1..20: mol_type = other DNA
tatcacgtaattctatttat

SEQ ID NO: 18891 - DNA, 20 bp, synthetic construct
  misc_feature 1..20: note = CRISPR gRNA sequence
  source 1..20: mol_type = other DNA
cacgtaattctatttatagg

SEQ ID NO: 18892 - DNA, 20 bp, synthetic construct
  misc_feature 1..20: note = CRISPR gRNA sequence
  source 1..20: mol_type = other DNA
ttctatttataggcggtgtc

SEQ ID NO: 18893 - DNA, 20 bp, synthetic construct
  misc_feature 1..20: note = CRISPR gRNA sequence
  source 1..20: mol_type = other DNA
ctatttataggcggtgtcta

SEQ ID NO: 18894 - DNA, 20 bp, synthetic construct
  misc_feature 1..20: note = CRISPR gRNA sequence
  source 1..20: mol_type = other DNA
tttataggcggtgtctagag

SEQ ID NO: 18895 - DNA, 20 bp, synthetic construct
  misc_feature 1..20: note = CRISPR gRNA sequence
  source 1..20: mol_type = other DNA
gtctagagtagcccaaaaca

SEQ ID NO: 18896 - DNA, 20 bp, synthetic construct
  misc_feature 1..20: note = CRISPR gRNA sequence
  source 1..20: mol_type = other DNA
ctagagtagcccaaaacata

SEQ ID NO: 18897 - DNA, 20 bp, synthetic construct
  misc_feature 1..20: note = CRISPR gRNA sequence
  source 1..20: mol_type = other DNA
agtagcccaaaacatagaga

SEQ ID NO: 18898 - DNA, 20 bp, synthetic construct
  misc_feature 1..20: note = CRISPR gRNA sequence
  source 1..20: mol_type = other DNA
gtagcccaaaacatagagac

SEQ ID NO: 18899 - DNA, 20 bp, synthetic construct
  misc_feature 1..20: note = CRISPR gRNA sequence
  source 1..20: mol_type = other DNA
gcccaaaacatagagacagg

SEQ ID NO: 18900 - DNA, 20 bp, synthetic construct
  misc_feature 1..20: note = CRISPR gRNA sequence
  source 1..20: mol_type = other DNA
aaaacatagagacaggaagt

SEQ ID NO: 18901 - DNA, 20 bp, synthetic construct
  misc_feature 1..20: note = CRISPR gRNA sequence
  source 1..20: mol_type = other DNA
aacatagagacaggaagttg

SEQ ID NO: 18902 - DNA, 20 bp, synthetic construct
  misc_feature 1..20: note = CRISPR gRNA sequence
  source 1..20: mol_type = other DNA
caggaagttggagttaccac

SEQ ID NO: 18903 - DNA, 20 bp, synthetic construct
  misc_feature 1..20: note = CRISPR gRNA sequence
  source 1..20: mol_type = other DNA
aagttggagttaccacgagc

SEQ ID NO: 18904 - DNA, 20 bp, synthetic construct
  misc_feature 1..20: note = CRISPR gRNA sequence
  source 1..20: mol_type = other DNA
agttggagttaccacgagct

SEQ ID NO: 18905 - DNA, 20 bp, synthetic construct
  misc_feature 1..20: note = CRISPR gRNA sequence
  source 1..20: mol_type = other DNA
tggagttaccacgagctggg

SEQ ID NO: 18906 - DNA, 20 bp, synthetic construct
  misc_feature 1..20: note = CRISPR gRNA sequence
  source 1..20: mol_type = other DNA
agttaccacgagctgggtgg

SEQ ID NO: 18907 - DNA, 20 bp, synthetic construct
  misc_feature 1..20: note = CRISPR gRNA sequence
  source 1..20: mol_type = other DNA
gttaccacgagctgggtgga

SEQ ID NO: 18908 - DNA, 20 bp, synthetic construct
  misc_feature 1..20: note = CRISPR gRNA sequence
  source 1..20: mol_type = other DNA
ttaccacgagctgggtggaa

SEQ ID NO: 18909 - DNA, 20 bp, synthetic construct
  misc_feature 1..20: note = CRISPR gRNA sequence
  source 1..20: mol_type = other DNA
taccacgagctgggtggaag

SEQ ID NO: 18910 - DNA, 20 bp, synthetic construct
  misc_feature 1..20: note = CRISPR gRNA sequence
  source 1..20: mol_type = other DNA
cacgagctgggtggaagggg

SEQ ID NO: 18911 - DNA, 20 bp, synthetic construct
  misc_feature 1..20: note = CRISPR gRNA sequence
  source 1..20: mol_type = other DNA
gagctgggtggaaggggcag

SEQ ID NO: 18912 - DNA, 20 bp, synthetic construct
  misc_feature 1..20: note = CRISPR gRNA sequence
  source 1..20: mol_type = other DNA
agctgggtggaaggggcagt

SEQ ID NO: 18913 - DNA, 20 bp, synthetic construct
  misc_feature 1..20: note = CRISPR gRNA sequence
  source 1..20: mol_type = other DNA
gctgggtggaaggggcagtg

SEQ ID NO: 18914 - DNA, 20 bp, synthetic construct
  misc_feature 1..20: note = CRISPR gRNA sequence
  source 1..20: mol_type = other DNA
tgggtggaaggggcagtggg

SEQ ID NO: 18915 - DNA, 20 bp, synthetic construct
  misc_feature 1..20: note = CRISPR gRNA sequence
  source 1..20: mol_type = other DNA
agtggggagttattgcttat

SEQ ID NO: 18916 - DNA, 20 bp, synthetic construct
  misc_feature 1..20: note = CRISPR gRNA sequence
  source 1..20: mol_type = other DNA
gtggggagttattgcttatt

SEQ ID NO: 18917 - DNA, 20 bp, synthetic construct
  misc_feature 1..20: note = CRISPR gRNA sequence
  source 1..20: mol_type = other DNA
gggagttattgcttattggg

SEQ ID NO: 18918 - DNA, 20 bp, synthetic construct
  misc_feature 1..20: note = CRISPR gRNA sequence
  source 1..20: mol_type = other DNA
gagttattgcttattgggta

SEQ ID NO: 18919 - DNA, 20 bp, synthetic construct
  misc_feature 1..20: note = CRISPR gRNA sequence
  source 1..20: mol_type = other DNA
ttgcttattgggtagagttt

SEQ ID NO: 18920 - DNA, 20 bp, synthetic construct
  misc_feature 1..20: note = CRISPR gRNA sequence
  source 1..20: mol_type = other DNA
tattgggtagagtttcagtt

SEQ ID NO: 18921 - DNA, 20 bp, synthetic construct
  misc_feature 1..20: note = CRISPR gRNA sequence
  source 1..20: mol_type = other DNA
attgggtagagtttcagttt

SEQ ID NO: 18922 - DNA, 20 bp, synthetic construct
  misc_feature 1..20: note = CRISPR gRNA sequence
  source 1..20: mol_type = other DNA
tgggtagagtttcagtttgg

SEQ ID NO: 18923 - DNA, 20 bp, synthetic construct
  misc_feature 1..20: note = CRISPR gRNA sequence
  source 1..20: mol_type = other DNA
gggtagagtttcagtttggg

SEQ ID NO: 18924 - DNA, 20 bp, synthetic construct
  misc_feature 1..20: note = CRISPR gRNA sequence
  source 1..20: mol_type = other DNA
ttcagtttgggaggatgaaa

SEQ ID NO: 18925 - DNA, 20 bp, synthetic construct
  misc_feature 1..20: note = CRISPR gRNA sequence
  source 1..20: mol_type = other DNA
ttgggaggatgaaaaagttc

SEQ ID NO: 18926 - DNA, 20 bp, synthetic construct
  misc_feature 1..20: note = CRISPR gRNA sequence
  source 1..20: mol_type = other DNA
gggaggatgaaaaagttctg

SEQ ID NO: 18927 - DNA, 20 bp, synthetic construct
  misc_feature 1..20: note = CRISPR gRNA sequence
  source 1..20: mol_type = other DNA
ggatgaaaaagttctggaga

SEQ ID NO: 18928 - DNA, 20 bp, synthetic construct
  misc_feature 1..20: note = CRISPR gRNA sequence
  source 1..20: mol_type = other DNA
gaaaaagttctggagatgga

SEQ ID NO: 18929 - DNA, 20 bp, synthetic construct
  misc_feature 1..20: note = CRISPR gRNA sequence
  source 1..20: mol_type = other DNA
aaagttctggagatggatgg

SEQ ID NO: 18930 - DNA, 20 bp, synthetic construct
  misc_feature 1..20: note = CRISPR gRNA sequence
  source 1..20: mol_type = other DNA
gttctggagatggatggtag

SEQ ID NO: 18931 - DNA, 20 bp, synthetic construct
  misc_feature 1..20: note = CRISPR gRNA sequence
  source 1..20: mol_type = other DNA
tctggagatggatggtagcg

SEQ ID NO: 18932 - DNA, 20 bp, synthetic construct
  misc_feature 1..20: note = CRISPR gRNA sequence
  source 1..20: mol_type = other DNA
ctggagatggatggtagcgg

SEQ ID NO: 18933 - DNA, 20 bp, synthetic construct
  misc_feature 1..20: note = CRISPR gRNA sequence
  source 1..20: mol_type = other DNA
tggtagcggaggttgcacaa

SEQ ID NO: 18934 - DNA, 20 bp, synthetic construct
  misc_feature 1..20: note = CRISPR gRNA sequence
  source 1..20: mol_type = other DNA
ccactgaaatgtacatttga

SEQ ID NO: 18935 - DNA, 20 bp, synthetic construct
  misc_feature 1..20: note = CRISPR gRNA sequence
  source 1..20: mol_type = other DNA
ctgaaatgtacatttgaaag

SEQ ID NO: 18936 - DNA, 20 bp, synthetic construct
  misc_feature 1..20: note = CRISPR gRNA sequence
  source 1..20: mol_type = other DNA
acatttgaaagtggttaaaa

SEQ ID NO: 18937 - DNA, 20 bp, synthetic construct
  misc_feature 1..20: note = CRISPR gRNA sequence
  source 1..20: mol_type = other DNA
ttttaccatgattttacaaa

SEQ ID NO: 18938 - DNA, 20 bp, synthetic construct
  misc_feature 1..20: note = CRISPR gRNA sequence
  source 1..20: mol_type = other DNA
cttttttttccatgtataaa

SEQ ID NO: 18939 - DNA, 20 bp, synthetic construct
  misc_feature 1..20: note = CRISPR gRNA sequence
  source 1..20: mol_type = other DNA
ttttccatgtataaacggaa

SEQ ID NO: 18940 - DNA, 20 bp, synthetic construct
  misc_feature 1..20: note = CRISPR gRNA sequence
  source 1..20: mol_type = other DNA
gaaaagcaaaaccaaaccaa

SEQ ID NO: 18941 - DNA, 20 bp, synthetic construct
  misc_feature 1..20: note = CRISPR gRNA sequence
  source 1..20: mol_type = other DNA
caaaccaacagtatcacttg

SEQ ID NO: 18942 - DNA, 20 bp, synthetic construct
  misc_feature 1..20: note = CRISPR gRNA sequence
  source 1..20: mol_type = other DNA
agtatcacttgtggttgaaa

SEQ ID NO: 18943 - DNA, 20 bp, synthetic construct
  misc_feature 1..20: note = CRISPR gRNA sequence
  source 1..20: mol_type = other DNA
caatgttactaaaataatct

SEQ ID NO: 18944 - DNA, 20 bp, synthetic construct
  misc_feature 1..20: note = CRISPR gRNA sequence
  source 1..20: mol_type = other DNA
ttctttaccactttgttaaa

SEQ ID NO: 18945 - DNA, 20 bp, synthetic construct
  misc_feature 1..20: note = CRISPR gRNA sequence
  source 1..20: mol_type = other DNA
actttgttaaaaagaaatct

SEQ ID NO: 18946 - DNA, 20 bp, synthetic construct
  misc_feature 1..20: note = CRISPR gRNA sequence
  source 1..20: mol_type = other DNA
tgttaaaaagaaatcttagc

SEQ ID NO: 18947 - DNA, 20 bp, synthetic construct
  misc_feature 1..20: note = CRISPR gRNA sequence
  source 1..20: mol_type = other DNA
aaagaaatcttagcaagcat

SEQ ID NO: 18948 - DNA, 20 bp, synthetic construct
  misc_feature 1..20: note = CRISPR gRNA sequence
  source 1..20: mol_type = other DNA
aagaaatcttagcaagcatt

SEQ ID NO: 18949 - DNA, 20 bp, synthetic construct
  misc_feature 1..20: note = CRISPR gRNA sequence
  source 1..20: mol_type = other DNA
agaaatcttagcaagcatta

SEQ ID NO: 18950 - DNA, 20 bp, synthetic construct
  misc_feature 1..20: note = CRISPR gRNA sequence
  source 1..20: mol_type = other DNA
attagggcactgtcaaacat

SEQ ID NO: 18951 - DNA, 20 bp, synthetic construct
  misc_feature 1..20: note = CRISPR gRNA sequence
  source 1..20: mol_type = other DNA
ttagggcactgtcaaacatc

SEQ ID NO: 18952 - DNA, 20 bp, synthetic construct
  misc_feature 1..20: note = CRISPR gRNA sequence
  source 1..20: mol_type = other DNA
tagggcactgtcaaacatca

SEQ ID NO: 18953 - DNA, 20 bp, synthetic construct
  misc_feature 1..20: note = CRISPR gRNA sequence
  source 1..20: mol_type = other DNA
tgtcaaacatcagggaaaat

SEQ ID NO: 18954 - DNA, 20 bp, synthetic construct
  misc_feature 1..20: note = CRISPR gRNA sequence
  source 1..20: mol_type = other DNA
tcaaacatcagggaaaatca

SEQ ID NO: 18955 - DNA, 20 bp, synthetic construct
  misc_feature 1..20: note = CRISPR gRNA sequence
  source 1..20: mol_type = other DNA
agagactttgtccttgatgt

SEQ ID NO: 18956 - DNA, 20 bp, synthetic construct
  misc_feature 1..20: note = CRISPR gRNA sequence
  source 1..20: mol_type = other DNA
gactttgtccttgatgtcag

SEQ ID NO: 18957 - DNA, 20 bp, synthetic construct
  misc_feature 1..20: note = CRISPR gRNA sequence
  source 1..20: mol_type = other DNA
actttgtccttgatgtcaga

SEQ ID NO: 18958 - DNA, 20 bp, synthetic construct
  misc_feature 1..20: note = CRISPR gRNA sequence
  source 1..20: mol_type = other DNA
ccttgatgtcagaaggattg

SEQ ID NO: 18959 - DNA, 20 bp, synthetic construct
  misc_feature 1..20: note = CRISPR gRNA sequence
  source 1..20: mol_type = other DNA
cttgatgtcagaaggattga

SEQ ID NO: 18960 - DNA, 20 bp, synthetic construct
  misc_feature 1..20: note = CRISPR gRNA sequence
  source 1..20: mol_type = other DNA
actatctatgtccttcctat

SEQ ID NO: 18961 - DNA, 20 bp, synthetic construct
  misc_feature 1..20: note = CRISPR gRNA sequence
  source 1..20: mol_type = other DNA
tatgtccttcctatgagaat

SEQ ID NO: 18962 - DNA, 20 bp, synthetic construct
  misc_feature 1..20: note = CRISPR gRNA sequence
  source 1..20: mol_type = other DNA
gtccttcctatgagaatcgg

SEQ ID NO: 18963 - DNA, 20 bp, synthetic construct
  misc_feature 1..20: note = CRISPR gRNA sequence
  source 1..20: mol_type = other DNA
tcttttgactgtgtgtgtct

SEQ ID NO: 18964 - DNA, 20 bp, synthetic construct
  misc_feature 1..20: note = CRISPR gRNA sequence
  source 1..20: mol_type = other DNA
actgtgtgtgtcttggtctt

SEQ ID NO: 18965 - DNA, 20 bp, synthetic construct
  misc_feature 1..20: note = CRISPR gRNA sequence
  source 1..20: mol_type = other DNA
ctctctcttttttttttcct

SEQ ID NO: 18966 - DNA, 20 bp, synthetic construct
  misc_feature 1..20: note = CRISPR gRNA sequence
  source 1..20: mol_type = other DNA
ctcttttttttttcctgaga

SEQ ID NO: 18967 - DNA, 20 bp, synthetic construct
  misc_feature 1..20: note = CRISPR gRNA sequence
  source 1..20: mol_type = other DNA
gacagtcttgctctgttgcc

SEQ ID NO: 18968 - DNA, 20 bp, synthetic construct
  misc_feature 1..20: note = CRISPR gRNA sequence
  source 1..20: mol_type = other DNA
acagtcttgctctgttgccc

SEQ ID NO: 18969 - DNA, 20 bp, synthetic construct
  misc_feature 1..20: note = CRISPR gRNA sequence
  source 1..20: mol_type = other DNA
tcttgctctgttgcccaggc

SEQ ID NO: 18970 - DNA, 20 bp, synthetic construct
  misc_feature 1..20: note = CRISPR gRNA sequence
  source 1..20: mol_type = other DNA
ctgttgcccaggctggcgtg

SEQ ID NO: 18971 - DNA, 20 bp, synthetic construct
  misc_feature 1..20: note = CRISPR gRNA sequence
  source 1..20: mol_type = other DNA
ttgcccaggctggcgtgcag

SEQ ID NO: 18972 - DNA, 20 bp, synthetic construct
  misc_feature 1..20: note = CRISPR gRNA sequence
  source 1..20: mol_type = other DNA
ggcgtgcagtggtgcaatct

SEQ ID NO: 18973 - DNA, 20 bp, synthetic construct
  misc_feature 1..20: note = CRISPR gRNA sequence
  source 1..20: mol_type = other DNA
agtggtgcaatctcagctct

SEQ ID NO: 18974 - DNA, 20 bp, synthetic construct
  misc_feature 1..20: note = CRISPR gRNA sequence
  source 1..20: mol_type = other DNA
gtggtgcaatctcagctctc

SEQ ID NO: 18975 - DNA, 20 bp, synthetic construct
  misc_feature 1..20: note = CRISPR gRNA sequence
  source 1..20: mol_type = other DNA
ctcgggtaacctccacctct

SEQ ID NO: 18976 - DNA, 20 bp, synthetic construct
  misc_feature 1..20: note = CRISPR gRNA sequence
  source 1..20: mol_type = other DNA
tcgggtaacctccacctctc

SEQ ID NO: 18977 - DNA, 20 bp, synthetic construct
  misc_feature 1..20: note = CRISPR gRNA sequence
  source 1..20: mol_type = other DNA
ctcgggtaaactccgcctct

SEQ ID NO: 18978 - DNA, 20 bp, synthetic construct
  misc_feature 1..20: note = CRISPR gRNA sequence
  source 1..20: mol_type = other DNA
tcgggtaaactccgcctctt

SEQ ID NO: 18979 - DNA, 20 bp, synthetic construct
  misc_feature 1..20: note = CRISPR gRNA sequence
  source 1..20: mol_type = other DNA
aaactccgcctcttgggttc

SEQ ID NO: 18980 - DNA, 20 bp, synthetic construct
  misc_feature 1..20: note = CRISPR gRNA sequence
  source 1..20: mol_type = other DNA
ttcaagtgattctcgtgcct

SEQ ID NO: 18981 - DNA, 20 bp, synthetic construct
  misc_feature 1..20: note = CRISPR gRNA sequence
  source 1..20: mol_type = other DNA
ttctcgtgcctcagcctccc

SEQ ID NO: 18982 - DNA, 20 bp, synthetic construct
  misc_feature 1..20: note = CRISPR gRNA sequence
  source 1..20: mol_type = other DNA
tcgtgcctcagcctcccaag

SEQ ID NO: 18983 - DNA, 20 bp, synthetic construct
  misc_feature 1..20: note = CRISPR gRNA sequence
  source 1..20: mol_type = other DNA
cctcagcctcccaagtagtt

SEQ ID NO: 18984 - DNA, 20 bp, synthetic construct
  misc_feature 1..20: note = CRISPR gRNA sequence
  source 1..20: mol_type = other DNA
ctcccaagtagttgagatta

SEQ ID NO: 18985 - DNA, 20 bp, synthetic construct
  misc_feature 1..20: note = CRISPR gRNA sequence
  source 1..20: mol_type = other DNA
tcccaagtagttgagattac

SEQ ID NO: 18986 - DNA, 20 bp, synthetic construct
  misc_feature 1..20: note = CRISPR gRNA sequence
  source 1..20: mol_type = other DNA
caggtgtgcaccaccatgcc

SEQ ID NO: 18987 - DNA, 20 bp, synthetic construct
  misc_feature 1..20: note = CRISPR gRNA sequence
  source 1..20: mol_type = other DNA
tgcccggctaaaacacaaaa

SEQ ID NO: 18988 - DNA, 20 bp, synthetic construct
  misc_feature 1..20: note = CRISPR gRNA sequence
  source 1..20: mol_type = other DNA
taaaacacaaaaaagtgttt

SEQ ID NO: 18989 - DNA, 20 bp, synthetic construct
  misc_feature 1..20: note = CRISPR gRNA sequence
  source 1..20: mol_type = other DNA
aacacaaaaaagtgttttag

SEQ ID NO: 18990 - DNA, 20 bp, synthetic construct
  misc_feature 1..20: note = CRISPR gRNA sequence
  source 1..20: mol_type = other DNA
cacaaaaaagtgttttagta

SEQ ID NO: 18991 - DNA, 20 bp, synthetic construct
  misc_feature 1..20: note = CRISPR gRNA sequence
  source 1..20: mol_type = other DNA
aaaaagtgttttagtagagt

SEQ ID NO: 18992 - DNA, 20 bp, synthetic construct
  misc_feature 1..20: note = CRISPR gRNA sequence
  source 1..20: mol_type = other DNA
aaaagtgttttagtagagtt

SEQ ID NO: 18993 - DNA, 20 bp, synthetic construct
  misc_feature 1..20: note = CRISPR gRNA sequence
  source 1..20: mol_type = other DNA
aaagtgttttagtagagttg

SEQ ID NO: 18994 - DNA, 20 bp, synthetic construct
  misc_feature 1..20: note = CRISPR gRNA sequence
  source 1..20: mol_type = other DNA
tagtagagttggggtttctc

SEQ ID NO: 18995 - DNA, 20 bp, synthetic construct
  misc_feature 1..20: note = CRISPR gRNA sequence
  source 1..20: mol_type = other DNA
agtagagttggggtttctcc

SEQ ID NO: 18996 - DNA, 20 bp, synthetic construct
  misc_feature 1..20: note = CRISPR gRNA sequence
  source 1..20: mol_type = other DNA
tggggtttctccaggttgcc

SEQ ID NO: 18997 - DNA, 20 bp, synthetic construct
  misc_feature 1..20: note = CRISPR gRNA sequence
  source 1..20: mol_type = other DNA
ggggtttctccaggttgccc

SEQ ID NO: 18998 - DNA, 20 bp, synthetic construct
  misc_feature 1..20: note = CRISPR gRNA sequence
  source 1..20: mol_type = other DNA
tttctccaggttgcccaggc

SEQ ID NO: 18999 - DNA, 20 bp, synthetic construct
  misc_feature 1..20: note = CRISPR gRNA sequence
  source 1..20: mol_type = other DNA
ccaggctggtcttgaactcc

SEQ ID NO: 19000 - DNA, 20 bp, synthetic construct
  misc_feature 1..20: note = CRISPR gRNA sequence
  source 1..20: mol_type = other DNA
ggtcttgaactcctggcctc

SEQ ID NO: 19001 - DNA, 20 bp, synthetic construct
  misc_feature 1..20: note = CRISPR gRNA sequence
  source 1..20: mol_type = other DNA
ctcaagcaatccacccgcct

SEQ ID NO: 19002 - DNA, 20 bp, synthetic construct
  misc_feature 1..20: note = CRISPR gRNA sequence
  source 1..20: mol_type = other DNA
ccacccgcctcggcctccca

SEQ ID NO: 19003 - DNA, 20 bp, synthetic construct
  misc_feature 1..20: note = CRISPR gRNA sequence
  source 1..20: mol_type = other DNA
gcctcggcctcccaaagtgc

SEQ ID NO: 19004 - DNA, 20 bp, synthetic construct
  misc_feature 1..20: note = CRISPR gRNA sequence
  source 1..20: mol_type = other DNA
cctcggcctcccaaagtgct

SEQ ID NO: 19005 - DNA, 20 bp, synthetic construct
  misc_feature 1..20: note = CRISPR gRNA sequence
  source 1..20: mol_type = other DNA
ctcccaaagtgctaggatta

SEQ ID NO: 19006 - DNA, 20 bp, synthetic construct
  misc_feature 1..20: note = CRISPR gRNA sequence
  source 1..20: mol_type = other DNA
tcccaaagtgctaggattac

SEQ ID NO: 19007 - DNA, 20 bp, synthetic construct
  misc_feature 1..20: note = CRISPR gRNA sequence
  source 1..20: mol_type = other DNA
caggtgtgaaccactgctcc

SEQ ID NO: 19008 - DNA, 20 bp, synthetic construct
  misc_feature 1..20: note = CRISPR gRNA sequence
  source 1..20: mol_type = other DNA
atctttctaaacaatccctt

SEQ ID NO: 19009 - DNA, 20 bp, synthetic construct
  misc_feature 1..20: note = CRISPR gRNA sequence
  source 1..20: mol_type = other DNA
tctttctaaacaatcccttt

SEQ ID NO: 19010 - DNA, 20 bp, synthetic construct
  misc_feature 1..20: note = CRISPR gRNA sequence
  source 1..20: mol_type = other DNA
cccaatgcatgaatattctt

SEQ ID NO: 19011 - DNA, 20 bp, synthetic construct
  misc_feature 1..20: note = CRISPR gRNA sequence
  source 1..20: mol_type = other DNA
aatgcatgaatattctttgg

SEQ ID NO: 19012 - DNA, 20 bp, synthetic construct
  misc_feature 1..20: note = CRISPR gRNA sequence
  source 1..20: mol_type = other DNA
tattctttggtggttttcta

SEQ ID NO: 19013 - DNA, 20 bp, synthetic construct
  misc_feature 1..20: note = CRISPR gRNA sequence
  source 1..20: mol_type = other DNA
agtgctttttctgtacacat

SEQ ID NO: 19014 - DNA, 20 bp, synthetic construct
  misc_feature 1..20: note = CRISPR gRNA sequence
  source 1..20: mol_type = other DNA
tgtacacatcagacatcatc

SEQ ID NO: 19015 - DNA, 20 bp, synthetic construct
  misc_feature 1..20: note = CRISPR gRNA sequence
  source 1..20: mol_type = other DNA
cacatcagacatcatcaagc

SEQ ID NO: 19016 - DNA, 20 bp, synthetic construct
  misc_feature 1..20: note = CRISPR gRNA sequence
  source 1..20: mol_type = other DNA
ctcatgttttatccatttta

SEQ ID NO: 19017 - DNA, 20 bp, synthetic construct
  misc_feature 1..20: note = CRISPR gRNA sequence
  source 1..20: mol_type = other DNA
tccattttacagatgaacct

SEQ ID NO: 19018 - DNA, 20 bp, synthetic construct
  misc_feature 1..20: note = CRISPR gRNA sequence
  source 1..20: mol_type = other DNA
cattttacagatgaacctca

SEQ ID NO: 19019 - DNA, 20 bp, synthetic construct
  misc_feature 1..20: note = CRISPR gRNA sequence
  source 1..20: mol_type = other DNA
ttttacagatgaacctcaga

SEQ ID NO: 19020 - DNA, 20 bp, synthetic construct
  misc_feature 1..20: note = CRISPR gRNA sequence
  source 1..20: mol_type = other DNA
tttacagatgaacctcagag

SEQ ID NO: 19021 - DNA, 20 bp, synthetic construct
  misc_feature 1..20: note = CRISPR gRNA sequence
  source 1..20: mol_type = other DNA
ttacagatgaacctcagaga

SEQ ID NO: 19022 - DNA, 20 bp, synthetic construct
  misc_feature 1..20: note = CRISPR gRNA sequence
  source 1..20: mol_type = other DNA
tacagatgaacctcagagag

SEQ ID NO: 19023 - DNA, 20 bp, synthetic construct
  misc_feature 1..20: note = CRISPR gRNA sequence
  source 1..20: mol_type = other DNA
agatgaacctcagagagggg

SEQ ID NO: 19024 - DNA, 20 bp, synthetic construct
  misc_feature 1..20: note = CRISPR gRNA sequence
  source 1..20: mol_type = other DNA
agagaggggaagtcacttgt

SEQ ID NO: 19025 - DNA, 20 bp, synthetic construct
  misc_feature 1..20: note = CRISPR gRNA sequence
  source 1..20: mol_type = other DNA
gtcacttgtcagtgtgactc

SEQ ID NO: 19026 - DNA, 20 bp, synthetic construct
  misc_feature 1..20: note = CRISPR gRNA sequence
  source 1..20: mol_type = other DNA
tcacttgtcagtgtgactca

SEQ ID NO: 19027 - DNA, 20 bp, synthetic construct
  misc_feature 1..20: note = CRISPR gRNA sequence
  source 1..20: mol_type = other DNA
gtgtgactcaaggcaaatct

SEQ ID NO: 19028 - DNA, 20 bp, synthetic construct
  misc_feature 1..20: note = CRISPR gRNA sequence
  source 1..20: mol_type = other DNA
tgtgactcaaggcaaatctg

SEQ ID NO: 19029 - DNA, 20 bp, synthetic construct
  misc_feature 1..20: note = CRISPR gRNA sequence
  source 1..20: mol_type = other DNA
ctcaaggcaaatctgaggct

SEQ ID NO: 19030 - DNA, 20 bp, synthetic construct
  misc_feature 1..20: note = CRISPR gRNA sequence
  source 1..20: mol_type = other DNA
ggcaaatctgaggctaagtc

SEQ ID NO: 19031 - DNA, 20 bp, synthetic construct
  misc_feature 1..20: note = CRISPR gRNA sequence
  source 1..20: mol_type = other DNA
aaatctgaggctaagtccag

SEQ ID NO: 19032 - DNA, 20 bp, synthetic construct
  misc_feature 1..20: note = CRISPR gRNA sequence
  source 1..20: mol_type = other DNA
agaagtttcctacctccctc

SEQ ID NO: 19033 - DNA, 20 bp, synthetic construct
  misc_feature 1..20: note = CRISPR gRNA sequence
  source 1..20: mol_type = other DNA
cagccacttccctgattgcc

SEQ ID NO: 19034 - DNA, 20 bp, synthetic construct
  misc_feature 1..20: note = CRISPR gRNA sequence
  source 1..20: mol_type = other DNA
ctgattgcctggaactaatc

SEQ ID NO: 19035 - DNA, 20 bp, synthetic construct
  misc_feature 1..20: note = CRISPR gRNA sequence
  source 1..20: mol_type = other DNA
gattgcctggaactaatcca

SEQ ID NO: 19036 - DNA, 20 bp, synthetic construct
  misc_feature 1..20: note = CRISPR gRNA sequence
  source 1..20: mol_type = other DNA
gaactaatccagagtttcct

SEQ ID NO: 19037 - DNA, 20 bp, synthetic construct
  misc_feature 1..20: note = CRISPR gRNA sequence
  source 1..20: mol_type = other DNA
aactaatccagagtttcctt

SEQ ID NO: 19038 - DNA, 20 bp, synthetic construct
  misc_feature 1..20: note = CRISPR gRNA sequence
  source 1..20: mol_type = other DNA
tttctgattctgctcttctc

SEQ ID NO: 19039 - DNA, 20 bp, synthetic construct
  misc_feature 1..20: note = CRISPR gRNA sequence
  source 1..20: mol_type = other DNA
ttctgattctgctcttctca

SEQ ID NO: 19040 - DNA, 20 bp, synthetic construct
  misc_feature 1..20: note = CRISPR gRNA sequence
  source 1..20: mol_type = other DNA
ctgctcttctcaaggtatct

SEQ ID NO: 19041 - DNA, 20 bp, synthetic construct
  misc_feature 1..20: note = CRISPR gRNA sequence
  source 1..20: mol_type = other DNA
tgctcttctcaaggtatctg

SEQ ID NO: 19042 - DNA, 20 bp, synthetic construct
  misc_feature 1..20: note = CRISPR gRNA sequence
  source 1..20: mol_type = other DNA
cttctcaaggtatctgaggc

SEQ ID NO: 19043 - DNA, 20 bp, synthetic construct
  misc_feature 1..20: note = CRISPR gRNA sequence
  source 1..20: mol_type = other DNA
ttctcaaggtatctgaggct

SEQ ID NO: 19044 - DNA, 20 bp, synthetic construct
  misc_feature 1..20: note = CRISPR gRNA sequence
  source 1..20: mol_type = other DNA
aggtatctgaggctgggtct

SEQ ID NO: 19045 - DNA, 20 bp, synthetic construct
  misc_feature 1..20: note = CRISPR gRNA sequence
  source 1..20: mol_type = other DNA
ggtatctgaggctgggtctt

SEQ ID NO: 19046 - DNA, 20 bp, synthetic construct
  misc_feature 1..20: note = CRISPR gRNA sequence
  source 1..20: mol_type = other DNA
gggtcttaggacatgaaacc

SEQ ID NO: 19047 - DNA, 20 bp, synthetic construct
  misc_feature 1..20: note = CRISPR gRNA sequence
  source 1..20: mol_type = other DNA
taggacatgaaaccaagccc

SEQ ID NO: 19048 - DNA, 20 bp, synthetic construct
  misc_feature 1..20: note = CRISPR gRNA sequence
  source 1..20: mol_type = other DNA
tgaaaccaagccccagccat

SEQ ID NO: 19049 - DNA, 20 bp, synthetic construct
  misc_feature 1..20: note = CRISPR gRNA sequence
  source 1..20: mol_type = other DNA
accaagccccagccatcaga

SEQ ID NO: 19050 - DNA, 20 bp, synthetic construct
  misc_feature 1..20: note = CRISPR gRNA sequence
  source 1..20: mol_type = other DNA
gccccagccatcagacagac

SEQ ID NO: 19051 - DNA, 20 bp, synthetic construct
  misc_feature 1..20: note = CRISPR gRNA sequence
  source 1..20: mol_type = other DNA
ccccagccatcagacagact

SEQ ID NO: 19052 - DNA, 20 bp, synthetic construct
  misc_feature 1..20: note = CRISPR gRNA sequence
  source 1..20: mol_type = other DNA
tcagacagactgggtatcaa

SEQ ID NO: 19053 - DNA, 20 bp, synthetic construct
  misc_feature 1..20: note = CRISPR gRNA sequence
  source 1..20: mol_type = other DNA
cagacagactgggtatcaac

SEQ ID NO: 19054 - DNA, 20 bp, synthetic construct
  misc_feature 1..20: note = CRISPR gRNA sequence
  source 1..20: mol_type = other DNA
caggtttctctctgactgcc

SEQ ID NO: 19055 - DNA, 20 bp, synthetic construct
  misc_feature 1..20: note = CRISPR gRNA sequence
  source 1..20: mol_type = other DNA
aggtttctctctgactgcct

SEQ ID NO: 19056 - DNA, 20 bp, synthetic construct
  misc_feature 1..20: note = CRISPR gRNA sequence
  source 1..20: mol_type = other DNA
tgggacctgccctgcatttg

SEQ ID NO: 19057 - DNA, 20 bp, synthetic construct
  misc_feature 1..20: note = CRISPR gRNA sequence
  source 1..20: mol_type = other DNA
ggacctgccctgcatttgtg

SEQ ID NO: 19058 - DNA, 20 bp, synthetic construct
  misc_feature 1..20: note = CRISPR gRNA sequence
  source 1..20: mol_type = other DNA
gacctgccctgcatttgtgg

SEQ ID NO: 19059 - DNA, 20 bp, synthetic construct
  misc_feature 1..20: note = CRISPR gRNA sequence
  source 1..20: mol_type = other DNA
ttcacatctgcttgctgcac

SEQ ID NO: 19060 - DNA, 20 bp, synthetic construct
  misc_feature 1..20: note = CRISPR gRNA sequence
  source 1..20: mol_type = other DNA
tcacatctgcttgctgcact

SEQ ID NO: 19061 - DNA, 20 bp, synthetic construct
  misc_feature 1..20: note = CRISPR gRNA sequence
  source 1..20: mol_type = other DNA
atctgcttgctgcactgggc

SEQ ID NO: 19062 - DNA, 20 bp, synthetic construct
  misc_feature 1..20: note = CRISPR gRNA sequence
  source 1..20: mol_type = other DNA
tctgcttgctgcactgggct

SEQ ID NO: 19063 - DNA, 20 bp, synthetic construct
  misc_feature 1..20: note = CRISPR gRNA sequence
  source 1..20: mol_type = other DNA
gctgcactgggctgggctct

SEQ ID NO: 19064 - DNA, 20 bp, synthetic construct
  misc_feature 1..20: note = CRISPR gRNA sequence
  source 1..20: mol_type = other DNA
gcactgggctgggctctcag

SEQ ID NO: 19065 - DNA, 20 bp, synthetic construct
  misc_feature 1..20: note = CRISPR gRNA sequence
  source 1..20: mol_type = other DNA
gggctgggctctcagtagac

SEQ ID NO: 19066 - DNA, 20 bp, synthetic construct
  misc_feature 1..20: note = CRISPR gRNA sequence
  source 1..20: mol_type = other DNA
ggctgggctctcagtagacc

SEQ ID NO: 19067 - DNA, 20 bp, synthetic construct
  misc_feature 1..20: note = CRISPR gRNA sequence
  source 1..20: mol_type = other DNA
gctgggctctcagtagacca

SEQ ID NO: 19068 - DNA, 20 bp, synthetic construct
  misc_feature 1..20: note = CRISPR gRNA sequence
  source 1..20: mol_type = other DNA
tctgcaaactgcttgctatg

SEQ ID NO: 19069 - DNA, 20 bp, synthetic construct
  misc_feature 1..20: note = CRISPR gRNA sequence
  source 1..20: mol_type = other DNA
actgcttgctatgtggcgtt

SEQ ID NO: 19070 - DNA, 20 bp, synthetic construct
  misc_feature 1..20: note = CRISPR gRNA sequence
  source 1..20: mol_type = other DNA
aaacaaaacaaaacacctcc

SEQ ID NO: 19071 - DNA, 20 bp, synthetic construct
  misc_feature 1..20: note = CRISPR gRNA sequence
  source 1..20: mol_type = other DNA
tcctggtactccttttctga

SEQ ID NO: 19072 - DNA, 20 bp, synthetic construct
  misc_feature 1..20: note = CRISPR gRNA sequence
  source 1..20: mol_type = other DNA
ctggtactccttttctgata

SEQ ID NO: 19073 - DNA, 20 bp, synthetic construct
  misc_feature 1..20: note = CRISPR gRNA sequence
  source 1..20: mol_type = other DNA
tggtactccttttctgatag

SEQ ID NO: 19074 - DNA, 20 bp, synthetic construct
  misc_feature 1..20: note = CRISPR gRNA sequence
  source 1..20: mol_type = other DNA
ttctgatagaggttttgtaa

SEQ ID NO: 19075 - DNA, 20 bp, synthetic construct
  misc_feature 1..20: note = CRISPR gRNA sequence
  source 1..20: mol_type = other DNA
tctgatagaggttttgtaac

SEQ ID NO: 19076 - DNA, 20 bp, synthetic construct
  misc_feature 1..20: note = CRISPR gRNA sequence
  source 1..20: mol_type = other DNA
ctgatagaggttttgtaaca

SEQ ID NO: 19077 - DNA, 20 bp, synthetic construct
  misc_feature 1..20: note = CRISPR gRNA sequence
  source 1..20: mol_type = other DNA
gatagaggttttgtaacagg

SEQ ID NO: 19078 - DNA, 20 bp, synthetic construct
  misc_feature 1..20: note = CRISPR gRNA sequence
  source 1..20: mol_type = other DNA
tagaggttttgtaacaggga

SEQ ID NO: 19079 - DNA, 20 bp, synthetic construct
  misc_feature 1..20: note = CRISPR gRNA sequence
  source 1..20: mol_type = other DNA
gaggttttgtaacagggaga

SEQ ID NO: 19080 - DNA, 20 bp, synthetic construct
  misc_feature 1..20: note = CRISPR gRNA sequence
  source 1..20: mol_type = other DNA
tttgtaacagggagagagta

SEQ ID NO: 19081 - DNA, 20 bp, synthetic construct
  misc_feature 1..20: note = CRISPR gRNA sequence
  source 1..20: mol_type = other DNA
tgtaacagggagagagtaaa

SEQ ID NO: 19082 - DNA, 20 bp, synthetic construct
  misc_feature 1..20: note = CRISPR gRNA sequence
  source 1..20: mol_type = other DNA
cagggagagagtaaagagat

SEQ ID NO: 19083 - DNA, 20 bp, synthetic construct
  misc_feature 1..20: note = CRISPR gRNA sequence
  source 1..20: mol_type = other DNA
gtaaagagatgagaccacat

SEQ ID NO: 19084 - DNA, 20 bp, synthetic construct
  misc_feature 1..20: note = CRISPR gRNA sequence
  source 1..20: mol_type = other DNA
gagaccacatcagcgcctcc

SEQ ID NO: 19085 - DNA, 20 bp, synthetic construct
  misc_feature 1..20: note = CRISPR gRNA sequence
  source 1..20: mol_type = other DNA
cctcccagtgtctctgactt

SEQ ID NO: 19086 - DNA, 20 bp, synthetic construct
  misc_feature 1..20: note = CRISPR gRNA sequence
  source 1..20: mol_type = other DNA
ctcccagtgtctctgacttg

SEQ ID NO: 19087 - DNA, 20 bp, synthetic construct
  misc_feature 1..20: note = CRISPR gRNA sequence
  source 1..20: mol_type = other DNA
tcccagtgtctctgacttga

SEQ ID NO: 19088 - DNA, 20 bp, synthetic construct
  misc_feature 1..20: note = CRISPR gRNA sequence
  source 1..20: mol_type = other DNA
tttgccccacaaacgaacat

SEQ ID NO: 19089 - DNA, 20 bp, synthetic construct
  misc_feature 1..20: note = CRISPR gRNA sequence
  source 1..20: mol_type = other DNA
tgccccacaaacgaacattg

SEQ ID NO: 19090 - DNA, 20 bp, synthetic construct
  misc_feature 1..20: note = CRISPR gRNA sequence
  source 1..20: mol_type = other DNA
aaacgaacattggagtcacc

SEQ ID NO: 19091 - DNA, 20 bp, synthetic construct
  misc_feature 1..20: note = CRISPR gRNA sequence
  source 1..20: mol_type = other DNA
aacgaacattggagtcacct

SEQ ID NO: 19092 - DNA, 20 bp, synthetic construct
  misc_feature 1..20: note = CRISPR gRNA sequence
  source 1..20: mol_type = other DNA
aacattggagtcacctggga

SEQ ID NO: 19093 - DNA, 20 bp, synthetic construct
  misc_feature 1..20: note = CRISPR gRNA sequence
  source 1..20: mol_type = other DNA
ttggagtcacctgggataga

SEQ ID NO: 19094 - DNA, 20 bp, synthetic construct
  misc_feature 1..20: note = CRISPR gRNA sequence
  source 1..20: mol_type = other DNA
gggatagatggtttaacctg

SEQ ID NO: 19095 - DNA, 20 bp, synthetic construct
  misc_feature 1..20: note = CRISPR gRNA sequence
  source 1..20: mol_type = other DNA
ggatagatggtttaacctgc

SEQ ID NO: 19096 - DNA, 20 bp, synthetic construct
  misc_feature 1..20: note = CRISPR gRNA sequence
  source 1..20: mol_type = other DNA
tggtttaacctgcaggatct

SEQ ID NO: 19097 - DNA, 20 bp, synthetic construct
  misc_feature 1..20: note = CRISPR gRNA sequence
  source 1..20: mol_type = other DNA
gcaggatctcagcctcaccc

SEQ ID NO: 19098 - DNA, 20 bp, synthetic construct
  misc_feature 1..20: note = CRISPR gRNA sequence
  source 1..20: mol_type = other DNA
caggatctcagcctcacccc

SEQ ID NO: 19099 - DNA, 20 bp, synthetic construct
  misc_feature 1..20: note = CRISPR gRNA sequence
  source 1..20: mol_type = other DNA
tctcagcctcaccccaggcc

SEQ ID NO: 19100 - DNA, 20 bp, synthetic construct
  misc_feature 1..20: note = CRISPR gRNA sequence
  source 1..20: mol_type = other DNA
tcaccccaggcctagccaac

SEQ ID NO: 19101 - DNA, 20 bp, synthetic construct
  misc_feature 1..20: note = CRISPR gRNA sequence
  source 1..20: mol_type = other DNA
caccccaggcctagccaacc

SEQ ID NO: 19102 - DNA, 20 bp, synthetic construct
  misc_feature 1..20: note = CRISPR gRNA sequence
  source 1..20: mol_type = other DNA
caggcctagccaaccgggcc

SEQ ID NO: 19103 - DNA, 20 bp, synthetic construct
  misc_feature 1..20: note = CRISPR gRNA sequence
  source 1..20: mol_type = other DNA
aggcctagccaaccgggcct

SEQ ID NO: 19104 - DNA, 20 bp, synthetic construct
  misc_feature 1..20: note = CRISPR gRNA sequence
  source 1..20: mol_type = other DNA
ggcctagccaaccgggcctg

SEQ ID NO: 19105 - DNA, 20 bp, synthetic construct
  misc_feature 1..20: note = CRISPR gRNA sequence
  source 1..20: mol_type = other DNA
gcctagccaaccgggcctgg

SEQ ID NO: 19106 - DNA, 20 bp, synthetic construct
  misc_feature 1..20: note = CRISPR gRNA sequence
  source 1..20: mol_type = other DNA
agccaaccgggcctgggggt

SEQ ID NO: 19107 - DNA, 20 bp, synthetic construct
  misc_feature 1..20: note = CRISPR gRNA sequence
  source 1..20: mol_type = other DNA
accgggcctgggggtgagcc

SEQ ID NO: 19108 - DNA, 20 bp, synthetic construct
  misc_feature 1..20: note = CRISPR gRNA sequence
  source 1..20: mol_type = other DNA
ccgggcctgggggtgagccc

SEQ ID NO: 19109 - DNA, 20 bp, synthetic construct
  misc_feature 1..20: note = CRISPR gRNA sequence
  source 1..20: mol_type = other DNA
ccgggaacctacatcctgaa

SEQ ID NO: 19110 - DNA, 20 bp, synthetic construct
  misc_feature 1..20: note = CRISPR gRNA sequence
  source 1..20: mol_type = other DNA
cgggaacctacatcctgaac

SEQ ID NO: 19111 - DNA, 20 bp, synthetic construct
  misc_feature 1..20: note = CRISPR gRNA sequence
  source 1..20: mol_type = other DNA
cctgaacaggttgatcatcc

SEQ ID NO: 19112 - DNA, 20 bp, synthetic construct
  misc_feature 1..20: note = CRISPR gRNA sequence
  source 1..20: mol_type = other DNA
ctgaacaggttgatcatccc

SEQ ID NO: 19113 - DNA, 20 bp, synthetic construct
  misc_feature 1..20: note = CRISPR gRNA sequence
  source 1..20: mol_type = other DNA
tcccaggtgatgttcatgtg

SEQ ID NO: 19114 - DNA, 20 bp, synthetic construct
  misc_feature 1..20: note = CRISPR gRNA sequence
  source 1..20: mol_type = other DNA
cccaggtgatgttcatgtgt

SEQ ID NO: 19115 - DNA, 20 bp, synthetic construct
  misc_feature 1..20: note = CRISPR gRNA sequence
  source 1..20: mol_type = other DNA
ccaggtgatgttcatgtgtg

SEQ ID NO: 19116 - DNA, 20 bp, synthetic construct
  misc_feature 1..20: note = CRISPR gRNA sequence
  source 1..20: mol_type = other DNA
aggtgatgttcatgtgtggg

SEQ ID NO: 19117 - DNA, 20 bp, synthetic construct
  misc_feature 1..20: note = CRISPR gRNA sequence
  source 1..20: mol_type = other DNA
atgttcatgtgtggggagcc

SEQ ID NO: 19118 - DNA, 20 bp, synthetic construct
  misc_feature 1..20: note = CRISPR gRNA sequence
  source 1..20: mol_type = other DNA
tgttcatgtgtggggagcct

SEQ ID NO: 19119 - DNA, 20 bp, synthetic construct
  misc_feature 1..20: note = CRISPR gRNA sequence
  source 1..20: mol_type = other DNA
ggagcctgggattccccact

SEQ ID NO: 19120 - DNA, 20 bp, synthetic construct
  misc_feature 1..20: note = CRISPR gRNA sequence
  source 1..20: mol_type = other DNA
tccccactcagtcatctcca

SEQ ID NO: 19121 - DNA, 20 bp, synthetic construct
  misc_feature 1..20: note = CRISPR gRNA sequence
  source 1..20: mol_type = other DNA
accctgcctccaaacgctct

SEQ ID NO: 19122 - DNA, 20 bp, synthetic construct
  misc_feature 1..20: note = CRISPR gRNA sequence
  source 1..20: mol_type = other DNA
tccaaacgctctgagattgt

SEQ ID NO: 19123 - DNA, 20 bp, synthetic construct
  misc_feature 1..20: note = CRISPR gRNA sequence
  source 1..20: mol_type = other DNA
caaacgctctgagattgttg

SEQ ID NO: 19124 - DNA, 20 bp, synthetic construct
  misc_feature 1..20: note = CRISPR gRNA sequence
  source 1..20: mol_type = other DNA
gctctgagattgttggagac

SEQ ID NO: 19125 - DNA, 20 bp, synthetic construct
  misc_feature 1..20: note = CRISPR gRNA sequence
  source 1..20: mol_type = other DNA
ctctgagattgttggagacc

SEQ ID NO: 19126 - DNA, 20 bp, synthetic construct
  misc_feature 1..20: note = CRISPR gRNA sequence
  source 1..20: mol_type = other DNA
tggagaccaggtcatcccct

SEQ ID NO: 19127 - DNA, 20 bp, synthetic construct
  misc_feature 1..20: note = CRISPR gRNA sequence
  source 1..20: mol_type = other DNA
ggagaccaggtcatccccta

SEQ ID NO: 19128 - DNA, 20 bp, synthetic construct
  misc_feature 1..20: note = CRISPR gRNA sequence
  source 1..20: mol_type = other DNA
gagaccaggtcatcccctaa

SEQ ID NO: 19129 - DNA, 20 bp, synthetic construct
  misc_feature 1..20: note = CRISPR gRNA sequence
  source 1..20: mol_type = other DNA
gaccaggtcatcccctaagg

SEQ ID NO: 19130 - DNA, 20 bp, synthetic construct
  misc_feature 1..20: note = CRISPR gRNA sequence
  source 1..20: mol_type = other DNA
aggtcatcccctaagggagc

SEQ ID NO: 19131 - DNA, 20 bp, synthetic construct
  misc_feature 1..20: note = CRISPR gRNA sequence
  source 1..20: mol_type = other DNA
ggtcatcccctaagggagcc

SEQ ID NO: 19132 - DNA, 20 bp, synthetic construct
  misc_feature 1..20: note = CRISPR gRNA sequence
  source 1..20: mol_type = other DNA
gtcatcccctaagggagccg

SEQ ID NO: 19133 - DNA, 20 bp, synthetic construct
  misc_feature 1..20: note = CRISPR gRNA sequence
  source 1..20: mol_type = other DNA
tcatcccctaagggagccgg

SEQ ID NO: 19134 - DNA, 20 bp, synthetic construct
  misc_feature 1..20: note = CRISPR gRNA sequence
  source 1..20: mol_type = other DNA
taagggagccgggggtttgc

SEQ ID NO: 19135 - DNA, 20 bp, synthetic construct
  misc_feature 1..20: note = CRISPR gRNA sequence
  source 1..20: mol_type = other DNA
aagggagccgggggtttgca

SEQ ID NO: 19136 - DNA, 20 bp, synthetic construct
  misc_feature 1..20: note = CRISPR gRNA sequence
  source 1..20: mol_type = other DNA
tttgcaaggtgatcatttgt

SEQ ID NO: 19137 - DNA, 20 bp, synthetic construct
  misc_feature 1..20: note = CRISPR gRNA sequence
  source 1..20: mol_type = other DNA
tgcaaggtgatcatttgttg

SEQ ID NO: 19138 - DNA, 20 bp, synthetic construct
  misc_feature 1..20: note = CRISPR gRNA sequence
  source 1..20: mol_type = other DNA
ggtgatcatttgttggagtc

SEQ ID NO: 19139 - DNA, 20 bp, synthetic construct
  misc_feature 1..20: note = CRISPR gRNA sequence
  source 1..20: mol_type = other DNA
ttgttggagtcaagttcctt

SEQ ID NO: 19140 - DNA, 20 bp, synthetic construct
  misc_feature 1..20: note = CRISPR gRNA sequence
  source 1..20: mol_type = other DNA
cctttggctcctctttctcc

SEQ ID NO: 19141 - DNA, 20 bp, synthetic construct
  misc_feature 1..20: note = CRISPR gRNA sequence
  source 1..20: mol_type = other DNA
tttggctcctctttctccaa

SEQ ID NO: 19142 - DNA, 20 bp, synthetic construct
  misc_feature 1..20: note = CRISPR gRNA sequence
  source 1..20: mol_type = other DNA
ttggctcctctttctccaag

SEQ ID NO: 19143 - DNA, 20 bp, synthetic construct
  misc_feature 1..20: note = CRISPR gRNA sequence
  source 1..20: mol_type = other DNA
gctcctctttctccaagagg

SEQ ID NO: 19144 - DNA, 20 bp, synthetic construct
  misc_feature 1..20: note = CRISPR gRNA sequence
  source 1..20: mol_type = other DNA
cctctttctccaagaggaag

SEQ ID NO: 19145 - DNA, 20 bp, synthetic construct
  misc_feature 1..20: note = CRISPR gRNA sequence
  source 1..20: mol_type = other DNA
ctgtttccttaatctcactc

SEQ ID NO: 19146 - DNA, 20 bp, synthetic construct
  misc_feature 1..20: note = CRISPR gRNA sequence
  source 1..20: mol_type = other DNA
gtttccttaatctcactccg

SEQ ID NO: 19147 - DNA, 20 bp, synthetic construct
  misc_feature 1..20: note = CRISPR gRNA sequence
  source 1..20: mol_type = other DNA
tccttaatctcactccggag

SEQ ID NO: 19148 - DNA, 20 bp, synthetic construct
  misc_feature 1..20: note = CRISPR gRNA sequence
  source 1..20: mol_type = other DNA
gtatttatttattttttctc

SEQ ID NO: 19149 - DNA, 20 bp, synthetic construct
  misc_feature 1..20: note = CRISPR gRNA sequence
  source 1..20: mol_type = other DNA
atttatttattttttctctg

SEQ ID NO: 19150 - DNA, 20 bp, synthetic construct
  misc_feature 1..20: note = CRISPR gRNA sequence
  source 1..20: mol_type = other DNA
tatttattttttctctggag

SEQ ID NO: 19151 - DNA, 20 bp, synthetic construct
  misc_feature 1..20: note = CRISPR gRNA sequence
  source 1..20: mol_type = other DNA
atttattttttctctggagt

SEQ ID NO: 19152 - DNA, 20 bp, synthetic construct
  misc_feature 1..20: note = CRISPR gRNA sequence
  source 1..20: mol_type = other DNA
tttattttttctctggagtg

SEQ ID NO: 19153 - DNA, 20 bp, synthetic construct
  misc_feature 1..20: note = CRISPR gRNA sequence
  source 1..20: mol_type = other DNA
tattttttctctggagtggg

SEQ ID NO: 19154 - DNA, 20 bp, synthetic construct
  misc_feature 1..20: note = CRISPR gRNA sequence
  source 1..20: mol_type = other DNA
tttttctctggagtggggag

SEQ ID NO: 19155 - DNA, 20 bp, synthetic construct
  misc_feature 1..20: note = CRISPR gRNA sequence
  source 1..20: mol_type = other DNA
tctggagtggggagcagaaa

SEQ ID NO: 19156 - DNA, 20 bp, synthetic construct
  misc_feature 1..20: note = CRISPR gRNA sequence
  source 1..20: mol_type = other DNA
ggagtggggagcagaaacgg

SEQ ID NO: 19157 - DNA, 20 bp, synthetic construct
  misc_feature 1..20: note = CRISPR gRNA sequence
  source 1..20: mol_type = other DNA
aaacggaagacttcctgcca

SEQ ID NO: 19158 - DNA, 20 bp, synthetic construct
  misc_feature 1..20: note = CRISPR gRNA sequence
  source 1..20: mol_type = other DNA
ggaagacttcctgccaaagt

SEQ ID NO: 19159 - DNA, 20 bp, synthetic construct
  misc_feature 1..20: note = CRISPR gRNA sequence
  source 1..20: mol_type = other DNA
cctgccaaagttagacactc

SEQ ID NO: 19160 - DNA, 20 bp, synthetic construct
  misc_feature 1..20: note = CRISPR gRNA sequence
  source 1..20: mol_type = other DNA
ctgccaaagttagacactcc

SEQ ID NO: 19161 - DNA, 20 bp, synthetic construct
  misc_feature 1..20: note = CRISPR gRNA sequence
  source 1..20: mol_type = other DNA
aagttagacactccaggctg

SEQ ID NO: 19162 - DNA, 20 bp, synthetic construct
  misc_feature 1..20: note = CRISPR gRNA sequence
  source 1..20: mol_type = other DNA
tagacactccaggctgcggc

SEQ ID NO: 19163 - DNA, 20 bp, synthetic construct
  misc_feature 1..20: note = CRISPR gRNA sequence
  source 1..20: mol_type = other DNA
agacactccaggctgcggct

SEQ ID NO: 19164 - DNA, 20 bp, synthetic construct
  misc_feature 1..20: note = CRISPR gRNA sequence
  source 1..20: mol_type = other DNA
gacactccaggctgcggctg

SEQ ID NO: 19165 - DNA, 20 bp, synthetic construct
  misc_feature 1..20: note = CRISPR gRNA sequence
  source 1..20: mol_type = other DNA
cactccaggctgcggctggg

SEQ ID NO: 19166 - DNA, 20 bp, synthetic construct
  misc_feature 1..20: note = CRISPR gRNA sequence
  source 1..20: mol_type = other DNA
actccaggctgcggctgggg

SEQ ID NO: 19167 - DNA, 20 bp, synthetic construct
  misc_feature 1..20: note = CRISPR gRNA sequence
  source 1..20: mol_type = other DNA
ctccaggctgcggctgggga

SEQ ID NO: 19168 - DNA, 20 bp, synthetic construct
  misc_feature 1..20: note = CRISPR gRNA sequence
  source 1..20: mol_type = other DNA
ccaggctgcggctggggagg

SEQ ID NO: 19169 - DNA, 20 bp, synthetic construct
  misc_feature 1..20: note = CRISPR gRNA sequence
  source 1..20: mol_type = other DNA
ggagccatgccttgaacttc

SEQ ID NO: 19170 - DNA, 20 bp, synthetic construct
  misc_feature 1..20: note = CRISPR gRNA sequence
  source 1..20: mol_type = other DNA
gagccatgccttgaacttct

SEQ ID NO: 19171 - DNA, 20 bp, synthetic construct
  misc_feature 1..20: note = CRISPR gRNA sequence
  source 1..20: mol_type = other DNA
gccacctctcctgtgccacc

SEQ ID NO: 19172 - DNA, 20 bp, synthetic construct
  misc_feature 1..20: note = CRISPR gRNA sequence
  source 1..20: mol_type = other DNA
ccacctctcctgtgccacct

SEQ ID NO: 19173 - DNA, 20 bp, synthetic construct
  misc_feature 1..20: note = CRISPR gRNA sequence
  source 1..20: mol_type = other DNA
cacctctcctgtgccaccta

SEQ ID NO: 19174 - DNA, 20 bp, synthetic construct
  misc_feature 1..20: note = CRISPR gRNA sequence
  source 1..20: mol_type = other DNA
ctctcctgtgccacctaggg

SEQ ID NO: 19175 - DNA, 20 bp, synthetic construct
  misc_feature 1..20: note = CRISPR gRNA sequence
  source 1..20: mol_type = other DNA
ctcctgtgccacctagggtg

SEQ ID NO: 19176 - DNA, 20 bp, synthetic construct
  misc_feature 1..20: note = CRISPR gRNA sequence
  source 1..20: mol_type = other DNA
cctgtgccacctagggtgga

SEQ ID NO: 19177 - DNA, 20 bp, synthetic construct
  misc_feature 1..20: note = CRISPR gRNA sequence
  source 1..20: mol_type = other DNA
ctgtgccacctagggtggag

SEQ ID NO: 19178 - DNA, 20 bp, synthetic construct
  misc_feature 1..20: note = CRISPR gRNA sequence
  source 1..20: mol_type = other DNA
tgtgccacctagggtggaga

SEQ ID NO: 19179 - DNA, 20 bp, synthetic construct
  misc_feature 1..20: note = CRISPR gRNA sequence
  source 1..20: mol_type = other DNA
gtgccacctagggtggagag

SEQ ID NO: 19180 - DNA, 20 bp, synthetic construct
  misc_feature 1..20: note = CRISPR gRNA sequence
  source 1..20: mol_type = other DNA
cctagggtggagaggggctg

SEQ ID NO: 19181 - DNA, 20 bp, synthetic construct
  misc_feature 1..20: note = CRISPR gRNA sequence
  source 1..20: mol_type = other DNA
ctagggtggagaggggctgt

SEQ ID NO: 19182 - DNA, 20 bp, synthetic construct
  misc_feature 1..20: note = CRISPR gRNA sequence
  source 1..20: mol_type = other DNA
tggagaggggctgtgggact

SEQ ID NO: 19183 - DNA, 20 bp, synthetic construct
  misc_feature 1..20: note = CRISPR gRNA sequence
  source 1..20: mol_type = other DNA
ggagaggggctgtgggactc

SEQ ID NO: 19184 - DNA, 20 bp, synthetic construct
  misc_feature 1..20: note = CRISPR gRNA sequence
  source 1..20: mol_type = other DNA
agaggggctgtgggactcag

SEQ ID NO: 19185 - DNA, 20 bp, synthetic construct
  misc_feature 1..20: note = CRISPR gRNA sequence
  source 1..20: mol_type = other DNA
gaggggctgtgggactcagg

SEQ ID NO: 19186 - DNA, 20 bp, synthetic construct
  misc_feature 1..20: note = CRISPR gRNA sequence
  source 1..20: mol_type = other DNA
tgtgggactcaggaggaccg

SEQ ID NO: 19187 - DNA, 20 bp, synthetic construct
  misc_feature 1..20: note = CRISPR gRNA sequence
  source 1..20: mol_type = other DNA
tcaggaggaccgcggctttt

SEQ ID NO: 19188 - DNA, 20 bp, synthetic construct
  misc_feature 1..20: note = CRISPR gRNA sequence
  source 1..20: mol_type = other DNA
aggaggaccgcggcttttaa

SEQ ID NO: 19189 - DNA, 20 bp, synthetic construct
  misc_feature 1..20: note = CRISPR gRNA sequence
  source 1..20: mol_type = other DNA
accgcggcttttaagagttc

SEQ ID NO: 19190 - DNA, 20 bp, synthetic construct
  misc_feature 1..20: note = CRISPR gRNA sequence
  source 1..20: mol_type = other DNA
gcttttaagagttccagact

SEQ ID NO: 19191 - DNA, 20 bp, synthetic construct
  misc_feature 1..20: note = CRISPR gRNA sequence
  source 1..20: mol_type = other DNA
taagagttccagactaagct

SEQ ID NO: 19192 - DNA, 20 bp, synthetic construct
  misc_feature 1..20: note = CRISPR gRNA sequence
  source 1..20: mol_type = other DNA
gttccagactaagctaagca

SEQ ID NO: 19193 - DNA, 20 bp, synthetic construct
  misc_feature 1..20: note = CRISPR gRNA sequence
  source 1..20: mol_type = other DNA
ccagactaagctaagcatgg

SEQ ID NO: 19194 - DNA, 20 bp, synthetic construct
  misc_feature 1..20: note = CRISPR gRNA sequence
  source 1..20: mol_type = other DNA
aagcatggtggctccgattc

SEQ ID NO: 19195 - DNA, 20 bp, synthetic construct
  misc_feature 1..20: note = CRISPR gRNA sequence
  source 1..20: mol_type = other DNA
ggctccgattccggctttcc

SEQ ID NO: 19196 - DNA, 20 bp, synthetic construct
  misc_feature 1..20: note = CRISPR gRNA sequence
  source 1..20: mol_type = other DNA
attccggctttcctggaccc

SEQ ID NO: 19197 - DNA, 20 bp, synthetic construct
  misc_feature 1..20: note = CRISPR gRNA sequence
  source 1..20: mol_type = other DNA
ttccggctttcctggacccc

SEQ ID NO: 19198 - DNA, 20 bp, synthetic construct
  misc_feature 1..20: note = CRISPR gRNA sequence
  source 1..20: mol_type = other DNA
tccggctttcctggacccca

SEQ ID NO: 19199 - DNA, 20 bp, synthetic construct
  misc_feature 1..20: note = CRISPR gRNA sequence
  source 1..20: mol_type = other DNA
cggctttcctggaccccagg

SEQ ID NO: 19200 - DNA, 20 bp, synthetic construct
  misc_feature 1..20: note = CRISPR gRNA sequence
  source 1..20: mol_type = other DNA
ccaatctcccactcccaccc

SEQ ID NO: 19201 - DNA, 20 bp, synthetic construct
  misc_feature 1..20: note = CRISPR gRNA sequence
  source 1..20: mol_type = other DNA
ccaccccggcattcgcacgc

SEQ ID NO: 19202 - DNA, 20 bp, synthetic construct
  misc_feature 1..20: note = CRISPR gRNA sequence
  source 1..20: mol_type = other DNA
gcattcgcacgctggctttc

SEQ ID NO: 19203 - DNA, 20 bp, synthetic construct
  misc_feature 1..20: note = CRISPR gRNA sequence
  source 1..20: mol_type = other DNA
cattcgcacgctggctttcc

SEQ ID NO: 19204 - DNA, 20 bp, synthetic construct
  misc_feature 1..20: note = CRISPR gRNA sequence
  source 1..20: mol_type = other DNA
attcgcacgctggctttccg

SEQ ID NO: 19205 - DNA, 20 bp, synthetic construct
  misc_feature 1..20: note = CRISPR gRNA sequence
  source 1..20: mol_type = other DNA
gctggctttccggggcgctt

SEQ ID NO: 19206 - DNA, 20 bp, synthetic construct
  misc_feature 1..20: note = CRISPR gRNA sequence
  source 1..20: mol_type = other DNA
ggcgctttagcctctctcct

SEQ ID NO: 19207 - DNA, 20 bp, synthetic construct
  misc_feature 1..20: note = CRISPR gRNA sequence
  source 1..20: mol_type = other DNA
cgctttagcctctctcctta

SEQ ID NO: 19208 - DNA, 20 bp, synthetic construct
  misc_feature 1..20: note = CRISPR gRNA sequence
  source 1..20: mol_type = other DNA
gctttagcctctctccttag

SEQ ID NO: 19209 - DNA, 20 bp, synthetic construct
  misc_feature 1..20: note = CRISPR gRNA sequence
  source 1..20: mol_type = other DNA
ctttagcctctctccttaga

SEQ ID NO: 19210 - DNA, 20 bp, synthetic construct
  misc_feature 1..20: note = CRISPR gRNA sequence
  source 1..20: mol_type = other DNA
tctccttagagggtgtgact

SEQ ID NO: 19211 - DNA, 20 bp, synthetic construct
  misc_feature 1..20: note = CRISPR gRNA sequence
  source 1..20: mol_type = other DNA
ctccttagagggtgtgactc

SEQ ID NO: 19212 - DNA, 20 bp, synthetic construct
  misc_feature 1..20: note = CRISPR gRNA sequence
  source 1..20: mol_type = other DNA
tccttagagggtgtgactca

SEQ ID NO: 19213 - DNA, 20 bp, synthetic construct
  misc_feature 1..20: note = CRISPR gRNA sequence
  source 1..20: mol_type = other DNA
gggtgtgactcagggcccca

SEQ ID NO: 19214 - DNA, 20 bp, synthetic construct
  misc_feature 1..20: note = CRISPR gRNA sequence
  source 1..20: mol_type = other DNA
gtgactcagggccccaaagc

SEQ ID NO: 19215 - DNA, 20 bp, synthetic construct
  misc_feature 1..20: note = CRISPR gRNA sequence
  source 1..20: mol_type = other DNA
tgactcagggccccaaagcg

SEQ ID NO: 19216 - DNA, 20 bp, synthetic construct
  misc_feature 1..20: note = CRISPR gRNA sequence
  source 1..20: mol_type = other DNA
ctcagggccccaaagcgagg

SEQ ID NO: 19217 - DNA, 20 bp, synthetic construct
  misc_feature 1..20: note = CRISPR gRNA sequence
  source 1..20: mol_type = other DNA
cagggccccaaagcgaggta

SEQ ID NO: 19218 - DNA, 20 bp, synthetic construct
  misc_feature 1..20: note = CRISPR gRNA sequence
  source 1..20: mol_type = other DNA
ggccccaaagcgaggtagag

SEQ ID NO: 19219 - DNA, 20 bp, synthetic construct
  misc_feature 1..20: note = CRISPR gRNA sequence
  source 1..20: mol_type = other DNA
ccaaagcgaggtagagaagt

SEQ ID NO: 19220 - DNA, 20 bp, synthetic construct
  misc_feature 1..20: note = CRISPR gRNA sequence
  source 1..20: mol_type = other DNA
aaagcgaggtagagaagtga

SEQ ID NO: 19221 - DNA, 20 bp, synthetic construct
  misc_feature 1..20: note = CRISPR gRNA sequence
  source 1..20: mol_type = other DNA
aggtagagaagtgagagatc

SEQ ID NO: 19222 - DNA, 20 bp, synthetic construct
  misc_feature 1..20: note = CRISPR gRNA sequence
  source 1..20: mol_type = other DNA
gtagagaagtgagagatcaa

SEQ ID NO: 19223 - DNA, 20 bp, synthetic construct
  misc_feature 1..20: note = CRISPR gRNA sequence
  source 1..20: mol_type = other DNA
gaagtgagagatcaagagat

SEQ ID NO: 19224 - DNA, 20 bp, synthetic construct
  misc_feature 1..20: note = CRISPR gRNA sequence
  source 1..20: mol_type = other DNA
gagagatcaagagatcggtt

SEQ ID NO: 19225 - DNA, 20 bp, synthetic construct
  misc_feature 1..20: note = CRISPR gRNA sequence
  source 1..20: mol_type = other DNA
atcaagagatcggttcagtc

SEQ ID NO: 19226 - DNA, 20 bp, synthetic construct
  misc_feature 1..20: note = CRISPR gRNA sequence
  source 1..20: mol_type = other DNA
tcaagagatcggttcagtcc

SEQ ID NO: 19227 - DNA, 20 bp, synthetic construct
  misc_feature 1..20: note = CRISPR gRNA sequence
  source 1..20: mol_type = other DNA
caagagatcggttcagtccg

SEQ ID NO: 19228 - DNA, 20 bp, synthetic construct
  misc_feature 1..20: note = CRISPR gRNA sequence
  source 1..20: mol_type = other DNA
aagagatcggttcagtccgg

SEQ ID NO: 19229 - DNA, 20 bp, synthetic construct
  misc_feature 1..20: note = CRISPR gRNA sequence
  source 1..20: mol_type = other DNA
agagatcggttcagtccggg

SEQ ID NO: 19230 - DNA, 20 bp, synthetic construct
  misc_feature 1..20: note = CRISPR gRNA sequence
  source 1..20: mol_type = other DNA
caacaacacacaccttcgcc

SEQ ID NO: 19231 - DNA, 20 bp, synthetic construct
  misc_feature 1..20: note = CRISPR gRNA sequence
  source 1..20: mol_type = other DNA
ccttcgccaagatgttcaac

SEQ ID NO: 19232 - DNA, 20 bp, synthetic construct
  misc_feature 1..20: note = CRISPR gRNA sequence
  source 1..20: mol_type = other DNA
ttcgccaagatgttcaacga

SEQ ID NO: 19233 - DNA, 20 bp, synthetic construct
  misc_feature 1..20: note = CRISPR gRNA sequence
  source 1..20: mol_type = other DNA
caagatgttcaacgagagtt

SEQ ID NO: 19234 - DNA, 20 bp, synthetic construct
  misc_feature 1..20: note = CRISPR gRNA sequence
  source 1..20: mol_type = other DNA
aagatgttcaacgagagttg

SEQ ID NO: 19235 - DNA, 20 bp, synthetic construct
  misc_feature 1..20: note = CRISPR gRNA sequence
  source 1..20: mol_type = other DNA
tgaggacttatcccatcctc

SEQ ID NO: 19236 - DNA, 20 bp, synthetic construct
  misc_feature 1..20: note = CRISPR gRNA sequence
  source 1..20: mol_type = other DNA
cttatcccatcctctggtta

SEQ ID NO: 19237 - DNA, 20 bp, synthetic construct
  misc_feature 1..20: note = CRISPR gRNA sequence
  source 1..20: mol_type = other DNA
ttatcccatcctctggttaa

SEQ ID NO: 19238 - DNA, 20 bp, synthetic construct
  misc_feature 1..20: note = CRISPR gRNA sequence
  source 1..20: mol_type = other DNA
ccatcctctggttaaaggtt

SEQ ID NO: 19239 - DNA, 20 bp, synthetic construct
  misc_feature 1..20: note = CRISPR gRNA sequence
  source 1..20: mol_type = other DNA
tggctccctactgcctccct

SEQ ID NO: 19240 - DNA, 20 bp, synthetic construct
  misc_feature 1..20: note = CRISPR gRNA sequence
  source 1..20: mol_type = other DNA
ctccctactgcctccctgag

SEQ ID NO: 19241 - DNA, 20 bp, synthetic construct
  misc_feature 1..20: note = CRISPR gRNA sequence
  source 1..20: mol_type = other DNA
tccctactgcctccctgagc

SEQ ID NO: 19242 - DNA, 20 bp, synthetic construct
  misc_feature 1..20: note = CRISPR gRNA sequence
  source 1..20: mol_type = other DNA
ccctactgcctccctgagca

SEQ ID NO: 19243 - DNA, 20 bp, synthetic construct
  misc_feature 1..20: note = CRISPR gRNA sequence
  source 1..20: mol_type = other DNA
cctgagcagggccccccgcc

SEQ ID NO: 19244 - DNA, 20 bp, synthetic construct
  misc_feature 1..20: note = CRISPR gRNA sequence
  source 1..20: mol_type = other DNA
tgagcagggccccccgcctg

SEQ ID NO: 19245 - DNA, 20 bp, synthetic construct
  misc_feature 1..20: note = CRISPR gRNA sequence
  source 1..20: mol_type = other DNA
agcagggccccccgcctgga

SEQ ID NO: 19246 - DNA, 20 bp, synthetic construct
  misc_feature 1..20: note = CRISPR gRNA sequence
  source 1..20: mol_type = other DNA
gcctggagagcccaataccc

SEQ ID NO: 19247 - DNA, 20 bp, synthetic construct
  misc_feature 1..20: note = CRISPR gRNA sequence
  source 1..20: mol_type = other DNA
gagcccaatacccaagattc

SEQ ID NO: 19248 - DNA, 20 bp, synthetic construct
  misc_feature 1..20: note = CRISPR gRNA sequence
  source 1..20: mol_type = other DNA
gcccaatacccaagattcca

SEQ ID NO: 19249 - DNA, 20 bp, synthetic construct
  misc_feature 1..20: note = CRISPR gRNA sequence
  source 1..20: mol_type = other DNA
aatacccaagattccagagt

SEQ ID NO: 19250 - DNA, 20 bp, synthetic construct
  misc_feature 1..20: note = CRISPR gRNA sequence
  source 1..20: mol_type = other DNA
tacccaagattccagagtta

SEQ ID NO: 19251 - DNA, 20 bp, synthetic construct
  misc_feature 1..20: note = CRISPR gRNA sequence
  source 1..20: mol_type = other DNA
caagattccagagttagaga

SEQ ID NO: 19252 - DNA, 20 bp, synthetic construct
  misc_feature 1..20: note = CRISPR gRNA sequence
  source 1..20: mol_type = other DNA
agagatggaatatgacccaa

SEQ ID NO: 19253 - DNA, 20 bp, synthetic construct
  misc_feature 1..20: note = CRISPR gRNA sequence
  source 1..20: mol_type = other DNA
gagatggaatatgacccaac

SEQ ID NO: 19254 - DNA, 20 bp, synthetic construct
  misc_feature 1..20: note = CRISPR gRNA sequence
  source 1..20: mol_type = other DNA
agatggaatatgacccaaca

SEQ ID NO: 19255 - DNA, 20 bp, synthetic construct
  misc_feature 1..20: note = CRISPR gRNA sequence
  source 1..20: mol_type = other DNA
ggaatatgacccaacaggga

SEQ ID NO: 19256 - DNA, 20 bp, synthetic construct
  misc_feature 1..20: note = CRISPR gRNA sequence
  source 1..20: mol_type = other DNA
atgacccaacagggaaagtg

SEQ ID NO: 19257 - DNA, 20 bp, synthetic construct
  misc_feature 1..20: note = CRISPR gRNA sequence
  source 1..20: mol_type = other DNA
ccaacagggaaagtgaagct

SEQ ID NO: 19258 - DNA, 20 bp, synthetic construct
  misc_feature 1..20: note = CRISPR gRNA sequence
  source 1..20: mol_type = other DNA
caacagggaaagtgaagctc

SEQ ID NO: 19259 - DNA, 20 bp, synthetic construct
  misc_feature 1..20: note = CRISPR gRNA sequence
  source 1..20: mol_type = other DNA
aacagggaaagtgaagctca

SEQ ID NO: 19260 - DNA, 20 bp, synthetic construct
  misc_feature 1..20: note = CRISPR gRNA sequence
  source 1..20: mol_type = other DNA
ggaaagtgaagctcagggaa

SEQ ID NO: 19261 - DNA, 20 bp, synthetic construct
  misc_feature 1..20: note = CRISPR gRNA sequence
  source 1..20: mol_type = other DNA
aagtgaagctcagggaacgg

SEQ ID NO: 19262 - DNA, 20 bp, synthetic construct
  misc_feature 1..20: note = CRISPR gRNA sequence
  source 1..20: mol_type = other DNA
agctcagggaacggcggccc

SEQ ID NO: 19263 - DNA, 20 bp, synthetic construct
  misc_feature 1..20: note = CRISPR gRNA sequence
  source 1..20: mol_type = other DNA
ggaacggcggccctggtcca

SEQ ID NO: 19264 - DNA, 20 bp, synthetic construct
  misc_feature 1..20: note = CRISPR gRNA sequence
  source 1..20: mol_type = other DNA
ggcggccctggtccaaagtc

SEQ ID NO: 19265 - DNA, 20 bp, synthetic construct
  misc_feature 1..20: note = CRISPR gRNA sequence
  source 1..20: mol_type = other DNA
tggtccaaagtctggcgtac

SEQ ID NO: 19266 - DNA, 20 bp, synthetic construct
  misc_feature 1..20: note = CRISPR gRNA sequence
  source 1..20: mol_type = other DNA
tccaaagtctggcgtacaag

SEQ ID NO: 19267 - DNA, 20 bp, synthetic construct
  misc_feature 1..20: note = CRISPR gRNA sequence
  source 1..20: mol_type = other DNA
ccaaagtctggcgtacaaga

SEQ ID NO: 19268 - DNA, 20 bp, synthetic construct
  misc_feature 1..20: note = CRISPR gRNA sequence
  source 1..20: mol_type = other DNA
caaagtctggcgtacaagaa

SEQ ID NO: 19269 - DNA, 20 bp, synthetic construct
  misc_feature 1..20: note = CRISPR gRNA sequence
  source 1..20: mol_type = other DNA
aagaagggcgcgcacctctg

SEQ ID NO: 19270 - DNA, 20 bp, synthetic construct
  misc_feature 1..20: note = CRISPR gRNA sequence
  source 1..20: mol_type = other DNA
agaagggcgcgcacctctgc

SEQ ID NO: 19271 - DNA, 20 bp, synthetic construct
  misc_feature 1..20: note = CRISPR gRNA sequence
  source 1..20: mol_type = other DNA
cgcgcacctctgcaggatcc

SEQ ID NO: 19272 - DNA, 20 bp, synthetic construct
  misc_feature 1..20: note = CRISPR gRNA sequence
  source 1..20: mol_type = other DNA
gcgcacctctgcaggatccc

SEQ ID NO: 19273 - DNA, 20 bp, synthetic construct
  misc_feature 1..20: note = CRISPR gRNA sequence
  source 1..20: mol_type = other DNA
tctgcaggatcccgggcgcg

SEQ ID NO: 19274 - DNA, 20 bp, synthetic construct
  misc_feature 1..20: note = CRISPR gRNA sequence
  source 1..20: mol_type = other DNA
tgcaggatcccgggcgcgcg

SEQ ID NO: 19275 - DNA, 20 bp, synthetic construct
  misc_feature 1..20: note = CRISPR gRNA sequence
  source 1..20: mol_type = other DNA
ggatcccgggcgcgcggagt

SEQ ID NO: 19276 - DNA, 20 bp, synthetic construct
  misc_feature 1..20: note = CRISPR gRNA sequence
  source 1..20: mol_type = other DNA
ccgggcgcgcggagtcggcc

SEQ ID NO: 19277 - DNA, 20 bp, synthetic construct
  misc_feature 1..20: note = CRISPR gRNA sequence
  source 1..20: mol_type = other DNA
cgggcgcgcggagtcggcca

SEQ ID NO: 19278 - DNA, 20 bp, synthetic construct
  misc_feature 1..20: note = CRISPR gRNA sequence
  source 1..20: mol_type = other DNA
gggcgcgcggagtcggccaa

SEQ ID NO: 19279 - DNA, 20 bp, synthetic construct
  misc_feature 1..20: note = CRISPR gRNA sequence
  source 1..20: mol_type = other DNA
cgcgcggagtcggccaaggg

SEQ ID NO: 19280 - DNA, 20 bp, synthetic construct
  misc_feature 1..20: note = CRISPR gRNA sequence
  source 1..20: mol_type = other DNA
cggagtcggccaagggtggc

SEQ ID NO: 19281 - DNA, 20 bp, synthetic construct
  misc_feature 1..20: note = CRISPR gRNA sequence
  source 1..20: mol_type = other DNA
ggagtcggccaagggtggcc

SEQ ID NO: 19282 - DNA, 20 bp, synthetic construct
  misc_feature 1..20: note = CRISPR gRNA sequence
  source 1..20: mol_type = other DNA
gagtcggccaagggtggccg

SEQ ID NO: 19283 - DNA, 20 bp, synthetic construct
  misc_feature 1..20: note = CRISPR gRNA sequence
  source 1..20: mol_type = other DNA
agtcggccaagggtggccgg

SEQ ID NO: 19284 - DNA, 20 bp, synthetic construct
  misc_feature 1..20: note = CRISPR gRNA sequence
  source 1..20: mol_type = other DNA
tcggccaagggtggccgggg

SEQ ID NO: 19285 - DNA, 20 bp, synthetic construct
  misc_feature 1..20: note = CRISPR gRNA sequence
  source 1..20: mol_type = other DNA
gtgtgtctgctccgcgctcc

SEQ ID NO: 19286 - DNA, 20 bp, synthetic construct
  misc_feature 1..20: note = CRISPR gRNA sequence
  source 1..20: mol_type = other DNA
cgcgctcccagtctgcgctc

SEQ ID NO: 19287 - DNA, 20 bp, synthetic construct
  misc_feature 1..20: note = CRISPR gRNA sequence
  source 1..20: mol_type = other DNA
tctgcgctccggcttctctg

SEQ ID NO: 19288 - DNA, 20 bp, synthetic construct
  misc_feature 1..20: note = CRISPR gRNA sequence
  source 1..20: mol_type = other DNA
gcgctccggcttctctgcag

SEQ ID NO: 19289 - DNA, 20 bp, synthetic construct
  misc_feature 1..20: note = CRISPR gRNA sequence
  source 1..20: mol_type = other DNA
ttctctgcagaagctgccgc

SEQ ID NO: 19290 - DNA, 20 bp, synthetic construct
  misc_feature 1..20: note = CRISPR gRNA sequence
  source 1..20: mol_type = other DNA
tctctgcagaagctgccgcc

SEQ ID NO: 19291 - DNA, 20 bp, synthetic construct
  misc_feature 1..20: note = CRISPR gRNA sequence
  source 1..20: mol_type = other DNA
gctttcctgccacccgccca

SEQ ID NO: 19292 - DNA, 20 bp, synthetic construct
  misc_feature 1..20: note = CRISPR gRNA sequence
  source 1..20: mol_type = other DNA
ctgccacccgcccacggccc

SEQ ID NO: 19293 - DNA, 20 bp, synthetic construct
  misc_feature 1..20: note = CRISPR gRNA sequence
  source 1..20: mol_type = other DNA
gccacccgcccacggccccg

SEQ ID NO: 19294 - DNA, 20 bp, synthetic construct
  misc_feature 1..20: note = CRISPR gRNA sequence
  source 1..20: mol_type = other DNA
cgcccacggccccggagctc

SEQ ID NO: 19295 - DNA, 20 bp, synthetic construct
  misc_feature 1..20: note = CRISPR gRNA sequence
  source 1..20: mol_type = other DNA
gcccacggccccggagctct

SEQ ID NO: 19296 - DNA, 20 bp, synthetic construct
  misc_feature 1..20: note = CRISPR gRNA sequence
  source 1..20: mol_type = other DNA
cggccccggagctctgggca

SEQ ID NO: 19297 - DNA, 20 bp, synthetic construct
  misc_feature 1..20: note = CRISPR gRNA sequence
  source 1..20: mol_type = other DNA
cccggagctctgggcacagc

SEQ ID NO: 19298 - DNA, 20 bp, synthetic construct
  misc_feature 1..20: note = CRISPR gRNA sequence
  source 1..20: mol_type = other DNA
agctctgggcacagcaagcc

SEQ ID NO: 19299 - DNA, 20 bp, synthetic construct
  misc_feature 1..20: note = CRISPR gRNA sequence
  source 1..20: mol_type = other DNA
gggcacagcaagccaagctc

SEQ ID NO: 19300 - DNA, 20 bp, synthetic construct
  misc_feature 1..20: note = CRISPR gRNA sequence
  source 1..20: mol_type = other DNA
ggcacagcaagccaagctcc

SEQ ID NO: 19301 - DNA, 20 bp, synthetic construct
  misc_feature 1..20: note = CRISPR gRNA sequence
  source 1..20: mol_type = other DNA
caagccaagctccgggttcc

SEQ ID NO: 19302 - DNA, 20 bp, synthetic construct
  misc_feature 1..20: note = CRISPR gRNA sequence
  source 1..20: mol_type = other DNA
agctccgggttcccggctcc

SEQ ID NO: 19303 - DNA, 20 bp, synthetic construct
  misc_feature 1..20: note = CRISPR gRNA sequence
  source 1..20: mol_type = other DNA
cccggctcctggttcccgcg

SEQ ID NO: 19304 - DNA, 20 bp, synthetic construct
  misc_feature 1..20: note = CRISPR gRNA sequence
  source 1..20: mol_type = other DNA
cggctcctggttcccgcgca

SEQ ID NO: 19305 - DNA, 20 bp, synthetic construct
  misc_feature 1..20: note = CRISPR gRNA sequence
  source 1..20: mol_type = other DNA
gttcccgcgcagagtcgttg

SEQ ID NO: 19306 - DNA, 20 bp, synthetic construct
  misc_feature 1..20: note = CRISPR gRNA sequence
  source 1..20: mol_type = other DNA
ttcccgcgcagagtcgttgc

SEQ ID NO: 19307 - DNA, 20 bp, synthetic construct
  misc_feature 1..20: note = CRISPR gRNA sequence
  source 1..20: mol_type = other DNA
tcccgcgcagagtcgttgcg

SEQ ID NO: 19308 - DNA, 20 bp, synthetic construct
  misc_feature 1..20: note = CRISPR gRNA sequence
  source 1..20: mol_type = other DNA
cagagtcgttgcggggatgc

SEQ ID NO: 19309 - DNA, 20 bp, synthetic construct
  misc_feature 1..20: note = CRISPR gRNA sequence
  source 1..20: mol_type = other DNA
gttgcggggatgctggaaac

SEQ ID NO: 19310 - DNA, 20 bp, synthetic construct
  misc_feature 1..20: note = CRISPR gRNA sequence
  source 1..20: mol_type = other DNA
ttgcggggatgctggaaacg

SEQ ID NO: 19311 - DNA, 20 bp, synthetic construct
  misc_feature 1..20: note = CRISPR gRNA sequence
  source 1..20: mol_type = other DNA
gctggaaacgaggtgtttcc

SEQ ID NO: 19312 - DNA, 20 bp, synthetic construct
  misc_feature 1..20: note = CRISPR gRNA sequence
  source 1..20: mol_type = other DNA
attccatccccccatcctcc

SEQ ID NO: 19313 - DNA, 20 bp, synthetic construct
  misc_feature 1..20: note = CRISPR gRNA sequence
  source 1..20: mol_type = other DNA
cagacttgctgtgtgacctt

SEQ ID NO: 19314 - DNA, 20 bp, synthetic construct
  misc_feature 1..20: note = CRISPR gRNA sequence
  source 1..20: mol_type = other DNA
cttgctgtgtgaccttgagc

SEQ ID NO: 19315 - DNA, 20 bp, synthetic construct
  misc_feature 1..20: note = CRISPR gRNA sequence
  source 1..20: mol_type = other DNA
gctgtgtgaccttgagcaag

SEQ ID NO: 19316 - DNA, 20 bp, synthetic construct
  misc_feature 1..20: note = CRISPR gRNA sequence
  source 1..20: mol_type = other DNA
gaccttgagcaagtagctga

SEQ ID NO: 19317 - DNA, 20 bp, synthetic construct
  misc_feature 1..20: note = CRISPR gRNA sequence
  source 1..20: mol_type = other DNA
gagcaagtagctgacagtct

SEQ ID NO: 19318 - DNA, 20 bp, synthetic construct
  misc_feature 1..20: note = CRISPR gRNA sequence
  source 1..20: mol_type = other DNA
gcaagtagctgacagtctcg

SEQ ID NO: 19319 - DNA, 20 bp, synthetic construct
  misc_feature 1..20: note = CRISPR gRNA sequence
  source 1..20: mol_type = other DNA
agtctcggagcctcgattct

SEQ ID NO: 19320 - DNA, 20 bp, synthetic construct
  misc_feature 1..20: note = CRISPR gRNA sequence
  source 1..20: mol_type = other DNA
ctcgattctcagcccgacct

SEQ ID NO: 19321 - DNA, 20 bp, synthetic construct
  misc_feature 1..20: note = CRISPR gRNA sequence
  source 1..20: mol_type = other DNA
tcgattctcagcccgacctt

SEQ ID NO: 19322 - DNA, 20 bp, synthetic construct
  misc_feature 1..20: note = CRISPR gRNA sequence
  source 1..20: mol_type = other DNA
cgattctcagcccgacctta

SEQ ID NO: 19323 - DNA, 20 bp, synthetic construct
  misc_feature 1..20: note = CRISPR gRNA sequence
  source 1..20: mol_type = other DNA
gattctcagcccgaccttag

SEQ ID NO: 19324 - DNA, 20 bp, synthetic construct
  misc_feature 1..20: note = CRISPR gRNA sequence
  source 1..20: mol_type = other DNA
cagcccgaccttaggggtta

SEQ ID NO: 19325 - DNA, 20 bp, synthetic construct
  misc_feature 1..20: note = CRISPR gRNA sequence
  source 1..20: mol_type = other DNA
gcccgaccttaggggttaca

SEQ ID NO: 19326 - DNA, 20 bp, synthetic construct
  misc_feature 1..20: note = CRISPR gRNA sequence
  source 1..20: mol_type = other DNA
cccgaccttaggggttacag

SEQ ID NO: 19327 - DNA, 20 bp, synthetic construct
  misc_feature 1..20: note = CRISPR gRNA sequence
  source 1..20: mol_type = other DNA
cgaccttaggggttacagag

SEQ ID NO: 19328 - DNA, 20 bp, synthetic construct
  misc_feature 1..20: note = CRISPR gRNA sequence
  source 1..20: mol_type = other DNA
aggggttacagaggagactt

SEQ ID NO: 19329 - DNA, 20 bp, synthetic construct
  misc_feature 1..20: note = CRISPR gRNA sequence
  source 1..20: mol_type = other DNA
ggtcacctaccgctgttccc

SEQ ID NO: 19330 - DNA, 20 bp, synthetic construct
  misc_feature 1..20: note = CRISPR gRNA sequence
  source 1..20: mol_type = other DNA
gtcacctaccgctgttcccc

SEQ ID NO: 19331 - DNA, 20 bp, synthetic construct
  misc_feature 1..20: note = CRISPR gRNA sequence
  source 1..20: mol_type = other DNA
cgggctcccgcgcgcgctgc

SEQ ID NO: 19332 - DNA, 20 bp, synthetic construct
  misc_feature 1..20: note = CRISPR gRNA sequence
  source 1..20: mol_type = other DNA
gctcccgcgcgcgctgctgg

SEQ ID NO: 19333 - DNA, 20 bp, synthetic construct
  misc_feature 1..20: note = CRISPR gRNA sequence
  source 1..20: mol_type = other DNA
tggtggcctctccctcccgc

SEQ ID NO: 19334 - DNA, 20 bp, synthetic construct
  misc_feature 1..20: note = CRISPR gRNA sequence
  source 1..20: mol_type = other DNA
cctctccctcccgccagctc

SEQ ID NO: 19335 - DNA, 20 bp, synthetic construct
  misc_feature 1..20: note = CRISPR gRNA sequence
  source 1..20: mol_type = other DNA
ctctccctcccgccagctct

SEQ ID NO: 19336 - DNA, 20 bp, synthetic construct
  misc_feature 1..20: note = CRISPR gRNA sequence
  source 1..20: mol_type = other DNA
tctccctcccgccagctctg

SEQ ID NO: 19337 - DNA, 20 bp, synthetic construct
  misc_feature 1..20: note = CRISPR gRNA sequence
  source 1..20: mol_type = other DNA
tcccgccagctctggggccg

SEQ ID NO: 19338 - DNA, 20 bp, synthetic construct
  misc_feature 1..20: note = CRISPR gRNA sequence
  source 1..20: mol_type = other DNA
gccagctctggggccgcggc

SEQ ID NO: 19339 - DNA, 20 bp, synthetic construct
  misc_feature 1..20: note = CRISPR gRNA sequence
  source 1..20: mol_type = other DNA
ctggggccgcggcaagtctg

SEQ ID NO: 19340 - DNA, 20 bp, synthetic construct
  misc_feature 1..20: note = CRISPR gRNA sequence
  source 1..20: mol_type = other DNA
gggccgcggcaagtctgtgg

SEQ ID NO: 19341 - DNA, 20 bp, synthetic construct
  misc_feature 1..20: note = CRISPR gRNA sequence
  source 1..20: mol_type = other DNA
gtctgtggcagctcgtccgc

SEQ ID NO: 19342 - DNA, 20 bp, synthetic construct
  misc_feature 1..20: note = CRISPR gRNA sequence
  source 1..20: mol_type = other DNA
cctacctccccgcctccccg

SEQ ID NO: 19343 - DNA, 20 bp, synthetic construct
  misc_feature 1..20: note = CRISPR gRNA sequence
  source 1..20: mol_type = other DNA
tccctttcactttctttctg

SEQ ID NO: 19344 - DNA, 20 bp, synthetic construct
  misc_feature 1..20: note = CRISPR gRNA sequence
  source 1..20: mol_type = other DNA
cactttctttctgcagcgct

SEQ ID NO: 19345 - DNA, 20 bp, synthetic construct
  misc_feature 1..20: note = CRISPR gRNA sequence
  source 1..20: mol_type = other DNA
tctttctgcagcgctgagct

SEQ ID NO: 19346 - DNA, 20 bp, synthetic construct
  misc_feature 1..20: note = CRISPR gRNA sequence
  source 1..20: mol_type = other DNA
ctttctgcagcgctgagctc

SEQ ID NO: 19347 - DNA, 20 bp, synthetic construct
  misc_feature 1..20: note = CRISPR gRNA sequence
  source 1..20: mol_type = other DNA
ctgcagcgctgagctcgggc

SEQ ID NO: 19348 - DNA, 20 bp, synthetic construct
  misc_feature 1..20: note = CRISPR gRNA sequence
  source 1..20: mol_type = other DNA
tgcagcgctgagctcgggcc

SEQ ID NO: 19349 - DNA, 20 bp, synthetic construct
  misc_feature 1..20: note = CRISPR gRNA sequence
  source 1..20: mol_type = other DNA
gctgagctcgggccaggctg

SEQ ID NO: 19350 - DNA, 20 bp, synthetic construct
  misc_feature 1..20: note = CRISPR gRNA sequence
  source 1..20: mol_type = other DNA
tgagctcgggccaggctgtg

SEQ ID NO: 19351 - DNA, 20 bp, synthetic construct
  misc_feature 1..20: note = CRISPR gRNA sequence
  source 1..20: mol_type = other DNA
ggccaggctgtggagcaacc

SEQ ID NO: 19352 - DNA, 20 bp, synthetic construct
  misc_feature 1..20: note = CRISPR gRNA sequence
  source 1..20: mol_type = other DNA
gagcaaccaagcacctactg

SEQ ID NO: 19353 - DNA, 20 bp, synthetic construct
  misc_feature 1..20: note = CRISPR gRNA sequence
  source 1..20: mol_type = other DNA
gtggccaccacgtgctttat

SEQ ID NO: 19354 - DNA, 20 bp, synthetic construct
  misc_feature 1..20: note = CRISPR gRNA sequence
  source 1..20: mol_type = other DNA
gccaccacgtgctttatcag

SEQ ID NO: 19355 - DNA, 20 bp, synthetic construct
  misc_feature 1..20: note = CRISPR gRNA sequence
  source 1..20: mol_type = other DNA
accacgtgctttatcagaag

SEQ ID NO: 19356 - DNA, 20 bp, synthetic construct
  misc_feature 1..20: note = CRISPR gRNA sequence
  source 1..20: mol_type = other DNA
gaagtggcatcccaactgcc

SEQ ID NO: 19357 - DNA, 20 bp, synthetic construct
  misc_feature 1..20: note = CRISPR gRNA sequence
  source 1..20: mol_type = other DNA
aagtggcatcccaactgcct

SEQ ID NO: 19358 - DNA, 20 bp, synthetic construct
  misc_feature 1..20: note = CRISPR gRNA sequence
  source 1..20: mol_type = other DNA
agtggcatcccaactgcctg

SEQ ID NO: 19359 - DNA, 20 bp, synthetic construct
  misc_feature 1..20: note = CRISPR gRNA sequence
  source 1..20: mol_type = other DNA
cccaactgcctggggcatcc

SEQ ID NO: 19360 - DNA, 20 bp, synthetic construct
  misc_feature 1..20: note = CRISPR gRNA sequence
  source 1..20: mol_type = other DNA
caactgcctggggcatccaa

SEQ ID NO: 19361 - DNA, 20 bp, synthetic construct
  misc_feature 1..20: note = CRISPR gRNA sequence
  source 1..20: mol_type = other DNA
aactgcctggggcatccaag

SEQ ID NO: 19362 - DNA, 20 bp, synthetic construct
  misc_feature 1..20: note = CRISPR gRNA sequence
  source 1..20: mol_type = other DNA
atccaagaggtccctgcctc

SEQ ID NO: 19363 - DNA, 20 bp, synthetic construct
  misc_feature 1..20: note = CRISPR gRNA sequence
  source 1..20: mol_type = other DNA
aagaggtccctgcctccagt

SEQ ID NO: 19364 - DNA, 20 bp, synthetic construct
  misc_feature 1..20: note = CRISPR gRNA sequence
  source 1..20: mol_type = other DNA
tgcctccagtcggttcctca

SEQ ID NO: 19365 - DNA, 20 bp, synthetic construct
  misc_feature 1..20: note = CRISPR gRNA sequence
  source 1..20: mol_type = other DNA
ctccagtcggttcctcacag

SEQ ID NO: 19366 - DNA, 20 bp, synthetic construct
  misc_feature 1..20: note = CRISPR gRNA sequence
  source 1..20: mol_type = other DNA
agtcggttcctcacagtggc

SEQ ID NO: 19367 - DNA, 20 bp, synthetic construct
  misc_feature 1..20: note = CRISPR gRNA sequence
  source 1..20: mol_type = other DNA
cacagtggccagccccactt

SEQ ID NO: 19368 - DNA, 20 bp, synthetic construct
  misc_feature 1..20: note = CRISPR gRNA sequence
  source 1..20: mol_type = other DNA
acagtggccagccccacttc

SEQ ID NO: 19369 - DNA, 20 bp, synthetic construct
  misc_feature 1..20: note = CRISPR gRNA sequence
  source 1..20: mol_type = other DNA
cagtggccagccccacttcg

SEQ ID NO: 19370 - DNA, 20 bp, synthetic construct
  misc_feature 1..20: note = CRISPR gRNA sequence
  source 1..20: mol_type = other DNA
gtggccagccccacttcggg

SEQ ID NO: 19371 - DNA, 20 bp, synthetic construct
  misc_feature 1..20: note = CRISPR gRNA sequence
  source 1..20: mol_type = other DNA
ggccagccccacttcgggga

SEQ ID NO: 19372 - DNA, 20 bp, synthetic construct
  misc_feature 1..20: note = CRISPR gRNA sequence
  source 1..20: mol_type = other DNA
ccccacttcggggagagtcc

SEQ ID NO: 19373 - DNA, 20 bp, synthetic construct
  misc_feature 1..20: note = CRISPR gRNA sequence
  source 1..20: mol_type = other DNA
cccacttcggggagagtccc

SEQ ID NO: 19374 - DNA, 20 bp, synthetic construct
  misc_feature 1..20: note = CRISPR gRNA sequence
  source 1..20: mol_type = other DNA
tcggggagagtcccaggccc

SEQ ID NO: 19375 - DNA, 20 bp, synthetic construct
  misc_feature 1..20: note = CRISPR gRNA sequence
  source 1..20: mol_type = other DNA
cggggagagtcccaggcccc

SEQ ID NO: 19376 - DNA, 20 bp, synthetic construct
  misc_feature 1..20: note = CRISPR gRNA sequence
  source 1..20: mol_type = other DNA
gagagtcccaggccccgggc

SEQ ID NO: 19377 - DNA, 20 bp, synthetic construct
  misc_feature 1..20: note = CRISPR gRNA sequence
  source 1..20: mol_type = other DNA
agagtcccaggccccgggcc

SEQ ID NO: 19378 - DNA, 20 bp, synthetic construct
  misc_feature 1..20: note = CRISPR gRNA sequence
  source 1..20: mol_type = other DNA
agtcccaggccccgggccag

SEQ ID NO: 19379 - DNA, 20 bp, synthetic construct
  misc_feature 1..20: note = CRISPR gRNA sequence
  source 1..20: mol_type = other DNA
ccaggccccgggccaggagc

SEQ ID NO: 19380 - DNA, 20 bp, synthetic construct
  misc_feature 1..20: note = CRISPR gRNA sequence
  source 1..20: mol_type = other DNA
caggccccgggccaggagcc

SEQ ID NO: 19381 - DNA, 20 bp, synthetic construct
  misc_feature 1..20: note = CRISPR gRNA sequence
  source 1..20: mol_type = other DNA
ggccccgggccaggagccag

SEQ ID NO: 19382 - DNA, 20 bp, synthetic construct
  misc_feature 1..20: note = CRISPR gRNA sequence
  source 1..20: mol_type = other DNA
ccgggccaggagccaggagc

SEQ ID NO: 19383 - DNA, 20 bp, synthetic construct
  misc_feature 1..20: note = CRISPR gRNA sequence
  source 1..20: mol_type = other DNA
cgggccaggagccaggagct

SEQ ID NO: 19384 - DNA, 20 bp, synthetic construct
  misc_feature 1..20: note = CRISPR gRNA sequence
  source 1..20: mol_type = other DNA
gggccaggagccaggagcta

SEQ ID NO: 19385 - DNA, 20 bp, synthetic construct
  misc_feature 1..20: note = CRISPR gRNA sequence
  source 1..20: mol_type = other DNA
gccaggagccaggagctagg

SEQ ID NO: 19386 - DNA, 20 bp, synthetic construct
  misc_feature 1..20: note = CRISPR gRNA sequence
  source 1..20: mol_type = other DNA
ccaggagctagggagccact

SEQ ID NO: 19387 - DNA, 20 bp, synthetic construct
  misc_feature 1..20: note = CRISPR gRNA sequence
  source 1..20: mol_type = other DNA
caggagctagggagccactt

SEQ ID NO: 19388 - DNA, 20 bp, synthetic construct
  misc_feature 1..20: note = CRISPR gRNA sequence
  source 1..20: mol_type = other DNA
agctagggagccacttgggc

SEQ ID NO: 19389 - DNA, 20 bp, synthetic construct
  misc_feature 1..20: note = CRISPR gRNA sequence
  source 1..20: mol_type = other DNA
cacttgggcaagtgatctgc

SEQ ID NO: 19390 - DNA, 20 bp, synthetic construct
  misc_feature 1..20: note = CRISPR gRNA sequence
  source 1..20: mol_type = other DNA
gcaagtgatctgcaagtcct

SEQ ID NO: 19391 - DNA, 20 bp, synthetic construct
  misc_feature 1..20: note = CRISPR gRNA sequence
  source 1..20: mol_type = other DNA
gatctgcaagtcctgagttg

SEQ ID NO: 19392 - DNA, 20 bp, synthetic construct
  misc_feature 1..20: note = CRISPR gRNA sequence
  source 1..20: mol_type = other DNA
atctgcaagtcctgagttgc

SEQ ID NO: 19393 - DNA, 20 bp, synthetic construct
  misc_feature 1..20: note = CRISPR gRNA sequence
  source 1..20: mol_type = other DNA
tctgcaagtcctgagttgca

SEQ ID NO: 19394 - DNA, 20 bp, synthetic construct
  misc_feature 1..20: note = CRISPR gRNA sequence
  source 1..20: mol_type = other DNA
tgcaagtcctgagttgcagg

SEQ ID NO: 19395 - DNA, 20 bp, synthetic construct
  misc_feature 1..20: note = CRISPR gRNA sequence
  source 1..20: mol_type = other DNA
agggagcttgtccccacccc

SEQ ID NO: 19396 - DNA, 20 bp, synthetic construct
  misc_feature 1..20: note = CRISPR gRNA sequence
  source 1..20: mol_type = other DNA
gggagcttgtccccacccct

SEQ ID NO: 19397 - DNA, 20 bp, synthetic construct
  misc_feature 1..20: note = CRISPR gRNA sequence
  source 1..20: mol_type = other DNA
agcttgtccccacccctggg

SEQ ID NO: 19398 - DNA, 20 bp, synthetic construct
  misc_feature 1..20: note = CRISPR gRNA sequence
  source 1..20: mol_type = other DNA
gcttgtccccacccctgggt

SEQ ID NO: 19399 - DNA, 20 bp, synthetic construct
  misc_feature 1..20: note = CRISPR gRNA sequence
  source 1..20: mol_type = other DNA
gtctctgtttctctccaact

SEQ ID NO: 19400 - DNA, 20 bp, synthetic construct
  misc_feature 1..20: note = CRISPR gRNA sequence
  source 1..20: mol_type = other DNA
ccaactcagtccaaccgtga

SEQ ID NO: 19401 - DNA, 20 bp, synthetic construct
  misc_feature 1..20: note = CRISPR gRNA sequence
  source 1..20: mol_type = other DNA
actcagtccaaccgtgaaag

SEQ ID NO: 19402 - DNA, 20 bp, synthetic construct
  misc_feature 1..20: note = CRISPR gRNA sequence
  source 1..20: mol_type = other DNA
gaaagtggcaaaccacctcc

SEQ ID NO: 19403 - DNA, 20 bp, synthetic construct
  misc_feature 1..20: note = CRISPR gRNA sequence
  source 1..20: mol_type = other DNA
aaagtggcaaaccacctccg

SEQ ID NO: 19404 - DNA, 20 bp, synthetic construct
  misc_feature 1..20: note = CRISPR gRNA sequence
  source 1..20: mol_type = other DNA
aagtggcaaaccacctccga

SEQ ID NO: 19405 - DNA, 20 bp, synthetic construct
  misc_feature 1..20: note = CRISPR gRNA sequence
  source 1..20: mol_type = other DNA
aaaccacctccgagggcaca

SEQ ID NO: 19406 - DNA, 20 bp, synthetic construct
  misc_feature 1..20: note = CRISPR gRNA sequence
  source 1..20: mol_type = other DNA
tccgagggcacatggcccct

SEQ ID NO: 19407 - DNA, 20 bp, synthetic construct
  misc_feature 1..20: note = CRISPR gRNA sequence
  source 1..20: mol_type = other DNA
gggcacatggcccctgagat

SEQ ID NO: 19408 - DNA, 20 bp, synthetic construct
  misc_feature 1..20: note = CRISPR gRNA sequence
  source 1..20: mol_type = other DNA
gcccctgagatgagctaact

SEQ ID NO: 19409 - DNA, 20 bp, synthetic construct
  misc_feature 1..20: note = CRISPR gRNA sequence
  source 1..20: mol_type = other DNA
gctattcactcctctgatgc

SEQ ID NO: 19410 - DNA, 20 bp, synthetic construct
  misc_feature 1..20: note = CRISPR gRNA sequence
  source 1..20: mol_type = other DNA
cactcctctgatgctggccc

SEQ ID NO: 19411 - DNA, 20 bp, synthetic construct
  misc_feature 1..20: note = CRISPR gRNA sequence
  source 1..20: mol_type = other DNA
actcctctgatgctggccct

SEQ ID NO: 19412 - DNA, 20 bp, synthetic construct
  misc_feature 1..20: note = CRISPR gRNA sequence
  source 1..20: mol_type = other DNA
ctcctctgatgctggcccta

SEQ ID NO: 19413 - DNA, 20 bp, synthetic construct
  misc_feature 1..20: note = CRISPR gRNA sequence
  source 1..20: mol_type = other DNA
cctctgatgctggccctagg

SEQ ID NO: 19414 - DNA, 20 bp, synthetic construct
  misc_feature 1..20: note = CRISPR gRNA sequence
  source 1..20: mol_type = other DNA
ctctgatgctggccctaggg

SEQ ID NO: 19415 - DNA, 20 bp, synthetic construct
  misc_feature 1..20: note = CRISPR gRNA sequence
  source 1..20: mol_type = other DNA
tgatgctggccctagggagg

SEQ ID NO: 19416 - DNA, 20 bp, synthetic construct
  misc_feature 1..20: note = CRISPR gRNA sequence
  source 1..20: mol_type = other DNA
atgctggccctagggaggaa

SEQ ID NO: 19417 - DNA, 20 bp, synthetic construct
  misc_feature 1..20: note = CRISPR gRNA sequence
  source 1..20: mol_type = other DNA
gggaggaagagaaaatccct

SEQ ID NO: 19418 - DNA, 20 bp, synthetic construct
  misc_feature 1..20: note = CRISPR gRNA sequence
  source 1..20: mol_type = other DNA
ggaggaagagaaaatccctc

SEQ ID NO: 19419 - DNA, 20 bp, synthetic construct
  misc_feature 1..20: note = CRISPR gRNA sequence
  source 1..20: mol_type = other DNA
aatccctcaggtaccttcca

SEQ ID NO: 19420 - DNA, 20 bp, synthetic construct
  misc_feature 1..20: note = CRISPR gRNA sequence
  source 1..20: mol_type = other DNA
cctcaggtaccttccatgga

SEQ ID NO: 19421 - DNA, 20 bp, synthetic construct
  misc_feature 1..20: note = CRISPR gRNA sequence
  source 1..20: mol_type = other DNA
tgttaccatgaccacacccc

SEQ ID NO: 19422 - DNA, 20 bp, synthetic construct
  misc_feature 1..20: note = CRISPR gRNA sequence
  source 1..20: mol_type = other DNA
catgaccacacccccagccg

SEQ ID NO: 19423 - DNA, 20 bp, synthetic construct
  misc_feature 1..20: note = CRISPR gRNA sequence
  source 1..20: mol_type = other DNA
accacacccccagccgtggc

SEQ ID NO: 19424 - DNA, 20 bp, synthetic construct
  misc_feature 1..20: note = CRISPR gRNA sequence
  source 1..20: mol_type = other DNA
cacacccccagccgtggcaa

SEQ ID NO: 19425 - DNA, 20 bp, synthetic construct
  misc_feature 1..20: note = CRISPR gRNA sequence
  source 1..20: mol_type = other DNA
agccgtggcaagagccctgc

SEQ ID NO: 19426 - DNA, 20 bp, synthetic construct
  misc_feature 1..20: note = CRISPR gRNA sequence
  source 1..20: mol_type = other DNA
agagccctgccggtcctttt

SEQ ID NO: 19427 - DNA, 20 bp, synthetic construct
  misc_feature 1..20: note = CRISPR gRNA sequence
  source 1..20: mol_type = other DNA
agccctgccggtccttttca

SEQ ID NO: 19428 - DNA, 20 bp, synthetic construct
  misc_feature 1..20: note = CRISPR gRNA sequence
  source 1..20: mol_type = other DNA
gccctgccggtccttttcag

SEQ ID NO: 19429 - DNA, 20 bp, synthetic construct
  misc_feature 1..20: note = CRISPR gRNA sequence
  source 1..20: mol_type = other DNA
ccggtccttttcagaggtct

SEQ ID NO: 19430 - DNA, 20 bp, synthetic construct
  misc_feature 1..20: note = CRISPR gRNA sequence
  source 1..20: mol_type = other DNA
cagaggtcttggattcctgc

SEQ ID NO: 19431 - DNA, 20 bp, synthetic construct
  misc_feature 1..20: note = CRISPR gRNA sequence
  source 1..20: mol_type = other DNA
agaggtcttggattcctgct

SEQ ID NO: 19432 - DNA, 20 bp, synthetic construct
  misc_feature 1..20: note = CRISPR gRNA sequence
  source 1..20: mol_type = other DNA
ggattcctgctgggtcctcc

SEQ ID NO: 19433 - DNA, 20 bp, synthetic construct
  misc_feature 1..20: note = CRISPR gRNA sequence
  source 1..20: mol_type = other DNA
gattcctgctgggtcctcca

SEQ ID NO: 19434 - DNA, 20 bp, synthetic construct
  misc_feature 1..20: note = CRISPR gRNA sequence
  source 1..20: mol_type = other DNA
tgctgggtcctccaaggcat

SEQ ID NO: 19435 - DNA, 20 bp, synthetic construct
  misc_feature 1..20: note = CRISPR gRNA sequence
  source 1..20: mol_type = other DNA
cctccaaggcatgagacttt

SEQ ID NO: 19436 - DNA, 20 bp, synthetic construct
  misc_feature 1..20: note = CRISPR gRNA sequence
  source 1..20: mol_type = other DNA
ctccaaggcatgagactttg

SEQ ID NO: 19437 - DNA, 20 bp, synthetic construct
  misc_feature 1..20: note = CRISPR gRNA sequence
  source 1..20: mol_type = other DNA
caaggcatgagactttgagg

SEQ ID NO: 19438 - DNA, 20 bp, synthetic construct
  misc_feature 1..20: note = CRISPR gRNA sequence
  source 1..20: mol_type = other DNA
aggtggtcactttccctttt

SEQ ID NO: 19439 - DNA, 20 bp, synthetic construct
  misc_feature 1..20: note = CRISPR gRNA sequence
  source 1..20: mol_type = other DNA
ggtggtcactttcccttttc

SEQ ID NO: 19440 - DNA, 20 bp, synthetic construct
  misc_feature 1..20: note = CRISPR gRNA sequence
  source 1..20: mol_type = other DNA
caggcctgaatttcctcatc

SEQ ID NO: 19441 - DNA, 20 bp, synthetic construct
  misc_feature 1..20: note = CRISPR gRNA sequence
  source 1..20: mol_type = other DNA
gaatttcctcatctggaatt

SEQ ID NO: 19442 - DNA, 20 bp, synthetic construct
  misc_feature 1..20: note = CRISPR gRNA sequence
  source 1..20: mol_type = other DNA
aatttcctcatctggaattg

SEQ ID NO: 19443 - DNA, 20 bp, synthetic construct
  misc_feature 1..20: note = CRISPR gRNA sequence
  source 1..20: mol_type = other DNA
atttcctcatctggaattga

SEQ ID NO: 19444 - DNA, 20 bp, synthetic construct
  misc_feature 1..20: note = CRISPR gRNA sequence
  source 1..20: mol_type = other DNA
ttcctcatctggaattgagg

SEQ ID NO: 19445 - DNA, 20 bp, synthetic construct
  misc_feature 1..20: note = CRISPR gRNA sequence
  source 1..20: mol_type = other DNA
tcctcatctggaattgaggg

SEQ ID NO: 19446 - DNA, 20 bp, synthetic construct
  misc_feature 1..20: note = CRISPR gRNA sequence
  source 1..20: mol_type = other DNA
cctcatctggaattgaggga

SEQ ID NO: 19447 - DNA, 20 bp, synthetic construct
  misc_feature 1..20: note = CRISPR gRNA sequence
  source 1..20: mol_type = other DNA
ctcatctggaattgagggag

SEQ ID NO: 19448 - DNA, 20 bp, synthetic construct
  misc_feature 1..20: note = CRISPR gRNA sequence
  source 1..20: mol_type = other DNA
tcatctggaattgagggagg

SEQ ID NO: 19449 - DNA, 20 bp, synthetic construct
  misc_feature 1..20: note = CRISPR gRNA sequence
  source 1..20: mol_type = other DNA
ctggaattgagggagggggc

SEQ ID NO: 19450 - DNA, 20 bp, synthetic construct
  misc_feature 1..20: note = CRISPR gRNA sequence
  source 1..20: mol_type = other DNA
tggaattgagggagggggca

SEQ ID NO: 19451 - DNA, 20 bp, synthetic construct
  misc_feature 1..20: note = CRISPR gRNA sequence
  source 1..20: mol_type = other DNA
ccccctccaacactttcccg

SEQ ID NO: 19452 - DNA, 20 bp, synthetic construct
  misc_feature 1..20: note = CRISPR gRNA sequence
  source 1..20: mol_type = other DNA
acactttcccgtagcaactt

SEQ ID NO: 19453 - DNA, 20 bp, synthetic construct
  misc_feature 1..20: note = CRISPR gRNA sequence
  source 1..20: mol_type = other DNA
cactttcccgtagcaactta

SEQ ID NO: 19454 - DNA, 20 bp, synthetic construct
  misc_feature 1..20: note = CRISPR gRNA sequence
  source 1..20: mol_type = other DNA
aaggctgcacccaaccacac

SEQ ID NO: 19455 - DNA, 20 bp, synthetic construct
  misc_feature 1..20: note = CRISPR gRNA sequence
  source 1..20: mol_type = other DNA
gctgcacccaaccacaccgg

SEQ ID NO: 19456 - DNA, 20 bp, synthetic construct
  misc_feature 1..20: note = CRISPR gRNA sequence
  source 1..20: mol_type = other DNA
cacaccggcagacctgtcat

SEQ ID NO: 19457 - DNA, 20 bp, synthetic construct
  misc_feature 1..20: note = CRISPR gRNA sequence
  source 1..20: mol_type = other DNA
gcagacctgtcatcagtctc

SEQ ID NO: 19458 - DNA, 20 bp, synthetic construct
  misc_feature 1..20: note = CRISPR gRNA sequence
  source 1..20: mol_type = other DNA
cagacctgtcatcagtctct

SEQ ID NO: 19459 - DNA, 20 bp, synthetic construct
  misc_feature 1..20: note = CRISPR gRNA sequence
  source 1..20: mol_type = other DNA
gtcatcagtctctgggttca

SEQ ID NO: 19460 - DNA, 20 bp, synthetic construct
  misc_feature 1..20: note = CRISPR gRNA sequence
  source 1..20: mol_type = other DNA
tcaaagcaaaccatacattt

SEQ ID NO: 19461 - DNA, 20 bp, synthetic construct
  misc_feature 1..20: note = CRISPR gRNA sequence
  source 1..20: mol_type = other DNA
caaagcaaaccatacatttc

SEQ ID NO: 19462 - DNA, 20 bp, synthetic construct
  misc_feature 1..20: note = CRISPR gRNA sequence
  source 1..20: mol_type = other DNA
aaagcaaaccatacatttca

SEQ ID NO: 19463 - DNA, 20 bp, synthetic construct
  misc_feature 1..20: note = CRISPR gRNA sequence
  source 1..20: mol_type = other DNA
aagcaaaccatacatttcag

SEQ ID NO: 19464 - DNA, 20 bp, synthetic construct
  misc_feature 1..20: note = CRISPR gRNA sequence
  source 1..20: mol_type = other DNA
gcaaaccatacatttcaggg

SEQ ID NO: 19465 - DNA, 20 bp, synthetic construct
  misc_feature 1..20: note = CRISPR gRNA sequence
  source 1..20: mol_type = other DNA
catacatttcaggggagtct

SEQ ID NO: 19466 - DNA, 20 bp, synthetic construct
  misc_feature 1..20: note = CRISPR gRNA sequence
  source 1..20: mol_type = other DNA
atttcaggggagtctgagaa

SEQ ID NO: 19467 - DNA, 20 bp, synthetic construct
  misc_feature 1..20: note = CRISPR gRNA sequence
  source 1..20: mol_type = other DNA
tttcaggggagtctgagaaa

SEQ ID NO: 19468 - DNA, 20 bp, synthetic construct
  misc_feature 1..20: note = CRISPR gRNA sequence
  source 1..20: mol_type = other DNA
ttcaggggagtctgagaaaa

SEQ ID NO: 19469 - DNA, 20 bp, synthetic construct
  misc_feature 1..20: note = CRISPR gRNA sequence
  source 1..20: mol_type = other DNA
cccctttaaccatccaacaa

SEQ ID NO: 19470 - DNA, 20 bp, synthetic construct
  misc_feature 1..20: note = CRISPR gRNA sequence
  source 1..20: mol_type = other DNA
acagcaatgccaataaaatt

SEQ ID NO: 19471 - DNA, 20 bp, synthetic construct
  misc_feature 1..20: note = CRISPR gRNA sequence
  source 1..20: mol_type = other DNA
caataaaattgagctcctat

SEQ ID NO: 19472 - DNA, 20 bp, synthetic construct
  misc_feature 1..20: note = CRISPR gRNA sequence
  source 1..20: mol_type = other DNA
agctcctatgagctcaattc

SEQ ID NO: 19473 - DNA, 20 bp, synthetic construct
  misc_feature 1..20: note = CRISPR gRNA sequence
  source 1..20: mol_type = other DNA
ttccagttcctataaaatat

SEQ ID NO: 19474 - DNA, 20 bp, synthetic construct
  misc_feature 1..20: note = CRISPR gRNA sequence
  source 1..20: mol_type = other DNA
taaaatattggacactgtgc

SEQ ID NO: 19475 - DNA, 20 bp, synthetic construct
  misc_feature 1..20: note = CRISPR gRNA sequence
  source 1..20: mol_type = other DNA
aaaatattggacactgtgct

SEQ ID NO: 19476 - DNA, 20 bp, synthetic construct
  misc_feature 1..20: note = CRISPR gRNA sequence
  source 1..20: mol_type = other DNA
ctcatcattaccctttcata

SEQ ID NO: 19477 - DNA, 20 bp, synthetic construct
  misc_feature 1..20: note = CRISPR gRNA sequence
  source 1..20: mol_type = other DNA
tcatcattaccctttcatac

SEQ ID NO: 19478 - DNA, 20 bp, synthetic construct
  misc_feature 1..20: note = CRISPR gRNA sequence
  source 1..20: mol_type = other DNA
ctttcatacaggctttccca

SEQ ID NO: 19479 - DNA, 20 bp, synthetic construct
  misc_feature 1..20: note = CRISPR gRNA sequence
  source 1..20: mol_type = other DNA
tttcatacaggctttcccac

SEQ ID NO: 19480 - DNA, 20 bp, synthetic construct
  misc_feature 1..20: note = CRISPR gRNA sequence
  source 1..20: mol_type = other DNA
cacaggtccattgtacactc

SEQ ID NO: 19481 - DNA, 20 bp, synthetic construct
  misc_feature 1..20: note = CRISPR gRNA sequence
  source 1..20: mol_type = other DNA
acaggtccattgtacactcc

SEQ ID NO: 19482 - DNA, 20 bp, synthetic construct
  misc_feature 1..20: note = CRISPR gRNA sequence
  source 1..20: mol_type = other DNA
cactccaggaaaattgactc

SEQ ID NO: 19483 - DNA, 20 bp, synthetic construct
  misc_feature 1..20: note = CRISPR gRNA sequence
  source 1..20: mol_type = other DNA
gagaatgtaaacgacttctt

SEQ ID NO: 19484 - DNA, 20 bp, synthetic construct
  misc_feature 1..20: note = CRISPR gRNA sequence
  source 1..20: mol_type = other DNA
agaatgtaaacgacttcttc

SEQ ID NO: 19485 - DNA, 20 bp, synthetic construct
  misc_feature 1..20: note = CRISPR gRNA sequence
  source 1..20: mol_type = other DNA
gaatgtaaacgacttcttca

SEQ ID NO: 19486 - DNA, 20 bp, synthetic construct
  misc_feature 1..20: note = CRISPR gRNA sequence
  source 1..20: mol_type = other DNA
aatgtaaacgacttcttcag

SEQ ID NO: 19487 - DNA, 20 bp, synthetic construct
  misc_feature 1..20: note = CRISPR gRNA sequence
  source 1..20: mol_type = other DNA
cttcaggggcacacccttcc

SEQ ID NO: 19488 - DNA, 20 bp, synthetic construct
  misc_feature 1..20: note = CRISPR gRNA sequence
  source 1..20: mol_type = other DNA
ggcacacccttcccagccaa

SEQ ID NO: 19489 - DNA, 20 bp, synthetic construct
  misc_feature 1..20: note = CRISPR gRNA sequence
  source 1..20: mol_type = other DNA
acccttcccagccaacggtg

SEQ ID NO: 19490 - DNA, 20 bp, synthetic construct
  misc_feature 1..20: note = CRISPR gRNA sequence
  source 1..20: mol_type = other DNA
tgtagctgccatgctgcctt

SEQ ID NO: 19491 - DNA, 20 bp, synthetic construct
  misc_feature 1..20: note = CRISPR gRNA sequence
  source 1..20: mol_type = other DNA
tagctgccatgctgccttca

SEQ ID NO: 19492 - DNA, 20 bp, synthetic construct
  misc_feature 1..20: note = CRISPR gRNA sequence
  source 1..20: mol_type = other DNA
tgccatgctgccttcagagc

SEQ ID NO: 19493 - DNA, 20 bp, synthetic construct
  misc_feature 1..20: note = CRISPR gRNA sequence
  source 1..20: mol_type = other DNA
gctgccttcagagccggtgc

SEQ ID NO: 19494 - DNA, 20 bp, synthetic construct
  misc_feature 1..20: note = CRISPR gRNA sequence
  source 1..20: mol_type = other DNA
ctgccttcagagccggtgcc

SEQ ID NO: 19495 - DNA, 20 bp, synthetic construct
  misc_feature 1..20: note = CRISPR gRNA sequence
  source 1..20: mol_type = other DNA
ccctttttaaacaacaccat

SEQ ID NO: 19496 - DNA, 20 bp, synthetic construct
  misc_feature 1..20: note = CRISPR gRNA sequence
  source 1..20: mol_type = other DNA
cctttttaaacaacaccatt

SEQ ID NO: 19497 - DNA, 20 bp, synthetic construct
  misc_feature 1..20: note = CRISPR gRNA sequence
  source 1..20: mol_type = other DNA
aaacaacaccattaggaaac

SEQ ID NO: 19498 - DNA, 20 bp, synthetic construct
  misc_feature 1..20: note = CRISPR gRNA sequence
  source 1..20: mol_type = other DNA
aacaacaccattaggaaact

SEQ ID NO: 19499 - DNA, 20 bp, synthetic construct
  misc_feature 1..20: note = CRISPR gRNA sequence
  source 1..20: mol_type = other DNA
acaacaccattaggaaactg

SEQ ID NO: 19500 - DNA, 20 bp, synthetic construct
  misc_feature 1..20: note = CRISPR gRNA sequence
  source 1..20: mol_type = other DNA
caacaccattaggaaactgg

SEQ ID NO: 19501 - DNA, 20 bp, synthetic construct
  misc_feature 1..20: note = CRISPR gRNA sequence
  source 1..20: mol_type = other DNA
aacaccattaggaaactggg

SEQ ID NO: 19502 - DNA, 20 bp, synthetic construct
  misc_feature 1..20: note = CRISPR gRNA sequence
  source 1..20: mol_type = other DNA
caccattaggaaactggggg

SEQ ID NO: 19503 - DNA, 20 bp, synthetic construct
  misc_feature 1..20: note = CRISPR gRNA sequence
  source 1..20: mol_type = other DNA
accattaggaaactgggggg

SEQ ID NO: 19504 - DNA, 20 bp, synthetic construct
  misc_feature 1..20: note = CRISPR gRNA sequence
  source 1..20: mol_type = other DNA
ccattaggaaactgggggga

SEQ ID NO: 19505 - DNA, 20 bp, synthetic construct
  misc_feature 1..20: note = CRISPR gRNA sequence
  source 1..20: mol_type = other DNA
ttaggaaactggggggaggg

SEQ ID NO: 19506 - DNA, 20 bp, synthetic construct
  misc_feature 1..20: note = CRISPR gRNA sequence
  source 1..20: mol_type = other DNA
ggggggagggcagcatccgc

SEQ ID NO: 19507 - DNA, 20 bp, synthetic construct
  misc_feature 1..20: note = CRISPR gRNA sequence
  source 1..20: mol_type = other DNA
cagcatccgccagctctccc

SEQ ID NO: 19508 - DNA, 20 bp, synthetic construct
  misc_feature 1..20: note = CRISPR gRNA sequence
  source 1..20: mol_type = other DNA
gccagctctccccagctgct

SEQ ID NO: 19509 - DNA, 20 bp, synthetic construct
  misc_feature 1..20: note = CRISPR gRNA sequence
  source 1..20: mol_type = other DNA
ccagctctccccagctgctg

SEQ ID NO: 19510 - DNA, 20 bp, synthetic construct
  misc_feature 1..20: note = CRISPR gRNA sequence
  source 1..20: mol_type = other DNA
cagctctccccagctgctga

SEQ ID NO: 19511 - DNA, 20 bp, synthetic construct
  misc_feature 1..20: note = CRISPR gRNA sequence
  source 1..20: mol_type = other DNA
cccagctgctgagggctcaa

SEQ ID NO: 19512 - DNA, 20 bp, synthetic construct
  misc_feature 1..20: note = CRISPR gRNA sequence
  source 1..20: mol_type = other DNA
gggctcaacagctacacctc

SEQ ID NO: 19513 - DNA, 20 bp, synthetic construct
  misc_feature 1..20: note = CRISPR gRNA sequence
  source 1..20: mol_type = other DNA
ggctcaacagctacacctca

SEQ ID NO: 19514 - DNA, 20 bp, synthetic construct
  misc_feature 1..20: note = CRISPR gRNA sequence
  source 1..20: mol_type = other DNA
ctcaaggctgactccaattt

SEQ ID NO: 19515 - DNA, 20 bp, synthetic construct
  misc_feature 1..20: note = CRISPR gRNA sequence
  source 1..20: mol_type = other DNA
ttttggtttccctgcttctc

SEQ ID NO: 19516 - DNA, 20 bp, synthetic construct
  misc_feature 1..20: note = CRISPR gRNA sequence
  source 1..20: mol_type = other DNA
tttggtttccctgcttctct

SEQ ID NO: 19517 - DNA, 20 bp, synthetic construct
  misc_feature 1..20: note = CRISPR gRNA sequence
  source 1..20: mol_type = other DNA
tttccctgcttctctgggta

SEQ ID NO: 19518 - DNA, 20 bp, synthetic construct
  misc_feature 1..20: note = CRISPR gRNA sequence
  source 1..20: mol_type = other DNA
tccctgcttctctgggtatg

SEQ ID NO: 19519 - DNA, 20 bp, synthetic construct
  misc_feature 1..20: note = CRISPR gRNA sequence
  source 1..20: mol_type = other DNA
ctgcttctctgggtatggag

SEQ ID NO: 19520 - DNA, 20 bp, synthetic construct
  misc_feature 1..20: note = CRISPR gRNA sequence
  source 1..20: mol_type = other DNA
gcttctctgggtatggagtg

SEQ ID NO: 19521 - DNA, 20 bp, synthetic construct
  misc_feature 1..20: note = CRISPR gRNA sequence
  source 1..20: mol_type = other DNA
tctgggtatggagtggagtc

SEQ ID NO: 19522 - DNA, 20 bp, synthetic construct
  misc_feature 1..20: note = CRISPR gRNA sequence
  source 1..20: mol_type = other DNA
gggtatggagtggagtctgg

SEQ ID NO: 19523 - DNA, 20 bp, synthetic construct
  misc_feature 1..20: note = CRISPR gRNA sequence
  source 1..20: mol_type = other DNA
gtatggagtggagtctggca

SEQ ID NO: 19524 - DNA, 20 bp, synthetic construct
  misc_feature 1..20: note = CRISPR gRNA sequence
  source 1..20: mol_type = other DNA
tatggagtggagtctggcag

SEQ ID NO: 19525 - DNA, 20 bp, synthetic construct
  misc_feature 1..20: note = CRISPR gRNA sequence
  source 1..20: mol_type = other DNA
ctggcagaggtcccgtcctg

SEQ ID NO: 19526 - DNA, 20 bp, synthetic construct
  misc_feature 1..20: note = CRISPR gRNA sequence
  source 1..20: mol_type = other DNA
ggcagaggtcccgtcctgca

SEQ ID NO: 19527 - DNA, 20 bp, synthetic construct
  misc_feature 1..20: note = CRISPR gRNA sequence
  source 1..20: mol_type = other DNA
gcagaggtcccgtcctgcag

SEQ ID NO: 19528 - DNA, 20 bp, synthetic construct
  misc_feature 1..20: note = CRISPR gRNA sequence
  source 1..20: mol_type = other DNA
cgtcctgcagaggcacccct

SEQ ID NO: 19529 - DNA, 20 bp, synthetic construct
  misc_feature 1..20: note = CRISPR gRNA sequence
  source 1..20: mol_type = other DNA
cacccctcagtatttaccca

SEQ ID NO: 19530 - DNA, 20 bp, synthetic construct
  misc_feature 1..20: note = CRISPR gRNA sequence
  source 1..20: mol_type = other DNA
acccctcagtatttacccaa

SEQ ID NO: 19531 - DNA, 20 bp, synthetic construct
  misc_feature 1..20: note = CRISPR gRNA sequence
  source 1..20: mol_type = other DNA
cccctcagtatttacccaaa

SEQ ID NO: 19532 - DNA, 20 bp, synthetic construct
  misc_feature 1..20: note = CRISPR gRNA sequence
  source 1..20: mol_type = other DNA
cctcagtatttacccaaagg

SEQ ID NO: 19533 - DNA, 20 bp, synthetic construct
  misc_feature 1..20: note = CRISPR gRNA sequence
  source 1..20: mol_type = other DNA
ctcagtatttacccaaaggg

SEQ ID NO: 19534 - DNA, 20 bp, synthetic construct
  misc_feature 1..20: note = CRISPR gRNA sequence
  source 1..20: mol_type = other DNA
gtatttacccaaagggaggc

SEQ ID NO: 19535 - DNA, 20 bp, synthetic construct
  misc_feature 1..20: note = CRISPR gRNA sequence
  source 1..20: mol_type = other DNA
tttacccaaagggaggcgag

SEQ ID NO: 19536 - DNA, 20 bp, synthetic construct
  misc_feature 1..20: note = CRISPR gRNA sequence
  source 1..20: mol_type = other DNA
gaggcgagaagaccttgctg

SEQ ID NO: 19537 - DNA, 20 bp, synthetic construct
  misc_feature 1..20: note = CRISPR gRNA sequence
  source 1..20: mol_type = other DNA
aggcgagaagaccttgctgt

SEQ ID NO: 19538 - DNA, 20 bp, synthetic construct
  misc_feature 1..20: note = CRISPR gRNA sequence
  source 1..20: mol_type = other DNA
agaagaccttgctgtgggcc

SEQ ID NO: 19539 - DNA, 20 bp, synthetic construct
  misc_feature 1..20: note = CRISPR gRNA sequence
  source 1..20: mol_type = other DNA
gaccttgctgtgggccgagc

SEQ ID NO: 19540 - DNA, 20 bp, synthetic construct
  misc_feature 1..20: note = CRISPR gRNA sequence
  source 1..20: mol_type = other DNA
accttgctgtgggccgagcc

SEQ ID NO: 19541 - DNA, 20 bp, synthetic construct
  misc_feature 1..20: note = CRISPR gRNA sequence
  source 1..20: mol_type = other DNA
tgctgtgggccgagccaggc

SEQ ID NO: 19542 - DNA, 20 bp, synthetic construct
  misc_feature 1..20: note = CRISPR gRNA sequence
  source 1..20: mol_type = other DNA
ccgagccaggccagcatgct

SEQ ID NO: 19543 - DNA, 20 bp, synthetic construct
  misc_feature 1..20: note = CRISPR gRNA sequence
  source 1..20: mol_type = other DNA
gagccaggccagcatgctga

SEQ ID NO: 19544 - DNA, 20 bp, synthetic construct
  misc_feature 1..20: note = CRISPR gRNA sequence
  source 1..20: mol_type = other DNA
caggccagcatgctgagagt

SEQ ID NO: 19545 - DNA, 20 bp, synthetic construct
  misc_feature 1..20: note = CRISPR gRNA sequence
  source 1..20: mol_type = other DNA
gttagtgacacactgcccga

SEQ ID NO: 19546 - DNA, 20 bp, synthetic construct
  misc_feature 1..20: note = CRISPR gRNA sequence
  source 1..20: mol_type = other DNA
ctgcccgaaagtctgacttc

SEQ ID NO: 19547 - DNA, 20 bp, synthetic construct
  misc_feature 1..20: note = CRISPR gRNA sequence
  source 1..20: mol_type = other DNA
gtctgacttctagaaccttt

SEQ ID NO: 19548 - DNA, 20 bp, synthetic construct
  misc_feature 1..20: note = CRISPR gRNA sequence
  source 1..20: mol_type = other DNA
aacctttcggtgctgataca

SEQ ID NO: 19549 - DNA, 20 bp, synthetic construct
  misc_feature 1..20: note = CRISPR gRNA sequence
  source 1..20: mol_type = other DNA
ctgatacatggttcatactc

SEQ ID NO: 19550 - DNA, 20 bp, synthetic construct
  misc_feature 1..20: note = CRISPR gRNA sequence
  source 1..20: mol_type = other DNA
tggttcatactccagacacc

SEQ ID NO: 19551 - DNA, 20 bp, synthetic construct
  misc_feature 1..20: note = CRISPR gRNA sequence
  source 1..20: mol_type = other DNA
ccagacacctggctgacctg

SEQ ID NO: 19552 - DNA, 20 bp, synthetic construct
  misc_feature 1..20: note = CRISPR gRNA sequence
  source 1..20: mol_type = other DNA
gctgacctgaagtctccctc

SEQ ID NO: 19553 - DNA, 20 bp, synthetic construct
  misc_feature 1..20: note = CRISPR gRNA sequence
  source 1..20: mol_type = other DNA
gacctgaagtctccctccgg

SEQ ID NO: 19554 - DNA, 20 bp, synthetic construct
  misc_feature 1..20: note = CRISPR gRNA sequence
  source 1..20: mol_type = other DNA
ctgaagtctccctccggtgg

SEQ ID NO: 19555 - DNA, 20 bp, synthetic construct
  misc_feature 1..20: note = CRISPR gRNA sequence
  source 1..20: mol_type = other DNA
tgaagtctccctccggtgga

SEQ ID NO: 19556 - DNA, 20 bp, synthetic construct
  misc_feature 1..20: note = CRISPR gRNA sequence
  source 1..20: mol_type = other DNA
ctccctccggtggaaggaaa

SEQ ID NO: 19557 - DNA, 20 bp, synthetic construct
  misc_feature 1..20: note = CRISPR gRNA sequence
  source 1..20: mol_type = other DNA
aactctttcacatcttccaa

SEQ ID NO: 19558 - DNA, 20 bp, synthetic construct
  misc_feature 1..20: note = CRISPR gRNA sequence
  source 1..20: mol_type = other DNA
catcttccaatggcctgccc

SEQ ID NO: 19559 - DNA, 20 bp, synthetic construct
  misc_feature 1..20: note = CRISPR gRNA sequence
  source 1..20: mol_type = other DNA
cttccaatggcctgccccag

SEQ ID NO: 19560 - DNA, 20 bp, synthetic construct
  misc_feature 1..20: note = CRISPR gRNA sequence
  source 1..20: mol_type = other DNA
ttccaatggcctgccccagc

SEQ ID NO: 19561 - DNA, 20 bp, synthetic construct
  misc_feature 1..20: note = CRISPR gRNA sequence
  source 1..20: mol_type = other DNA
tggcctgccccagcaggaca

SEQ ID NO: 19562 - DNA, 20 bp, synthetic construct
  misc_feature 1..20: note = CRISPR gRNA sequence
  source 1..20: mol_type = other DNA
cctcacccccatccccaatt

SEQ ID NO: 19563 - DNA, 20 bp, synthetic construct
  misc_feature 1..20: note = CRISPR gRNA sequence
  source 1..20: mol_type = other DNA
cccccatccccaattcagaa

SEQ ID NO: 19564 - DNA, 20 bp, synthetic construct
  misc_feature 1..20: note = CRISPR gRNA sequence
  source 1..20: mol_type = other DNA
gaatggtttctctgtttatc

SEQ ID NO: 19565 - DNA, 20 bp, synthetic construct
  misc_feature 1..20: note = CRISPR gRNA sequence
  source 1..20: mol_type = other DNA
gtttctctgtttatctggaa

SEQ ID NO: 19566 - DNA, 20 bp, synthetic construct
  misc_feature 1..20: note = CRISPR gRNA sequence
  source 1..20: mol_type = other DNA
tctctgtttatctggaatgg

SEQ ID NO: 19567 - DNA, 20 bp, synthetic construct
  misc_feature 1..20: note = CRISPR gRNA sequence
  source 1..20: mol_type = other DNA
ctctgtttatctggaatggc

SEQ ID NO: 19568 - DNA, 20 bp, synthetic construct
  misc_feature 1..20: note = CRISPR gRNA sequence
  source 1..20: mol_type = other DNA
tttatctggaatggcaggac

SEQ ID NO: 19569 - DNA, 20 bp, synthetic construct
  misc_feature 1..20: note = CRISPR gRNA sequence
  source 1..20: mol_type = other DNA
ctggaatggcaggaccagct

SEQ ID NO: 19570 - DNA, 20 bp, synthetic construct
  misc_feature 1..20: note = CRISPR gRNA sequence
  source 1..20: mol_type = other DNA
ctgagactgcacgctaaatt

SEQ ID NO: 19571 - DNA, 20 bp, synthetic construct
  misc_feature 1..20: note = CRISPR gRNA sequence
  source 1..20: mol_type = other DNA
gctaaattaagatgctttcc

SEQ ID NO: 19572 - DNA, 20 bp, synthetic construct
  misc_feature 1..20: note = CRISPR gRNA sequence
  source 1..20: mol_type = other DNA
ctttcccggcctttttacct

SEQ ID NO: 19573 - DNA, 20 bp, synthetic construct
  misc_feature 1..20: note = CRISPR gRNA sequence
  source 1..20: mol_type = other DNA
tttcccggcctttttacctt

SEQ ID NO: 19574 - DNA, 20 bp, synthetic construct
  misc_feature 1..20: note = CRISPR gRNA sequence
  source 1..20: mol_type = other DNA
ttcccggcctttttaccttg

SEQ ID NO: 19575 - DNA, 20 bp, synthetic construct
  misc_feature 1..20: note = CRISPR gRNA sequence
  source 1..20: mol_type = other DNA
tttttaccttggggctctga

SEQ ID NO: 19576 - DNA, 20 bp, synthetic construct
  misc_feature 1..20: note = CRISPR gRNA sequence
  source 1..20: mol_type = other DNA
ttttaccttggggctctgac

SEQ ID NO: 19577 - DNA, 20 bp, synthetic construct
  misc_feature 1..20: note = CRISPR gRNA sequence
  source 1..20: mol_type = other DNA
taccttggggctctgacagg

SEQ ID NO: 19578 - DNA, 20 bp, synthetic construct
  misc_feature 1..20: note = CRISPR gRNA sequence
  source 1..20: mol_type = other DNA
accttggggctctgacaggt

SEQ ID NO: 19579 - DNA, 20 bp, synthetic construct
  misc_feature 1..20: note = CRISPR gRNA sequence
  source 1..20: mol_type = other DNA
gggctctgacaggtaggacc

SEQ ID NO: 19580 - DNA, 20 bp, synthetic construct
  misc_feature 1..20: note = CRISPR gRNA sequence
  source 1..20: mol_type = other DNA
ctctgacaggtaggacccag

SEQ ID NO: 19581 - DNA, 20 bp, synthetic construct
  misc_feature 1..20: note = CRISPR gRNA sequence
  source 1..20: mol_type = other DNA
tctgacaggtaggacccagc

SEQ ID NO: 19582 - DNA, 20 bp, synthetic construct
  misc_feature 1..20: note = CRISPR gRNA sequence
  source 1..20: mol_type = other DNA
ctgacaggtaggacccagca

SEQ ID NO: 19583 - DNA, 20 bp, synthetic construct
  misc_feature 1..20: note = CRISPR gRNA sequence
  source 1..20: mol_type = other DNA
aggtaggacccagcagggcg

SEQ ID NO: 19584 - DNA, 20 bp, synthetic construct
  misc_feature 1..20: note = CRISPR gRNA sequence
  source 1..20: mol_type = other DNA
gtaggacccagcagggcgtg

SEQ ID NO: 19585 - DNA, 20 bp, synthetic construct
  misc_feature 1..20: note = CRISPR gRNA sequence
  source 1..20: mol_type = other DNA
gacccagcagggcgtggagc

SEQ ID NO: 19586 - DNA, 20 bp, synthetic construct
  misc_feature 1..20: note = CRISPR gRNA sequence
  source 1..20: mol_type = other DNA
acccagcagggcgtggagcc

SEQ ID NO: 19587 - DNA, 20 bp, synthetic construct
  misc_feature 1..20: note = CRISPR gRNA sequence
  source 1..20: mol_type = other DNA
gagccaggcaacgcattgtg

SEQ ID NO: 19588 - DNA, 20 bp, synthetic construct
  misc_feature 1..20: note = CRISPR gRNA sequence
  source 1..20: mol_type = other DNA
agccaggcaacgcattgtgt

SEQ ID NO: 19589 - DNA, 20 bp, synthetic construct
  misc_feature 1..20: note = CRISPR gRNA sequence
  source 1..20: mol_type = other DNA
aacgcattgtgtaggaatcc

SEQ ID NO: 19590 - DNA, 20 bp, synthetic construct
  misc_feature 1..20: note = CRISPR gRNA sequence
  source 1..20: mol_type = other DNA
cattgtgtaggaatcccagc

SEQ ID NO: 19591 - DNA, 20 bp, synthetic construct
  misc_feature 1..20: note = CRISPR gRNA sequence
  source 1..20: mol_type = other DNA
attgtgtaggaatcccagcc

SEQ ID NO: 19592 - DNA, 20 bp, synthetic construct
  misc_feature 1..20: note = CRISPR gRNA sequence
  source 1..20: mol_type = other DNA
gtgtaggaatcccagccagg

SEQ ID NO: 19593 - DNA, 20 bp, synthetic construct
  misc_feature 1..20: note = CRISPR gRNA sequence
  source 1..20: mol_type = other DNA
taggaatcccagccaggcag

SEQ ID NO: 19594 - DNA, 20 bp, synthetic construct
  misc_feature 1..20: note = CRISPR gRNA sequence
  source 1..20: mol_type = other DNA
cccagccaggcagcagctcc

SEQ ID NO: 19595 - DNA, 20 bp, synthetic construct
  misc_feature 1..20: note = CRISPR gRNA sequence
  source 1..20: mol_type = other DNA
cagccaggcagcagctcccg

SEQ ID NO: 19596 - DNA, 20 bp, synthetic construct
  misc_feature 1..20: note = CRISPR gRNA sequence
  source 1..20: mol_type = other DNA
aggcagcagctcccggagtc

SEQ ID NO: 19597 - DNA, 20 bp, synthetic construct
  misc_feature 1..20: note = CRISPR gRNA sequence
  source 1..20: mol_type = other DNA
cagcagctcccggagtctgg

SEQ ID NO: 19598 - DNA, 20 bp, synthetic construct
  misc_feature 1..20: note = CRISPR gRNA sequence
  source 1..20: mol_type = other DNA
gcagcccctcctcgtgccct

SEQ ID NO: 19599 - DNA, 20 bp, synthetic construct
  misc_feature 1..20: note = CRISPR gRNA sequence
  source 1..20: mol_type = other DNA
ctcgtgccctcagcttcccc

SEQ ID NO: 19600 - DNA, 20 bp, synthetic construct
  misc_feature 1..20: note = CRISPR gRNA sequence
  source 1..20: mol_type = other DNA
tcgtgccctcagcttcccca

SEQ ID NO: 19601 - DNA, 20 bp, synthetic construct
  misc_feature 1..20: note = CRISPR gRNA sequence
  source 1..20: mol_type = other DNA
agcttccccaaggatgcctt

SEQ ID NO: 19602 - DNA, 20 bp, synthetic construct
  misc_feature 1..20: note = CRISPR gRNA sequence
  source 1..20: mol_type = other DNA
caaggatgccttcggatgcc

SEQ ID NO: 19603 - DNA, 20 bp, synthetic construct
  misc_feature 1..20: note = CRISPR gRNA sequence
  source 1..20: mol_type = other DNA
atgccttcggatgcccagct

SEQ ID NO: 19604 - DNA, 20 bp, synthetic construct
  misc_feature 1..20: note = CRISPR gRNA sequence
  source 1..20: mol_type = other DNA
ccttcggatgcccagctcag

SEQ ID NO: 19605 - DNA, 20 bp, synthetic construct
  misc_feature 1..20: note = CRISPR gRNA sequence
  source 1..20: mol_type = other DNA
tccgggagctgctgcctggc

SEQ ID NO: 19606 - DNA, 20 bp, synthetic construct
  misc_feature 1..20: note = CRISPR gRNA sequence
  source 1..20: mol_type = other DNA
ttgcctggctccacgccctg

SEQ ID NO: 19607 - DNA, 20 bp, synthetic construct
  misc_feature 1..20: note = CRISPR gRNA sequence
  source 1..20: mol_type = other DNA
agataaacagagaaaccatt

SEQ ID NO: 19608 - DNA, 20 bp, synthetic construct
  misc_feature 1..20: note = CRISPR gRNA sequence
  source 1..20: mol_type = other DNA
cagagaaaccattctgaatt

SEQ ID NO: 19609 - DNA, 20 bp, synthetic construct
  misc_feature 1..20: note = CRISPR gRNA sequence
  source 1..20: mol_type = other DNA
aaccattctgaattggggat

SEQ ID NO: 19610 - DNA, 20 bp, synthetic construct
  misc_feature 1..20: note = CRISPR gRNA sequence
  source 1..20: mol_type = other DNA
tctgaattggggatgggggt

SEQ ID NO: 19611 - DNA, 20 bp, synthetic construct
  misc_feature 1..20: note = CRISPR gRNA sequence
  source 1..20: mol_type = other DNA
atgggggtgaggatgggaac

SEQ ID NO: 19612 - DNA, 20 bp, synthetic construct
  misc_feature 1..20: note = CRISPR gRNA sequence
  source 1..20: mol_type = other DNA
caggccattggaagatgtga

SEQ ID NO: 19613 - DNA, 20 bp, synthetic construct
  misc_feature 1..20: note = CRISPR gRNA sequence
  source 1..20: mol_type = other DNA
cttcaggtcagccaggtgtc

SEQ ID NO: 19614 - DNA, 20 bp, synthetic construct
  misc_feature 1..20: note = CRISPR gRNA sequence
  source 1..20: mol_type = other DNA
caaggtcttctcgcctccct

SEQ ID NO: 19615 - DNA, 20 bp, synthetic construct
  misc_feature 1..20: note = CRISPR gRNA sequence
  source 1..20: mol_type = other DNA
ctccctttgggtaaatactg

SEQ ID NO: 19616 - DNA, 20 bp, synthetic construct
  misc_feature 1..20: note = CRISPR gRNA sequence
  source 1..20: mol_type = other DNA
agaagcagggaaaccaaaat

SEQ ID NO: 19617 - DNA, 20 bp, synthetic construct
  misc_feature 1..20: note = CRISPR gRNA sequence
  source 1..20: mol_type = other DNA
tcagcagctggggagagctg

SEQ ID NO: 19618 - DNA, 20 bp, synthetic construct
  misc_feature 1..20: note = CRISPR gRNA sequence
  source 1..20: mol_type = other DNA
tcctaatggtgttgtttaaa

SEQ ID NO: 19619 - DNA, 20 bp, synthetic construct
  misc_feature 1..20: note = CRISPR gRNA sequence
  source 1..20: mol_type = other DNA
cagctacaccgttggctggg

SEQ ID NO: 19620 - DNA, 20 bp, synthetic construct
  misc_feature 1..20: note = CRISPR gRNA sequence
  source 1..20: mol_type = other DNA
tgaagaagtcgtttacattc

SEQ ID NO: 19621 - DNA, 20 bp, synthetic construct
  misc_feature 1..20: note = CRISPR gRNA sequence
  source 1..20: mol_type = other DNA
cattctcgagtcaattttcc

SEQ ID NO: 19622 - DNA, 20 bp, synthetic construct
  misc_feature 1..20: note = CRISPR gRNA sequence
  source 1..20: mol_type = other DNA
ctgtgggaaagcctgtatga

SEQ ID NO: 19623 - DNA, 20 bp, synthetic construct
  misc_feature 1..20: note = CRISPR gRNA sequence
  source 1..20: mol_type = other DNA
gtccaatattttataggaac

SEQ ID NO: 19624 - DNA, 20 bp, synthetic construct
  misc_feature 1..20: note = CRISPR gRNA sequence
  source 1..20: mol_type = other DNA
ttttattggcattgctgttg

SEQ ID NO: 19625 - DNA, 20 bp, synthetic construct
  misc_feature 1..20: note = CRISPR gRNA sequence
  source 1..20: mol_type = other DNA
tgctgttgttggatggttaa

SEQ ID NO: 19626 - DNA, 20 bp, synthetic construct
  misc_feature 1..20: note = CRISPR gRNA sequence
  source 1..20: mol_type = other DNA
tgacaggtctgccggtgtgg

SEQ ID NO: 19627 - DNA, 20 bp, synthetic construct
  misc_feature 1..20: note = CRISPR gRNA sequence
  source 1..20: mol_type = other DNA
catgccttggaggacccagc

SEQ ID NO: 19628 - DNA, 20 bp, synthetic construct
  misc_feature 1..20: note = CRISPR gRNA sequence
  source 1..20: mol_type = other DNA
gcagggctcttgccacggct

SEQ ID NO: 19629 - DNA, 20 bp, synthetic construct
  misc_feature 1..20: note = CRISPR gRNA sequence
  source 1..20: mol_type = other DNA
ccatccatggaaggtacctg

SEQ ID NO: 19630 - DNA, 20 bp, synthetic construct
  misc_feature 1..20: note = CRISPR gRNA sequence
  source 1..20: mol_type = other DNA
ctccctagggccagcatcag

SEQ ID NO: 19631 - DNA, 20 bp, synthetic construct
  misc_feature 1..20: note = CRISPR gRNA sequence
  source 1..20: mol_type = other DNA
ctagggccagcatcagagga

SEQ ID NO: 19632 - DNA, 20 bp, synthetic construct
  misc_feature 1..20: note = CRISPR gRNA sequence
  source 1..20: mol_type = other DNA
ttgccactttcacggttgga

SEQ ID NO: 19633 - DNA, 20 bp, synthetic construct
  misc_feature 1..20: note = CRISPR gRNA sequence
  source 1..20: mol_type = other DNA
agagaaacagagacccaccc

SEQ ID NO: 19634 - DNA, 20 bp, synthetic construct
  misc_feature 1..20: note = CRISPR gRNA sequence
  source 1..20: mol_type = other DNA
cgactggaggcagggacctc

SEQ ID NO: 19635 - DNA, 20 bp, synthetic construct
  misc_feature 1..20: note = CRISPR gRNA sequence
  source 1..20: mol_type = other DNA
tcttggatgccccaggcagt

SEQ ID NO: 19636 - DNA, 20 bp, synthetic construct
  misc_feature 1..20: note = CRISPR gRNA sequence
  source 1..20: mol_type = other DNA
actgcggggaggcggggagg

SEQ ID NO: 19637 - DNA, 20 bp, synthetic construct
  misc_feature 1..20: note = CRISPR gRNA sequence
  source 1..20: mol_type = other DNA
gtaacccctaaggtcgggct

SEQ ID NO: 19638 - DNA, 20 bp, synthetic construct
  misc_feature 1..20: note = CRISPR gRNA sequence
  source 1..20: mol_type = other DNA
aggtcacacagcaagtctgg

SEQ ID NO: 19639 - DNA, 20 bp, synthetic construct
  misc_feature 1..20: note = CRISPR gRNA sequence
  source 1..20: mol_type = other DNA
cagcaagtctgggaggatgg

SEQ ID NO: 19640 - DNA, 20 bp, synthetic construct
  misc_feature 1..20: note = CRISPR gRNA sequence
  source 1..20: mol_type = other DNA
agtctgggaggatgggggga

SEQ ID NO: 19641 - DNA, 20 bp, synthetic construct
  misc_feature 1..20: note = CRISPR gRNA sequence
  source 1..20: mol_type = other DNA
ccagagctccggggccgtgg

SEQ ID NO: 19642 - DNA, 20 bp, synthetic construct
  misc_feature 1..20: note = CRISPR gRNA sequence
  source 1..20: mol_type = other DNA
cttggccgactccgcgcgcc

SEQ ID NO: 19643 - DNA, 20 bp, synthetic construct
  misc_feature 1..20: note = CRISPR gRNA sequence
  source 1..20: mol_type = other DNA
cctgagcttcactttccctg

SEQ ID NO: 19644 - DNA, 20 bp, synthetic construct
  misc_feature 1..20: note = CRISPR gRNA sequence
  source 1..20: mol_type = other DNA
tcatattccatctctaactc

SEQ ID NO: 19645 - DNA, 20 bp, synthetic construct
  misc_feature 1..20: note = CRISPR gRNA sequence
  source 1..20: mol_type = other DNA
ccatctctaactctggaatc

SEQ ID NO: 19646 - DNA, 20 bp, synthetic construct
  misc_feature 1..20: note = CRISPR gRNA sequence
  source 1..20: mol_type = other DNA
gggagccaaacctttaacca

SEQ ID NO: 19647 - DNA, 20 bp, synthetic construct
  misc_feature 1..20: note = CRISPR gRNA sequence
  source 1..20: mol_type = other DNA
ccaaacctttaaccagagga

SEQ ID NO: 19648 - DNA, 20 bp, synthetic construct
  misc_feature 1..20: note = CRISPR gRNA sequence
  source 1..20: mol_type = other DNA
cgaaggtgtgtgttgttggg

SEQ ID NO: 19649 - DNA, 20 bp, synthetic construct
  misc_feature 1..20: note = CRISPR gRNA sequence
  source 1..20: mol_type = other DNA
gttgttgggaggggtggggg

SEQ ID NO: 19650 - DNA, 20 bp, synthetic construct
  misc_feature 1..20: note = CRISPR gRNA sequence
  source 1..20: mol_type = other DNA
ctctacctcgctttggggcc

SEQ ID NO: 19651 - DNA, 20 bp, synthetic construct
  misc_feature 1..20: note = CRISPR gRNA sequence
  source 1..20: mol_type = other DNA
gcgccccggaaagccagcgt

SEQ ID NO: 19652 - DNA, 20 bp, synthetic construct
  misc_feature 1..20: note = CRISPR gRNA sequence
  source 1..20: mol_type = other DNA
gaaagccagcgtgcgaatgc

SEQ ID NO: 19653 - DNA, 20 bp, synthetic construct
  misc_feature 1..20: note = CRISPR gRNA sequence
  source 1..20: mol_type = other DNA
cagcgtgcgaatgccggggt

SEQ ID NO: 19654 - DNA, 20 bp, synthetic construct
  misc_feature 1..20: note = CRISPR gRNA sequence
  source 1..20: mol_type = other DNA
gccggggtgggagtgggaga

SEQ ID NO: 19655 - DNA, 20 bp, synthetic construct
  misc_feature 1..20: note = CRISPR gRNA sequence
  source 1..20: mol_type = other DNA
agtgggagattggatctccc

SEQ ID NO: 19656 - DNA, 20 bp, synthetic construct
  misc_feature 1..20: note = CRISPR gRNA sequence
  source 1..20: mol_type = other DNA
tccctggggtccaggaaagc

SEQ ID NO: 19657 - DNA, 20 bp, synthetic construct
  misc_feature 1..20: note = CRISPR gRNA sequence
  source 1..20: mol_type = other DNA
tcttaaaagccgcggtcctc

SEQ ID NO: 19658 - DNA, 20 bp, synthetic construct
  misc_feature 1..20: note = CRISPR gRNA sequence
  source 1..20: mol_type = other DNA
ctccctccccagccgcagcc

SEQ ID NO: 19659 - DNA, 20 bp, synthetic construct
  misc_feature 1..20: note = CRISPR gRNA sequence
  source 1..20: mol_type = other DNA
aaaataaataaatacttctc

SEQ ID NO: 19660 - DNA, 20 bp, synthetic construct
  misc_feature 1..20: note = CRISPR gRNA sequence
  source 1..20: mol_type = other DNA
gcaaacccccggctccctta

SEQ ID NO: 19661 - DNA, 20 bp, synthetic construct
  misc_feature 1..20: note = CRISPR gRNA sequence
  source 1..20: mol_type = other DNA
aatctcagagcgtttggagg

SEQ ID NO: 19662 - DNA, 20 bp, synthetic construct
  misc_feature 1..20: note = CRISPR gRNA sequence
  source 1..20: mol_type = other DNA
ggcagggtctttggagatga

SEQ ID NO: 19663 - DNA, 20 bp, synthetic construct
  misc_feature 1..20: note = CRISPR gRNA sequence
  source 1..20: mol_type = other DNA
tctttggagatgactgagtg

SEQ ID NO: 19664 - DNA, 20 bp, synthetic construct
  misc_feature 1..20: note = CRISPR gRNA sequence
  source 1..20: mol_type = other DNA
ccccacacatgaacatcacc

SEQ ID NO: 19665 - DNA, 20 bp, synthetic construct
  misc_feature 1..20: note = CRISPR gRNA sequence
  source 1..20: mol_type = other DNA
cctgggatgatcaacctgtt

SEQ ID NO: 19666 - DNA, 20 bp, synthetic construct
  misc_feature 1..20: note = CRISPR gRNA sequence
  source 1..20: mol_type = other DNA
caggcccggttggctaggcc

SEQ ID NO: 19667 - DNA, 20 bp, synthetic construct
  misc_feature 1..20: note = CRISPR gRNA sequence
  source 1..20: mol_type = other DNA
tacaaaacctctatcagaaa

SEQ ID NO: 19668 - DNA, 20 bp, synthetic construct
  misc_feature 1..20: note = CRISPR gRNA sequence
  source 1..20: mol_type = other DNA
tagcaagcagtttgcagacg

SEQ ID NO: 19669 - DNA, 20 bp, synthetic construct
  misc_feature 1..20: note = CRISPR gRNA sequence
  source 1..20: mol_type = other DNA
ctcagataccttgagaagag

SEQ ID NO: 19670 - DNA, 20 bp, synthetic construct
  misc_feature 1..20: note = CRISPR gRNA sequence
  source 1..20: mol_type = other DNA
gaaattaacccaaggaaact

SEQ ID NO: 19671 - DNA, 20 bp, synthetic construct
  misc_feature 1..20: note = CRISPR gRNA sequence
  source 1..20: mol_type = other DNA
gacttagcctcagatttgcc

SEQ ID NO: 19672 - DNA, 20 bp, synthetic construct
  misc_feature 1..20: note = CRISPR gRNA sequence
  source 1..20: mol_type = other DNA
ctctgaggttcatctgtaaa

SEQ ID NO: 19673 - DNA, 20 bp, synthetic construct
  misc_feature 1..20: note = CRISPR gRNA sequence
  source 1..20: mol_type = other DNA
agcactttagaaaaccacca

SEQ ID NO: 19674 - DNA, 20 bp, synthetic construct
  misc_feature 1..20: note = CRISPR gRNA sequence
  source 1..20: mol_type = other DNA
ccaaagaatattcatgcatt

SEQ ID NO: 19675 - DNA, 20 bp, synthetic construct
  misc_feature 1..20: note = CRISPR gRNA sequence
  source 1..20: mol_type = other DNA
ataattattatagatcctaa

SEQ ID NO: 19676 - DNA, 20 bp, synthetic construct
  misc_feature 1..20: note = CRISPR gRNA sequence
  source 1..20: mol_type = other DNA
tagcactttgggaggccgag

SEQ ID NO: 19677 - DNA, 20 bp, synthetic construct
  misc_feature 1..20: note = CRISPR gRNA sequence
  source 1..20: mol_type = other DNA
actttgggaggccgaggcgg

SEQ ID NO: 19678 - DNA, 20 bp, synthetic construct
  misc_feature 1..20: note = CRISPR gRNA sequence
  source 1..20: mol_type = other DNA
cgggtggattgcttgaggcc

SEQ ID NO: 19679 - DNA, 20 bp, synthetic construct
  misc_feature 1..20: note = CRISPR gRNA sequence
  source 1..20: mol_type = other DNA
tacttgggaggctgaggcac

SEQ ID NO: 19680 - DNA, 20 bp, synthetic construct
  misc_feature 1..20: note = CRISPR gRNA sequence
  source 1..20: mol_type = other DNA
aatcacttgaacccaagagg

SEQ ID NO: 19681 - DNA, 20 bp, synthetic construct
  misc_feature 1..20: note = CRISPR gRNA sequence
  source 1..20: mol_type = other DNA
ctctagacaccgcctataaa

SEQ ID NO: 19682 - DNA, 20 bp, synthetic construct
  misc_feature 1..20: note = CRISPR gRNA sequence
  source 1..20: mol_type = other DNA
tgtgtaattcctttctatgg

SEQ ID NO: 19683 - DNA, 20 bp, synthetic construct
  misc_feature 1..20: note = CRISPR gRNA sequence
  source 1..20: mol_type = other DNA
gcggaatagtattctaatat

SEQ ID NO: 19684 - DNA, 20 bp, synthetic construct
  misc_feature 1..20: note = CRISPR gRNA sequence
  source 1..20: mol_type = other DNA
attcatttgttgatagacac

SEQ ID NO: 19685 - DNA, 20 bp, synthetic construct
  misc_feature 1..20: note = CRISPR gRNA sequence
  source 1..20: mol_type = other DNA
gttcctacctcttgactatt

SEQ ID NO: 19686 - DNA, 20 bp, synthetic construct
  misc_feature 1..20: note = CRISPR gRNA sequence
  source 1..20: mol_type = other DNA
tgaataatcttgctaggtac

SEQ ID NO: 19687 - DNA, 20 bp, synthetic construct
  misc_feature 1..20: note = CRISPR gRNA sequence
  source 1..20: mol_type = other DNA
aaaaattgtaaagatggaag

SEQ ID NO: 19688 - DNA, 20 bp, synthetic construct
  misc_feature 1..20: note = CRISPR gRNA sequence
  source 1..20: mol_type = other DNA
aatgcctgcagtttgggaaa

SEQ ID NO: 19689 - DNA, 20 bp, synthetic construct
  misc_feature 1..20: note = CRISPR gRNA sequence
  source 1..20: mol_type = other DNA
gctattgtaaaatctatgct

SEQ ID NO: 19690 - DNA, 20 bp, synthetic construct
  misc_feature 1..20: note = CRISPR gRNA sequence
  source 1..20: mol_type = other DNA
acttcaggaaggaaagatat

SEQ ID NO: 19691 - DNA, 20 bp, synthetic construct
  misc_feature 1..20: note = CRISPR gRNA sequence
  source 1..20: mol_type = other DNA
atcaccttgggaggtcaagg

SEQ ID NO: 19692 - DNA, 20 bp, synthetic construct
  misc_feature 1..20: note = CRISPR gRNA sequence
  source 1..20: mol_type = other DNA
caggatgatggcttgagacc

SEQ ID NO: 19693 - DNA, 20 bp, synthetic construct
  misc_feature 1..20: note = CRISPR gRNA sequence
  source 1..20: mol_type = other DNA
actttgggaggctgaggccg

SEQ ID NO: 19694 - DNA, 20 bp, synthetic construct
  misc_feature 1..20: note = CRISPR gRNA sequence
  source 1..20: mol_type = other DNA
gctgaggccggtggatcacc

SEQ ID NO: 19695 - DNA, 20 bp, synthetic construct
  misc_feature 1..20: note = CRISPR gRNA sequence
  source 1..20: mol_type = other DNA
ccggtggatcacctgggatc

SEQ ID NO: 19696 - DNA, 20 bp, synthetic construct
  misc_feature 1..20: note = CRISPR gRNA sequence
  source 1..20: mol_type = other DNA
tcctaaaaatacaaaattag

SEQ ID NO: 19697 - DNA, 20 bp, synthetic construct
  misc_feature 1..20: note = CRISPR gRNA sequence
  source 1..20: mol_type = other DNA
tactcggtaggctggtggag

SEQ ID NO: 19698 - DNA, 20 bp, synthetic construct
  misc_feature 1..20: note = CRISPR gRNA sequence
  source 1..20: mol_type = other DNA
tgcactccagcctgggcaac

SEQ ID NO: 19699 - DNA, 20 bp, synthetic construct
  misc_feature 1..20: note = CRISPR gRNA sequence
  source 1..20: mol_type = other DNA
tgggcccggctgcagactcc

SEQ ID NO: 19700 - DNA, 20 bp, synthetic construct
  misc_feature 1..20: note = CRISPR gRNA sequence
  source 1..20: mol_type = other DNA
ccggctgcagactccctgaa

SEQ ID NO: 19701 - DNA, 20 bp, synthetic construct
  misc_feature 1..20: note = CRISPR gRNA sequence
  source 1..20: mol_type = other DNA
actccctgaatagaatcact

SEQ ID NO: 19702 - DNA, 20 bp, synthetic construct
  misc_feature 1..20: note = CRISPR gRNA sequence
  source 1..20: mol_type = other DNA
gactggctcgtggttcatct

SEQ ID NO: 19703 - DNA, 20 bp, synthetic construct
  misc_feature 1..20: note = CRISPR gRNA sequence
  source 1..20: mol_type = other DNA
ttggggtctccagcacccag

SEQ ID NO: 19704 - DNA, 20 bp, synthetic construct
  misc_feature 1..20: note = CRISPR gRNA sequence
  source 1..20: mol_type = other DNA
ggggactgtgttaagtagag

SEQ ID NO: 19705 - DNA, 20 bp, synthetic construct
  misc_feature 1..20: note = CRISPR gRNA sequence
  source 1..20: mol_type = other DNA
actgtgttaagtagagccgg

SEQ ID NO: 19706 - DNA, 20 bp, synthetic construct
  misc_feature 1..20: note = CRISPR gRNA sequence
  source 1..20: mol_type = other DNA
agagccggatgggtcaggac

SEQ ID NO: 19707 - DNA, 20 bp, synthetic construct
  misc_feature 1..20: note = CRISPR gRNA sequence
  source 1..20: mol_type = other DNA
tccaccccctaccccagcac

SEQ ID NO: 19708 - DNA, 20 bp, synthetic construct
  misc_feature 1..20: note = CRISPR gRNA sequence
  source 1..20: mol_type = other DNA
ccaggtcattgactgcagtt

SEQ ID NO: 19709 - DNA, 20 bp, synthetic construct
  misc_feature 1..20: note = CRISPR gRNA sequence
  source 1..20: mol_type = other DNA
agctggagatgatggcccat

SEQ ID NO: 19710 - DNA, 20 bp, synthetic construct
  misc_feature 1..20: note = CRISPR gRNA sequence
  source 1..20: mol_type = other DNA
ggcatctgtggtgtcttttg

SEQ ID NO: 19711 - DNA, 20 bp, synthetic construct
  misc_feature 1..20: note = CRISPR gRNA sequence
  source 1..20: mol_type = other DNA
gtgtcttttgtggggtcctg

SEQ ID NO: 19712 - DNA, 20 bp, synthetic construct
  misc_feature 1..20: note = CRISPR gRNA sequence
  source 1..20: mol_type = other DNA
cgaaggaaaagggaagaaag

SEQ ID NO: 19713 - DNA, 20 bp, synthetic construct
  misc_feature 1..20: note = CRISPR gRNA sequence
  source 1..20: mol_type = other DNA
aagcagggttgggaagcagc

SEQ ID NO: 19714 - DNA, 20 bp, synthetic construct
  misc_feature 1..20: note = CRISPR gRNA sequence
  source 1..20: mol_type = other DNA
ggtccatggtttgtttacat

SEQ ID NO: 19715 - DNA, 20 bp, synthetic construct
  misc_feature 1..20: note = CRISPR gRNA sequence
  source 1..20: mol_type = other DNA
ctcttggtgttgtacattct

SEQ ID NO: 19716 - DNA, 20 bp, synthetic construct
  misc_feature 1..20: note = CRISPR gRNA sequence
  source 1..20: mol_type = other DNA
tgctgagaagccctttggct

SEQ ID NO: 19717 - DNA, 20 bp, synthetic construct
  misc_feature 1..20: note = CRISPR gRNA sequence
  source 1..20: mol_type = other DNA
ggaaatccattcaacggtgc

SEQ ID NO: 19718 - DNA, 20 bp, synthetic construct
  misc_feature 1..20: note = CRISPR gRNA sequence
  source 1..20: mol_type = other DNA
ccattcaacggtgctggaat

SEQ ID NO: 19719 - DNA, 20 bp, synthetic construct
  misc_feature 1..20: note = CRISPR gRNA sequence
  source 1..20: mol_type = other DNA
tctcactctgttgcccaggt

SEQ ID NO: 19720 - DNA, 20 bp, synthetic construct
  misc_feature 1..20: note = CRISPR gRNA sequence
  source 1..20: mol_type = other DNA
atcttttatttctgaagaga

SEQ ID NO: 19721 - DNA, 20 bp, synthetic construct
  misc_feature 1..20: note = CRISPR gRNA sequence
  source 1..20: mol_type = other DNA
tcctcagcctcccaaagtgc

SEQ ID NO: 19722 - DNA, 20 bp, synthetic construct
  misc_feature 1..20: note = CRISPR gRNA sequence
  source 1..20: mol_type = other DNA
tctgtgtggaactggcctgt

SEQ ID NO: 19723 - DNA, 20 bp, synthetic construct
  misc_feature 1..20: note = CRISPR gRNA sequence
  source 1..20: mol_type = other DNA
cattgcaggacaggacataa

SEQ ID NO: 19724 - DNA, 20 bp, synthetic construct
  misc_feature 1..20: note = CRISPR gRNA sequence
  source 1..20: mol_type = other DNA
cctgcaagggcctccaagcc

SEQ ID NO: 19725 - DNA, 20 bp, synthetic construct
  misc_feature 1..20: note = CRISPR gRNA sequence
  source 1..20: mol_type = other DNA
tgtccaggcagaaggcaata

SEQ ID NO: 19726 - DNA, 20 bp, synthetic construct
  misc_feature 1..20: note = CRISPR gRNA sequence
  source 1..20: mol_type = other DNA
aaaacaaataggcctatcga

SEQ ID NO: 19727 - DNA, 20 bp, synthetic construct
  misc_feature 1..20: note = CRISPR gRNA sequence
  source 1..20: mol_type = other DNA
aggagcttgcaggtcagaaa

SEQ ID NO: 19728 - DNA, 20 bp, synthetic construct
  misc_feature 1..20: note = CRISPR gRNA sequence
  source 1..20: mol_type = other DNA
cactccaggaagtgaaagtc

SEQ ID NO: 19729 - DNA, 20 bp, synthetic construct
  misc_feature 1..20: note = CRISPR gRNA sequence
  source 1..20: mol_type = other DNA
ctctctctgtctcgttctcc

SEQ ID NO: 19730 - DNA, 20 bp, synthetic construct
  misc_feature 1..20: note = CRISPR gRNA sequence
  source 1..20: mol_type = other DNA
ggtttgcaaacagcaggctg

SEQ ID NO: 19731 - DNA, 20 bp, synthetic construct
  misc_feature 1..20: note = CRISPR gRNA sequence
  source 1..20: mol_type = other DNA
agccatcaccagacagcctg

SEQ ID NO: 19732 - DNA, 20 bp, synthetic construct
  misc_feature 1..20: note = CRISPR gRNA sequence
  source 1..20: mol_type = other DNA
agaggtaccaacctcacccc

SEQ ID NO: 19733 - DNA, 20 bp, synthetic construct
  misc_feature 1..20: note = CRISPR gRNA sequence
  source 1..20: mol_type = other DNA
ctatgatctttggttcacat

SEQ ID NO: 19734 - DNA, 20 bp, synthetic construct
  misc_feature 1..20: note = CRISPR gRNA sequence
  source 1..20: mol_type = other DNA
taatgtccctatttcccata

SEQ ID NO: 19735 - DNA, 20 bp, synthetic construct
  misc_feature 1..20: note = CRISPR gRNA sequence
  source 1..20: mol_type = other DNA
cttttttttttttttttaga

SEQ ID NO: 19736 - DNA, 20 bp, synthetic construct
  misc_feature 1..20: note = CRISPR gRNA sequence
  source 1..20: mol_type = other DNA
gtctcactctgtcacccagg

SEQ ID NO: 19737 - DNA, 20 bp, synthetic construct
  misc_feature 1..20: note = CRISPR gRNA sequence
  source 1..20: mol_type = other DNA
ttttctatttttagtagaga

SEQ ID NO: 19738 - DNA, 20 bp, synthetic construct
  misc_feature 1..20: note = CRISPR gRNA sequence
  source 1..20: mol_type = other DNA
gcctcggcctcccaaagtgc

SEQ ID NO: 19739 - DNA, 20 bp, synthetic construct
  misc_feature 1..20: note = CRISPR gRNA sequence
  source 1..20: mol_type = other DNA
aaagtgctggaattacaggt

SEQ ID NO: 19740 - DNA, 20 bp, synthetic construct
  misc_feature 1..20: note = CRISPR gRNA sequence
  source 1..20: mol_type = other DNA
tgcattctgtactatgtttt

SEQ ID NO: 19741 - DNA, 20 bp, synthetic construct
  misc_feature 1..20: note = CRISPR gRNA sequence
  source 1..20: mol_type = other DNA
atcacggacattgttctcta

SEQ ID NO: 19742 - DNA, 20 bp, synthetic construct
  misc_feature 1..20: note = CRISPR gRNA sequence
  source 1..20: mol_type = other DNA
cattgttctctatggagtgc

SEQ ID NO: 19743 - DNA, 20 bp, synthetic construct
  misc_feature 1..20: note = CRISPR gRNA sequence
  source 1..20: mol_type = other DNA
acagcagtaaccatcctcag

SEQ ID NO: 19744 - DNA, 20 bp, synthetic construct
  misc_feature 1..20: note = CRISPR gRNA sequence
  source 1..20: mol_type = other DNA
tcctcagatgggttctcctg

SEQ ID NO: 19745 - DNA, 20 bp, synthetic construct
  misc_feature 1..20: note = CRISPR gRNA sequence
  source 1..20: mol_type = other DNA
gagttgtgggaacatttctt

SEQ ID NO: 19746 - DNA, 20 bp, synthetic construct
  misc_feature 1..20: note = CRISPR gRNA sequence
  source 1..20: mol_type = other DNA
aggatatatagacccaagag

SEQ ID NO: 19747 - DNA, 20 bp, synthetic construct
  misc_feature 1..20: note = CRISPR gRNA sequence
  source 1..20: mol_type = other DNA
agagctgaattgccaggtgg

SEQ ID NO: 19748 - DNA, 20 bp, synthetic construct
  misc_feature 1..20: note = CRISPR gRNA sequence
  source 1..20: mol_type = other DNA
tcactttgctgttttatttt

SEQ ID NO: 19749 - DNA, 20 bp, synthetic construct
  misc_feature 1..20: note = CRISPR gRNA sequence
  source 1..20: mol_type = other DNA
gattctgtgactcagagagg

SEQ ID NO: 19750 - DNA, 20 bp, synthetic construct
  misc_feature 1..20: note = CRISPR gRNA sequence
  source 1..20: mol_type = other DNA
tctctctcctaaaatatcat

SEQ ID NO: 19751 - DNA, 20 bp, synthetic construct
  misc_feature 1..20: note = CRISPR gRNA sequence
  source 1..20: mol_type = other DNA
tgagctcagtgactttctta

SEQ ID NO: 19752 - DNA, 20 bp, synthetic construct
  misc_feature 1..20: note = CRISPR gRNA sequence
  source 1..20: mol_type = other DNA
actttcttacggggtgctca

SEQ ID NO: 19753 - DNA, 20 bp, synthetic construct
  misc_feature 1..20: note = CRISPR gRNA sequence
  source 1..20: mol_type = other DNA
gaaaagtgagagatgtttct

SEQ ID NO: 19754 - DNA, 20 bp, synthetic construct
  misc_feature 1..20: note = CRISPR gRNA sequence
  source 1..20: mol_type = other DNA
agagtttatctggaggacta

SEQ ID NO: 19755 - DNA, 20 bp, synthetic construct
  misc_feature 1..20: note = CRISPR gRNA sequence
  source 1..20: mol_type = other DNA
acccccacaaagaagctgtt

SEQ ID NO: 19756 - DNA, 20 bp, synthetic construct
  misc_feature 1..20: note = CRISPR gRNA sequence
  source 1..20: mol_type = other DNA
gagaagactgccaggcaacg

SEQ ID NO: 19757 - DNA, 20 bp, synthetic construct
  misc_feature 1..20: note = CRISPR gRNA sequence
  source 1..20: mol_type = other DNA
actgccaggcaacgaggaat

SEQ ID NO: 19758 - DNA, 20 bp, synthetic construct
  misc_feature 1..20: note = CRISPR gRNA sequence
  source 1..20: mol_type = other DNA
gagggctaaggtaatgtact

SEQ ID NO: 19759 - DNA, 20 bp, synthetic construct
  misc_feature 1..20: note = CRISPR gRNA sequence
  source 1..20: mol_type = other DNA
aggaggagaagttcatggtc

SEQ ID NO: 19760 - DNA, 20 bp, synthetic construct
  misc_feature 1..20: note = CRISPR gRNA sequence
  source 1..20: mol_type = other DNA
ttttttttttttgtctgaga

SEQ ID NO: 19761 - DNA, 20 bp, synthetic construct
  misc_feature 1..20: note = CRISPR gRNA sequence
  source 1..20: mol_type = other DNA
tcttgctctgtcaccgaggc

SEQ ID NO: 19762 - DNA, 20 bp, synthetic construct
  misc_feature 1..20: note = CRISPR gRNA sequence
  source 1..20: mol_type = other DNA
gcctcagcctcccaagtagc

SEQ ID NO: 19763 - DNA, 20 bp, synthetic construct
  misc_feature 1..20: note = CRISPR gRNA sequence
  source 1..20: mol_type = other DNA
tttttgtatttttgcagaga

SEQ ID NO: 19764 - DNA, 20 bp, synthetic construct
  misc_feature 1..20: note = CRISPR gRNA sequence
  source 1..20: mol_type = other DNA
gcctcggcctctcaaagtgc

SEQ ID NO: 19765 - DNA, 20 bp, synthetic construct
  misc_feature 1..20: note = CRISPR gRNA sequence
  source 1..20: mol_type = other DNA
gagcagtgctggaggctttt

SEQ ID NO: 19766 - DNA, 20 bp, synthetic construct
  misc_feature 1..20: note = CRISPR gRNA sequence
  source 1..20: mol_type = other DNA
ctataataacaacaatctcc

SEQ ID NO: 19767 - DNA, 20 bp, synthetic construct
  misc_feature 1..20: note = CRISPR gRNA sequence
  source 1..20: mol_type = other DNA
gttgccgttaacagttgaaa

SEQ ID NO: 19768 - DNA, 20 bp, synthetic construct
  misc_feature 1..20: note = CRISPR gRNA sequence
  source 1..20: mol_type = other DNA
aacttaactcccctaatcct

SEQ ID NO: 19769 - DNA, 20 bp, synthetic construct
  misc_feature 1..20: note = CRISPR gRNA sequence
  source 1..20: mol_type = other DNA
attgtagtgcgttggtaggt

SEQ ID NO: 19770 - DNA, 20 bp, synthetic construct
  misc_feature 1..20: note = CRISPR gRNA sequence
  source 1..20: mol_type = other DNA
gatcttcagatagtttaagt

SEQ ID NO: 19771 - DNA, 20 bp, synthetic construct
  misc_feature 1..20: note = CRISPR gRNA sequence
  source 1..20: mol_type = other DNA
ttccctcgggggagagagag

SEQ ID NO: 19772 - DNA, 20 bp, synthetic construct
  misc_feature 1..20: note = CRISPR gRNA sequence
  source 1..20: mol_type = other DNA
tcctgcatgcagtgtgaagt

SEQ ID NO: 19773 - DNA, 20 bp, synthetic construct
  misc_feature 1..20: note = CRISPR gRNA sequence
  source 1..20: mol_type = other DNA
cttttgatggcaaaaagatc

SEQ ID NO: 19774 - DNA, 20 bp, synthetic construct
  misc_feature 1..20: note = CRISPR gRNA sequence
  source 1..20: mol_type = other DNA
aaaagatcaggaatattttc

SEQ ID NO: 19775 - DNA, 20 bp, synthetic construct
  misc_feature 1..20: note = CRISPR gRNA sequence
  source 1..20: mol_type = other DNA
atcaggaatattttctcgag

SEQ ID NO: 19776 - DNA, 20 bp, synthetic construct
  misc_feature 1..20: note = CRISPR gRNA sequence
  source 1..20: mol_type = other DNA
ccacccacgccttccctcgc

SEQ ID NO: 19777 - DNA, 20 bp, synthetic construct
  misc_feature 1..20: note = CRISPR gRNA sequence
  source 1..20: mol_type = other DNA
acagcaattcaaaaaggcta

SEQ ID NO: 19778 - DNA, 20 bp, synthetic construct
  misc_feature 1..20: note = CRISPR gRNA sequence
  source 1..20: mol_type = other DNA
agtgggctgagactttggag

SEQ ID NO: 19779 - DNA, 20 bp, synthetic construct
  misc_feature 1..20: note = CRISPR gRNA sequence
  source 1..20: mol_type = other DNA
tgtctcttcatctgaaaaac

SEQ ID NO: 19780 - DNA, 20 bp, synthetic construct
  misc_feature 1..20: note = CRISPR gRNA sequence
  source 1..20: mol_type = other DNA
gatgtgtaagttagaccaaa

SEQ ID NO: 19781 - DNA, 20 bp, synthetic construct
  misc_feature 1..20: note = CRISPR gRNA sequence
  source 1..20: mol_type = other DNA
gaccaaatggggtaatgcct

SEQ ID NO: 19782 - DNA, 20 bp, synthetic construct
  misc_feature 1..20: note = CRISPR gRNA sequence
  source 1..20: mol_type = other DNA
cctggcacttgctggacact

SEQ ID NO: 19783 - DNA, 20 bp, synthetic construct
  misc_feature 1..20: note = CRISPR gRNA sequence
  source 1..20: mol_type = other DNA
tctagttctatatcattgcc

SEQ ID NO: 19784 - DNA, 20 bp, synthetic construct
  misc_feature 1..20: note = CRISPR gRNA sequence
  source 1..20: mol_type = other DNA
gctgggagaaggtgagctag

SEQ ID NO: 19785 - DNA, 20 bp, synthetic construct
  misc_feature 1..20: note = CRISPR gRNA sequence
  source 1..20: mol_type = other DNA
aagggctctctctcctgcca

SEQ ID NO: 19786 - DNA, 20 bp, synthetic construct
  misc_feature 1..20: note = CRISPR gRNA sequence
  source 1..20: mol_type = other DNA
gacataggaaacttggctct

SEQ ID NO: 19787 - DNA, 20 bp, synthetic construct
  misc_feature 1..20: note = CRISPR gRNA sequence
  source 1..20: mol_type = other DNA
tgtggcgttgtggggaaacc

SEQ ID NO: 19788 - DNA, 20 bp, synthetic construct
  misc_feature 1..20: note = CRISPR gRNA sequence
  source 1..20: mol_type = other DNA
ggaaacctagagtcttgggc

SEQ ID NO: 19789 - DNA, 20 bp, synthetic construct
  misc_feature 1..20: note = CRISPR gRNA sequence
  source 1..20: mol_type = other DNA
tctcactttgtcgcccaggc

SEQ ID NO: 19790 - DNA, 20 bp, synthetic construct
  misc_feature 1..20: note = CRISPR gRNA sequence
  source 1..20: mol_type = other DNA
gcctcagcctcccaagtagc

SEQ ID NO: 19791 - DNA, 20 bp, synthetic construct
  misc_feature 1..20: note = CRISPR gRNA sequence
  source 1..20: mol_type = other DNA
ttttgtatttttagtagaga

SEQ ID NO: 19792 - DNA, 20 bp, synthetic construct
  misc_feature 1..20: note = CRISPR gRNA sequence
  source 1..20: mol_type = other DNA
cttggctaaggcatcacagc

SEQ ID NO: 19793 - DNA, 20 bp, synthetic construct
  misc_feature 1..20: note = CRISPR gRNA sequence
  source 1..20: mol_type = other DNA
ttgggaactcagatggtgtg

SEQ ID NO: 19794 - DNA, 20 bp, synthetic construct
  misc_feature 1..20: note = CRISPR gRNA sequence
  source 1..20: mol_type = other DNA
tgtattgggggcttctggga

SEQ ID NO: 19795 - DNA, 20 bp, synthetic construct
  misc_feature 1..20: note = CRISPR gRNA sequence
  source 1..20: mol_type = other DNA
tctggctctatcacccaggc

SEQ ID NO: 19796 - DNA, 20 bp, synthetic construct
  misc_feature 1..20: note = CRISPR gRNA sequence
  source 1..20: mol_type = other DNA
tatcctcccacctcagcctc

SEQ ID NO: 19797 - DNA, 20 bp, synthetic construct
  misc_feature 1..20: note = CRISPR gRNA sequence
  source 1..20: mol_type = other DNA
gccttggactcccaaagtgc

SEQ ID NO: 19798 - DNA, 20 bp, synthetic construct
  misc_feature 1..20: note = CRISPR gRNA sequence
  source 1..20: mol_type = other DNA
tcttgttcctatgaagtctg

SEQ ID NO: 19799 - DNA, 20 bp, synthetic construct
  misc_feature 1..20: note = CRISPR gRNA sequence
  source 1..20: mol_type = other DNA
ctcggaagaaatggaaggga

SEQ ID NO: 19800 - DNA, 20 bp, synthetic construct
  misc_feature 1..20: note = CRISPR gRNA sequence
  source 1..20: mol_type = other DNA
acttaactcccctaatcctt

SEQ ID NO: 19801 - DNA, 20 bp, synthetic construct
  misc_feature 1..20: note = CRISPR gRNA sequence
  source 1..20: mol_type = other DNA
gttacagtgtgttggtaggt

SEQ ID NO: 19802 - DNA, 20 bp, synthetic construct
  misc_feature 1..20: note = CRISPR gRNA sequence
  source 1..20: mol_type = other DNA
aaccacacagcagtgtcatc

SEQ ID NO: 19803 - DNA, 20 bp, synthetic construct
  misc_feature 1..20: note = CRISPR gRNA sequence
  source 1..20: mol_type = other DNA
agcagagctcatcaataagt

SEQ ID NO: 19804 - DNA, 20 bp, synthetic construct
  misc_feature 1..20: note = CRISPR gRNA sequence
  source 1..20: mol_type = other DNA
tgcttgagcccagacaggac

SEQ ID NO: 19805 - DNA, 20 bp, synthetic construct
  misc_feature 1..20: note = CRISPR gRNA sequence
  source 1..20: mol_type = other DNA
gggggaaagagcaccagcct

SEQ ID NO: 19806 - DNA, 20 bp, synthetic construct
  misc_feature 1..20: note = CRISPR gRNA sequence
  source 1..20: mol_type = other DNA
agcctgggagtcttggcagg

SEQ ID NO: 19807 - DNA, 20 bp, synthetic construct
  misc_feature 1..20: note = CRISPR gRNA sequence
  source 1..20: mol_type = other DNA
tgtgcaagtcacgtccttcc

SEQ ID NO: 19808 - DNA, 20 bp, synthetic construct
  misc_feature 1..20: note = CRISPR gRNA sequence
  source 1..20: mol_type = other DNA
ggtctcagtcttgtcatctg

SEQ ID NO: 19809 - DNA, 20 bp, synthetic construct
  misc_feature 1..20: note = CRISPR gRNA sequence
  source 1..20: mol_type = other DNA
cccaatgccctgtgagaaaa

SEQ ID NO: 19810 - DNA, 20 bp, synthetic construct
  misc_feature 1..20: note = CRISPR gRNA sequence
  source 1..20: mol_type = other DNA
gccctgtgagaaaactgagt

SEQ ID NO: 19811 - DNA, 20 bp, synthetic construct
  misc_feature 1..20: note = CRISPR gRNA sequence
  source 1..20: mol_type = other DNA
aacttattattttatagata

SEQ ID NO: 19812 - DNA, 20 bp, synthetic construct
  misc_feature 1..20: note = CRISPR gRNA sequence
  source 1..20: mol_type = other DNA
ttatagaaatgttatagata

SEQ ID NO: 19813 - DNA, 20 bp, synthetic construct
  misc_feature 1..20: note = CRISPR gRNA sequence
  source 1..20: mol_type = other DNA
aaagtcacacaactcattca

SEQ ID NO: 19814 - DNA, 20 bp, synthetic construct
  misc_feature 1..20: note = CRISPR gRNA sequence
  source 1..20: mol_type = other DNA
caactcattcacggagttgc

SEQ ID NO: 19815 - DNA, 20 bp, synthetic construct
  misc_feature 1..20: note = CRISPR gRNA sequence
  source 1..20: mol_type = other DNA
gtaggttcttaataaagagc

SEQ ID NO: 19816 - DNA, 20 bp, synthetic construct
  misc_feature 1..20: note = CRISPR gRNA sequence
  source 1..20: mol_type = other DNA
ttcttaataaagagcatggg

SEQ ID NO: 19817 - DNA, 20 bp, synthetic construct
  misc_feature 1..20: note = CRISPR gRNA sequence
  source 1..20: mol_type = other DNA
ttcctctagtcatggttggc

SEQ ID NO: 19818 - DNA, 20 bp, synthetic construct
  misc_feature 1..20: note = CRISPR gRNA sequence
  source 1..20: mol_type = other DNA
tcgctgcaagccggttatgt

SEQ ID NO: 19819 - DNA, 20 bp, synthetic construct
  misc_feature 1..20: note = CRISPR gRNA sequence
  source 1..20: mol_type = other DNA
gatcattctctgtgacatcc

SEQ ID NO: 19820 - DNA, 20 bp, synthetic construct
  misc_feature 1..20: note = CRISPR gRNA sequence
  source 1..20: mol_type = other DNA
ctccccaggcagtgaaagct

SEQ ID NO: 19821 - DNA, 20 bp, synthetic construct
  misc_feature 1..20: note = CRISPR gRNA sequence
  source 1..20: mol_type = other DNA
ctgtggatgcgtgaaagaaa

SEQ ID NO: 19822 - DNA, 20 bp, synthetic construct
  misc_feature 1..20: note = CRISPR gRNA sequence
  source 1..20: mol_type = other DNA
aaagaaaatgggtctctggg

SEQ ID NO: 19823 - DNA, 20 bp, synthetic construct
  misc_feature 1..20: note = CRISPR gRNA sequence
  source 1..20: mol_type = other DNA
cagcactttgggaggccaag

SEQ ID NO: 19824 - DNA, 20 bp, synthetic construct
  misc_feature 1..20: note = CRISPR gRNA sequence
  source 1..20: mol_type = other DNA
actttgggaggccaaggcgg

SEQ ID NO: 19825 - DNA, 20 bp, synthetic construct
  misc_feature 1..20: note = CRISPR gRNA sequence
  source 1..20: mol_type = other DNA
cgggtggatcacctgaggtc

SEQ ID NO: 19826 - DNA, 20 bp, synthetic construct
  misc_feature 1..20: note = CRISPR gRNA sequence
  source 1..20: mol_type = other DNA
aaaattagccaggcatggtg

SEQ ID NO: 19827 - DNA, 20 bp, synthetic construct
  misc_feature 1..20: note = CRISPR gRNA sequence
  source 1..20: mol_type = other DNA
tacttgggaggttgaagcag

SEQ ID NO: 19828 - DNA, 20 bp, synthetic construct
  misc_feature 1..20: note = CRISPR gRNA sequence
  source 1..20: mol_type = other DNA
ggttgaagcaggagaattgc

SEQ ID NO: 19829 - DNA, 20 bp, synthetic construct
  misc_feature 1..20: note = CRISPR gRNA sequence
  source 1..20: mol_type = other DNA
ctgcactccagcctgggcga

SEQ ID NO: 19830 - DNA, 20 bp, synthetic construct
  misc_feature 1..20: note = CRISPR gRNA sequence
  source 1..20: mol_type = other DNA
aaaaaaaaaagaaaaagaaa

SEQ ID NO: 19831 - DNA, 20 bp, synthetic construct
  misc_feature 1..20: note = CRISPR gRNA sequence
  source 1..20: mol_type = other DNA
agaaaaagaaaatgagtctc

SEQ ID NO: 19832 - DNA, 20 bp, synthetic construct
  misc_feature 1..20: note = CRISPR gRNA sequence
  source 1..20: mol_type = other DNA
aagaaaatgagtctcaggaa

SEQ ID NO: 19833 - DNA, 20 bp, synthetic construct
  misc_feature 1..20: note = CRISPR gRNA sequence
  source 1..20: mol_type = other DNA
ctcaggaatggggtggcaag

SEQ ID NO: 19834 - DNA, 20 bp, synthetic construct
  misc_feature 1..20: note = CRISPR gRNA sequence
  source 1..20: mol_type = other DNA
tcatctgcatgtcatgtgtg

SEQ ID NO: 19835 - DNA, 20 bp, synthetic construct
  misc_feature 1..20: note = CRISPR gRNA sequence
  source 1..20: mol_type = other DNA
agtgtgactttatttgggaa

SEQ ID NO: 19836 - DNA, 20 bp, synthetic construct
  misc_feature 1..20: note = CRISPR gRNA sequence
  source 1..20: mol_type = other DNA
gggaaaagggtctttgcaga

SEQ ID NO: 19837 - DNA, 20 bp, synthetic construct
  misc_feature 1..20: note = CRISPR gRNA sequence
  source 1..20: mol_type = other DNA
gatagaattaagttaagggg

SEQ ID NO: 19838 - DNA, 20 bp, synthetic construct
  misc_feature 1..20: note = CRISPR gRNA sequence
  source 1..20: mol_type = other DNA
actttgggaagctgagattg

SEQ ID NO: 19839 - DNA, 20 bp, synthetic construct
  misc_feature 1..20: note = CRISPR gRNA sequence
  source 1..20: mol_type = other DNA
ttggaggatcacctgaggtc

SEQ ID NO: 19840 - DNA, 20 bp, synthetic construct
  misc_feature 1..20: note = CRISPR gRNA sequence
  source 1..20: mol_type = other DNA
tactcaggagactggggcag

SEQ ID NO: 19841 - DNA, 20 bp, synthetic construct
  misc_feature 1..20: note = CRISPR gRNA sequence
  source 1..20: mol_type = other DNA
gtctcaaaagaaggcaaaaa

SEQ ID NO: 19842 - DNA, 20 bp, synthetic construct
  misc_feature 1..20: note = CRISPR gRNA sequence
  source 1..20: mol_type = other DNA
gatcttgaaatgacatcatc

SEQ ID NO: 19843 - DNA, 20 bp, synthetic construct
  misc_feature 1..20: note = CRISPR gRNA sequence
  source 1..20: mol_type = other DNA
catcatcctggattatctag

SEQ ID NO: 19844 - DNA, 20 bp, synthetic construct
  misc_feature 1..20: note = CRISPR gRNA sequence
  source 1..20: mol_type = other DNA
agaaagagacttgctacatg

SEQ ID NO: 19845 - DNA, 20 bp, synthetic construct
  misc_feature 1..20: note = CRISPR gRNA sequence
  source 1..20: mol_type = other DNA
aggtgatgtggccactaaag

SEQ ID NO: 19846 - DNA, 20 bp, synthetic construct
  misc_feature 1..20: note = CRISPR gRNA sequence
  source 1..20: mol_type = other DNA
gtggccactaaagctgagtt

SEQ ID NO: 19847 - DNA, 20 bp, synthetic construct
  misc_feature 1..20: note = CRISPR gRNA sequence
  source 1..20: mol_type = other DNA
cagccacaagaccacaagtc

SEQ ID NO: 19848 - DNA, 20 bp, synthetic construct
  misc_feature 1..20: note = CRISPR gRNA sequence
  source 1..20: mol_type = other DNA
tctggcctccagaaccatga

SEQ ID NO: 19849 - DNA, 20 bp, synthetic construct
  misc_feature 1..20: note = CRISPR gRNA sequence
  source 1..20: mol_type = other DNA
gtgctgttgttctgagctac

SEQ ID NO: 19850 - DNA, 20 bp, synthetic construct
  misc_feature 1..20: note = CRISPR gRNA sequence
  source 1..20: mol_type = other DNA
tgtttcagcagccctgggaa

SEQ ID NO: 19851 - DNA, 20 bp, synthetic construct
  misc_feature 1..20: note = CRISPR gRNA sequence
  source 1..20: mol_type = other DNA
tggaaacatggacctgaacc

SEQ ID NO: 19852 - DNA, 20 bp, synthetic construct
  misc_feature 1..20: note = CRISPR gRNA sequence
  source 1..20: mol_type = other DNA
gaggaagctgcttgtcttct

SEQ ID NO: 19853 - DNA, 20 bp, synthetic construct
  misc_feature 1..20: note = CRISPR gRNA sequence
  source 1..20: mol_type = other DNA
ttgggaggccgaggagacag

SEQ ID NO: 19854 - DNA, 20 bp, synthetic construct
  misc_feature 1..20: note = CRISPR gRNA sequence
  source 1..20: mol_type = other DNA
caggcggatcacttgaggtc

SEQ ID NO: 19855 - DNA, 20 bp, synthetic construct
  misc_feature 1..20: note = CRISPR gRNA sequence
  source 1..20: mol_type = other DNA
actaaaaatgcaaaaattag

SEQ ID NO: 19856 - DNA, 20 bp, synthetic construct
  misc_feature 1..20: note = CRISPR gRNA sequence
  source 1..20: mol_type = other DNA
aaaattagccgggtgtggtg

SEQ ID NO: 19857 - DNA, 20 bp, synthetic construct
  misc_feature 1..20: note = CRISPR gRNA sequence
  source 1..20: mol_type = other DNA
tgctcaggaggctgaggcag

SEQ ID NO: 19858 - DNA, 20 bp, synthetic construct
  misc_feature 1..20: note = CRISPR gRNA sequence
  source 1..20: mol_type = other DNA
ttgcacccctgcactccagc

SEQ ID NO: 19859 - DNA, 20 bp, synthetic construct
  misc_feature 1..20: note = CRISPR gRNA sequence
  source 1..20: mol_type = other DNA
aaaaaaaaaaaaaaaaaaag

SEQ ID NO: 19860 - DNA, 20 bp, synthetic construct
  misc_feature 1..20: note = CRISPR gRNA sequence
  source 1..20: mol_type = other DNA
gtagagttcagtgttctttt

SEQ ID NO: 19861 - DNA, 20 bp, synthetic construct
  misc_feature 1..20: note = CRISPR gRNA sequence
  source 1..20: mol_type = other DNA
tgttcttttgggaatactca

SEQ ID NO: 19862 - DNA, 20 bp, synthetic construct
  misc_feature 1..20: note = CRISPR gRNA sequence
  source 1..20: mol_type = other DNA
gtctcagcctcccaaagtgc

SEQ ID NO: 19863 - DNA, 20 bp, synthetic construct
  misc_feature 1..20: note = CRISPR gRNA sequence
  source 1..20: mol_type = other DNA
ccctcctactttatgtctcc

SEQ ID NO: 19864 - DNA, 20 bp, synthetic construct
  misc_feature 1..20: note = CRISPR gRNA sequence
  source 1..20: mol_type = other DNA
ttttggtcatttcaaataaa

SEQ ID NO: 19865 - DNA, 20 bp, synthetic construct
  misc_feature 1..20: note = CRISPR gRNA sequence
  source 1..20: mol_type = other DNA
gtgctttctccctttaatgg

SEQ ID NO: 19866 - DNA, 20 bp, synthetic construct
  misc_feature 1..20: note = CRISPR gRNA sequence
  source 1..20: mol_type = other DNA
gtttatccatttattttttg

SEQ ID NO: 19867 - DNA, 20 bp, synthetic construct
  misc_feature 1..20: note = CRISPR gRNA sequence
  source 1..20: mol_type = other DNA
gtttttatattttggctatt

SEQ ID NO: 19868 - DNA, 20 bp, synthetic construct
  misc_feature 1..20: note = CRISPR gRNA sequence
  source 1..20: mol_type = other DNA
attcgtgtataggtttttgt

SEQ ID NO: 19869 - DNA, 20 bp, synthetic construct
  misc_feature 1..20: note = CRISPR gRNA sequence
  source 1..20: mol_type = other DNA
cataatatgatacatattta

SEQ ID NO: 19870 - DNA, 20 bp, synthetic construct
  misc_feature 1..20: note = CRISPR gRNA sequence
  source 1..20: mol_type = other DNA
tacatatttatggggtatat

SEQ ID NO: 19871 - DNA, 20 bp, synthetic construct
  misc_feature 1..20: note = CRISPR gRNA sequence
  source 1..20: mol_type = other DNA
agaaggtataatgatcatgt

SEQ ID NO: 19872 - DNA, 20 bp, synthetic construct
  misc_feature 1..20: note = CRISPR gRNA sequence
  source 1..20: mol_type = other DNA
atatttgaggtatccacatt

SEQ ID NO: 19873 - DNA, 20 bp, synthetic construct
  misc_feature 1..20: note = CRISPR gRNA sequence
  source 1..20: mol_type = other DNA
aacaaatgatgaggaaatct

SEQ ID NO: 19874 - DNA, 20 bp, synthetic construct
  misc_feature 1..20: note = CRISPR gRNA sequence
  source 1..20: mol_type = other DNA
caggacttcagtcagactgt

SEQ ID NO: 19875 - DNA, 20 bp, synthetic construct
  misc_feature 1..20: note = CRISPR gRNA sequence
  source 1..20: mol_type = other DNA
aatcctggttccacttggac

SEQ ID NO: 19876 - DNA, 20 bp, synthetic construct
  misc_feature 1..20: note = CRISPR gRNA sequence
  source 1..20: mol_type = other DNA
agttttctcatatgcaaagt

SEQ ID NO: 19877 - DNA, 20 bp, synthetic construct
  misc_feature 1..20: note = CRISPR gRNA sequence
  source 1..20: mol_type = other DNA
ttccttacatggttactgat

SEQ ID NO: 19878 - DNA, 20 bp, synthetic construct
  misc_feature 1..20: note = CRISPR gRNA sequence
  source 1..20: mol_type = other DNA
atggcattgccaaatgtggg

SEQ ID NO: 19879 - DNA, 20 bp, synthetic construct
  misc_feature 1..20: note = CRISPR gRNA sequence
  source 1..20: mol_type = other DNA
actctctggtgtgagattga

SEQ ID NO: 19880 - DNA, 20 bp, synthetic construct
  misc_feature 1..20: note = CRISPR gRNA sequence
  source 1..20: mol_type = other DNA
ccagttcccttttctacctc

SEQ ID NO: 19881 - DNA, 20 bp, synthetic construct
  misc_feature 1..20: note = CRISPR gRNA sequence
  source 1..20: mol_type = other DNA
ttgtaagttccttggaggaa

SEQ ID NO: 19882 - DNA, 20 bp, synthetic construct
  misc_feature 1..20: note = CRISPR gRNA sequence
  source 1..20: mol_type = other DNA
cgctgagcatataagaggtg

SEQ ID NO: 19883 - DNA, 20 bp, synthetic construct
  misc_feature 1..20: note = CRISPR gRNA sequence
  source 1..20: mol_type = other DNA
atccccagccctcaccagct

SEQ ID NO: 19884 - DNA, 20 bp, synthetic construct
  misc_feature 1..20: note = CRISPR gRNA sequence
  source 1..20: mol_type = other DNA
cagctcacagtgtgccacca

SEQ ID NO: 19885 - DNA, 20 bp, synthetic construct
  misc_feature 1..20: note = CRISPR gRNA sequence
  source 1..20: mol_type = other DNA
gtgggacgctctctgcagat

SEQ ID NO: 19886 - DNA, 20 bp, synthetic construct
  misc_feature 1..20: note = CRISPR gRNA sequence
  source 1..20: mol_type = other DNA
agaaaaggacaatcaagggc

SEQ ID NO: 19887 - DNA, 20 bp, synthetic construct
  misc_feature 1..20: note = CRISPR gRNA sequence
  source 1..20: mol_type = other DNA
cccacagaaatcattgcaag

SEQ ID NO: 19888 - DNA, 20 bp, synthetic construct
  misc_feature 1..20: note = CRISPR gRNA sequence
  source 1..20: mol_type = other DNA
tttgtaataactagcattta

SEQ ID NO: 19889 - DNA, 20 bp, synthetic construct
  misc_feature 1..20: note = CRISPR gRNA sequence
  source 1..20: mol_type = other DNA
gctgtccatacattatcatc

SEQ ID NO: 19890 - DNA, 20 bp, synthetic construct
  misc_feature 1..20: note = CRISPR gRNA sequence
  source 1..20: mol_type = other DNA
ccacaaaaaaagaaagtgtc

SEQ ID NO: 19891 - DNA, 20 bp, synthetic construct
  misc_feature 1..20: note = CRISPR gRNA sequence
  source 1..20: mol_type = other DNA
tgttttttgggggagagacg

SEQ ID NO: 19892 - DNA, 20 bp, synthetic construct
  misc_feature 1..20: note = CRISPR gRNA sequence
  source 1..20: mol_type = other DNA
tgggggagagacgtgggata

SEQ ID NO: 19893 - DNA, 20 bp, synthetic construct
  misc_feature 1..20: note = CRISPR gRNA sequence
  source 1..20: mol_type = other DNA
aaaaaagtggcctttttctg

SEQ ID NO: 19894 - DNA, 20 bp, synthetic construct
  misc_feature 1..20: note = CRISPR gRNA sequence
  source 1..20: mol_type = other DNA
ttggctagcaaagtgcaagc

SEQ ID NO: 19895 - DNA, 20 bp, synthetic construct
  misc_feature 1..20: note = CRISPR gRNA sequence
  source 1..20: mol_type = other DNA
gactgcttccttcccttcct

SEQ ID NO: 19896 - DNA, 20 bp, synthetic construct
  misc_feature 1..20: note = CRISPR gRNA sequence
  source 1..20: mol_type = other DNA
cacaactggaggcagtcatt

SEQ ID NO: 19897 - DNA, 20 bp, synthetic construct
  misc_feature 1..20: note = CRISPR gRNA sequence
  source 1..20: mol_type = other DNA
ttaaggatttgggcatgtca

SEQ ID NO: 19898 - DNA, 20 bp, synthetic construct
  misc_feature 1..20: note = CRISPR gRNA sequence
  source 1..20: mol_type = other DNA
atttgggcatgtcataggat

SEQ ID NO: 19899 - DNA, 20 bp, synthetic construct
  misc_feature 1..20: note = CRISPR gRNA sequence
  source 1..20: mol_type = other DNA
ttaaaacaacatacctgaca

SEQ ID NO: 19900 - DNA, 20 bp, synthetic construct
  misc_feature 1..20: note = CRISPR gRNA sequence
  source 1..20: mol_type = other DNA
ttactggtgaggactctctg

SEQ ID NO: 19901 - DNA, 20 bp, synthetic construct
  misc_feature 1..20: note = CRISPR gRNA sequence
  source 1..20: mol_type = other DNA
gtttatccactaatccatga

SEQ ID NO: 19902 - DNA, 20 bp, synthetic construct
  misc_feature 1..20: note = CRISPR gRNA sequence
  source 1..20: mol_type = other DNA
cctctcaatactgccacata

SEQ ID NO: 19903 - DNA, 20 bp, synthetic construct
  misc_feature 1..20: note = CRISPR gRNA sequence
  source 1..20: mol_type = other DNA
ataggggattacatttatac

SEQ ID NO: 19904 - DNA, 20 bp, synthetic construct
  misc_feature 1..20: note = CRISPR gRNA sequence
  source 1..20: mol_type = other DNA
caagtctgctcctcaagtct

SEQ ID NO: 19905 - DNA, 20 bp, synthetic construct
  misc_feature 1..20: note = CRISPR gRNA sequence
  source 1..20: mol_type = other DNA
aataatcacacccaccatca

SEQ ID NO: 19906 - DNA, 20 bp, synthetic construct
  misc_feature 1..20: note = CRISPR gRNA sequence
  source 1..20: mol_type = other DNA
atcacgggatggttgtaaga

SEQ ID NO: 19907 - DNA, 20 bp, synthetic construct
  misc_feature 1..20: note = CRISPR gRNA sequence
  source 1..20: mol_type = other DNA
atgtgtaaagcatttagaaa

SEQ ID NO: 19908 - DNA, 20 bp, synthetic construct
  misc_feature 1..20: note = CRISPR gRNA sequence
  source 1..20: mol_type = other DNA
atttagaaaaggaatttgca

SEQ ID NO: 19909 - DNA, 20 bp, synthetic construct
  misc_feature 1..20: note = CRISPR gRNA sequence
  source 1..20: mol_type = other DNA
taccaccgtcacctatctct

SEQ ID NO: 19910 - DNA, 20 bp, synthetic construct
  misc_feature 1..20: note = CRISPR gRNA sequence
  source 1..20: mol_type = other DNA
catctttcaaggcctggttc

SEQ ID NO: 19911 - DNA, 20 bp, synthetic construct
  misc_feature 1..20: note = CRISPR gRNA sequence
  source 1..20: mol_type = other DNA
tatatagttaccactattta

SEQ ID NO: 19912 - DNA, 20 bp, synthetic construct
  misc_feature 1..20: note = CRISPR gRNA sequence
  source 1..20: mol_type = other DNA
actgtataccagctactgtg

SEQ ID NO: 19913 - DNA, 20 bp, synthetic construct
  misc_feature 1..20: note = CRISPR gRNA sequence
  source 1..20: mol_type = other DNA
ctaattatcaccatcgattc

SEQ ID NO: 19914 - DNA, 20 bp, synthetic construct
  misc_feature 1..20: note = CRISPR gRNA sequence
  source 1..20: mol_type = other DNA
gggctagtggaaagtagagg

SEQ ID NO: 19915 - DNA, 20 bp, synthetic construct
  misc_feature 1..20: note = CRISPR gRNA sequence
  source 1..20: mol_type = other DNA
gtagcagtagataagttttc

SEQ ID NO: 19916 - DNA, 20 bp, synthetic construct
  misc_feature 1..20: note = CRISPR gRNA sequence
  source 1..20: mol_type = other DNA
ttgattagattaagggcccc

SEQ ID NO: 19917 - DNA, 20 bp, synthetic construct
  misc_feature 1..20: note = CRISPR gRNA sequence
  source 1..20: mol_type = other DNA
attcattcaacaaacatttc

SEQ ID NO: 19918 - DNA, 20 bp, synthetic construct
  misc_feature 1..20: note = CRISPR gRNA sequence
  source 1..20: mol_type = other DNA
acattttcagtaagtttgtg

SEQ ID NO: 19919 - DNA, 20 bp, synthetic construct
  misc_feature 1..20: note = CRISPR gRNA sequence
  source 1..20: mol_type = other DNA
atttcctgccttgttccctg

SEQ ID NO: 19920 - DNA, 20 bp, synthetic construct
  misc_feature 1..20: note = CRISPR gRNA sequence
  source 1..20: mol_type = other DNA
gtcagacccctctccccaag

SEQ ID NO: 19921 - DNA, 20 bp, synthetic construct
  misc_feature 1..20: note = CRISPR gRNA sequence
  source 1..20: mol_type = other DNA
cttgggctttcattgattgt

SEQ ID NO: 19922 - DNA, 20 bp, synthetic construct
  misc_feature 1..20: note = CRISPR gRNA sequence
  source 1..20: mol_type = other DNA
gaccagatgaagtgatcggt

SEQ ID NO: 19923 - DNA, 20 bp, synthetic construct
  misc_feature 1..20: note = CRISPR gRNA sequence
  source 1..20: mol_type = other DNA
gcagaaaagtcagaaaagac

SEQ ID NO: 19924 - DNA, 20 bp, synthetic construct
  misc_feature 1..20: note = CRISPR gRNA sequence
  source 1..20: mol_type = other DNA
ccttgactccaaagcctgct

SEQ ID NO: 19925 - DNA, 20 bp, synthetic construct
  misc_feature 1..20: note = CRISPR gRNA sequence
  source 1..20: mol_type = other DNA
cagttgctatagtctctatc

SEQ ID NO: 19926 - DNA, 20 bp, synthetic construct
  misc_feature 1..20: note = CRISPR gRNA sequence
  source 1..20: mol_type = other DNA
tcttcccatggctgactcct

SEQ ID NO: 19927 - DNA, 20 bp, synthetic construct
  misc_feature 1..20: note = CRISPR gRNA sequence
  source 1..20: mol_type = other DNA
agcacctcagtagatatctg

SEQ ID NO: 19928 - DNA, 20 bp, synthetic construct
  misc_feature 1..20: note = CRISPR gRNA sequence
  source 1..20: mol_type = other DNA
tgaatgaaaacatctgtaaa

SEQ ID NO: 19929 - DNA, 20 bp, synthetic construct
  misc_feature 1..20: note = CRISPR gRNA sequence
  source 1..20: mol_type = other DNA
aaaatgggtgtaacagttaa

SEQ ID NO: 19930 - DNA, 20 bp, synthetic construct
  misc_feature 1..20: note = CRISPR gRNA sequence
  source 1..20: mol_type = other DNA
cagttaactgagtacttatt

SEQ ID NO: 19931 - DNA, 20 bp, synthetic construct
  misc_feature 1..20: note = CRISPR gRNA sequence
  source 1..20: mol_type = other DNA
tttattcagttcttaaacag

SEQ ID NO: 19932 - DNA, 20 bp, synthetic construct
  misc_feature 1..20: note = CRISPR gRNA sequence
  source 1..20: mol_type = other DNA
ttaaacaggtgaatcgcaca

SEQ ID NO: 19933 - DNA, 20 bp, synthetic construct
  misc_feature 1..20: note = CRISPR gRNA sequence
  source 1..20: mol_type = other DNA
tatgagattttaaaagtgca

SEQ ID NO: 19934 - DNA, 20 bp, synthetic construct
  misc_feature 1..20: note = CRISPR gRNA sequence
  source 1..20: mol_type = other DNA
agtttgggaggccaaggggg

SEQ ID NO: 19935 - DNA, 20 bp, synthetic construct
  misc_feature 1..20: note = CRISPR gRNA sequence
  source 1..20: mol_type = other DNA
gggacggatcacttgaggtc

SEQ ID NO: 19936 - DNA, 20 bp, synthetic construct
  misc_feature 1..20: note = CRISPR gRNA sequence
  source 1..20: mol_type = other DNA
ccaaaaaatacaaaaattag

SEQ ID NO: 19937 - DNA, 20 bp, synthetic construct
  misc_feature 1..20: note = CRISPR gRNA sequence
  source 1..20: mol_type = other DNA
tactcgggaggctgaggcag

SEQ ID NO: 19938 - DNA, 20 bp, synthetic construct
  misc_feature 1..20: note = CRISPR gRNA sequence
  source 1..20: mol_type = other DNA
tcacgccactgcactccagc

SEQ ID NO: 19939 - DNA, 20 bp, synthetic construct
  misc_feature 1..20: note = CRISPR gRNA sequence
  source 1..20: mol_type = other DNA
ctgcactccagcctgggtgg

SEQ ID NO: 19940 - DNA, 20 bp, synthetic construct
  misc_feature 1..20: note = CRISPR gRNA sequence
  source 1..20: mol_type = other DNA
tctcaaacaacaacaaccaa

SEQ ID NO: 19941 - DNA, 20 bp, synthetic construct
  misc_feature 1..20: note = CRISPR gRNA sequence
  source 1..20: mol_type = other DNA
ctggcagatcacctgaggtc

SEQ ID NO: 19942 - DNA, 20 bp, synthetic construct
  misc_feature 1..20: note = CRISPR gRNA sequence
  source 1..20: mol_type = other DNA
atcccagctaccagggaggc

SEQ ID NO: 19943 - DNA, 20 bp, synthetic construct
  misc_feature 1..20: note = CRISPR gRNA sequence
  source 1..20: mol_type = other DNA
taccagggaggctagggtgg

SEQ ID NO: 19944 - DNA, 20 bp, synthetic construct
  misc_feature 1..20: note = CRISPR gRNA sequence
  source 1..20: mol_type = other DNA
tcaagatacaataaaagtga

SEQ ID NO: 19945 - DNA, 20 bp, synthetic construct
  misc_feature 1..20: note = CRISPR gRNA sequence
  source 1..20: mol_type = other DNA
ttttgattctacaattaatg

SEQ ID NO: 19946 - DNA, 20 bp, synthetic construct
  misc_feature 1..20: note = CRISPR gRNA sequence
  source 1..20: mol_type = other DNA
taaggccatgcagtgtttcg

SEQ ID NO: 19947 - DNA, 20 bp, synthetic construct
  misc_feature 1..20: note = CRISPR gRNA sequence
  source 1..20: mol_type = other DNA
agtcccttgctaagggacac

SEQ ID NO: 19948 - DNA, 20 bp, synthetic construct
  misc_feature 1..20: note = CRISPR gRNA sequence
  source 1..20: mol_type = other DNA
tgggtttttaatctgttgct

SEQ ID NO: 19949 - DNA, 20 bp, synthetic construct
  misc_feature 1..20: note = CRISPR gRNA sequence
  source 1..20: mol_type = other DNA
ctgcctggtatggtttgaga

SEQ ID NO: 19950 - DNA, 20 bp, synthetic construct
  misc_feature 1..20: note = CRISPR gRNA sequence
  source 1..20: mol_type = other DNA
ggtatggtttgagatggggt

SEQ ID NO: 19951 - DNA, 20 bp, synthetic construct
  misc_feature 1..20: note = CRISPR gRNA sequence
  source 1..20: mol_type = other DNA
ttgggttcaagccaaggagc

SEQ ID NO: 19952 - DNA, 20 bp, synthetic construct
  misc_feature 1..20: note = CRISPR gRNA sequence
  source 1..20: mol_type = other DNA
tcaagccaaggagctggggt

SEQ ID NO: 19953 - DNA, 20 bp, synthetic construct
  misc_feature 1..20: note = CRISPR gRNA sequence
  source 1..20: mol_type = other DNA
gttaaggccgtatagcctgc

SEQ ID NO: 19954 - DNA, 20 bp, synthetic construct
  misc_feature 1..20: note = CRISPR gRNA sequence
  source 1..20: mol_type = other DNA
ggtgtgcagggcaggtgggc

SEQ ID NO: 19955 - DNA, 20 bp, synthetic construct
  misc_feature 1..20: note = CRISPR gRNA sequence
  source 1..20: mol_type = other DNA
gcaggtgggctggggttggg

SEQ ID NO: 19956 - DNA, 20 bp, synthetic construct
  misc_feature 1..20: note = CRISPR gRNA sequence
  source 1..20: mol_type = other DNA
gtgggctggggttgggaagg

SEQ ID NO: 19957 - DNA, 20 bp, synthetic construct
  misc_feature 1..20: note = CRISPR gRNA sequence
  source 1..20: mol_type = other DNA
aagggtggatgccttgggga

SEQ ID NO: 19958 - DNA, 20 bp, synthetic construct
  misc_feature 1..20: note = CRISPR gRNA sequence
  source 1..20: mol_type = other DNA
actcctggcccaagtctgat

SEQ ID NO: 19959 - DNA, 20 bp, synthetic construct
  misc_feature 1..20: note = CRISPR gRNA sequence
  source 1..20: mol_type = other DNA
ggtgcagcccctgcccttct

SEQ ID NO: 19960 - DNA, 20 bp, synthetic construct
  misc_feature 1..20: note = CRISPR gRNA sequence
  source 1..20: mol_type = other DNA
ttgggtagaggctgagagct

SEQ ID NO: 19961 - DNA, 20 bp, synthetic construct
  misc_feature 1..20: note = CRISPR gRNA sequence
  source 1..20: mol_type = other DNA
gctgagagcttggggtccct

SEQ ID NO: 19962 - DNA, 20 bp, synthetic construct
  misc_feature 1..20: note = CRISPR gRNA sequence
  source 1..20: mol_type = other DNA
agctctccgtgtggaggccc

SEQ ID NO: 19963 - DNA, 20 bp, synthetic construct
  misc_feature 1..20: note = CRISPR gRNA sequence
  source 1..20: mol_type = other DNA
agtatgttagggggcttgga

SEQ ID NO: 19964 - DNA, 20 bp, synthetic construct
  misc_feature 1..20: note = CRISPR gRNA sequence
  source 1..20: mol_type = other DNA
ggctttctccctcttgggag

SEQ ID NO: 19965 - DNA, 20 bp, synthetic construct
  misc_feature 1..20: note = CRISPR gRNA sequence
  source 1..20: mol_type = other DNA
tccctcttgggaggtggata

SEQ ID NO: 19966 - DNA, 20 bp, synthetic construct
  misc_feature 1..20: note = CRISPR gRNA sequence
  source 1..20: mol_type = other DNA
catccgtgcgagcatcagga

SEQ ID NO: 19967 - DNA, 20 bp, synthetic construct
  misc_feature 1..20: note = CRISPR gRNA sequence
  source 1..20: mol_type = other DNA
caactgctctgctaggtgct

SEQ ID NO: 19968 - DNA, 20 bp, synthetic construct
  misc_feature 1..20: note = CRISPR gRNA sequence
  source 1..20: mol_type = other DNA
gggaaattagggccctttag

SEQ ID NO: 19969 - DNA, 20 bp, synthetic construct
  misc_feature 1..20: note = CRISPR gRNA sequence
  source 1..20: mol_type = other DNA
attaatcaaataagcaaaag

SEQ ID NO: 19970 - DNA, 20 bp, synthetic construct
  misc_feature 1..20: note = CRISPR gRNA sequence
  source 1..20: mol_type = other DNA
ccagttcctcgttgagctgc

SEQ ID NO: 19971 - DNA, 20 bp, synthetic construct
  misc_feature 1..20: note = CRISPR gRNA sequence
  source 1..20: mol_type = other DNA
caaatctctgaggctggaac

SEQ ID NO: 19972 - DNA, 20 bp, synthetic construct
  misc_feature 1..20: note = CRISPR gRNA sequence
  source 1..20: mol_type = other DNA
cagtatattcatctaccatg

SEQ ID NO: 19973 - DNA, 20 bp, synthetic construct
  misc_feature 1..20: note = CRISPR gRNA sequence
  source 1..20: mol_type = other DNA
gcagagattcctgaggtggt

SEQ ID NO: 19974 - DNA, 20 bp, synthetic construct
  misc_feature 1..20: note = CRISPR gRNA sequence
  source 1..20: mol_type = other DNA
ggtggtctgggtgcatgacc

SEQ ID NO: 19975 - DNA, 20 bp, synthetic construct
  misc_feature 1..20: note = CRISPR gRNA sequence
  source 1..20: mol_type = other DNA
taatgacaagtgatgtttac

SEQ ID NO: 19976 - DNA, 20 bp, synthetic construct
  misc_feature 1..20: note = CRISPR gRNA sequence
  source 1..20: mol_type = other DNA
cactcttttagtatactgat

SEQ ID NO: 19977 - DNA, 20 bp, synthetic construct
  misc_feature 1..20: note = CRISPR gRNA sequence
  source 1..20: mol_type = other DNA
cctactgacccaccacactg

SEQ ID NO: 19978 - DNA, 20 bp, synthetic construct
  misc_feature 1..20: note = CRISPR gRNA sequence
  source 1..20: mol_type = other DNA
gaaggtgtgtttgggctgtc

SEQ ID NO: 19979 - DNA, 20 bp, synthetic construct
  misc_feature 1..20: note = CRISPR gRNA sequence
  source 1..20: mol_type = other DNA
gctgtcagggatgagaccag

SEQ ID NO: 19980 - DNA, 20 bp, synthetic construct
  misc_feature 1..20: note = CRISPR gRNA sequence
  source 1..20: mol_type = other DNA
agcactgaccacacagcagg

SEQ ID NO: 19981 - DNA, 20 bp, synthetic construct
  misc_feature 1..20: note = CRISPR gRNA sequence
  source 1..20: mol_type = other DNA
ctgagctccacagcccagtt

SEQ ID NO: 19982 - DNA, 20 bp, synthetic construct
  misc_feature 1..20: note = CRISPR gRNA sequence
  source 1..20: mol_type = other DNA
tccacagcccagtttggagt

SEQ ID NO: 19983 - DNA, 20 bp, synthetic construct
  misc_feature 1..20: note = CRISPR gRNA sequence
  source 1..20: mol_type = other DNA
gggtgacccaagtgcatttc

SEQ ID NO: 19984 - DNA, 20 bp, synthetic construct
  misc_feature 1..20: note = CRISPR gRNA sequence
  source 1..20: mol_type = other DNA
cagccaagtaccccctccca

SEQ ID NO: 19985 - DNA, 20 bp, synthetic construct
  misc_feature 1..20: note = CRISPR gRNA sequence
  source 1..20: mol_type = other DNA
cctgtgagaggtactagaag

SEQ ID NO: 19986 - DNA, 20 bp, synthetic construct
  misc_feature 1..20: note = CRISPR gRNA sequence
  source 1..20: mol_type = other DNA
caggatcgaggccctgggga

SEQ ID NO: 19987 - DNA, 20 bp, synthetic construct
  misc_feature 1..20: note = CRISPR gRNA sequence
  source 1..20: mol_type = other DNA
agggacaacaggtcatgttt

SEQ ID NO: 19988 - DNA, 20 bp, synthetic construct
  misc_feature 1..20: note = CRISPR gRNA sequence
  source 1..20: mol_type = other DNA
taggggtcagtcgggacagg

SEQ ID NO: 19989 - DNA, 20 bp, synthetic construct
  misc_feature 1..20: note = CRISPR gRNA sequence
  source 1..20: mol_type = other DNA
cgggacagggagggtctcca

SEQ ID NO: 19990 - DNA, 20 bp, synthetic construct
  misc_feature 1..20: note = CRISPR gRNA sequence
  source 1..20: mol_type = other DNA
gagtggaggcatggttgtgg

SEQ ID NO: 19991 - DNA, 20 bp, synthetic construct
  misc_feature 1..20: note = CRISPR gRNA sequence
  source 1..20: mol_type = other DNA
tgtgggggaatggacagcta

SEQ ID NO: 19992 - DNA, 20 bp, synthetic construct
  misc_feature 1..20: note = CRISPR gRNA sequence
  source 1..20: mol_type = other DNA
ttatttatttattgttgaga

SEQ ID NO: 19993 - DNA, 20 bp, synthetic construct
  misc_feature 1..20: note = CRISPR gRNA sequence
  source 1..20: mol_type = other DNA
tctcactctgttgcccaggc

SEQ ID NO: 19994 - DNA, 20 bp, synthetic construct
  misc_feature 1..20: note = CRISPR gRNA sequence
  source 1..20: mol_type = other DNA
gcctcagcctccggagcagc

SEQ ID NO: 19995 - DNA, 20 bp, synthetic construct
  misc_feature 1..20: note = CRISPR gRNA sequence
  source 1..20: mol_type = other DNA
gcctcgacctcccaaagtgc

SEQ ID NO: 19996 - DNA, 20 bp, synthetic construct
  misc_feature 1..20: note = CRISPR gRNA sequence
  source 1..20: mol_type = other DNA
tgcgattttcttttttaaac

SEQ ID NO: 19997 - DNA, 20 bp, synthetic construct
  misc_feature 1..20: note = CRISPR gRNA sequence
  source 1..20: mol_type = other DNA
ttggccaaagaaagacatat

SEQ ID NO: 19998 - DNA, 20 bp, synthetic construct
  misc_feature 1..20: note = CRISPR gRNA sequence
  source 1..20: mol_type = other DNA
actaagtggcccagagggag

SEQ ID NO: 19999 - DNA, 20 bp, synthetic construct
  misc_feature 1..20: note = CRISPR gRNA sequence
  source 1..20: mol_type = other DNA
ccagagggaggggggtcccc

SEQ ID NO: 20000 - DNA, 20 bp, synthetic construct
  misc_feature 1..20: note = CRISPR gRNA sequence
  source 1..20: mol_type = other DNA
caagcttccaaaatggcctg

SEQ ID NO: 20001 - DNA, 20 bp, synthetic construct
  misc_feature 1..20: note = CRISPR gRNA sequence
  source 1..20: mol_type = other DNA
aaatggcctggtgagtgatg

SEQ ID NO: 20002 - DNA, 20 bp, synthetic construct
  misc_feature 1..20: note = CRISPR gRNA sequence
  source 1..20: mol_type = other DNA
tgatgcgggatctctctgcc

SEQ ID NO: 20003 - DNA, 20 bp, synthetic construct
  misc_feature 1..20: note = CRISPR gRNA sequence
  source 1..20: mol_type = other DNA
tgcccttcaataagcctgca

SEQ ID NO: 20004 - DNA, 20 bp, synthetic construct
  misc_feature 1..20: note = CRISPR gRNA sequence
  source 1..20: mol_type = other DNA
acacttcattgtcaggctga

SEQ ID NO: 20005 - DNA, 20 bp, synthetic construct
  misc_feature 1..20: note = CRISPR gRNA sequence
  source 1..20: mol_type = other DNA
ttcattgtcaggctgagaga

SEQ ID NO: 20006 - DNA, 20 bp, synthetic construct
  misc_feature 1..20: note = CRISPR gRNA sequence
  source 1..20: mol_type = other DNA
agagaatgaatgaggggcaa

SEQ ID NO: 20007 - DNA, 20 bp, synthetic construct
  misc_feature 1..20: note = CRISPR gRNA sequence
  source 1..20: mol_type = other DNA
aggggcaagcgaatgatgaa

SEQ ID NO: 20008 - DNA, 20 bp, synthetic construct
  misc_feature 1..20: note = CRISPR gRNA sequence
  source 1..20: mol_type = other DNA
gcaagcgaatgatgaagtga

SEQ ID NO: 20009 - DNA, 20 bp, synthetic construct
  misc_feature 1..20: note = CRISPR gRNA sequence
  source 1..20: mol_type = other DNA
gcgaatgatgaagtgagtga

SEQ ID NO: 20010 - DNA, 20 bp, synthetic construct
  misc_feature 1..20: note = CRISPR gRNA sequence
  source 1..20: mol_type = other DNA
ggatgaagtgagaagttgat

SEQ ID NO: 20011 - DNA, 20 bp, synthetic construct
  misc_feature 1..20: note = CRISPR gRNA sequence
  source 1..20: mol_type = other DNA
ggatgggagcaatggaaagt

SEQ ID NO: 20012 - DNA, 20 bp, synthetic construct
  misc_feature 1..20: note = CRISPR gRNA sequence
  source 1..20: mol_type = other DNA
tggaaagtgggaataaacca

SEQ ID NO: 20013 - DNA, 20 bp, synthetic construct
  misc_feature 1..20: note = CRISPR gRNA sequence
  source 1..20: mol_type = other DNA
gggaataaaccagtgaataa

SEQ ID NO: 20014 - DNA, 20 bp, synthetic construct
  misc_feature 1..20: note = CRISPR gRNA sequence
  source 1..20: mol_type = other DNA
atgaggctactgaggcatgg

SEQ ID NO: 20015 - DNA, 20 bp, synthetic construct
  misc_feature 1..20: note = CRISPR gRNA sequence
  source 1..20: mol_type = other DNA
ggtgggatgtatagcatgct

SEQ ID NO: 20016 - DNA, 20 bp, synthetic construct
  misc_feature 1..20: note = CRISPR gRNA sequence
  source 1..20: mol_type = other DNA
gctccagcaagtggtagaac

SEQ ID NO: 20017 - DNA, 20 bp, synthetic construct
  misc_feature 1..20: note = CRISPR gRNA sequence
  source 1..20: mol_type = other DNA
cctcccatgacctccccatg

SEQ ID NO: 20018 - DNA, 20 bp, synthetic construct
  misc_feature 1..20: note = CRISPR gRNA sequence
  source 1..20: mol_type = other DNA
ccatgacctccccatggtga

SEQ ID NO: 20019 - DNA, 20 bp, synthetic construct
  misc_feature 1..20: note = CRISPR gRNA sequence
  source 1..20: mol_type = other DNA
tcaagcgaagaaaaagctta

SEQ ID NO: 20020 - DNA, 20 bp, synthetic construct
  misc_feature 1..20: note = CRISPR gRNA sequence
  source 1..20: mol_type = other DNA
aaagcttagtgagtaaatga

SEQ ID NO: 20021 - DNA, 20 bp, synthetic construct
  misc_feature 1..20: note = CRISPR gRNA sequence
  source 1..20: mol_type = other DNA
actttgggaggccaaggcag

SEQ ID NO: 20022 - DNA, 20 bp, synthetic construct
  misc_feature 1..20: note = CRISPR gRNA sequence
  source 1..20: mol_type = other DNA
caggtggatcacctgaggtc

SEQ ID NO: 20023 - DNA, 20 bp, synthetic construct
  misc_feature 1..20: note = CRISPR gRNA sequence
  source 1..20: mol_type = other DNA
aaaattagccagacgtggta

SEQ ID NO: 20024 - DNA, 20 bp, synthetic construct
  misc_feature 1..20: note = CRISPR gRNA sequence
  source 1..20: mol_type = other DNA
tacttggcaggccgaggcag

SEQ ID NO: 20025 - DNA, 20 bp, synthetic construct
  misc_feature 1..20: note = CRISPR gRNA sequence
  source 1..20: mol_type = other DNA
ctccagcctggggcacaggg

SEQ ID NO: 20026 - DNA, 20 bp, synthetic construct
  misc_feature 1..20: note = CRISPR gRNA sequence
  source 1..20: mol_type = other DNA
aaagagagaaaaggtctaaa

SEQ ID NO: 20027 - DNA, 20 bp, synthetic construct
  misc_feature 1..20: note = CRISPR gRNA sequence
  source 1..20: mol_type = other DNA
acacttaaacaagagagacg

SEQ ID NO: 20028 - DNA, 20 bp, synthetic construct
  misc_feature 1..20: note = CRISPR gRNA sequence
  source 1..20: mol_type = other DNA
acaagagagacgatgagtga

SEQ ID NO: 20029 - DNA, 20 bp, synthetic construct
  misc_feature 1..20: note = CRISPR gRNA sequence
  source 1..20: mol_type = other DNA
gagagacgatgagtgaagga

SEQ ID NO: 20030 - DNA, 20 bp, synthetic construct
  misc_feature 1..20: note = CRISPR gRNA sequence
  source 1..20: mol_type = other DNA
gtgaaggaatgggtgtggaa

SEQ ID NO: 20031 - DNA, 20 bp, synthetic construct
  misc_feature 1..20: note = CRISPR gRNA sequence
  source 1..20: mol_type = other DNA
gtgtggaaatgagtgaacta

SEQ ID NO: 20032 - DNA, 20 bp, synthetic construct
  misc_feature 1..20: note = CRISPR gRNA sequence
  source 1..20: mol_type = other DNA
ggaaatgagtgaactaatga

SEQ ID NO: 20033 - DNA, 20 bp, synthetic construct
  misc_feature 1..20: note = CRISPR gRNA sequence
  source 1..20: mol_type = other DNA
agtgaactaatgaatgagtg

SEQ ID NO: 20034 - DNA, 20 bp, synthetic construct
  misc_feature 1..20: note = CRISPR gRNA sequence
  source 1..20: mol_type = other DNA
aatgaatgagtggtgggtga

SEQ ID NO: 20035 - DNA, 20 bp, synthetic construct
  misc_feature 1..20: note = CRISPR gRNA sequence
  source 1..20: mol_type = other DNA
tactcaggaggctgaggtgg

SEQ ID NO: 20036 - DNA, 20 bp, synthetic construct
  misc_feature 1..20: note = CRISPR gRNA sequence
  source 1..20: mol_type = other DNA
ggtcccagctacttgggagg

SEQ ID NO: 20037 - DNA, 20 bp, synthetic construct
  misc_feature 1..20: note = CRISPR gRNA sequence
  source 1..20: mol_type = other DNA
tacttgggaggtggagtcag

SEQ ID NO: 20038 - DNA, 20 bp, synthetic construct
  misc_feature 1..20: note = CRISPR gRNA sequence
  source 1..20: mol_type = other DNA
atggtgccgagcccgcaggc

SEQ ID NO: 20039 - DNA, 20 bp, synthetic construct
  misc_feature 1..20: note = CRISPR gRNA sequence
  source 1..20: mol_type = other DNA
cggatggcatcctagtggag

SEQ ID NO: 20040 - DNA, 20 bp, synthetic construct
  misc_feature 1..20: note = CRISPR gRNA sequence
  source 1..20: mol_type = other DNA
caccggcggccgcgtgagac

SEQ ID NO: 20041 - DNA, 20 bp, synthetic construct
  misc_feature 1..20: note = CRISPR gRNA sequence
  source 1..20: mol_type = other DNA
gccattgcttgaaccgtccg

SEQ ID NO: 20042 - DNA, 20 bp, synthetic construct
  misc_feature 1..20: note = CRISPR gRNA sequence
  source 1..20: mol_type = other DNA
cgggggatgcctatggcctg

SEQ ID NO: 20043 - DNA, 20 bp, synthetic construct
  misc_feature 1..20: note = CRISPR gRNA sequence
  source 1..20: mol_type = other DNA
atgcgctactttgagagctc

SEQ ID NO: 20044 - DNA, 20 bp, synthetic construct
  misc_feature 1..20: note = CRISPR gRNA sequence
  source 1..20: mol_type = other DNA
ccaacacccaccgcgggccg

SEQ ID NO: 20045 - DNA, 20 bp, synthetic construct
  misc_feature 1..20: note = CRISPR gRNA sequence
  source 1..20: mol_type = other DNA
tgggggccctgtggctggct

SEQ ID NO: 20046 - DNA, 20 bp, synthetic construct
  misc_feature 1..20: note = CRISPR gRNA sequence
  source 1..20: mol_type = other DNA
gcccacgaggccgaggaggc

SEQ ID NO: 20047 - DNA, 20 bp, synthetic construct
  misc_feature 1..20: note = CRISPR gRNA sequence
  source 1..20: mol_type = other DNA
cagcactggcatttgcccct

SEQ ID NO: 20048 - DNA, 20 bp, synthetic construct
  misc_feature 1..20: note = CRISPR gRNA sequence
  source 1..20: mol_type = other DNA
gctgtgtcacccgtttcagg

SEQ ID NO: 20049 - DNA, 20 bp, synthetic construct
  misc_feature 1..20: note = CRISPR gRNA sequence
  source 1..20: mol_type = other DNA
gtgccaagcccagtgctctg

SEQ ID NO: 20050 - DNA, 20 bp, synthetic construct
  misc_feature 1..20: note = CRISPR gRNA sequence
  source 1..20: mol_type = other DNA
tcttttagtatgcagagcag

SEQ ID NO: 20051 - DNA, 20 bp, synthetic construct
  misc_feature 1..20: note = CRISPR gRNA sequence
  source 1..20: mol_type = other DNA
tgcagagcagccgggtgggg

SEQ ID NO: 20052 - DNA, 20 bp, synthetic construct
  misc_feature 1..20: note = CRISPR gRNA sequence
  source 1..20: mol_type = other DNA
gagcagccgggtggggcaga

SEQ ID NO: 20053 - DNA, 20 bp, synthetic construct
  misc_feature 1..20: note = CRISPR gRNA sequence
  source 1..20: mol_type = other DNA
attctctccatttttaagat

SEQ ID NO: 20054 - DNA, 20 bp, synthetic construct
  misc_feature 1..20: note = CRISPR gRNA sequence
  source 1..20: mol_type = other DNA
gcccgccatgtgccagtcac

SEQ ID NO: 20055 - DNA, 20 bp, synthetic construct
  misc_feature 1..20: note = CRISPR gRNA sequence
  source 1..20: mol_type = other DNA
gccagtcactggggtatgtc

SEQ ID NO: 20056 - DNA, 20 bp, synthetic construct
  misc_feature 1..20: note = CRISPR gRNA sequence
  source 1..20: mol_type = other DNA
cgccaccgttttcttatgct

SEQ ID NO: 20057 - DNA, 20 bp, synthetic construct
  misc_feature 1..20: note = CRISPR gRNA sequence
  source 1..20: mol_type = other DNA
cagaccaatcttctcagaac

SEQ ID NO: 20058 - DNA, 20 bp, synthetic construct
  misc_feature 1..20: note = CRISPR gRNA sequence
  source 1..20: mol_type = other DNA
cagggacactccaccactgt

SEQ ID NO: 20059 - DNA, 20 bp, synthetic construct
  misc_feature 1..20: note = CRISPR gRNA sequence
  source 1..20: mol_type = other DNA
gcatttcagcttaatcgcca

SEQ ID NO: 20060 - DNA, 20 bp, synthetic construct
  misc_feature 1..20: note = CRISPR gRNA sequence
  source 1..20: mol_type = other DNA
aagggaaagaaaaccactgt

SEQ ID NO: 20061 - DNA, 20 bp, synthetic construct
  misc_feature 1..20: note = CRISPR gRNA sequence
  source 1..20: mol_type = other DNA
tgtgtgagttgtgagaaagt

SEQ ID NO: 20062 - DNA, 20 bp, synthetic construct
  misc_feature 1..20: note = CRISPR gRNA sequence
  source 1..20: mol_type = other DNA
aagtaggaatcaataaaggc

SEQ ID NO: 20063 - DNA, 20 bp, synthetic construct
  misc_feature 1..20: note = CRISPR gRNA sequence
  source 1..20: mol_type = other DNA
gtctagcctggtcaccgtgc

SEQ ID NO: 20064 - DNA, 20 bp, synthetic construct
  misc_feature 1..20: note = CRISPR gRNA sequence
  source 1..20: mol_type = other DNA
gagcgacacggtggcgctgt

SEQ ID NO: 20065 - DNA, 20 bp, synthetic construct
  misc_feature 1..20: note = CRISPR gRNA sequence
  source 1..20: mol_type = other DNA
ctttcaaagccaagtccctg

SEQ ID NO: 20066 - DNA, 20 bp, synthetic construct
  misc_feature 1..20: note = CRISPR gRNA sequence
  source 1..20: mol_type = other DNA
actcagaggtgagaggagag

SEQ ID NO: 20067 - DNA, 20 bp, synthetic construct
  misc_feature 1..20: note = CRISPR gRNA sequence
  source 1..20: mol_type = other DNA
ctttctgggcaatggctaac

SEQ ID NO: 20068 - DNA, 20 bp, synthetic construct
  misc_feature 1..20: note = CRISPR gRNA sequence
  source 1..20: mol_type = other DNA
cgctgcccaggcggagcctc

SEQ ID NO: 20069 - DNA, 20 bp, synthetic construct
  misc_feature 1..20: note = CRISPR gRNA sequence
  source 1..20: mol_type = other DNA
tggagaacctctccccttct

SEQ ID NO: 20070 - DNA, 20 bp, synthetic construct
  misc_feature 1..20: note = CRISPR gRNA sequence
  source 1..20: mol_type = other DNA
ctccccttctaggagttaac

SEQ ID NO: 20071 - DNA, 20 bp, synthetic construct
  misc_feature 1..20: note = CRISPR gRNA sequence
  source 1..20: mol_type = other DNA
agcgcctcttaagtgctgtc

SEQ ID NO: 20072 - DNA, 20 bp, synthetic construct
  misc_feature 1..20: note = CRISPR gRNA sequence
  source 1..20: mol_type = other DNA
tttttattatttcttaaaga

SEQ ID NO: 20073 - DNA, 20 bp, synthetic construct
  misc_feature 1..20: note = CRISPR gRNA sequence
  source 1..20: mol_type = other DNA
tctcgctgtgtctaccaggc

SEQ ID NO: 20074 - DNA, 20 bp, synthetic construct
  misc_feature 1..20: note = CRISPR gRNA sequence
  source 1..20: mol_type = other DNA
gcctcagcctcccaagtagc

SEQ ID NO: 20075 - DNA, 20 bp, synthetic construct
  misc_feature 1..20: note = CRISPR gRNA sequence
  source 1..20: mol_type = other DNA
tataggtgcacgtcatcaca

SEQ ID NO: 20076 - DNA, 20 bp, synthetic construct
  misc_feature 1..20: note = CRISPR gRNA sequence
  source 1..20: mol_type = other DNA
ttttaagtttttgtagacac

SEQ ID NO: 20077 - DNA, 20 bp, synthetic construct
  misc_feature 1..20: note = CRISPR gRNA sequence
  source 1..20: mol_type = other DNA
caaggaaagcaatccccctg

SEQ ID NO: 20078 - DNA, 20 bp, synthetic construct
  misc_feature 1..20: note = CRISPR gRNA sequence
  source 1..20: mol_type = other DNA
gggcagccatcatgggaccc

SEQ ID NO: 20079 - DNA, 20 bp, synthetic construct
  misc_feature 1..20: note = CRISPR gRNA sequence
  source 1..20: mol_type = other DNA
tgttcgggacctaaagaaac

SEQ ID NO: 20080 - DNA, 20 bp, synthetic construct
  misc_feature 1..20: note = CRISPR gRNA sequence
  source 1..20: mol_type = other DNA
actggagtttgcgtaagcaa

SEQ ID NO: 20081 - DNA, 20 bp, synthetic construct
  misc_feature 1..20: note = CRISPR gRNA sequence
  source 1..20: mol_type = other DNA
gagtttgcgtaagcaaaggg

SEQ ID NO: 20082 - DNA, 20 bp, synthetic construct
  misc_feature 1..20: note = CRISPR gRNA sequence
  source 1..20: mol_type = other DNA
gcaaaggggtggattgtctt

SEQ ID NO: 20083 - DNA, 20 bp, synthetic construct
  misc_feature 1..20: note = CRISPR gRNA sequence
  source 1..20: mol_type = other DNA
attagctgggcttgtaccac

SEQ ID NO: 20084 - DNA, 20 bp, synthetic construct
  misc_feature 1..20: note = CRISPR gRNA sequence
  source 1..20: mol_type = other DNA
cctgaatggagatagatctc

SEQ ID NO: 20085 - DNA, 20 bp, synthetic construct
  misc_feature 1..20: note = CRISPR gRNA sequence
  source 1..20: mol_type = other DNA
tcaacagaggtattgagcac

SEQ ID NO: 20086 - DNA, 20 bp, synthetic construct
  misc_feature 1..20: note = CRISPR gRNA sequence
  source 1..20: mol_type = other DNA
atctgcactgaagcttcagt

SEQ ID NO: 20087 - DNA, 20 bp, synthetic construct
  misc_feature 1..20: note = CRISPR gRNA sequence
  source 1..20: mol_type = other DNA
ctgaagcttcagtgaggata

SEQ ID NO: 20088 - DNA, 20 bp, synthetic construct
  misc_feature 1..20: note = CRISPR gRNA sequence
  source 1..20: mol_type = other DNA
cagtgaggataaggaatgag

SEQ ID NO: 20089 - DNA, 20 bp, synthetic construct
  misc_feature 1..20: note = CRISPR gRNA sequence
  source 1..20: mol_type = other DNA
aatgagctgagtggggagag

SEQ ID NO: 20090 - DNA, 20 bp, synthetic construct
  misc_feature 1..20: note = CRISPR gRNA sequence
  source 1..20: mol_type = other DNA
gggagtaagaaaggctttcc

SEQ ID NO: 20091 - DNA, 20 bp, synthetic construct
  misc_feature 1..20: note = CRISPR gRNA sequence
  source 1..20: mol_type = other DNA
ccaggaattgtaatttcgcc

SEQ ID NO: 20092 - DNA, 20 bp, synthetic construct
  misc_feature 1..20: note = CRISPR gRNA sequence
  source 1..20: mol_type = other DNA
gtgtccccaaccttccatag

SEQ ID NO: 20093 - DNA, 20 bp, synthetic construct
  misc_feature 1..20: note = CRISPR gRNA sequence
  source 1..20: mol_type = other DNA
ggaggatgccactatgacta

SEQ ID NO: 20094 - DNA, 20 bp, synthetic construct
  misc_feature 1..20: note = CRISPR gRNA sequence
  source 1..20: mol_type = other DNA
cttgtttacttccacagcca

SEQ ID NO: 20095 - DNA, 20 bp, synthetic construct
  misc_feature 1..20: note = CRISPR gRNA sequence
  source 1..20: mol_type = other DNA
caagggatggcctccccagg

SEQ ID NO: 20096 - DNA, 20 bp, synthetic construct
  misc_feature 1..20: note = CRISPR gRNA sequence
  source 1..20: mol_type = other DNA
aggagcttttgatgtgcagc

SEQ ID NO: 20097 - DNA, 20 bp, synthetic construct
  misc_feature 1..20: note = CRISPR gRNA sequence
  source 1..20: mol_type = other DNA
cacaccctaggcagtgttgc

SEQ ID NO: 20098 - DNA, 20 bp, synthetic construct
  misc_feature 1..20: note = CRISPR gRNA sequence
  source 1..20: mol_type = other DNA
gagacctaggcaaggctcta

SEQ ID NO: 20099 - DNA, 20 bp, synthetic construct
  misc_feature 1..20: note = CRISPR gRNA sequence
  source 1..20: mol_type = other DNA
tctagggagtccagttgtgt

SEQ ID NO: 20100 - DNA, 20 bp, synthetic construct
  misc_feature 1..20: note = CRISPR gRNA sequence
  source 1..20: mol_type = other DNA
attattatatttagatctgt

SEQ ID NO: 20101 - DNA, 20 bp, synthetic construct
  misc_feature 1..20: note = CRISPR gRNA sequence
  source 1..20: mol_type = other DNA
ttttcttttctttcttgagg

SEQ ID NO: 20102 - DNA, 20 bp, synthetic construct
  misc_feature 1..20: note = CRISPR gRNA sequence
  source 1..20: mol_type = other DNA
tcttactctgtccctcaggc

SEQ ID NO: 20103 - DNA, 20 bp, synthetic construct
  misc_feature 1..20: note = CRISPR gRNA sequence
  source 1..20: mol_type = other DNA
ttttgtattttttgtagaga

SEQ ID NO: 20104 - DNA, 20 bp, synthetic construct
  misc_feature 1..20: note = CRISPR gRNA sequence
  source 1..20: mol_type = other DNA
acctcagcctcccaaagtgc

SEQ ID NO: 20105 - DNA, 20 bp, synthetic construct
  misc_feature 1..20: note = CRISPR gRNA sequence
  source 1..20: mol_type = other DNA
ccttccacagaaaaagctaa

SEQ ID NO: 20106 - DNA, 20 bp, synthetic construct
  misc_feature 1..20: note = CRISPR gRNA sequence
  source 1..20: mol_type = other DNA
atgaatgtttgttccttggt

SEQ ID NO: 20107 - DNA, 20 bp, synthetic construct
  misc_feature 1..20: note = CRISPR gRNA sequence
  source 1..20: mol_type = other DNA
agatcatctaatgattagga

SEQ ID NO: 20108 - DNA, 20 bp, synthetic construct
  misc_feature 1..20: note = CRISPR gRNA sequence
  source 1..20: mol_type = other DNA
gtgctgtttttttttggaga

SEQ ID NO: 20109 - DNA, 20 bp, synthetic construct
  misc_feature 1..20: note = CRISPR gRNA sequence
  source 1..20: mol_type = other DNA
tcttgctctgtcacccaggc

SEQ ID NO: 20110 - DNA, 20 bp, synthetic construct
  misc_feature 1..20: note = CRISPR gRNA sequence
  source 1..20: mol_type = other DNA
aattttcctgcctcagcctc

SEQ ID NO: 20111 - DNA, 20 bp, synthetic construct
  misc_feature 1..20: note = CRISPR gRNA sequence
  source 1..20: mol_type = other DNA
gcctcagcctcccgagtagc

SEQ ID NO: 20112 - DNA, 20 bp, synthetic construct
  misc_feature 1..20: note = CRISPR gRNA sequence
  source 1..20: mol_type = other DNA
acctcagcctcccaaagtgc

SEQ ID NO: 20113 - DNA, 20 bp, synthetic construct
  misc_feature 1..20: note = CRISPR gRNA sequence
  source 1..20: mol_type = other DNA
gctctggggaacagcggcca

SEQ ID NO: 20114 - DNA, 20 bp, synthetic construct
  misc_feature 1..20: note = CRISPR gRNA sequence
  source 1..20: mol_type = other DNA
tggggtggaacagcctagag

SEQ ID NO: 20115 - DNA, 20 bp, synthetic construct
  misc_feature 1..20: note = CRISPR gRNA sequence
  source 1..20: mol_type = other DNA
acctcatctgtctgtcaaat

SEQ ID NO: 20116 - DNA, 20 bp, synthetic construct
  misc_feature 1..20: note = CRISPR gRNA sequence
  source 1..20: mol_type = other DNA
acagggacttcgtttgtaca

SEQ ID NO: 20117 - DNA, 20 bp, synthetic construct
  misc_feature 1..20: note = CRISPR gRNA sequence
  source 1..20: mol_type = other DNA
acccttatctcctacactcg

SEQ ID NO: 20118 - DNA, 20 bp, synthetic construct
  misc_feature 1..20: note = CRISPR gRNA sequence
  source 1..20: mol_type = other DNA
caccggctgtgccctctgcc

SEQ ID NO: 20119 - DNA, 20 bp, synthetic construct
  misc_feature 1..20: note = CRISPR gRNA sequence
  source 1..20: mol_type = other DNA
ttctttttctttttttgagg

SEQ ID NO: 20120 - DNA, 20 bp, synthetic construct
  misc_feature 1..20: note = CRISPR gRNA sequence
  source 1..20: mol_type = other DNA
tctcgctctgtcacccaggc

SEQ ID NO: 20121 - DNA, 20 bp, synthetic construct
  misc_feature 1..20: note = CRISPR gRNA sequence
  source 1..20: mol_type = other DNA
gattctcttgcctcagcctc

SEQ ID NO: 20122 - DNA, 20 bp, synthetic construct
  misc_feature 1..20: note = CRISPR gRNA sequence
  source 1..20: mol_type = other DNA
ttttgtatttttagtagaga

SEQ ID NO: 20123 - DNA, 20 bp, synthetic construct
  misc_feature 1..20: note = CRISPR gRNA sequence
  source 1..20: mol_type = other DNA
cggggtttcaccgtgttagc

SEQ ID NO: 20124 - DNA, 20 bp, synthetic construct
  misc_feature 1..20: note = CRISPR gRNA sequence
  source 1..20: mol_type = other DNA
acctcggcctcccaaagtgc

SEQ ID NO: 20125 - DNA, 20 bp, synthetic construct
  misc_feature 1..20: note = CRISPR gRNA sequence
  source 1..20: mol_type = other DNA
actttgggaggccgaggcag

SEQ ID NO: 20126 - DNA, 20 bp, synthetic construct
  misc_feature 1..20: note = CRISPR gRNA sequence
  source 1..20: mol_type = other DNA
ggcaggtggatcacaaggcc

SEQ ID NO: 20127 - DNA, 20 bp, synthetic construct
  misc_feature 1..20: note = CRISPR gRNA sequence
  source 1..20: mol_type = other DNA
tacttgggaggctgaggcag

SEQ ID NO: 20128 - DNA, 20 bp, synthetic construct
  misc_feature 1..20: note = CRISPR gRNA sequence
  source 1..20: mol_type = other DNA
tcacgccactgcagtccagc

SEQ ID NO: 20129 - DNA, 20 bp, synthetic construct
  misc_feature 1..20: note = CRISPR gRNA sequence
  source 1..20: mol_type = other DNA
ctgcagtccagcttggatga

SEQ ID NO: 20130 - DNA, 20 bp, synthetic construct
  misc_feature 1..20: note = CRISPR gRNA sequence
  source 1..20: mol_type = other DNA
tatctgtctatcttcccccc

SEQ ID NO: 20131 - DNA, 20 bp, synthetic construct
  misc_feature 1..20: note = CRISPR gRNA sequence
  source 1..20: mol_type = other DNA
aatgtcagcacccagaaggc

SEQ ID NO: 20132 - DNA, 20 bp, synthetic construct
  misc_feature 1..20: note = CRISPR gRNA sequence
  source 1..20: mol_type = other DNA
caagcggtcaatatttaaca

SEQ ID NO: 20133 - DNA, 20 bp, synthetic construct
  misc_feature 1..20: note = CRISPR gRNA sequence
  source 1..20: mol_type = other DNA
tccaagaacccccataagat

SEQ ID NO: 20134 - DNA, 20 bp, synthetic construct
  misc_feature 1..20: note = CRISPR gRNA sequence
  source 1..20: mol_type = other DNA
atttgaggagatcaagactt

SEQ ID NO: 20135 - DNA, 20 bp, synthetic construct
  misc_feature 1..20: note = CRISPR gRNA sequence
  source 1..20: mol_type = other DNA
agatcaagacttaagggtga

SEQ ID NO: 20136 - DNA, 20 bp, synthetic construct
  misc_feature 1..20: note = CRISPR gRNA sequence
  source 1..20: mol_type = other DNA
gggagccaaatgccagatcc

SEQ ID NO: 20137 - DNA, 20 bp, synthetic construct
  misc_feature 1..20: note = CRISPR gRNA sequence
  source 1..20: mol_type = other DNA
aggccagtgttctcagactt

SEQ ID NO: 20138 - DNA, 20 bp, synthetic construct
  misc_feature 1..20: note = CRISPR gRNA sequence
  source 1..20: mol_type = other DNA
ttcagaggccgagaacattt

SEQ ID NO: 20139 - DNA, 20 bp, synthetic construct
  misc_feature 1..20: note = CRISPR gRNA sequence
  source 1..20: mol_type = other DNA
gaggccgagaacatttcgga

SEQ ID NO: 20140 - DNA, 20 bp, synthetic construct
  misc_feature 1..20: note = CRISPR gRNA sequence
  source 1..20: mol_type = other DNA
gagaacatttcggaatgaat

SEQ ID NO: 20141 - DNA, 20 bp, synthetic construct
  misc_feature 1..20: note = CRISPR gRNA sequence
  source 1..20: mol_type = other DNA
actgttttttaatgtttatc

SEQ ID NO: 20142 - DNA, 20 bp, synthetic construct
  misc_feature 1..20: note = CRISPR gRNA sequence
  source 1..20: mol_type = other DNA
ctggcaccataattttacca

SEQ ID NO: 20143 - DNA, 20 bp, synthetic construct
  misc_feature 1..20: note = CRISPR gRNA sequence
  source 1..20: mol_type = other DNA
aagttcaaaggacataattg

SEQ ID NO: 20144 - DNA, 20 bp, synthetic construct
  misc_feature 1..20: note = CRISPR gRNA sequence
  source 1..20: mol_type = other DNA
ataaaagacagctctttata

SEQ ID NO: 20145 - DNA, 20 bp, synthetic construct
  misc_feature 1..20: note = CRISPR gRNA sequence
  source 1..20: mol_type = other DNA
ggagataagagcccatagct

SEQ ID NO: 20146 - DNA, 20 bp, synthetic construct
  misc_feature 1..20: note = CRISPR gRNA sequence
  source 1..20: mol_type = other DNA
gcccatagctcagagtcttg

SEQ ID NO: 20147 - DNA, 20 bp, synthetic construct
  misc_feature 1..20: note = CRISPR gRNA sequence
  source 1..20: mol_type = other DNA
tccccaggctgcggcgggag

SEQ ID NO: 20148 - DNA, 20 bp, synthetic construct
  misc_feature 1..20: note = CRISPR gRNA sequence
  source 1..20: mol_type = other DNA
gcggcgggagaagggtatct

SEQ ID NO: 20149 - DNA, 20 bp, synthetic construct
  misc_feature 1..20: note = CRISPR gRNA sequence
  source 1..20: mol_type = other DNA
gggtatctgtggatgttggg

SEQ ID NO: 20150 - DNA, 20 bp, synthetic construct
  misc_feature 1..20: note = CRISPR gRNA sequence
  source 1..20: mol_type = other DNA
gttttttttcttttttgaga

SEQ ID NO: 20151 - DNA, 20 bp, synthetic construct
  misc_feature 1..20: note = CRISPR gRNA sequence
  source 1..20: mol_type = other DNA
ggtctcgctcttacccaggc

SEQ ID NO: 20152 - DNA, 20 bp, synthetic construct
  misc_feature 1..20: note = CRISPR gRNA sequence
  source 1..20: mol_type = other DNA
tattgtgttttttgtagaga

SEQ ID NO: 20153 - DNA, 20 bp, synthetic construct
  misc_feature 1..20: note = CRISPR gRNA sequence
  source 1..20: mol_type = other DNA
accttggcctcccaaaatgc

SEQ ID NO: 20154 - DNA, 20 bp, synthetic construct
  misc_feature 1..20: note = CRISPR gRNA sequence
  source 1..20: mol_type = other DNA
ctaccccaagcagaaaagat

SEQ ID NO: 20155 - DNA, 20 bp, synthetic construct
  misc_feature 1..20: note = CRISPR gRNA sequence
  source 1..20: mol_type = other DNA
aagattggggtcctacgtgg

SEQ ID NO: 20156 - DNA, 20 bp, synthetic construct
  misc_feature 1..20: note = CRISPR gRNA sequence
  source 1..20: mol_type = other DNA
gttgcagggacctaagaggc

SEQ ID NO: 20157 - DNA, 20 bp, synthetic construct
  misc_feature 1..20: note = CRISPR gRNA sequence
  source 1..20: mol_type = other DNA
gtctctgccccaccctgggg

SEQ ID NO: 20158 - DNA, 20 bp, synthetic construct
  misc_feature 1..20: note = CRISPR gRNA sequence
  source 1..20: mol_type = other DNA
caggctttccccaaactggt

SEQ ID NO: 20159 - DNA, 20 bp, synthetic construct
  misc_feature 1..20: note = CRISPR gRNA sequence
  source 1..20: mol_type = other DNA
cttttcctccctgcagcatc

SEQ ID NO: 20160 - DNA, 20 bp, synthetic construct
  misc_feature 1..20: note = CRISPR gRNA sequence
  source 1..20: mol_type = other DNA
tcctccctgcagcatctgga

SEQ ID NO: 20161 - DNA, 20 bp, synthetic construct
  misc_feature 1..20: note = CRISPR gRNA sequence
  source 1..20: mol_type = other DNA
ggaccccttcctctcaacat

SEQ ID NO: 20162 - DNA, 20 bp, synthetic construct
  misc_feature 1..20: note = CRISPR gRNA sequence
  source 1..20: mol_type = other DNA
gatcatagctcactgcagcc

SEQ ID NO: 20163 - DNA, 20 bp, synthetic construct
  misc_feature 1..20: note = CRISPR gRNA sequence
  source 1..20: mol_type = other DNA
agtcctcctgcctcagcctc

SEQ ID NO: 20164 - DNA, 20 bp, synthetic construct
  misc_feature 1..20: note = CRISPR gRNA sequence
  source 1..20: mol_type = other DNA
gctacagtgcccagcaacct

SEQ ID NO: 20165 - DNA, 20 bp, synthetic construct
  misc_feature 1..20: note = CRISPR gRNA sequence
  source 1..20: mol_type = other DNA
atcctcaatgtggctggcac

SEQ ID NO: 20166 - DNA, 20 bp, synthetic construct
  misc_feature 1..20: note = CRISPR gRNA sequence
  source 1..20: mol_type = other DNA
gagatgacgccacatcagat

SEQ ID NO: 20167 - DNA, 20 bp, synthetic construct
  misc_feature 1..20: note = CRISPR gRNA sequence
  source 1..20: mol_type = other DNA
tctcagcaattcagctgggg

SEQ ID NO: 20168 - DNA, 20 bp, synthetic construct
  misc_feature 1..20: note = CRISPR gRNA sequence
  source 1..20: mol_type = other DNA
tagttcctaagaagctaaac

SEQ ID NO: 20169 - DNA, 20 bp, synthetic construct
  misc_feature 1..20: note = CRISPR gRNA sequence
  source 1..20: mol_type = other DNA
aacagggattcaagtccatc

SEQ ID NO: 20170 - DNA, 20 bp, synthetic construct
  misc_feature 1..20: note = CRISPR gRNA sequence
  source 1..20: mol_type = other DNA
agtcctcgtctgaaaagctc

SEQ ID NO: 20171 - DNA, 20 bp, synthetic construct
  misc_feature 1..20: note = CRISPR gRNA sequence
  source 1..20: mol_type = other DNA
cctatggtgtattagagctg

SEQ ID NO: 20172 - DNA, 20 bp, synthetic construct
  misc_feature 1..20: note = CRISPR gRNA sequence
  source 1..20: mol_type = other DNA
agggctgaggaggccctcac

SEQ ID NO: 20173 - DNA, 20 bp, synthetic construct
  misc_feature 1..20: note = CRISPR gRNA sequence
  source 1..20: mol_type = other DNA
gaggccctcactgggatggg

SEQ ID NO: 20174 - DNA, 20 bp, synthetic construct
  misc_feature 1..20: note = CRISPR gRNA sequence
  source 1..20: mol_type = other DNA
catctgattccacctgcagc

SEQ ID NO: 20175 - DNA, 20 bp, synthetic construct
  misc_feature 1..20: note = CRISPR gRNA sequence
  source 1..20: mol_type = other DNA
ccacctgcagcctggatgcg

SEQ ID NO: 20176 - DNA, 20 bp, synthetic construct
  misc_feature 1..20: note = CRISPR gRNA sequence
  source 1..20: mol_type = other DNA
gtgagaacaagatcggggac

SEQ ID NO: 20177 - DNA, 20 bp, synthetic construct
  misc_feature 1..20: note = CRISPR gRNA sequence
  source 1..20: mol_type = other DNA
aagtccttggaaaccctcaa

SEQ ID NO: 20178 - DNA, 20 bp, synthetic construct
  misc_feature 1..20: note = CRISPR gRNA sequence
  source 1..20: mol_type = other DNA
agctgggcctgcccttcctg

SEQ ID NO: 20179 - DNA, 20 bp, synthetic construct
  misc_feature 1..20: note = CRISPR gRNA sequence
  source 1..20: mol_type = other DNA
gctcgctgtgtcacccaggc

SEQ ID NO: 20180 - DNA, 20 bp, synthetic construct
  misc_feature 1..20: note = CRISPR gRNA sequence
  source 1..20: mol_type = other DNA
gccttgaactcctggcctca

SEQ ID NO: 20181 - DNA, 20 bp, synthetic construct
  misc_feature 1..20: note = CRISPR gRNA sequence
  source 1..20: mol_type = other DNA
acctccgcttcccaaagtgc

SEQ ID NO: 20182 - DNA, 20 bp, synthetic construct
  misc_feature 1..20: note = CRISPR gRNA sequence
  source 1..20: mol_type = other DNA
acttaccatgcccagcccca

SEQ ID NO: 20183 - DNA, 20 bp, synthetic construct
  misc_feature 1..20: note = CRISPR gRNA sequence
  source 1..20: mol_type = other DNA
caaataaatcccctgacctc

SEQ ID NO: 20184 - DNA, 20 bp, synthetic construct
  misc_feature 1..20: note = CRISPR gRNA sequence
  source 1..20: mol_type = other DNA
ggtgacagaaaattatactg

SEQ ID NO: 20185 - DNA, 20 bp, synthetic construct
  misc_feature 1..20: note = CRISPR gRNA sequence
  source 1..20: mol_type = other DNA
gtgaaataggagagatagat

SEQ ID NO: 20186 - DNA, 20 bp, synthetic construct
  misc_feature 1..20: note = CRISPR gRNA sequence
  source 1..20: mol_type = other DNA
tgggctctgggaagttggag

SEQ ID NO: 20187 - DNA, 20 bp, synthetic construct
  misc_feature 1..20: note = CRISPR gRNA sequence
  source 1..20: mol_type = other DNA
tggagatggataagatacag

SEQ ID NO: 20188 - DNA, 20 bp, synthetic construct
  misc_feature 1..20: note = CRISPR gRNA sequence
  source 1..20: mol_type = other DNA
caaggtctcgctctgtcacc

SEQ ID NO: 20189 - DNA, 20 bp, synthetic construct
  misc_feature 1..20: note = CRISPR gRNA sequence
  source 1..20: mol_type = other DNA
tctcgctctgtcacccaggg

SEQ ID NO: 20190 - DNA, 20 bp, synthetic construct
  misc_feature 1..20: note = CRISPR gRNA sequence
  source 1..20: mol_type = other DNA
aatcctcccatctcaacctt

SEQ ID NO: 20191 - DNA, 20 bp, synthetic construct
  misc_feature 1..20: note = CRISPR gRNA sequence
  source 1..20: mol_type = other DNA
gcctctgcctcccaaagtac

SEQ ID NO: 20192 - DNA, 20 bp, synthetic construct
  misc_feature 1..20: note = CRISPR gRNA sequence
  source 1..20: mol_type = other DNA
aaagtactgggattacaggc

SEQ ID NO: 20193 - DNA, 20 bp, synthetic construct
  misc_feature 1..20: note = CRISPR gRNA sequence
  source 1..20: mol_type = other DNA
agtcactgtgcctggttcaa

SEQ ID NO: 20194 - DNA, 20 bp, synthetic construct
  misc_feature 1..20: note = CRISPR gRNA sequence
  source 1..20: mol_type = other DNA
ttttttttttttttttgaca

SEQ ID NO: 20195 - DNA, 20 bp, synthetic construct
  misc_feature 1..20: note = CRISPR gRNA sequence
  source 1..20: mol_type = other DNA
tctcgctctgtagcccaggc

SEQ ID NO: 20196 - DNA, 20 bp, synthetic construct
  misc_feature 1..20: note = CRISPR gRNA sequence
  source 1..20: mol_type = other DNA
tttattgcaaacttcacctc

SEQ ID NO: 20197 - DNA, 20 bp, synthetic construct
  misc_feature 1..20: note = CRISPR gRNA sequence
  source 1..20: mol_type = other DNA
acctcagcctcccaagtagc

SEQ ID NO: 20198 - DNA, 20 bp, synthetic construct
  misc_feature 1..20: note = CRISPR gRNA sequence
  source 1..20: mol_type = other DNA
ttttgtatttttagtagaga

SEQ ID NO: 20199 - DNA, 20 bp, synthetic construct
  misc_feature 1..20: note = CRISPR gRNA sequence
  source 1..20: mol_type = other DNA
acctcagcctcccaaagtgc

SEQ ID NO: 20200 - DNA, 20 bp, synthetic construct
  misc_feature 1..20: note = CRISPR gRNA sequence
  source 1..20: mol_type = other DNA
atgattttttactgaaccta

SEQ ID NO: 20201 - DNA, 20 bp, synthetic construct
  misc_feature 1..20: note = CRISPR gRNA sequence
  source 1..20: mol_type = other DNA
ccccctcacaaccaaggtct

SEQ ID NO: 20202 - DNA, 20 bp, synthetic construct
  misc_feature 1..20: note = CRISPR gRNA sequence
  source 1..20: mol_type = other DNA
aggatggccaaataatttac

SEQ ID NO: 20203 - DNA, 20 bp, synthetic construct
  misc_feature 1..20: note = CRISPR gRNA sequence
  source 1..20: mol_type = other DNA
cctggcagtgctctaggcac

SEQ ID NO: 20204 - DNA, 20 bp, synthetic construct
  misc_feature 1..20: note = CRISPR gRNA sequence
  source 1..20: mol_type = other DNA
gaagcccacaacccggcaga

SEQ ID NO: 20205 - DNA, 20 bp, synthetic construct
  misc_feature 1..20: note = CRISPR gRNA sequence
  source 1..20: mol_type = other DNA
agtggcgcagagggaaaaga

SEQ ID NO: 20206 - DNA, 20 bp, synthetic construct
  misc_feature 1..20: note = CRISPR gRNA sequence
  source 1..20: mol_type = other DNA
catgggacaggtgggggcag

SEQ ID NO: 20207 - DNA, 20 bp, synthetic construct
  misc_feature 1..20: note = CRISPR gRNA sequence
  source 1..20: mol_type = other DNA
cccagaacaacatcactgac

SEQ ID NO: 20208 - DNA, 20 bp, synthetic construct
  misc_feature 1..20: note = CRISPR gRNA sequence
  source 1..20: mol_type = other DNA
gcatccctgctcaggctaag

SEQ ID NO: 20209 - DNA, 20 bp, synthetic construct
  misc_feature 1..20: note = CRISPR gRNA sequence
  source 1..20: mol_type = other DNA
aggctaaggtgagtggggcc

SEQ ID NO: 20210 - DNA, 20 bp, synthetic construct
  misc_feature 1..20: note = CRISPR gRNA sequence
  source 1..20: mol_type = other DNA
atcaccacagccctgaacaa

SEQ ID NO: 20211 - DNA, 20 bp, synthetic construct
  misc_feature 1..20: note = CRISPR gRNA sequence
  source 1..20: mol_type = other DNA
aatattgctccttttccccc

SEQ ID NO: 20212 - DNA, 20 bp, synthetic construct
  misc_feature 1..20: note = CRISPR gRNA sequence
  source 1..20: mol_type = other DNA
ccaggctttttccggaacct

SEQ ID NO: 20213 - DNA, 20 bp, synthetic construct
  misc_feature 1..20: note = CRISPR gRNA sequence
  source 1..20: mol_type = other DNA
tggcatagcacctcttgctt

SEQ ID NO: 20214 - DNA, 20 bp, synthetic construct
  misc_feature 1..20: note = CRISPR gRNA sequence
  source 1..20: mol_type = other DNA
cttcacttactgaggacaac

SEQ ID NO: 20215 - DNA, 20 bp, synthetic construct
  misc_feature 1..20: note = CRISPR gRNA sequence
  source 1..20: mol_type = other DNA
tttaatttctgtttttgaga

SEQ ID NO: 20216 - DNA, 20 bp, synthetic construct
  misc_feature 1..20: note = CRISPR gRNA sequence
  source 1..20: mol_type = other DNA
tctcgctctgtcacccaggc

SEQ ID NO: 20217 - DNA, 20 bp, synthetic construct
  misc_feature 1..20: note = CRISPR gRNA sequence
  source 1..20: mol_type = other DNA
tattcgcctgcctcagtgct

SEQ ID NO: 20218 - DNA, 20 bp, synthetic construct
  misc_feature 1..20: note = CRISPR gRNA sequence
  source 1..20: mol_type = other DNA
gcctcagtgctccgagtagc

SEQ ID NO: 20219 - DNA, 20 bp, synthetic construct
  misc_feature 1..20: note = CRISPR gRNA sequence
  source 1..20: mol_type = other DNA
ttttatatttttagtagaga

SEQ ID NO: 20220 - DNA, 20 bp, synthetic construct
  misc_feature 1..20: note = CRISPR gRNA sequence
  source 1..20: mol_type = other DNA
acctgcctcggcctcccaaa

SEQ ID NO: 20221 - DNA, 20 bp, synthetic construct
  misc_feature 1..20: note = CRISPR gRNA sequence
  source 1..20: mol_type = other DNA
cggcctcccaaagtgagtac

SEQ ID NO: 20222 - DNA, 20 bp, synthetic construct
  misc_feature 1..20: note = CRISPR gRNA sequence
  source 1..20: mol_type = other DNA
tttatttatttatttggaga

SEQ ID NO: 20223 - DNA, 20 bp, synthetic construct
  misc_feature 1..20: note = CRISPR gRNA sequence
  source 1..20: mol_type = other DNA
tctcacccaggttgtagtgc

SEQ ID NO: 20224 - DNA, 20 bp, synthetic construct
  misc_feature 1..20: note = CRISPR gRNA sequence
  source 1..20: mol_type = other DNA
cacctcagccttccaagtag

SEQ ID NO: 20225 - DNA, 20 bp, synthetic construct
  misc_feature 1..20: note = CRISPR gRNA sequence
  source 1..20: mol_type = other DNA
aagaaactcagaagcaaaaa

SEQ ID NO: 20226 - DNA, 20 bp, synthetic construct
  misc_feature 1..20: note = CRISPR gRNA sequence
  source 1..20: mol_type = other DNA
gacagatgtcgttcttgctt

SEQ ID NO: 20227 - DNA, 20 bp, synthetic construct
  misc_feature 1..20: note = CRISPR gRNA sequence
  source 1..20: mol_type = other DNA
tttgagtttctttgcgtagt

SEQ ID NO: 20228 - DNA, 20 bp, synthetic construct
  misc_feature 1..20: note = CRISPR gRNA sequence
  source 1..20: mol_type = other DNA
aggaaactaacaagccccag

SEQ ID NO: 20229 - DNA, 20 bp, synthetic construct
  misc_feature 1..20: note = CRISPR gRNA sequence
  source 1..20: mol_type = other DNA
gggaaaaggggctgtgtttt

SEQ ID NO: 20230 - DNA, 20 bp, synthetic construct
  misc_feature 1..20: note = CRISPR gRNA sequence
  source 1..20: mol_type = other DNA
ggccactgtggctgtgtgta

SEQ ID NO: 20231 - DNA, 20 bp, synthetic construct
  misc_feature 1..20: note = CRISPR gRNA sequence
  source 1..20: mol_type = other DNA
gtggaagtaggggaggtcag

SEQ ID NO: 20232 - DNA, 20 bp, synthetic construct
  misc_feature 1..20: note = CRISPR gRNA sequence
  source 1..20: mol_type = other DNA
gatcacacagggaggccctt

SEQ ID NO: 20233 - DNA, 20 bp, synthetic construct
  misc_feature 1..20: note = CRISPR gRNA sequence
  source 1..20: mol_type = other DNA
ggtatttgcagtttttcagt

SEQ ID NO: 20234 - DNA, 20 bp, synthetic construct
  misc_feature 1..20: note = CRISPR gRNA sequence
  source 1..20: mol_type = other DNA
ctcactgcaagcactgcctc

SEQ ID NO: 20235 - DNA, 20 bp, synthetic construct
  misc_feature 1..20: note = CRISPR gRNA sequence
  source 1..20: mol_type = other DNA
gcctcagcctcccaagtagc

SEQ ID NO: 20236 - DNA, 20 bp, synthetic construct
  misc_feature 1..20: note = CRISPR gRNA sequence
  source 1..20: mol_type = other DNA
acctcagccttccaaagtgc

SEQ ID NO: 20237 - DNA, 20 bp, synthetic construct
  misc_feature 1..20: note = CRISPR gRNA sequence
  source 1..20: mol_type = other DNA
ccttccaaagtgctgggatt

SEQ ID NO: 20238 - DNA, 20 bp, synthetic construct
  misc_feature 1..20: note = CRISPR gRNA sequence
  source 1..20: mol_type = other DNA
ttaagaaacatcatatttca

SEQ ID NO: 20239 - DNA, 20 bp, synthetic construct
  misc_feature 1..20: note = CRISPR gRNA sequence
  source 1..20: mol_type = other DNA
tggtcagattactctccctg

SEQ ID NO: 20240 - DNA, 20 bp, synthetic construct
  misc_feature 1..20: note = CRISPR gRNA sequence
  source 1..20: mol_type = other DNA
ctctccctgtggggtggagg

SEQ ID NO: 20241 - DNA, 20 bp, synthetic construct
  misc_feature 1..20: note = CRISPR gRNA sequence
  source 1..20: mol_type = other DNA
tggggtggaggaagggtctc

SEQ ID NO: 20242 - DNA, 20 bp, synthetic construct
  misc_feature 1..20: note = CRISPR gRNA sequence
  source 1..20: mol_type = other DNA
ggtaccggccgacccgtgat

SEQ ID NO: 20243 - DNA, 20 bp, synthetic construct
  misc_feature 1..20: note = CRISPR gRNA sequence
  source 1..20: mol_type = other DNA
gtgatgtgagttgatttagc

SEQ ID NO: 20244 - DNA, 20 bp, synthetic construct
  misc_feature 1..20: note = CRISPR gRNA sequence
  source 1..20: mol_type = other DNA
tttttctttttttttcgaga

SEQ ID NO: 20245 - DNA, 20 bp, synthetic construct
  misc_feature 1..20: note = CRISPR gRNA sequence
  source 1..20: mol_type = other DNA
ttcgctcttgttgccaaggc

SEQ ID NO: 20246 - DNA, 20 bp, synthetic construct
  misc_feature 1..20: note = CRISPR gRNA sequence
  source 1..20: mol_type = other DNA
gttcactgcaactccgcctc

SEQ ID NO: 20247 - DNA, 20 bp, synthetic construct
  misc_feature 1..20: note = CRISPR gRNA sequence
  source 1..20: mol_type = other DNA
cctcagcctctcaagtagct

SEQ ID NO: 20248 - DNA, 20 bp, synthetic construct
  misc_feature 1..20: note = CRISPR gRNA sequence
  source 1..20: mol_type = other DNA
ttttgtatttttagtagaga

SEQ ID NO: 20249 - DNA, 20 bp, synthetic construct
  misc_feature 1..20: note = CRISPR gRNA sequence
  source 1..20: mol_type = other DNA
cgcctcggcctccaaagtgt

SEQ ID NO: 20250 - DNA, 20 bp, synthetic construct
  misc_feature 1..20: note = CRISPR gRNA sequence
  source 1..20: mol_type = other DNA
ttttatatgcagccctgcaa

SEQ ID NO: 20251 - DNA, 20 bp, synthetic construct
  misc_feature 1..20: note = CRISPR gRNA sequence
  source 1..20: mol_type = other DNA
cctgcaagggagttctgagg

SEQ ID NO: 20252 - DNA, 20 bp, synthetic construct
  misc_feature 1..20: note = CRISPR gRNA sequence
  source 1..20: mol_type = other DNA
tgttaaaaggctgcttggtg

SEQ ID NO: 20253 - DNA, 20 bp, synthetic construct
  misc_feature 1..20: note = CRISPR gRNA sequence
  source 1..20: mol_type = other DNA
cactgctactaatgctggtt

SEQ ID NO: 20254 - DNA, 20 bp, synthetic construct
  misc_feature 1..20: note = CRISPR gRNA sequence
  source 1..20: mol_type = other DNA
ccattttacagatgggcaaa

SEQ ID NO: 20255 - DNA, 20 bp, synthetic construct
  misc_feature 1..20: note = CRISPR gRNA sequence
  source 1..20: mol_type = other DNA
atgggcaaactgagtctcag

SEQ ID NO: 20256 - DNA, 20 bp, synthetic construct
  misc_feature 1..20: note = CRISPR gRNA sequence
  source 1..20: mol_type = other DNA
caaactgagtctcagaagag

SEQ ID NO: 20257 - DNA, 20 bp, synthetic construct
  misc_feature 1..20: note = CRISPR gRNA sequence
  source 1..20: mol_type = other DNA
taggcagtaagaggcatagc

SEQ ID NO: 20258 - DNA, 20 bp, synthetic construct
  misc_feature 1..20: note = CRISPR gRNA sequence
  source 1..20: mol_type = other DNA
agagaagtggtctcaactct

SEQ ID NO: 20259 - DNA, 20 bp, synthetic construct
  misc_feature 1..20: note = CRISPR gRNA sequence
  source 1..20: mol_type = other DNA
aaatattgattccttccccc

SEQ ID NO: 20260 - DNA, 20 bp, synthetic construct
  misc_feature 1..20: note = CRISPR gRNA sequence
  source 1..20: mol_type = other DNA
tagtgggaccaggctttttc

SEQ ID NO: 20261 - DNA, 20 bp, synthetic construct
  misc_feature 1..20: note = CRISPR gRNA sequence
  source 1..20: mol_type = other DNA
ccaggctttttctggaatct

SEQ ID NO: 20262 - DNA, 20 bp, synthetic construct
  misc_feature 1..20: note = CRISPR gRNA sequence
  source 1..20: mol_type = other DNA
cttccggacatggtgtccct

SEQ ID NO: 20263 - DNA, 20 bp, synthetic construct
  misc_feature 1..20: note = CRISPR gRNA sequence
  source 1..20: mol_type = other DNA
catggtgtccctccgggtga

SEQ ID NO: 20264 - DNA, 20 bp, synthetic construct
  misc_feature 1..20: note = CRISPR gRNA sequence
  source 1..20: mol_type = other DNA
gtgtccctccgggtgatgga

SEQ ID NO: 20265 - DNA, 20 bp, synthetic construct
  misc_feature 1..20: note = CRISPR gRNA sequence
  source 1..20: mol_type = other DNA
ccgggtgatggagtgagtgt

SEQ ID NO: 20266 - DNA, 20 bp, synthetic construct
  misc_feature 1..20: note = CRISPR gRNA sequence
  source 1..20: mol_type = other DNA
tgagtgtgggagtctgggcg

SEQ ID NO: 20267 - DNA, 20 bp, synthetic construct
  misc_feature 1..20: note = CRISPR gRNA sequence
  source 1..20: mol_type = other DNA
gggcggtgggtggctcagcc

SEQ ID NO: 20268 - DNA, 20 bp, synthetic construct
  misc_feature 1..20: note = CRISPR gRNA sequence
  source 1..20: mol_type = other DNA
tccctggtgtcctggaagag

SEQ ID NO: 20269 - DNA, 20 bp, synthetic construct
  misc_feature 1..20: note = CRISPR gRNA sequence
  source 1..20: mol_type = other DNA
gtcctggaagagctggatgt

SEQ ID NO: 20270 - DNA, 20 bp, synthetic construct
  misc_feature 1..20: note = CRISPR gRNA sequence
  source 1..20: mol_type = other DNA
gtggccttggtctggagctg

SEQ ID NO: 20271 - DNA, 20 bp, synthetic construct
  misc_feature 1..20: note = CRISPR gRNA sequence
  source 1..20: mol_type = other DNA
cccaagggccaggccccaag

SEQ ID NO: 20272 - DNA, 20 bp, synthetic construct
  misc_feature 1..20: note = CRISPR gRNA sequence
  source 1..20: mol_type = other DNA
cgtaagtccaggcaaccctg

SEQ ID NO: 20273 - DNA, 20 bp, synthetic construct
  misc_feature 1..20: note = CRISPR gRNA sequence
  source 1..20: mol_type = other DNA
cccttcaccaatctgcaacc

SEQ ID NO: 20274 - DNA, 20 bp, synthetic construct
  misc_feature 1..20: note = CRISPR gRNA sequence
  source 1..20: mol_type = other DNA
ctcacctcttctaagacgca

SEQ ID NO: 20275 - DNA, 20 bp, synthetic construct
  misc_feature 1..20: note = CRISPR gRNA sequence
  source 1..20: mol_type = other DNA
cctcttctaagacgcacagg

SEQ ID NO: 20276 - DNA, 20 bp, synthetic construct
  misc_feature 1..20: note = CRISPR gRNA sequence
  source 1..20: mol_type = other DNA
gagcagttaactaacctttc

SEQ ID NO: 20277 - DNA, 20 bp, synthetic construct
  misc_feature 1..20: note = CRISPR gRNA sequence
  source 1..20: mol_type = other DNA
agtcagctgcagaaccataa

SEQ ID NO: 20278 - DNA, 20 bp, synthetic construct
  misc_feature 1..20: note = CRISPR gRNA sequence
  source 1..20: mol_type = other DNA
aaagtccccaacgttctagg

SEQ ID NO: 20279 - DNA, 20 bp, synthetic construct
  misc_feature 1..20: note = CRISPR gRNA sequence
  source 1..20: mol_type = other DNA
gttctaggctgggtggaagg

SEQ ID NO: 20280 - DNA, 20 bp, synthetic construct
  misc_feature 1..20: note = CRISPR gRNA sequence
  source 1..20: mol_type = other DNA
ctctctcctctaacctggct

SEQ ID NO: 20281 - DNA, 20 bp, synthetic construct
  misc_feature 1..20: note = CRISPR gRNA sequence
  source 1..20: mol_type = other DNA
ctgagtcccatccccccttg

SEQ ID NO: 20282 - DNA, 20 bp, synthetic construct
  misc_feature 1..20: note = CRISPR gRNA sequence
  source 1..20: mol_type = other DNA
tccaggaacacctgcaacaa

SEQ ID NO: 20283 - DNA, 20 bp, synthetic construct
  misc_feature 1..20: note = CRISPR gRNA sequence
  source 1..20: mol_type = other DNA
cacctgcaacaacaggattc

SEQ ID NO: 20284 - DNA, 20 bp, synthetic construct
  misc_feature 1..20: note = CRISPR gRNA sequence
  source 1..20: mol_type = other DNA
gatcccagctgtgctctgga

SEQ ID NO: 20285 - DNA, 20 bp, synthetic construct
  misc_feature 1..20: note = CRISPR gRNA sequence
  source 1..20: mol_type = other DNA
tgtgctctggacagggtaac

SEQ ID NO: 20286 - DNA, 20 bp, synthetic construct
  misc_feature 1..20: note = CRISPR gRNA sequence
  source 1..20: mol_type = other DNA
cttgggaggggagagccgca

SEQ ID NO: 20287 - DNA, 20 bp, synthetic construct
  misc_feature 1..20: note = CRISPR gRNA sequence
  source 1..20: mol_type = other DNA
taccctgtccagagcacagc

SEQ ID NO: 20288 - DNA, 20 bp, synthetic construct
  misc_feature 1..20: note = CRISPR gRNA sequence
  source 1..20: mol_type = other DNA
ggatcatctcaggctgatcc

SEQ ID NO: 20289 - DNA, 20 bp, synthetic construct
  misc_feature 1..20: note = CRISPR gRNA sequence
  source 1..20: mol_type = other DNA
gttgcaggtgttcctggaca

SEQ ID NO: 20290 - DNA, 20 bp, synthetic construct
  misc_feature 1..20: note = CRISPR gRNA sequence
  source 1..20: mol_type = other DNA
aggtgttcctggacactgaa

SEQ ID NO: 20291 - DNA, 20 bp, synthetic construct
  misc_feature 1..20: note = CRISPR gRNA sequence
  source 1..20: mol_type = other DNA
ggcgtccacatcctgcaagg

SEQ ID NO: 20292 - DNA, 20 bp, synthetic construct
  misc_feature 1..20: note = CRISPR gRNA sequence
  source 1..20: mol_type = other DNA
ctggcaagataccgaccggt

SEQ ID NO: 20293 - DNA, 20 bp, synthetic construct
  misc_feature 1..20: note = CRISPR gRNA sequence
  source 1..20: mol_type = other DNA
ttattttcctcatctgtaaa

SEQ ID NO: 20294 - DNA, 20 bp, synthetic construct
  misc_feature 1..20: note = CRISPR gRNA sequence
  source 1..20: mol_type = other DNA
ccctgtgcgtcttagaagag

SEQ ID NO: 20295 - DNA, 20 bp, synthetic construct
  misc_feature 1..20: note = CRISPR gRNA sequence
  source 1..20: mol_type = other DNA
tggagataaaagtgctttga

SEQ ID NO: 20296 - DNA, 20 bp, synthetic construct
  misc_feature 1..20: note = CRISPR gRNA sequence
  source 1..20: mol_type = other DNA
gccaattttacaggtcaaaa

SEQ ID NO: 20297 - DNA, 20 bp, synthetic construct
  misc_feature 1..20: note = CRISPR gRNA sequence
  source 1..20: mol_type = other DNA
attttacaggtcaaaaatgg

SEQ ID NO: 20298 - DNA, 20 bp, synthetic construct
  misc_feature 1..20: note = CRISPR gRNA sequence
  source 1..20: mol_type = other DNA
tttaagcctcacaaaacctc

SEQ ID NO: 20299 - DNA, 20 bp, synthetic construct
  misc_feature 1..20: note = CRISPR gRNA sequence
  source 1..20: mol_type = other DNA
agcctcacaaaacctcttgg

SEQ ID NO: 20300 - DNA, 20 bp, synthetic construct
  misc_feature 1..20: note = CRISPR gRNA sequence
  source 1..20: mol_type = other DNA
gggggaagtgtctgctcacc

SEQ ID NO: 20301 - DNA, 20 bp, synthetic construct
  misc_feature 1..20: note = CRISPR gRNA sequence
  source 1..20: mol_type = other DNA
gaagagcatgatttgagctc

SEQ ID NO: 20302 - DNA, 20 bp, synthetic construct
  misc_feature 1..20: note = CRISPR gRNA sequence
  source 1..20: mol_type = other DNA
cacactgggccacacgcctg

SEQ ID NO: 20303 - DNA, 20 bp, synthetic construct
  misc_feature 1..20: note = CRISPR gRNA sequence
  source 1..20: mol_type = other DNA
ctgggccacacgcctgggga

SEQ ID NO: 20304 - DNA, 20 bp, synthetic construct
  misc_feature 1..20: note = CRISPR gRNA sequence
  source 1..20: mol_type = other DNA
gtgagttgttctccacccac

SEQ ID NO: 20305 - DNA, 20 bp, synthetic construct
  misc_feature 1..20: note = CRISPR gRNA sequence
  source 1..20: mol_type = other DNA
cggaaacagaggccaggggg

SEQ ID NO: 20306 - DNA, 20 bp, synthetic construct
  misc_feature 1..20: note = CRISPR gRNA sequence
  source 1..20: mol_type = other DNA
gtcccactatccctggggga

SEQ ID NO: 20307 - DNA, 20 bp, synthetic construct
  misc_feature 1..20: note = CRISPR gRNA sequence
  source 1..20: mol_type = other DNA
caagtacttacataggccat

SEQ ID NO: 20308 - DNA, 20 bp, synthetic construct
  misc_feature 1..20: note = CRISPR gRNA sequence
  source 1..20: mol_type = other DNA
tagatatgaaaatagaggct

SEQ ID NO: 20309 - DNA, 20 bp, synthetic construct
  misc_feature 1..20: note = CRISPR gRNA sequence
  source 1..20: mol_type = other DNA
tatgaaaatagaggctagga

SEQ ID NO: 20310 - DNA, 20 bp, synthetic construct
  misc_feature 1..20: note = CRISPR gRNA sequence
  source 1..20: mol_type = other DNA
agggctgtggtgattgcttc

SEQ ID NO: 20311 - DNA, 20 bp, synthetic construct
  misc_feature 1..20: note = CRISPR gRNA sequence
  source 1..20: mol_type = other DNA
agcctggaggtcagccccgt

SEQ ID NO: 20312 - DNA, 20 bp, synthetic construct
  misc_feature 1..20: note = CRISPR gRNA sequence
  source 1..20: mol_type = other DNA
ccgtgggagtcaccacctac

SEQ ID NO: 20313 - DNA, 20 bp, synthetic construct
  misc_feature 1..20: note = CRISPR gRNA sequence
  source 1..20: mol_type = other DNA
gacaggcaaaccaagaccca

SEQ ID NO: 20314 - DNA, 20 bp, synthetic construct
  misc_feature 1..20: note = CRISPR gRNA sequence
  source 1..20: mol_type = other DNA
catctgtaaaatgggcatga

SEQ ID NO: 20315 - DNA, 20 bp, synthetic construct
  misc_feature 1..20: note = CRISPR gRNA sequence
  source 1..20: mol_type = other DNA
atgatagagtcattgtgggg

SEQ ID NO: 20316 - DNA, 20 bp, synthetic construct
  misc_feature 1..20: note = CRISPR gRNA sequence
  source 1..20: mol_type = other DNA
gtcattgtggggaggagtaa

SEQ ID NO: 20317 - DNA, 20 bp, synthetic construct
  misc_feature 1..20: note = CRISPR gRNA sequence
  source 1..20: mol_type = other DNA
ttagaacatgccttggtgcc

SEQ ID NO: 20318 - DNA, 20 bp, synthetic construct
  misc_feature 1..20: note = CRISPR gRNA sequence
  source 1..20: mol_type = other DNA
tacatcacaggaacattggt

SEQ ID NO: 20319 - DNA, 20 bp, synthetic construct
  misc_feature 1..20: note = CRISPR gRNA sequence
  source 1..20: mol_type = other DNA
ggaacattggtgagggtcgc

SEQ ID NO: 20320 - DNA, 20 bp, synthetic construct
  misc_feature 1..20: note = CRISPR gRNA sequence
  source 1..20: mol_type = other DNA
gggtcgcatgagttaacata

SEQ ID NO: 20321 - DNA, 20 bp, synthetic construct
  misc_feature 1..20: note = CRISPR gRNA sequence
  source 1..20: mol_type = other DNA
gtagcagtgaaaatagcatg

SEQ ID NO: 20322 - DNA, 20 bp, synthetic construct
  misc_feature 1..20: note = CRISPR gRNA sequence
  source 1..20: mol_type = other DNA
ttaacaggtcaggtgctgct

SEQ ID NO: 20323 - DNA, 20 bp, synthetic construct
  misc_feature 1..20: note = CRISPR gRNA sequence
  source 1..20: mol_type = other DNA
ctaacactttggaggccgag

SEQ ID NO: 20324 - DNA, 20 bp, synthetic construct
  misc_feature 1..20: note = CRISPR gRNA sequence
  source 1..20: mol_type = other DNA
cactttggaggccgaggcgg

SEQ ID NO: 20325 - DNA, 20 bp, synthetic construct
  misc_feature 1..20: note = CRISPR gRNA sequence
  source 1..20: mol_type = other DNA
cgggtggatcacctaaggtc

SEQ ID NO: 20326 - DNA, 20 bp, synthetic construct
  misc_feature 1..20: note = CRISPR gRNA sequence
  source 1..20: mol_type = other DNA
tactaaaaatacaaaattag

SEQ ID NO: 20327 - DNA, 20 bp, synthetic construct
  misc_feature 1..20: note = CRISPR gRNA sequence
  source 1..20: mol_type = other DNA
tacttgagaggctgaggcag

SEQ ID NO: 20328 - DNA, 20 bp, synthetic construct
  misc_feature 1..20: note = CRISPR gRNA sequence
  source 1..20: mol_type = other DNA
aattgcttgaactcgggagg

SEQ ID NO: 20329 - DNA, 20 bp, synthetic construct
  misc_feature 1..20: note = CRISPR gRNA sequence
  source 1..20: mol_type = other DNA
caggtttacactgctgccaa

SEQ ID NO: 20330 - DNA, 20 bp, synthetic construct
  misc_feature 1..20: note = CRISPR gRNA sequence
  source 1..20: mol_type = other DNA
aggctaaatcaactcacatc

SEQ ID NO: 20331 - DNA, 20 bp, synthetic construct
  misc_feature 1..20: note = CRISPR gRNA sequence
  source 1..20: mol_type = other DNA
taccagtgcagaaactagat

SEQ ID NO: 20332 - DNA, 20 bp, synthetic construct
  misc_feature 1..20: note = CRISPR gRNA sequence
  source 1..20: mol_type = other DNA
cccttcctccaccccacagg

SEQ ID NO: 20333 - DNA, 20 bp, synthetic construct
  misc_feature 1..20: note = CRISPR gRNA sequence
  source 1..20: mol_type = other DNA
caagacatatatgtcaccat

SEQ ID NO: 20334 - DNA, 20 bp, synthetic construct
  misc_feature 1..20: note = CRISPR gRNA sequence
  source 1..20: mol_type = other DNA
catttgaatatcattgagat

SEQ ID NO: 20335 - DNA, 20 bp, synthetic construct
  misc_feature 1..20: note = CRISPR gRNA sequence
  source 1..20: mol_type = other DNA
tttgcattttggcctcatat

SEQ ID NO: 20336 - DNA, 20 bp, synthetic construct
  misc_feature 1..20: note = CRISPR gRNA sequence
  source 1..20: mol_type = other DNA
cctcatattggggtcttaca

SEQ ID NO: 20337 - DNA, 20 bp, synthetic construct
  misc_feature 1..20: note = CRISPR gRNA sequence
  source 1..20: mol_type = other DNA
atgaaatatgatgtttctta

SEQ ID NO: 20338 - DNA, 20 bp, synthetic construct
  misc_feature 1..20: note = CRISPR gRNA sequence
  source 1..20: mol_type = other DNA
cagcactttggaaggctgag

SEQ ID NO: 20339 - DNA, 20 bp, synthetic construct
  misc_feature 1..20: note = CRISPR gRNA sequence
  source 1..20: mol_type = other DNA
actttggaaggctgaggtgg

SEQ ID NO: 20340 - DNA, 20 bp, synthetic construct
  misc_feature 1..20: note = CRISPR gRNA sequence
  source 1..20: mol_type = other DNA
gtgggtggatcgcttgggcc

SEQ ID NO: 20341 - DNA, 20 bp, synthetic construct
  misc_feature 1..20: note = CRISPR gRNA sequence
  source 1..20: mol_type = other DNA
tacttgggaggctgaggcat

SEQ ID NO: 20342 - DNA, 20 bp, synthetic construct
  misc_feature 1..20: note = CRISPR gRNA sequence
  source 1..20: mol_type = other DNA
caagggcctccctgtgtgat

SEQ ID NO: 20343 - DNA, 20 bp, synthetic construct
  misc_feature 1..20: note = CRISPR gRNA sequence
  source 1..20: mol_type = other DNA
cacctgctgttctttcttcc

SEQ ID NO: 20344 - DNA, 20 bp, synthetic construct
  misc_feature 1..20: note = CRISPR gRNA sequence
  source 1..20: mol_type = other DNA
tcccctagagcttcccacgg

SEQ ID NO: 20345 - DNA, 20 bp, synthetic construct
  misc_feature 1..20: note = CRISPR gRNA sequence
  source 1..20: mol_type = other DNA
ttgttagtttccttcccagc

SEQ ID NO: 20346 - DNA, 20 bp, synthetic construct
  misc_feature 1..20: note = CRISPR gRNA sequence
  source 1..20: mol_type = other DNA
gacagattctatttttgctt

SEQ ID NO: 20347 - DNA, 20 bp, synthetic construct
  misc_feature 1..20: note = CRISPR gRNA sequence
  source 1..20: mol_type = other DNA
aagaaattaacaaggctcag

SEQ ID NO: 20348 - DNA, 20 bp, synthetic construct
  misc_feature 1..20: note = CRISPR gRNA sequence
  source 1..20: mol_type = other DNA
ttgcacccctgcactacaac

SEQ ID NO: 20349 - DNA, 20 bp, synthetic construct
  misc_feature 1..20: note = CRISPR gRNA sequence
  source 1..20: mol_type = other DNA
actttgggaggccgaggcag

SEQ ID NO: 20350 - DNA, 20 bp, synthetic construct
  misc_feature 1..20: note = CRISPR gRNA sequence
  source 1..20: mol_type = other DNA
caggtggatcacctgagatc

SEQ ID NO: 20351 - DNA, 20 bp, synthetic construct
  misc_feature 1..20: note = CRISPR gRNA sequence
  source 1..20: mol_type = other DNA
tactcggagcactgaggcag

SEQ ID NO: 20352 - DNA, 20 bp, synthetic construct
  misc_feature 1..20: note = CRISPR gRNA sequence
  source 1..20: mol_type = other DNA
tcacaccacttcactccagc

SEQ ID NO: 20353 - DNA, 20 bp, synthetic construct
  misc_feature 1..20: note = CRISPR gRNA sequence
  source 1..20: mol_type = other DNA
gaccaaatgccatctttcct

SEQ ID NO: 20354 - DNA, 20 bp, synthetic construct
  misc_feature 1..20: note = CRISPR gRNA sequence
  source 1..20: mol_type = other DNA
gagcagtttctctcagtctg

SEQ ID NO: 20355 - DNA, 20 bp, synthetic construct
  misc_feature 1..20: note = CRISPR gRNA sequence
  source 1..20: mol_type = other DNA
agtaagaagagctggtaatg

SEQ ID NO: 20356 - DNA, 20 bp, synthetic construct
  misc_feature 1..20: note = CRISPR gRNA sequence
  source 1..20: mol_type = other DNA
gaagagctggtaatgctgag

SEQ ID NO: 20357 - DNA, 20 bp, synthetic construct
  misc_feature 1..20: note = CRISPR gRNA sequence
  source 1..20: mol_type = other DNA
ctctgggaccacaccagggc

SEQ ID NO: 20358 - DNA, 20 bp, synthetic construct
  misc_feature 1..20: note = CRISPR gRNA sequence
  source 1..20: mol_type = other DNA
caagtgcttacatagaccat

SEQ ID NO: 20359 - DNA, 20 bp, synthetic construct
  misc_feature 1..20: note = CRISPR gRNA sequence
  source 1..20: mol_type = other DNA
caggtaagaaaacagcggct

SEQ ID NO: 20360 - DNA, 20 bp, synthetic construct
  misc_feature 1..20: note = CRISPR gRNA sequence
  source 1..20: mol_type = other DNA
taagaaaacagcggctagga

SEQ ID NO: 20361 - DNA, 20 bp, synthetic construct
  misc_feature 1..20: note = CRISPR gRNA sequence
  source 1..20: mol_type = other DNA
gaatgaataactgacttgct

SEQ ID NO: 20362 - DNA, 20 bp, synthetic construct
  misc_feature 1..20: note = CRISPR gRNA sequence
  source 1..20: mol_type = other DNA
agggctgtggtgattgcttc

SEQ ID NO: 20363 - DNA, 20 bp, synthetic construct
  misc_feature 1..20: note = CRISPR gRNA sequence
  source 1..20: mol_type = other DNA
tcccctgcagccagcacgat

SEQ ID NO: 20364 - DNA, 20 bp, synthetic construct
  misc_feature 1..20: note = CRISPR gRNA sequence
  source 1..20: mol_type = other DNA
ccactcaccttagcctgagc

SEQ ID NO: 20365 - DNA, 20 bp, synthetic construct
  misc_feature 1..20: note = CRISPR gRNA sequence
  source 1..20: mol_type = other DNA
cgagcgaaggcagggcctcg

SEQ ID NO: 20366 - DNA, 20 bp, synthetic construct
  misc_feature 1..20: note = CRISPR gRNA sequence
  source 1..20: mol_type = other DNA
tgcctcactttgacctcaag

SEQ ID NO: 20367 - DNA, 20 bp, synthetic construct
  misc_feature 1..20: note = CRISPR gRNA sequence
  source 1..20: mol_type = other DNA
ctttgacctcaaggagagtt

SEQ ID NO: 20368 - DNA, 20 bp, synthetic construct
  misc_feature 1..20: note = CRISPR gRNA sequence
  source 1..20: mol_type = other DNA
agagttctgggtcataggct

SEQ ID NO: 20369 - DNA, 20 bp, synthetic construct
  misc_feature 1..20: note = CRISPR gRNA sequence
  source 1..20: mol_type = other DNA
agctacctctcggtaaatag

SEQ ID NO: 20370 - DNA, 20 bp, synthetic construct
  misc_feature 1..20: note = CRISPR gRNA sequence
  source 1..20: mol_type = other DNA
ctgtggccaagtgggagggc

SEQ ID NO: 20371 - DNA, 20 bp, synthetic construct
  misc_feature 1..20: note = CRISPR gRNA sequence
  source 1..20: mol_type = other DNA
gggagggcagggatgaggag

SEQ ID NO: 20372 - DNA, 20 bp, synthetic construct
  misc_feature 1..20: note = CRISPR gRNA sequence
  source 1..20: mol_type = other DNA
atgaggaggtggatgggagg

SEQ ID NO: 20373 - DNA, 20 bp, synthetic construct
  misc_feature 1..20: note = CRISPR gRNA sequence
  source 1..20: mol_type = other DNA
tggctgtgtaatcctttctg

SEQ ID NO: 20374 - DNA, 20 bp, synthetic construct
  misc_feature 1..20: note = CRISPR gRNA sequence
  source 1..20: mol_type = other DNA
gtgctcaataaatacttaag

SEQ ID NO: 20375 - DNA, 20 bp, synthetic construct
  misc_feature 1..20: note = CRISPR gRNA sequence
  source 1..20: mol_type = other DNA
ataaatacttaagtggggtg

SEQ ID NO: 20376 - DNA, 20 bp, synthetic construct
  misc_feature 1..20: note = CRISPR gRNA sequence
  source 1..20: mol_type = other DNA
ctaagaccttggttgtgagg

SEQ ID NO: 20377 - DNA, 20 bp, synthetic construct
  misc_feature 1..20: note = CRISPR gRNA sequence
  source 1..20: mol_type = other DNA
actttgggaggctgaggtgg

SEQ ID NO: 20378 - DNA, 20 bp, synthetic construct
  misc_feature 1..20: note = CRISPR gRNA sequence
  source 1..20: mol_type = other DNA
tgggcggatcacttgaggtc

SEQ ID NO: 20379 - DNA, 20 bp, synthetic construct
  misc_feature 1..20: note = CRISPR gRNA sequence
  source 1..20: mol_type = other DNA
actaaaaatacaaaaattag

SEQ ID NO: 20380 - DNA, 20 bp, synthetic construct
  misc_feature 1..20: note = CRISPR gRNA sequence
  source 1..20: mol_type = other DNA
tacttgggaggctgaggtgt

SEQ ID NO: 20381 - DNA, 20 bp, synthetic construct
  misc_feature 1..20: note = CRISPR gRNA sequence
  source 1..20: mol_type = other DNA
actttgggaggcagaggcag

SEQ ID NO: 20382 - DNA, 20 bp, synthetic construct
  misc_feature 1..20: note = CRISPR gRNA sequence
  source 1..20: mol_type = other DNA
tactcagaaggttgagatgg

SEQ ID NO: 20383 - DNA, 20 bp, synthetic construct
  misc_feature 1..20: note = CRISPR gRNA sequence
  source 1..20: mol_type = other DNA
ttacaccactgcactccacc

SEQ ID NO: 20384 - DNA, 20 bp, synthetic construct
  misc_feature 1..20: note = CRISPR gRNA sequence
  source 1..20: mol_type = other DNA
tgttcattgtgtctcctcac

SEQ ID NO: 20385 - DNA, 20 bp, synthetic construct
  misc_feature 1..20: note = CRISPR gRNA sequence
  source 1..20: mol_type = other DNA
atttaagattcctgaggtca

SEQ ID NO: 20386 - DNA, 20 bp, synthetic construct
  misc_feature 1..20: note = CRISPR gRNA sequence
  source 1..20: mol_type = other DNA
tttatttgttttgtttaaag

SEQ ID NO: 20387 - DNA, 20 bp, synthetic construct
  misc_feature 1..20: note = CRISPR gRNA sequence
  source 1..20: mol_type = other DNA
ttgattaaattaataaatgg

SEQ ID NO: 20388 - DNA, 20 bp, synthetic construct
  misc_feature 1..20: note = CRISPR gRNA sequence
  source 1..20: mol_type = other DNA
ttgggtaagtaaagaaatga

SEQ ID NO: 20389 - DNA, 20 bp, synthetic construct
  misc_feature 1..20: note = CRISPR gRNA sequence
  source 1..20: mol_type = other DNA
agaaatgattgagtgagcgg

SEQ ID NO: 20390 - DNA, 20 bp, synthetic construct
  misc_feature 1..20: note = CRISPR gRNA sequence
  source 1..20: mol_type = other DNA
ttgagtgagcggttggatga

SEQ ID NO: 20391 - DNA, 20 bp, synthetic construct
  misc_feature 1..20: note = CRISPR gRNA sequence
  source 1..20: mol_type = other DNA
gtaaagaaatgactgcataa

SEQ ID NO: 20392 - DNA, 20 bp, synthetic construct
  misc_feature 1..20: note = CRISPR gRNA sequence
  source 1..20: mol_type = other DNA
agaaatgactgcataagtga

SEQ ID NO: 20393 - DNA, 20 bp, synthetic construct
  misc_feature 1..20: note = CRISPR gRNA sequence
  source 1..20: mol_type = other DNA
atgactgcataagtgaatgg

SEQ ID NO: 20394 - DNA, 20 bp, synthetic construct
  misc_feature 1..20: note = CRISPR gRNA sequence
  source 1..20: mol_type = other DNA
ataagtgaatggatgaatca

SEQ ID NO: 20395 - DNA, 20 bp, synthetic construct
  misc_feature 1..20: note = CRISPR gRNA sequence
  source 1..20: mol_type = other DNA
atggatgaatcattgaatgg

SEQ ID NO: 20396 - DNA, 20 bp, synthetic construct
  misc_feature 1..20: note = CRISPR gRNA sequence
  source 1..20: mol_type = other DNA
atgaatcattgaatggaagg

SEQ ID NO: 20397 - DNA, 20 bp, synthetic construct
  misc_feature 1..20: note = CRISPR gRNA sequence
  source 1..20: mol_type = other DNA
atggaaggatgaatggctga

SEQ ID NO: 20398 - DNA, 20 bp, synthetic construct
  misc_feature 1..20: note = CRISPR gRNA sequence
  source 1..20: mol_type = other DNA
atgaatggctgattgaatag

SEQ ID NO: 20399 - DNA, 20 bp, synthetic construct
  misc_feature 1..20: note = CRISPR gRNA sequence
  source 1..20: mol_type = other DNA
atggctgattgaataggtga

SEQ ID NO: 20400 - DNA, 20 bp, synthetic construct
  misc_feature 1..20: note = CRISPR gRNA sequence
  source 1..20: mol_type = other DNA
ctgattgaataggtgaatga

SEQ ID NO: 20401 - DNA, 20 bp, synthetic construct
  misc_feature 1..20: note = CRISPR gRNA sequence
  source 1..20: mol_type = other DNA
ttgaataggtgaatgagtga

SEQ ID NO: 20402 - DNA, 20 bp, synthetic construct
  misc_feature 1..20: note = CRISPR gRNA sequence
  source 1..20: mol_type = other DNA
ataggtgaatgagtgaatgg

SEQ ID NO: 20403 - DNA, 20 bp, synthetic construct
  misc_feature 1..20: note = CRISPR gRNA sequence
  source 1..20: mol_type = other DNA
tgaggagattccttgaggcc

SEQ ID NO: 20404 - DNA, 20 bp, synthetic construct
  misc_feature 1..20: note = CRISPR gRNA sequence
  source 1..20: mol_type = other DNA
tcatagcactatattctagc

SEQ ID NO: 20405 - DNA, 20 bp, synthetic construct
  misc_feature 1..20: note = CRISPR gRNA sequence
  source 1..20: mol_type = other DNA
caggcccagctcactcactt

SEQ ID NO: 20406 - DNA, 20 bp, synthetic construct
  misc_feature 1..20: note = CRISPR gRNA sequence
  source 1..20: mol_type = other DNA
cagcgcatccaggctgcagg

SEQ ID NO: 20407 - DNA, 20 bp, synthetic construct
  misc_feature 1..20: note = CRISPR gRNA sequence
  source 1..20: mol_type = other DNA
aagtctaactcatgatggac

SEQ ID NO: 20408 - DNA, 20 bp, synthetic construct
  misc_feature 1..20: note = CRISPR gRNA sequence
  source 1..20: mol_type = other DNA
gctccccaatccctccccag

SEQ ID NO: 20409 - DNA, 20 bp, synthetic construct
  misc_feature 1..20: note = CRISPR gRNA sequence
  source 1..20: mol_type = other DNA
gcaaatgaggttgtgaggaa

SEQ ID NO: 20410 - DNA, 20 bp, synthetic construct
  misc_feature 1..20: note = CRISPR gRNA sequence
  source 1..20: mol_type = other DNA
aggagtttcaaaggtcacga

SEQ ID NO: 20411 - DNA, 20 bp, synthetic construct
  misc_feature 1..20: note = CRISPR gRNA sequence
  source 1..20: mol_type = other DNA
ctacaactttttttgtcact

SEQ ID NO: 20412 - DNA, 20 bp, synthetic construct
  misc_feature 1..20: note = CRISPR gRNA sequence
  source 1..20: mol_type = other DNA
actcatgtgccagccacatt

SEQ ID NO: 20413 - DNA, 20 bp, synthetic construct
  misc_feature 1..20: note = CRISPR gRNA sequence
  source 1..20: mol_type = other DNA
ttctgcaggtgccttggggg

SEQ ID NO: 20414 - DNA, 20 bp, synthetic construct
  misc_feature 1..20: note = CRISPR gRNA sequence
  source 1..20: mol_type = other DNA
ggtgccttgggggcaggatt

SEQ ID NO: 20415 - DNA, 20 bp, synthetic construct
  misc_feature 1..20: note = CRISPR gRNA sequence
  source 1..20: mol_type = other DNA
caggaggactacttgaggcc

SEQ ID NO: 20416 - DNA, 20 bp, synthetic construct
  misc_feature 1..20: note = CRISPR gRNA sequence
  source 1..20: mol_type = other DNA
gcacccagatgttgagagga

SEQ ID NO: 20417 - DNA, 20 bp, synthetic construct
  misc_feature 1..20: note = CRISPR gRNA sequence
  source 1..20: mol_type = other DNA
atgttgagaggaaggggtcc

SEQ ID NO: 20418 - DNA, 20 bp, synthetic construct
  misc_feature 1..20: note = CRISPR gRNA sequence
  source 1..20: mol_type = other DNA
tgcagggaggaaaaggccgt

SEQ ID NO: 20419 - DNA, 20 bp, synthetic construct
  misc_feature 1..20: note = CRISPR gRNA sequence
  source 1..20: mol_type = other DNA
cagcctaggaggcaaagagc

SEQ ID NO: 20420 - DNA, 20 bp, synthetic construct
  misc_feature 1..20: note = CRISPR gRNA sequence
  source 1..20: mol_type = other DNA
cacagcccctcattcagccc

SEQ ID NO: 20421 - DNA, 20 bp, synthetic construct
  misc_feature 1..20: note = CRISPR gRNA sequence
  source 1..20: mol_type = other DNA
ggaccccaatcttttctgct

SEQ ID NO: 20422 - DNA, 20 bp, synthetic construct
  misc_feature 1..20: note = CRISPR gRNA sequence
  source 1..20: mol_type = other DNA
taagaggactgcttgagccc

SEQ ID NO: 20423 - DNA, 20 bp, synthetic construct
  misc_feature 1..20: note = CRISPR gRNA sequence
  source 1..20: mol_type = other DNA
tcgcttgagcccaggaggtg

SEQ ID NO: 20424 - DNA, 20 bp, synthetic construct
  misc_feature 1..20: note = CRISPR gRNA sequence
  source 1..20: mol_type = other DNA
tcacaccactgcactccagc

SEQ ID NO: 20425 - DNA, 20 bp, synthetic construct
  misc_feature 1..20: note = CRISPR gRNA sequence
  source 1..20: mol_type = other DNA
ctcccgccgcagcctgggga

SEQ ID NO: 20426 - DNA, 20 bp, synthetic construct
  misc_feature 1..20: note = CRISPR gRNA sequence
  source 1..20: mol_type = other DNA
aggcgatcaaatagctcaca

SEQ ID NO: 20427 - DNA, 20 bp, synthetic construct
  misc_feature 1..20: note = CRISPR gRNA sequence
  source 1..20: mol_type = other DNA
ctcacacagggtcacacagc

SEQ ID NO: 20428 - DNA, 20 bp, synthetic construct
  misc_feature 1..20: note = CRISPR gRNA sequence
  source 1..20: mol_type = other DNA
acatttagagcagacttcaa

SEQ ID NO: 20429 - DNA, 20 bp, synthetic construct
  misc_feature 1..20: note = CRISPR gRNA sequence
  source 1..20: mol_type = other DNA
cctttgaactttttcaatat

SEQ ID NO: 20430 - DNA, 20 bp, synthetic construct
  misc_feature 1..20: note = CRISPR gRNA sequence
  source 1..20: mol_type = other DNA
gtaaaattatggtgccagca

SEQ ID NO: 20431 - DNA, 20 bp, synthetic construct
  misc_feature 1..20: note = CRISPR gRNA sequence
  source 1..20: mol_type = other DNA
ttttgttgttatttgtttgt

SEQ ID NO: 20432 - DNA, 20 bp, synthetic construct
  misc_feature 1..20: note = CRISPR gRNA sequence
  source 1..20: mol_type = other DNA
cagtaaccgcgcacggtcac

SEQ ID NO: 20433 - DNA, 20 bp, synthetic construct
  misc_feature 1..20: note = CRISPR gRNA sequence
  source 1..20: mol_type = other DNA
ctggcctcagcaaaaggcca

SEQ ID NO: 20434 - DNA, 20 bp, synthetic construct
  misc_feature 1..20: note = CRISPR gRNA sequence
  source 1..20: mol_type = other DNA
tcagcaaaaggccacaggat

SEQ ID NO: 20435 - DNA, 20 bp, synthetic construct
  misc_feature 1..20: note = CRISPR gRNA sequence
  source 1..20: mol_type = other DNA
acaggatcagagtttgactc

SEQ ID NO: 20436 - DNA, 20 bp, synthetic construct
  misc_feature 1..20: note = CRISPR gRNA sequence
  source 1..20: mol_type = other DNA
atatttcaccccaatcttat

SEQ ID NO: 20437 - DNA, 20 bp, synthetic construct
  misc_feature 1..20: note = CRISPR gRNA sequence
  source 1..20: mol_type = other DNA
ccccaatcttatgggggttc

SEQ ID NO: 20438 - DNA, 20 bp, synthetic construct
  misc_feature 1..20: note = CRISPR gRNA sequence
  source 1..20: mol_type = other DNA
cagacgaaaatccctgcctt

SEQ ID NO: 20439 - DNA, 20 bp, synthetic construct
  misc_feature 1..20: note = CRISPR gRNA sequence
  source 1..20: mol_type = other DNA
gcaagctgatgtctgagaca

SEQ ID NO: 20440 - DNA, 20 bp, synthetic construct
  misc_feature 1..20: note = CRISPR gRNA sequence
  source 1..20: mol_type = other DNA
tggaaatatacagtggtgag

SEQ ID NO: 20441 - DNA, 20 bp, synthetic construct
  misc_feature 1..20: note = CRISPR gRNA sequence
  source 1..20: mol_type = other DNA
atatacagtggtgaggggga

SEQ ID NO: 20442 - DNA, 20 bp, synthetic construct
  misc_feature 1..20: note = CRISPR gRNA sequence
  source 1..20: mol_type = other DNA
gttttttttttaaccatgag

SEQ ID NO: 20443 - DNA, 20 bp, synthetic construct
  misc_feature 1..20: note = CRISPR gRNA sequence
  source 1..20: mol_type = other DNA
ttttttaaccatgaggggaa

SEQ ID NO: 20444 - DNA, 20 bp, synthetic construct
  misc_feature 1..20: note = CRISPR gRNA sequence
  source 1..20: mol_type = other DNA
ttatttatttatttttgaga

SEQ ID NO: 20445 - DNA, 20 bp, synthetic construct
  misc_feature 1..20: note = CRISPR gRNA sequence
  source 1..20: mol_type = other DNA
ttttgtatatttagtagaga

SEQ ID NO: 20446 - DNA, 20 bp, synthetic construct
  misc_feature 1..20: note = CRISPR gRNA sequence
  source 1..20: mol_type = other DNA
gcctcggcctcccaaagtgc

SEQ ID NO: 20447 - DNA, 20 bp, synthetic construct
  misc_feature 1..20: note = CRISPR gRNA sequence
  source 1..20: mol_type = other DNA
cataagccactgcgcctggc

SEQ ID NO: 20448 - DNA, 20 bp, synthetic construct
  misc_feature 1..20: note = CRISPR gRNA sequence
  source 1..20: mol_type = other DNA
agagttttatttttaactgt

SEQ ID NO: 20449 - DNA, 20 bp, synthetic construct
  misc_feature 1..20: note = CRISPR gRNA sequence
  source 1..20: mol_type = other DNA
cagaaaagacctcactgagg

SEQ ID NO: 20450 - DNA, 20 bp, synthetic construct
  misc_feature 1..20: note = CRISPR gRNA sequence
  source 1..20: mol_type = other DNA
actttgggaggccgaggtgg

SEQ ID NO: 20451 - DNA, 20 bp, synthetic construct
  misc_feature 1..20: note = CRISPR gRNA sequence
  source 1..20: mol_type = other DNA
tactcgggaggctgaggcaa

SEQ ID NO: 20452 - DNA, 20 bp, synthetic construct
  misc_feature 1..20: note = CRISPR gRNA sequence
  source 1..20: mol_type = other DNA
cttgggaggaggaggttgca

SEQ ID NO: 20453 - DNA, 20 bp, synthetic construct
  misc_feature 1..20: note = CRISPR gRNA sequence
  source 1..20: mol_type = other DNA
ttgtgccactgcactccagc

SEQ ID NO: 20454 - DNA, 20 bp, synthetic construct
  misc_feature 1..20: note = CRISPR gRNA sequence
  source 1..20: mol_type = other DNA
aaagaaaagaaaaggcctca

SEQ ID NO: 20455 - DNA, 20 bp, synthetic construct
  misc_feature 1..20: note = CRISPR gRNA sequence
  source 1..20: mol_type = other DNA
cagcaaggaggccctgtggc

SEQ ID NO: 20456 - DNA, 20 bp, synthetic construct
  misc_feature 1..20: note = CRISPR gRNA sequence
  source 1..20: mol_type = other DNA
tggaatggagagagcaccca

SEQ ID NO: 20457 - DNA, 20 bp, synthetic construct
  misc_feature 1..20: note = CRISPR gRNA sequence
  source 1..20: mol_type = other DNA
acccagcgagtgtaggagat

SEQ ID NO: 20458 - DNA, 20 bp, synthetic construct
  misc_feature 1..20: note = CRISPR gRNA sequence
  source 1..20: mol_type = other DNA
taggagataagggtgaacag

SEQ ID NO: 20459 - DNA, 20 bp, synthetic construct
  misc_feature 1..20: note = CRISPR gRNA sequence
  source 1..20: mol_type = other DNA
gtgtacaaacgaagtccctg

SEQ ID NO: 20460 - DNA, 20 bp, synthetic construct
  misc_feature 1..20: note = CRISPR gRNA sequence
  source 1..20: mol_type = other DNA
aacgaagtccctgtagggtt

SEQ ID NO: 20461 - DNA, 20 bp, synthetic construct
  misc_feature 1..20: note = CRISPR gRNA sequence
  source 1..20: mol_type = other DNA
tgacagacagatgaggtcta

SEQ ID NO: 20462 - DNA, 20 bp, synthetic construct
  misc_feature 1..20: note = CRISPR gRNA sequence
  source 1..20: mol_type = other DNA
tcagggagagctgatagctt

SEQ ID NO: 20463 - DNA, 20 bp, synthetic construct
  misc_feature 1..20: note = CRISPR gRNA sequence
  source 1..20: mol_type = other DNA
gagattatatataaaatgca

SEQ ID NO: 20464 - DNA, 20 bp, synthetic construct
  misc_feature 1..20: note = CRISPR gRNA sequence
  source 1..20: mol_type = other DNA
tgggaggaacatctgaggcc

SEQ ID NO: 20465 - DNA, 20 bp, synthetic construct
  misc_feature 1..20: note = CRISPR gRNA sequence
  source 1..20: mol_type = other DNA
tcataccactgcattctagc

SEQ ID NO: 20466 - DNA, 20 bp, synthetic construct
  misc_feature 1..20: note = CRISPR gRNA sequence
  source 1..20: mol_type = other DNA
atctccaaaaaaaaacagca

SEQ ID NO: 20467 - DNA, 20 bp, synthetic construct
  misc_feature 1..20: note = CRISPR gRNA sequence
  source 1..20: mol_type = other DNA
ctgacctgacctttatgact

SEQ ID NO: 20468 - DNA, 20 bp, synthetic construct
  misc_feature 1..20: note = CRISPR gRNA sequence
  source 1..20: mol_type = other DNA
tgatgacaatgcctgtagag

SEQ ID NO: 20469 - DNA, 20 bp, synthetic construct
  misc_feature 1..20: note = CRISPR gRNA sequence
  source 1..20: mol_type = other DNA
actttgggaggctgaggtgg

SEQ ID NO: 20470 - DNA, 20 bp, synthetic construct
  misc_feature 1..20: note = CRISPR gRNA sequence
  source 1..20: mol_type = other DNA
tactagggaggctgaggtgg

SEQ ID NO: 20471 - DNA, 20 bp, synthetic construct
  misc_feature 1..20: note = CRISPR gRNA sequence
  source 1..20: mol_type = other DNA
ctgaactccagcctgaggga

SEQ ID NO: 20472 - DNA, 20 bp, synthetic construct
  misc_feature 1..20: note = CRISPR gRNA sequence
  source 1..20: mol_type = other DNA
gggaaggaaagagaaagaaa

SEQ ID NO: 20473 - DNA, 20 bp, synthetic construct
  misc_feature 1..20: note = CRISPR gRNA sequence
  source 1..20: mol_type = other DNA
gtcaccccagcaacactgcc

SEQ ID NO: 20474 - DNA, 20 bp, synthetic construct
  misc_feature 1..20: note = CRISPR gRNA sequence
  source 1..20: mol_type = other DNA
cctgggactaaggggcttct

SEQ ID NO: 20475 - DNA, 20 bp, synthetic construct
  misc_feature 1..20: note = CRISPR gRNA sequence
  source 1..20: mol_type = other DNA
aagactttcagttttcaaac

SEQ ID NO: 20476 - DNA, 20 bp, synthetic construct
  misc_feature 1..20: note = CRISPR gRNA sequence
  source 1..20: mol_type = other DNA
ccaggatagtcccaggcaag

SEQ ID NO: 20477 - DNA, 20 bp, synthetic construct
  misc_feature 1..20: note = CRISPR gRNA sequence
  source 1..20: mol_type = other DNA
gctgcacatcaaaagctcct

SEQ ID NO: 20478 - DNA, 20 bp, synthetic construct
  misc_feature 1..20: note = CRISPR gRNA sequence
  source 1..20: mol_type = other DNA
ccccctgacctcctccagag

SEQ ID NO: 20479 - DNA, 20 bp, synthetic construct
  misc_feature 1..20: note = CRISPR gRNA sequence
  source 1..20: mol_type = other DNA
tcaagtgctcaatacctctg

SEQ ID NO: 20480 - DNA, 20 bp, synthetic construct
  misc_feature 1..20: note = CRISPR gRNA sequence
  source 1..20: mol_type = other DNA
gtgctcaatacctctgttga

SEQ ID NO: 20481 - DNA, 20 bp, synthetic construct
  misc_feature 1..20: note = CRISPR gRNA sequence
  source 1..20: mol_type = other DNA
acctctgttgaatgagtgat

SEQ ID NO: 20482 - DNA, 20 bp, synthetic construct
  misc_feature 1..20: note = CRISPR gRNA sequence
  source 1..20: mol_type = other DNA
atgaccatgttaaccagcaa

SEQ ID NO: 20483 - DNA, 20 bp, synthetic construct
  misc_feature 1..20: note = CRISPR gRNA sequence
  source 1..20: mol_type = other DNA
atttccaaagtggtgggcaa

SEQ ID NO: 20484 - DNA, 20 bp, synthetic construct
  misc_feature 1..20: note = CRISPR gRNA sequence
  source 1..20: mol_type = other DNA
aaagtggtgggcaagagggt

SEQ ID NO: 20485 - DNA, 20 bp, synthetic construct
  misc_feature 1..20: note = CRISPR gRNA sequence
  source 1..20: mol_type = other DNA
ctgtcactgagcccttaccc

SEQ ID NO: 20486 - DNA, 20 bp, synthetic construct
  misc_feature 1..20: note = CRISPR gRNA sequence
  source 1..20: mol_type = other DNA
cagtgccccaaattccccag

SEQ ID NO: 20487 - DNA, 20 bp, synthetic construct
  misc_feature 1..20: note = CRISPR gRNA sequence
  source 1..20: mol_type = other DNA
tcttaaaaaaaaagatctgt

SEQ ID NO: 20488 - DNA, 20 bp, synthetic construct
  misc_feature 1..20: note = CRISPR gRNA sequence
  source 1..20: mol_type = other DNA
actttgggaggctgaggcag

SEQ ID NO: 20489 - DNA, 20 bp, synthetic construct
  misc_feature 1..20: note = CRISPR gRNA sequence
  source 1..20: mol_type = other DNA
caggaggattgcttgaggcc

SEQ ID NO: 20490 - DNA, 20 bp, synthetic construct
  misc_feature 1..20: note = CRISPR gRNA sequence
  source 1..20: mol_type = other DNA
tacttgggaggctgaggcag

SEQ ID NO: 20491 - DNA, 20 bp, synthetic construct
  misc_feature 1..20: note = CRISPR gRNA sequence
  source 1..20: mol_type = other DNA
caggaggatcgcttgagctc

SEQ ID NO: 20492 - DNA, 20 bp, synthetic construct
  misc_feature 1..20: note = CRISPR gRNA sequence
  source 1..20: mol_type = other DNA
gctcaaacaatgtgtgatga

SEQ ID NO: 20493 - DNA, 20 bp, synthetic construct
  misc_feature 1..20: note = CRISPR gRNA sequence
  source 1..20: mol_type = other DNA
aaacaatgtgtgatgaagga

SEQ ID NO: 20494 - DNA, 20 bp, synthetic construct
  misc_feature 1..20: note = CRISPR gRNA sequence
  source 1..20: mol_type = other DNA
cagttgtcctaaatgcctca

SEQ ID NO: 20495 - DNA, 20 bp, synthetic construct
  misc_feature 1..20: note = CRISPR gRNA sequence
  source 1..20: mol_type = other DNA
tgggcacatgatggcaggtt

SEQ ID NO: 20496 - DNA, 20 bp, synthetic construct
  misc_feature 1..20: note = CRISPR gRNA sequence
  source 1..20: mol_type = other DNA
ctagaggctccgcctgggca

SEQ ID NO: 20497 - DNA, 20 bp, synthetic construct
  misc_feature 1..20: note = CRISPR gRNA sequence
  source 1..20: mol_type = other DNA
cattgcccagaaagagggca

SEQ ID NO: 20498 - DNA, 20 bp, synthetic construct
  misc_feature 1..20: note = CRISPR gRNA sequence
  source 1..20: mol_type = other DNA
gaaatgcccatgacaaactt

SEQ ID NO: 20499 - DNA, 20 bp, synthetic construct
  misc_feature 1..20: note = CRISPR gRNA sequence
  source 1..20: mol_type = other DNA
tgcccatgacaaacttgaga

SEQ ID NO: 20500 - DNA, 20 bp, synthetic construct
  misc_feature 1..20: note = CRISPR gRNA sequence
  source 1..20: mol_type = other DNA
atccgcctctcctctcacct

SEQ ID NO: 20501 - DNA, 20 bp, synthetic construct
  misc_feature 1..20: note = CRISPR gRNA sequence
  source 1..20: mol_type = other DNA
aatggaagggcagctccatg

SEQ ID NO: 20502 - DNA, 20 bp, synthetic construct
  misc_feature 1..20: note = CRISPR gRNA sequence
  source 1..20: mol_type = other DNA
attatgtaggaccttacagc

SEQ ID NO: 20503 - DNA, 20 bp, synthetic construct
  misc_feature 1..20: note = CRISPR gRNA sequence
  source 1..20: mol_type = other DNA
gacttaatgaaaccaaatta

SEQ ID NO: 20504 - DNA, 20 bp, synthetic construct
  misc_feature 1..20: note = CRISPR gRNA sequence
  source 1..20: mol_type = other DNA
agccttcatcctgacagtgg

SEQ ID NO: 20505 - DNA, 20 bp, synthetic construct
  misc_feature 1..20: note = CRISPR gRNA sequence
  source 1..20: mol_type = other DNA
acagtggtggagtgtccctg

SEQ ID NO: 20506 - DNA, 20 bp, synthetic construct
  misc_feature 1..20: note = CRISPR gRNA sequence
  source 1..20: mol_type = other DNA
gtccctgaaggattgtaagc

SEQ ID NO: 20507 - DNA, 20 bp, synthetic construct
  misc_feature 1..20: note = CRISPR gRNA sequence
  source 1..20: mol_type = other DNA
tgaaggattgtaagcaggga

SEQ ID NO: 20508 - DNA, 20 bp, synthetic construct
  misc_feature 1..20: note = CRISPR gRNA sequence
  source 1..20: mol_type = other DNA
tgagaagattggtctggttg

SEQ ID NO: 20509 - DNA, 20 bp, synthetic construct
  misc_feature 1..20: note = CRISPR gRNA sequence
  source 1..20: mol_type = other DNA
tctggttgctgaatacaaaa

SEQ ID NO: 20510 - DNA, 20 bp, synthetic construct
  misc_feature 1..20: note = CRISPR gRNA sequence
  source 1..20: mol_type = other DNA
caaaatggagtggaagagga

SEQ ID NO: 20511 - DNA, 20 bp, synthetic construct
  misc_feature 1..20: note = CRISPR gRNA sequence
  source 1..20: mol_type = other DNA
aagaggagagaatggaggca

SEQ ID NO: 20512 - DNA, 20 bp, synthetic construct
  misc_feature 1..20: note = CRISPR gRNA sequence
  source 1..20: mol_type = other DNA
agaaaacggtggcgtgctca

SEQ ID NO: 20513 - DNA, 20 bp, synthetic construct
  misc_feature 1..20: note = CRISPR gRNA sequence
  source 1..20: mol_type = other DNA
tggcgtgctcagggggtgga

SEQ ID NO: 20514 - DNA, 20 bp, synthetic construct
  misc_feature 1..20: note = CRISPR gRNA sequence
  source 1..20: mol_type = other DNA
ggccttcaaatattgactgg

SEQ ID NO: 20515 - DNA, 20 bp, synthetic construct
  misc_feature 1..20: note = CRISPR gRNA sequence
  source 1..20: mol_type = other DNA
atcctcatcttaaaaatgga

SEQ ID NO: 20516 - DNA, 20 bp, synthetic construct
  misc_feature 1..20: note = CRISPR gRNA sequence
  source 1..20: mol_type = other DNA
ccgcagttaatgcccaacac

SEQ ID NO: 20517 - DNA, 20 bp, synthetic construct
  misc_feature 1..20: note = CRISPR gRNA sequence
  source 1..20: mol_type = other DNA
agcccctcaccccacctgaa

SEQ ID NO: 20518 - DNA, 20 bp, synthetic construct
  misc_feature 1..20: note = CRISPR gRNA sequence
  source 1..20: mol_type = other DNA
acctgaaacgggtgacacag

SEQ ID NO: 20519 - DNA, 20 bp, synthetic construct
  misc_feature 1..20: note = CRISPR gRNA sequence
  source 1..20: mol_type = other DNA
tgtgcatcaggaggcgtgag

SEQ ID NO: 20520 - DNA, 20 bp, synthetic construct
  misc_feature 1..20: note = CRISPR gRNA sequence
  source 1..20: mol_type = other DNA
ccgaggcagccgccgatggc

SEQ ID NO: 20521 - DNA, 20 bp, synthetic construct
  misc_feature 1..20: note = CRISPR gRNA sequence
  source 1..20: mol_type = other DNA
tcatagggcctcttcttcct

SEQ ID NO: 20522 - DNA, 20 bp, synthetic construct
  misc_feature 1..20: note = CRISPR gRNA sequence
  source 1..20: mol_type = other DNA
ctcggactctgcggcccgcg

SEQ ID NO: 20523 - DNA, 20 bp, synthetic construct
  misc_feature 1..20: note = CRISPR gRNA sequence
  source 1..20: mol_type = other DNA
tcgcccaggtcctcacgtct

SEQ ID NO: 20524 - DNA, 20 bp, synthetic construct
  misc_feature 1..20: note = CRISPR gRNA sequence
  source 1..20: mol_type = other DNA
gatgggaactggtcctcctg

SEQ ID NO: 20525 - DNA, 20 bp, synthetic construct
  misc_feature 1..20: note = CRISPR gRNA sequence
  source 1..20: mol_type = other DNA
cacggcccagcaggccgaca

SEQ ID NO: 20526 - DNA, 20 bp, synthetic construct
  misc_feature 1..20: note = CRISPR gRNA sequence
  source 1..20: mol_type = other DNA
cggggccgggctgtgaggag

SEQ ID NO: 20527 - DNA, 20 bp, synthetic construct
  misc_feature 1..20: note = CRISPR gRNA sequence
  source 1..20: mol_type = other DNA
tccagctcctcgaagccgtc

SEQ ID NO: 20528 - DNA, 20 bp, synthetic construct
  misc_feature 1..20: note = CRISPR gRNA sequence
  source 1..20: mol_type = other DNA
tgaaaacctcatcggccgcc

SEQ ID NO: 20529 - DNA, 20 bp, synthetic construct
  misc_feature 1..20: note = CRISPR gRNA sequence
  source 1..20: mol_type = other DNA
agctgccgttctgcccagtc

SEQ ID NO: 20530 - DNA, 20 bp, synthetic construct
  misc_feature 1..20: note = CRISPR gRNA sequence
  source 1..20: mol_type = other DNA
tgcaccagatccacctccac

SEQ ID NO: 20531 - DNA, 20 bp, synthetic construct
  misc_feature 1..20: note = CRISPR gRNA sequence
  source 1..20: mol_type = other DNA
tgcaaaggccaggggcgtgt

SEQ ID NO: 20532 - DNA, 20 bp, synthetic construct
  misc_feature 1..20: note = CRISPR gRNA sequence
  source 1..20: mol_type = other DNA
ggccaggggcgtgtcagggt

SEQ ID NO: 20533 - DNA, 20 bp, synthetic construct
  misc_feature 1..20: note = CRISPR gRNA sequence
  source 1..20: mol_type = other DNA
tgttttgttttgttttgaga

SEQ ID NO: 20534 - DNA, 20 bp, synthetic construct
  misc_feature 1..20: note = CRISPR gRNA sequence
  source 1..20: mol_type = other DNA
tctggcttttttgcccaggc

SEQ ID NO: 20535 - DNA, 20 bp, synthetic construct
  misc_feature 1..20: note = CRISPR gRNA sequence
  source 1..20: mol_type = other DNA
ttttgatttttttgtagaga

SEQ ID NO: 20536 - DNA, 20 bp, synthetic construct
  misc_feature 1..20: note = CRISPR gRNA sequence
  source 1..20: mol_type = other DNA
aatcctcccacctcagcctc

SEQ ID NO: 20537 - DNA, 20 bp, synthetic construct
  misc_feature 1..20: note = CRISPR gRNA sequence
  source 1..20: mol_type = other DNA
gccttggcctcccaaagtgc

SEQ ID NO: 20538 - DNA, 20 bp, synthetic construct
  misc_feature 1..20: note = CRISPR gRNA sequence
  source 1..20: mol_type = other DNA
ctctcttttttttttttgag

SEQ ID NO: 20539 - DNA, 20 bp, synthetic construct
  misc_feature 1..20: note = CRISPR gRNA sequence
  source 1..20: mol_type = other DNA
tcctgccctgtgccccaggc

SEQ ID NO: 20540 - DNA, 20 bp, synthetic construct
  misc_feature 1..20: note = CRISPR gRNA sequence
  source 1..20: mol_type = other DNA
ctcacggcaacctccacctc

SEQ ID NO: 20541 - DNA, 20 bp, synthetic construct
  misc_feature 1..20: note = CRISPR gRNA sequence
  source 1..20: mol_type = other DNA
gcctcggcctgccaagtagc

SEQ ID NO: 20542 - DNA, 20 bp, synthetic construct
  misc_feature 1..20: note = CRISPR gRNA sequence
  source 1..20: mol_type = other DNA
tttgtattttttaatggaga

SEQ ID NO: 20543 - DNA, 20 bp, synthetic construct
  misc_feature 1..20: note = CRISPR gRNA sequence
  source 1..20: mol_type = other DNA
gccttggcctcccaaagtgc

SEQ ID NO: 20544 - DNA, 20 bp, synthetic construct
  misc_feature 1..20: note = CRISPR gRNA sequence
  source 1..20: mol_type = other DNA
accatggggaggtcatggga

SEQ ID NO: 20545 - DNA, 20 bp, synthetic construct
  misc_feature 1..20: note = CRISPR gRNA sequence
  source 1..20: mol_type = other DNA
aggtcatgggagggagtgtt

SEQ ID NO: 20546 - DNA, 20 bp, synthetic construct
  misc_feature 1..20: note = CRISPR gRNA sequence
  source 1..20: mol_type = other DNA
agacagtggagcccacgtgt

SEQ ID NO: 20547 - DNA, 20 bp, synthetic construct
  misc_feature 1..20: note = CRISPR gRNA sequence
  source 1..20: mol_type = other DNA
agtagcctcatctggaaaat

SEQ ID NO: 20548 - DNA, 20 bp, synthetic construct
  misc_feature 1..20: note = CRISPR gRNA sequence
  source 1..20: mol_type = other DNA
ctggaaaatggggataatat

SEQ ID NO: 20549 - DNA, 20 bp, synthetic construct
  misc_feature 1..20: note = CRISPR gRNA sequence
  source 1..20: mol_type = other DNA
acatgcttagaccagtatgt

SEQ ID NO: 20550 - DNA, 20 bp, synthetic construct
  misc_feature 1..20: note = CRISPR gRNA sequence
  source 1..20: mol_type = other DNA
gggcaataaatattatttga

SEQ ID NO: 20551 - DNA, 20 bp, synthetic construct
  misc_feature 1..20: note = CRISPR gRNA sequence
  source 1..20: mol_type = other DNA
aatattatttgagggagtgg

SEQ ID NO: 20552 - DNA, 20 bp, synthetic construct
  misc_feature 1..20: note = CRISPR gRNA sequence
  source 1..20: mol_type = other DNA
ttatttgagggagtggtgga

SEQ ID NO: 20553 - DNA, 20 bp, synthetic construct
  misc_feature 1..20: note = CRISPR gRNA sequence
  source 1..20: mol_type = other DNA
atgatggcataatcaaataa

SEQ ID NO: 20554 - DNA, 20 bp, synthetic construct
  misc_feature 1..20: note = CRISPR gRNA sequence
  source 1..20: mol_type = other DNA
tggcataatcaaataagtga

SEQ ID NO: 20555 - DNA, 20 bp, synthetic construct
  misc_feature 1..20: note = CRISPR gRNA sequence
  source 1..20: mol_type = other DNA
ataatcaaataagtgaatga

SEQ ID NO: 20556 - DNA, 20 bp, synthetic construct
  misc_feature 1..20: note = CRISPR gRNA sequence
  source 1..20: mol_type = other DNA
tcaaataagtgaatgaatga

SEQ ID NO: 20557 - DNA, 20 bp, synthetic construct
  misc_feature 1..20: note = CRISPR gRNA sequence
  source 1..20: mol_type = other DNA
ataagtgaatgaatgaatga

SEQ ID NO: 20558 - DNA, 20 bp, synthetic construct
  misc_feature 1..20: note = CRISPR gRNA sequence
  source 1..20: mol_type = other DNA
atgaatgaatgaataaataa

SEQ ID NO: 20559 - DNA, 20 bp, synthetic construct
  misc_feature 1..20: note = CRISPR gRNA sequence
  source 1..20: mol_type = other DNA
agtgtgtgagccaacaaaga

SEQ ID NO: 20560 - DNA, 20 bp, synthetic construct
  misc_feature 1..20: note = CRISPR gRNA sequence
  source 1..20: mol_type = other DNA
gtgagccaacaaagaagggg

SEQ ID NO: 20561 - DNA, 20 bp, synthetic construct
  misc_feature 1..20: note = CRISPR gRNA sequence
  source 1..20: mol_type = other DNA
aggggttgaataagtgtcaa

SEQ ID NO: 20562 - DNA, 20 bp, synthetic construct
  misc_feature 1..20: note = CRISPR gRNA sequence
  source 1..20: mol_type = other DNA
acctctccagctgccgggca

SEQ ID NO: 20563 - DNA, 20 bp, synthetic construct
  misc_feature 1..20: note = CRISPR gRNA sequence
  source 1..20: mol_type = other DNA
ggagaagcaggtgccagatt

SEQ ID NO: 20564 - DNA, 20 bp, synthetic construct
  misc_feature 1..20: note = CRISPR gRNA sequence
  source 1..20: mol_type = other DNA
gcaggtgccagatttagggt

SEQ ID NO: 20565 - DNA, 20 bp, synthetic construct
  misc_feature 1..20: note = CRISPR gRNA sequence
  source 1..20: mol_type = other DNA
gtccttacagccttcatggg

SEQ ID NO: 20566 - DNA, 20 bp, synthetic construct
  misc_feature 1..20: note = CRISPR gRNA sequence
  source 1..20: mol_type = other DNA
aagaaaatcgcaatatcagg

SEQ ID NO: 20567 - DNA, 20 bp, synthetic construct
  misc_feature 1..20: note = CRISPR gRNA sequence
  source 1..20: mol_type = other DNA
actttgggaggtcgaggcag

SEQ ID NO: 20568 - DNA, 20 bp, synthetic construct
  misc_feature 1..20: note = CRISPR gRNA sequence
  source 1..20: mol_type = other DNA
caggtggatcacttgagatc

SEQ ID NO: 20569 - DNA, 20 bp, synthetic construct
  misc_feature 1..20: note = CRISPR gRNA sequence
  source 1..20: mol_type = other DNA
actgaaattacaaaaattgg

SEQ ID NO: 20570 - DNA, 20 bp, synthetic construct
  misc_feature 1..20: note = CRISPR gRNA sequence
  source 1..20: mol_type = other DNA
tgctccggaggctgaggcag

SEQ ID NO: 20571 - DNA, 20 bp, synthetic construct
  misc_feature 1..20: note = CRISPR gRNA sequence
  source 1..20: mol_type = other DNA
ctgcactctagcctgggcaa

SEQ ID NO: 20572 - DNA, 20 bp, synthetic construct
  misc_feature 1..20: note = CRISPR gRNA sequence
  source 1..20: mol_type = other DNA
cacaatatctatgtaaaaat

SEQ ID NO: 20573 - DNA, 20 bp, synthetic construct
  misc_feature 1..20: note = CRISPR gRNA sequence
  source 1..20: mol_type = other DNA
cacattgtctggcttttctg

SEQ ID NO: 20574 - DNA, 20 bp, synthetic construct
  misc_feature 1..20: note = CRISPR gRNA sequence
  source 1..20: mol_type = other DNA
ctgaaggctgatggctgtat

SEQ ID NO: 20575 - DNA, 20 bp, synthetic construct
  misc_feature 1..20: note = CRISPR gRNA sequence
  source 1..20: mol_type = other DNA
ggctgatggctgtatttgga

SEQ ID NO: 20576 - DNA, 20 bp, synthetic construct
  misc_feature 1..20: note = CRISPR gRNA sequence
  source 1..20: mol_type = other DNA
tggctgtatttggatgggat

SEQ ID NO: 20577 - DNA, 20 bp, synthetic construct
  misc_feature 1..20: note = CRISPR gRNA sequence
  source 1..20: mol_type = other DNA
ccctacaggcagctttgctt

SEQ ID NO: 20578 - DNA, 20 bp, synthetic construct
  misc_feature 1..20: note = CRISPR gRNA sequence
  source 1..20: mol_type = other DNA
tagtacctctcacaggccct

SEQ ID NO: 20579 - DNA, 20 bp, synthetic construct
  misc_feature 1..20: note = CRISPR gRNA sequence
  source 1..20: mol_type = other DNA
atgttgggaggccgtggaca

SEQ ID NO: 20580 - DNA, 20 bp, synthetic construct
  misc_feature 1..20: note = CRISPR gRNA sequence
  source 1..20: mol_type = other DNA
ggacagtgaatccactggga

SEQ ID NO: 20581 - DNA, 20 bp, synthetic construct
  misc_feature 1..20: note = CRISPR gRNA sequence
  source 1..20: mol_type = other DNA
tggggcacctcacctacatt

SEQ ID NO: 20582 - DNA, 20 bp, synthetic construct
  misc_feature 1..20: note = CRISPR gRNA sequence
  source 1..20: mol_type = other DNA
cctcacctacattgggggtg

SEQ ID NO: 20583 - DNA, 20 bp, synthetic construct
  misc_feature 1..20: note = CRISPR gRNA sequence
  source 1..20: mol_type = other DNA
ttgggggtggagagtggtgt

SEQ ID NO: 20584 - DNA, 20 bp, synthetic construct
  misc_feature 1..20: note = CRISPR gRNA sequence
  source 1..20: mol_type = other DNA
tattgattccagaaatgcac

SEQ ID NO: 20585 - DNA, 20 bp, synthetic construct
  misc_feature 1..20: note = CRISPR gRNA sequence
  source 1..20: mol_type = other DNA
ctcaggaagtctggagagaa

SEQ ID NO: 20586 - DNA, 20 bp, synthetic construct
  misc_feature 1..20: note = CRISPR gRNA sequence
  source 1..20: mol_type = other DNA
cagagctgaagaaagagctc

SEQ ID NO: 20587 - DNA, 20 bp, synthetic construct
  misc_feature 1..20: note = CRISPR gRNA sequence
  source 1..20: mol_type = other DNA
ttgcttttccaatctgtgaa

SEQ ID NO: 20588 - DNA, 20 bp, synthetic construct
  misc_feature 1..20: note = CRISPR gRNA sequence
  source 1..20: mol_type = other DNA
actgaaactgtcttgcaacc

SEQ ID NO: 20589 - DNA, 20 bp, synthetic construct
  misc_feature 1..20: note = CRISPR gRNA sequence
  source 1..20: mol_type = other DNA
aaactgtcttgcaaccagga

SEQ ID NO: 20590 - DNA, 20 bp, synthetic construct
  misc_feature 1..20: note = CRISPR gRNA sequence
  source 1..20: mol_type = other DNA
caggaatggatgctctggac

SEQ ID NO: 20591 - DNA, 20 bp, synthetic construct
  misc_feature 1..20: note = CRISPR gRNA sequence
  source 1..20: mol_type = other DNA
agtcacaacccctcagtgtg

SEQ ID NO: 20592 - DNA, 20 bp, synthetic construct
  misc_feature 1..20: note = CRISPR gRNA sequence
  source 1..20: mol_type = other DNA
caaatcagagaaagctatgc

SEQ ID NO: 20593 - DNA, 20 bp, synthetic construct
  misc_feature 1..20: note = CRISPR gRNA sequence
  source 1..20: mol_type = other DNA
tattcacatcagtatactaa

SEQ ID NO: 20594 - DNA, 20 bp, synthetic construct
  misc_feature 1..20: note = CRISPR gRNA sequence
  source 1..20: mol_type = other DNA
ctaaaagagtgagagagaca

SEQ ID NO: 20595 - DNA, 20 bp, synthetic construct
  misc_feature 1..20: note = CRISPR gRNA sequence
  source 1..20: mol_type = other DNA
aaaaaaaataaggaaaaact

SEQ ID NO: 20596 - DNA, 20 bp, synthetic construct
  misc_feature 1..20: note = CRISPR gRNA sequence
  source 1..20: mol_type = other DNA
tcatgcacccagaccacctc

SEQ ID NO: 20597 - DNA, 20 bp, synthetic construct
  misc_feature 1..20: note = CRISPR gRNA sequence
  source 1..20: mol_type = other DNA
agaaagttgtgctggggagg

SEQ ID NO: 20598 - DNA, 20 bp, synthetic construct
  misc_feature 1..20: note = CRISPR gRNA sequence
  source 1..20: mol_type = other DNA
gggcaccactgccaagtgca

SEQ ID NO: 20599 - DNA, 20 bp, synthetic construct
  misc_feature 1..20: note = CRISPR gRNA sequence
  source 1..20: mol_type = other DNA
ccaagtgcatggagtatggg

SEQ ID NO: 20600 - DNA, 20 bp, synthetic construct
  misc_feature 1..20: note = CRISPR gRNA sequence
  source 1..20: mol_type = other DNA
ccccgcactcaccatggtag

SEQ ID NO: 20601 - DNA, 20 bp, synthetic construct
  misc_feature 1..20: note = CRISPR gRNA sequence
  source 1..20: mol_type = other DNA
atttgccagagcccatgggg

SEQ ID NO: 20602 - DNA, 20 bp, synthetic construct
  misc_feature 1..20: note = CRISPR gRNA sequence
  source 1..20: mol_type = other DNA
gtggagatggtggggacaaa

SEQ ID NO: 20603 - DNA, 20 bp, synthetic construct
  misc_feature 1..20: note = CRISPR gRNA sequence
  source 1..20: mol_type = other DNA
agatggtggggacaaactgg

SEQ ID NO: 20604 - DNA, 20 bp, synthetic construct
  misc_feature 1..20: note = CRISPR gRNA sequence
  source 1..20: mol_type = other DNA
aagagacaaaggcagtgagg

SEQ ID NO: 20605 - DNA, 20 bp, synthetic construct
  misc_feature 1..20: note = CRISPR gRNA sequence
  source 1..20: mol_type = other DNA
ctgtttctgtcctgccctga

SEQ ID NO: 20606 - DNA, 20 bp, synthetic construct
  misc_feature 1..20: note = CRISPR gRNA sequence
  source 1..20: mol_type = other DNA
gctccatgaagagctgatga

SEQ ID NO: 20607 - DNA, 20 bp, synthetic construct
  misc_feature 1..20: note = CRISPR gRNA sequence
  source 1..20: mol_type = other DNA
tgaacgaataaggctggcag

SEQ ID NO: 20608 - DNA, 20 bp, synthetic construct
  misc_feature 1..20: note = CRISPR gRNA sequence
  source 1..20: mol_type = other DNA
gattccctcctgatgctcgc

SEQ ID NO: 20609 - DNA, 20 bp, synthetic construct
  misc_feature 1..20: note = CRISPR gRNA sequence
  source 1..20: mol_type = other DNA
tctgaggcatgttctctgcc

SEQ ID NO: 20610 - DNA, 20 bp, synthetic construct
  misc_feature 1..20: note = CRISPR gRNA sequence
  source 1..20: mol_type = other DNA
attgagctgacgggggcccc

SEQ ID NO: 20611 - DNA, 20 bp, synthetic construct
  misc_feature 1..20: note = CRISPR gRNA sequence
  source 1..20: mol_type = other DNA
taaaactggctggggcagag

SEQ ID NO: 20612 - DNA, 20 bp, synthetic construct
  misc_feature 1..20: note = CRISPR gRNA sequence
  source 1..20: mol_type = other DNA
gcagaggtgagtgacactga

SEQ ID NO: 20613 - DNA, 20 bp, synthetic construct
  misc_feature 1..20: note = CRISPR gRNA sequence
  source 1..20: mol_type = other DNA
tccaagccccctaacatact

SEQ ID NO: 20614 - DNA, 20 bp, synthetic construct
  misc_feature 1..20: note = CRISPR gRNA sequence
  source 1..20: mol_type = other DNA
gcaggcagtggcaggcaggg

SEQ ID NO: 20615 - DNA, 20 bp, synthetic construct
  misc_feature 1..20: note = CRISPR gRNA sequence
  source 1..20: mol_type = other DNA
gaagtgggctgtgttagaga

SEQ ID NO: 20616 - DNA, 20 bp, synthetic construct
  misc_feature 1..20: note = CRISPR gRNA sequence
  source 1..20: mol_type = other DNA
ggtgcttggaggggccttcc

SEQ ID NO: 20617 - DNA, 20 bp, synthetic construct
  misc_feature 1..20: note = CRISPR gRNA sequence
  source 1..20: mol_type = other DNA
tcctgggatggggagggccc

SEQ ID NO: 20618 - DNA, 20 bp, synthetic construct
  misc_feature 1..20: note = CRISPR gRNA sequence
  source 1..20: mol_type = other DNA
ggggagggccctggagtggc

SEQ ID NO: 20619 - DNA, 20 bp, synthetic construct
  misc_feature 1..20: note = CRISPR gRNA sequence
  source 1..20: mol_type = other DNA
ctccacacggagagctgggg

SEQ ID NO: 20620 - DNA, 20 bp, synthetic construct
  misc_feature 1..20: note = CRISPR gRNA sequence
  source 1..20: mol_type = other DNA
atccccatcagacttgggcc

SEQ ID NO: 20621 - DNA, 20 bp, synthetic construct
  misc_feature 1..20: note = CRISPR gRNA sequence
  source 1..20: mol_type = other DNA
gtgatcagctgccccaggga

SEQ ID NO: 20622 - DNA, 20 bp, synthetic construct
  misc_feature 1..20: note = CRISPR gRNA sequence
  source 1..20: mol_type = other DNA
atacggccttaacttcaagg

SEQ ID NO: 20623 - DNA, 20 bp, synthetic construct
  misc_feature 1..20: note = CRISPR gRNA sequence
  source 1..20: mol_type = other DNA
caaggctgggtagtggtctt

SEQ ID NO: 20624 - DNA, 20 bp, synthetic construct
  misc_feature 1..20: note = CRISPR gRNA sequence
  source 1..20: mol_type = other DNA
cagtgtagcagcagaagagg

SEQ ID NO: 20625 - DNA, 20 bp, synthetic construct
  misc_feature 1..20: note = CRISPR gRNA sequence
  source 1..20: mol_type = other DNA
gtcacaaatggggacacaac

SEQ ID NO: 20626 - DNA, 20 bp, synthetic construct
  misc_feature 1..20: note = CRISPR gRNA sequence
  source 1..20: mol_type = other DNA
tgatctcacatctatgaaat

SEQ ID NO: 20627 - DNA, 20 bp, synthetic construct
  misc_feature 1..20: note = CRISPR gRNA sequence
  source 1..20: mol_type = other DNA
ggtggtggttcctacattgc

SEQ ID NO: 20628 - DNA, 20 bp, synthetic construct
  misc_feature 1..20: note = CRISPR gRNA sequence
  source 1..20: mol_type = other DNA
caggagtatgccagaaatca

SEQ ID NO: 20629 - DNA, 20 bp, synthetic construct
  misc_feature 1..20: note = CRISPR gRNA sequence
  source 1..20: mol_type = other DNA
agtatgccagaaatcagtga

SEQ ID NO: 20630 - DNA, 20 bp, synthetic construct
  misc_feature 1..20: note = CRISPR gRNA sequence
  source 1..20: mol_type = other DNA
cactgcatggccttaaaaga

SEQ ID NO: 20631 - DNA, 20 bp, synthetic construct
  misc_feature 1..20: note = CRISPR gRNA sequence
  source 1..20: mol_type = other DNA
aggatgctgaagtacacgag

SEQ ID NO: 20632 - DNA, 20 bp, synthetic construct
  misc_feature 1..20: note = CRISPR gRNA sequence
  source 1..20: mol_type = other DNA
tgaaatgtaccaaaaatata

SEQ ID NO: 20633 - DNA, 20 bp, synthetic construct
  misc_feature 1..20: note = CRISPR gRNA sequence
  source 1..20: mol_type = other DNA
atgtaccaaaaatataatga

SEQ ID NO: 20634 - DNA, 20 bp, synthetic construct
  misc_feature 1..20: note = CRISPR gRNA sequence
  source 1..20: mol_type = other DNA
aaaatataatgaatgggtgt

SEQ ID NO: 20635 - DNA, 20 bp, synthetic construct
  misc_feature 1..20: note = CRISPR gRNA sequence
  source 1..20: mol_type = other DNA
tataatgaatgggtgtgtgg

SEQ ID NO: 20636 - DNA, 20 bp, synthetic construct
  misc_feature 1..20: note = CRISPR gRNA sequence
  source 1..20: mol_type = other DNA
atgggtgtgtggatggatag

SEQ ID NO: 20637 - DNA, 20 bp, synthetic construct
  misc_feature 1..20: note = CRISPR gRNA sequence
  source 1..20: mol_type = other DNA
atggatagagggatggacag

SEQ ID NO: 20638 - DNA, 20 bp, synthetic construct
  misc_feature 1..20: note = CRISPR gRNA sequence
  source 1..20: mol_type = other DNA
atgaatagagatgtgataag

SEQ ID NO: 20639 - DNA, 20 bp, synthetic construct
  misc_feature 1..20: note = CRISPR gRNA sequence
  source 1..20: mol_type = other DNA
ataaaacccaacattaattg

SEQ ID NO: 20640 - DNA, 20 bp, synthetic construct
  misc_feature 1..20: note = CRISPR gRNA sequence
  source 1..20: mol_type = other DNA
tagaatcaaaatggtacatg

SEQ ID NO: 20641 - DNA, 20 bp, synthetic construct
  misc_feature 1..20: note = CRISPR gRNA sequence
  source 1..20: mol_type = other DNA
atttttttttttttttgaaa

SEQ ID NO: 20642 - DNA, 20 bp, synthetic construct
  misc_feature 1..20: note = CRISPR gRNA sequence
  source 1..20: mol_type = other DNA
tctagctctgttgcccaggc

SEQ ID NO: 20643 - DNA, 20 bp, synthetic construct
  misc_feature 1..20: note = CRISPR gRNA sequence
  source 1..20: mol_type = other DNA
accctagcctccctggtagc

SEQ ID NO: 20644 - DNA, 20 bp, synthetic construct
  misc_feature 1..20: note = CRISPR gRNA sequence
  source 1..20: mol_type = other DNA
ttttgtatttttagtagaga

SEQ ID NO: 20645 - DNA, 20 bp, synthetic construct
  misc_feature 1..20: note = CRISPR gRNA sequence
  source 1..20: mol_type = other DNA
gccttggcctcccaaagtgc

SEQ ID NO: 20646 - DNA, 20 bp, synthetic construct
  misc_feature 1..20: note = CRISPR gRNA sequence
  source 1..20: mol_type = other DNA
ggaacgtgacctcccagaca

SEQ ID NO: 20647 - DNA, 20 bp, synthetic construct
  misc_feature 1..20: note = CRISPR gRNA sequence
  source 1..20: mol_type = other DNA
taaatgaagaaagcaaaatg

SEQ ID NO: 20648 - DNA, 20 bp, synthetic construct
  misc_feature 1..20: note = CRISPR gRNA sequence
  source 1..20: mol_type = other DNA
aaactgagggactacagaac

SEQ ID NO: 20649 - DNA, 20 bp, synthetic construct
  misc_feature 1..20: note = CRISPR gRNA sequence
  source 1..20: mol_type = other DNA
ggagggagatttttttttca

SEQ ID NO: 20650 - DNA, 20 bp, synthetic construct
  misc_feature 1..20: note = CRISPR gRNA sequence
  source 1..20: mol_type = other DNA
ttggttgttgttgtttgaga

SEQ ID NO: 20651 - DNA, 20 bp, synthetic construct
  misc_feature 1..20: note = CRISPR gRNA sequence
  source 1..20: mol_type = other DNA
tcttactctgccacccaggc

SEQ ID NO: 20652 - DNA, 20 bp, synthetic construct
  misc_feature 1..20: note = CRISPR gRNA sequence
  source 1..20: mol_type = other DNA
ctcactgcaacctccacctc

SEQ ID NO: 20653 - DNA, 20 bp, synthetic construct
  misc_feature 1..20: note = CRISPR gRNA sequence
  source 1..20: mol_type = other DNA
gattctcctgcctcagcctc

SEQ ID NO: 20654 - DNA, 20 bp, synthetic construct
  misc_feature 1..20: note = CRISPR gRNA sequence
  source 1..20: mol_type = other DNA
gcctcagcctcccgagtagc

SEQ ID NO: 20655 - DNA, 20 bp, synthetic construct
  misc_feature 1..20: note = CRISPR gRNA sequence
  source 1..20: mol_type = other DNA
cccttggcctcccaaactgc

SEQ ID NO: 20656 - DNA, 20 bp, synthetic construct
  misc_feature 1..20: note = CRISPR gRNA sequence
  source 1..20: mol_type = other DNA
gccgctgcgcccagccttca

SEQ ID NO: 20657 - DNA, 20 bp, synthetic construct
  misc_feature 1..20: note = CRISPR gRNA sequence
  source 1..20: mol_type = other DNA
gcgattcacctgtttaagaa

SEQ ID NO: 20658 - DNA, 20 bp, synthetic construct
  misc_feature 1..20: note = CRISPR gRNA sequence
  source 1..20: mol_type = other DNA
taaaatatgtccagatggta

SEQ ID NO: 20659 - DNA, 20 bp, synthetic construct
  misc_feature 1..20: note = CRISPR gRNA sequence
  source 1..20: mol_type = other DNA
aggaaaaagacacacaaggt

SEQ ID NO: 20660 - DNA, 20 bp, synthetic construct
  misc_feature 1..20: note = CRISPR gRNA sequence
  source 1..20: mol_type = other DNA
aactgagctaatctacatgg

SEQ ID NO: 20661 - DNA, 20 bp, synthetic construct
  misc_feature 1..20: note = CRISPR gRNA sequence
  source 1..20: mol_type = other DNA
acatggaaggatggtcagag

SEQ ID NO: 20662 - DNA, 20 bp, synthetic construct
  misc_feature 1..20: note = CRISPR gRNA sequence
  source 1..20: mol_type = other DNA
ccaacaccagaaagattcaa

SEQ ID NO: 20663 - DNA, 20 bp, synthetic construct
  misc_feature 1..20: note = CRISPR gRNA sequence
  source 1..20: mol_type = other DNA
cccgaggcttgaaagggcac

SEQ ID NO: 20664 - DNA, 20 bp, synthetic construct
  misc_feature 1..20: note = CRISPR gRNA sequence
  source 1..20: mol_type = other DNA
tgaaagggcacatgggttat

SEQ ID NO: 20665 - DNA, 20 bp, synthetic construct
  misc_feature 1..20: note = CRISPR gRNA sequence
  source 1..20: mol_type = other DNA
ctgaagtgtggtgtctcata

SEQ ID NO: 20666 - DNA, 20 bp, synthetic construct
  misc_feature 1..20: note = CRISPR gRNA sequence
  source 1..20: mol_type = other DNA
catgtattttgtagccattg

SEQ ID NO: 20667 - DNA, 20 bp, synthetic construct
  misc_feature 1..20: note = CRISPR gRNA sequence
  source 1..20: mol_type = other DNA
gttggacccacagcaggctt

SEQ ID NO: 20668 - DNA, 20 bp, synthetic construct
  misc_feature 1..20: note = CRISPR gRNA sequence
  source 1..20: mol_type = other DNA
aggtctcaagcaaggctagg

SEQ ID NO: 20669 - DNA, 20 bp, synthetic construct
  misc_feature 1..20: note = CRISPR gRNA sequence
  source 1..20: mol_type = other DNA
acaatcaatgaaagcccaag

SEQ ID NO: 20670 - DNA, 20 bp, synthetic construct
  misc_feature 1..20: note = CRISPR gRNA sequence
  source 1..20: mol_type = other DNA
attgtacccaccttggggag

SEQ ID NO: 20671 - DNA, 20 bp, synthetic construct
  misc_feature 1..20: note = CRISPR gRNA sequence
  source 1..20: mol_type = other DNA
aggggtctgactgcccatca

SEQ ID NO: 20672 - DNA, 20 bp, synthetic construct
  misc_feature 1..20: note = CRISPR gRNA sequence
  source 1..20: mol_type = other DNA
cttgctcaggccctccagct

SEQ ID NO: 20673 - DNA, 20 bp, synthetic construct
  misc_feature 1..20: note = CRISPR gRNA sequence
  source 1..20: mol_type = other DNA
ggggactcaagaaatgtttg

SEQ ID NO: 20674 - DNA, 20 bp, synthetic construct
  misc_feature 1..20: note = CRISPR gRNA sequence
  source 1..20: mol_type = other DNA
actcaagaaatgtttgttga

SEQ ID NO: 20675 - DNA, 20 bp, synthetic construct
  misc_feature 1..20: note = CRISPR gRNA sequence
  source 1..20: mol_type = other DNA
aagaaatgtttgttgaatga

SEQ ID NO: 20676 - DNA, 20 bp, synthetic construct
  misc_feature 1..20: note = CRISPR gRNA sequence
  source 1..20: mol_type = other DNA
atgaatgaatgatcaaacaa

SEQ ID NO: 20677 - DNA, 20 bp, synthetic construct
  misc_feature 1..20: note = CRISPR gRNA sequence
  source 1..20: mol_type = other DNA
ggggcccttaatctaatcaa

SEQ ID NO: 20678 - DNA, 20 bp, synthetic construct
  misc_feature 1..20: note = CRISPR gRNA sequence
  source 1..20: mol_type = other DNA
tgctacaaagaagagcaagg

SEQ ID NO: 20679 - DNA, 20 bp, synthetic construct
  misc_feature 1..20: note = CRISPR gRNA sequence
  source 1..20: mol_type = other DNA
agaagagcaaggcagaatgg

SEQ ID NO: 20680 - DNA, 20 bp, synthetic construct
  misc_feature 1..20: note = CRISPR gRNA sequence
  source 1..20: mol_type = other DNA
gcagaatggtagagttactg

SEQ ID NO: 20681 - DNA, 20 bp, synthetic construct
  misc_feature 1..20: note = CRISPR gRNA sequence
  source 1..20: mol_type = other DNA
tggtagagttactgcaggat

SEQ ID NO: 20682 - DNA, 20 bp, synthetic construct
  misc_feature 1..20: note = CRISPR gRNA sequence
  source 1..20: mol_type = other DNA
cattttctcatctgtgtaag

SEQ ID NO: 20683 - DNA, 20 bp, synthetic construct
  misc_feature 1..20: note = CRISPR gRNA sequence
  source 1..20: mol_type = other DNA
ataaataatgcctactaccc

SEQ ID NO: 20684 - DNA, 20 bp, synthetic construct
  misc_feature 1..20: note = CRISPR gRNA sequence
  source 1..20: mol_type = other DNA
aaatagtggtaactatataa

SEQ ID NO: 20685 - DNA, 20 bp, synthetic construct
  misc_feature 1..20: note = CRISPR gRNA sequence
  source 1..20: mol_type = other DNA
ggtacatggctcagagccct

SEQ ID NO: 20686 - DNA, 20 bp, synthetic construct
  misc_feature 1..20: note = CRISPR gRNA sequence
  source 1..20: mol_type = other DNA
ccgagaaaaaaggtgtatgg

SEQ ID NO: 20687 - DNA, 20 bp, synthetic construct
  misc_feature 1..20: note = CRISPR gRNA sequence
  source 1..20: mol_type = other DNA
agggaaggcttcctggagga

SEQ ID NO: 20688 - DNA, 20 bp, synthetic construct
  misc_feature 1..20: note = CRISPR gRNA sequence
  source 1..20: mol_type = other DNA
ccaggccttgaaagatgagg

SEQ ID NO: 20689 - DNA, 20 bp, synthetic construct
  misc_feature 1..20: note = CRISPR gRNA sequence
  source 1..20: mol_type = other DNA
gaaggagaacagatagcttt

SEQ ID NO: 20690 - DNA, 20 bp, synthetic construct
  misc_feature 1..20: note = CRISPR gRNA sequence
  source 1..20: mol_type = other DNA
agctttctgggtcacagtgg

SEQ ID NO: 20691 - DNA, 20 bp, synthetic construct
  misc_feature 1..20: note = CRISPR gRNA sequence
  source 1..20: mol_type = other DNA
gcagagtgaggaaacttgtt

SEQ ID NO: 20692 - DNA, 20 bp, synthetic construct
  misc_feature 1..20: note = CRISPR gRNA sequence
  source 1..20: mol_type = other DNA
catagaaggcttctgagctg

SEQ ID NO: 20693 - DNA, 20 bp, synthetic construct
  misc_feature 1..20: note = CRISPR gRNA sequence
  source 1..20: mol_type = other DNA
aaggcttctgagctgaggaa

SEQ ID NO: 20694 - DNA, 20 bp, synthetic construct
  misc_feature 1..20: note = CRISPR gRNA sequence
  source 1..20: mol_type = other DNA
aataatgataacggtggttg

SEQ ID NO: 20695 - DNA, 20 bp, synthetic construct
  misc_feature 1..20: note = CRISPR gRNA sequence
  source 1..20: mol_type = other DNA
ggggtagtacctaacatcta

SEQ ID NO: 20696 - DNA, 20 bp, synthetic construct
  misc_feature 1..20: note = CRISPR gRNA sequence
  source 1..20: mol_type = other DNA
cttacaaccatcccgtgatg

SEQ ID NO: 20697 - DNA, 20 bp, synthetic construct
  misc_feature 1..20: note = CRISPR gRNA sequence
  source 1..20: mol_type = other DNA
tagaagctaaggtcatattt

SEQ ID NO: 20698 - DNA, 20 bp, synthetic construct
  misc_feature 1..20: note = CRISPR gRNA sequence
  source 1..20: mol_type = other DNA
catatttcaggatgctgcaa

SEQ ID NO: 20699 - DNA, 20 bp, synthetic construct
  misc_feature 1..20: note = CRISPR gRNA sequence
  source 1..20: mol_type = other DNA
cacagacttgaggagcagac

SEQ ID NO: 20700 - DNA, 20 bp, synthetic construct
  misc_feature 1..20: note = CRISPR gRNA sequence
  source 1..20: mol_type = other DNA
gtgaagctgcctgttatgac

SEQ ID NO: 20701 - DNA, 20 bp, synthetic construct
  misc_feature 1..20: note = CRISPR gRNA sequence
  source 1..20: mol_type = other DNA
gtgactggggcttttccttg

SEQ ID NO: 20702 - DNA, 20 bp, synthetic construct
  misc_feature 1..20: note = CRISPR gRNA sequence
  source 1..20: mol_type = other DNA
ctggggcttttccttgatga

SEQ ID NO: 20703 - DNA, 20 bp, synthetic construct
  misc_feature 1..20: note = CRISPR gRNA sequence
  source 1..20: mol_type = other DNA
atgaatgggttaatccgttc

SEQ ID NO: 20704 - DNA, 20 bp, synthetic construct
  misc_feature 1..20: note = CRISPR gRNA sequence
  source 1..20: mol_type = other DNA
gttaatccgttcatggatta

SEQ ID NO: 20705 - DNA, 20 bp, synthetic construct
  misc_feature 1..20: note = CRISPR gRNA sequence
  source 1..20: mol_type = other DNA
ataaacaggttaataagtta

SEQ ID NO: 20706 - DNA, 20 bp, synthetic construct
  misc_feature 1..20: note = CRISPR gRNA sequence
  source 1..20: mol_type = other DNA
ataagttaatgggttgtcgt

SEQ ID NO: 20707 - DNA, 20 bp, synthetic construct
  misc_feature 1..20: note = CRISPR gRNA sequence
  source 1..20: mol_type = other DNA
cactgccttgggactctgca

SEQ ID NO: 20708 - DNA, 20 bp, synthetic construct
  misc_feature 1..20: note = CRISPR gRNA sequence
  source 1..20: mol_type = other DNA
gcctccagttgtgaggaaat

SEQ ID NO: 20709 - DNA, 20 bp, synthetic construct
  misc_feature 1..20: note = CRISPR gRNA sequence
  source 1..20: mol_type = other DNA
tggggaaaaattggccacat

SEQ ID NO: 20710 - DNA, 20 bp, synthetic construct
  misc_feature 1..20: note = CRISPR gRNA sequence
  source 1..20: mol_type = other DNA
ttggatcaagcacagaactg

SEQ ID NO: 20711 - DNA, 20 bp, synthetic construct
  misc_feature 1..20: note = CRISPR gRNA sequence
  source 1..20: mol_type = other DNA
actgctgaatgctgctgttc

SEQ ID NO: 20712 - DNA, 20 bp, synthetic construct
  misc_feature 1..20: note = CRISPR gRNA sequence
  source 1..20: mol_type = other DNA
gcaggaagaagaccactaag

SEQ ID NO: 20713 - DNA, 20 bp, synthetic construct
  misc_feature 1..20: note = CRISPR gRNA sequence
  source 1..20: mol_type = other DNA
caccaccaccacctctcccc

SEQ ID NO: 20714 - DNA, 20 bp, synthetic construct
  misc_feature 1..20: note = CRISPR gRNA sequence
  source 1..20: mol_type = other DNA
gaaacgagaaagacctaggt

SEQ ID NO: 20715 - DNA, 20 bp, synthetic construct
  misc_feature 1..20: note = CRISPR gRNA sequence
  source 1..20: mol_type = other DNA
ttactatctctaatgcaaac

SEQ ID NO: 20716 - DNA, 20 bp, synthetic construct
  misc_feature 1..20: note = CRISPR gRNA sequence
  source 1..20: mol_type = other DNA
tgtatttcctttgttgttgt

SEQ ID NO: 20717 - DNA, 20 bp, synthetic construct
  misc_feature 1..20: note = CRISPR gRNA sequence
  source 1..20: mol_type = other DNA
tggacagcaatgagcatact

SEQ ID NO: 20718 - DNA, 20 bp, synthetic construct
  misc_feature 1..20: note = CRISPR gRNA sequence
  source 1..20: mol_type = other DNA
atgctagttattacaaatac

SEQ ID NO: 20719 - DNA, 20 bp, synthetic construct
  misc_feature 1..20: note = CRISPR gRNA sequence
  source 1..20: mol_type = other DNA
gagctgggaggaaaagggaa

SEQ ID NO: 20720 - DNA, 20 bp, synthetic construct
  misc_feature 1..20: note = CRISPR gRNA sequence
  source 1..20: mol_type = other DNA
tatggtatgggctttgtaga

SEQ ID NO: 20721 - DNA, 20 bp, synthetic construct
  misc_feature 1..20: note = CRISPR gRNA sequence
  source 1..20: mol_type = other DNA
tgcgtatagaaatggaggtg

SEQ ID NO: 20722 - DNA, 20 bp, synthetic construct
  misc_feature 1..20: note = CRISPR gRNA sequence
  source 1..20: mol_type = other DNA
tccatctcccctctcttccc

SEQ ID NO: 20723 - DNA, 20 bp, synthetic construct
  misc_feature 1..20: note = CRISPR gRNA sequence
  source 1..20: mol_type = other DNA
ggggactgacgtggctcatg

SEQ ID NO: 20724 - DNA, 20 bp, synthetic construct
  misc_feature 1..20: note = CRISPR gRNA sequence
  source 1..20: mol_type = other DNA
actgacgtggctcatgatga

SEQ ID NO: 20725 - DNA, 20 bp, synthetic construct
  misc_feature 1..20: note = CRISPR gRNA sequence
  source 1..20: mol_type = other DNA
cgcagttgatggtgtctgtg

SEQ ID NO: 20726 - DNA, 20 bp, synthetic construct
  misc_feature 1..20: note = CRISPR gRNA sequence
  source 1..20: mol_type = other DNA
gttctgggaggaaaagtccc

SEQ ID NO: 20727 - DNA, 20 bp, synthetic construct
  misc_feature 1..20: note = CRISPR gRNA sequence
  source 1..20: mol_type = other DNA
gctgacgggagggcagggac

SEQ ID NO: 20728 - DNA, 20 bp, synthetic construct
  misc_feature 1..20: note = CRISPR gRNA sequence
  source 1..20: mol_type = other DNA
gccgtctctacagcaagctg

SEQ ID NO: 20729 - DNA, 20 bp, synthetic construct
  misc_feature 1..20: note = CRISPR gRNA sequence
  source 1..20: mol_type = other DNA
ctacagcaagctgaggggtg

SEQ ID NO: 20730 - DNA, 20 bp, synthetic construct
  misc_feature 1..20: note = CRISPR gRNA sequence
  source 1..20: mol_type = other DNA
ccagagggaggagggcccac

SEQ ID NO: 20731 - DNA, 20 bp, synthetic construct
  misc_feature 1..20: note = CRISPR gRNA sequence
  source 1..20: mol_type = other DNA
atagaagtggtagaggcaca

SEQ ID NO: 20732 - DNA, 20 bp, synthetic construct
  misc_feature 1..20: note = CRISPR gRNA sequence
  source 1..20: mol_type = other DNA
gacaatgctcagtcacctca

SEQ ID NO: 20733 - DNA, 20 bp, synthetic construct
  misc_feature 1..20: note = CRISPR gRNA sequence
  source 1..20: mol_type = other DNA
actcccagctggtgagggct

SEQ ID NO: 20734 - DNA, 20 bp, synthetic construct
  misc_feature 1..20: note = CRISPR gRNA sequence
  source 1..20: mol_type = other DNA
tggtgagggctggggatgag

SEQ ID NO: 20735 - DNA, 20 bp, synthetic construct
  misc_feature 1..20: note = CRISPR gRNA sequence
  source 1..20: mol_type = other DNA
gagggctggggatgagagga

SEQ ID NO: 20736 - DNA, 20 bp, synthetic construct
  misc_feature 1..20: note = CRISPR gRNA sequence
  source 1..20: mol_type = other DNA
agaaaagggaactggaaagt

SEQ ID NO: 20737 - DNA, 20 bp, synthetic construct
  misc_feature 1..20: note = CRISPR gRNA sequence
  source 1..20: mol_type = other DNA
attccatcaatctcacacca

SEQ ID NO: 20738 - DNA, 20 bp, synthetic construct
  misc_feature 1..20: note = CRISPR gRNA sequence
  source 1..20: mol_type = other DNA
gtcccacatttggcaatgcc

SEQ ID NO: 20739 - DNA, 20 bp, synthetic construct
  misc_feature 1..20: note = CRISPR gRNA sequence
  source 1..20: mol_type = other DNA
aacccatgtccaagtggaac

SEQ ID NO: 20740 - DNA, 20 bp, synthetic construct
  misc_feature 1..20: note = CRISPR gRNA sequence
  source 1..20: mol_type = other DNA
aaccacaatgctctactgct

SEQ ID NO: 20741 - DNA, 20 bp, synthetic construct
  misc_feature 1..20: note = CRISPR gRNA sequence
  source 1..20: mol_type = other DNA
tttcctaatatgtaaactga

SEQ ID NO: 20742 - DNA, 20 bp, synthetic construct
  misc_feature 1..20: note = CRISPR gRNA sequence
  source 1..20: mol_type = other DNA
atctttaaacaatcccaaat

SEQ ID NO: 20743 - DNA, 20 bp, synthetic construct
  misc_feature 1..20: note = CRISPR gRNA sequence
  source 1..20: mol_type = other DNA
atccacacaaaaacctatac

SEQ ID NO: 20744 - DNA, 20 bp, synthetic construct
  misc_feature 1..20: note = CRISPR gRNA sequence
  source 1..20: mol_type = other DNA
ctatacacgaatgttcacag

SEQ ID NO: 20745 - DNA, 20 bp, synthetic construct
  misc_feature 1..20: note = CRISPR gRNA sequence
  source 1..20: mol_type = other DNA
aaatatccaccaaaaaataa

SEQ ID NO: 20746 - DNA, 20 bp, synthetic construct
  misc_feature 1..20: note = CRISPR gRNA sequence
  source 1..20: mol_type = other DNA
gcactgatacatgctggaac

SEQ ID NO: 20747 - DNA, 20 bp, synthetic construct
  misc_feature 1..20: note = CRISPR gRNA sequence
  source 1..20: mol_type = other DNA
aagtgaagaagccggacaca

SEQ ID NO: 20748 - DNA, 20 bp, synthetic construct
  misc_feature 1..20: note = CRISPR gRNA sequence
  source 1..20: mol_type = other DNA
ccatggagacataaagtagg

SEQ ID NO: 20749 - DNA, 20 bp, synthetic construct
  misc_feature 1..20: note = CRISPR gRNA sequence
  source 1..20: mol_type = other DNA
actttgggaggctgagacag

SEQ ID NO: 20750 - DNA, 20 bp, synthetic construct
  misc_feature 1..20: note = CRISPR gRNA sequence
  source 1..20: mol_type = other DNA
ttgcctagggcttggcagag

SEQ ID NO: 20751 - DNA, 20 bp, synthetic construct
  misc_feature 1..20: note = CRISPR gRNA sequence
  source 1..20: mol_type = other DNA
gaaatggggaacaactgctg

SEQ ID NO: 20752 - DNA, 20 bp, synthetic construct
  misc_feature 1..20: note = CRISPR gRNA sequence
  source 1..20: mol_type = other DNA
ggaacaactgctgatgggtc

SEQ ID NO: 20753 - DNA, 20 bp, synthetic construct
  misc_feature 1..20: note = CRISPR gRNA sequence
  source 1..20: mol_type = other DNA
atgggtctggagtttcttta

SEQ ID NO: 20754 - DNA, 20 bp, synthetic construct
  misc_feature 1..20: note = CRISPR gRNA sequence
  source 1..20: mol_type = other DNA
aatgtgctaaaattgactgt

SEQ ID NO: 20755 - DNA, 20 bp, synthetic construct
  misc_feature 1..20: note = CRISPR gRNA sequence
  source 1..20: mol_type = other DNA
ggagatggtcacacaactct

SEQ ID NO: 20756 - DNA, 20 bp, synthetic construct
  misc_feature 1..20: note = CRISPR gRNA sequence
  source 1..20: mol_type = other DNA
ttttttttttttttttaaga

SEQ ID NO: 20757 - DNA, 20 bp, synthetic construct
  misc_feature 1..20: note = CRISPR gRNA sequence
  source 1..20: mol_type = other DNA
ggagtctctgtcacccaggc

SEQ ID NO: 20758 - DNA, 20 bp, synthetic construct
  misc_feature 1..20: note = CRISPR gRNA sequence
  source 1..20: mol_type = other DNA
tgtcacccaggctggagtgc

SEQ ID NO: 20759 - DNA, 20 bp, synthetic construct
  misc_feature 1..20: note = CRISPR gRNA sequence
  source 1..20: mol_type = other DNA
gcctcagcctcctgagcagc

SEQ ID NO: 20760 - DNA, 20 bp, synthetic construct
  misc_feature 1..20: note = CRISPR gRNA sequence
  source 1..20: mol_type = other DNA
tcctcggcctcccaaagtgt

SEQ ID NO: 20761 - DNA, 20 bp, synthetic construct
  misc_feature 1..20: note = CRISPR gRNA sequence
  source 1..20: mol_type = other DNA
taagtgggcaaattgtatat

SEQ ID NO: 20762 - DNA, 20 bp, synthetic construct
  misc_feature 1..20: note = CRISPR gRNA sequence
  source 1..20: mol_type = other DNA
tgtggctctaaggctcctgc

SEQ ID NO: 20763 - DNA, 20 bp, synthetic construct
  misc_feature 1..20: note = CRISPR gRNA sequence
  source 1..20: mol_type = other DNA
tgcctctggaggctcgaggg

SEQ ID NO: 20764 - DNA, 20 bp, synthetic construct
  misc_feature 1..20: note = CRISPR gRNA sequence
  source 1..20: mol_type = other DNA
tcttataaagacacttgtca

SEQ ID NO: 20765 - DNA, 20 bp, synthetic construct
  misc_feature 1..20: note = CRISPR gRNA sequence
  source 1..20: mol_type = other DNA
taggacccacctagataatc

SEQ ID NO: 20766 - DNA, 20 bp, synthetic construct
  misc_feature 1..20: note = CRISPR gRNA sequence
  source 1..20: mol_type = other DNA
gcttgctctgttgcccaggc

SEQ ID NO: 20767 - DNA, 20 bp, synthetic construct
  misc_feature 1..20: note = CRISPR gRNA sequence
  source 1..20: mol_type = other DNA
gattctcctgccccagtctc

SEQ ID NO: 20768 - DNA, 20 bp, synthetic construct
  misc_feature 1..20: note = CRISPR gRNA sequence
  source 1..20: mol_type = other DNA
gccccagtctcctgagtagc

SEQ ID NO: 20769 - DNA, 20 bp, synthetic construct
  misc_feature 1..20: note = CRISPR gRNA sequence
  source 1..20: mol_type = other DNA
ttttgtatttttagtagaaa

SEQ ID NO: 20770 - DNA, 20 bp, synthetic construct
  misc_feature 1..20: note = CRISPR gRNA sequence
  source 1..20: mol_type = other DNA
atctcagcttcccaaagtgc

SEQ ID NO: 20771 - DNA, 20 bp, synthetic construct
  misc_feature 1..20: note = CRISPR gRNA sequence
  source 1..20: mol_type = other DNA
aagtcacactgacaggttcc

SEQ ID NO: 20772 - DNA, 20 bp, synthetic construct
  misc_feature 1..20: note = CRISPR gRNA sequence
  source 1..20: mol_type = other DNA
gccctgttctgggcccagaa

SEQ ID NO: 20773 - DNA, 20 bp, synthetic construct
  misc_feature 1..20: note = CRISPR gRNA sequence
  source 1..20: mol_type = other DNA
gcccagaagagaatacattg

SEQ ID NO: 20774 - DNA, 20 bp, synthetic construct
  misc_feature 1..20: note = CRISPR gRNA sequence
  source 1..20: mol_type = other DNA
ttttctttttttttttgaga

SEQ ID NO: 20775 - DNA, 20 bp, synthetic construct
  misc_feature 1..20: note = CRISPR gRNA sequence
  source 1..20: mol_type = other DNA
tctcactctgtcgcccaggc

SEQ ID NO: 20776 - DNA, 20 bp, synthetic construct
  misc_feature 1..20: note = CRISPR gRNA sequence
  source 1..20: mol_type = other DNA
ctcactgcaacctctgcctc

SEQ ID NO: 20777 - DNA, 20 bp, synthetic construct
  misc_feature 1..20: note = CRISPR gRNA sequence
  source 1..20: mol_type = other DNA
ttttttatttttagtaaaga

SEQ ID NO: 20778 - DNA, 20 bp, synthetic construct
  misc_feature 1..20: note = CRISPR gRNA sequence
  source 1..20: mol_type = other DNA
gccttggcctcccaaagtgc

SEQ ID NO: 20779 - DNA, 20 bp, synthetic construct
  misc_feature 1..20: note = CRISPR gRNA sequence
  source 1..20: mol_type = other DNA
gagaggctcagcacagaccc

SEQ ID NO: 20780 - DNA, 20 bp, synthetic construct
  misc_feature 1..20: note = CRISPR gRNA sequence
  source 1..20: mol_type = other DNA
acagacccccggatgtcaca

SEQ ID NO: 20781 - DNA, 20 bp, synthetic construct
  misc_feature 1..20: note = CRISPR gRNA sequence
  source 1..20: mol_type = other DNA
gccaaagctgggagatggtt

SEQ ID NO: 20782 - DNA, 20 bp, synthetic construct
  misc_feature 1..20: note = CRISPR gRNA sequence
  source 1..20: mol_type = other DNA
agactgatcctagcaactcc

SEQ ID NO: 20783 - DNA, 20 bp, synthetic construct
  misc_feature 1..20: note = CRISPR gRNA sequence
  source 1..20: mol_type = other DNA
tgatcctagcaactccgtga

SEQ ID NO: 20784 - DNA, 20 bp, synthetic construct
  misc_feature 1..20: note = CRISPR gRNA sequence
  source 1..20: mol_type = other DNA
ctcagttttctcacagggca

SEQ ID NO: 20785 - DNA, 20 bp, synthetic construct
  misc_feature 1..20: note = CRISPR gRNA sequence
  source 1..20: mol_type = other DNA
cacaggtggtatcacagatg

SEQ ID NO: 20786 - DNA, 20 bp, synthetic construct
  misc_feature 1..20: note = CRISPR gRNA sequence
  source 1..20: mol_type = other DNA
gatgagctctgcttcaaact

SEQ ID NO: 20787 - DNA, 20 bp, synthetic construct
  misc_feature 1..20: note = CRISPR gRNA sequence
  source 1..20: mol_type = other DNA
agtttccatatctataaaat

SEQ ID NO: 20788 - DNA, 20 bp, synthetic construct
  misc_feature 1..20: note = CRISPR gRNA sequence
  source 1..20: mol_type = other DNA
aataataattggcaactcac

SEQ ID NO: 20789 - DNA, 20 bp, synthetic construct
  misc_feature 1..20: note = CRISPR gRNA sequence
  source 1..20: mol_type = other DNA
tggcaactcacaaggattag

SEQ ID NO: 20790 - DNA, 20 bp, synthetic construct
  misc_feature 1..20: note = CRISPR gRNA sequence
  source 1..20: mol_type = other DNA
ggactggcaatcagtaagtg

SEQ ID NO: 20791 - DNA, 20 bp, synthetic construct
  misc_feature 1..20: note = CRISPR gRNA sequence
  source 1..20: mol_type = other DNA
ggcagcacagcttctacatg

SEQ ID NO: 20792 - DNA, 20 bp, synthetic construct
  misc_feature 1..20: note = CRISPR gRNA sequence
  source 1..20: mol_type = other DNA
agtttgcttcttacgtttgt

SEQ ID NO: 20793 - DNA, 20 bp, synthetic construct
  misc_feature 1..20: note = CRISPR gRNA sequence
  source 1..20: mol_type = other DNA
tgtagaaattccagcacttt

SEQ ID NO: 20794 - DNA, 20 bp, synthetic construct
  misc_feature 1..20: note = CRISPR gRNA sequence
  source 1..20: mol_type = other DNA
gcactttgggagtccaaggc

SEQ ID NO: 20795 - DNA, 20 bp, synthetic construct
  misc_feature 1..20: note = CRISPR gRNA sequence
  source 1..20: mol_type = other DNA
caggagtatcacctcagtcc

SEQ ID NO: 20796 - DNA, 20 bp, synthetic construct
  misc_feature 1..20: note = CRISPR gRNA sequence
  source 1..20: mol_type = other DNA
tactcaggaggctgaggtgg

SEQ ID NO: 20797 - DNA, 20 bp, synthetic construct
  misc_feature 1..20: note = CRISPR gRNA sequence
  source 1..20: mol_type = other DNA
ttgcaccactgcactccagc

SEQ ID NO: 20798 - DNA, 20 bp, synthetic construct
  misc_feature 1..20: note = CRISPR gRNA sequence
  source 1..20: mol_type = other DNA
cccacagccagcagggcagc

SEQ ID NO: 20799 - DNA, 20 bp, synthetic construct
  misc_feature 1..20: note = CRISPR gRNA sequence
  source 1..20: mol_type = other DNA
tgcaccttaagcacttcctc

SEQ ID NO: 20800 - DNA, 20 bp, synthetic construct
  misc_feature 1..20: note = CRISPR gRNA sequence
  source 1..20: mol_type = other DNA
gcacttcctcttgggtgatc

SEQ ID NO: 20801 - DNA, 20 bp, synthetic construct
  misc_feature 1..20: note = CRISPR gRNA sequence
  source 1..20: mol_type = other DNA
gcctccatcctccacaccat

SEQ ID NO: 20802 - DNA, 20 bp, synthetic construct
  misc_feature 1..20: note = CRISPR gRNA sequence
  source 1..20: mol_type = other DNA
aaaaagctctggggaaaagg

SEQ ID NO: 20803 - DNA, 20 bp, synthetic construct
  misc_feature 1..20: note = CRISPR gRNA sequence
  source 1..20: mol_type = other DNA
gctctggggaaaaggcaggg

SEQ ID NO: 20804 - DNA, 20 bp, synthetic construct
  misc_feature 1..20: note = CRISPR gRNA sequence
  source 1..20: mol_type = other DNA
tgtggtttaggagcttgcat

SEQ ID NO: 20805 - DNA, 20 bp, synthetic construct
  misc_feature 1..20: note = CRISPR gRNA sequence
  source 1..20: mol_type = other DNA
ttttcccaatattagttctg

SEQ ID NO: 20806 - DNA, 20 bp, synthetic construct
  misc_feature 1..20: note = CRISPR gRNA sequence
  source 1..20: mol_type = other DNA
caggcagatcacttgaggtc

SEQ ID NO: 20807 - DNA, 20 bp, synthetic construct
  misc_feature 1..20: note = CRISPR gRNA sequence
  source 1..20: mol_type = other DNA
tacttgggaggctgaggcag

SEQ ID NO: 20808 - DNA, 20 bp, synthetic construct
  misc_feature 1..20: note = CRISPR gRNA sequence
  source 1..20: mol_type = other DNA
aaacaaaaaagattgtcctg

SEQ ID NO: 20809 - DNA, 20 bp, synthetic construct
  misc_feature 1..20: note = CRISPR gRNA sequence
  source 1..20: mol_type = other DNA
caggatcatcagaaggccaa

SEQ ID NO: 20810 - DNA, 20 bp, synthetic construct
  misc_feature 1..20: note = CRISPR gRNA sequence
  source 1..20: mol_type = other DNA
aaggccaagggagttctgtg

SEQ ID NO: 20811 - DNA, 20 bp, synthetic construct
  misc_feature 1..20: note = CRISPR gRNA sequence
  source 1..20: mol_type = other DNA
aaaggaagcccattacatta

SEQ ID NO: 20812 - DNA, 20 bp, synthetic construct
  misc_feature 1..20: note = CRISPR gRNA sequence
  source 1..20: mol_type = other DNA
ccagtcacaccaagatctac

SEQ ID NO: 20813 - DNA, 20 bp, synthetic construct
  misc_feature 1..20: note = CRISPR gRNA sequence
  source 1..20: mol_type = other DNA
tccaaaccacattgccagag

SEQ ID NO: 20814 - DNA, 20 bp, synthetic construct
  misc_feature 1..20: note = CRISPR gRNA sequence
  source 1..20: mol_type = other DNA
ccgtggcaatgatatagaac

SEQ ID NO: 20815 - DNA, 20 bp, synthetic construct
  misc_feature 1..20: note = CRISPR gRNA sequence
  source 1..20: mol_type = other DNA
agatgaagagacaggctcag

SEQ ID NO: 20816 - DNA, 20 bp, synthetic construct
  misc_feature 1..20: note = CRISPR gRNA sequence
  source 1..20: mol_type = other DNA
cagcccactctatagccttt

SEQ ID NO: 20817 - DNA, 20 bp, synthetic construct
  misc_feature 1..20: note = CRISPR gRNA sequence
  source 1..20: mol_type = other DNA
gcaccccggcgagggaaggc

SEQ ID NO: 20818 - DNA, 20 bp, synthetic construct
  misc_feature 1..20: note = CRISPR gRNA sequence
  source 1..20: mol_type = other DNA
ttgccatcaaaagtcctttt

SEQ ID NO: 20819 - DNA, 20 bp, synthetic construct
  misc_feature 1..20: note = CRISPR gRNA sequence
  source 1..20: mol_type = other DNA
tccccacttcacactgcatg

SEQ ID NO: 20820 - DNA, 20 bp, synthetic construct
  misc_feature 1..20: note = CRISPR gRNA sequence
  source 1..20: mol_type = other DNA
tccatctcagctggtgggag

SEQ ID NO: 20821 - DNA, 20 bp, synthetic construct
  misc_feature 1..20: note = CRISPR gRNA sequence
  source 1..20: mol_type = other DNA
ggagctcagatggtgagctt

SEQ ID NO: 20822 - DNA, 20 bp, synthetic construct
  misc_feature 1..20: note = CRISPR gRNA sequence
  source 1..20: mol_type = other DNA
acctaccaacgcactacaat

SEQ ID NO: 20823 - DNA, 20 bp, synthetic construct
  misc_feature 1..20: note = CRISPR gRNA sequence
  source 1..20: mol_type = other DNA
gtttccttatctgtaaagtg

SEQ ID NO: 20824 - DNA, 20 bp, synthetic construct
  misc_feature 1..20: note = CRISPR gRNA sequence
  source 1..20: mol_type = other DNA
ggataataattggcaactca

SEQ ID NO: 20825 - DNA, 20 bp, synthetic construct
  misc_feature 1..20: note = CRISPR gRNA sequence
  source 1..20: mol_type = other DNA
ttggcaactcataggattag

SEQ ID NO: 20826 - DNA, 20 bp, synthetic construct
  misc_feature 1..20: note = CRISPR gRNA sequence
  source 1..20: mol_type = other DNA
ggcagcacaacttctgcatg

SEQ ID NO: 20827 - DNA, 20 bp, synthetic construct
  misc_feature 1..20: note = CRISPR gRNA sequence
  source 1..20: mol_type = other DNA
aatgtgcttcttacctctgt

SEQ ID NO: 20828 - DNA, 20 bp, synthetic construct
  misc_feature 1..20: note = CRISPR gRNA sequence
  source 1..20: mol_type = other DNA
atgttttcttcccagaggcg

SEQ ID NO: 20829 - DNA, 20 bp, synthetic construct
  misc_feature 1..20: note = CRISPR gRNA sequence
  source 1..20: mol_type = other DNA
gaggcggggagtctatcttt

SEQ ID NO: 20830 - DNA, 20 bp, synthetic construct
  misc_feature 1..20: note = CRISPR gRNA sequence
  source 1..20: mol_type = other DNA
aagagcatgagaaggaggcc

SEQ ID NO: 20831 - DNA, 20 bp, synthetic construct
  misc_feature 1..20: note = CRISPR gRNA sequence
  source 1..20: mol_type = other DNA
actttgagaggccgaggctg

SEQ ID NO: 20832 - DNA, 20 bp, synthetic construct
  misc_feature 1..20: note = CRISPR gRNA sequence
  source 1..20: mol_type = other DNA
ctggcggattacttgaggtc

SEQ ID NO: 20833 - DNA, 20 bp, synthetic construct
  misc_feature 1..20: note = CRISPR gRNA sequence
  source 1..20: mol_type = other DNA
aaaatgagctgggcgtggtg

SEQ ID NO: 20834 - DNA, 20 bp, synthetic construct
  misc_feature 1..20: note = CRISPR gRNA sequence
  source 1..20: mol_type = other DNA
aaaaaaaaaaaagcttgaga

SEQ ID NO: 20835 - DNA, 20 bp, synthetic construct
  misc_feature 1..20: note = CRISPR gRNA sequence
  source 1..20: mol_type = other DNA
accatgaacttctcctcctg

SEQ ID NO: 20836 - DNA, 20 bp, synthetic construct
  misc_feature 1..20: note = CRISPR gRNA sequence
  source 1..20: mol_type = other DNA
tgtgtgcctagagacatggt

SEQ ID NO: 20837 - DNA, 20 bp, synthetic construct
  misc_feature 1..20: note = CRISPR gRNA sequence
  source 1..20: mol_type = other DNA
tttctgctctgcctttgatc

SEQ ID NO: 20838 - DNA, 20 bp, synthetic construct
  misc_feature 1..20: note = CRISPR gRNA sequence
  source 1..20: mol_type = other DNA
ccctctgagcctccgtttca

SEQ ID NO: 20839 - DNA, 20 bp, synthetic construct
  misc_feature 1..20: note = CRISPR gRNA sequence
  source 1..20: mol_type = other DNA
gagtgttggagccccttcaa

SEQ ID NO: 20840 - DNA, 20 bp, synthetic construct
  misc_feature 1..20: note = CRISPR gRNA sequence
  source 1..20: mol_type = other DNA
tgttgggaagccaggggcct

SEQ ID NO: 20841 - DNA, 20 bp, synthetic construct
  misc_feature 1..20: note = CRISPR gRNA sequence
  source 1..20: mol_type = other DNA
accccaaacagcttctttgt

SEQ ID NO: 20842 - DNA, 20 bp, synthetic construct
  misc_feature 1..20: note = CRISPR gRNA sequence
  source 1..20: mol_type = other DNA
ttgtgggggtagtagctcaa

SEQ ID NO: 20843 - DNA, 20 bp, synthetic construct
  misc_feature 1..20: note = CRISPR gRNA sequence
  source 1..20: mol_type = other DNA
ataataatagcatagtggtt

SEQ ID NO: 20844 - DNA, 20 bp, synthetic construct
  misc_feature 1..20: note = CRISPR gRNA sequence
  source 1..20: mol_type = other DNA
agtggttaagggtgcaggct

SEQ ID NO: 20845 - DNA, 20 bp, synthetic construct
  misc_feature 1..20: note = CRISPR gRNA sequence
  source 1..20: mol_type = other DNA
gcaaatgttactcaacctct

SEQ ID NO: 20846 - DNA, 20 bp, synthetic construct
  misc_feature 1..20: note = CRISPR gRNA sequence
  source 1..20: mol_type = other DNA
tactcaacctctctgagtca

SEQ ID NO: 20847 - DNA, 20 bp, synthetic construct
  misc_feature 1..20: note = CRISPR gRNA sequence
  source 1..20: mol_type = other DNA
ttggcacagtgcttatgtca

SEQ ID NO: 20848 - DNA, 20 bp, synthetic construct
  misc_feature 1..20: note = CRISPR gRNA sequence
  source 1..20: mol_type = other DNA
gacttacctaaagtgactta

SEQ ID NO: 20849 - DNA, 20 bp, synthetic construct
  misc_feature 1..20: note = CRISPR gRNA sequence
  source 1..20: mol_type = other DNA
aaatgccaagtgttggttac

SEQ ID NO: 20850 - DNA, 20 bp, synthetic construct
  misc_feature 1..20: note = CRISPR gRNA sequence
  source 1..20: mol_type = other DNA
tgttggttacacgggtttgt

SEQ ID NO: 20851 - DNA, 20 bp, synthetic construct
  misc_feature 1..20: note = CRISPR gRNA sequence
  source 1..20: mol_type = other DNA
acgggtttgtgggaatgtag

SEQ ID NO: 20852 - DNA, 20 bp, synthetic construct
  misc_feature 1..20: note = CRISPR gRNA sequence
  source 1..20: mol_type = other DNA
gagaacgacctggcatcatg

SEQ ID NO: 20853 - DNA, 20 bp, synthetic construct
  misc_feature 1..20: note = CRISPR gRNA sequence
  source 1..20: mol_type = other DNA
tggcatcatgtagaatatct

SEQ ID NO: 20854 - DNA, 20 bp, synthetic construct
  misc_feature 1..20: note = CRISPR gRNA sequence
  source 1..20: mol_type = other DNA
accacctggcaattcagctc

SEQ ID NO: 20855 - DNA, 20 bp, synthetic construct
  misc_feature 1..20: note = CRISPR gRNA sequence
  source 1..20: mol_type = other DNA
ctccccaggagaacccatct

SEQ ID NO: 20856 - DNA, 20 bp, synthetic construct
  misc_feature 1..20: note = CRISPR gRNA sequence
  source 1..20: mol_type = other DNA
ctgtgttatttgtggtgaca

SEQ ID NO: 20857 - DNA, 20 bp, synthetic construct
  misc_feature 1..20: note = CRISPR gRNA sequence
  source 1..20: mol_type = other DNA
tcacctaggtgtccatcact

SEQ ID NO: 20858 - DNA, 20 bp, synthetic construct
  misc_feature 1..20: note = CRISPR gRNA sequence
  source 1..20: mol_type = other DNA
tagatcctaaaaacatagta

SEQ ID NO: 20859 - DNA, 20 bp, synthetic construct
  misc_feature 1..20: note = CRISPR gRNA sequence
  source 1..20: mol_type = other DNA
cagcactttgggaggccgag

SEQ ID NO: 20860 - DNA, 20 bp, synthetic construct
  misc_feature 1..20: note = CRISPR gRNA sequence
  source 1..20: mol_type = other DNA
actttgggaggccgaggcgg

SEQ ID NO: 20861 - DNA, 20 bp, synthetic construct
  misc_feature 1..20: note = CRISPR gRNA sequence
  source 1..20: mol_type = other DNA
cgggtggatcacctgaggtc

SEQ ID NO: 20862 - DNA, 20 bp, synthetic construct
  misc_feature 1..20: note = CRISPR gRNA sequence
  source 1..20: mol_type = other DNA
ctaaaaatagaaaactcagc

SEQ ID NO: 20863 - DNA, 20 bp, synthetic construct
  misc_feature 1..20: note = CRISPR gRNA sequence
  source 1..20: mol_type = other DNA
agaaaactcagcctgggtga

SEQ ID NO: 20864 - DNA, 20 bp, synthetic construct
  misc_feature 1..20: note = CRISPR gRNA sequence
  source 1..20: mol_type = other DNA
aagatacacctgaaatgcat

SEQ ID NO: 20865 - DNA, 20 bp, synthetic construct
  misc_feature 1..20: note = CRISPR gRNA sequence
  source 1..20: mol_type = other DNA
aatcgaaggtttaaaggccc

SEQ ID NO: 20866 - DNA, 20 bp, synthetic construct
  misc_feature 1..20: note = CRISPR gRNA sequence
  source 1..20: mol_type = other DNA
tgaaaagaaaagaaacaaag

SEQ ID NO: 20867 - DNA, 20 bp, synthetic construct
  misc_feature 1..20: note = CRISPR gRNA sequence
  source 1..20: mol_type = other DNA
aagaaacaaaggaggattca

SEQ ID NO: 20868 - DNA, 20 bp, synthetic construct
  misc_feature 1..20: note = CRISPR gRNA sequence
  source 1..20: mol_type = other DNA
ttgatttgtgcccaagagcc

SEQ ID NO: 20869 - DNA, 20 bp, synthetic construct
  misc_feature 1..20: note = CRISPR gRNA sequence
  source 1..20: mol_type = other DNA
ggaacatgctggacttggag

SEQ ID NO: 20870 - DNA, 20 bp, synthetic construct
  misc_feature 1..20: note = CRISPR gRNA sequence
  source 1..20: mol_type = other DNA
ggagcaggatgggggaggag

SEQ ID NO: 20871 - DNA, 20 bp, synthetic construct
  misc_feature 1..20: note = CRISPR gRNA sequence
  source 1..20: mol_type = other DNA
cactcaagactttcacttcc

SEQ ID NO: 20872 - DNA, 20 bp, synthetic construct
  misc_feature 1..20: note = CRISPR gRNA sequence
  source 1..20: mol_type = other DNA
tatgggcctggaaacagttg

SEQ ID NO: 20873 - DNA, 20 bp, synthetic construct
  misc_feature 1..20: note = CRISPR gRNA sequence
  source 1..20: mol_type = other DNA
cttggctgcaaaatcaaaag

SEQ ID NO: 20874 - DNA, 20 bp, synthetic construct
  misc_feature 1..20: note = CRISPR gRNA sequence
  source 1..20: mol_type = other DNA
accatcacaatgtctctata

SEQ ID NO: 20875 - DNA, 20 bp, synthetic construct
  misc_feature 1..20: note = CRISPR gRNA sequence
  source 1..20: mol_type = other DNA
cattatggcccctttggtat

SEQ ID NO: 20876 - DNA, 20 bp, synthetic construct
  misc_feature 1..20: note = CRISPR gRNA sequence
  source 1..20: mol_type = other DNA
tcccaagataatggcttggg

SEQ ID NO: 20877 - DNA, 20 bp, synthetic construct
  misc_feature 1..20: note = CRISPR gRNA sequence
  source 1..20: mol_type = other DNA
aagataatggcttgggaggg

SEQ ID NO: 20878 - DNA, 20 bp, synthetic construct
  misc_feature 1..20: note = CRISPR gRNA sequence
  source 1..20: mol_type = other DNA
gtgactggggcagggagagg

SEQ ID NO: 20879 - DNA, 20 bp, synthetic construct
  misc_feature 1..20: note = CRISPR gRNA sequence
  source 1..20: mol_type = other DNA
aattatgtcctgtcctgcaa

SEQ ID NO: 20880 - DNA, 20 bp, synthetic construct
  misc_feature 1..20: note = CRISPR gRNA sequence
  source 1..20: mol_type = other DNA
aatggaattgaggtgtacag

SEQ ID NO: 20881 - DNA, 20 bp, synthetic construct
  misc_feature 1..20: note = CRISPR gRNA sequence
  source 1..20: mol_type = other DNA
cagtagggtctttttctaca

SEQ ID NO: 20882 - DNA, 20 bp, synthetic construct
  misc_feature 1..20: note = CRISPR gRNA sequence
  source 1..20: mol_type = other DNA
ggtcttggaggggactggcc

SEQ ID NO: 20883 - DNA, 20 bp, synthetic construct
  misc_feature 1..20: note = CRISPR gRNA sequence
  source 1..20: mol_type = other DNA
agcactaaagttgcagcatc

SEQ ID NO: 20884 - DNA, 20 bp, synthetic construct
  misc_feature 1..20: note = CRISPR gRNA sequence
  source 1..20: mol_type = other DNA
aagttgcagcatctggggtg

SEQ ID NO: 20885 - DNA, 20 bp, synthetic construct
  misc_feature 1..20: note = CRISPR gRNA sequence
  source 1..20: mol_type = other DNA
actttgggaggctgaggagg

SEQ ID NO: 20886 - DNA, 20 bp, synthetic construct
  misc_feature 1..20: note = CRISPR gRNA sequence
  source 1..20: mol_type = other DNA
agggaggatgacttgaggcc

SEQ ID NO: 20887 - DNA, 20 bp, synthetic construct
  misc_feature 1..20: note = CRISPR gRNA sequence
  source 1..20: mol_type = other DNA
ataaaagatacaaaaattag

SEQ ID NO: 20888 - DNA, 20 bp, synthetic construct
  misc_feature 1..20: note = CRISPR gRNA sequence
  source 1..20: mol_type = other DNA
caaaaattagctgggtgtgg

SEQ ID NO: 20889 - DNA, 20 bp, synthetic construct
  misc_feature 1..20: note = CRISPR gRNA sequence
  source 1..20: mol_type = other DNA
tacttgggaggctgaggcag

SEQ ID NO: 20890 - DNA, 20 bp, synthetic construct
  misc_feature 1..20: note = CRISPR gRNA sequence
  source 1..20: mol_type = other DNA
ctgcactccaacctgggcaa

SEQ ID NO: 20891 - DNA, 20 bp, synthetic construct
  misc_feature 1..20: note = CRISPR gRNA sequence
  source 1..20: mol_type = other DNA
agactttgtctcataaatga

SEQ ID NO: 20892 - DNA, 20 bp, synthetic construct
  misc_feature 1..20: note = CRISPR gRNA sequence
  source 1..20: mol_type = other DNA
tttgtctcataaatgaaagg

SEQ ID NO: 20893 - DNA, 20 bp, synthetic construct
  misc_feature 1..20: note = CRISPR gRNA sequence
  source 1..20: mol_type = other DNA
tctcataaatgaaaggatga

SEQ ID NO: 20894 - DNA, 20 bp, synthetic construct
  misc_feature 1..20: note = CRISPR gRNA sequence
  source 1..20: mol_type = other DNA
ataaatgaaaggatgaatga

SEQ ID NO: 20895 - DNA, 20 bp, synthetic construct
  misc_feature 1..20: note = CRISPR gRNA sequence
  source 1..20: mol_type = other DNA
aaggatgaatgaatgaatga

SEQ ID NO: 20896 - DNA, 20 bp, synthetic construct
  misc_feature 1..20: note = CRISPR gRNA sequence
  source 1..20: mol_type = other DNA
ggtaagctccctgggaactg

SEQ ID NO: 20897 - DNA, 20 bp, synthetic construct
  misc_feature 1..20: note = CRISPR gRNA sequence
  source 1..20: mol_type = other DNA
ccatcccaattccagcaccg

SEQ ID NO: 20898 - DNA, 20 bp, synthetic construct
  misc_feature 1..20: note = CRISPR gRNA sequence
  source 1..20: mol_type = other DNA
cccaattccagcaccgttga

SEQ ID NO: 20899 - DNA, 20 bp, synthetic construct
  misc_feature 1..20: note = CRISPR gRNA sequence
  source 1..20: mol_type = other DNA
ccattgcagctccctgccct

SEQ ID NO: 20900 - DNA, 20 bp, synthetic construct
  misc_feature 1..20: note = CRISPR gRNA sequence
  source 1..20: mol_type = other DNA
caagctcagtcacaagtgaa

SEQ ID NO: 20901 - DNA, 20 bp, synthetic construct
  misc_feature 1..20: note = CRISPR gRNA sequence
  source 1..20: mol_type = other DNA
catgtatctgtccaaaccca

SEQ ID NO: 20902 - DNA, 20 bp, synthetic construct
  misc_feature 1..20: note = CRISPR gRNA sequence
  source 1..20: mol_type = other DNA
cccacagaatgtacaacacc

SEQ ID NO: 20903 - DNA, 20 bp, synthetic construct
  misc_feature 1..20: note = CRISPR gRNA sequence
  source 1..20: mol_type = other DNA
atgtaaacaaaccatggacc

SEQ ID NO: 20904 - DNA, 20 bp, synthetic construct
  misc_feature 1..20: note = CRISPR gRNA sequence
  source 1..20: mol_type = other DNA
acaaatgtatcagtctggtg

SEQ ID NO: 20905 - DNA, 20 bp, synthetic construct
  misc_feature 1..20: note = CRISPR gRNA sequence
  source 1..20: mol_type = other DNA
tgggaggacggaggtagatg

SEQ ID NO: 20906 - DNA, 20 bp, synthetic construct
  misc_feature 1..20: note = CRISPR gRNA sequence
  source 1..20: mol_type = other DNA
agcttccttgctgtcccagc

SEQ ID NO: 20907 - DNA, 20 bp, synthetic construct
  misc_feature 1..20: note = CRISPR gRNA sequence
  source 1..20: mol_type = other DNA
cccagcttgagtgctcccta

SEQ ID NO: 20908 - DNA, 20 bp, synthetic construct
  misc_feature 1..20: note = CRISPR gRNA sequence
  source 1..20: mol_type = other DNA
ctgctttcttcccttttcct

SEQ ID NO: 20909 - DNA, 20 bp, synthetic construct
  misc_feature 1..20: note = CRISPR gRNA sequence
  source 1..20: mol_type = other DNA
tccttcgggtgttccctcct

SEQ ID NO: 20910 - DNA, 20 bp, synthetic construct
  misc_feature 1..20: note = CRISPR gRNA sequence
  source 1..20: mol_type = other DNA
aggcaagccacctatcttct

SEQ ID NO: 20911 - DNA, 20 bp, synthetic construct
  misc_feature 1..20: note = CRISPR gRNA sequence
  source 1..20: mol_type = other DNA
aacttggaaaatcttaaaac

SEQ ID NO: 20912 - DNA, 20 bp, synthetic construct
  misc_feature 1..20: note = CRISPR gRNA sequence
  source 1..20: mol_type = other DNA
agcttgtgcatttgccagta

SEQ ID NO: 20913 - DNA, 20 bp, synthetic construct
  misc_feature 1..20: note = CRISPR gRNA sequence
  source 1..20: mol_type = other DNA
cagtaaagggtaaagttatt

SEQ ID NO: 20914 - DNA, 20 bp, synthetic construct
  misc_feature 1..20: note = CRISPR gRNA sequence
  source 1..20: mol_type = other DNA
ggtgaggggcctggtggtcc

SEQ ID NO: 20915 - DNA, 20 bp, synthetic construct
  misc_feature 1..20: note = CRISPR gRNA sequence
  source 1..20: mol_type = other DNA
gggcctggtggtcccaggat

SEQ ID NO: 20916 - DNA, 20 bp, synthetic construct
  misc_feature 1..20: note = CRISPR gRNA sequence
  source 1..20: mol_type = other DNA
ggagaccttcggtccctgtc

SEQ ID NO: 20917 - DNA, 20 bp, synthetic construct
  misc_feature 1..20: note = CRISPR gRNA sequence
  source 1..20: mol_type = other DNA
ttcggtccctgtccagaatg

SEQ ID NO: 20918 - DNA, 20 bp, synthetic construct
  misc_feature 1..20: note = CRISPR gRNA sequence
  source 1..20: mol_type = other DNA
ccctgtccagaatgcagggt

SEQ ID NO: 20919 - DNA, 20 bp, synthetic construct
  misc_feature 1..20: note = CRISPR gRNA sequence
  source 1..20: mol_type = other DNA
ccagaatgcagggttgggat

SEQ ID NO: 20920 - DNA, 20 bp, synthetic construct
  misc_feature 1..20: note = CRISPR gRNA sequence
  source 1..20: mol_type = other DNA
ctgcagtcaatgacctggaa

SEQ ID NO: 20921 - DNA, 20 bp, synthetic construct
  misc_feature 1..20: note = CRISPR gRNA sequence
  source 1..20: mol_type = other DNA
agggaacctgaccctggtgc

SEQ ID NO: 20922 - DNA, 20 bp, synthetic construct
  misc_feature 1..20: note = CRISPR gRNA sequence
  source 1..20: mol_type = other DNA
ctgaccctggtgctggggta

SEQ ID NO: 20923 - DNA, 20 bp, synthetic construct
  misc_feature 1..20: note = CRISPR gRNA sequence
  source 1..20: mol_type = other DNA
cctggtgctggggtaggggg

SEQ ID NO: 20924 - DNA, 20 bp, synthetic construct
  misc_feature 1..20: note = CRISPR gRNA sequence
  source 1..20: mol_type = other DNA
ggggtagggggtggagtgat

SEQ ID NO: 20925 - DNA, 20 bp, synthetic construct
  misc_feature 1..20: note = CRISPR gRNA sequence
  source 1..20: mol_type = other DNA
gtccccccgccagcactctg

SEQ ID NO: 20926 - DNA, 20 bp, synthetic construct
  misc_feature 1..20: note = CRISPR gRNA sequence
  source 1..20: mol_type = other DNA
tgcttgctgagatctgacta

SEQ ID NO: 20927 - DNA, 20 bp, synthetic construct
  misc_feature 1..20: note = CRISPR gRNA sequence
  source 1..20: mol_type = other DNA
agccatcggcaggcttggct

SEQ ID NO: 20928 - DNA, 20 bp, synthetic construct
  misc_feature 1..20: note = CRISPR gRNA sequence
  source 1..20: mol_type = other DNA
cggcaggcttggctgtgagt

SEQ ID NO: 20929 - DNA, 20 bp, synthetic construct
  misc_feature 1..20: note = CRISPR gRNA sequence
  source 1..20: mol_type = other DNA
gtgagtgagaattacctggg

SEQ ID NO: 20930 - DNA, 20 bp, synthetic construct
  misc_feature 1..20: note = CRISPR gRNA sequence
  source 1..20: mol_type = other DNA
acccccagtgattctattca

SEQ ID NO: 20931 - DNA, 20 bp, synthetic construct
  misc_feature 1..20: note = CRISPR gRNA sequence
  source 1..20: mol_type = other DNA
gggagtctgcagccgggccc

SEQ ID NO: 20932 - DNA, 20 bp, synthetic construct
  misc_feature 1..20: note = CRISPR gRNA sequence
  source 1..20: mol_type = other DNA
ttctttcattttttttgaga

SEQ ID NO: 20933 - DNA, 20 bp, synthetic construct
  misc_feature 1..20: note = CRISPR gRNA sequence
  source 1..20: mol_type = other DNA
ttcactcttgttgcccaggc

SEQ ID NO: 20934 - DNA, 20 bp, synthetic construct
  misc_feature 1..20: note = CRISPR gRNA sequence
  source 1..20: mol_type = other DNA
ctcaccgcaatctccgcctc

SEQ ID NO: 20935 - DNA, 20 bp, synthetic construct
  misc_feature 1..20: note = CRISPR gRNA sequence
  source 1..20: mol_type = other DNA
gattctcctccaccagccta

SEQ ID NO: 20936 - DNA, 20 bp, synthetic construct
  misc_feature 1..20: note = CRISPR gRNA sequence
  source 1..20: mol_type = other DNA
ccaccagcctaccgagtagc

SEQ ID NO: 20937 - DNA, 20 bp, synthetic construct
  misc_feature 1..20: note = CRISPR gRNA sequence
  source 1..20: mol_type = other DNA
gcctcagcctcccaaagtgc

SEQ ID NO: 20938 - DNA, 20 bp, synthetic construct
  misc_feature 1..20: note = CRISPR gRNA sequence
  source 1..20: mol_type = other DNA
gtgagccaccatgcccggcc

SEQ ID NO: 20939 - DNA, 20 bp, synthetic construct
  misc_feature 1..20: note = CRISPR gRNA sequence
  source 1..20: mol_type = other DNA
gccttgacctcccaaggtga

SEQ ID NO: 20940 - DNA, 20 bp, synthetic construct
  misc_feature 1..20: note = CRISPR gRNA sequence
  source 1..20: mol_type = other DNA
tcttccatctttacaatttt

SEQ ID NO: 20941 - DNA, 20 bp, synthetic construct
  misc_feature 1..20: note = CRISPR gRNA sequence
  source 1..20: mol_type = other DNA
gattttaaaagaaagctttc

SEQ ID NO: 20942 - DNA, 20 bp, synthetic construct
  misc_feature 1..20: note = CRISPR gRNA sequence
  source 1..20: mol_type = other DNA
gctttctagagttgaaagcg

SEQ ID NO: 20943 - DNA, 20 bp, synthetic construct
  misc_feature 1..20: note = CRISPR gRNA sequence
  source 1..20: mol_type = other DNA
acccaagtgtctatcaacaa

SEQ ID NO: 20944 - DNA, 20 bp, synthetic construct
  misc_feature 1..20: note = CRISPR gRNA sequence
  source 1..20: mol_type = other DNA
aagtgtctatcaacaaatga

SEQ ID NO: 20945 - DNA, 20 bp, synthetic construct
  misc_feature 1..20: note = CRISPR gRNA sequence
  source 1..20: mol_type = other DNA
atgaatggatgaacaaaata

SEQ ID NO: 20946 - DNA, 20 bp, synthetic construct
  misc_feature 1..20: note = CRISPR gRNA sequence
  source 1..20: mol_type = other DNA
aatatgggatatccacatat

SEQ ID NO: 20947 - DNA, 20 bp, synthetic construct
  misc_feature 1..20: note = CRISPR gRNA sequence
  source 1..20: mol_type = other DNA
aatactattccgccatagaa

SEQ ID NO: 20948 - DNA, 20 bp, synthetic construct
  misc_feature 1..20: note = CRISPR gRNA sequence
  source 1..20: mol_type = other DNA
ggaattacacatggcacgac

SEQ ID NO: 20949 - DNA, 20 bp, synthetic construct
  misc_feature 1..20: note = CRISPR gRNA sequence
  source 1..20: mol_type = other DNA
ttctatttataggcggtgtc

SEQ ID NO: 20950 - DNA, 20 bp, synthetic construct
  misc_feature 1..20: note = CRISPR gRNA sequence
  source 1..20: mol_type = other DNA
aaaacatagagacaggaagt

SEQ ID NO: 20951 - DNA, 20 bp, synthetic construct
  misc_feature 1..20: note = CRISPR gRNA sequence
  source 1..20: mol_type = other DNA
gaagttggagttaccacgag

SEQ ID NO: 20952 - DNA, 20 bp, synthetic construct
  misc_feature 1..20: note = CRISPR gRNA sequence
  source 1..20: mol_type = other DNA
gctgggtggaaggggcagtg

SEQ ID NO: 20953 - DNA, 20 bp, synthetic construct
  misc_feature 1..20: note = CRISPR gRNA sequence
  source 1..20: mol_type = other DNA
cagtggggagttattgctta

SEQ ID NO: 20954 - DNA, 20 bp, synthetic construct
  misc_feature 1..20: note = CRISPR gRNA sequence
  source 1..20: mol_type = other DNA
gggagttattgcttattggg

SEQ ID NO: 20955 - DNA, 20 bp, synthetic construct
  misc_feature 1..20: note = CRISPR gRNA sequence
  source 1..20: mol_type = other DNA
tgggtagagtttcagtttgg

SEQ ID NO: 20956 - DNA, 20 bp, synthetic construct
  misc_feature 1..20: note = CRISPR gRNA sequence
  source 1..20: mol_type = other DNA
aggatgaaaaagttctggag

SEQ ID NO: 20957 - DNA, 20 bp, synthetic construct
  misc_feature 1..20: note = CRISPR gRNA sequence
  source 1..20: mol_type = other DNA
gactttgtccttgatgtcag

SEQ ID NO: 20958 - DNA, 20 bp, synthetic construct
  misc_feature 1..20: note = CRISPR gRNA sequence
  source 1..20: mol_type = other DNA
cttgatgtcagaaggattga

SEQ ID NO: 20959 - DNA, 20 bp, synthetic construct
  misc_feature 1..20: note = CRISPR gRNA sequence
  source 1..20: mol_type = other DNA
actatctatgtccttcctat

SEQ ID NO: 20960 - DNA, 20 bp, synthetic construct
  misc_feature 1..20: note = CRISPR gRNA sequence
  source 1..20: mol_type = other DNA
cagtggtgcaatctcagctc

SEQ ID NO: 20961 - DNA, 20 bp, synthetic construct
  misc_feature 1..20: note = CRISPR gRNA sequence
  source 1..20: mol_type = other DNA
tctcgggtaacctccacctc

SEQ ID NO: 20962 - DNA, 20 bp, synthetic construct
  misc_feature 1..20: note = CRISPR gRNA sequence
  source 1..20: mol_type = other DNA
tctcgggtaaactccgcctc

SEQ ID NO: 20963 - DNA, 20 bp, synthetic construct
  misc_feature 1..20: note = CRISPR gRNA sequence
  source 1..20: mol_type = other DNA
aacacaaaaaagtgttttag

SEQ ID NO: 20964 - DNA, 20 bp, synthetic construct
  misc_feature 1..20: note = CRISPR gRNA sequence
  source 1..20: mol_type = other DNA
aaaaagtgttttagtagagt

SEQ ID NO: 20965 - DNA, 20 bp, synthetic construct
  misc_feature 1..20: note = CRISPR gRNA sequence
  source 1..20: mol_type = other DNA
gcctcggcctcccaaagtgc

SEQ ID NO: 20966 - DNA, 20 bp, synthetic construct
  misc_feature 1..20: note = CRISPR gRNA sequence
  source 1..20: mol_type = other DNA
atctttctaaacaatccctt

SEQ ID NO: 20967 - DNA, 20 bp, synthetic construct
  misc_feature 1..20: note = CRISPR gRNA sequence
  source 1..20: mol_type = other DNA
ataataattattcccaatgc

SEQ ID NO: 20968 - DNA, 20 bp, synthetic construct
  misc_feature 1..20: note = CRISPR gRNA sequence
  source 1..20: mol_type = other DNA
ctgattgcctggaactaatc

SEQ ID NO: 20969 - DNA, 20 bp, synthetic construct
  misc_feature 1..20: note = CRISPR gRNA sequence
  source 1..20: mol_type = other DNA
ggaactaatccagagtttcc

SEQ ID NO: 20970 - DNA, 20 bp, synthetic construct
  misc_feature 1..20: note = CRISPR gRNA sequence
  source 1..20: mol_type = other DNA
tcttctcaaggtatctgagg

SEQ ID NO: 20971 - DNA, 20 bp, synthetic construct
  misc_feature 1..20: note = CRISPR gRNA sequence
  source 1..20: mol_type = other DNA
agccccagccatcagacaga

SEQ ID NO: 20972 - DNA, 20 bp, synthetic construct
  misc_feature 1..20: note = CRISPR gRNA sequence
  source 1..20: mol_type = other DNA
gggctgggctctcagtagac

SEQ ID NO: 20973 - DNA, 20 bp, synthetic construct
  misc_feature 1..20: note = CRISPR gRNA sequence
  source 1..20: mol_type = other DNA
tagaggttttgtaacaggga

SEQ ID NO: 20974 - DNA, 20 bp, synthetic construct
  misc_feature 1..20: note = CRISPR gRNA sequence
  source 1..20: mol_type = other DNA
tttgccccacaaacgaacat

SEQ ID NO: 20975 - DNA, 20 bp, synthetic construct
  misc_feature 1..20: note = CRISPR gRNA sequence
  source 1..20: mol_type = other DNA
aaacgaacattggagtcacc

SEQ ID NO: 20976 - DNA, 20 bp, synthetic construct
  misc_feature 1..20: note = CRISPR gRNA sequence
  source 1..20: mol_type = other DNA
gggatagatggtttaacctg

SEQ ID NO: 20977 - DNA, 20 bp, synthetic construct
  misc_feature 1..20: note = CRISPR gRNA sequence
  source 1..20: mol_type = other DNA
aggcctagccaaccgggcct

SEQ ID NO: 20978 - DNA, 20 bp, synthetic construct
  misc_feature 1..20: note = CRISPR gRNA sequence
  source 1..20: mol_type = other DNA
atgttcatgtgtggggagcc

SEQ ID NO: 20979 - DNA, 20 bp, synthetic construct
  misc_feature 1..20: note = CRISPR gRNA sequence
  source 1..20: mol_type = other DNA
ggtcatcccctaagggagcc

SEQ ID NO: 20980 - DNA, 20 bp, synthetic construct
  misc_feature 1..20: note = CRISPR gRNA sequence
  source 1..20: mol_type = other DNA
tttgcaaggtgatcatttgt

SEQ ID NO: 20981 - DNA, 20 bp, synthetic construct
  misc_feature 1..20: note = CRISPR gRNA sequence
  source 1..20: mol_type = other DNA
gtatttatttattttttctc

SEQ ID NO: 20982 - DNA, 20 bp, synthetic construct
  misc_feature 1..20: note = CRISPR gRNA sequence
  source 1..20: mol_type = other DNA
gccacctctcctgtgccacc

SEQ ID NO: 20983 - DNA, 20 bp, synthetic construct
  misc_feature 1..20: note = CRISPR gRNA sequence
  source 1..20: mol_type = other DNA
tcaggaggaccgcggctttt

SEQ ID NO: 20984 - DNA, 20 bp, synthetic construct
  misc_feature 1..20: note = CRISPR gRNA sequence
  source 1..20: mol_type = other DNA
cgctttagcctctctcctta

SEQ ID NO: 20985 - DNA, 20 bp, synthetic construct
  misc_feature 1..20: note = CRISPR gRNA sequence
  source 1..20: mol_type = other DNA
aagagatcggttcagtccgg

SEQ ID NO: 20986 - DNA, 20 bp, synthetic construct
  misc_feature 1..20: note = CRISPR gRNA sequence
  source 1..20: mol_type = other DNA
ccttcgccaagatgttcaac

SEQ ID NO: 20987 - DNA, 20 bp, synthetic construct
  misc_feature 1..20: note = CRISPR gRNA sequence
  source 1..20: mol_type = other DNA
gagcccaatacccaagattc

SEQ ID NO: 20988 - DNA, 20 bp, synthetic construct
  misc_feature 1..20: note = CRISPR gRNA sequence
  source 1..20: mol_type = other DNA
caagattccagagttagaga

SEQ ID NO: 20989 - DNA, 20 bp, synthetic construct
  misc_feature 1..20: note = CRISPR gRNA sequence
  source 1..20: mol_type = other DNA
aagaagggcgcgcacctctg

SEQ ID NO: 20990 - DNA, 20 bp, synthetic construct
  misc_feature 1..20: note = CRISPR gRNA sequence
  source 1..20: mol_type = other DNA
tctgcaggatcccgggcgcg

SEQ ID NO: 20991 - DNA, 20 bp, synthetic construct
  misc_feature 1..20: note = CRISPR gRNA sequence
  source 1..20: mol_type = other DNA
ccgggcgcgcggagtcggcc

SEQ ID NO: 20992 - DNA, 20 bp, synthetic construct
  misc_feature 1..20: note = CRISPR gRNA sequence
  source 1..20: mol_type = other DNA
agtcggccaagggtggccgg

SEQ ID NO: 20993 - DNA, 20 bp, synthetic construct
  misc_feature 1..20: note = CRISPR gRNA sequence
  source 1..20: mol_type = other DNA
tgggcacagcaagccaagct

SEQ ID NO: 20994 - DNA, 20 bp, synthetic construct
  misc_feature 1..20: note = CRISPR gRNA sequence
  source 1..20: mol_type = other DNA
cccggctcctggttcccgcg

SEQ ID NO: 20995 - DNA, 20 bp, synthetic construct
  misc_feature 1..20: note = CRISPR gRNA sequence
  source 1..20: mol_type = other DNA
ttcccgcgcagagtcgttgc

SEQ ID NO: 20996 - DNA, 20 bp, synthetic construct
  misc_feature 1..20: note = CRISPR gRNA sequence
  source 1..20: mol_type = other DNA
tcgattctcagcccgacctt

SEQ ID NO: 20997 - DNA, 20 bp, synthetic construct
  misc_feature 1..20: note = CRISPR gRNA sequence
  source 1..20: mol_type = other DNA
gtggccagccccacttcggg

SEQ ID NO: 20998 - DNA, 20 bp, synthetic construct
  misc_feature 1..20: note = CRISPR gRNA sequence
  source 1..20: mol_type = other DNA
gggcaagtgatctgcaagtc

SEQ ID NO: 20999 - DNA, 20 bp, synthetic construct
  misc_feature 1..20: note = CRISPR gRNA sequence
  source 1..20: mol_type = other DNA
cagggagcttgtccccaccc

SEQ ID NO: 21000 - DNA, 20 bp, synthetic construct
  misc_feature 1..20: note = CRISPR gRNA sequence
  source 1..20: mol_type = other DNA
gagcttgtccccacccctgg

SEQ ID NO: 21001 - DNA, 20 bp, synthetic construct
  misc_feature 1..20: note = CRISPR gRNA sequence
  source 1..20: mol_type = other DNA
aaatccctcaggtaccttcc

SEQ ID NO: 21002 - DNA, 20 bp, synthetic construct
  misc_feature 1..20: note = CRISPR gRNA sequence
  source 1..20: mol_type = other DNA
gccggtccttttcagaggtc

SEQ ID NO: 21003 - DNA, 20 bp, synthetic construct
  misc_feature 1..20: note = CRISPR gRNA sequence
  source 1..20: mol_type = other DNA
tcagaggtcttggattcctg

SEQ ID NO: 21004 - DNA, 20 bp, synthetic construct
  misc_feature 1..20: note = CRISPR gRNA sequence
  source 1..20: mol_type = other DNA
gtcactttcccttttcaggc

SEQ ID NO: 21005 - DNA, 20 bp, synthetic construct
  misc_feature 1..20: note = CRISPR gRNA sequence
  source 1..20: mol_type = other DNA
caggcctgaatttcctcatc

SEQ ID NO: 21006 - DNA, 20 bp, synthetic construct
  misc_feature 1..20: note = CRISPR gRNA sequence
  source 1..20: mol_type = other DNA
ggcagacctgtcatcagtct

SEQ ID NO: 21007 - DNA, 20 bp, synthetic construct
  misc_feature 1..20: note = CRISPR gRNA sequence
  source 1..20: mol_type = other DNA
aagcaaaccatacatttcag

SEQ ID NO: 21008 - DNA, 20 bp, synthetic construct
  misc_feature 1..20: note = CRISPR gRNA sequence
  source 1..20: mol_type = other DNA
tttcaggggagtctgagaaa

SEQ ID NO: 21009 - DNA, 20 bp, synthetic construct
  misc_feature 1..20: note = CRISPR gRNA sequence
  source 1..20: mol_type = other DNA
cactccaggaaaattgactc

SEQ ID NO: 21010 - DNA, 20 bp, synthetic construct
  misc_feature 1..20: note = CRISPR gRNA sequence
  source 1..20: mol_type = other DNA
attttggtttccctgcttct

SEQ ID NO: 21011 - DNA, 20 bp, synthetic construct
  misc_feature 1..20: note = CRISPR gRNA sequence
  source 1..20: mol_type = other DNA
tttccctgcttctctgggta

SEQ ID NO: 21012 - DNA, 20 bp, synthetic construct
  misc_feature 1..20: note = CRISPR gRNA sequence
  source 1..20: mol_type = other DNA
ctgcttctctgggtatggag

SEQ ID NO: 21013 - DNA, 20 bp, synthetic construct
  misc_feature 1..20: note = CRISPR gRNA sequence
  source 1..20: mol_type = other DNA
ccgagccaggccagcatgct

SEQ ID NO: 21014 - DNA, 20 bp, synthetic construct
  misc_feature 1..20: note = CRISPR gRNA sequence
  source 1..20: mol_type = other DNA
cctcacccccatccccaatt

SEQ ID NO: 21015 - DNA, 20 bp, synthetic construct
  misc_feature 1..20: note = CRISPR gRNA sequence
  source 1..20: mol_type = other DNA
gaatggtttctctgtttatc

SEQ ID NO: 21016 - DNA, 20 bp, synthetic construct
  misc_feature 1..20: note = CRISPR gRNA sequence
  source 1..20: mol_type = other DNA
agccaggcaacgcattgtgt

SEQ ID NO: 21017 - DNA, 20 bp, synthetic construct
  misc_feature 1..20: note = CRISPR gRNA sequence
  source 1..20: mol_type = other DNA
cccagccaggcagcagctcc

SEQ ID NO: 21018 - DNA, 20 bp, synthetic construct
  misc_feature 1..20: note = CRISPR gRNA sequence
  source 1..20: mol_type = other DNA
ctcgtgccctcagcttcccc

SEQ ID NO: 21019 - DNA, 20 bp, synthetic construct
  misc_feature 1..20: note = CRISPR gRNA sequence
  source 1..20: mol_type = other DNA
cagcttccccaaggatgcct

SEQ ID NO: 21020 - DNA, 20 bp, synthetic construct
  misc_feature 1..20: note = CRISPR gRNA sequence
  source 1..20: mol_type = other DNA
ctccgggagctgctgcctgg

SEQ ID NO: 21021 - DNA, 20 bp, synthetic construct
  misc_feature 1..20: note = CRISPR gRNA sequence
  source 1..20: mol_type = other DNA
ctggcggatgctgccctccc

SEQ ID NO: 21022 - DNA, 20 bp, synthetic construct
  misc_feature 1..20: note = CRISPR gRNA sequence
  source 1..20: mol_type = other DNA
tccccccagtttcctaatgg

SEQ ID NO: 21023 - DNA, 20 bp, synthetic construct
  misc_feature 1..20: note = CRISPR gRNA sequence
  source 1..20: mol_type = other DNA
gaagggtgtgcccctgaaga

SEQ ID NO: 21024 - DNA, 20 bp, synthetic construct
  misc_feature 1..20: note = CRISPR gRNA sequence
  source 1..20: mol_type = other DNA
tctcagactcccctgaaatg

SEQ ID NO: 21025 - DNA, 20 bp, synthetic construct
  misc_feature 1..20: note = CRISPR gRNA sequence
  source 1..20: mol_type = other DNA
agactcccctgaaatgtatg

SEQ ID NO: 21026 - DNA, 20 bp, synthetic construct
  misc_feature 1..20: note = CRISPR gRNA sequence
  source 1..20: mol_type = other DNA
gggggtgtggtcatggtaac

SEQ ID NO: 21027 - DNA, 20 bp, synthetic construct
  misc_feature 1..20: note = CRISPR gRNA sequence
  source 1..20: mol_type = other DNA
tccatccatggaaggtacct

SEQ ID NO: 21028 - DNA, 20 bp, synthetic construct
  misc_feature 1..20: note = CRISPR gRNA sequence
  source 1..20: mol_type = other DNA
aggggccatgtgccctcgga

SEQ ID NO: 21029 - DNA, 20 bp, synthetic construct
  misc_feature 1..20: note = CRISPR gRNA sequence
  source 1..20: mol_type = other DNA
aagcacgtggtggccacagt

SEQ ID NO: 21030 - DNA, 20 bp, synthetic construct
  misc_feature 1..20: note = CRISPR gRNA sequence
  source 1..20: mol_type = other DNA
aaatgtagggccgggaaaca

SEQ ID NO: 21031 - DNA, 20 bp, synthetic construct
  misc_feature 1..20: note = CRISPR gRNA sequence
  source 1..20: mol_type = other DNA
ggaaccaggagccgggaacc

SEQ ID NO: 21032 - DNA, 20 bp, synthetic construct
  misc_feature 1..20: note = CRISPR gRNA sequence
  source 1..20: mol_type = other DNA
caggagccgggaacccggag

SEQ ID NO: 21033 - DNA, 20 bp, synthetic construct
  misc_feature 1..20: note = CRISPR gRNA sequence
  source 1..20: mol_type = other DNA
gggtggcaggaaagcctggc

SEQ ID NO: 21034 - DNA, 20 bp, synthetic construct
  misc_feature 1..20: note = CRISPR gRNA sequence
  source 1..20: mol_type = other DNA
tggaccagggccgccgttcc

SEQ ID NO: 21035 - DNA, 20 bp, synthetic construct
  misc_feature 1..20: note = CRISPR gRNA sequence
  source 1..20: mol_type = other DNA
cttgatctctcacttctcta

SEQ ID NO: 21036 - DNA, 20 bp, synthetic construct
  misc_feature 1..20: note = CRISPR gRNA sequence
  source 1..20: mol_type = other DNA
gcgaatgccggggtgggagt

SEQ ID NO: 21037 - DNA, 20 bp, synthetic construct
  misc_feature 1..20: note = CRISPR gRNA sequence
  source 1..20: mol_type = other DNA
gaaagccggaatcggagcca

SEQ ID NO: 21038 - DNA, 20 bp, synthetic construct
  misc_feature 1..20: note = CRISPR gRNA sequence
  source 1..20: mol_type = other DNA
ccggaatcggagccaccatg

SEQ ID NO: 21039 - DNA, 20 bp, synthetic construct
  misc_feature 1..20: note = CRISPR gRNA sequence
  source 1..20: mol_type = other DNA
tctaactttggcaggaagtc

SEQ ID NO: 21040 - DNA, 20 bp, synthetic construct
  misc_feature 1..20: note = CRISPR gRNA sequence
  source 1..20: mol_type = other DNA
taaataaatacttctccgga

SEQ ID NO: 21041 - DNA, 20 bp, synthetic construct
  misc_feature 1..20: note = CRISPR gRNA sequence
  source 1..20: mol_type = other DNA
cctggtctccaacaatctca

SEQ ID NO: 21042 - DNA, 20 bp, synthetic construct
  misc_feature 1..20: note = CRISPR gRNA sequence
  source 1..20: mol_type = other DNA
ctatcccaggtgactccaat

SEQ ID NO: 21043 - DNA, 20 bp, synthetic construct
  misc_feature 1..20: note = CRISPR gRNA sequence
  source 1..20: mol_type = other DNA
atcagaaaaggagtaccagg

SEQ ID NO: 21044 - DNA, 20 bp, synthetic construct
  misc_feature 1..20: note = CRISPR gRNA sequence
  source 1..20: mol_type = other DNA
aaaaggagtaccaggaggtg

SEQ ID NO: 21045 - DNA, 20 bp, synthetic construct
  misc_feature 1..20: note = CRISPR gRNA sequence
  source 1..20: mol_type = other DNA
gagtaccaggaggtgttttg

SEQ ID NO: 21046 - DNA, 20 bp, synthetic construct
  misc_feature 1..20: note = CRISPR gRNA sequence
  source 1..20: mol_type = other DNA
ccaggaggtgttttgttttg

SEQ ID NO: 21047 - DNA, 20 bp, synthetic construct
  misc_feature 1..20: note = CRISPR gRNA sequence
  source 1..20: mol_type = other DNA
ttgcttaacgccacatagca

SEQ ID NO: 21048 - DNA, 20 bp, synthetic construct
  misc_feature 1..20: note = CRISPR gRNA sequence
  source 1..20: mol_type = other DNA
atagcaagcagtttgcagac

SEQ ID NO: 21049 - DNA, 20 bp, synthetic construct
  misc_feature 1..20: note = CRISPR gRNA sequence
  source 1..20: mol_type = other DNA
tacccagtctgtctgatggc

SEQ ID NO: 21050 - DNA, 20 bp, synthetic construct
  misc_feature 1..20: note = CRISPR gRNA sequence
  source 1..20: mol_type = other DNA
agtctgtctgatggctgggg

SEQ ID NO: 21051 - DNA, 20 bp, synthetic construct
  misc_feature 1..20: note = CRISPR gRNA sequence
  source 1..20: mol_type = other DNA
agaaattaacccaaggaaac

SEQ ID NO: 21052 - DNA, 20 bp, synthetic construct
  misc_feature 1..20: note = CRISPR gRNA sequence
  source 1..20: mol_type = other DNA
aggaaacttctggacttagc

SEQ ID NO: 21053 - DNA, 20 bp, synthetic construct
  misc_feature 1..20: note = CRISPR gRNA sequence
  source 1..20: mol_type = other DNA
ctgtaaaatggataaaacat

SEQ ID NO: 21054 - DNA, 20 bp, synthetic construct
  misc_feature 1..20: note = CRISPR gRNA sequence
  source 1..20: mol_type = other DNA
aaaatggataaaacatgaga

SEQ ID NO: 21055 - DNA, 20 bp, synthetic construct
  misc_feature 1..20: note = CRISPR gRNA sequence
  source 1..20: mol_type = other DNA
aataattattatagatccta

SEQ ID NO: 21056 - DNA, 20 bp, synthetic construct
  misc_feature 1..20: note = CRISPR gRNA sequence
  source 1..20: mol_type = other DNA
attattatagatcctaaagg

SEQ ID NO: 21057 - DNA, 20 bp, synthetic construct
  misc_feature 1..20: note = CRISPR gRNA sequence
  source 1..20: mol_type = other DNA
cactttgggaggccgaggcg

SEQ ID NO: 21058 - DNA, 20 bp, synthetic construct
  misc_feature 1..20: note = CRISPR gRNA sequence
  source 1..20: mol_type = other DNA
ttgggaggccgaggcgggtg

SEQ ID NO: 21059 - DNA, 20 bp, synthetic construct
  misc_feature 1..20: note = CRISPR gRNA sequence
  source 1..20: mol_type = other DNA
aactctactaaaacactttt

SEQ ID NO: 21060 - DNA, 20 bp, synthetic construct
  misc_feature 1..20: note = CRISPR gRNA sequence
  source 1..20: mol_type = other DNA
aatcacttgaacccaagagg

SEQ ID NO: 21061 - DNA, 20 bp, synthetic construct
  misc_feature 1..20: note = CRISPR gRNA sequence
  source 1..20: mol_type = other DNA
aggtggaggttacccgagag

SEQ ID NO: 21062 - DNA, 20 bp, synthetic construct
  misc_feature 1..20: note = CRISPR gRNA sequence
  source 1..20: mol_type = other DNA
gaggaaagcataggcagatg

SEQ ID NO: 21063 - DNA, 20 bp, synthetic construct
  misc_feature 1..20: note = CRISPR gRNA sequence
  source 1..20: mol_type = other DNA
cagaaaggggcattagttac

SEQ ID NO: 21064 - DNA, 20 bp, synthetic construct
  misc_feature 1..20: note = CRISPR gRNA sequence
  source 1..20: mol_type = other DNA
attctcataggaaggacata

SEQ ID NO: 21065 - DNA, 20 bp, synthetic construct
  misc_feature 1..20: note = CRISPR gRNA sequence
  source 1..20: mol_type = other DNA
taggaaggacatagatagtt

SEQ ID NO: 21066 - DNA, 20 bp, synthetic construct
  misc_feature 1..20: note = CRISPR gRNA sequence
  source 1..20: mol_type = other DNA
tctgacatcaaggacaaagt

SEQ ID NO: 21067 - DNA, 20 bp, synthetic construct
  misc_feature 1..20: note = CRISPR gRNA sequence
  source 1..20: mol_type = other DNA
acaaagtctctgattttccc

SEQ ID NO: 21068 - DNA, 20 bp, synthetic construct
  misc_feature 1..20: note = CRISPR gRNA sequence
  source 1..20: mol_type = other DNA
cctgatgtttgacagtgccc

SEQ ID NO: 21069 - DNA, 20 bp, synthetic construct
  misc_feature 1..20: note = CRISPR gRNA sequence
  source 1..20: mol_type = other DNA
tgacagtgccctaatgcttg

SEQ ID NO: 21070 - DNA, 20 bp, synthetic construct
  misc_feature 1..20: note = CRISPR gRNA sequence
  source 1..20: mol_type = other DNA
ttaacaaagtggtaaagaag

SEQ ID NO: 21071 - DNA, 20 bp, synthetic construct
  misc_feature 1..20: note = CRISPR gRNA sequence
  source 1..20: mol_type = other DNA
agctgagattattttagtaa

SEQ ID NO: 21072 - DNA, 20 bp, synthetic construct
  misc_feature 1..20: note = CRISPR gRNA sequence
  source 1..20: mol_type = other DNA
tttcaaccacaagtgatact

SEQ ID NO: 21073 - DNA, 20 bp, synthetic construct
  misc_feature 1..20: note = CRISPR gRNA sequence
  source 1..20: mol_type = other DNA
accacaagtgatactgttgg

SEQ ID NO: 21074 - DNA, 20 bp, synthetic construct
  misc_feature 1..20: note = CRISPR gRNA sequence
  source 1..20: mol_type = other DNA
aagtgatactgttggtttgg

SEQ ID NO: 21075 - DNA, 20 bp, synthetic construct
  misc_feature 1..20: note = CRISPR gRNA sequence
  source 1..20: mol_type = other DNA
ctgttggtttggttttgctt

SEQ ID NO: 21076 - DNA, 20 bp, synthetic construct
  misc_feature 1..20: note = CRISPR gRNA sequence
  source 1..20: mol_type = other DNA
ttccgtttatacatggaaaa

SEQ ID NO: 21077 - DNA, 20 bp, synthetic construct
  misc_feature 1..20: note = CRISPR gRNA sequence
  source 1..20: mol_type = other DNA
gtaactccaacttcctgtct

SEQ ID NO: 21078 - DNA, 20 bp, synthetic construct
  misc_feature 1..20: note = CRISPR gRNA sequence
  source 1..20: mol_type = other DNA
gtgatatttgtctttttgtg

SEQ ID NO: 21079 - DNA, 20 bp, synthetic construct
  misc_feature 1..20: note = CRISPR gRNA sequence
  source 1..20: mol_type = other DNA
ggacaaatatctgtctgact

SEQ ID NO: 21080 - DNA, 20 bp, synthetic construct
  misc_feature 1..20: note = CRISPR gRNA sequence
  source 1..20: mol_type = other DNA
actccccgctttcaactcta

SEQ ID NO: 21081 - DNA, 20 bp, synthetic construct
  misc_feature 1..20: note = CRISPR gRNA sequence
  source 1..20: mol_type = other DNA
ttcttttaaaatcggtctat

SEQ ID NO: 21082 - DNA, 20 bp, synthetic construct
  misc_feature 1..20: note = CRISPR gRNA sequence
  source 1..20: mol_type = other DNA
aaagatggaagacgaatgcc

SEQ ID NO: 21083 - DNA, 20 bp, synthetic construct
  misc_feature 1..20: note = CRISPR gRNA sequence
  source 1..20: mol_type = other DNA
ttgggaggtcaaggcaggat

SEQ ID NO: 21084 - DNA, 20 bp, synthetic construct
  misc_feature 1..20: note = CRISPR gRNA sequence
  source 1..20: mol_type = other DNA
taaaaataaatttttgaaaa

SEQ ID NO: 21085 - DNA, 20 bp, synthetic construct
  misc_feature 1..20: note = CRISPR gRNA sequence
  source 1..20: mol_type = other DNA
aatcgcctgaacccaggagg

SEQ ID NO: 21086 - DNA, 20 bp, synthetic construct
  misc_feature 1..20: note = CRISPR gRNA sequence
  source 1..20: mol_type = other DNA
tcaaaaaaaatgaaagaaaa

SEQ ID NO: 21087 - DNA, 20 bp, synthetic construct
  misc_feature 1..20: note = CRISPR gRNA sequence
  source 1..20: mol_type = other DNA
tgggggtgaggcccaggacg

SEQ ID NO: 21088 - DNA, 20 bp, synthetic construct
  misc_feature 1..20: note = CRISPR gRNA sequence
  source 1..20: mol_type = other DNA
gtcaggactggagtgtgggg

SEQ ID NO: 21089 - DNA, 20 bp, synthetic construct
  misc_feature 1..20: note = CRISPR gRNA sequence
  source 1..20: mol_type = other DNA
agctggagatgatggcccat

SEQ ID NO: 21090 - DNA, 20 bp, synthetic construct
  misc_feature 1..20: note = CRISPR gRNA sequence
  source 1..20: mol_type = other DNA
gatgatggcccattcgagtt

SEQ ID NO: 21091 - DNA, 20 bp, synthetic construct
  misc_feature 1..20: note = CRISPR gRNA sequence
  source 1..20: mol_type = other DNA
atcgggacccagagaagata

SEQ ID NO: 21092 - DNA, 20 bp, synthetic construct
  misc_feature 1..20: note = CRISPR gRNA sequence
  source 1..20: mol_type = other DNA
ggtgtcttttgtggggtcct

SEQ ID NO: 21093 - DNA, 20 bp, synthetic construct
  misc_feature 1..20: note = CRISPR gRNA sequence
  source 1..20: mol_type = other DNA
atagaagtaagttgtctcag

SEQ ID NO: 21094 - DNA, 20 bp, synthetic construct
  misc_feature 1..20: note = CRISPR gRNA sequence
  source 1..20: mol_type = other DNA
ctgggaagccaagtaggaga

SEQ ID NO: 21095 - DNA, 20 bp, synthetic construct
  misc_feature 1..20: note = CRISPR gRNA sequence
  source 1..20: mol_type = other DNA
gagatggagatttgcatata

SEQ ID NO: 21096 - DNA, 20 bp, synthetic construct
  misc_feature 1..20: note = CRISPR gRNA sequence
  source 1..20: mol_type = other DNA
catcattattacccaaggtc

SEQ ID NO: 21097 - DNA, 20 bp, synthetic construct
  misc_feature 1..20: note = CRISPR gRNA sequence
  source 1..20: mol_type = other DNA
attattacccaaggtccatg

SEQ ID NO: 21098 - DNA, 20 bp, synthetic construct
  misc_feature 1..20: note = CRISPR gRNA sequence
  source 1..20: mol_type = other DNA
ggtccatggtttgtttacat

SEQ ID NO: 21099 - DNA, 20 bp, synthetic construct
  misc_feature 1..20: note = CRISPR gRNA sequence
  source 1..20: mol_type = other DNA
ctcttggtgttgtacattct

SEQ ID NO: 21100 - DNA, 20 bp, synthetic construct
  misc_feature 1..20: note = CRISPR gRNA sequence
  source 1..20: mol_type = other DNA
cagactcatttcacttgtga

SEQ ID NO: 21101 - DNA, 20 bp, synthetic construct
  misc_feature 1..20: note = CRISPR gRNA sequence
  source 1..20: mol_type = other DNA
ctgctgagaagccctttggc

SEQ ID NO: 21102 - DNA, 20 bp, synthetic construct
  misc_feature 1..20: note = CRISPR gRNA sequence
  source 1..20: mol_type = other DNA
agggattgcagccaatttta

SEQ ID NO: 21103 - DNA, 20 bp, synthetic construct
  misc_feature 1..20: note = CRISPR gRNA sequence
  source 1..20: mol_type = other DNA
actttcctgctctgaagtta

SEQ ID NO: 21104 - DNA, 20 bp, synthetic construct
  misc_feature 1..20: note = CRISPR gRNA sequence
  source 1..20: mol_type = other DNA
tttgcatcccacagttccca

SEQ ID NO: 21105 - DNA, 20 bp, synthetic construct
  misc_feature 1..20: note = CRISPR gRNA sequence
  source 1..20: mol_type = other DNA
atcttttatttctgaagaga

SEQ ID NO: 21106 - DNA, 20 bp, synthetic construct
  misc_feature 1..20: note = CRISPR gRNA sequence
  source 1..20: mol_type = other DNA
ctcctcagcctcccaaagtg

SEQ ID NO: 21107 - DNA, 20 bp, synthetic construct
  misc_feature 1..20: note = CRISPR gRNA sequence
  source 1..20: mol_type = other DNA
ggattacaggtgtgatctca

SEQ ID NO: 21108 - DNA, 20 bp, synthetic construct
  misc_feature 1..20: note = CRISPR gRNA sequence
  source 1..20: mol_type = other DNA
caccccagatgctgcaactt

SEQ ID NO: 21109 - DNA, 20 bp, synthetic construct
  misc_feature 1..20: note = CRISPR gRNA sequence
  source 1..20: mol_type = other DNA
tccttctctgtgtggaactg

SEQ ID NO: 21110 - DNA, 20 bp, synthetic construct
  misc_feature 1..20: note = CRISPR gRNA sequence
  source 1..20: mol_type = other DNA
tctatatagagacattgtga

SEQ ID NO: 21111 - DNA, 20 bp, synthetic construct
  misc_feature 1..20: note = CRISPR gRNA sequence
  source 1..20: mol_type = other DNA
ttagacacacacacacttat

SEQ ID NO: 21112 - DNA, 20 bp, synthetic construct
  misc_feature 1..20: note = CRISPR gRNA sequence
  source 1..20: mol_type = other DNA
caaaacaaataggcctatcg

SEQ ID NO: 21113 - DNA, 20 bp, synthetic construct
  misc_feature 1..20: note = CRISPR gRNA sequence
  source 1..20: mol_type = other DNA
gcctatcgactggattcaac

SEQ ID NO: 21114 - DNA, 20 bp, synthetic construct
  misc_feature 1..20: note = CRISPR gRNA sequence
  source 1..20: mol_type = other DNA
aagcccctgtggcacagctg

SEQ ID NO: 21115 - DNA, 20 bp, synthetic construct
  misc_feature 1..20: note = CRISPR gRNA sequence
  source 1..20: mol_type = other DNA
gaggagcttgcaggtcagaa

SEQ ID NO: 21116 - DNA, 20 bp, synthetic construct
  misc_feature 1..20: note = CRISPR gRNA sequence
  source 1..20: mol_type = other DNA
gacaaatgatcagatcctgc

SEQ ID NO: 21117 - DNA, 20 bp, synthetic construct
  misc_feature 1..20: note = CRISPR gRNA sequence
  source 1..20: mol_type = other DNA
attgcagtgttgctacatgc

SEQ ID NO: 21118 - DNA, 20 bp, synthetic construct
  misc_feature 1..20: note = CRISPR gRNA sequence
  source 1..20: mol_type = other DNA
tgaaagtcttgagtgagacc

SEQ ID NO: 21119 - DNA, 20 bp, synthetic construct
  misc_feature 1..20: note = CRISPR gRNA sequence
  source 1..20: mol_type = other DNA
gttctcctgggatatctaca

SEQ ID NO: 21120 - DNA, 20 bp, synthetic construct
  misc_feature 1..20: note = CRISPR gRNA sequence
  source 1..20: mol_type = other DNA
aaacagcaggctggagagtg

SEQ ID NO: 21121 - DNA, 20 bp, synthetic construct
  misc_feature 1..20: note = CRISPR gRNA sequence
  source 1..20: mol_type = other DNA
gcctgtggggtggcaagagc

SEQ ID NO: 21122 - DNA, 20 bp, synthetic construct
  misc_feature 1..20: note = CRISPR gRNA sequence
  source 1..20: mol_type = other DNA
gtggggtggcaagagcagag

SEQ ID NO: 21123 - DNA, 20 bp, synthetic construct
  misc_feature 1..20: note = CRISPR gRNA sequence
  source 1..20: mol_type = other DNA
acctcaccccatgaatcctc

SEQ ID NO: 21124 - DNA, 20 bp, synthetic construct
  misc_feature 1..20: note = CRISPR gRNA sequence
  source 1..20: mol_type = other DNA
caacccctgggcctttaaac

SEQ ID NO: 21125 - DNA, 20 bp, synthetic construct
  misc_feature 1..20: note = CRISPR gRNA sequence
  source 1..20: mol_type = other DNA
ctatgatctttggttcacat

SEQ ID NO: 21126 - DNA, 20 bp, synthetic construct
  misc_feature 1..20: note = CRISPR gRNA sequence
  source 1..20: mol_type = other DNA
aatgcatttcaggtgtatct

SEQ ID NO: 21127 - DNA, 20 bp, synthetic construct
  misc_feature 1..20: note = CRISPR gRNA sequence
  source 1..20: mol_type = other DNA
tttgtatgtgctcttataaa

SEQ ID NO: 21128 - DNA, 20 bp, synthetic construct
  misc_feature 1..20: note = CRISPR gRNA sequence
  source 1..20: mol_type = other DNA
gtctcactctgtcacccagg

SEQ ID NO: 21129 - DNA, 20 bp, synthetic construct
  misc_feature 1..20: note = CRISPR gRNA sequence
  source 1..20: mol_type = other DNA
ttttctatttttagtagaga

SEQ ID NO: 21130 - DNA, 20 bp, synthetic construct
  misc_feature 1..20: note = CRISPR gRNA sequence
  source 1..20: mol_type = other DNA
tgcgagtcaccacgcctggc

SEQ ID NO: 21131 - DNA, 20 bp, synthetic construct
  misc_feature 1..20: note = CRISPR gRNA sequence
  source 1..20: mol_type = other DNA
tcttacttttgcattctgta

SEQ ID NO: 21132 - DNA, 20 bp, synthetic construct
  misc_feature 1..20: note = CRISPR gRNA sequence
  source 1..20: mol_type = other DNA
atgtttttaggatctacttg

SEQ ID NO: 21133 - DNA, 20 bp, synthetic construct
  misc_feature 1..20: note = CRISPR gRNA sequence
  source 1..20: mol_type = other DNA
ttgcttctgatgcatttgat

SEQ ID NO: 21134 - DNA, 20 bp, synthetic construct
  misc_feature 1..20: note = CRISPR gRNA sequence
  source 1..20: mol_type = other DNA
tacagtatcaagtgtcactt

SEQ ID NO: 21135 - DNA, 20 bp, synthetic construct
  misc_feature 1..20: note = CRISPR gRNA sequence
  source 1..20: mol_type = other DNA
tcactttgctgttttatttt

SEQ ID NO: 21136 - DNA, 20 bp, synthetic construct
  misc_feature 1..20: note = CRISPR gRNA sequence
  source 1..20: mol_type = other DNA
gcactgtgccaacaaaatgc

SEQ ID NO: 21137 - DNA, 20 bp, synthetic construct
  misc_feature 1..20: note = CRISPR gRNA sequence
  source 1..20: mol_type = other DNA
gtcacacagcaagtgtggaa

SEQ ID NO: 21138 - DNA, 20 bp, synthetic construct
  misc_feature 1..20: note = CRISPR gRNA sequence
  source 1..20: mol_type = other DNA
ccttaaccactatgctatta

SEQ ID NO: 21139 - DNA, 20 bp, synthetic construct
  misc_feature 1..20: note = CRISPR gRNA sequence
  source 1..20: mol_type = other DNA
ttacggggtgctcagtgaat

SEQ ID NO: 21140 - DNA, 20 bp, synthetic construct
  misc_feature 1..20: note = CRISPR gRNA sequence
  source 1..20: mol_type = other DNA
tgctcagtgaatcattgttt

SEQ ID NO: 21141 - DNA, 20 bp, synthetic construct
  misc_feature 1..20: note = CRISPR gRNA sequence
  source 1..20: mol_type = other DNA
ctttagaggggaaaagtgag

SEQ ID NO: 21142 - DNA, 20 bp, synthetic construct
  misc_feature 1..20: note = CRISPR gRNA sequence
  source 1..20: mol_type = other DNA
gaaaagtgagagatgtttct

SEQ ID NO: 21143 - DNA, 20 bp, synthetic construct
  misc_feature 1..20: note = CRISPR gRNA sequence
  source 1..20: mol_type = other DNA
agctactacccccacaaaga

SEQ ID NO: 21144 - DNA, 20 bp, synthetic construct
  misc_feature 1..20: note = CRISPR gRNA sequence
  source 1..20: mol_type = other DNA
tagataggcattcctaggcc

SEQ ID NO: 21145 - DNA, 20 bp, synthetic construct
  misc_feature 1..20: note = CRISPR gRNA sequence
  source 1..20: mol_type = other DNA
aacaccatttggcccccgga

SEQ ID NO: 21146 - DNA, 20 bp, synthetic construct
  misc_feature 1..20: note = CRISPR gRNA sequence
  source 1..20: mol_type = other DNA
gagtagggaagtattccttc

SEQ ID NO: 21147 - DNA, 20 bp, synthetic construct
  misc_feature 1..20: note = CRISPR gRNA sequence
  source 1..20: mol_type = other DNA
tgcctcagcctcccaagtag

SEQ ID NO: 21148 - DNA, 20 bp, synthetic construct
  misc_feature 1..20: note = CRISPR gRNA sequence
  source 1..20: mol_type = other DNA
tttttgtatttttgcagaga

SEQ ID NO: 21149 - DNA, 20 bp, synthetic construct
  misc_feature 1..20: note = CRISPR gRNA sequence
  source 1..20: mol_type = other DNA
agcctcggcctctcaaagtg

SEQ ID NO: 21150 - DNA, 20 bp, synthetic construct
  misc_feature 1..20: note = CRISPR gRNA sequence
  source 1..20: mol_type = other DNA
tcacagttcagagcagtgct

SEQ ID NO: 21151 - DNA, 20 bp, synthetic construct
  misc_feature 1..20: note = CRISPR gRNA sequence
  source 1..20: mol_type = other DNA
ataaggaaactgaggctcca

SEQ ID NO: 21152 - DNA, 20 bp, synthetic construct
  misc_feature 1..20: note = CRISPR gRNA sequence
  source 1..20: mol_type = other DNA
tggtttaaaaaatgaactta

SEQ ID NO: 21153 - DNA, 20 bp, synthetic construct
  misc_feature 1..20: note = CRISPR gRNA sequence
  source 1..20: mol_type = other DNA
gatgcatgcactgatcttca

SEQ ID NO: 21154 - DNA, 20 bp, synthetic construct
  misc_feature 1..20: note = CRISPR gRNA sequence
  source 1..20: mol_type = other DNA
agttagaacattgtggcgac

SEQ ID NO: 21155 - DNA, 20 bp, synthetic construct
  misc_feature 1..20: note = CRISPR gRNA sequence
  source 1..20: mol_type = other DNA
ggtgaattgttatttcagac

SEQ ID NO: 21156 - DNA, 20 bp, synthetic construct
  misc_feature 1..20: note = CRISPR gRNA sequence
  source 1..20: mol_type = other DNA
ggtggtggcccagggggaag

SEQ ID NO: 21157 - DNA, 20 bp, synthetic construct
  misc_feature 1..20: note = CRISPR gRNA sequence
  source 1..20: mol_type = other DNA
gggctgagactttggagatg

SEQ ID NO: 21158 - DNA, 20 bp, synthetic construct
  misc_feature 1..20: note = CRISPR gRNA sequence
  source 1..20: mol_type = other DNA
cctccatcccgctctggcaa

SEQ ID NO: 21159 - DNA, 20 bp, synthetic construct
  misc_feature 1..20: note = CRISPR gRNA sequence
  source 1..20: mol_type = other DNA
ggatagaggaaggtcccatg

SEQ ID NO: 21160 - DNA, 20 bp, synthetic construct
  misc_feature 1..20: note = CRISPR gRNA sequence
  source 1..20: mol_type = other DNA
ctagagtcttgggcctgaat

SEQ ID NO: 21161 - DNA, 20 bp, synthetic construct
  misc_feature 1..20: note = CRISPR gRNA sequence
  source 1..20: mol_type = other DNA
ctttgacaccctctaatgta

SEQ ID NO: 21162 - DNA, 20 bp, synthetic construct
  misc_feature 1..20: note = CRISPR gRNA sequence
  source 1..20: mol_type = other DNA
gtaatgggcttcctttgact

SEQ ID NO: 21163 - DNA, 20 bp, synthetic construct
  misc_feature 1..20: note = CRISPR gRNA sequence
  source 1..20: mol_type = other DNA
tgatcctgcaggacaatctt

SEQ ID NO: 21164 - DNA, 20 bp, synthetic construct
  misc_feature 1..20: note = CRISPR gRNA sequence
  source 1..20: mol_type = other DNA
gcaggacaatcttttttgtt

SEQ ID NO: 21165 - DNA, 20 bp, synthetic construct
  misc_feature 1..20: note = CRISPR gRNA sequence
  source 1..20: mol_type = other DNA
aatcttttttgttttttgtt

SEQ ID NO: 21166 - DNA, 20 bp, synthetic construct
  misc_feature 1..20: note = CRISPR gRNA sequence
  source 1..20: mol_type = other DNA
agcctctgcctcccaggttc

SEQ ID NO: 21167 - DNA, 20 bp, synthetic construct
  misc_feature 1..20: note = CRISPR gRNA sequence
  source 1..20: mol_type = other DNA
tgcctcagcctcccaagtag

SEQ ID NO: 21168 - DNA, 20 bp, synthetic construct
  misc_feature 1..20: note = CRISPR gRNA sequence
  source 1..20: mol_type = other DNA
attttgtatttttagtagag

SEQ ID NO: 21169 - DNA, 20 bp, synthetic construct
  misc_feature 1..20: note = CRISPR gRNA sequence
  source 1..20: mol_type = other DNA
actctaccctgccttttccc

SEQ ID NO: 21170 - DNA, 20 bp, synthetic construct
  misc_feature 1..20: note = CRISPR gRNA sequence
  source 1..20: mol_type = other DNA
atccttgatcacccaagagg

SEQ ID NO: 21171 - DNA, 20 bp, synthetic construct
  misc_feature 1..20: note = CRISPR gRNA sequence
  source 1..20: mol_type = other DNA
caagaggaagtgcttaaggt

SEQ ID NO: 21172 - DNA, 20 bp, synthetic construct
  misc_feature 1..20: note = CRISPR gRNA sequence
  source 1..20: mol_type = other DNA
ggggcgctgaaatgtgtatt

SEQ ID NO: 21173 - DNA, 20 bp, synthetic construct
  misc_feature 1..20: note = CRISPR gRNA sequence
  source 1..20: mol_type = other DNA
tgtattgggggcttctggga

SEQ ID NO: 21174 - DNA, 20 bp, synthetic construct
  misc_feature 1..20: note = CRISPR gRNA sequence
  source 1..20: mol_type = other DNA
atgcacatcaccacgcccag

SEQ ID NO: 21175 - DNA, 20 bp, synthetic construct
  misc_feature 1..20: note = CRISPR gRNA sequence
  source 1..20: mol_type = other DNA
ttttgtgttatttgtagaga

SEQ ID NO: 21176 - DNA, 20 bp, synthetic construct
  misc_feature 1..20: note = CRISPR gRNA sequence
  source 1..20: mol_type = other DNA
ttatgcaaaagaacagaaag

SEQ ID NO: 21177 - DNA, 20 bp, synthetic construct
  misc_feature 1..20: note = CRISPR gRNA sequence
  source 1..20: mol_type = other DNA
gaacagaaagctcggcttca

SEQ ID NO: 21178 - DNA, 20 bp, synthetic construct
  misc_feature 1..20: note = CRISPR gRNA sequence
  source 1..20: mol_type = other DNA
acttctgttcattcagcact

SEQ ID NO: 21179 - DNA, 20 bp, synthetic construct
  misc_feature 1..20: note = CRISPR gRNA sequence
  source 1..20: mol_type = other DNA
atatggaaactgaggctcca

SEQ ID NO: 21180 - DNA, 20 bp, synthetic construct
  misc_feature 1..20: note = CRISPR gRNA sequence
  source 1..20: mol_type = other DNA
ctcaatttatttctctgact

SEQ ID NO: 21181 - DNA, 20 bp, synthetic construct
  misc_feature 1..20: note = CRISPR gRNA sequence
  source 1..20: mol_type = other DNA
aaccacacagcagtgtcatc

SEQ ID NO: 21182 - DNA, 20 bp, synthetic construct
  misc_feature 1..20: note = CRISPR gRNA sequence
  source 1..20: mol_type = other DNA
ctgtgataccacctgtgtct

SEQ ID NO: 21183 - DNA, 20 bp, synthetic construct
  misc_feature 1..20: note = CRISPR gRNA sequence
  source 1..20: mol_type = other DNA
tgcagagtgaaggaaagagg

SEQ ID NO: 21184 - DNA, 20 bp, synthetic construct
  misc_feature 1..20: note = CRISPR gRNA sequence
  source 1..20: mol_type = other DNA
cccaatgccctgtgagaaaa

SEQ ID NO: 21185 - DNA, 20 bp, synthetic construct
  misc_feature 1..20: note = CRISPR gRNA sequence
  source 1..20: mol_type = other DNA
tcacactgcctcaaagagga

SEQ ID NO: 21186 - DNA, 20 bp, synthetic construct
  misc_feature 1..20: note = CRISPR gRNA sequence
  source 1..20: mol_type = other DNA
ttttctcactgctctgagag

SEQ ID NO: 21187 - DNA, 20 bp, synthetic construct
  misc_feature 1..20: note = CRISPR gRNA sequence
  source 1..20: mol_type = other DNA
catctcacccccaaccatct

SEQ ID NO: 21188 - DNA, 20 bp, synthetic construct
  misc_feature 1..20: note = CRISPR gRNA sequence
  source 1..20: mol_type = other DNA
gcggtggccccatctttcag

SEQ ID NO: 21189 - DNA, 20 bp, synthetic construct
  misc_feature 1..20: note = CRISPR gRNA sequence
  source 1..20: mol_type = other DNA
gggatctcgctgcaagccgg

SEQ ID NO: 21190 - DNA, 20 bp, synthetic construct
  misc_feature 1..20: note = CRISPR gRNA sequence
  source 1..20: mol_type = other DNA
caagtgggcccagccagtgc

SEQ ID NO: 21191 - DNA, 20 bp, synthetic construct
  misc_feature 1..20: note = CRISPR gRNA sequence
  source 1..20: mol_type = other DNA
ttgggaggttgaagcaggag

SEQ ID NO: 21192 - DNA, 20 bp, synthetic construct
  misc_feature 1..20: note = CRISPR gRNA sequence
  source 1..20: mol_type = other DNA
gaggcagaggttgcagtgag

SEQ ID NO: 21193 - DNA, 20 bp, synthetic construct
  misc_feature 1..20: note = CRISPR gRNA sequence
  source 1..20: mol_type = other DNA
aatggggtggcaagttgagt

SEQ ID NO: 21194 - DNA, 20 bp, synthetic construct
  misc_feature 1..20: note = CRISPR gRNA sequence
  source 1..20: mol_type = other DNA
agttgagtgtgtgttttctc

SEQ ID NO: 21195 - DNA, 20 bp, synthetic construct
  misc_feature 1..20: note = CRISPR gRNA sequence
  source 1..20: mol_type = other DNA
taggagcctccctctggtct

SEQ ID NO: 21196 - DNA, 20 bp, synthetic construct
  misc_feature 1..20: note = CRISPR gRNA sequence
  source 1..20: mol_type = other DNA
tacctcctccaggaagctcc

SEQ ID NO: 21197 - DNA, 20 bp, synthetic construct
  misc_feature 1..20: note = CRISPR gRNA sequence
  source 1..20: mol_type = other DNA
aatcccagcactttgggaag

SEQ ID NO: 21198 - DNA, 20 bp, synthetic construct
  misc_feature 1..20: note = CRISPR gRNA sequence
  source 1..20: mol_type = other DNA
tcaggagactggggcaggag

SEQ ID NO: 21199 - DNA, 20 bp, synthetic construct
  misc_feature 1..20: note = CRISPR gRNA sequence
  source 1..20: mol_type = other DNA
agatcttgaaatgacatcat

SEQ ID NO: 21200 - DNA, 20 bp, synthetic construct
  misc_feature 1..20: note = CRISPR gRNA sequence
  source 1..20: mol_type = other DNA
aggtgatgtggccactaaag

SEQ ID NO: 21201 - DNA, 20 bp, synthetic construct
  misc_feature 1..20: note = CRISPR gRNA sequence
  source 1..20: mol_type = other DNA
cagcgtggccctgctgacac

SEQ ID NO: 21202 - DNA, 20 bp, synthetic construct
  misc_feature 1..20: note = CRISPR gRNA sequence
  source 1..20: mol_type = other DNA
gagctacctggatgctggta

SEQ ID NO: 21203 - DNA, 20 bp, synthetic construct
  misc_feature 1..20: note = CRISPR gRNA sequence
  source 1..20: mol_type = other DNA
tagagccacacagatgagcc

SEQ ID NO: 21204 - DNA, 20 bp, synthetic construct
  misc_feature 1..20: note = CRISPR gRNA sequence
  source 1..20: mol_type = other DNA
ccacacagatgagccttcag

SEQ ID NO: 21205 - DNA, 20 bp, synthetic construct
  misc_feature 1..20: note = CRISPR gRNA sequence
  source 1..20: mol_type = other DNA
gagctacatgatcttgagga

SEQ ID NO: 21206 - DNA, 20 bp, synthetic construct
  misc_feature 1..20: note = CRISPR gRNA sequence
  source 1..20: mol_type = other DNA
tcatctgccaatggagacaa

SEQ ID NO: 21207 - DNA, 20 bp, synthetic construct
  misc_feature 1..20: note = CRISPR gRNA sequence
  source 1..20: mol_type = other DNA
gagacaataatgcttacttc

SEQ ID NO: 21208 - DNA, 20 bp, synthetic construct
  misc_feature 1..20: note = CRISPR gRNA sequence
  source 1..20: mol_type = other DNA
atgcttacttcctaggtttt

SEQ ID NO: 21209 - DNA, 20 bp, synthetic construct
  misc_feature 1..20: note = CRISPR gRNA sequence
  source 1..20: mol_type = other DNA
caggcggatcacttgaggtc

SEQ ID NO: 21210 - DNA, 20 bp, synthetic construct
  misc_feature 1..20: note = CRISPR gRNA sequence
  source 1..20: mol_type = other DNA
tcaggaggctgaggcagaag

SEQ ID NO: 21211 - DNA, 20 bp, synthetic construct
  misc_feature 1..20: note = CRISPR gRNA sequence
  source 1..20: mol_type = other DNA
gaggcagacgttgcagtgag

SEQ ID NO: 21212 - DNA, 20 bp, synthetic construct
  misc_feature 1..20: note = CRISPR gRNA sequence
  source 1..20: mol_type = other DNA
caagccctaggcaaccacta

SEQ ID NO: 21213 - DNA, 20 bp, synthetic construct
  misc_feature 1..20: note = CRISPR gRNA sequence
  source 1..20: mol_type = other DNA
ttaaaaaaaaattaatagag

SEQ ID NO: 21214 - DNA, 20 bp, synthetic construct
  misc_feature 1..20: note = CRISPR gRNA sequence
  source 1..20: mol_type = other DNA
ggtcttgaacacctgggctc

SEQ ID NO: 21215 - DNA, 20 bp, synthetic construct
  misc_feature 1..20: note = CRISPR gRNA sequence
  source 1..20: mol_type = other DNA
tgtctcagcctcccaaagtg

SEQ ID NO: 21216 - DNA, 20 bp, synthetic construct
  misc_feature 1..20: note = CRISPR gRNA sequence
  source 1..20: mol_type = other DNA
cccctcctactttatgtctc

SEQ ID NO: 21217 - DNA, 20 bp, synthetic construct
  misc_feature 1..20: note = CRISPR gRNA sequence
  source 1..20: mol_type = other DNA
ctttatgtctccatggattt

SEQ ID NO: 21218 - DNA, 20 bp, synthetic construct
  misc_feature 1..20: note = CRISPR gRNA sequence
  source 1..20: mol_type = other DNA
acaatatgtgaccctttgtg

SEQ ID NO: 21219 - DNA, 20 bp, synthetic construct
  misc_feature 1..20: note = CRISPR gRNA sequence
  source 1..20: mol_type = other DNA
atccatgttccagcatgtat

SEQ ID NO: 21220 - DNA, 20 bp, synthetic construct
  misc_feature 1..20: note = CRISPR gRNA sequence
  source 1..20: mol_type = other DNA
tattgtatagataagcaaca

SEQ ID NO: 21221 - DNA, 20 bp, synthetic construct
  misc_feature 1..20: note = CRISPR gRNA sequence
  source 1..20: mol_type = other DNA
tattttttggtggatatttg

SEQ ID NO: 21222 - DNA, 20 bp, synthetic construct
  misc_feature 1..20: note = CRISPR gRNA sequence
  source 1..20: mol_type = other DNA
ccttctgtgaacattcgtgt

SEQ ID NO: 21223 - DNA, 20 bp, synthetic construct
  misc_feature 1..20: note = CRISPR gRNA sequence
  source 1..20: mol_type = other DNA
taggtttttgtgtggatata

SEQ ID NO: 21224 - DNA, 20 bp, synthetic construct
  misc_feature 1..20: note = CRISPR gRNA sequence
  source 1..20: mol_type = other DNA
gtgtggatatatctggtttt

SEQ ID NO: 21225 - DNA, 20 bp, synthetic construct
  misc_feature 1..20: note = CRISPR gRNA sequence
  source 1..20: mol_type = other DNA
atctggtttttcttgttttc

SEQ ID NO: 21226 - DNA, 20 bp, synthetic construct
  misc_feature 1..20: note = CRISPR gRNA sequence
  source 1..20: mol_type = other DNA
gatatttgaggtatccacat

SEQ ID NO: 21227 - DNA, 20 bp, synthetic construct
  misc_feature 1..20: note = CRISPR gRNA sequence
  source 1..20: mol_type = other DNA
tttgaggtatccacatttgg

SEQ ID NO: 21228 - DNA, 20 bp, synthetic construct
  misc_feature 1..20: note = CRISPR gRNA sequence
  source 1..20: mol_type = other DNA
tatccacatttgggattgtt

SEQ ID NO: 21229 - DNA, 20 bp, synthetic construct
  misc_feature 1..20: note = CRISPR gRNA sequence
  source 1..20: mol_type = other DNA
ttagaatctgctcagactcc

SEQ ID NO: 21230 - DNA, 20 bp, synthetic construct
  misc_feature 1..20: note = CRISPR gRNA sequence
  source 1..20: mol_type = other DNA
aatcctggttccacttggac

SEQ ID NO: 21231 - DNA, 20 bp, synthetic construct
  misc_feature 1..20: note = CRISPR gRNA sequence
  source 1..20: mol_type = other DNA
atcacttcacctctctgagc

SEQ ID NO: 21232 - DNA, 20 bp, synthetic construct
  misc_feature 1..20: note = CRISPR gRNA sequence
  source 1..20: mol_type = other DNA
tcatgtgcctggcgtatagg

SEQ ID NO: 21233 - DNA, 20 bp, synthetic construct
  misc_feature 1..20: note = CRISPR gRNA sequence
  source 1..20: mol_type = other DNA
gggtctcctgactctctggt

SEQ ID NO: 21234 - DNA, 20 bp, synthetic construct
  misc_feature 1..20: note = CRISPR gRNA sequence
  source 1..20: mol_type = other DNA
agttccttggaggaagggaa

SEQ ID NO: 21235 - DNA, 20 bp, synthetic construct
  misc_feature 1..20: note = CRISPR gRNA sequence
  source 1..20: mol_type = other DNA
gcatataagaggtgctgaat

SEQ ID NO: 21236 - DNA, 20 bp, synthetic construct
  misc_feature 1..20: note = CRISPR gRNA sequence
  source 1..20: mol_type = other DNA
gcccctagaaggtggctacc

SEQ ID NO: 21237 - DNA, 20 bp, synthetic construct
  misc_feature 1..20: note = CRISPR gRNA sequence
  source 1..20: mol_type = other DNA
gatggacctggctggagaag

SEQ ID NO: 21238 - DNA, 20 bp, synthetic construct
  misc_feature 1..20: note = CRISPR gRNA sequence
  source 1..20: mol_type = other DNA
tcttccggtatcccccaccc

SEQ ID NO: 21239 - DNA, 20 bp, synthetic construct
  misc_feature 1..20: note = CRISPR gRNA sequence
  source 1..20: mol_type = other DNA
gaaggtgatgaagagaccag

SEQ ID NO: 21240 - DNA, 20 bp, synthetic construct
  misc_feature 1..20: note = CRISPR gRNA sequence
  source 1..20: mol_type = other DNA
accaccaagaaaacaaaatc

SEQ ID NO: 21241 - DNA, 20 bp, synthetic construct
  misc_feature 1..20: note = CRISPR gRNA sequence
  source 1..20: mol_type = other DNA
acctccatttctatacgcat

SEQ ID NO: 21242 - DNA, 20 bp, synthetic construct
  misc_feature 1..20: note = CRISPR gRNA sequence
  source 1..20: mol_type = other DNA
caacaaaggaaatacatatt

SEQ ID NO: 21243 - DNA, 20 bp, synthetic construct
  misc_feature 1..20: note = CRISPR gRNA sequence
  source 1..20: mol_type = other DNA
tcttttacaaatgaggaaat

SEQ ID NO: 21244 - DNA, 20 bp, synthetic construct
  misc_feature 1..20: note = CRISPR gRNA sequence
  source 1..20: mol_type = other DNA
agagaggtgaaacgacctac

SEQ ID NO: 21245 - DNA, 20 bp, synthetic construct
  misc_feature 1..20: note = CRISPR gRNA sequence
  source 1..20: mol_type = other DNA
gaaattctaacctaggtctt

SEQ ID NO: 21246 - DNA, 20 bp, synthetic construct
  misc_feature 1..20: note = CRISPR gRNA sequence
  source 1..20: mol_type = other DNA
aaaagaaagtgtctggggtt

SEQ ID NO: 21247 - DNA, 20 bp, synthetic construct
  misc_feature 1..20: note = CRISPR gRNA sequence
  source 1..20: mol_type = other DNA
tctggggttggaagatttgc

SEQ ID NO: 21248 - DNA, 20 bp, synthetic construct
  misc_feature 1..20: note = CRISPR gRNA sequence
  source 1..20: mol_type = other DNA
tttgtagccttaagaagagc

SEQ ID NO: 21249 - DNA, 20 bp, synthetic construct
  misc_feature 1..20: note = CRISPR gRNA sequence
  source 1..20: mol_type = other DNA
gtggtggtggtgttgctgct

SEQ ID NO: 21250 - DNA, 20 bp, synthetic construct
  misc_feature 1..20: note = CRISPR gRNA sequence
  source 1..20: mol_type = other DNA
tggtggtgttgctgctagtg

SEQ ID NO: 21251 - DNA, 20 bp, synthetic construct
  misc_feature 1..20: note = CRISPR gRNA sequence
  source 1..20: mol_type = other DNA
tgcagcccctaccaggaagt

SEQ ID NO: 21252 - DNA, 20 bp, synthetic construct
  misc_feature 1..20: note = CRISPR gRNA sequence
  source 1..20: mol_type = other DNA
gtcctgcccccattttcctt

SEQ ID NO: 21253 - DNA, 20 bp, synthetic construct
  misc_feature 1..20: note = CRISPR gRNA sequence
  source 1..20: mol_type = other DNA
aacagcagcattcagcagtt

SEQ ID NO: 21254 - DNA, 20 bp, synthetic construct
  misc_feature 1..20: note = CRISPR gRNA sequence
  source 1..20: mol_type = other DNA
tggaggggactagtaattgt

SEQ ID NO: 21255 - DNA, 20 bp, synthetic construct
  misc_feature 1..20: note = CRISPR gRNA sequence
  source 1..20: mol_type = other DNA
gtttcagaaattacagaact

SEQ ID NO: 21256 - DNA, 20 bp, synthetic construct
  misc_feature 1..20: note = CRISPR gRNA sequence
  source 1..20: mol_type = other DNA
aattacagaactgagagctt

SEQ ID NO: 21257 - DNA, 20 bp, synthetic construct
  misc_feature 1..20: note = CRISPR gRNA sequence
  source 1..20: mol_type = other DNA
tgactgcttccttcccttcc

SEQ ID NO: 21258 - DNA, 20 bp, synthetic construct
  misc_feature 1..20: note = CRISPR gRNA sequence
  source 1..20: mol_type = other DNA
gatttacatgggggaagcag

SEQ ID NO: 21259 - DNA, 20 bp, synthetic construct
  misc_feature 1..20: note = CRISPR gRNA sequence
  source 1..20: mol_type = other DNA
tcacaactggaggcagtcat

SEQ ID NO: 21260 - DNA, 20 bp, synthetic construct
  misc_feature 1..20: note = CRISPR gRNA sequence
  source 1..20: mol_type = other DNA
attaaggatttgggcatgtc

SEQ ID NO: 21261 - DNA, 20 bp, synthetic construct
  misc_feature 1..20: note = CRISPR gRNA sequence
  source 1..20: mol_type = other DNA
ttgggcatgtcataggattt

SEQ ID NO: 21262 - DNA, 20 bp, synthetic construct
  misc_feature 1..20: note = CRISPR gRNA sequence
  source 1..20: mol_type = other DNA
cagtgcgttagtccattttt

SEQ ID NO: 21263 - DNA, 20 bp, synthetic construct
  misc_feature 1..20: note = CRISPR gRNA sequence
  source 1..20: mol_type = other DNA
gtgtggggcatcacgaggca

SEQ ID NO: 21264 - DNA, 20 bp, synthetic construct
  misc_feature 1..20: note = CRISPR gRNA sequence
  source 1..20: mol_type = other DNA
gacaacccattaacttatta

SEQ ID NO: 21265 - DNA, 20 bp, synthetic construct
  misc_feature 1..20: note = CRISPR gRNA sequence
  source 1..20: mol_type = other DNA
tgtttatccactaatccatg

SEQ ID NO: 21266 - DNA, 20 bp, synthetic construct
  misc_feature 1..20: note = CRISPR gRNA sequence
  source 1..20: mol_type = other DNA
acctctcaatactgccacat

SEQ ID NO: 21267 - DNA, 20 bp, synthetic construct
  misc_feature 1..20: note = CRISPR gRNA sequence
  source 1..20: mol_type = other DNA
ataggggattacatttatac

SEQ ID NO: 21268 - DNA, 20 bp, synthetic construct
  misc_feature 1..20: note = CRISPR gRNA sequence
  source 1..20: mol_type = other DNA
caaacattcacgtcataaca

SEQ ID NO: 21269 - DNA, 20 bp, synthetic construct
  misc_feature 1..20: note = CRISPR gRNA sequence
  source 1..20: mol_type = other DNA
caagtctgctcctcaagtct

SEQ ID NO: 21270 - DNA, 20 bp, synthetic construct
  misc_feature 1..20: note = CRISPR gRNA sequence
  source 1..20: mol_type = other DNA
ctcaagtctgtgggttttct

SEQ ID NO: 21271 - DNA, 20 bp, synthetic construct
  misc_feature 1..20: note = CRISPR gRNA sequence
  source 1..20: mol_type = other DNA
gcagcatcctgaaatatgac

SEQ ID NO: 21272 - DNA, 20 bp, synthetic construct
  misc_feature 1..20: note = CRISPR gRNA sequence
  source 1..20: mol_type = other DNA
agaagccttctatggctccc

SEQ ID NO: 21273 - DNA, 20 bp, synthetic construct
  misc_feature 1..20: note = CRISPR gRNA sequence
  source 1..20: mol_type = other DNA
taccaccgtcacctatctct

SEQ ID NO: 21274 - DNA, 20 bp, synthetic construct
  misc_feature 1..20: note = CRISPR gRNA sequence
  source 1..20: mol_type = other DNA
gtttcctaaacatactctga

SEQ ID NO: 21275 - DNA, 20 bp, synthetic construct
  misc_feature 1..20: note = CRISPR gRNA sequence
  source 1..20: mol_type = other DNA
cccttcctccaggaagcctt

SEQ ID NO: 21276 - DNA, 20 bp, synthetic construct
  misc_feature 1..20: note = CRISPR gRNA sequence
  source 1..20: mol_type = other DNA
gtagaacctctaattatcac

SEQ ID NO: 21277 - DNA, 20 bp, synthetic construct
  misc_feature 1..20: note = CRISPR gRNA sequence
  source 1..20: mol_type = other DNA
acagtggttaaataagtagc

SEQ ID NO: 21278 - DNA, 20 bp, synthetic construct
  misc_feature 1..20: note = CRISPR gRNA sequence
  source 1..20: mol_type = other DNA
gctcttctttgtagcagtag

SEQ ID NO: 21279 - DNA, 20 bp, synthetic construct
  misc_feature 1..20: note = CRISPR gRNA sequence
  source 1..20: mol_type = other DNA
catggatacatacctcatcc

SEQ ID NO: 21280 - DNA, 20 bp, synthetic construct
  misc_feature 1..20: note = CRISPR gRNA sequence
  source 1..20: mol_type = other DNA
atacatacctcatccttttg

SEQ ID NO: 21281 - DNA, 20 bp, synthetic construct
  misc_feature 1..20: note = CRISPR gRNA sequence
  source 1..20: mol_type = other DNA
tggagtgtcagtgttcattc

SEQ ID NO: 21282 - DNA, 20 bp, synthetic construct
  misc_feature 1..20: note = CRISPR gRNA sequence
  source 1..20: mol_type = other DNA
gtgggccttcagttagacct

SEQ ID NO: 21283 - DNA, 20 bp, synthetic construct
  misc_feature 1..20: note = CRISPR gRNA sequence
  source 1..20: mol_type = other DNA
agttagaccttgttgattga

SEQ ID NO: 21284 - DNA, 20 bp, synthetic construct
  misc_feature 1..20: note = CRISPR gRNA sequence
  source 1..20: mol_type = other DNA
cctgagcaaggacattttca

SEQ ID NO: 21285 - DNA, 20 bp, synthetic construct
  misc_feature 1..20: note = CRISPR gRNA sequence
  source 1..20: mol_type = other DNA
gggtacaatagagactcacc

SEQ ID NO: 21286 - DNA, 20 bp, synthetic construct
  misc_feature 1..20: note = CRISPR gRNA sequence
  source 1..20: mol_type = other DNA
agagactcaccttgggcttt

SEQ ID NO: 21287 - DNA, 20 bp, synthetic construct
  misc_feature 1..20: note = CRISPR gRNA sequence
  source 1..20: mol_type = other DNA
attgattgtgtgagttggtc

SEQ ID NO: 21288 - DNA, 20 bp, synthetic construct
  misc_feature 1..20: note = CRISPR gRNA sequence
  source 1..20: mol_type = other DNA
ccctccctgatccaacctag

SEQ ID NO: 21289 - DNA, 20 bp, synthetic construct
  misc_feature 1..20: note = CRISPR gRNA sequence
  source 1..20: mol_type = other DNA
caaagcctgctgtgggtcca

SEQ ID NO: 21290 - DNA, 20 bp, synthetic construct
  misc_feature 1..20: note = CRISPR gRNA sequence
  source 1..20: mol_type = other DNA
acaggagccttaaaatgtac

SEQ ID NO: 21291 - DNA, 20 bp, synthetic construct
  misc_feature 1..20: note = CRISPR gRNA sequence
  source 1..20: mol_type = other DNA
gacaccacacttcagccacc

SEQ ID NO: 21292 - DNA, 20 bp, synthetic construct
  misc_feature 1..20: note = CRISPR gRNA sequence
  source 1..20: mol_type = other DNA
cttctctgaccatccttcca

SEQ ID NO: 21293 - DNA, 20 bp, synthetic construct
  misc_feature 1..20: note = CRISPR gRNA sequence
  source 1..20: mol_type = other DNA
accttgtgtgtctttttcct

SEQ ID NO: 21294 - DNA, 20 bp, synthetic construct
  misc_feature 1..20: note = CRISPR gRNA sequence
  source 1..20: mol_type = other DNA
accttgtctttcttgctcgt

SEQ ID NO: 21295 - DNA, 20 bp, synthetic construct
  misc_feature 1..20: note = CRISPR gRNA sequence
  source 1..20: mol_type = other DNA
aggtgaatcgcacacagggt

SEQ ID NO: 21296 - DNA, 20 bp, synthetic construct
  misc_feature 1..20: note = CRISPR gRNA sequence
  source 1..20: mol_type = other DNA
cggctcacacctgtaatccc

SEQ ID NO: 21297 - DNA, 20 bp, synthetic construct
  misc_feature 1..20: note = CRISPR gRNA sequence
  source 1..20: mol_type = other DNA
gggacggatcacttgaggtc

SEQ ID NO: 21298 - DNA, 20 bp, synthetic construct
  misc_feature 1..20: note = CRISPR gRNA sequence
  source 1..20: mol_type = other DNA
tcgggaggctgaggcaggag

SEQ ID NO: 21299 - DNA, 20 bp, synthetic construct
  misc_feature 1..20: note = CRISPR gRNA sequence
  source 1..20: mol_type = other DNA
ccactcctgttctgtagtcc

SEQ ID NO: 21300 - DNA, 20 bp, synthetic construct
  misc_feature 1..20: note = CRISPR gRNA sequence
  source 1..20: mol_type = other DNA
tatcttagtcaacctatgtg

SEQ ID NO: 21301 - DNA, 20 bp, synthetic construct
  misc_feature 1..20: note = CRISPR gRNA sequence
  source 1..20: mol_type = other DNA
gaaataaagcgagctcctgt

SEQ ID NO: 21302 - DNA, 20 bp, synthetic construct
  misc_feature 1..20: note = CRISPR gRNA sequence
  source 1..20: mol_type = other DNA
tttatttacactattctgca

SEQ ID NO: 21303 - DNA, 20 bp, synthetic construct
  misc_feature 1..20: note = CRISPR gRNA sequence
  source 1..20: mol_type = other DNA
gaggacacggtcctatcttc

SEQ ID NO: 21304 - DNA, 20 bp, synthetic construct
  misc_feature 1..20: note = CRISPR gRNA sequence
  source 1..20: mol_type = other DNA
cttctttattttctttcttt

SEQ ID NO: 21305 - DNA, 20 bp, synthetic construct
  misc_feature 1..20: note = CRISPR gRNA sequence
  source 1..20: mol_type = other DNA
tcttttcttgtttttcttct

SEQ ID NO: 21306 - DNA, 20 bp, synthetic construct
  misc_feature 1..20: note = CRISPR gRNA sequence
  source 1..20: mol_type = other DNA
catttgataaatatttcccc

SEQ ID NO: 21307 - DNA, 20 bp, synthetic construct
  misc_feature 1..20: note = CRISPR gRNA sequence
  source 1..20: mol_type = other DNA
tccccccaagattttattgt

SEQ ID NO: 21308 - DNA, 20 bp, synthetic construct
  misc_feature 1..20: note = CRISPR gRNA sequence
  source 1..20: mol_type = other DNA
ctggcagatcacctgaggtc

SEQ ID NO: 21309 - DNA, 20 bp, synthetic construct
  misc_feature 1..20: note = CRISPR gRNA sequence
  source 1..20: mol_type = other DNA
cagggaggctagggtgggag

SEQ ID NO: 21310 - DNA, 20 bp, synthetic construct
  misc_feature 1..20: note = CRISPR gRNA sequence
  source 1..20: mol_type = other DNA
gaagcagaggttgcagtgag

SEQ ID NO: 21311 - DNA, 20 bp, synthetic construct
  misc_feature 1..20: note = CRISPR gRNA sequence
  source 1..20: mol_type = other DNA
gcctgggcaacagagctaga

SEQ ID NO: 21312 - DNA, 20 bp, synthetic construct
  misc_feature 1..20: note = CRISPR gRNA sequence
  source 1..20: mol_type = other DNA
tctgtttcaaaaaaaaaaaa

SEQ ID NO: 21313 - DNA, 20 bp, synthetic construct
  misc_feature 1..20: note = CRISPR gRNA sequence
  source 1..20: mol_type = other DNA
catatacccaccatgtacca

SEQ ID NO: 21314 - DNA, 20 bp, synthetic construct
  misc_feature 1..20: note = CRISPR gRNA sequence
  source 1..20: mol_type = other DNA
ttttgattctacaattaatg

SEQ ID NO: 21315 - DNA, 20 bp, synthetic construct
  misc_feature 1..20: note = CRISPR gRNA sequence
  source 1..20: mol_type = other DNA
tgtacatttcaaatgtaaat

SEQ ID NO: 21316 - DNA, 20 bp, synthetic construct
  misc_feature 1..20: note = CRISPR gRNA sequence
  source 1..20: mol_type = other DNA
tcctttcttttaaggccatg

SEQ ID NO: 21317 - DNA, 20 bp, synthetic construct
  misc_feature 1..20: note = CRISPR gRNA sequence
  source 1..20: mol_type = other DNA
cgttgggtagatgaaccata

SEQ ID NO: 21318 - DNA, 20 bp, synthetic construct
  misc_feature 1..20: note = CRISPR gRNA sequence
  source 1..20: mol_type = other DNA
agtcccttgctaagggacac

SEQ ID NO: 21319 - DNA, 20 bp, synthetic construct
  misc_feature 1..20: note = CRISPR gRNA sequence
  source 1..20: mol_type = other DNA
ggtttttaatctgttgctgt

SEQ ID NO: 21320 - DNA, 20 bp, synthetic construct
  misc_feature 1..20: note = CRISPR gRNA sequence
  source 1..20: mol_type = other DNA
gtgagtgcttgatactcact

SEQ ID NO: 21321 - DNA, 20 bp, synthetic construct
  misc_feature 1..20: note = CRISPR gRNA sequence
  source 1..20: mol_type = other DNA
agcggttcaaaagcaggttc

SEQ ID NO: 21322 - DNA, 20 bp, synthetic construct
  misc_feature 1..20: note = CRISPR gRNA sequence
  source 1..20: mol_type = other DNA
ttcaaaagcaggttcctttg

SEQ ID NO: 21323 - DNA, 20 bp, synthetic construct
  misc_feature 1..20: note = CRISPR gRNA sequence
  source 1..20: mol_type = other DNA
aagcaggttcctttgttttg

SEQ ID NO: 21324 - DNA, 20 bp, synthetic construct
  misc_feature 1..20: note = CRISPR gRNA sequence
  source 1..20: mol_type = other DNA
ggttcctttgttttgttttg

SEQ ID NO: 21325 - DNA, 20 bp, synthetic construct
  misc_feature 1..20: note = CRISPR gRNA sequence
  source 1..20: mol_type = other DNA
tctgctgctacactgcctgg

SEQ ID NO: 21326 - DNA, 20 bp, synthetic construct
  misc_feature 1..20: note = CRISPR gRNA sequence
  source 1..20: mol_type = other DNA
ctgcctggtatggtttgaga

SEQ ID NO: 21327 - DNA, 20 bp, synthetic construct
  misc_feature 1..20: note = CRISPR gRNA sequence
  source 1..20: mol_type = other DNA
tgctagagtcctgagcccct

SEQ ID NO: 21328 - DNA, 20 bp, synthetic construct
  misc_feature 1..20: note = CRISPR gRNA sequence
  source 1..20: mol_type = other DNA
tctccctggggcagctgatc

SEQ ID NO: 21329 - DNA, 20 bp, synthetic construct
  misc_feature 1..20: note = CRISPR gRNA sequence
  source 1..20: mol_type = other DNA
tttctctgcagccttcccag

SEQ ID NO: 21330 - DNA, 20 bp, synthetic construct
  misc_feature 1..20: note = CRISPR gRNA sequence
  source 1..20: mol_type = other DNA
atgccttggggaggggatgg

SEQ ID NO: 21331 - DNA, 20 bp, synthetic construct
  misc_feature 1..20: note = CRISPR gRNA sequence
  source 1..20: mol_type = other DNA
cccttctttgggtagaggct

SEQ ID NO: 21332 - DNA, 20 bp, synthetic construct
  misc_feature 1..20: note = CRISPR gRNA sequence
  source 1..20: mol_type = other DNA
gagtcctctaaggggctcac

SEQ ID NO: 21333 - DNA, 20 bp, synthetic construct
  misc_feature 1..20: note = CRISPR gRNA sequence
  source 1..20: mol_type = other DNA
gactgtttgtggaaggtggt

SEQ ID NO: 21334 - DNA, 20 bp, synthetic construct
  misc_feature 1..20: note = CRISPR gRNA sequence
  source 1..20: mol_type = other DNA
ggtggtaggggcttggagct

SEQ ID NO: 21335 - DNA, 20 bp, synthetic construct
  misc_feature 1..20: note = CRISPR gRNA sequence
  source 1..20: mol_type = other DNA
gatgcgcctggagaaaaccg

SEQ ID NO: 21336 - DNA, 20 bp, synthetic construct
  misc_feature 1..20: note = CRISPR gRNA sequence
  source 1..20: mol_type = other DNA
accagattcccagtatgtta

SEQ ID NO: 21337 - DNA, 20 bp, synthetic construct
  misc_feature 1..20: note = CRISPR gRNA sequence
  source 1..20: mol_type = other DNA
tgttagggggcttggagaga

SEQ ID NO: 21338 - DNA, 20 bp, synthetic construct
  misc_feature 1..20: note = CRISPR gRNA sequence
  source 1..20: mol_type = other DNA
tgtcactcacctctgcccca

SEQ ID NO: 21339 - DNA, 20 bp, synthetic construct
  misc_feature 1..20: note = CRISPR gRNA sequence
  source 1..20: mol_type = other DNA
gaatctccctgagggaccca

SEQ ID NO: 21340 - DNA, 20 bp, synthetic construct
  misc_feature 1..20: note = CRISPR gRNA sequence
  source 1..20: mol_type = other DNA
caaaaatcaaagcagaagag

SEQ ID NO: 21341 - DNA, 20 bp, synthetic construct
  misc_feature 1..20: note = CRISPR gRNA sequence
  source 1..20: mol_type = other DNA
tggttgtgtggccttccata

SEQ ID NO: 21342 - DNA, 20 bp, synthetic construct
  misc_feature 1..20: note = CRISPR gRNA sequence
  source 1..20: mol_type = other DNA
gttgctttccccttctgacc

SEQ ID NO: 21343 - DNA, 20 bp, synthetic construct
  misc_feature 1..20: note = CRISPR gRNA sequence
  source 1..20: mol_type = other DNA
agtttttccttatttttttt

SEQ ID NO: 21344 - DNA, 20 bp, synthetic construct
  misc_feature 1..20: note = CRISPR gRNA sequence
  source 1..20: mol_type = other DNA
tccttattttttttaaatgt

SEQ ID NO: 21345 - DNA, 20 bp, synthetic construct
  misc_feature 1..20: note = CRISPR gRNA sequence
  source 1..20: mol_type = other DNA
actaataagctaatgacaag

SEQ ID NO: 21346 - DNA, 20 bp, synthetic construct
  misc_feature 1..20: note = CRISPR gRNA sequence
  source 1..20: mol_type = other DNA
tcttttagtatactgatgtg

SEQ ID NO: 21347 - DNA, 20 bp, synthetic construct
  misc_feature 1..20: note = CRISPR gRNA sequence
  source 1..20: mol_type = other DNA
tagtttggtgtgcatccttg

SEQ ID NO: 21348 - DNA, 20 bp, synthetic construct
  misc_feature 1..20: note = CRISPR gRNA sequence
  source 1..20: mol_type = other DNA
gtgcatccttgcatagcttt

SEQ ID NO: 21349 - DNA, 20 bp, synthetic construct
  misc_feature 1..20: note = CRISPR gRNA sequence
  source 1..20: mol_type = other DNA
gcatagctttctctgatttg

SEQ ID NO: 21350 - DNA, 20 bp, synthetic construct
  misc_feature 1..20: note = CRISPR gRNA sequence
  source 1..20: mol_type = other DNA
tgtgacttgtctcagggaag

SEQ ID NO: 21351 - DNA, 20 bp, synthetic construct
  misc_feature 1..20: note = CRISPR gRNA sequence
  source 1..20: mol_type = other DNA
tgtcagggatgagaccagga

SEQ ID NO: 21352 - DNA, 20 bp, synthetic construct
  misc_feature 1..20: note = CRISPR gRNA sequence
  source 1..20: mol_type = other DNA
gcatccattcctggttgcaa

SEQ ID NO: 21353 - DNA, 20 bp, synthetic construct
  misc_feature 1..20: note = CRISPR gRNA sequence
  source 1..20: mol_type = other DNA
tgagctaattgcacccattt

SEQ ID NO: 21354 - DNA, 20 bp, synthetic construct
  misc_feature 1..20: note = CRISPR gRNA sequence
  source 1..20: mol_type = other DNA
agacttcctgagctccacag

SEQ ID NO: 21355 - DNA, 20 bp, synthetic construct
  misc_feature 1..20: note = CRISPR gRNA sequence
  source 1..20: mol_type = other DNA
ccagccaagtaccccctccc

SEQ ID NO: 21356 - DNA, 20 bp, synthetic construct
  misc_feature 1..20: note = CRISPR gRNA sequence
  source 1..20: mol_type = other DNA
ctgcctgtagggacaacagg

SEQ ID NO: 21357 - DNA, 20 bp, synthetic construct
  misc_feature 1..20: note = CRISPR gRNA sequence
  source 1..20: mol_type = other DNA
aaatacagccatcagccttc

SEQ ID NO: 21358 - DNA, 20 bp, synthetic construct
  misc_feature 1..20: note = CRISPR gRNA sequence
  source 1..20: mol_type = other DNA
agatcttttgaagttgaaaa

SEQ ID NO: 21359 - DNA, 20 bp, synthetic construct
  misc_feature 1..20: note = CRISPR gRNA sequence
  source 1..20: mol_type = other DNA
ccctgatttttacatagata

SEQ ID NO: 21360 - DNA, 20 bp, synthetic construct
  misc_feature 1..20: note = CRISPR gRNA sequence
  source 1..20: mol_type = other DNA
aacctccgccctacaggttc

SEQ ID NO: 21361 - DNA, 20 bp, synthetic construct
  misc_feature 1..20: note = CRISPR gRNA sequence
  source 1..20: mol_type = other DNA
tttttgtaatttcagtagag

SEQ ID NO: 21362 - DNA, 20 bp, synthetic construct
  misc_feature 1..20: note = CRISPR gRNA sequence
  source 1..20: mol_type = other DNA
tgcctcgacctcccaaagtg

SEQ ID NO: 21363 - DNA, 20 bp, synthetic construct
  misc_feature 1..20: note = CRISPR gRNA sequence
  source 1..20: mol_type = other DNA
ccactgcacccagcctgata

SEQ ID NO: 21364 - DNA, 20 bp, synthetic construct
  misc_feature 1..20: note = CRISPR gRNA sequence
  source 1..20: mol_type = other DNA
accctcaccctaaatctggc

SEQ ID NO: 21365 - DNA, 20 bp, synthetic construct
  misc_feature 1..20: note = CRISPR gRNA sequence
  source 1..20: mol_type = other DNA
ggcagctggagaggtctcca

SEQ ID NO: 21366 - DNA, 20 bp, synthetic construct
  misc_feature 1..20: note = CRISPR gRNA sequence
  source 1..20: mol_type = other DNA
ggtggagatggaagcccata

SEQ ID NO: 21367 - DNA, 20 bp, synthetic construct
  misc_feature 1..20: note = CRISPR gRNA sequence
  source 1..20: mol_type = other DNA
attcattcattcattcactt

SEQ ID NO: 21368 - DNA, 20 bp, synthetic construct
  misc_feature 1..20: note = CRISPR gRNA sequence
  source 1..20: mol_type = other DNA
aagagaattactaaattact

SEQ ID NO: 21369 - DNA, 20 bp, synthetic construct
  misc_feature 1..20: note = CRISPR gRNA sequence
  source 1..20: mol_type = other DNA
tgctccagcaagtggtagaa

SEQ ID NO: 21370 - DNA, 20 bp, synthetic construct
  misc_feature 1..20: note = CRISPR gRNA sequence
  source 1..20: mol_type = other DNA
gagtagtgatcaagcgaaga

SEQ ID NO: 21371 - DNA, 20 bp, synthetic construct
  misc_feature 1..20: note = CRISPR gRNA sequence
  source 1..20: mol_type = other DNA
gaggtggaggttgccgtgag

SEQ ID NO: 21372 - DNA, 20 bp, synthetic construct
  misc_feature 1..20: note = CRISPR gRNA sequence
  source 1..20: mol_type = other DNA
cactttgggaggccaaggcg

SEQ ID NO: 21373 - DNA, 20 bp, synthetic construct
  misc_feature 1..20: note = CRISPR gRNA sequence
  source 1..20: mol_type = other DNA
ttgggaggccaaggcggaac

SEQ ID NO: 21374 - DNA, 20 bp, synthetic construct
  misc_feature 1..20: note = CRISPR gRNA sequence
  source 1..20: mol_type = other DNA
ctactcaggaggctgaggtg

SEQ ID NO: 21375 - DNA, 20 bp, synthetic construct
  misc_feature 1..20: note = CRISPR gRNA sequence
  source 1..20: mol_type = other DNA
tcaggaggctgaggtgggag

SEQ ID NO: 21376 - DNA, 20 bp, synthetic construct
  misc_feature 1..20: note = CRISPR gRNA sequence
  source 1..20: mol_type = other DNA
gaggttgaagctgtggtgga

SEQ ID NO: 21377 - DNA, 20 bp, synthetic construct
  misc_feature 1..20: note = CRISPR gRNA sequence
  source 1..20: mol_type = other DNA
ccggcggccgcgtgagacac

SEQ ID NO: 21378 - DNA, 20 bp, synthetic construct
  misc_feature 1..20: note = CRISPR gRNA sequence
  source 1..20: mol_type = other DNA
gctggggcagtgagccgggc

SEQ ID NO: 21379 - DNA, 20 bp, synthetic construct
  misc_feature 1..20: note = CRISPR gRNA sequence
  source 1..20: mol_type = other DNA
gagccgggcctgggcttgtg

SEQ ID NO: 21380 - DNA, 20 bp, synthetic construct
  misc_feature 1..20: note = CRISPR gRNA sequence
  source 1..20: mol_type = other DNA
ttgtcttctctgtcccctgc

SEQ ID NO: 21381 - DNA, 20 bp, synthetic construct
  misc_feature 1..20: note = CRISPR gRNA sequence
  source 1..20: mol_type = other DNA
cagccactcgtggcggccga

SEQ ID NO: 21382 - DNA, 20 bp, synthetic construct
  misc_feature 1..20: note = CRISPR gRNA sequence
  source 1..20: mol_type = other DNA
accgcgttctgctcatccta

SEQ ID NO: 21383 - DNA, 20 bp, synthetic construct
  misc_feature 1..20: note = CRISPR gRNA sequence
  source 1..20: mol_type = other DNA
tcgaggagctggaagcgcaa

SEQ ID NO: 21384 - DNA, 20 bp, synthetic construct
  misc_feature 1..20: note = CRISPR gRNA sequence
  source 1..20: mol_type = other DNA
ccgacgccctatttgagctg

SEQ ID NO: 21385 - DNA, 20 bp, synthetic construct
  misc_feature 1..20: note = CRISPR gRNA sequence
  source 1..20: mol_type = other DNA
ccagctctcagaggccctgc

SEQ ID NO: 21386 - DNA, 20 bp, synthetic construct
  misc_feature 1..20: note = CRISPR gRNA sequence
  source 1..20: mol_type = other DNA
tgaggacctgggcgatggcc

SEQ ID NO: 21387 - DNA, 20 bp, synthetic construct
  misc_feature 1..20: note = CRISPR gRNA sequence
  source 1..20: mol_type = other DNA
cagagtccgagctggccttc

SEQ ID NO: 21388 - DNA, 20 bp, synthetic construct
  misc_feature 1..20: note = CRISPR gRNA sequence
  source 1..20: mol_type = other DNA
ccttccccagcttcctcctg

SEQ ID NO: 21389 - DNA, 20 bp, synthetic construct
  misc_feature 1..20: note = CRISPR gRNA sequence
  source 1..20: mol_type = other DNA
acaactggctggagggcgtg

SEQ ID NO: 21390 - DNA, 20 bp, synthetic construct
  misc_feature 1..20: note = CRISPR gRNA sequence
  source 1..20: mol_type = other DNA
ctcggtggacaggaagcaga

SEQ ID NO: 21391 - DNA, 20 bp, synthetic construct
  misc_feature 1..20: note = CRISPR gRNA sequence
  source 1..20: mol_type = other DNA
gcagcactggcatttgcccc

SEQ ID NO: 21392 - DNA, 20 bp, synthetic construct
  misc_feature 1..20: note = CRISPR gRNA sequence
  source 1..20: mol_type = other DNA
tcgtgggactcagctgtgtc

SEQ ID NO: 21393 - DNA, 20 bp, synthetic construct
  misc_feature 1..20: note = CRISPR gRNA sequence
  source 1..20: mol_type = other DNA
cacccgtttcaggtggggtg

SEQ ID NO: 21394 - DNA, 20 bp, synthetic construct
  misc_feature 1..20: note = CRISPR gRNA sequence
  source 1..20: mol_type = other DNA
agagcagccgggtggggcag

SEQ ID NO: 21395 - DNA, 20 bp, synthetic construct
  misc_feature 1..20: note = CRISPR gRNA sequence
  source 1..20: mol_type = other DNA
tgagactgacctgggctcaa

SEQ ID NO: 21396 - DNA, 20 bp, synthetic construct
  misc_feature 1..20: note = CRISPR gRNA sequence
  source 1..20: mol_type = other DNA
tttccaccccctgagcacgc

SEQ ID NO: 21397 - DNA, 20 bp, synthetic construct
  misc_feature 1..20: note = CRISPR gRNA sequence
  source 1..20: mol_type = other DNA
ccaatcttctcagaacttga

SEQ ID NO: 21398 - DNA, 20 bp, synthetic construct
  misc_feature 1..20: note = CRISPR gRNA sequence
  source 1..20: mol_type = other DNA
tgaatctgattgtatcccat

SEQ ID NO: 21399 - DNA, 20 bp, synthetic construct
  misc_feature 1..20: note = CRISPR gRNA sequence
  source 1..20: mol_type = other DNA
atgaaggctaaattccttaa

SEQ ID NO: 21400 - DNA, 20 bp, synthetic construct
  misc_feature 1..20: note = CRISPR gRNA sequence
  source 1..20: mol_type = other DNA
tttcattaagtcggtctgca

SEQ ID NO: 21401 - DNA, 20 bp, synthetic construct
  misc_feature 1..20: note = CRISPR gRNA sequence
  source 1..20: mol_type = other DNA
tctgcaatctgcttgagcat

SEQ ID NO: 21402 - DNA, 20 bp, synthetic construct
  misc_feature 1..20: note = CRISPR gRNA sequence
  source 1..20: mol_type = other DNA
agcatttcagcttaatcgcc

SEQ ID NO: 21403 - DNA, 20 bp, synthetic construct
  misc_feature 1..20: note = CRISPR gRNA sequence
  source 1..20: mol_type = other DNA
tttcagcttaatcgccagag

SEQ ID NO: 21404 - DNA, 20 bp, synthetic construct
  misc_feature 1..20: note = CRISPR gRNA sequence
  source 1..20: mol_type = other DNA
attgtgccaataatttagca

SEQ ID NO: 21405 - DNA, 20 bp, synthetic construct
  misc_feature 1..20: note = CRISPR gRNA sequence
  source 1..20: mol_type = other DNA
taaaggctggagtggtcatg

SEQ ID NO: 21406 - DNA, 20 bp, synthetic construct
  misc_feature 1..20: note = CRISPR gRNA sequence
  source 1..20: mol_type = other DNA
gaaggatgtggaagacctgg

SEQ ID NO: 21407 - DNA, 20 bp, synthetic construct
  misc_feature 1..20: note = CRISPR gRNA sequence
  source 1..20: mol_type = other DNA
aggacatgtaggacccattc

SEQ ID NO: 21408 - DNA, 20 bp, synthetic construct
  misc_feature 1..20: note = CRISPR gRNA sequence
  source 1..20: mol_type = other DNA
aggtccagaaggcagacaaa

SEQ ID NO: 21409 - DNA, 20 bp, synthetic construct
  misc_feature 1..20: note = CRISPR gRNA sequence
  source 1..20: mol_type = other DNA
tcattcattccttcatcaca

SEQ ID NO: 21410 - DNA, 20 bp, synthetic construct
  misc_feature 1..20: note = CRISPR gRNA sequence
  source 1..20: mol_type = other DNA
ctagaatacagtagtgcgat

SEQ ID NO: 21411 - DNA, 20 bp, synthetic construct
  misc_feature 1..20: note = CRISPR gRNA sequence
  source 1..20: mol_type = other DNA
gtagtgcgatcatagcttac

SEQ ID NO: 21412 - DNA, 20 bp, synthetic construct
  misc_feature 1..20: note = CRISPR gRNA sequence
  source 1..20: mol_type = other DNA
tgcctcagcctcccaagtag

SEQ ID NO: 21413 - DNA, 20 bp, synthetic construct
  misc_feature 1..20: note = CRISPR gRNA sequence
  source 1..20: mol_type = other DNA
taggtgcacgtcatcacacc

SEQ ID NO: 21414 - DNA, 20 bp, synthetic construct
  misc_feature 1..20: note = CRISPR gRNA sequence
  source 1..20: mol_type = other DNA
tcatcacaccggatgatttt

SEQ ID NO: 21415 - DNA, 20 bp, synthetic construct
  misc_feature 1..20: note = CRISPR gRNA sequence
  source 1..20: mol_type = other DNA
tgttcgggacctaaagaaac

SEQ ID NO: 21416 - DNA, 20 bp, synthetic construct
  misc_feature 1..20: note = CRISPR gRNA sequence
  source 1..20: mol_type = other DNA
ggagtttgcgtaagcaaagg

SEQ ID NO: 21417 - DNA, 20 bp, synthetic construct
  misc_feature 1..20: note = CRISPR gRNA sequence
  source 1..20: mol_type = other DNA
gattgtcttgtgggtctgcg

SEQ ID NO: 21418 - DNA, 20 bp, synthetic construct
  misc_feature 1..20: note = CRISPR gRNA sequence
  source 1..20: mol_type = other DNA
ggtttcccctgcagcattag

SEQ ID NO: 21419 - DNA, 20 bp, synthetic construct
  misc_feature 1..20: note = CRISPR gRNA sequence
  source 1..20: mol_type = other DNA
ctcttgcccaccactttgga

SEQ ID NO: 21420 - DNA, 20 bp, synthetic construct
  misc_feature 1..20: note = CRISPR gRNA sequence
  source 1..20: mol_type = other DNA
gtgggcaaatgctggaggtt

SEQ ID NO: 21421 - DNA, 20 bp, synthetic construct
  misc_feature 1..20: note = CRISPR gRNA sequence
  source 1..20: mol_type = other DNA
ctcagatttgaagctaatgg

SEQ ID NO: 21422 - DNA, 20 bp, synthetic construct
  misc_feature 1..20: note = CRISPR gRNA sequence
  source 1..20: mol_type = other DNA
ggaggaggtgatatctgcac

SEQ ID NO: 21423 - DNA, 20 bp, synthetic construct
  misc_feature 1..20: note = CRISPR gRNA sequence
  source 1..20: mol_type = other DNA
agtggggagaggggagtaag

SEQ ID NO: 21424 - DNA, 20 bp, synthetic construct
  misc_feature 1..20: note = CRISPR gRNA sequence
  source 1..20: mol_type = other DNA
ctgcacaacgtcccttgtgc

SEQ ID NO: 21425 - DNA, 20 bp, synthetic construct
  misc_feature 1..20: note = CRISPR gRNA sequence
  source 1..20: mol_type = other DNA
acaacgtcccttgtgcctga

SEQ ID NO: 21426 - DNA, 20 bp, synthetic construct
  misc_feature 1..20: note = CRISPR gRNA sequence
  source 1..20: mol_type = other DNA
tcccccattttgaaattccc

SEQ ID NO: 21427 - DNA, 20 bp, synthetic construct
  misc_feature 1..20: note = CRISPR gRNA sequence
  source 1..20: mol_type = other DNA
ccctacttgcctgggactat

SEQ ID NO: 21428 - DNA, 20 bp, synthetic construct
  misc_feature 1..20: note = CRISPR gRNA sequence
  source 1..20: mol_type = other DNA
tatatttagatctgtcagaa

SEQ ID NO: 21429 - DNA, 20 bp, synthetic construct
  misc_feature 1..20: note = CRISPR gRNA sequence
  source 1..20: mol_type = other DNA
cttttcttctttttctttct

SEQ ID NO: 21430 - DNA, 20 bp, synthetic construct
  misc_feature 1..20: note = CRISPR gRNA sequence
  source 1..20: mol_type = other DNA
tttttgtattttttgtagag

SEQ ID NO: 21431 - DNA, 20 bp, synthetic construct
  misc_feature 1..20: note = CRISPR gRNA sequence
  source 1..20: mol_type = other DNA
cacctcagcctcccaaagtg

SEQ ID NO: 21432 - DNA, 20 bp, synthetic construct
  misc_feature 1..20: note = CRISPR gRNA sequence
  source 1..20: mol_type = other DNA
agctcccgcacctggccaga

SEQ ID NO: 21433 - DNA, 20 bp, synthetic construct
  misc_feature 1..20: note = CRISPR gRNA sequence
  source 1..20: mol_type = other DNA
gctgagaacaagagacttta

SEQ ID NO: 21434 - DNA, 20 bp, synthetic construct
  misc_feature 1..20: note = CRISPR gRNA sequence
  source 1..20: mol_type = other DNA
ttccacagaaaaagctaaat

SEQ ID NO: 21435 - DNA, 20 bp, synthetic construct
  misc_feature 1..20: note = CRISPR gRNA sequence
  source 1..20: mol_type = other DNA
tggtaggggtctagatcatc

SEQ ID NO: 21436 - DNA, 20 bp, synthetic construct
  misc_feature 1..20: note = CRISPR gRNA sequence
  source 1..20: mol_type = other DNA
tatgcctgtggtatattcgg

SEQ ID NO: 21437 - DNA, 20 bp, synthetic construct
  misc_feature 1..20: note = CRISPR gRNA sequence
  source 1..20: mol_type = other DNA
tgcctcagcctcccgagtag

SEQ ID NO: 21438 - DNA, 20 bp, synthetic construct
  misc_feature 1..20: note = CRISPR gRNA sequence
  source 1..20: mol_type = other DNA
tttttgtatttttagtagag

SEQ ID NO: 21439 - DNA, 20 bp, synthetic construct
  misc_feature 1..20: note = CRISPR gRNA sequence
  source 1..20: mol_type = other DNA
cacctcagcctcccaaagtg

SEQ ID NO: 21440 - DNA, 20 bp, synthetic construct
  misc_feature 1..20: note = CRISPR gRNA sequence
  source 1..20: mol_type = other DNA
tacaggtgtaagccaccatg

SEQ ID NO: 21441 - DNA, 20 bp, synthetic construct
  misc_feature 1..20: note = CRISPR gRNA sequence
  source 1..20: mol_type = other DNA
cccagaaaaaagccagtgtc

SEQ ID NO: 21442 - DNA, 20 bp, synthetic construct
  misc_feature 1..20: note = CRISPR gRNA sequence
  source 1..20: mol_type = other DNA
agactatttctggcattttc

SEQ ID NO: 21443 - DNA, 20 bp, synthetic construct
  misc_feature 1..20: note = CRISPR gRNA sequence
  source 1..20: mol_type = other DNA
cactcacaaccctacaggga

SEQ ID NO: 21444 - DNA, 20 bp, synthetic construct
  misc_feature 1..20: note = CRISPR gRNA sequence
  source 1..20: mol_type = other DNA
tccagccacagggcctcctt

SEQ ID NO: 21445 - DNA, 20 bp, synthetic construct
  misc_feature 1..20: note = CRISPR gRNA sequence
  source 1..20: mol_type = other DNA
gctggctttcaacctcctag

SEQ ID NO: 21446 - DNA, 20 bp, synthetic construct
  misc_feature 1..20: note = CRISPR gRNA sequence
  source 1..20: mol_type = other DNA
gccttttcttttctttcttt

SEQ ID NO: 21447 - DNA, 20 bp, synthetic construct
  misc_feature 1..20: note = CRISPR gRNA sequence
  source 1..20: mol_type = other DNA
aacctcctcctcccaagtcc

SEQ ID NO: 21448 - DNA, 20 bp, synthetic construct
  misc_feature 1..20: note = CRISPR gRNA sequence
  source 1..20: mol_type = other DNA
ttttgtatttttagtagaga

SEQ ID NO: 21449 - DNA, 20 bp, synthetic construct
  misc_feature 1..20: note = CRISPR gRNA sequence
  source 1..20: mol_type = other DNA
cacctcggcctcccaaagtg

SEQ ID NO: 21450 - DNA, 20 bp, synthetic construct
  misc_feature 1..20: note = CRISPR gRNA sequence
  source 1..20: mol_type = other DNA
ataaaactctggccaggcgc

SEQ ID NO: 21451 - DNA, 20 bp, synthetic construct
  misc_feature 1..20: note = CRISPR gRNA sequence
  source 1..20: mol_type = other DNA
ggcaggtggatcacaaggcc

SEQ ID NO: 21452 - DNA, 20 bp, synthetic construct
  misc_feature 1..20: note = CRISPR gRNA sequence
  source 1..20: mol_type = other DNA
ctgagatcacgccactgcag

SEQ ID NO: 21453 - DNA, 20 bp, synthetic construct
  misc_feature 1..20: note = CRISPR gRNA sequence
  source 1..20: mol_type = other DNA
cctcaccactgtatatttcc

SEQ ID NO: 21454 - DNA, 20 bp, synthetic construct
  misc_feature 1..20: note = CRISPR gRNA sequence
  source 1..20: mol_type = other DNA
tatgattcattgtctcagac

SEQ ID NO: 21455 - DNA, 20 bp, synthetic construct
  misc_feature 1..20: note = CRISPR gRNA sequence
  source 1..20: mol_type = other DNA
attcattgtctcagacatca

SEQ ID NO: 21456 - DNA, 20 bp, synthetic construct
  misc_feature 1..20: note = CRISPR gRNA sequence
  source 1..20: mol_type = other DNA
gtctcagacatcagcttgct

SEQ ID NO: 21457 - DNA, 20 bp, synthetic construct
  misc_feature 1..20: note = CRISPR gRNA sequence
  source 1..20: mol_type = other DNA
atcagcttgctttccgattt

SEQ ID NO: 21458 - DNA, 20 bp, synthetic construct
  misc_feature 1..20: note = CRISPR gRNA sequence
  source 1..20: mol_type = other DNA
gaatgtcagcacccagaagg

SEQ ID NO: 21459 - DNA, 20 bp, synthetic construct
  misc_feature 1..20: note = CRISPR gRNA sequence
  source 1..20: mol_type = other DNA
cccagaaggcagggattttc

SEQ ID NO: 21460 - DNA, 20 bp, synthetic construct
  misc_feature 1..20: note = CRISPR gRNA sequence
  source 1..20: mol_type = other DNA
gccttaatccaagaaccccc

SEQ ID NO: 21461 - DNA, 20 bp, synthetic construct
  misc_feature 1..20: note = CRISPR gRNA sequence
  source 1..20: mol_type = other DNA
gagatcaagacttaagggtg

SEQ ID NO: 21462 - DNA, 20 bp, synthetic construct
  misc_feature 1..20: note = CRISPR gRNA sequence
  source 1..20: mol_type = other DNA
gaggccagtgttctcagact

SEQ ID NO: 21463 - DNA, 20 bp, synthetic construct
  misc_feature 1..20: note = CRISPR gRNA sequence
  source 1..20: mol_type = other DNA
ttcgagtgaccgtgcgcggt

SEQ ID NO: 21464 - DNA, 20 bp, synthetic construct
  misc_feature 1..20: note = CRISPR gRNA sequence
  source 1..20: mol_type = other DNA
cgtgcgcggttactgttttt

SEQ ID NO: 21465 - DNA, 20 bp, synthetic construct
  misc_feature 1..20: note = CRISPR gRNA sequence
  source 1..20: mol_type = other DNA
gctatttgatcgcctagtgc

SEQ ID NO: 21466 - DNA, 20 bp, synthetic construct
  misc_feature 1..20: note = CRISPR gRNA sequence
  source 1..20: mol_type = other DNA
agggaagggcctagcatgcc

SEQ ID NO: 21467 - DNA, 20 bp, synthetic construct
  misc_feature 1..20: note = CRISPR gRNA sequence
  source 1..20: mol_type = other DNA
aaaggcatattagtcaacca

SEQ ID NO: 21468 - DNA, 20 bp, synthetic construct
  misc_feature 1..20: note = CRISPR gRNA sequence
  source 1..20: mol_type = other DNA
tacctctttttcttttcttt

SEQ ID NO: 21469 - DNA, 20 bp, synthetic construct
  misc_feature 1..20: note = CRISPR gRNA sequence
  source 1..20: mol_type = other DNA
ctccacctcctgggctcaag

SEQ ID NO: 21470 - DNA, 20 bp, synthetic construct
  misc_feature 1..20: note = CRISPR gRNA sequence
  source 1..20: mol_type = other DNA
ccaccacacttggctaatta

SEQ ID NO: 21471 - DNA, 20 bp, synthetic construct
  misc_feature 1..20: note = CRISPR gRNA sequence
  source 1..20: mol_type = other DNA
atgaaatctaccccaagcag

SEQ ID NO: 21472 - DNA, 20 bp, synthetic construct
  misc_feature 1..20: note = CRISPR gRNA sequence
  source 1..20: mol_type = other DNA
ctgggccctgtctcaggccc

SEQ ID NO: 21473 - DNA, 20 bp, synthetic construct
  misc_feature 1..20: note = CRISPR gRNA sequence
  source 1..20: mol_type = other DNA
gctacagtgcccagcaacct

SEQ ID NO: 21474 - DNA, 20 bp, synthetic construct
  misc_feature 1..20: note = CRISPR gRNA sequence
  source 1..20: mol_type = other DNA
ctctcagcaattcagctggg

SEQ ID NO: 21475 - DNA, 20 bp, synthetic construct
  misc_feature 1..20: note = CRISPR gRNA sequence
  source 1..20: mol_type = other DNA
taaggaagttgccaagcctc

SEQ ID NO: 21476 - DNA, 20 bp, synthetic construct
  misc_feature 1..20: note = CRISPR gRNA sequence
  source 1..20: mol_type = other DNA
ttagttcctaagaagctaaa

SEQ ID NO: 21477 - DNA, 20 bp, synthetic construct
  misc_feature 1..20: note = CRISPR gRNA sequence
  source 1..20: mol_type = other DNA
gacgctagctgatggccccc

SEQ ID NO: 21478 - DNA, 20 bp, synthetic construct
  misc_feature 1..20: note = CRISPR gRNA sequence
  source 1..20: mol_type = other DNA
ctttttcaaaattaatttaa

SEQ ID NO: 21479 - DNA, 20 bp, synthetic construct
  misc_feature 1..20: note = CRISPR gRNA sequence
  source 1..20: mol_type = other DNA
gcctcaaggaatctcctcac

SEQ ID NO: 21480 - DNA, 20 bp, synthetic construct
  misc_feature 1..20: note = CRISPR gRNA sequence
  source 1..20: mol_type = other DNA
cacctccgcttcccaaagtg

SEQ ID NO: 21481 - DNA, 20 bp, synthetic construct
  misc_feature 1..20: note = CRISPR gRNA sequence
  source 1..20: mol_type = other DNA
gacttaccatgcccagcccc

SEQ ID NO: 21482 - DNA, 20 bp, synthetic construct
  misc_feature 1..20: note = CRISPR gRNA sequence
  source 1..20: mol_type = other DNA
cagccattcatccttccatt

SEQ ID NO: 21483 - DNA, 20 bp, synthetic construct
  misc_feature 1..20: note = CRISPR gRNA sequence
  source 1..20: mol_type = other DNA
acctttctaggccctggaga

SEQ ID NO: 21484 - DNA, 20 bp, synthetic construct
  misc_feature 1..20: note = CRISPR gRNA sequence
  source 1..20: mol_type = other DNA
aaagtatacagtaatgaaaa

SEQ ID NO: 21485 - DNA, 20 bp, synthetic construct
  misc_feature 1..20: note = CRISPR gRNA sequence
  source 1..20: mol_type = other DNA
ctggggggtgaaataggaga

SEQ ID NO: 21486 - DNA, 20 bp, synthetic construct
  misc_feature 1..20: note = CRISPR gRNA sequence
  source 1..20: mol_type = other DNA
ggtgaaataggagagataga

SEQ ID NO: 21487 - DNA, 20 bp, synthetic construct
  misc_feature 1..20: note = CRISPR gRNA sequence
  source 1..20: mol_type = other DNA
gataagatacaggaggatca

SEQ ID NO: 21488 - DNA, 20 bp, synthetic construct
  misc_feature 1..20: note = CRISPR gRNA sequence
  source 1..20: mol_type = other DNA
tttgtatttttttgtagaga

SEQ ID NO: 21489 - DNA, 20 bp, synthetic construct
  misc_feature 1..20: note = CRISPR gRNA sequence
  source 1..20: mol_type = other DNA
tgcctctgcctcccaaagta

SEQ ID NO: 21490 - DNA, 20 bp, synthetic construct
  misc_feature 1..20: note = CRISPR gRNA sequence
  source 1..20: mol_type = other DNA
gagtcactgtgcctggttca

SEQ ID NO: 21491 - DNA, 20 bp, synthetic construct
  misc_feature 1..20: note = CRISPR gRNA sequence
  source 1..20: mol_type = other DNA
ttttgtatttttagtagaga

SEQ ID NO: 21492 - DNA, 20 bp, synthetic construct
  misc_feature 1..20: note = CRISPR gRNA sequence
  source 1..20: mol_type = other DNA
cacctcagcctcccaaagtg

SEQ ID NO: 21493 - DNA, 20 bp, synthetic construct
  misc_feature 1..20: note = CRISPR gRNA sequence
  source 1..20: mol_type = other DNA
gagccaccacgcccagttca

SEQ ID NO: 21494 - DNA, 20 bp, synthetic construct
  misc_feature 1..20: note = CRISPR gRNA sequence
  source 1..20: mol_type = other DNA
tgtcctaggtaacactgtaa

SEQ ID NO: 21495 - DNA, 20 bp, synthetic construct
  misc_feature 1..20: note = CRISPR gRNA sequence
  source 1..20: mol_type = other DNA
tgaagcccacaacccggcag

SEQ ID NO: 21496 - DNA, 20 bp, synthetic construct
  misc_feature 1..20: note = CRISPR gRNA sequence
  source 1..20: mol_type = other DNA
tatcctcctatttaccgaga

SEQ ID NO: 21497 - DNA, 20 bp, synthetic construct
  misc_feature 1..20: note = CRISPR gRNA sequence
  source 1..20: mol_type = other DNA
ttgaggtcaaagtgaggcat

SEQ ID NO: 21498 - DNA, 20 bp, synthetic construct
  misc_feature 1..20: note = CRISPR gRNA sequence
  source 1..20: mol_type = other DNA
aatcaccacagccctgaaca

SEQ ID NO: 21499 - DNA, 20 bp, synthetic construct
  misc_feature 1..20: note = CRISPR gRNA sequence
  source 1..20: mol_type = other DNA
gtcagttattcattcctagc

SEQ ID NO: 21500 - DNA, 20 bp, synthetic construct
  misc_feature 1..20: note = CRISPR gRNA sequence
  source 1..20: mol_type = other DNA
ttcccccagggatggcggga

SEQ ID NO: 21501 - DNA, 20 bp, synthetic construct
  misc_feature 1..20: note = CRISPR gRNA sequence
  source 1..20: mol_type = other DNA
tttttccggaacctaggggt

SEQ ID NO: 21502 - DNA, 20 bp, synthetic construct
  misc_feature 1..20: note = CRISPR gRNA sequence
  source 1..20: mol_type = other DNA
ctggaaggctaaccacgtac

SEQ ID NO: 21503 - DNA, 20 bp, synthetic construct
  misc_feature 1..20: note = CRISPR gRNA sequence
  source 1..20: mol_type = other DNA
cttgtcacttacatgccggt

SEQ ID NO: 21504 - DNA, 20 bp, synthetic construct
  misc_feature 1..20: note = CRISPR gRNA sequence
  source 1..20: mol_type = other DNA
gtaggccttggcatagcacc

SEQ ID NO: 21505 - DNA, 20 bp, synthetic construct
  misc_feature 1..20: note = CRISPR gRNA sequence
  source 1..20: mol_type = other DNA
tcccagaggtaatgagcgga

SEQ ID NO: 21506 - DNA, 20 bp, synthetic construct
  misc_feature 1..20: note = CRISPR gRNA sequence
  source 1..20: mol_type = other DNA
acttactgaggacaaccaga

SEQ ID NO: 21507 - DNA, 20 bp, synthetic construct
  misc_feature 1..20: note = CRISPR gRNA sequence
  source 1..20: mol_type = other DNA
ttatttttaatttttttaat

SEQ ID NO: 21508 - DNA, 20 bp, synthetic construct
  misc_feature 1..20: note = CRISPR gRNA sequence
  source 1..20: mol_type = other DNA
tgcctcagtgctccgagtag

SEQ ID NO: 21509 - DNA, 20 bp, synthetic construct
  misc_feature 1..20: note = CRISPR gRNA sequence
  source 1..20: mol_type = other DNA
ggcgcccaccaccacgtcca

SEQ ID NO: 21510 - DNA, 20 bp, synthetic construct
  misc_feature 1..20: note = CRISPR gRNA sequence
  source 1..20: mol_type = other DNA
ttttatatttttagtagaga

SEQ ID NO: 21511 - DNA, 20 bp, synthetic construct
  misc_feature 1..20: note = CRISPR gRNA sequence
  source 1..20: mol_type = other DNA
tcggcctcccaaagtgagta

SEQ ID NO: 21512 - DNA, 20 bp, synthetic construct
  misc_feature 1..20: note = CRISPR gRNA sequence
  source 1..20: mol_type = other DNA
taatttcttcccagcatgat

SEQ ID NO: 21513 - DNA, 20 bp, synthetic construct
  misc_feature 1..20: note = CRISPR gRNA sequence
  source 1..20: mol_type = other DNA
ttacaatattttatttatgt

SEQ ID NO: 21514 - DNA, 20 bp, synthetic construct
  misc_feature 1..20: note = CRISPR gRNA sequence
  source 1..20: mol_type = other DNA
atgaactagacagatgtcgt

SEQ ID NO: 21515 - DNA, 20 bp, synthetic construct
  misc_feature 1..20: note = CRISPR gRNA sequence
  source 1..20: mol_type = other DNA
gacagatgtcgttcttgctt

SEQ ID NO: 21516 - DNA, 20 bp, synthetic construct
  misc_feature 1..20: note = CRISPR gRNA sequence
  source 1..20: mol_type = other DNA
ataaataaaatattgtaaaa

SEQ ID NO: 21517 - DNA, 20 bp, synthetic construct
  misc_feature 1..20: note = CRISPR gRNA sequence
  source 1..20: mol_type = other DNA
agggtacaggacttctgggg

SEQ ID NO: 21518 - DNA, 20 bp, synthetic construct
  misc_feature 1..20: note = CRISPR gRNA sequence
  source 1..20: mol_type = other DNA
gccctaagtgggaaaagggg

SEQ ID NO: 21519 - DNA, 20 bp, synthetic construct
  misc_feature 1..20: note = CRISPR gRNA sequence
  source 1..20: mol_type = other DNA
tgtgggtcacaagaggtatt

SEQ ID NO: 21520 - DNA, 20 bp, synthetic construct
  misc_feature 1..20: note = CRISPR gRNA sequence
  source 1..20: mol_type = other DNA
gcctgggaaggcgacacttg

SEQ ID NO: 21521 - DNA, 20 bp, synthetic construct
  misc_feature 1..20: note = CRISPR gRNA sequence
  source 1..20: mol_type = other DNA
aagcactgcctcctgggttc

SEQ ID NO: 21522 - DNA, 20 bp, synthetic construct
  misc_feature 1..20: note = CRISPR gRNA sequence
  source 1..20: mol_type = other DNA
tgcctcagcctcccaagtag

SEQ ID NO: 21523 - DNA, 20 bp, synthetic construct
  misc_feature 1..20: note = CRISPR gRNA sequence
  source 1..20: mol_type = other DNA
gccaccacaccaggctattt

SEQ ID NO: 21524 - DNA, 20 bp, synthetic construct
  misc_feature 1..20: note = CRISPR gRNA sequence
  source 1..20: mol_type = other DNA
ttttgtgttttcagtagaga

SEQ ID NO: 21525 - DNA, 20 bp, synthetic construct
  misc_feature 1..20: note = CRISPR gRNA sequence
  source 1..20: mol_type = other DNA
cacctcagccttccaaagtg

SEQ ID NO: 21526 - DNA, 20 bp, synthetic construct
  misc_feature 1..20: note = CRISPR gRNA sequence
  source 1..20: mol_type = other DNA
ggtgtgagccaccatgccca

SEQ ID NO: 21527 - DNA, 20 bp, synthetic construct
  misc_feature 1..20: note = CRISPR gRNA sequence
  source 1..20: mol_type = other DNA
cttggcatcgatgaaatatg

SEQ ID NO: 21528 - DNA, 20 bp, synthetic construct
  misc_feature 1..20: note = CRISPR gRNA sequence
  source 1..20: mol_type = other DNA
gaggaagggtctccagggtt

SEQ ID NO: 21529 - DNA, 20 bp, synthetic construct
  misc_feature 1..20: note = CRISPR gRNA sequence
  source 1..20: mol_type = other DNA
cagagattgcaaaaccccca

SEQ ID NO: 21530 - DNA, 20 bp, synthetic construct
  misc_feature 1..20: note = CRISPR gRNA sequence
  source 1..20: mol_type = other DNA
accggccgacccgtgatgtg

SEQ ID NO: 21531 - DNA, 20 bp, synthetic construct
  misc_feature 1..20: note = CRISPR gRNA sequence
  source 1..20: mol_type = other DNA
tttttctttttttttcgaga

SEQ ID NO: 21532 - DNA, 20 bp, synthetic construct
  misc_feature 1..20: note = CRISPR gRNA sequence
  source 1..20: mol_type = other DNA
ttttgtatttttagtagaga

SEQ ID NO: 21533 - DNA, 20 bp, synthetic construct
  misc_feature 1..20: note = CRISPR gRNA sequence
  source 1..20: mol_type = other DNA
ccgcctcggcctccaaagtg

SEQ ID NO: 21534 - DNA, 20 bp, synthetic construct
  misc_feature 1..20: note = CRISPR gRNA sequence
  source 1..20: mol_type = other DNA
caggcgtgagccactgcacc

SEQ ID NO: 21535 - DNA, 20 bp, synthetic construct
  misc_feature 1..20: note = CRISPR gRNA sequence
  source 1..20: mol_type = other DNA
cagcacctgacctgttaaaa

SEQ ID NO: 21536 - DNA, 20 bp, synthetic construct
  misc_feature 1..20: note = CRISPR gRNA sequence
  source 1..20: mol_type = other DNA
aaactggagctggtccagtg

SEQ ID NO: 21537 - DNA, 20 bp, synthetic construct
  misc_feature 1..20: note = CRISPR gRNA sequence
  source 1..20: mol_type = other DNA
tgttctaaatgttatatcag

SEQ ID NO: 21538 - DNA, 20 bp, synthetic construct
  misc_feature 1..20: note = CRISPR gRNA sequence
  source 1..20: mol_type = other DNA
actgagtctcagaagagttg

SEQ ID NO: 21539 - DNA, 20 bp, synthetic construct
  misc_feature 1..20: note = CRISPR gRNA sequence
  source 1..20: mol_type = other DNA
ataggcagtaagaggcatag

SEQ ID NO: 21540 - DNA, 20 bp, synthetic construct
  misc_feature 1..20: note = CRISPR gRNA sequence
  source 1..20: mol_type = other DNA
tgaacttgggaagttgttct

SEQ ID NO: 21541 - DNA, 20 bp, synthetic construct
  misc_feature 1..20: note = CRISPR gRNA sequence
  source 1..20: mol_type = other DNA
aaatgacttccttttagtcc

SEQ ID NO: 21542 - DNA, 20 bp, synthetic construct
  misc_feature 1..20: note = CRISPR gRNA sequence
  source 1..20: mol_type = other DNA
tcctgctgttttcctgggct

SEQ ID NO: 21543 - DNA, 20 bp, synthetic construct
  misc_feature 1..20: note = CRISPR gRNA sequence
  source 1..20: mol_type = other DNA
gtggtctcaactctctgggt

SEQ ID NO: 21544 - DNA, 20 bp, synthetic construct
  misc_feature 1..20: note = CRISPR gRNA sequence
  source 1..20: mol_type = other DNA
aggctctgttgtgcaataaa

SEQ ID NO: 21545 - DNA, 20 bp, synthetic construct
  misc_feature 1..20: note = CRISPR gRNA sequence
  source 1..20: mol_type = other DNA
ttcccccagggatagtggga

SEQ ID NO: 21546 - DNA, 20 bp, synthetic construct
  misc_feature 1..20: note = CRISPR gRNA sequence
  source 1..20: mol_type = other DNA
tttttctggaatctagggat

SEQ ID NO: 21547 - DNA, 20 bp, synthetic construct
  misc_feature 1..20: note = CRISPR gRNA sequence
  source 1..20: mol_type = other DNA
ctccaatccctccccctggc

SEQ ID NO: 21548 - DNA, 20 bp, synthetic construct
  misc_feature 1..20: note = CRISPR gRNA sequence
  source 1..20: mol_type = other DNA
tccccctggcctctgtttcc

SEQ ID NO: 21549 - DNA, 20 bp, synthetic construct
  misc_feature 1..20: note = CRISPR gRNA sequence
  source 1..20: mol_type = other DNA
gcatctgcgacgtgggagcc

SEQ ID NO: 21550 - DNA, 20 bp, synthetic construct
  misc_feature 1..20: note = CRISPR gRNA sequence
  source 1..20: mol_type = other DNA
gggagccgagagcttggctc

SEQ ID NO: 21551 - DNA, 20 bp, synthetic construct
  misc_feature 1..20: note = CRISPR gRNA sequence
  source 1..20: mol_type = other DNA
cccaagggccaggccccaag

SEQ ID NO: 21552 - DNA, 20 bp, synthetic construct
  misc_feature 1..20: note = CRISPR gRNA sequence
  source 1..20: mol_type = other DNA
ggtgagcagacacttccccc

SEQ ID NO: 21553 - DNA, 20 bp, synthetic construct
  misc_feature 1..20: note = CRISPR gRNA sequence
  source 1..20: mol_type = other DNA
cagacacttccccctctggc

SEQ ID NO: 21554 - DNA, 20 bp, synthetic construct
  misc_feature 1..20: note = CRISPR gRNA sequence
  source 1..20: mol_type = other DNA
acagtaataatatccaccca

SEQ ID NO: 21555 - DNA, 20 bp, synthetic construct
  misc_feature 1..20: note = CRISPR gRNA sequence
  source 1..20: mol_type = other DNA
tatccacccaagaggttttg

SEQ ID NO: 21556 - DNA, 20 bp, synthetic construct
  misc_feature 1..20: note = CRISPR gRNA sequence
  source 1..20: mol_type = other DNA
aattggcaatttcatatggt

SEQ ID NO: 21557 - DNA, 20 bp, synthetic construct
  misc_feature 1..20: note = CRISPR gRNA sequence
  source 1..20: mol_type = other DNA
ataaaggaatctcgggcctc

SEQ ID NO: 21558 - DNA, 20 bp, synthetic construct
  misc_feature 1..20: note = CRISPR gRNA sequence
  source 1..20: mol_type = other DNA
cgttctaggctgggtggaag

SEQ ID NO: 21559 - DNA, 20 bp, synthetic construct
  misc_feature 1..20: note = CRISPR gRNA sequence
  source 1..20: mol_type = other DNA
gtccaggaacacctgcaaca

SEQ ID NO: 21560 - DNA, 20 bp, synthetic construct
  misc_feature 1..20: note = CRISPR gRNA sequence
  source 1..20: mol_type = other DNA
ctctggacagggtaaccagg

SEQ ID NO: 21561 - DNA, 20 bp, synthetic construct
  misc_feature 1..20: note = CRISPR gRNA sequence
  source 1..20: mol_type = other DNA
aaaggagaagcctaggaggc

SEQ ID NO: 21562 - DNA, 20 bp, synthetic construct
  misc_feature 1..20: note = CRISPR gRNA sequence
  source 1..20: mol_type = other DNA
agaaaggttagttaactgct

SEQ ID NO: 21563 - DNA, 20 bp, synthetic construct
  misc_feature 1..20: note = CRISPR gRNA sequence
  source 1..20: mol_type = other DNA
ctgtgcgtcttagaagaggt

SEQ ID NO: 21564 - DNA, 20 bp, synthetic construct
  misc_feature 1..20: note = CRISPR gRNA sequence
  source 1..20: mol_type = other DNA
gtgagtgattgtggagataa

SEQ ID NO: 21565 - DNA, 20 bp, synthetic construct
  misc_feature 1..20: note = CRISPR gRNA sequence
  source 1..20: mol_type = other DNA
gtgccagctactgttgttat

SEQ ID NO: 21566 - DNA, 20 bp, synthetic construct
  misc_feature 1..20: note = CRISPR gRNA sequence
  source 1..20: mol_type = other DNA
ctgttgttataagagctttg

SEQ ID NO: 21567 - DNA, 20 bp, synthetic construct
  misc_feature 1..20: note = CRISPR gRNA sequence
  source 1..20: mol_type = other DNA
tgttataagagctttgtagg

SEQ ID NO: 21568 - DNA, 20 bp, synthetic construct
  misc_feature 1..20: note = CRISPR gRNA sequence
  source 1..20: mol_type = other DNA
taagagctttgtagggcttg

SEQ ID NO: 21569 - DNA, 20 bp, synthetic construct
  misc_feature 1..20: note = CRISPR gRNA sequence
  source 1..20: mol_type = other DNA
agtgtctgctcacccagggt

SEQ ID NO: 21570 - DNA, 20 bp, synthetic construct
  misc_feature 1..20: note = CRISPR gRNA sequence
  source 1..20: mol_type = other DNA
gcagattggtgaagggaaga

SEQ ID NO: 21571 - DNA, 20 bp, synthetic construct
  misc_feature 1..20: note = CRISPR gRNA sequence
  source 1..20: mol_type = other DNA
tcggaaacagaggccagggg

SEQ ID NO: 21572 - DNA, 20 bp, synthetic construct
  misc_feature 1..20: note = CRISPR gRNA sequence
  source 1..20: mol_type = other DNA
gccttccagaagccaccatc

SEQ ID NO: 21573 - DNA, 20 bp, synthetic construct
  misc_feature 1..20: note = CRISPR gRNA sequence
  source 1..20: mol_type = other DNA
gaatgaataagtgacttgct

SEQ ID NO: 21574 - DNA, 20 bp, synthetic construct
  misc_feature 1..20: note = CRISPR gRNA sequence
  source 1..20: mol_type = other DNA
agttctcttgttcagggctg

SEQ ID NO: 21575 - DNA, 20 bp, synthetic construct
  misc_feature 1..20: note = CRISPR gRNA sequence
  source 1..20: mol_type = other DNA
ctcttgttcagggctgtggt

SEQ ID NO: 21576 - DNA, 20 bp, synthetic construct
  misc_feature 1..20: note = CRISPR gRNA sequence
  source 1..20: mol_type = other DNA
cccgtgggagtcaccaccta

SEQ ID NO: 21577 - DNA, 20 bp, synthetic construct
  misc_feature 1..20: note = CRISPR gRNA sequence
  source 1..20: mol_type = other DNA
gctactcaactcttctgaga

SEQ ID NO: 21578 - DNA, 20 bp, synthetic construct
  misc_feature 1..20: note = CRISPR gRNA sequence
  source 1..20: mol_type = other DNA
aagccagtcactggaccagc

SEQ ID NO: 21579 - DNA, 20 bp, synthetic construct
  misc_feature 1..20: note = CRISPR gRNA sequence
  source 1..20: mol_type = other DNA
gtgtcactgatgccaacttc

SEQ ID NO: 21580 - DNA, 20 bp, synthetic construct
  misc_feature 1..20: note = CRISPR gRNA sequence
  source 1..20: mol_type = other DNA
caggtcaggtgctgctgcgg

SEQ ID NO: 21581 - DNA, 20 bp, synthetic construct
  misc_feature 1..20: note = CRISPR gRNA sequence
  source 1..20: mol_type = other DNA
atttcagggccatgactttg

SEQ ID NO: 21582 - DNA, 20 bp, synthetic construct
  misc_feature 1..20: note = CRISPR gRNA sequence
  source 1..20: mol_type = other DNA
cgggtggatcacctaaggtc

SEQ ID NO: 21583 - DNA, 20 bp, synthetic construct
  misc_feature 1..20: note = CRISPR gRNA sequence
  source 1..20: mol_type = other DNA
ttgagaggctgaggcaggag

SEQ ID NO: 21584 - DNA, 20 bp, synthetic construct
  misc_feature 1..20: note = CRISPR gRNA sequence
  source 1..20: mol_type = other DNA
gaaaaaaataaataaatgca

SEQ ID NO: 21585 - DNA, 20 bp, synthetic construct
  misc_feature 1..20: note = CRISPR gRNA sequence
  source 1..20: mol_type = other DNA
gcaggtttacactgctgcca

SEQ ID NO: 21586 - DNA, 20 bp, synthetic construct
  misc_feature 1..20: note = CRISPR gRNA sequence
  source 1..20: mol_type = other DNA
taccagtgcagaaactagat

SEQ ID NO: 21587 - DNA, 20 bp, synthetic construct
  misc_feature 1..20: note = CRISPR gRNA sequence
  source 1..20: mol_type = other DNA
tcttataaccaatagcgtgt

SEQ ID NO: 21588 - DNA, 20 bp, synthetic construct
  misc_feature 1..20: note = CRISPR gRNA sequence
  source 1..20: mol_type = other DNA
ggtcttacaatggatggcat

SEQ ID NO: 21589 - DNA, 20 bp, synthetic construct
  misc_feature 1..20: note = CRISPR gRNA sequence
  source 1..20: mol_type = other DNA
atcttagattccatgaaata

SEQ ID NO: 21590 - DNA, 20 bp, synthetic construct
  misc_feature 1..20: note = CRISPR gRNA sequence
  source 1..20: mol_type = other DNA
ttggaaggctgaggtgggtg

SEQ ID NO: 21591 - DNA, 20 bp, synthetic construct
  misc_feature 1..20: note = CRISPR gRNA sequence
  source 1..20: mol_type = other DNA
ggtgggtggatcgcttgggc

SEQ ID NO: 21592 - DNA, 20 bp, synthetic construct
  misc_feature 1..20: note = CRISPR gRNA sequence
  source 1..20: mol_type = other DNA
aatcacttgaacccaggagg

SEQ ID NO: 21593 - DNA, 20 bp, synthetic construct
  misc_feature 1..20: note = CRISPR gRNA sequence
  source 1..20: mol_type = other DNA
acaagggcctccctgtgtga

SEQ ID NO: 21594 - DNA, 20 bp, synthetic construct
  misc_feature 1..20: note = CRISPR gRNA sequence
  source 1..20: mol_type = other DNA
ttcctagagtccttttcccc

SEQ ID NO: 21595 - DNA, 20 bp, synthetic construct
  misc_feature 1..20: note = CRISPR gRNA sequence
  source 1..20: mol_type = other DNA
ccagaagtcctgtaccctcc

SEQ ID NO: 21596 - DNA, 20 bp, synthetic construct
  misc_feature 1..20: note = CRISPR gRNA sequence
  source 1..20: mol_type = other DNA
cctgtaccctcctggggctt

SEQ ID NO: 21597 - DNA, 20 bp, synthetic construct
  misc_feature 1..20: note = CRISPR gRNA sequence
  source 1..20: mol_type = other DNA
gtttccttcccagcatgaat

SEQ ID NO: 21598 - DNA, 20 bp, synthetic construct
  misc_feature 1..20: note = CRISPR gRNA sequence
  source 1..20: mol_type = other DNA
gtctagttcatacttgtatc

SEQ ID NO: 21599 - DNA, 20 bp, synthetic construct
  misc_feature 1..20: note = CRISPR gRNA sequence
  source 1..20: mol_type = other DNA
tttagcacaattatgaacca

SEQ ID NO: 21600 - DNA, 20 bp, synthetic construct
  misc_feature 1..20: note = CRISPR gRNA sequence
  source 1..20: mol_type = other DNA
atgaaccagacagattctat

SEQ ID NO: 21601 - DNA, 20 bp, synthetic construct
  misc_feature 1..20: note = CRISPR gRNA sequence
  source 1..20: mol_type = other DNA
gacagattctatttttgctt

SEQ ID NO: 21602 - DNA, 20 bp, synthetic construct
  misc_feature 1..20: note = CRISPR gRNA sequence
  source 1..20: mol_type = other DNA
ttggaaggctgaggtgggag

SEQ ID NO: 21603 - DNA, 20 bp, synthetic construct
  misc_feature 1..20: note = CRISPR gRNA sequence
  source 1..20: mol_type = other DNA
caggtggatcacctgagatc

SEQ ID NO: 21604 - DNA, 20 bp, synthetic construct
  misc_feature 1..20: note = CRISPR gRNA sequence
  source 1..20: mol_type = other DNA
tcggagcactgaggcaggcg

SEQ ID NO: 21605 - DNA, 20 bp, synthetic construct
  misc_feature 1..20: note = CRISPR gRNA sequence
  source 1..20: mol_type = other DNA
agagctctggcgaagaggag

SEQ ID NO: 21606 - DNA, 20 bp, synthetic construct
  misc_feature 1..20: note = CRISPR gRNA sequence
  source 1..20: mol_type = other DNA
acagaacctggcattgtgac

SEQ ID NO: 21607 - DNA, 20 bp, synthetic construct
  misc_feature 1..20: note = CRISPR gRNA sequence
  source 1..20: mol_type = other DNA
gaatgaataactgacttgct

SEQ ID NO: 21608 - DNA, 20 bp, synthetic construct
  misc_feature 1..20: note = CRISPR gRNA sequence
  source 1..20: mol_type = other DNA
aatccttttgttcagggctg

SEQ ID NO: 21609 - DNA, 20 bp, synthetic construct
  misc_feature 1..20: note = CRISPR gRNA sequence
  source 1..20: mol_type = other DNA
cttttgttcagggctgtggt

SEQ ID NO: 21610 - DNA, 20 bp, synthetic construct
  misc_feature 1..20: note = CRISPR gRNA sequence
  source 1..20: mol_type = other DNA
cgagcgaaggcagggcctcg

SEQ ID NO: 21611 - DNA, 20 bp, synthetic construct
  misc_feature 1..20: note = CRISPR gRNA sequence
  source 1..20: mol_type = other DNA
atgaaataagtgttggcatt

SEQ ID NO: 21612 - DNA, 20 bp, synthetic construct
  misc_feature 1..20: note = CRISPR gRNA sequence
  source 1..20: mol_type = other DNA
gtaatcctttctgccgggtt

SEQ ID NO: 21613 - DNA, 20 bp, synthetic construct
  misc_feature 1..20: note = CRISPR gRNA sequence
  source 1..20: mol_type = other DNA
ttcacatggagcagggctgt

SEQ ID NO: 21614 - DNA, 20 bp, synthetic construct
  misc_feature 1..20: note = CRISPR gRNA sequence
  source 1..20: mol_type = other DNA
gaaggactaaggagaagaaa

SEQ ID NO: 21615 - DNA, 20 bp, synthetic construct
  misc_feature 1..20: note = CRISPR gRNA sequence
  source 1..20: mol_type = other DNA
tggttgtgagggggagtgtg

SEQ ID NO: 21616 - DNA, 20 bp, synthetic construct
  misc_feature 1..20: note = CRISPR gRNA sequence
  source 1..20: mol_type = other DNA
ttgggaggctgaggtgtgag

SEQ ID NO: 21617 - DNA, 20 bp, synthetic construct
  misc_feature 1..20: note = CRISPR gRNA sequence
  source 1..20: mol_type = other DNA
aattgcttgaacccaggagg

SEQ ID NO: 21618 - DNA, 20 bp, synthetic construct
  misc_feature 1..20: note = CRISPR gRNA sequence
  source 1..20: mol_type = other DNA
ttgggaggcagaggcaggag

SEQ ID NO: 21619 - DNA, 20 bp, synthetic construct
  misc_feature 1..20: note = CRISPR gRNA sequence
  source 1..20: mol_type = other DNA
ctactcagaaggttgagatg

SEQ ID NO: 21620 - DNA, 20 bp, synthetic construct
  misc_feature 1..20: note = CRISPR gRNA sequence
  source 1..20: mol_type = other DNA
tcagaaggttgagatgggag

SEQ ID NO: 21621 - DNA, 20 bp, synthetic construct
  misc_feature 1..20: note = CRISPR gRNA sequence
  source 1..20: mol_type = other DNA
tgggaggattgcttgagcct

SEQ ID NO: 21622 - DNA, 20 bp, synthetic construct
  misc_feature 1..20: note = CRISPR gRNA sequence
  source 1..20: mol_type = other DNA
gagattgaggctgcagtgag

SEQ ID NO: 21623 - DNA, 20 bp, synthetic construct
  misc_feature 1..20: note = CRISPR gRNA sequence
  source 1..20: mol_type = other DNA
tccaacttcccagagcccag

SEQ ID NO: 21624 - DNA, 20 bp, synthetic construct
  misc_feature 1..20: note = CRISPR gRNA sequence
  source 1..20: mol_type = other DNA
agagcccagaacagttttta

SEQ ID NO: 21625 - DNA, 20 bp, synthetic construct
  misc_feature 1..20: note = CRISPR gRNA sequence
  source 1..20: mol_type = other DNA
gaacagtttttaaaaagttt

SEQ ID NO: 21626 - DNA, 20 bp, synthetic construct
  misc_feature 1..20: note = CRISPR gRNA sequence
  source 1..20: mol_type = other DNA
aagttttactgttttgataa

SEQ ID NO: 21627 - DNA, 20 bp, synthetic construct
  misc_feature 1..20: note = CRISPR gRNA sequence
  source 1..20: mol_type = other DNA
tgtatactttataattaccg

SEQ ID NO: 21628 - DNA, 20 bp, synthetic construct
  misc_feature 1..20: note = CRISPR gRNA sequence
  source 1..20: mol_type = other DNA
ttgtgtctcctcactagaat

SEQ ID NO: 21629 - DNA, 20 bp, synthetic construct
  misc_feature 1..20: note = CRISPR gRNA sequence
  source 1..20: mol_type = other DNA
aatttaagattcctgaggtc

SEQ ID NO: 21630 - DNA, 20 bp, synthetic construct
  misc_feature 1..20: note = CRISPR gRNA sequence
  source 1..20: mol_type = other DNA
ttcctgaggtcaggggattt

SEQ ID NO: 21631 - DNA, 20 bp, synthetic construct
  misc_feature 1..20: note = CRISPR gRNA sequence
  source 1..20: mol_type = other DNA
gaggtcaggggatttatttg

SEQ ID NO: 21632 - DNA, 20 bp, synthetic construct
  misc_feature 1..20: note = CRISPR gRNA sequence
  source 1..20: mol_type = other DNA
gtaggtcctccttaaatatt

SEQ ID NO: 21633 - DNA, 20 bp, synthetic construct
  misc_feature 1..20: note = CRISPR gRNA sequence
  source 1..20: mol_type = other DNA
aaatggttgggtaagtaaag

SEQ ID NO: 21634 - DNA, 20 bp, synthetic construct
  misc_feature 1..20: note = CRISPR gRNA sequence
  source 1..20: mol_type = other DNA
cattgaatggaaggatgaat

SEQ ID NO: 21635 - DNA, 20 bp, synthetic construct
  misc_feature 1..20: note = CRISPR gRNA sequence
  source 1..20: mol_type = other DNA
cactttgggaagcggaggtg

SEQ ID NO: 21636 - DNA, 20 bp, synthetic construct
  misc_feature 1..20: note = CRISPR gRNA sequence
  source 1..20: mol_type = other DNA
aagtcagccggactttgggg

SEQ ID NO: 21637 - DNA, 20 bp, synthetic construct
  misc_feature 1..20: note = CRISPR gRNA sequence
  source 1..20: mol_type = other DNA
caggcccagctcactcactt

SEQ ID NO: 21638 - DNA, 20 bp, synthetic construct
  misc_feature 1..20: note = CRISPR gRNA sequence
  source 1..20: mol_type = other DNA
cataggcagccggcacattc

SEQ ID NO: 21639 - DNA, 20 bp, synthetic construct
  misc_feature 1..20: note = CRISPR gRNA sequence
  source 1..20: mol_type = other DNA
aactcatgatggacttgaat

SEQ ID NO: 21640 - DNA, 20 bp, synthetic construct
  misc_feature 1..20: note = CRISPR gRNA sequence
  source 1..20: mol_type = other DNA
atgatggacttgaatccctg

SEQ ID NO: 21641 - DNA, 20 bp, synthetic construct
  misc_feature 1..20: note = CRISPR gRNA sequence
  source 1..20: mol_type = other DNA
cttcttaggaactaagcccc

SEQ ID NO: 21642 - DNA, 20 bp, synthetic construct
  misc_feature 1..20: note = CRISPR gRNA sequence
  source 1..20: mol_type = other DNA
gcaaatgaggttgtgaggaa

SEQ ID NO: 21643 - DNA, 20 bp, synthetic construct
  misc_feature 1..20: note = CRISPR gRNA sequence
  source 1..20: mol_type = other DNA
tctacaactttttttgtcac

SEQ ID NO: 21644 - DNA, 20 bp, synthetic construct
  misc_feature 1..20: note = CRISPR gRNA sequence
  source 1..20: mol_type = other DNA
gagaaaaaaagggacaaagt

SEQ ID NO: 21645 - DNA, 20 bp, synthetic construct
  misc_feature 1..20: note = CRISPR gRNA sequence
  source 1..20: mol_type = other DNA
tttctgcaggtgccttgggg

SEQ ID NO: 21646 - DNA, 20 bp, synthetic construct
  misc_feature 1..20: note = CRISPR gRNA sequence
  source 1..20: mol_type = other DNA
aaaaggccgtgaggatccgc

SEQ ID NO: 21647 - DNA, 20 bp, synthetic construct
  misc_feature 1..20: note = CRISPR gRNA sequence
  source 1..20: mol_type = other DNA
ccacgtaggaccccaatctt

SEQ ID NO: 21648 - DNA, 20 bp, synthetic construct
  misc_feature 1..20: note = CRISPR gRNA sequence
  source 1..20: mol_type = other DNA
ccccaatcttttctgcttgg

SEQ ID NO: 21649 - DNA, 20 bp, synthetic construct
  misc_feature 1..20: note = CRISPR gRNA sequence
  source 1..20: mol_type = other DNA
ttgggaggccaaggtaagag

SEQ ID NO: 21650 - DNA, 20 bp, synthetic construct
  misc_feature 1..20: note = CRISPR gRNA sequence
  source 1..20: mol_type = other DNA
cttgagcccaggagttcaag

SEQ ID NO: 21651 - DNA, 20 bp, synthetic construct
  misc_feature 1..20: note = CRISPR gRNA sequence
  source 1..20: mol_type = other DNA
gtggtggtgtgtcctgtggt

SEQ ID NO: 21652 - DNA, 20 bp, synthetic construct
  misc_feature 1..20: note = CRISPR gRNA sequence
  source 1..20: mol_type = other DNA
ttaggaggctgaggtggaag

SEQ ID NO: 21653 - DNA, 20 bp, synthetic construct
  misc_feature 1..20: note = CRISPR gRNA sequence
  source 1..20: mol_type = other DNA
gggctcccatcttggggctc

SEQ ID NO: 21654 - DNA, 20 bp, synthetic construct
  misc_feature 1..20: note = CRISPR gRNA sequence
  source 1..20: mol_type = other DNA
gaaaaataaggacaacgaag

SEQ ID NO: 21655 - DNA, 20 bp, synthetic construct
  misc_feature 1..20: note = CRISPR gRNA sequence
  source 1..20: mol_type = other DNA
ataaggacaacgaagggccg

SEQ ID NO: 21656 - DNA, 20 bp, synthetic construct
  misc_feature 1..20: note = CRISPR gRNA sequence
  source 1..20: mol_type = other DNA
gcagtgggtattttgttgtt

SEQ ID NO: 21657 - DNA, 20 bp, synthetic construct
  misc_feature 1..20: note = CRISPR gRNA sequence
  source 1..20: mol_type = other DNA
tgggtattttgttgttattt

SEQ ID NO: 21658 - DNA, 20 bp, synthetic construct
  misc_feature 1..20: note = CRISPR gRNA sequence
  source 1..20: mol_type = other DNA
tcagcaaaaggccacaggat

SEQ ID NO: 21659 - DNA, 20 bp, synthetic construct
  misc_feature 1..20: note = CRISPR gRNA sequence
  source 1..20: mol_type = other DNA
accccaatcttatgggggtt

SEQ ID NO: 21660 - DNA, 20 bp, synthetic construct
  misc_feature 1..20: note = CRISPR gRNA sequence
  source 1..20: mol_type = other DNA
ggcattcgttgttaaatatt

SEQ ID NO: 21661 - DNA, 20 bp, synthetic construct
  misc_feature 1..20: note = CRISPR gRNA sequence
  source 1..20: mol_type = other DNA
atatacagtggtgaggggga

SEQ ID NO: 21662 - DNA, 20 bp, synthetic construct
  misc_feature 1..20: note = CRISPR gRNA sequence
  source 1..20: mol_type = other DNA
gctcaccgcaacctccgcct

SEQ ID NO: 21663 - DNA, 20 bp, synthetic construct
  misc_feature 1..20: note = CRISPR gRNA sequence
  source 1..20: mol_type = other DNA
aacctccgcctcccggtttc

SEQ ID NO: 21664 - DNA, 20 bp, synthetic construct
  misc_feature 1..20: note = CRISPR gRNA sequence
  source 1..20: mol_type = other DNA
cctgccaccatgcccagcta

SEQ ID NO: 21665 - DNA, 20 bp, synthetic construct
  misc_feature 1..20: note = CRISPR gRNA sequence
  source 1..20: mol_type = other DNA
ttttgtatatttagtagaga

SEQ ID NO: 21666 - DNA, 20 bp, synthetic construct
  misc_feature 1..20: note = CRISPR gRNA sequence
  source 1..20: mol_type = other DNA
tgcctcggcctcccaaagtg

SEQ ID NO: 21667 - DNA, 20 bp, synthetic construct
  misc_feature 1..20: note = CRISPR gRNA sequence
  source 1..20: mol_type = other DNA
cataagccactgcgcctggc

SEQ ID NO: 21668 - DNA, 20 bp, synthetic construct
  misc_feature 1..20: note = CRISPR gRNA sequence
  source 1..20: mol_type = other DNA
ggtggggggatcacgaggtc

SEQ ID NO: 21669 - DNA, 20 bp, synthetic construct
  misc_feature 1..20: note = CRISPR gRNA sequence
  source 1..20: mol_type = other DNA
gaggaggaggttgcagtgag

SEQ ID NO: 21670 - DNA, 20 bp, synthetic construct
  misc_feature 1..20: note = CRISPR gRNA sequence
  source 1..20: mol_type = other DNA
gggttgtgagtggctaagaa

SEQ ID NO: 21671 - DNA, 20 bp, synthetic construct
  misc_feature 1..20: note = CRISPR gRNA sequence
  source 1..20: mol_type = other DNA
tccttcctcagaacctcctc

SEQ ID NO: 21672 - DNA, 20 bp, synthetic construct
  misc_feature 1..20: note = CRISPR gRNA sequence
  source 1..20: mol_type = other DNA
cgcagttccgatcttgaact

SEQ ID NO: 21673 - DNA, 20 bp, synthetic construct
  misc_feature 1..20: note = CRISPR gRNA sequence
  source 1..20: mol_type = other DNA
ggccagaaagggccctcagt

SEQ ID NO: 21674 - DNA, 20 bp, synthetic construct
  misc_feature 1..20: note = CRISPR gRNA sequence
  source 1..20: mol_type = other DNA
ctctgttcaaaacaagagac

SEQ ID NO: 21675 - DNA, 20 bp, synthetic construct
  misc_feature 1..20: note = CRISPR gRNA sequence
  source 1..20: mol_type = other DNA
agcagtgatcagggagagct

SEQ ID NO: 21676 - DNA, 20 bp, synthetic construct
  misc_feature 1..20: note = CRISPR gRNA sequence
  source 1..20: mol_type = other DNA
tctgtcttccacagtagctc

SEQ ID NO: 21677 - DNA, 20 bp, synthetic construct
  misc_feature 1..20: note = CRISPR gRNA sequence
  source 1..20: mol_type = other DNA
cacagtagctcttgagatta

SEQ ID NO: 21678 - DNA, 20 bp, synthetic construct
  misc_feature 1..20: note = CRISPR gRNA sequence
  source 1..20: mol_type = other DNA
ctgaattataagctgggcat

SEQ ID NO: 21679 - DNA, 20 bp, synthetic construct
  misc_feature 1..20: note = CRISPR gRNA sequence
  source 1..20: mol_type = other DNA
tcgggaggctgaggcaggaa

SEQ ID NO: 21680 - DNA, 20 bp, synthetic construct
  misc_feature 1..20: note = CRISPR gRNA sequence
  source 1..20: mol_type = other DNA
aaattgcttgaaccgagagg

SEQ ID NO: 21681 - DNA, 20 bp, synthetic construct
  misc_feature 1..20: note = CRISPR gRNA sequence
  source 1..20: mol_type = other DNA
taccaaggaacaaacattca

SEQ ID NO: 21682 - DNA, 20 bp, synthetic construct
  misc_feature 1..20: note = CRISPR gRNA sequence
  source 1..20: mol_type = other DNA
catttagctttttctgtgga

SEQ ID NO: 21683 - DNA, 20 bp, synthetic construct
  misc_feature 1..20: note = CRISPR gRNA sequence
  source 1..20: mol_type = other DNA
cactttgggaggctgaggtg

SEQ ID NO: 21684 - DNA, 20 bp, synthetic construct
  misc_feature 1..20: note = CRISPR gRNA sequence
  source 1..20: mol_type = other DNA
ttgggaggctgaggtgggag

SEQ ID NO: 21685 - DNA, 20 bp, synthetic construct
  misc_feature 1..20: note = CRISPR gRNA sequence
  source 1..20: mol_type = other DNA
gaggttgaggctgtggtgag

SEQ ID NO: 21686 - DNA, 20 bp, synthetic construct
  misc_feature 1..20: note = CRISPR gRNA sequence
  source 1..20: mol_type = other DNA
agatctaaatataataatta

SEQ ID NO: 21687 - DNA, 20 bp, synthetic construct
  misc_feature 1..20: note = CRISPR gRNA sequence
  source 1..20: mol_type = other DNA
cacatagagcaaccaactgt

SEQ ID NO: 21688 - DNA, 20 bp, synthetic construct
  misc_feature 1..20: note = CRISPR gRNA sequence
  source 1..20: mol_type = other DNA
tcccagtttgcctgggacta

SEQ ID NO: 21689 - DNA, 20 bp, synthetic construct
  misc_feature 1..20: note = CRISPR gRNA sequence
  source 1..20: mol_type = other DNA
gcttcttgggatgcaagact

SEQ ID NO: 21690 - DNA, 20 bp, synthetic construct
  misc_feature 1..20: note = CRISPR gRNA sequence
  source 1..20: mol_type = other DNA
ggatagtcccaggcaagtag

SEQ ID NO: 21691 - DNA, 20 bp, synthetic construct
  misc_feature 1..20: note = CRISPR gRNA sequence
  source 1..20: mol_type = other DNA
ctgggaatttcaaaatgggg

SEQ ID NO: 21692 - DNA, 20 bp, synthetic construct
  misc_feature 1..20: note = CRISPR gRNA sequence
  source 1..20: mol_type = other DNA
agctcattccttatcctcac

SEQ ID NO: 21693 - DNA, 20 bp, synthetic construct
  misc_feature 1..20: note = CRISPR gRNA sequence
  source 1..20: mol_type = other DNA
cctgacctcctccagagggg

SEQ ID NO: 21694 - DNA, 20 bp, synthetic construct
  misc_feature 1..20: note = CRISPR gRNA sequence
  source 1..20: mol_type = other DNA
gttaaccagcaaacgggtcc

SEQ ID NO: 21695 - DNA, 20 bp, synthetic construct
  misc_feature 1..20: note = CRISPR gRNA sequence
  source 1..20: mol_type = other DNA
agtggtgggcaagagggtaa

SEQ ID NO: 21696 - DNA, 20 bp, synthetic construct
  misc_feature 1..20: note = CRISPR gRNA sequence
  source 1..20: mol_type = other DNA
acccacaagacaatccaccc

SEQ ID NO: 21697 - DNA, 20 bp, synthetic construct
  misc_feature 1..20: note = CRISPR gRNA sequence
  source 1..20: mol_type = other DNA
acccctttgcttacgcaaac

SEQ ID NO: 21698 - DNA, 20 bp, synthetic construct
  misc_feature 1..20: note = CRISPR gRNA sequence
  source 1..20: mol_type = other DNA
ccagtgccccaaattcccca

SEQ ID NO: 21699 - DNA, 20 bp, synthetic construct
  misc_feature 1..20: note = CRISPR gRNA sequence
  source 1..20: mol_type = other DNA
tgccccaaattccccagggg

SEQ ID NO: 21700 - DNA, 20 bp, synthetic construct
  misc_feature 1..20: note = CRISPR gRNA sequence
  source 1..20: mol_type = other DNA
cactttgggaggctgaggca

SEQ ID NO: 21701 - DNA, 20 bp, synthetic construct
  misc_feature 1..20: note = CRISPR gRNA sequence
  source 1..20: mol_type = other DNA
ttgggaggctgaggcaggag

SEQ ID NO: 21702 - DNA, 20 bp, synthetic construct
  misc_feature 1..20: note = CRISPR gRNA sequence
  source 1..20: mol_type = other DNA
ttgggaggctgaggcaggag

SEQ ID NO: 21703 - DNA, 20 bp, synthetic construct
  misc_feature 1..20: note = CRISPR gRNA sequence
  source 1..20: mol_type = other DNA
tatctttcatggaaatgagc

SEQ ID NO: 21704 - DNA, 20 bp, synthetic construct
  misc_feature 1..20: note = CRISPR gRNA sequence
  source 1..20: mol_type = other DNA
acagttaacttgttctgtaa

SEQ ID NO: 21705 - DNA, 20 bp, synthetic construct
  misc_feature 1..20: note = CRISPR gRNA sequence
  source 1..20: mol_type = other DNA
ctagaaggggagaggttctc

SEQ ID NO: 21706 - DNA, 20 bp, synthetic construct
  misc_feature 1..20: note = CRISPR gRNA sequence
  source 1..20: mol_type = other DNA
taagacttgggcacatgatg

SEQ ID NO: 21707 - DNA, 20 bp, synthetic construct
  misc_feature 1..20: note = CRISPR gRNA sequence
  source 1..20: mol_type = other DNA
atggcaggttttgaatgcag

SEQ ID NO: 21708 - DNA, 20 bp, synthetic construct
  misc_feature 1..20: note = CRISPR gRNA sequence
  source 1..20: mol_type = other DNA
cctctcacctctgagtctgc

SEQ ID NO: 21709 - DNA, 20 bp, synthetic construct
  misc_feature 1..20: note = CRISPR gRNA sequence
  source 1..20: mol_type = other DNA
tcttccacatccttcaggga

SEQ ID NO: 21710 - DNA, 20 bp, synthetic construct
  misc_feature 1..20: note = CRISPR gRNA sequence
  source 1..20: mol_type = other DNA
acttctcctctgctgcctga

SEQ ID NO: 21711 - DNA, 20 bp, synthetic construct
  misc_feature 1..20: note = CRISPR gRNA sequence
  source 1..20: mol_type = other DNA
tccatgaccactccagcctt

SEQ ID NO: 21712 - DNA, 20 bp, synthetic construct
  misc_feature 1..20: note = CRISPR gRNA sequence
  source 1..20: mol_type = other DNA
tactttctcacaactcacac

SEQ ID NO: 21713 - DNA, 20 bp, synthetic construct
  misc_feature 1..20: note = CRISPR gRNA sequence
  source 1..20: mol_type = other DNA
cacagtggttttctttccct

SEQ ID NO: 21714 - DNA, 20 bp, synthetic construct
  misc_feature 1..20: note = CRISPR gRNA sequence
  source 1..20: mol_type = other DNA
ggcacaattatgtaggacct

SEQ ID NO: 21715 - DNA, 20 bp, synthetic construct
  misc_feature 1..20: note = CRISPR gRNA sequence
  source 1..20: mol_type = other DNA
gaccttacagcttgggtaaa

SEQ ID NO: 21716 - DNA, 20 bp, synthetic construct
  misc_feature 1..20: note = CRISPR gRNA sequence
  source 1..20: mol_type = other DNA
gaaatatggaagcaatcctc

SEQ ID NO: 21717 - DNA, 20 bp, synthetic construct
  misc_feature 1..20: note = CRISPR gRNA sequence
  source 1..20: mol_type = other DNA
cgattaagctgaaatgctca

SEQ ID NO: 21718 - DNA, 20 bp, synthetic construct
  misc_feature 1..20: note = CRISPR gRNA sequence
  source 1..20: mol_type = other DNA
gacagtggtggagtgtccct

SEQ ID NO: 21719 - DNA, 20 bp, synthetic construct
  misc_feature 1..20: note = CRISPR gRNA sequence
  source 1..20: mol_type = other DNA
gtaagcagggatgggataca

SEQ ID NO: 21720 - DNA, 20 bp, synthetic construct
  misc_feature 1..20: note = CRISPR gRNA sequence
  source 1..20: mol_type = other DNA
acaatcagattcaagttctg

SEQ ID NO: 21721 - DNA, 20 bp, synthetic construct
  misc_feature 1..20: note = CRISPR gRNA sequence
  source 1..20: mol_type = other DNA
cagagagtccaaggggaggc

SEQ ID NO: 21722 - DNA, 20 bp, synthetic construct
  misc_feature 1..20: note = CRISPR gRNA sequence
  source 1..20: mol_type = other DNA
aaatttgagcccaggtcagt

SEQ ID NO: 21723 - DNA, 20 bp, synthetic construct
  misc_feature 1..20: note = CRISPR gRNA sequence
  source 1..20: mol_type = other DNA
aaaagagaccccacagagca

SEQ ID NO: 21724 - DNA, 20 bp, synthetic construct
  misc_feature 1..20: note = CRISPR gRNA sequence
  source 1..20: mol_type = other DNA
cccgcagtgtccccggctgc

SEQ ID NO: 21725 - DNA, 20 bp, synthetic construct
  misc_feature 1..20: note = CRISPR gRNA sequence
  source 1..20: mol_type = other DNA
tcaggtacctcgcaagcacc

SEQ ID NO: 21726 - DNA, 20 bp, synthetic construct
  misc_feature 1..20: note = CRISPR gRNA sequence
  source 1..20: mol_type = other DNA
gtactgcgggagctccttgt

SEQ ID NO: 21727 - DNA, 20 bp, synthetic construct
  misc_feature 1..20: note = CRISPR gRNA sequence
  source 1..20: mol_type = other DNA
gtctgcggcccagctcccag

SEQ ID NO: 21728 - DNA, 20 bp, synthetic construct
  misc_feature 1..20: note = CRISPR gRNA sequence
  source 1..20: mol_type = other DNA
agagtcccgtgagcgtggag

SEQ ID NO: 21729 - DNA, 20 bp, synthetic construct
  misc_feature 1..20: note = CRISPR gRNA sequence
  source 1..20: mol_type = other DNA
ggaggagggtgcaacctcgg

SEQ ID NO: 21730 - DNA, 20 bp, synthetic construct
  misc_feature 1..20: note = CRISPR gRNA sequence
  source 1..20: mol_type = other DNA
gtgctgtgcaggaagccatc

SEQ ID NO: 21731 - DNA, 20 bp, synthetic construct
  misc_feature 1..20: note = CRISPR gRNA sequence
  source 1..20: mol_type = other DNA
gcccaatagctcttgccctg

SEQ ID NO: 21732 - DNA, 20 bp, synthetic construct
  misc_feature 1..20: note = CRISPR gRNA sequence
  source 1..20: mol_type = other DNA
tcatttacatctgttcccca

SEQ ID NO: 21733 - DNA, 20 bp, synthetic construct
  misc_feature 1..20: note = CRISPR gRNA sequence
  source 1..20: mol_type = other DNA
atctgttccccacacagttt

SEQ ID NO: 21734 - DNA, 20 bp, synthetic construct
  misc_feature 1..20: note = CRISPR gRNA sequence
  source 1..20: mol_type = other DNA
gttccccacacagttttttt

SEQ ID NO: 21735 - DNA, 20 bp, synthetic construct
  misc_feature 1..20: note = CRISPR gRNA sequence
  source 1..20: mol_type = other DNA
cccacacagtttttttgttt

SEQ ID NO: 21736 - DNA, 20 bp, synthetic construct
  misc_feature 1..20: note = CRISPR gRNA sequence
  source 1..20: mol_type = other DNA
acagtttttttgtttgtttg

SEQ ID NO: 21737 - DNA, 20 bp, synthetic construct
  misc_feature 1..20: note = CRISPR gRNA sequence
  source 1..20: mol_type = other DNA
ttttttgtttgtttgttttg

SEQ ID NO: 21738 - DNA, 20 bp, synthetic construct
  misc_feature 1..20: note = CRISPR gRNA sequence
  source 1..20: mol_type = other DNA
tgttttgttttgagacaggg

SEQ ID NO: 21739 - DNA, 20 bp, synthetic construct
  misc_feature 1..20: note = CRISPR gRNA sequence
  source 1..20: mol_type = other DNA
gacaccatgcccagataatt

SEQ ID NO: 21740 - DNA, 20 bp, synthetic construct
  misc_feature 1..20: note = CRISPR gRNA sequence
  source 1..20: mol_type = other DNA
atggcacaatcatggtccac

SEQ ID NO: 21741 - DNA, 20 bp, synthetic construct
  misc_feature 1..20: note = CRISPR gRNA sequence
  source 1..20: mol_type = other DNA
atgcctggctaatttttctt

SEQ ID NO: 21742 - DNA, 20 bp, synthetic construct
  misc_feature 1..20: note = CRISPR gRNA sequence
  source 1..20: mol_type = other DNA
cgccttggcctcccaaagtg

SEQ ID NO: 21743 - DNA, 20 bp, synthetic construct
  misc_feature 1..20: note = CRISPR gRNA sequence
  source 1..20: mol_type = other DNA
gcccccatacagtcttcatc

SEQ ID NO: 21744 - DNA, 20 bp, synthetic construct
  misc_feature 1..20: note = CRISPR gRNA sequence
  source 1..20: mol_type = other DNA
attccttcactcatcgtctc

SEQ ID NO: 21745 - DNA, 20 bp, synthetic construct
  misc_feature 1..20: note = CRISPR gRNA sequence
  source 1..20: mol_type = other DNA
ctcacggcaacctccacctc

SEQ ID NO: 21746 - DNA, 20 bp, synthetic construct
  misc_feature 1..20: note = CRISPR gRNA sequence
  source 1..20: mol_type = other DNA
aacctccacctcctgggttt

SEQ ID NO: 21747 - DNA, 20 bp, synthetic construct
  misc_feature 1..20: note = CRISPR gRNA sequence
  source 1..20: mol_type = other DNA
tgcctcggcctgccaagtag

SEQ ID NO: 21748 - DNA, 20 bp, synthetic construct
  misc_feature 1..20: note = CRISPR gRNA sequence
  source 1..20: mol_type = other DNA
tttgtattttttaatggaga

SEQ ID NO: 21749 - DNA, 20 bp, synthetic construct
  misc_feature 1..20: note = CRISPR gRNA sequence
  source 1..20: mol_type = other DNA
tgccttggcctcccaaagtg

SEQ ID NO: 21750 - DNA, 20 bp, synthetic construct
  misc_feature 1..20: note = CRISPR gRNA sequence
  source 1..20: mol_type = other DNA
ctcattccttcatttactca

SEQ ID NO: 21751 - DNA, 20 bp, synthetic construct
  misc_feature 1..20: note = CRISPR gRNA sequence
  source 1..20: mol_type = other DNA
atttactcactaagcttttt

SEQ ID NO: 21752 - DNA, 20 bp, synthetic construct
  misc_feature 1..20: note = CRISPR gRNA sequence
  source 1..20: mol_type = other DNA
tctggaaaatggggataata

SEQ ID NO: 21753 - DNA, 20 bp, synthetic construct
  misc_feature 1..20: note = CRISPR gRNA sequence
  source 1..20: mol_type = other DNA
attgggattgtgtgagatgt

SEQ ID NO: 21754 - DNA, 20 bp, synthetic construct
  misc_feature 1..20: note = CRISPR gRNA sequence
  source 1..20: mol_type = other DNA
ttaatgatttagcataccta

SEQ ID NO: 21755 - DNA, 20 bp, synthetic construct
  misc_feature 1..20: note = CRISPR gRNA sequence
  source 1..20: mol_type = other DNA
atttagtaattctcttattc

SEQ ID NO: 21756 - DNA, 20 bp, synthetic construct
  misc_feature 1..20: note = CRISPR gRNA sequence
  source 1..20: mol_type = other DNA
atccactcactcacttcatc

SEQ ID NO: 21757 - DNA, 20 bp, synthetic construct
  misc_feature 1..20: note = CRISPR gRNA sequence
  source 1..20: mol_type = other DNA
atgaagtgttaacacccagt

SEQ ID NO: 21758 - DNA, 20 bp, synthetic construct
  misc_feature 1..20: note = CRISPR gRNA sequence
  source 1..20: mol_type = other DNA
tgagcaatgtgaagccagat

SEQ ID NO: 21759 - DNA, 20 bp, synthetic construct
  misc_feature 1..20: note = CRISPR gRNA sequence
  source 1..20: mol_type = other DNA
atcactcaccaggccatttt

SEQ ID NO: 21760 - DNA, 20 bp, synthetic construct
  misc_feature 1..20: note = CRISPR gRNA sequence
  source 1..20: mol_type = other DNA
ctggagatggagaagcaggt

SEQ ID NO: 21761 - DNA, 20 bp, synthetic construct
  misc_feature 1..20: note = CRISPR gRNA sequence
  source 1..20: mol_type = other DNA
gtccttacagccttcatggg

SEQ ID NO: 21762 - DNA, 20 bp, synthetic construct
  misc_feature 1..20: note = CRISPR gRNA sequence
  source 1..20: mol_type = other DNA
tgtacttttaaaaatttcac

SEQ ID NO: 21763 - DNA, 20 bp, synthetic construct
  misc_feature 1..20: note = CRISPR gRNA sequence
  source 1..20: mol_type = other DNA
cacaatatctatgtaaaaat

SEQ ID NO: 21764 - DNA, 20 bp, synthetic construct
  misc_feature 1..20: note = CRISPR gRNA sequence
  source 1..20: mol_type = other DNA
caaaagatctgaccacattg

SEQ ID NO: 21765 - DNA, 20 bp, synthetic construct
  misc_feature 1..20: note = CRISPR gRNA sequence
  source 1..20: mol_type = other DNA
atggctgtatttggatggga

SEQ ID NO: 21766 - DNA, 20 bp, synthetic construct
  misc_feature 1..20: note = CRISPR gRNA sequence
  source 1..20: mol_type = other DNA
catgacctgttgtccctaca

SEQ ID NO: 21767 - DNA, 20 bp, synthetic construct
  misc_feature 1..20: note = CRISPR gRNA sequence
  source 1..20: mol_type = other DNA
cctgttgtccctacaggcag

SEQ ID NO: 21768 - DNA, 20 bp, synthetic construct
  misc_feature 1..20: note = CRISPR gRNA sequence
  source 1..20: mol_type = other DNA
ttccttccccagggcctcga

SEQ ID NO: 21769 - DNA, 20 bp, synthetic construct
  misc_feature 1..20: note = CRISPR gRNA sequence
  source 1..20: mol_type = other DNA
gccctaagggtccttacctg

SEQ ID NO: 21770 - DNA, 20 bp, synthetic construct
  misc_feature 1..20: note = CRISPR gRNA sequence
  source 1..20: mol_type = other DNA
gtggtgtgagaataaccagg

SEQ ID NO: 21771 - DNA, 20 bp, synthetic construct
  misc_feature 1..20: note = CRISPR gRNA sequence
  source 1..20: mol_type = other DNA
gttacatctagctcctggaa

SEQ ID NO: 21772 - DNA, 20 bp, synthetic construct
  misc_feature 1..20: note = CRISPR gRNA sequence
  source 1..20: mol_type = other DNA
tcattttcctagatatcagg

SEQ ID NO: 21773 - DNA, 20 bp, synthetic construct
  misc_feature 1..20: note = CRISPR gRNA sequence
  source 1..20: mol_type = other DNA
ctagatatcaggaactgctt

SEQ ID NO: 21774 - DNA, 20 bp, synthetic construct
  misc_feature 1..20: note = CRISPR gRNA sequence
  source 1..20: mol_type = other DNA
tgggtcagtagggaccattt

SEQ ID NO: 21775 - DNA, 20 bp, synthetic construct
  misc_feature 1..20: note = CRISPR gRNA sequence
  source 1..20: mol_type = other DNA
tcttgtaaacatcacttgtc

SEQ ID NO: 21776 - DNA, 20 bp, synthetic construct
  misc_feature 1..20: note = CRISPR gRNA sequence
  source 1..20: mol_type = other DNA
cacctcaggaatctctgctc

SEQ ID NO: 21777 - DNA, 20 bp, synthetic construct
  misc_feature 1..20: note = CRISPR gRNA sequence
  source 1..20: mol_type = other DNA
caggaatctctgctcttctg

SEQ ID NO: 21778 - DNA, 20 bp, synthetic construct
  misc_feature 1..20: note = CRISPR gRNA sequence
  source 1..20: mol_type = other DNA
ggagacccctgttccagcct

SEQ ID NO: 21779 - DNA, 20 bp, synthetic construct
  misc_feature 1..20: note = CRISPR gRNA sequence
  source 1..20: mol_type = other DNA
caaactggatgggtccctca

SEQ ID NO: 21780 - DNA, 20 bp, synthetic construct
  misc_feature 1..20: note = CRISPR gRNA sequence
  source 1..20: mol_type = other DNA
ggtgggatcttgcatagcac

SEQ ID NO: 21781 - DNA, 20 bp, synthetic construct
  misc_feature 1..20: note = CRISPR gRNA sequence
  source 1..20: mol_type = other DNA
atcttgcatagcacctgtgt

SEQ ID NO: 21782 - DNA, 20 bp, synthetic construct
  misc_feature 1..20: note = CRISPR gRNA sequence
  source 1..20: mol_type = other DNA
catagcacctgtgtttgcga

SEQ ID NO: 21783 - DNA, 20 bp, synthetic construct
  misc_feature 1..20: note = CRISPR gRNA sequence
  source 1..20: mol_type = other DNA
acctgtgtttgcgattctgc

SEQ ID NO: 21784 - DNA, 20 bp, synthetic construct
  misc_feature 1..20: note = CRISPR gRNA sequence
  source 1..20: mol_type = other DNA
ttgcgattctgcttttgctt

SEQ ID NO: 21785 - DNA, 20 bp, synthetic construct
  misc_feature 1..20: note = CRISPR gRNA sequence
  source 1..20: mol_type = other DNA
ctaatttccctaagagcagt

SEQ ID NO: 21786 - DNA, 20 bp, synthetic construct
  misc_feature 1..20: note = CRISPR gRNA sequence
  source 1..20: mol_type = other DNA
caggtgaatgctctaattgg

SEQ ID NO: 21787 - DNA, 20 bp, synthetic construct
  misc_feature 1..20: note = CRISPR gRNA sequence
  source 1..20: mol_type = other DNA
ccctcctgatgctcgcacgg

SEQ ID NO: 21788 - DNA, 20 bp, synthetic construct
  misc_feature 1..20: note = CRISPR gRNA sequence
  source 1..20: mol_type = other DNA
ttctgaggcatgttctctgc

SEQ ID NO: 21789 - DNA, 20 bp, synthetic construct
  misc_feature 1..20: note = CRISPR gRNA sequence
  source 1..20: mol_type = other DNA
cctaacatactgggaatctg

SEQ ID NO: 21790 - DNA, 20 bp, synthetic construct
  misc_feature 1..20: note = CRISPR gRNA sequence
  source 1..20: mol_type = other DNA
agtgggctgtgttagagact

SEQ ID NO: 21791 - DNA, 20 bp, synthetic construct
  misc_feature 1..20: note = CRISPR gRNA sequence
  source 1..20: mol_type = other DNA
gatgtctctcctgacagagg

SEQ ID NO: 21792 - DNA, 20 bp, synthetic construct
  misc_feature 1..20: note = CRISPR gRNA sequence
  source 1..20: mol_type = other DNA
cagcccacctgccctgcaca

SEQ ID NO: 21793 - DNA, 20 bp, synthetic construct
  misc_feature 1..20: note = CRISPR gRNA sequence
  source 1..20: mol_type = other DNA
tgccctgcacacctggcttc

SEQ ID NO: 21794 - DNA, 20 bp, synthetic construct
  misc_feature 1..20: note = CRISPR gRNA sequence
  source 1..20: mol_type = other DNA
taacattccaaccccagctc

SEQ ID NO: 21795 - DNA, 20 bp, synthetic construct
  misc_feature 1..20: note = CRISPR gRNA sequence
  source 1..20: mol_type = other DNA
gtcacaaatggggacacaac

SEQ ID NO: 21796 - DNA, 20 bp, synthetic construct
  misc_feature 1..20: note = CRISPR gRNA sequence
  source 1..20: mol_type = other DNA
aaacaaaacaaaacaaagga

SEQ ID NO: 21797 - DNA, 20 bp, synthetic construct
  misc_feature 1..20: note = CRISPR gRNA sequence
  source 1..20: mol_type = other DNA
aacaaaggaacctgcttttg

SEQ ID NO: 21798 - DNA, 20 bp, synthetic construct
  misc_feature 1..20: note = CRISPR gRNA sequence
  source 1..20: mol_type = other DNA
ctagctgtgtgcctttgcaa

SEQ ID NO: 21799 - DNA, 20 bp, synthetic construct
  misc_feature 1..20: note = CRISPR gRNA sequence
  source 1..20: mol_type = other DNA
gagtatcaagcactcacagc

SEQ ID NO: 21800 - DNA, 20 bp, synthetic construct
  misc_feature 1..20: note = CRISPR gRNA sequence
  source 1..20: mol_type = other DNA
ccacgtgtcccttagcaagg

SEQ ID NO: 21801 - DNA, 20 bp, synthetic construct
  misc_feature 1..20: note = CRISPR gRNA sequence
  source 1..20: mol_type = other DNA
caatcttggctcactgcaac

SEQ ID NO: 21802 - DNA, 20 bp, synthetic construct
  misc_feature 1..20: note = CRISPR gRNA sequence
  source 1..20: mol_type = other DNA
aacctctgcttcttaggttc

SEQ ID NO: 21803 - DNA, 20 bp, synthetic construct
  misc_feature 1..20: note = CRISPR gRNA sequence
  source 1..20: mol_type = other DNA
caccctagcctccctggtag

SEQ ID NO: 21804 - DNA, 20 bp, synthetic construct
  misc_feature 1..20: note = CRISPR gRNA sequence
  source 1..20: mol_type = other DNA
ttttgtatttttagtagaga

SEQ ID NO: 21805 - DNA, 20 bp, synthetic construct
  misc_feature 1..20: note = CRISPR gRNA sequence
  source 1..20: mol_type = other DNA
agccttggcctcccaaagtg

SEQ ID NO: 21806 - DNA, 20 bp, synthetic construct
  misc_feature 1..20: note = CRISPR gRNA sequence
  source 1..20: mol_type = other DNA
aaattaaagcaaatacagga

SEQ ID NO: 21807 - DNA, 20 bp, synthetic construct
  misc_feature 1..20: note = CRISPR gRNA sequence
  source 1..20: mol_type = other DNA
actacagaacaggagtggga

SEQ ID NO: 21808 - DNA, 20 bp, synthetic construct
  misc_feature 1..20: note = CRISPR gRNA sequence
  source 1..20: mol_type = other DNA
ctgaatattcttttggttgt

SEQ ID NO: 21809 - DNA, 20 bp, synthetic construct
  misc_feature 1..20: note = CRISPR gRNA sequence
  source 1..20: mol_type = other DNA
aacctccacctcctgggttc

SEQ ID NO: 21810 - DNA, 20 bp, synthetic construct
  misc_feature 1..20: note = CRISPR gRNA sequence
  source 1..20: mol_type = other DNA
tgcctcagcctcccgagtag

SEQ ID NO: 21811 - DNA, 20 bp, synthetic construct
  misc_feature 1..20: note = CRISPR gRNA sequence
  source 1..20: mol_type = other DNA
tttgtattttttggtagaga

SEQ ID NO: 21812 - DNA, 20 bp, synthetic construct
  misc_feature 1..20: note = CRISPR gRNA sequence
  source 1..20: mol_type = other DNA
ccccttggcctcccaaactg

SEQ ID NO: 21813 - DNA, 20 bp, synthetic construct
  misc_feature 1..20: note = CRISPR gRNA sequence
  source 1..20: mol_type = other DNA
tttaaaatctcataccctgt

SEQ ID NO: 21814 - DNA, 20 bp, synthetic construct
  misc_feature 1..20: note = CRISPR gRNA sequence
  source 1..20: mol_type = other DNA
tcataccctgtgtgcgattc

SEQ ID NO: 21815 - DNA, 20 bp, synthetic construct
  misc_feature 1..20: note = CRISPR gRNA sequence
  source 1..20: mol_type = other DNA
aactgttacacccattttac

SEQ ID NO: 21816 - DNA, 20 bp, synthetic construct
  misc_feature 1..20: note = CRISPR gRNA sequence
  source 1..20: mol_type = other DNA
gaagggttccaggaagaggt

SEQ ID NO: 21817 - DNA, 20 bp, synthetic construct
  misc_feature 1..20: note = CRISPR gRNA sequence
  source 1..20: mol_type = other DNA
tgacagtttagccaacacca

SEQ ID NO: 21818 - DNA, 20 bp, synthetic construct
  misc_feature 1..20: note = CRISPR gRNA sequence
  source 1..20: mol_type = other DNA
tatagcaactgcaaaggccc

SEQ ID NO: 21819 - DNA, 20 bp, synthetic construct
  misc_feature 1..20: note = CRISPR gRNA sequence
  source 1..20: mol_type = other DNA
ctgaagtgtggtgtctcata

SEQ ID NO: 21820 - DNA, 20 bp, synthetic construct
  misc_feature 1..20: note = CRISPR gRNA sequence
  source 1..20: mol_type = other DNA
atgtacattttaaggctcct

SEQ ID NO: 21821 - DNA, 20 bp, synthetic construct
  misc_feature 1..20: note = CRISPR gRNA sequence
  source 1..20: mol_type = other DNA
ggaagcaagttggacccaca

SEQ ID NO: 21822 - DNA, 20 bp, synthetic construct
  misc_feature 1..20: note = CRISPR gRNA sequence
  source 1..20: mol_type = other DNA
gcacacagtggggactcaag

SEQ ID NO: 21823 - DNA, 20 bp, synthetic construct
  misc_feature 1..20: note = CRISPR gRNA sequence
  source 1..20: mol_type = other DNA
ggcagaatggtagagttact

SEQ ID NO: 21824 - DNA, 20 bp, synthetic construct
  misc_feature 1..20: note = CRISPR gRNA sequence
  source 1..20: mol_type = other DNA
ggtggaatagggcaatcagg

SEQ ID NO: 21825 - DNA, 20 bp, synthetic construct
  misc_feature 1..20: note = CRISPR gRNA sequence
  source 1..20: mol_type = other DNA
agtctgggagaaggagaaca

SEQ ID NO: 21826 - DNA, 20 bp, synthetic construct
  misc_feature 1..20: note = CRISPR gRNA sequence
  source 1..20: mol_type = other DNA
agtgaggaaacttgttcaga

SEQ ID NO: 21827 - DNA, 20 bp, synthetic construct
  misc_feature 1..20: note = CRISPR gRNA sequence
  source 1..20: mol_type = other DNA
gagagataggtgacggtggt

SEQ ID NO: 21828 - DNA, 20 bp, synthetic construct
  misc_feature 1..20: note = CRISPR gRNA sequence
  source 1..20: mol_type = other DNA
tcatgctggggaaagttagg

SEQ ID NO: 21829 - DNA, 20 bp, synthetic construct
  misc_feature 1..20: note = CRISPR gRNA sequence
  source 1..20: mol_type = other DNA
ataagcaatggggagccata

SEQ ID NO: 21830 - DNA, 20 bp, synthetic construct
  misc_feature 1..20: note = CRISPR gRNA sequence
  source 1..20: mol_type = other DNA
ggtagtacctaacatctact

SEQ ID NO: 21831 - DNA, 20 bp, synthetic construct
  misc_feature 1..20: note = CRISPR gRNA sequence
  source 1..20: mol_type = other DNA
tctgtgcaaattccttttct

SEQ ID NO: 21832 - DNA, 20 bp, synthetic construct
  misc_feature 1..20: note = CRISPR gRNA sequence
  source 1..20: mol_type = other DNA
caaccatcccgtgatggtgg

SEQ ID NO: 21833 - DNA, 20 bp, synthetic construct
  misc_feature 1..20: note = CRISPR gRNA sequence
  source 1..20: mol_type = other DNA
aaaagaatacttgcccaggc

SEQ ID NO: 21834 - DNA, 20 bp, synthetic construct
  misc_feature 1..20: note = CRISPR gRNA sequence
  source 1..20: mol_type = other DNA
gaagctgcctgttatgacgt

SEQ ID NO: 21835 - DNA, 20 bp, synthetic construct
  misc_feature 1..20: note = CRISPR gRNA sequence
  source 1..20: mol_type = other DNA
tggggcctttaagaggtgac

SEQ ID NO: 21836 - DNA, 20 bp, synthetic construct
  misc_feature 1..20: note = CRISPR gRNA sequence
  source 1..20: mol_type = other DNA
gatgaatgggttaatccgtt

SEQ ID NO: 21837 - DNA, 20 bp, synthetic construct
  misc_feature 1..20: note = CRISPR gRNA sequence
  source 1..20: mol_type = other DNA
gttgtcgtgggagtaagact

SEQ ID NO: 21838 - DNA, 20 bp, synthetic construct
  misc_feature 1..20: note = CRISPR gRNA sequence
  source 1..20: mol_type = other DNA
aaattactcagtgtcaggta

SEQ ID NO: 21839 - DNA, 20 bp, synthetic construct
  misc_feature 1..20: note = CRISPR gRNA sequence
  source 1..20: mol_type = other DNA
actaacgcactgcctcacct

SEQ ID NO: 21840 - DNA, 20 bp, synthetic construct
  misc_feature 1..20: note = CRISPR gRNA sequence
  source 1..20: mol_type = other DNA
ctgcctcacctatttgctta

SEQ ID NO: 21841 - DNA, 20 bp, synthetic construct
  misc_feature 1..20: note = CRISPR gRNA sequence
  source 1..20: mol_type = other DNA
atgtcctcagccccaatcac

SEQ ID NO: 21842 - DNA, 20 bp, synthetic construct
  misc_feature 1..20: note = CRISPR gRNA sequence
  source 1..20: mol_type = other DNA
cccctccattttcttccttg

SEQ ID NO: 21843 - DNA, 20 bp, synthetic construct
  misc_feature 1..20: note = CRISPR gRNA sequence
  source 1..20: mol_type = other DNA
gcaggaagaagaccactaag

SEQ ID NO: 21844 - DNA, 20 bp, synthetic construct
  misc_feature 1..20: note = CRISPR gRNA sequence
  source 1..20: mol_type = other DNA
aaggaaaatgggggcaggac

SEQ ID NO: 21845 - DNA, 20 bp, synthetic construct
  misc_feature 1..20: note = CRISPR gRNA sequence
  source 1..20: mol_type = other DNA
gtggtggtgatgctggtgag

SEQ ID NO: 21846 - DNA, 20 bp, synthetic construct
  misc_feature 1..20: note = CRISPR gRNA sequence
  source 1..20: mol_type = other DNA
agctcttcttaaggctacaa

SEQ ID NO: 21847 - DNA, 20 bp, synthetic construct
  misc_feature 1..20: note = CRISPR gRNA sequence
  source 1..20: mol_type = other DNA
ttaaggctacaaattagctt

SEQ ID NO: 21848 - DNA, 20 bp, synthetic construct
  misc_feature 1..20: note = CRISPR gRNA sequence
  source 1..20: mol_type = other DNA
ctctaatgcaaacttgggta

SEQ ID NO: 21849 - DNA, 20 bp, synthetic construct
  misc_feature 1..20: note = CRISPR gRNA sequence
  source 1..20: mol_type = other DNA
atgtatttcctttgttgttg

SEQ ID NO: 21850 - DNA, 20 bp, synthetic construct
  misc_feature 1..20: note = CRISPR gRNA sequence
  source 1..20: mol_type = other DNA
ctagttattacaaatactag

SEQ ID NO: 21851 - DNA, 20 bp, synthetic construct
  misc_feature 1..20: note = CRISPR gRNA sequence
  source 1..20: mol_type = other DNA
aagggaaaggggtgtatggt

SEQ ID NO: 21852 - DNA, 20 bp, synthetic construct
  misc_feature 1..20: note = CRISPR gRNA sequence
  source 1..20: mol_type = other DNA
tggaggtggaggatgtaaac

SEQ ID NO: 21853 - DNA, 20 bp, synthetic construct
  misc_feature 1..20: note = CRISPR gRNA sequence
  source 1..20: mol_type = other DNA
tggaggatgtaaacatgaga

SEQ ID NO: 21854 - DNA, 20 bp, synthetic construct
  misc_feature 1..20: note = CRISPR gRNA sequence
  source 1..20: mol_type = other DNA
attgctccgcatcccccttg

SEQ ID NO: 21855 - DNA, 20 bp, synthetic construct
  misc_feature 1..20: note = CRISPR gRNA sequence
  source 1..20: mol_type = other DNA
tggcagcaaagaactcttgc

SEQ ID NO: 21856 - DNA, 20 bp, synthetic construct
  misc_feature 1..20: note = CRISPR gRNA sequence
  source 1..20: mol_type = other DNA
gattgtccttttctgggctc

SEQ ID NO: 21857 - DNA, 20 bp, synthetic construct
  misc_feature 1..20: note = CRISPR gRNA sequence
  source 1..20: mol_type = other DNA
agggcagggaccagaatttc

SEQ ID NO: 21858 - DNA, 20 bp, synthetic construct
  misc_feature 1..20: note = CRISPR gRNA sequence
  source 1..20: mol_type = other DNA
tagaaaagggaactggaaag

SEQ ID NO: 21859 - DNA, 20 bp, synthetic construct
  misc_feature 1..20: note = CRISPR gRNA sequence
  source 1..20: mol_type = other DNA
atgccatgagtggtaacagc

SEQ ID NO: 21860 - DNA, 20 bp, synthetic construct
  misc_feature 1..20: note = CRISPR gRNA sequence
  source 1..20: mol_type = other DNA
aactgaggctcagagaggtg

SEQ ID NO: 21861 - DNA, 20 bp, synthetic construct
  misc_feature 1..20: note = CRISPR gRNA sequence
  source 1..20: mol_type = other DNA
aaacccatgtccaagtggaa

SEQ ID NO: 21862 - DNA, 20 bp, synthetic construct
  misc_feature 1..20: note = CRISPR gRNA sequence
  source 1..20: mol_type = other DNA
tgcatttaaccacaatgctc

SEQ ID NO: 21863 - DNA, 20 bp, synthetic construct
  misc_feature 1..20: note = CRISPR gRNA sequence
  source 1..20: mol_type = other DNA
gtctctgctcctttctgtgc

SEQ ID NO: 21864 - DNA, 20 bp, synthetic construct
  misc_feature 1..20: note = CRISPR gRNA sequence
  source 1..20: mol_type = other DNA
atgtaaactgaaggagtctg

SEQ ID NO: 21865 - DNA, 20 bp, synthetic construct
  misc_feature 1..20: note = CRISPR gRNA sequence
  source 1..20: mol_type = other DNA
tgaaggagtctgagcagatt

SEQ ID NO: 21866 - DNA, 20 bp, synthetic construct
  misc_feature 1..20: note = CRISPR gRNA sequence
  source 1..20: mol_type = other DNA
aaataaatggataaacaaaa

SEQ ID NO: 21867 - DNA, 20 bp, synthetic construct
  misc_feature 1..20: note = CRISPR gRNA sequence
  source 1..20: mol_type = other DNA
gacacaaagggtcacatatt

SEQ ID NO: 21868 - DNA, 20 bp, synthetic construct
  misc_feature 1..20: note = CRISPR gRNA sequence
  source 1..20: mol_type = other DNA
ttgggaggctgagacaggag

SEQ ID NO: 21869 - DNA, 20 bp, synthetic construct
  misc_feature 1..20: note = CRISPR gRNA sequence
  source 1..20: mol_type = other DNA
aaagcatattagtggttgcc

SEQ ID NO: 21870 - DNA, 20 bp, synthetic construct
  misc_feature 1..20: note = CRISPR gRNA sequence
  source 1..20: mol_type = other DNA
gttgcctagggcttggcaga

SEQ ID NO: 21871 - DNA, 20 bp, synthetic construct
  misc_feature 1..20: note = CRISPR gRNA sequence
  source 1..20: mol_type = other DNA
ggaacaactgctgatgggtc

SEQ ID NO: 21872 - DNA, 20 bp, synthetic construct
  misc_feature 1..20: note = CRISPR gRNA sequence
  source 1..20: mol_type = other DNA
tgcctcagcctcctgagcag

SEQ ID NO: 21873 - DNA, 20 bp, synthetic construct
  misc_feature 1..20: note = CRISPR gRNA sequence
  source 1..20: mol_type = other DNA
ttttgcatttttagtagaga

SEQ ID NO: 21874 - DNA, 20 bp, synthetic construct
  misc_feature 1..20: note = CRISPR gRNA sequence
  source 1..20: mol_type = other DNA
ctcctcggcctcccaaagtg

SEQ ID NO: 21875 - DNA, 20 bp, synthetic construct
  misc_feature 1..20: note = CRISPR gRNA sequence
  source 1..20: mol_type = other DNA
cttgagacccagagaagaca

SEQ ID NO: 21876 - DNA, 20 bp, synthetic construct
  misc_feature 1..20: note = CRISPR gRNA sequence
  source 1..20: mol_type = other DNA
ccaggatccgtggttcaggt

SEQ ID NO: 21877 - DNA, 20 bp, synthetic construct
  misc_feature 1..20: note = CRISPR gRNA sequence
  source 1..20: mol_type = other DNA
cctctggaggctcgagggga

SEQ ID NO: 21878 - DNA, 20 bp, synthetic construct
  misc_feature 1..20: note = CRISPR gRNA sequence
  source 1..20: mol_type = other DNA
tgtggctgcatcactctaaa

SEQ ID NO: 21879 - DNA, 20 bp, synthetic construct
  misc_feature 1..20: note = CRISPR gRNA sequence
  source 1..20: mol_type = other DNA
ctcttataaagacacttgtc

SEQ ID NO: 21880 - DNA, 20 bp, synthetic construct
  misc_feature 1..20: note = CRISPR gRNA sequence
  source 1..20: mol_type = other DNA
tttttgccttcttttgagac

SEQ ID NO: 21881 - DNA, 20 bp, synthetic construct
  misc_feature 1..20: note = CRISPR gRNA sequence
  source 1..20: mol_type = other DNA
caacctccacctcccagttc

SEQ ID NO: 21882 - DNA, 20 bp, synthetic construct
  misc_feature 1..20: note = CRISPR gRNA sequence
  source 1..20: mol_type = other DNA
tgccccagtctcctgagtag

SEQ ID NO: 21883 - DNA, 20 bp, synthetic construct
  misc_feature 1..20: note = CRISPR gRNA sequence
  source 1..20: mol_type = other DNA
ttttgtatttttagtagaaa

SEQ ID NO: 21884 - DNA, 20 bp, synthetic construct
  misc_feature 1..20: note = CRISPR gRNA sequence
  source 1..20: mol_type = other DNA
acctcaggtgatcctccaat

SEQ ID NO: 21885 - DNA, 20 bp, synthetic construct
  misc_feature 1..20: note = CRISPR gRNA sequence
  source 1..20: mol_type = other DNA
aatctcagcttcccaaagtg

SEQ ID NO: 21886 - DNA, 20 bp, synthetic construct
  misc_feature 1..20: note = CRISPR gRNA sequence
  source 1..20: mol_type = other DNA
aaagtcacactgacaggttc

SEQ ID NO: 21887 - DNA, 20 bp, synthetic construct
  misc_feature 1..20: note = CRISPR gRNA sequence
  source 1..20: mol_type = other DNA
gaaggctggaaagaaacaga

SEQ ID NO: 21888 - DNA, 20 bp, synthetic construct
  misc_feature 1..20: note = CRISPR gRNA sequence
  source 1..20: mol_type = other DNA
gctcactgcaacctctgcct

SEQ ID NO: 21889 - DNA, 20 bp, synthetic construct
  misc_feature 1..20: note = CRISPR gRNA sequence
  source 1..20: mol_type = other DNA
ctcccggattcaagcaattc

SEQ ID NO: 21890 - DNA, 20 bp, synthetic construct
  misc_feature 1..20: note = CRISPR gRNA sequence
  source 1..20: mol_type = other DNA
ttttttatttttagtaaaga

SEQ ID NO: 21891 - DNA, 20 bp, synthetic construct
  misc_feature 1..20: note = CRISPR gRNA sequence
  source 1..20: mol_type = other DNA
ggtttcaccatgttggtcag

SEQ ID NO: 21892 - DNA, 20 bp, synthetic construct
  misc_feature 1..20: note = CRISPR gRNA sequence
  source 1..20: mol_type = other DNA
cgccttggcctcccaaagtg

SEQ ID NO: 21893 - DNA, 20 bp, synthetic construct
  misc_feature 1..20: note = CRISPR gRNA sequence
  source 1..20: mol_type = other DNA
cccattttctttcacgcatc

SEQ ID NO: 21894 - DNA, 20 bp, synthetic construct
  misc_feature 1..20: note = CRISPR gRNA sequence
  source 1..20: mol_type = other DNA
gctgcaggaacccaaacata

SEQ ID NO: 21895 - DNA, 20 bp, synthetic construct
  misc_feature 1..20: note = CRISPR gRNA sequence
  source 1..20: mol_type = other DNA
gactttgggccatatctata

SEQ ID NO: 21896 - DNA, 20 bp, synthetic construct
  misc_feature 1..20: note = CRISPR gRNA sequence
  source 1..20: mol_type = other DNA
aaaataataagttacccaaa

SEQ ID NO: 21897 - DNA, 20 bp, synthetic construct
  misc_feature 1..20: note = CRISPR gRNA sequence
  source 1..20: mol_type = other DNA
attgggtctgccagggacct

SEQ ID NO: 21898 - DNA, 20 bp, synthetic construct
  misc_feature 1..20: note = CRISPR gRNA sequence
  source 1..20: mol_type = other DNA
cacccccacttattgatgag

SEQ ID NO: 21899 - DNA, 20 bp, synthetic construct
  misc_feature 1..20: note = CRISPR gRNA sequence
  source 1..20: mol_type = other DNA
agggaaagaaggcaagtatc

SEQ ID NO: 21900 - DNA, 20 bp, synthetic construct
  misc_feature 1..20: note = CRISPR gRNA sequence
  source 1..20: mol_type = other DNA
ttttttaaaccacttggagc

SEQ ID NO: 21901 - DNA, 20 bp, synthetic construct
  misc_feature 1..20: note = CRISPR gRNA sequence
  source 1..20: mol_type = other DNA
gaataataattggcaactca

SEQ ID NO: 21902 - DNA, 20 bp, synthetic construct
  misc_feature 1..20: note = CRISPR gRNA sequence
  source 1..20: mol_type = other DNA
tcagtaagtgctgaatgaac

SEQ ID NO: 21903 - DNA, 20 bp, synthetic construct
  misc_feature 1..20: note = CRISPR gRNA sequence
  source 1..20: mol_type = other DNA
tgaacagaagtttaaggcag

SEQ ID NO: 21904 - DNA, 20 bp, synthetic construct
  misc_feature 1..20: note = CRISPR gRNA sequence
  source 1..20: mol_type = other DNA
tatgtgtgatggccatcatt

SEQ ID NO: 21905 - DNA, 20 bp, synthetic construct
  misc_feature 1..20: note = CRISPR gRNA sequence
  source 1..20: mol_type = other DNA
tgtgatggccatcattatta

SEQ ID NO: 21906 - DNA, 20 bp, synthetic construct
  misc_feature 1..20: note = CRISPR gRNA sequence
  source 1..20: mol_type = other DNA
catcattattagtttgcttc

SEQ ID NO: 21907 - DNA, 20 bp, synthetic construct
  misc_feature 1..20: note = CRISPR gRNA sequence
  source 1..20: mol_type = other DNA
cgaggtcaaactttgtgaag

SEQ ID NO: 21908 - DNA, 20 bp, synthetic construct
  misc_feature 1..20: note = CRISPR gRNA sequence
  source 1..20: mol_type = other DNA
caggagtatcacctcagtcc

SEQ ID NO: 21909 - DNA, 20 bp, synthetic construct
  misc_feature 1..20: note = CRISPR gRNA sequence
  source 1..20: mol_type = other DNA
tcaggaggctgaggtgggag

SEQ ID NO: 21910 - DNA, 20 bp, synthetic construct
  misc_feature 1..20: note = CRISPR gRNA sequence
  source 1..20: mol_type = other DNA
ggtgtcaaggctgcagtgaa

SEQ ID NO: 21911 - DNA, 20 bp, synthetic construct
  misc_feature 1..20: note = CRISPR gRNA sequence
  source 1..20: mol_type = other DNA
aaggcccccacagccagcag

SEQ ID NO: 21912 - DNA, 20 bp, synthetic construct
  misc_feature 1..20: note = CRISPR gRNA sequence
  source 1..20: mol_type = other DNA
acacatttcagcgccccact

SEQ ID NO: 21913 - DNA, 20 bp, synthetic construct
  misc_feature 1..20: note = CRISPR gRNA sequence
  source 1..20: mol_type = other DNA
agcacttcctcttgggtgat

SEQ ID NO: 21914 - DNA, 20 bp, synthetic construct
  misc_feature 1..20: note = CRISPR gRNA sequence
  source 1..20: mol_type = other DNA
gggtagagtgttatgcccat

SEQ ID NO: 21915 - DNA, 20 bp, synthetic construct
  misc_feature 1..20: note = CRISPR gRNA sequence
  source 1..20: mol_type = other DNA
aggttcacacgcctcagtga

SEQ ID NO: 21916 - DNA, 20 bp, synthetic construct
  misc_feature 1..20: note = CRISPR gRNA sequence
  source 1..20: mol_type = other DNA
aaatggcttgtccaaggtca

SEQ ID NO: 21917 - DNA, 20 bp, synthetic construct
  misc_feature 1..20: note = CRISPR gRNA sequence
  source 1..20: mol_type = other DNA
tgtccaaggtcatgtggttt

SEQ ID NO: 21918 - DNA, 20 bp, synthetic construct
  misc_feature 1..20: note = CRISPR gRNA sequence
  source 1..20: mol_type = other DNA
gtcacttgacctctctgaac

SEQ ID NO: 21919 - DNA, 20 bp, synthetic construct
  misc_feature 1..20: note = CRISPR gRNA sequence
  source 1..20: mol_type = other DNA
ccaatattagttctggagaa

SEQ ID NO: 21920 - DNA, 20 bp, synthetic construct
  misc_feature 1..20: note = CRISPR gRNA sequence
  source 1..20: mol_type = other DNA
caggcagatcacttgaggtc

SEQ ID NO: 21921 - DNA, 20 bp, synthetic construct
  misc_feature 1..20: note = CRISPR gRNA sequence
  source 1..20: mol_type = other DNA
aaaattagccaggcatggtg

SEQ ID NO: 21922 - DNA, 20 bp, synthetic construct
  misc_feature 1..20: note = CRISPR gRNA sequence
  source 1..20: mol_type = other DNA
ttgggaggctgaggcaggag

SEQ ID NO: 21923 - DNA, 20 bp, synthetic construct
  misc_feature 1..20: note = CRISPR gRNA sequence
  source 1..20: mol_type = other DNA
aaacaaaaaacaaaaaacaa

SEQ ID NO: 21924 - DNA, 20 bp, synthetic construct
  misc_feature 1..20: note = CRISPR gRNA sequence
  source 1..20: mol_type = other DNA
tgaaattcaggcccaagact

SEQ ID NO: 21925 - DNA, 20 bp, synthetic construct
  misc_feature 1..20: note = CRISPR gRNA sequence
  source 1..20: mol_type = other DNA
accttcctctatccccagag

SEQ ID NO: 21926 - DNA, 20 bp, synthetic construct
  misc_feature 1..20: note = CRISPR gRNA sequence
  source 1..20: mol_type = other DNA
gccaagtttcctatgtctat

SEQ ID NO: 21927 - DNA, 20 bp, synthetic construct
  misc_feature 1..20: note = CRISPR gRNA sequence
  source 1..20: mol_type = other DNA
tatgtctatagatgcttagg

SEQ ID NO: 21928 - DNA, 20 bp, synthetic construct
  misc_feature 1..20: note = CRISPR gRNA sequence
  source 1..20: mol_type = other DNA
cttcaaaggccccttcattg

SEQ ID NO: 21929 - DNA, 20 bp, synthetic construct
  misc_feature 1..20: note = CRISPR gRNA sequence
  source 1..20: mol_type = other DNA
tcaccttctcccagctctca

SEQ ID NO: 21930 - DNA, 20 bp, synthetic construct
  misc_feature 1..20: note = CRISPR gRNA sequence
  source 1..20: mol_type = other DNA
tacacatcagctatttgtat

SEQ ID NO: 21931 - DNA, 20 bp, synthetic construct
  misc_feature 1..20: note = CRISPR gRNA sequence
  source 1..20: mol_type = other DNA
cagatgaagagacaggctca

SEQ ID NO: 21932 - DNA, 20 bp, synthetic construct
  misc_feature 1..20: note = CRISPR gRNA sequence
  source 1..20: mol_type = other DNA
ggctcagagggattagtggg

SEQ ID NO: 21933 - DNA, 20 bp, synthetic construct
  misc_feature 1..20: note = CRISPR gRNA sequence
  source 1..20: mol_type = other DNA
ttagaaggtcctctttgaaa

SEQ ID NO: 21934 - DNA, 20 bp, synthetic construct
  misc_feature 1..20: note = CRISPR gRNA sequence
  source 1..20: mol_type = other DNA
ttgccatcaaaagtcctttt

SEQ ID NO: 21935 - DNA, 20 bp, synthetic construct
  misc_feature 1..20: note = CRISPR gRNA sequence
  source 1..20: mol_type = other DNA
atccccacttcacactgcat

SEQ ID NO: 21936 - DNA, 20 bp, synthetic construct
  misc_feature 1..20: note = CRISPR gRNA sequence
  source 1..20: mol_type = other DNA
agatgaatggagctcagatg

SEQ ID NO: 21937 - DNA, 20 bp, synthetic construct
  misc_feature 1..20: note = CRISPR gRNA sequence
  source 1..20: mol_type = other DNA
ttttttaaaccacttggagc

SEQ ID NO: 21938 - DNA, 20 bp, synthetic construct
  misc_feature 1..20: note = CRISPR gRNA sequence
  source 1..20: mol_type = other DNA
gggataataattggcaactc

SEQ ID NO: 21939 - DNA, 20 bp, synthetic construct
  misc_feature 1..20: note = CRISPR gRNA sequence
  source 1..20: mol_type = other DNA
ccagtaagtgctcaatgaac

SEQ ID NO: 21940 - DNA, 20 bp, synthetic construct
  misc_feature 1..20: note = CRISPR gRNA sequence
  source 1..20: mol_type = other DNA
gatgaccatttttattatta

SEQ ID NO: 21941 - DNA, 20 bp, synthetic construct
  misc_feature 1..20: note = CRISPR gRNA sequence
  source 1..20: mol_type = other DNA
acctctgtgagagtgaccag

SEQ ID NO: 21942 - DNA, 20 bp, synthetic construct
  misc_feature 1..20: note = CRISPR gRNA sequence
  source 1..20: mol_type = other DNA
tagatgccttgcatttacta

SEQ ID NO: 21943 - DNA, 20 bp, synthetic construct
  misc_feature 1..20: note = CRISPR gRNA sequence
  source 1..20: mol_type = other DNA
caactgttaacggcaactct

SEQ ID NO: 21944 - DNA, 20 bp, synthetic construct
  misc_feature 1..20: note = CRISPR gRNA sequence
  source 1..20: mol_type = other DNA
ccattttacagacgcaggcg

SEQ ID NO: 21945 - DNA, 20 bp, synthetic construct
  misc_feature 1..20: note = CRISPR gRNA sequence
  source 1..20: mol_type = other DNA
gagattacgtccagttcatt

SEQ ID NO: 21946 - DNA, 20 bp, synthetic construct
  misc_feature 1..20: note = CRISPR gRNA sequence
  source 1..20: mol_type = other DNA
gcctccagcactgctctgaa

SEQ ID NO: 21947 - DNA, 20 bp, synthetic construct
  misc_feature 1..20: note = CRISPR gRNA sequence
  source 1..20: mol_type = other DNA
cactttgagaggccgaggct

SEQ ID NO: 21948 - DNA, 20 bp, synthetic construct
  misc_feature 1..20: note = CRISPR gRNA sequence
  source 1..20: mol_type = other DNA
ttgggaggctgaggcaggaa

SEQ ID NO: 21949 - DNA, 20 bp, synthetic construct
  misc_feature 1..20: note = CRISPR gRNA sequence
  source 1..20: mol_type = other DNA
ctgtctcagacaaaaaaaaa

SEQ ID NO: 21950 - DNA, 20 bp, synthetic construct
  misc_feature 1..20: note = CRISPR gRNA sequence
  source 1..20: mol_type = other DNA
ctgaactgtgtgcctagaga

SEQ ID NO: 21951 - DNA, 20 bp, synthetic construct
  misc_feature 1..20: note = CRISPR gRNA sequence
  source 1..20: mol_type = other DNA
tgtgtgcctagagacatggt

SEQ ID NO: 21952 - DNA, 20 bp, synthetic construct
  misc_feature 1..20: note = CRISPR gRNA sequence
  source 1..20: mol_type = other DNA
attaccttagccctctgagc

SEQ ID NO: 21953 - DNA, 20 bp, synthetic construct
  misc_feature 1..20: note = CRISPR gRNA sequence
  source 1..20: mol_type = other DNA
gccccttcaattgagtcttt

SEQ ID NO: 21954 - DNA, 20 bp, synthetic construct
  misc_feature 1..20: note = CRISPR gRNA sequence
  source 1..20: mol_type = other DNA
tcaattgagtctttttgaga

SEQ ID NO: 21955 - DNA, 20 bp, synthetic construct
  misc_feature 1..20: note = CRISPR gRNA sequence
  source 1..20: mol_type = other DNA
tgctccccaacctcatgaca

SEQ ID NO: 21956 - DNA, 20 bp, synthetic construct
  misc_feature 1..20: note = CRISPR gRNA sequence
  source 1..20: mol_type = other DNA
tctaccatgaccagacccca

SEQ ID NO: 21957 - DNA, 20 bp, synthetic construct
  misc_feature 1..20: note = CRISPR gRNA sequence
  source 1..20: mol_type = other DNA
ggggtagtagctcaaatgag

SEQ ID NO: 21958 - DNA, 20 bp, synthetic construct
  misc_feature 1..20: note = CRISPR gRNA sequence
  source 1..20: mol_type = other DNA
tcccctctaaagctgtaaaa

SEQ ID NO: 21959 - DNA, 20 bp, synthetic construct
  misc_feature 1..20: note = CRISPR gRNA sequence
  source 1..20: mol_type = other DNA
cagttccttactggccccaa

SEQ ID NO: 21960 - DNA, 20 bp, synthetic construct
  misc_feature 1..20: note = CRISPR gRNA sequence
  source 1..20: mol_type = other DNA
taccacacagtccctgccaa

SEQ ID NO: 21961 - DNA, 20 bp, synthetic construct
  misc_feature 1..20: note = CRISPR gRNA sequence
  source 1..20: mol_type = other DNA
tcgactgcattttgttggca

SEQ ID NO: 21962 - DNA, 20 bp, synthetic construct
  misc_feature 1..20: note = CRISPR gRNA sequence
  source 1..20: mol_type = other DNA
aaatgccaagtgttggttac

SEQ ID NO: 21963 - DNA, 20 bp, synthetic construct
  misc_feature 1..20: note = CRISPR gRNA sequence
  source 1..20: mol_type = other DNA
cactccatagagaacaatgt

SEQ ID NO: 21964 - DNA, 20 bp, synthetic construct
  misc_feature 1..20: note = CRISPR gRNA sequence
  source 1..20: mol_type = other DNA
cgggtggatcacctgaggtc

SEQ ID NO: 21965 - DNA, 20 bp, synthetic construct
  misc_feature 1..20: note = CRISPR gRNA sequence
  source 1..20: mol_type = other DNA
aaaaaaaaaaaaaaggcaaa

SEQ ID NO: 21966 - DNA, 20 bp, synthetic construct
  misc_feature 1..20: note = CRISPR gRNA sequence
  source 1..20: mol_type = other DNA
gctgcactgggcagttaatc

SEQ ID NO: 21967 - DNA, 20 bp, synthetic construct
  misc_feature 1..20: note = CRISPR gRNA sequence
  source 1..20: mol_type = other DNA
ttgaaaagaaaagaaacaaa

SEQ ID NO: 21968 - DNA, 20 bp, synthetic construct
  misc_feature 1..20: note = CRISPR gRNA sequence
  source 1..20: mol_type = other DNA
caccccacaggctgtctggt

SEQ ID NO: 21969 - DNA, 20 bp, synthetic construct
  misc_feature 1..20: note = CRISPR gRNA sequence
  source 1..20: mol_type = other DNA
ccacaggctgtctggtgatg

SEQ ID NO: 21970 - DNA, 20 bp, synthetic construct
  misc_feature 1..20: note = CRISPR gRNA sequence
  source 1..20: mol_type = other DNA
aagcccctcactctccagcc

SEQ ID NO: 21971 - DNA, 20 bp, synthetic construct
  misc_feature 1..20: note = CRISPR gRNA sequence
  source 1..20: mol_type = other DNA
gtagcaacactgcaatgctc

SEQ ID NO: 21972 - DNA, 20 bp, synthetic construct
  misc_feature 1..20: note = CRISPR gRNA sequence
  source 1..20: mol_type = other DNA
taatgggggcaggaggtcag

SEQ ID NO: 21973 - DNA, 20 bp, synthetic construct
  misc_feature 1..20: note = CRISPR gRNA sequence
  source 1..20: mol_type = other DNA
aagctcctcagctgtgccac

SEQ ID NO: 21974 - DNA, 20 bp, synthetic construct
  misc_feature 1..20: note = CRISPR gRNA sequence
  source 1..20: mol_type = other DNA
tgaatccagtcgataggcct

SEQ ID NO: 21975 - DNA, 20 bp, synthetic construct
  misc_feature 1..20: note = CRISPR gRNA sequence
  source 1..20: mol_type = other DNA
ccagtcgataggcctatttg

SEQ ID NO: 21976 - DNA, 20 bp, synthetic construct
  misc_feature 1..20: note = CRISPR gRNA sequence
  source 1..20: mol_type = other DNA
tcattatggcccctttggta

SEQ ID NO: 21977 - DNA, 20 bp, synthetic construct
  misc_feature 1..20: note = CRISPR gRNA sequence
  source 1..20: mol_type = other DNA
tggtatttggatttgccacc

SEQ ID NO: 21978 - DNA, 20 bp, synthetic construct
  misc_feature 1..20: note = CRISPR gRNA sequence
  source 1..20: mol_type = other DNA
gcccttgcaggtcccaagat

SEQ ID NO: 21979 - DNA, 20 bp, synthetic construct
  misc_feature 1..20: note = CRISPR gRNA sequence
  source 1..20: mol_type = other DNA
ggtgactggggcagggagag

SEQ ID NO: 21980 - DNA, 20 bp, synthetic construct
  misc_feature 1..20: note = CRISPR gRNA sequence
  source 1..20: mol_type = other DNA
tgctgccagctcagatggaa

SEQ ID NO: 21981 - DNA, 20 bp, synthetic construct
  misc_feature 1..20: note = CRISPR gRNA sequence
  source 1..20: mol_type = other DNA
agggaggatgacttgaggcc

SEQ ID NO: 21982 - DNA, 20 bp, synthetic construct
  misc_feature 1..20: note = CRISPR gRNA sequence
  source 1..20: mol_type = other DNA
ttgggaggctgaggcaggag

SEQ ID NO: 21983 - DNA, 20 bp, synthetic construct
  misc_feature 1..20: note = CRISPR gRNA sequence
  source 1..20: mol_type = other DNA
caggaggatggcttgagctc

SEQ ID NO: 21984 - DNA, 20 bp, synthetic construct
  misc_feature 1..20: note = CRISPR gRNA sequence
  source 1..20: mol_type = other DNA
tcccaattccagcaccgttg

SEQ ID NO: 21985 - DNA, 20 bp, synthetic construct
  misc_feature 1..20: note = CRISPR gRNA sequence
  source 1..20: mol_type = other DNA
ccattgcagctccctgccct

SEQ ID NO: 21986 - DNA, 20 bp, synthetic construct
  misc_feature 1..20: note = CRISPR gRNA sequence
  source 1..20: mol_type = other DNA
ttggctgcaatccctagcca

SEQ ID NO: 21987 - DNA, 20 bp, synthetic construct
  misc_feature 1..20: note = CRISPR gRNA sequence
  source 1..20: mol_type = other DNA
atgatgcatcaatgtaggtt

SEQ ID NO: 21988 - DNA, 20 bp, synthetic construct
  misc_feature 1..20: note = CRISPR gRNA sequence
  source 1..20: mol_type = other DNA
gtagatgagggatgtgaagg

SEQ ID NO: 21989 - DNA, 20 bp, synthetic construct
  misc_feature 1..20: note = CRISPR gRNA sequence
  source 1..20: mol_type = other DNA
aggtctagcttccttgctgt

SEQ ID NO: 21990 - DNA, 20 bp, synthetic construct
  misc_feature 1..20: note = CRISPR gRNA sequence
  source 1..20: mol_type = other DNA
tcccagcttgagtgctccct

SEQ ID NO: 21991 - DNA, 20 bp, synthetic construct
  misc_feature 1..20: note = CRISPR gRNA sequence
  source 1..20: mol_type = other DNA
ctgcattgcacctcaactcc

SEQ ID NO: 21992 - DNA, 20 bp, synthetic construct
  misc_feature 1..20: note = CRISPR gRNA sequence
  source 1..20: mol_type = other DNA
caactcctgctgcttcccaa

SEQ ID NO: 21993 - DNA, 20 bp, synthetic construct
  misc_feature 1..20: note = CRISPR gRNA sequence
  source 1..20: mol_type = other DNA
atgcaaatctccatctccta

SEQ ID NO: 21994 - DNA, 20 bp, synthetic construct
  misc_feature 1..20: note = CRISPR gRNA sequence
  source 1..20: mol_type = other DNA
agccacctatcttctctggg

SEQ ID NO: 21995 - DNA, 20 bp, synthetic construct
  misc_feature 1..20: note = CRISPR gRNA sequence
  source 1..20: mol_type = other DNA
aactcgaatgggccatcatc

SEQ ID NO: 21996 - DNA, 20 bp, synthetic construct
  misc_feature 1..20: note = CRISPR gRNA sequence
  source 1..20: mol_type = other DNA
gttgggataagagttccctt

SEQ ID NO: 21997 - DNA, 20 bp, synthetic construct
  misc_feature 1..20: note = CRISPR gRNA sequence
  source 1..20: mol_type = other DNA
atgacctggaaaggagtcca

SEQ ID NO: 21998 - DNA, 20 bp, synthetic construct
  misc_feature 1..20: note = CRISPR gRNA sequence
  source 1..20: mol_type = other DNA
caagatgaaccacgagccag

SEQ ID NO: 21999 - DNA, 20 bp, synthetic construct
  misc_feature 1..20: note = CRISPR gRNA sequence
  source 1..20: mol_type = other DNA
actacggagtccagccatcg

SEQ ID NO: 22000 - DNA, 20 bp, synthetic construct
  misc_feature 1..20: note = CRISPR gRNA sequence
  source 1..20: mol_type = other DNA
agcgtcctgggcctcacccc

SEQ ID NO: 22001 - DNA, 20 bp, synthetic construct
  misc_feature 1..20: note = CRISPR gRNA sequence
  source 1..20: mol_type = other DNA
ttctttcattttttttgaga

SEQ ID NO: 22002 - DNA, 20 bp, synthetic construct
  misc_feature 1..20: note = CRISPR gRNA sequence
  source 1..20: mol_type = other DNA
aatctccgcctcctgggttc

SEQ ID NO: 22003 - DNA, 20 bp, synthetic construct
  misc_feature 1..20: note = CRISPR gRNA sequence
  source 1..20: mol_type = other DNA
tccaccagcctaccgagtag

SEQ ID NO: 22004 - DNA, 20 bp, synthetic construct
  misc_feature 1..20: note = CRISPR gRNA sequence
  source 1..20: mol_type = other DNA
ttttgtatttttaggagaga

SEQ ID NO: 22005 - DNA, 20 bp, synthetic construct
  misc_feature 1..20: note = CRISPR gRNA sequence
  source 1..20: mol_type = other DNA
agtagtcaccagaccctcag

SEQ ID NO: 22006 - DNA, 20 bp, synthetic construct
  misc_feature 1..20: note = CRISPR gRNA sequence
  source 1..20: mol_type = other DNA
accctcagcatagattttac

SEQ ID NO: 22007 - DNA, 20 bp, synthetic construct
  misc_feature 1..20: note = CRISPR gRNA sequence
  source 1..20: mol_type = other DNA
cttccaggtctttcctctca

SEQ ID NO: 22008 - DNA, 20 bp, synthetic construct
  misc_feature 1..20: note = CRISPR gRNA sequence
  source 1..20: mol_type = other DNA
tttttaaagaaacttaaata

SEQ ID NO: 22009 - DNA, 20 bp, synthetic construct
  misc_feature 1..20: note = CRISPR gRNA sequence
  source 1..20: mol_type = other DNA
taaatagaccgattttaaaa

SEQ ID NO: 22010 - DNA, 20 bp, synthetic construct
  misc_feature 1..20: note = CRISPR gRNA sequence
  source 1..20: mol_type = other DNA
tttgtccacccatgtaccta

SEQ ID NO: 22011 - DNA, 20 bp, synthetic construct
  misc_feature 1..20: note = CRISPR gRNA sequence
  source 1..20: mol_type = other DNA
tggaaggggcagtggggagt

SEQ ID NO: 22012 - DNA, 20 bp, synthetic construct
  misc_feature 1..20: note = CRISPR gRNA sequence
  source 1..20: mol_type = other DNA
gggagttattgcttattggg

SEQ ID NO: 22013 - DNA, 20 bp, synthetic construct
  misc_feature 1..20: note = CRISPR gRNA sequence
  source 1..20: mol_type = other DNA
tattgcttattgggtagagt

SEQ ID NO: 22014 - DNA, 20 bp, synthetic construct
  misc_feature 1..20: note = CRISPR gRNA sequence
  source 1..20: mol_type = other DNA
gatggtagcggaggttgcac

SEQ ID NO: 22015 - DNA, 20 bp, synthetic construct
  misc_feature 1..20: note = CRISPR gRNA sequence
  source 1..20: mol_type = other DNA
tttatgttatatgtatttta

SEQ ID NO: 22016 - DNA, 20 bp, synthetic construct
  misc_feature 1..20: note = CRISPR gRNA sequence
  source 1..20: mol_type = other DNA
aacaatgttactaaaataat

SEQ ID NO: 22017 - DNA, 20 bp, synthetic construct
  misc_feature 1..20: note = CRISPR gRNA sequence
  source 1..20: mol_type = other DNA
agactttgtccttgatgtca

SEQ ID NO: 22018 - DNA, 20 bp, synthetic construct
  misc_feature 1..20: note = CRISPR gRNA sequence
  source 1..20: mol_type = other DNA
tttggaaacctcccatctgc

SEQ ID NO: 22019 - DNA, 20 bp, synthetic construct
  misc_feature 1..20: note = CRISPR gRNA sequence
  source 1..20: mol_type = other DNA
aaactccgcctcttgggttc

SEQ ID NO: 22020 - DNA, 20 bp, synthetic construct
  misc_feature 1..20: note = CRISPR gRNA sequence
  source 1..20: mol_type = other DNA
tgcctcagcctcccaagtag

SEQ ID NO: 22021 - DNA, 20 bp, synthetic construct
  misc_feature 1..20: note = CRISPR gRNA sequence
  source 1..20: mol_type = other DNA
tgcccggctaaaacacaaaa

SEQ ID NO: 22022 - DNA, 20 bp, synthetic construct
  misc_feature 1..20: note = CRISPR gRNA sequence
  source 1..20: mol_type = other DNA
aaaaagtgttttagtagagt

SEQ ID NO: 22023 - DNA, 20 bp, synthetic construct
  misc_feature 1..20: note = CRISPR gRNA sequence
  source 1..20: mol_type = other DNA
cgcctcggcctcccaaagtg

SEQ ID NO: 22024 - DNA, 20 bp, synthetic construct
  misc_feature 1..20: note = CRISPR gRNA sequence
  source 1..20: mol_type = other DNA
ccaatgcatgaatattcttt

SEQ ID NO: 22025 - DNA, 20 bp, synthetic construct
  misc_feature 1..20: note = CRISPR gRNA sequence
  source 1..20: mol_type = other DNA
tattctttggtggttttcta

SEQ ID NO: 22026 - DNA, 20 bp, synthetic construct
  misc_feature 1..20: note = CRISPR gRNA sequence
  source 1..20: mol_type = other DNA
agacatcatcaagcaagctc

SEQ ID NO: 22027 - DNA, 20 bp, synthetic construct
  misc_feature 1..20: note = CRISPR gRNA sequence
  source 1..20: mol_type = other DNA
gcaaatctgaggctaagtcc

SEQ ID NO: 22028 - DNA, 20 bp, synthetic construct
  misc_feature 1..20: note = CRISPR gRNA sequence
  source 1..20: mol_type = other DNA
ctacctccctccagccactt

SEQ ID NO: 22029 - DNA, 20 bp, synthetic construct
  misc_feature 1..20: note = CRISPR gRNA sequence
  source 1..20: mol_type = other DNA
ctgattgcctggaactaatc

SEQ ID NO: 22030 - DNA, 20 bp, synthetic construct
  misc_feature 1..20: note = CRISPR gRNA sequence
  source 1..20: mol_type = other DNA
cagagtttccttgggttaat

SEQ ID NO: 22031 - DNA, 20 bp, synthetic construct
  misc_feature 1..20: note = CRISPR gRNA sequence
  source 1..20: mol_type = other DNA
atcagacagactgggtatca

SEQ ID NO: 22032 - DNA, 20 bp, synthetic construct
  misc_feature 1..20: note = CRISPR gRNA sequence
  source 1..20: mol_type = other DNA
ctgcatttgtggaggttcac

SEQ ID NO: 22033 - DNA, 20 bp, synthetic construct
  misc_feature 1..20: note = CRISPR gRNA sequence
  source 1..20: mol_type = other DNA
gttcaaatcctgcgtctgca

SEQ ID NO: 22034 - DNA, 20 bp, synthetic construct
  misc_feature 1..20: note = CRISPR gRNA sequence
  source 1..20: mol_type = other DNA
cctggtactccttttctgat

SEQ ID NO: 22035 - DNA, 20 bp, synthetic construct
  misc_feature 1..20: note = CRISPR gRNA sequence
  source 1..20: mol_type = other DNA
cattggagtcacctgggata

SEQ ID NO: 22036 - DNA, 20 bp, synthetic construct
  misc_feature 1..20: note = CRISPR gRNA sequence
  source 1..20: mol_type = other DNA
gatgttcatgtgtggggagc

SEQ ID NO: 22037 - DNA, 20 bp, synthetic construct
  misc_feature 1..20: note = CRISPR gRNA sequence
  source 1..20: mol_type = other DNA
agaccctgcctccaaacgct

SEQ ID NO: 22038 - DNA, 20 bp, synthetic construct
  misc_feature 1..20: note = CRISPR gRNA sequence
  source 1..20: mol_type = other DNA
ggtcatcccctaagggagcc

SEQ ID NO: 22039 - DNA, 20 bp, synthetic construct
  misc_feature 1..20: note = CRISPR gRNA sequence
  source 1..20: mol_type = other DNA
tttctccaagaggaagaagt

SEQ ID NO: 22040 - DNA, 20 bp, synthetic construct
  misc_feature 1..20: note = CRISPR gRNA sequence
  source 1..20: mol_type = other DNA
gggagccatgccttgaactt

SEQ ID NO: 22041 - DNA, 20 bp, synthetic construct
  misc_feature 1..20: note = CRISPR gRNA sequence
  source 1..20: mol_type = other DNA
gctgtgggactcaggaggac

SEQ ID NO: 22042 - DNA, 20 bp, synthetic construct
  misc_feature 1..20: note = CRISPR gRNA sequence
  source 1..20: mol_type = other DNA
gactaagctaagcatggtgg

SEQ ID NO: 22043 - DNA, 20 bp, synthetic construct
  misc_feature 1..20: note = CRISPR gRNA sequence
  source 1..20: mol_type = other DNA
ctaagcatggtggctccgat

SEQ ID NO: 22044 - DNA, 20 bp, synthetic construct
  misc_feature 1..20: note = CRISPR gRNA sequence
  source 1..20: mol_type = other DNA
tcccaccccggcattcgcac

SEQ ID NO: 22045 - DNA, 20 bp, synthetic construct
  misc_feature 1..20: note = CRISPR gRNA sequence
  source 1..20: mol_type = other DNA
attcgcacgctggctttccg

SEQ ID NO: 22046 - DNA, 20 bp, synthetic construct
  misc_feature 1..20: note = CRISPR gRNA sequence
  source 1..20: mol_type = other DNA
acttatcccatcctctggtt

SEQ ID NO: 22047 - DNA, 20 bp, synthetic construct
  misc_feature 1..20: note = CRISPR gRNA sequence
  source 1..20: mol_type = other DNA
ccgcctggagagcccaatac

SEQ ID NO: 22048 - DNA, 20 bp, synthetic construct
  misc_feature 1..20: note = CRISPR gRNA sequence
  source 1..20: mol_type = other DNA
tccgcgctcccagtctgcgc

SEQ ID NO: 22049 - DNA, 20 bp, synthetic construct
  misc_feature 1..20: note = CRISPR gRNA sequence
  source 1..20: mol_type = other DNA
cttctctgcagaagctgccg

SEQ ID NO: 22050 - DNA, 20 bp, synthetic construct
  misc_feature 1..20: note = CRISPR gRNA sequence
  source 1..20: mol_type = other DNA
ttgcggggatgctggaaacg

SEQ ID NO: 22051 - DNA, 20 bp, synthetic construct
  misc_feature 1..20: note = CRISPR gRNA sequence
  source 1..20: mol_type = other DNA
agtagctgacagtctcggag

SEQ ID NO: 22052 - DNA, 20 bp, synthetic construct
  misc_feature 1..20: note = CRISPR gRNA sequence
  source 1..20: mol_type = other DNA
aagcacctactgtggccacc

SEQ ID NO: 22053 - DNA, 20 bp, synthetic construct
  misc_feature 1..20: note = CRISPR gRNA sequence
  source 1..20: mol_type = other DNA
tctgcaagtcctgagttgca

SEQ ID NO: 22054 - DNA, 20 bp, synthetic construct
  misc_feature 1..20: note = CRISPR gRNA sequence
  source 1..20: mol_type = other DNA
gtccccacccctgggtgggt

SEQ ID NO: 22055 - DNA, 20 bp, synthetic construct
  misc_feature 1..20: note = CRISPR gRNA sequence
  source 1..20: mol_type = other DNA
tgccggtccttttcagaggt

SEQ ID NO: 22056 - DNA, 20 bp, synthetic construct
  misc_feature 1..20: note = CRISPR gRNA sequence
  source 1..20: mol_type = other DNA
cctcatcattaccctttcat

SEQ ID NO: 22057 - DNA, 20 bp, synthetic construct
  misc_feature 1..20: note = CRISPR gRNA sequence
  source 1..20: mol_type = other DNA
acctcaaggctgactccaat

SEQ ID NO: 22058 - DNA, 20 bp, synthetic construct
  misc_feature 1..20: note = CRISPR gRNA sequence
  source 1..20: mol_type = other DNA
gctgactccaattttggttt

SEQ ID NO: 22059 - DNA, 20 bp, synthetic construct
  misc_feature 1..20: note = CRISPR gRNA sequence
  source 1..20: mol_type = other DNA
cacccccatccccaattcag

SEQ ID NO: 22060 - DNA, 20 bp, synthetic construct
  misc_feature 1..20: note = CRISPR gRNA sequence
  source 1..20: mol_type = other DNA
tccccaattcagaatggttt

SEQ ID NO: 22061 - DNA, 20 bp, synthetic construct
  misc_feature 1..20: note = CRISPR gRNA sequence
  source 1..20: mol_type = other DNA
tgagactgcacgctaaatta

SEQ ID NO: 22062 - DNA, 20 bp, synthetic construct
  misc_feature 1..20: note = CRISPR gRNA sequence
  source 1..20: mol_type = other DNA
tggcagcccctcctcgtgcc

SEQ ID NO: 22063 - DNA, 20 bp, synthetic construct
  misc_feature 1..20: note = CRISPR gRNA sequence
  source 1..20: mol_type = other DNA
tcctgccattccagataaac

SEQ ID NO: 22064 - DNA, 20 bp, synthetic construct
  misc_feature 1..20: note = CRISPR gRNA sequence
  source 1..20: mol_type = other DNA
tcacggttggactgagttgg

SEQ ID NO: 22065 - DNA, 20 bp, synthetic construct
  misc_feature 1..20: note = CRISPR gRNA sequence
  source 1..20: mol_type = other DNA
cctggcccgagctcagcgct

SEQ ID NO: 22066 - DNA, 20 bp, synthetic construct
  misc_feature 1..20: note = CRISPR gRNA sequence
  source 1..20: mol_type = other DNA
gcccgagctcagcgctgcag

SEQ ID NO: 22067 - DNA, 20 bp, synthetic construct
  misc_feature 1..20: note = CRISPR gRNA sequence
  source 1..20: mol_type = other DNA
tgtaacccctaaggtcgggc

SEQ ID NO: 22068 - DNA, 20 bp, synthetic construct
  misc_feature 1..20: note = CRISPR gRNA sequence
  source 1..20: mol_type = other DNA
ccgtttctgctccccactcc

SEQ ID NO: 22069 - DNA, 20 bp, synthetic construct
  misc_feature 1..20: note = CRISPR gRNA sequence
  source 1..20: mol_type = other DNA
aacaggtacttcttcctctt

SEQ ID NO: 22070 - DNA, 20 bp, synthetic construct
  misc_feature 1..20: note = CRISPR gRNA sequence
  source 1..20: mol_type = other DNA
tccctgttacaaaacctcta

SEQ ID NO: 22071 - DNA, 20 bp, synthetic construct
  misc_feature 1..20: note = CRISPR gRNA sequence
  source 1..20: mol_type = other DNA
ggcaggtcccaggcagtcag

SEQ ID NO: 22072 - DNA, 20 bp, synthetic construct
  misc_feature 1..20: note = CRISPR gRNA sequence
  source 1..20: mol_type = other DNA
cctcagataccttgagaaga

SEQ ID NO: 22073 - DNA, 20 bp, synthetic construct
  misc_feature 1..20: note = CRISPR gRNA sequence
  source 1..20: mol_type = other DNA
ataccttgagaagagcagaa

SEQ ID NO: 22074 - DNA, 20 bp, synthetic construct
  misc_feature 1..20: note = CRISPR gRNA sequence
  source 1..20: mol_type = other DNA
cttgatgatgtctgatgtgt

SEQ ID NO: 22075 - DNA, 20 bp, synthetic construct
  misc_feature 1..20: note = CRISPR gRNA sequence
  source 1..20: mol_type = other DNA
atgtgtacagaaaaagcact

SEQ ID NO: 22076 - DNA, 20 bp, synthetic construct
  misc_feature 1..20: note = CRISPR gRNA sequence
  source 1..20: mol_type = other DNA
aagcactttagaaaaccacc

SEQ ID NO: 22077 - DNA, 20 bp, synthetic construct
  misc_feature 1..20: note = CRISPR gRNA sequence
  source 1..20: mol_type = other DNA
atagatcctaaagggattgt

SEQ ID NO: 22078 - DNA, 20 bp, synthetic construct
  misc_feature 1..20: note = CRISPR gRNA sequence
  source 1..20: mol_type = other DNA
aagaccagcctgggcaacct

SEQ ID NO: 22079 - DNA, 20 bp, synthetic construct
  misc_feature 1..20: note = CRISPR gRNA sequence
  source 1..20: mol_type = other DNA
ctacttgggaggctgaggca

SEQ ID NO: 22080 - DNA, 20 bp, synthetic construct
  misc_feature 1..20: note = CRISPR gRNA sequence
  source 1..20: mol_type = other DNA
tctcaggaaaaaaaaaagag

SEQ ID NO: 22081 - DNA, 20 bp, synthetic construct
  misc_feature 1..20: note = CRISPR gRNA sequence
  source 1..20: mol_type = other DNA
acacacagtcaaaagacagt

SEQ ID NO: 22082 - DNA, 20 bp, synthetic construct
  misc_feature 1..20: note = CRISPR gRNA sequence
  source 1..20: mol_type = other DNA
actctagacaccgcctataa

SEQ ID NO: 22083 - DNA, 20 bp, synthetic construct
  misc_feature 1..20: note = CRISPR gRNA sequence
  source 1..20: mol_type = other DNA
ctgactccccgctttcaact

SEQ ID NO: 22084 - DNA, 20 bp, synthetic construct
  misc_feature 1..20: note = CRISPR gRNA sequence
  source 1..20: mol_type = other DNA
gtttctttaaaaagttaatt

SEQ ID NO: 22085 - DNA, 20 bp, synthetic construct
  misc_feature 1..20: note = CRISPR gRNA sequence
  source 1..20: mol_type = other DNA
gacttcaggaaggaaagata

SEQ ID NO: 22086 - DNA, 20 bp, synthetic construct
  misc_feature 1..20: note = CRISPR gRNA sequence
  source 1..20: mol_type = other DNA
ggaaggaaagatataagaat

SEQ ID NO: 22087 - DNA, 20 bp, synthetic construct
  misc_feature 1..20: note = CRISPR gRNA sequence
  source 1..20: mol_type = other DNA
ctactcggtaggctggtgga

SEQ ID NO: 22088 - DNA, 20 bp, synthetic construct
  misc_feature 1..20: note = CRISPR gRNA sequence
  source 1..20: mol_type = other DNA
actccgtctcaaaaaaaatg

SEQ ID NO: 22089 - DNA, 20 bp, synthetic construct
  misc_feature 1..20: note = CRISPR gRNA sequence
  source 1..20: mol_type = other DNA
cccggctgcagactccctga

SEQ ID NO: 22090 - DNA, 20 bp, synthetic construct
  misc_feature 1..20: note = CRISPR gRNA sequence
  source 1..20: mol_type = other DNA
ggaacacccgaaggaaaagg

SEQ ID NO: 22091 - DNA, 20 bp, synthetic construct
  misc_feature 1..20: note = CRISPR gRNA sequence
  source 1..20: mol_type = other DNA
agtcccctccaagaccctct

SEQ ID NO: 22092 - DNA, 20 bp, synthetic construct
  misc_feature 1..20: note = CRISPR gRNA sequence
  source 1..20: mol_type = other DNA
acagctgaggagcttgcagg

SEQ ID NO: 22093 - DNA, 20 bp, synthetic construct
  misc_feature 1..20: note = CRISPR gRNA sequence
  source 1..20: mol_type = other DNA
gactgccaggcaacgaggaa

SEQ ID NO: 22094 - DNA, 20 bp, synthetic construct
  misc_feature 1..20: note = CRISPR gRNA sequence
  source 1..20: mol_type = other DNA
tactcaggatcaaaggcaga

SEQ ID NO: 22095 - DNA, 20 bp, synthetic construct
  misc_feature 1..20: note = CRISPR gRNA sequence
  source 1..20: mol_type = other DNA
gatagactccccgcctctgg

SEQ ID NO: 22096 - DNA, 20 bp, synthetic construct
  misc_feature 1..20: note = CRISPR gRNA sequence
  source 1..20: mol_type = other DNA
agttgccgttaacagttgaa

SEQ ID NO: 22097 - DNA, 20 bp, synthetic construct
  misc_feature 1..20: note = CRISPR gRNA sequence
  source 1..20: mol_type = other DNA
tctagcacagccccagacac

SEQ ID NO: 22098 - DNA, 20 bp, synthetic construct
  misc_feature 1..20: note = CRISPR gRNA sequence
  source 1..20: mol_type = other DNA
ccccacatggctcctcaaaa

SEQ ID NO: 22099 - DNA, 20 bp, synthetic construct
  misc_feature 1..20: note = CRISPR gRNA sequence
  source 1..20: mol_type = other DNA
atgaagagaggctgccatgc

SEQ ID NO: 22100 - DNA, 20 bp, synthetic construct
  misc_feature 1..20: note = CRISPR gRNA sequence
  source 1..20: mol_type = other DNA
ccgctctggcaatgtggttt

SEQ ID NO: 22101 - DNA, 20 bp, synthetic construct
  misc_feature 1..20: note = CRISPR gRNA sequence
  source 1..20: mol_type = other DNA
acttggctaaggcatcacag

SEQ ID NO: 22102 - DNA, 20 bp, synthetic construct
  misc_feature 1..20: note = CRISPR gRNA sequence
  source 1..20: mol_type = other DNA
gggtccccttatgcaaaaga

SEQ ID NO: 22103 - DNA, 20 bp, synthetic construct
  misc_feature 1..20: note = CRISPR gRNA sequence
  source 1..20: mol_type = other DNA
cttcacaaagtttgacctcg

SEQ ID NO: 22104 - DNA, 20 bp, synthetic construct
  misc_feature 1..20: note = CRISPR gRNA sequence
  source 1..20: mol_type = other DNA
ctggcagacccaatgccctg

SEQ ID NO: 22105 - DNA, 20 bp, synthetic construct
  misc_feature 1..20: note = CRISPR gRNA sequence
  source 1..20: mol_type = other DNA
tatagatatggaattatctt

SEQ ID NO: 22106 - DNA, 20 bp, synthetic construct
  misc_feature 1..20: note = CRISPR gRNA sequence
  source 1..20: mol_type = other DNA
gtgaaagctgtggatgcgtg

SEQ ID NO: 22107 - DNA, 20 bp, synthetic construct
  misc_feature 1..20: note = CRISPR gRNA sequence
  source 1..20: mol_type = other DNA
ctacttgggaggttgaagca

SEQ ID NO: 22108 - DNA, 20 bp, synthetic construct
  misc_feature 1..20: note = CRISPR gRNA sequence
  source 1..20: mol_type = other DNA
agactctgtctcaaaaaaaa

SEQ ID NO: 22109 - DNA, 20 bp, synthetic construct
  misc_feature 1..20: note = CRISPR gRNA sequence
  source 1..20: mol_type = other DNA
tgtctcaaaaaaaaaaagaa

SEQ ID NO: 22110 - DNA, 20 bp, synthetic construct
  misc_feature 1..20: note = CRISPR gRNA sequence
  source 1..20: mol_type = other DNA
tgggaaaagggtctttgcag

SEQ ID NO: 22111 - DNA, 20 bp, synthetic construct
  misc_feature 1..20: note = CRISPR gRNA sequence
  source 1..20: mol_type = other DNA
ctactcaggagactggggca

SEQ ID NO: 22112 - DNA, 20 bp, synthetic construct
  misc_feature 1..20: note = CRISPR gRNA sequence
  source 1..20: mol_type = other DNA
tgtctcaaaagaaggcaaaa

SEQ ID NO: 22113 - DNA, 20 bp, synthetic construct
  misc_feature 1..20: note = CRISPR gRNA sequence
  source 1..20: mol_type = other DNA
caatgacaagtgtctttata

SEQ ID NO: 22114 - DNA, 20 bp, synthetic construct
  misc_feature 1..20: note = CRISPR gRNA sequence
  source 1..20: mol_type = other DNA
ttctggcctccagaaccatg

SEQ ID NO: 22115 - DNA, 20 bp, synthetic construct
  misc_feature 1..20: note = CRISPR gRNA sequence
  source 1..20: mol_type = other DNA
ctgctcaggaggctgaggca

SEQ ID NO: 22116 - DNA, 20 bp, synthetic construct
  misc_feature 1..20: note = CRISPR gRNA sequence
  source 1..20: mol_type = other DNA
agcacatttcatcaccccct

SEQ ID NO: 22117 - DNA, 20 bp, synthetic construct
  misc_feature 1..20: note = CRISPR gRNA sequence
  source 1..20: mol_type = other DNA
gttttggtcatttcaaataa

SEQ ID NO: 22118 - DNA, 20 bp, synthetic construct
  misc_feature 1..20: note = CRISPR gRNA sequence
  source 1..20: mol_type = other DNA
caacaaatgatgaggaaatc

SEQ ID NO: 22119 - DNA, 20 bp, synthetic construct
  misc_feature 1..20: note = CRISPR gRNA sequence
  source 1..20: mol_type = other DNA
acatattaggaaactgaggc

SEQ ID NO: 22120 - DNA, 20 bp, synthetic construct
  misc_feature 1..20: note = CRISPR gRNA sequence
  source 1..20: mol_type = other DNA
gttccccaccagccctcttt

SEQ ID NO: 22121 - DNA, 20 bp, synthetic construct
  misc_feature 1..20: note = CRISPR gRNA sequence
  source 1..20: mol_type = other DNA
cggtgaggaagcacctgagc

SEQ ID NO: 22122 - DNA, 20 bp, synthetic construct
  misc_feature 1..20: note = CRISPR gRNA sequence
  source 1..20: mol_type = other DNA
agccacgtcagtcccctccc

SEQ ID NO: 22123 - DNA, 20 bp, synthetic construct
  misc_feature 1..20: note = CRISPR gRNA sequence
  source 1..20: mol_type = other DNA
gccccttcactaatgaccac

SEQ ID NO: 22124 - DNA, 20 bp, synthetic construct
  misc_feature 1..20: note = CRISPR gRNA sequence
  source 1..20: mol_type = other DNA
ctccatttttaaccacaaaa

SEQ ID NO: 22125 - DNA, 20 bp, synthetic construct
  misc_feature 1..20: note = CRISPR gRNA sequence
  source 1..20: mol_type = other DNA
ttgggggagagacgtgggat

SEQ ID NO: 22126 - DNA, 20 bp, synthetic construct
  misc_feature 1..20: note = CRISPR gRNA sequence
  source 1..20: mol_type = other DNA
catacagagcctatgttgaa

SEQ ID NO: 22127 - DNA, 20 bp, synthetic construct
  misc_feature 1..20: note = CRISPR gRNA sequence
  source 1..20: mol_type = other DNA
gtattgaaaatcataccaag

SEQ ID NO: 22128 - DNA, 20 bp, synthetic construct
  misc_feature 1..20: note = CRISPR gRNA sequence
  source 1..20: mol_type = other DNA
gactagtaattgttcatgtt

SEQ ID NO: 22129 - DNA, 20 bp, synthetic construct
  misc_feature 1..20: note = CRISPR gRNA sequence
  source 1..20: mol_type = other DNA
cctgacactgagtaatttat

SEQ ID NO: 22130 - DNA, 20 bp, synthetic construct
  misc_feature 1..20: note = CRISPR gRNA sequence
  source 1..20: mol_type = other DNA
agttacaatgtgtaaagcat

SEQ ID NO: 22131 - DNA, 20 bp, synthetic construct
  misc_feature 1..20: note = CRISPR gRNA sequence
  source 1..20: mol_type = other DNA
cctcactctgccactgtgac

SEQ ID NO: 22132 - DNA, 20 bp, synthetic construct
  misc_feature 1..20: note = CRISPR gRNA sequence
  source 1..20: mol_type = other DNA
atttattcatcttacacaga

SEQ ID NO: 22133 - DNA, 20 bp, synthetic construct
  misc_feature 1..20: note = CRISPR gRNA sequence
  source 1..20: mol_type = other DNA
gagatgccagcagaagttgg

SEQ ID NO: 22134 - DNA, 20 bp, synthetic construct
  misc_feature 1..20: note = CRISPR gRNA sequence
  source 1..20: mol_type = other DNA
gcagaagttgggcagaaaag

SEQ ID NO: 22135 - DNA, 20 bp, synthetic construct
  misc_feature 1..20: note = CRISPR gRNA sequence
  source 1..20: mol_type = other DNA
gtatgagattttaaaagtgc

SEQ ID NO: 22136 - DNA, 20 bp, synthetic construct
  misc_feature 1..20: note = CRISPR gRNA sequence
  source 1..20: mol_type = other DNA
ctactcgggaggctgaggca

SEQ ID NO: 22137 - DNA, 20 bp, synthetic construct
  misc_feature 1..20: note = CRISPR gRNA sequence
  source 1..20: mol_type = other DNA
gtctcaaacaacaacaacca

SEQ ID NO: 22138 - DNA, 20 bp, synthetic construct
  misc_feature 1..20: note = CRISPR gRNA sequence
  source 1..20: mol_type = other DNA
ccagcttcctttttgccttg

SEQ ID NO: 22139 - DNA, 20 bp, synthetic construct
  misc_feature 1..20: note = CRISPR gRNA sequence
  source 1..20: mol_type = other DNA
ctaccagggaggctagggtg

SEQ ID NO: 22140 - DNA, 20 bp, synthetic construct
  misc_feature 1..20: note = CRISPR gRNA sequence
  source 1..20: mol_type = other DNA
ttcaagatacaataaaagtg

SEQ ID NO: 22141 - DNA, 20 bp, synthetic construct
  misc_feature 1..20: note = CRISPR gRNA sequence
  source 1..20: mol_type = other DNA
gcctccggccagatgcgcct

SEQ ID NO: 22142 - DNA, 20 bp, synthetic construct
  misc_feature 1..20: note = CRISPR gRNA sequence
  source 1..20: mol_type = other DNA
ccaactgctctgctaggtgc

SEQ ID NO: 22143 - DNA, 20 bp, synthetic construct
  misc_feature 1..20: note = CRISPR gRNA sequence
  source 1..20: mol_type = other DNA
aagaattccatcagggcagg

SEQ ID NO: 22144 - DNA, 20 bp, synthetic construct
  misc_feature 1..20: note = CRISPR gRNA sequence
  source 1..20: mol_type = other DNA
cattaatcaaataagcaaaa

SEQ ID NO: 22145 - DNA, 20 bp, synthetic construct
  misc_feature 1..20: note = CRISPR gRNA sequence
  source 1..20: mol_type = other DNA
ctaatgacaagtgatgttta

SEQ ID NO: 22146 - DNA, 20 bp, synthetic construct
  misc_feature 1..20: note = CRISPR gRNA sequence
  source 1..20: mol_type = other DNA
ttgtgggggaatggacagct

SEQ ID NO: 22147 - DNA, 20 bp, synthetic construct
  misc_feature 1..20: note = CRISPR gRNA sequence
  source 1..20: mol_type = other DNA
cttcagctgcttgttaccca

SEQ ID NO: 22148 - DNA, 20 bp, synthetic construct
  misc_feature 1..20: note = CRISPR gRNA sequence
  source 1..20: mol_type = other DNA
ttttaaaagtacagttggcc

SEQ ID NO: 22149 - DNA, 20 bp, synthetic construct
  misc_feature 1..20: note = CRISPR gRNA sequence
  source 1..20: mol_type = other DNA
aacacttcattgtcaggctg

SEQ ID NO: 22150 - DNA, 20 bp, synthetic construct
  misc_feature 1..20: note = CRISPR gRNA sequence
  source 1..20: mol_type = other DNA
tgggaataaaccagtgaata

SEQ ID NO: 22151 - DNA, 20 bp, synthetic construct
  misc_feature 1..20: note = CRISPR gRNA sequence
  source 1..20: mol_type = other DNA
tggtgggatgtatagcatgc

SEQ ID NO: 22152 - DNA, 20 bp, synthetic construct
  misc_feature 1..20: note = CRISPR gRNA sequence
  source 1..20: mol_type = other DNA
tgagtgagtagtgatcaagc

SEQ ID NO: 22153 - DNA, 20 bp, synthetic construct
  misc_feature 1..20: note = CRISPR gRNA sequence
  source 1..20: mol_type = other DNA
ttagtgagtaaatgaaggaa

SEQ ID NO: 22154 - DNA, 20 bp, synthetic construct
  misc_feature 1..20: note = CRISPR gRNA sequence
  source 1..20: mol_type = other DNA
ctacttggcaggccgaggca

SEQ ID NO: 22155 - DNA, 20 bp, synthetic construct
  misc_feature 1..20: note = CRISPR gRNA sequence
  source 1..20: mol_type = other DNA
ccatctcaaaaaaaaaaaag

SEQ ID NO: 22156 - DNA, 20 bp, synthetic construct
  misc_feature 1..20: note = CRISPR gRNA sequence
  source 1..20: mol_type = other DNA
tatctccacaaaaaaacaaa

SEQ ID NO: 22157 - DNA, 20 bp, synthetic construct
  misc_feature 1..20: note = CRISPR gRNA sequence
  source 1..20: mol_type = other DNA
atgcagagcagccgggtggg

SEQ ID NO: 22158 - DNA, 20 bp, synthetic construct
  misc_feature 1..20: note = CRISPR gRNA sequence
  source 1..20: mol_type = other DNA
tgccagtcactggggtatgt

SEQ ID NO: 22159 - DNA, 20 bp, synthetic construct
  misc_feature 1..20: note = CRISPR gRNA sequence
  source 1..20: mol_type = other DNA
ggtagccgaagcaaaaaggg

SEQ ID NO: 22160 - DNA, 20 bp, synthetic construct
  misc_feature 1..20: note = CRISPR gRNA sequence
  source 1..20: mol_type = other DNA
gaaaaccactgtgtgagttg

SEQ ID NO: 22161 - DNA, 20 bp, synthetic construct
  misc_feature 1..20: note = CRISPR gRNA sequence
  source 1..20: mol_type = other DNA
aggtagaggttgagctaagg

SEQ ID NO: 22162 - DNA, 20 bp, synthetic construct
  misc_feature 1..20: note = CRISPR gRNA sequence
  source 1..20: mol_type = other DNA
tcgctgcccaggcggagcct

SEQ ID NO: 22163 - DNA, 20 bp, synthetic construct
  misc_feature 1..20: note = CRISPR gRNA sequence
  source 1..20: mol_type = other DNA
gtctcgctgtgtctaccagg

SEQ ID NO: 22164 - DNA, 20 bp, synthetic construct
  misc_feature 1..20: note = CRISPR gRNA sequence
  source 1..20: mol_type = other DNA
ctccctgctgttcgggacct

SEQ ID NO: 22165 - DNA, 20 bp, synthetic construct
  misc_feature 1..20: note = CRISPR gRNA sequence
  source 1..20: mol_type = other DNA
acctgaatggagatagatct

SEQ ID NO: 22166 - DNA, 20 bp, synthetic construct
  misc_feature 1..20: note = CRISPR gRNA sequence
  source 1..20: mol_type = other DNA
gctgagtggggagaggggag

SEQ ID NO: 22167 - DNA, 20 bp, synthetic construct
  misc_feature 1..20: note = CRISPR gRNA sequence
  source 1..20: mol_type = other DNA
aattgtaatttcgccaggga

SEQ ID NO: 22168 - DNA, 20 bp, synthetic construct
  misc_feature 1..20: note = CRISPR gRNA sequence
  source 1..20: mol_type = other DNA
ccaagggatggcctccccag

SEQ ID NO: 22169 - DNA, 20 bp, synthetic construct
  misc_feature 1..20: note = CRISPR gRNA sequence
  source 1..20: mol_type = other DNA
taggcagtgttgctggggtg

SEQ ID NO: 22170 - DNA, 20 bp, synthetic construct
  misc_feature 1..20: note = CRISPR gRNA sequence
  source 1..20: mol_type = other DNA
agcccaccatacatgggccc

SEQ ID NO: 22171 - DNA, 20 bp, synthetic construct
  misc_feature 1..20: note = CRISPR gRNA sequence
  source 1..20: mol_type = other DNA
aattattatatttagatctg

SEQ ID NO: 22172 - DNA, 20 bp, synthetic construct
  misc_feature 1..20: note = CRISPR gRNA sequence
  source 1..20: mol_type = other DNA
cctggccctaagctccttcc

SEQ ID NO: 22173 - DNA, 20 bp, synthetic construct
  misc_feature 1..20: note = CRISPR gRNA sequence
  source 1..20: mol_type = other DNA
gtcttgctctgtcacccagg

SEQ ID NO: 22174 - DNA, 20 bp, synthetic construct
  misc_feature 1..20: note = CRISPR gRNA sequence
  source 1..20: mol_type = other DNA
gatcactgctcccctgtgcc

SEQ ID NO: 22175 - DNA, 20 bp, synthetic construct
  misc_feature 1..20: note = CRISPR gRNA sequence
  source 1..20: mol_type = other DNA
ctacttgggaggctgaggca

SEQ ID NO: 22176 - DNA, 20 bp, synthetic construct
  misc_feature 1..20: note = CRISPR gRNA sequence
  source 1..20: mol_type = other DNA
gctggcaccataattttacc

SEQ ID NO: 22177 - DNA, 20 bp, synthetic construct
  misc_feature 1..20: note = CRISPR gRNA sequence
  source 1..20: mol_type = other DNA
aaagttcaaaggacataatt

SEQ ID NO: 22178 - DNA, 20 bp, synthetic construct
  misc_feature 1..20: note = CRISPR gRNA sequence
  source 1..20: mol_type = other DNA
ggctatgaaatctaccccaa

SEQ ID NO: 22179 - DNA, 20 bp, synthetic construct
  misc_feature 1..20: note = CRISPR gRNA sequence
  source 1..20: mol_type = other DNA
atcctgcccccaaggcacct

SEQ ID NO: 22180 - DNA, 20 bp, synthetic construct
  misc_feature 1..20: note = CRISPR gRNA sequence
  source 1..20: mol_type = other DNA
tgcccccaaggcacctgcag

SEQ ID NO: 22181 - DNA, 20 bp, synthetic construct
  misc_feature 1..20: note = CRISPR gRNA sequence
  source 1..20: mol_type = other DNA
ggctcgctgtgtcacccagg

SEQ ID NO: 22182 - DNA, 20 bp, synthetic construct
  misc_feature 1..20: note = CRISPR gRNA sequence
  source 1..20: mol_type = other DNA
aatgaaaataatgtttggtg

SEQ ID NO: 22183 - DNA, 20 bp, synthetic construct
  misc_feature 1..20: note = CRISPR gRNA sequence
  source 1..20: mol_type = other DNA
catgtgaagcccacaacccg

SEQ ID NO: 22184 - DNA, 20 bp, synthetic construct
  misc_feature 1..20: note = CRISPR gRNA sequence
  source 1..20: mol_type = other DNA
aggattagcgggacgtggtg

SEQ ID NO: 22185 - DNA, 20 bp, synthetic construct
  misc_feature 1..20: note = CRISPR gRNA sequence
  source 1..20: mol_type = other DNA
tcttcttactcgccagactg

SEQ ID NO: 22186 - DNA, 20 bp, synthetic construct
  misc_feature 1..20: note = CRISPR gRNA sequence
  source 1..20: mol_type = other DNA
gtgcttacttcttgctatgc

SEQ ID NO: 22187 - DNA, 20 bp, synthetic construct
  misc_feature 1..20: note = CRISPR gRNA sequence
  source 1..20: mol_type = other DNA
aaagaaactcagaagcaaaa

SEQ ID NO: 22188 - DNA, 20 bp, synthetic construct
  misc_feature 1..20: note = CRISPR gRNA sequence
  source 1..20: mol_type = other DNA
ctaggggaaaaggactctag

SEQ ID NO: 22189 - DNA, 20 bp, synthetic construct
  misc_feature 1..20: note = CRISPR gRNA sequence
  source 1..20: mol_type = other DNA
gcccagcctgatttaccctt

SEQ ID NO: 22190 - DNA, 20 bp, synthetic construct
  misc_feature 1..20: note = CRISPR gRNA sequence
  source 1..20: mol_type = other DNA
atgctggttgtgaatatgct

SEQ ID NO: 22191 - DNA, 20 bp, synthetic construct
  misc_feature 1..20: note = CRISPR gRNA sequence
  source 1..20: mol_type = other DNA
acagtttccacacagtaagg

SEQ ID NO: 22192 - DNA, 20 bp, synthetic construct
  misc_feature 1..20: note = CRISPR gRNA sequence
  source 1..20: mol_type = other DNA
agaactagtgggacctgggg

SEQ ID NO: 22193 - DNA, 20 bp, synthetic construct
  misc_feature 1..20: note = CRISPR gRNA sequence
  source 1..20: mol_type = other DNA
cctagcctctattttcatat

SEQ ID NO: 22194 - DNA, 20 bp, synthetic construct
  misc_feature 1..20: note = CRISPR gRNA sequence
  source 1..20: mol_type = other DNA
agctgacttgctgtgtgacc

SEQ ID NO: 22195 - DNA, 20 bp, synthetic construct
  misc_feature 1..20: note = CRISPR gRNA sequence
  source 1..20: mol_type = other DNA
gtggagataaaagtgctttg

SEQ ID NO: 22196 - DNA, 20 bp, synthetic construct
  misc_feature 1..20: note = CRISPR gRNA sequence
  source 1..20: mol_type = other DNA
tgttgtactggacgctggca

SEQ ID NO: 22197 - DNA, 20 bp, synthetic construct
  misc_feature 1..20: note = CRISPR gRNA sequence
  source 1..20: mol_type = other DNA
gaagccaccatccctagatt

SEQ ID NO: 22198 - DNA, 20 bp, synthetic construct
  misc_feature 1..20: note = CRISPR gRNA sequence
  source 1..20: mol_type = other DNA
tttagaacatgccttggtgc

SEQ ID NO: 22199 - DNA, 20 bp, synthetic construct
  misc_feature 1..20: note = CRISPR gRNA sequence
  source 1..20: mol_type = other DNA
gaccagcactgggggcagga

SEQ ID NO: 22200 - DNA, 20 bp, synthetic construct
  misc_feature 1..20: note = CRISPR gRNA sequence
  source 1..20: mol_type = other DNA
gagaccagcctgaccaacat

SEQ ID NO: 22201 - DNA, 20 bp, synthetic construct
  misc_feature 1..20: note = CRISPR gRNA sequence
  source 1..20: mol_type = other DNA
ctacttgagaggctgaggca

SEQ ID NO: 22202 - DNA, 20 bp, synthetic construct
  misc_feature 1..20: note = CRISPR gRNA sequence
  source 1..20: mol_type = other DNA
gaaactctgtctcgaaaaaa

SEQ ID NO: 22203 - DNA, 20 bp, synthetic construct
  misc_feature 1..20: note = CRISPR gRNA sequence
  source 1..20: mol_type = other DNA
acgggtcggccggtaccagt

SEQ ID NO: 22204 - DNA, 20 bp, synthetic construct
  misc_feature 1..20: note = CRISPR gRNA sequence
  source 1..20: mol_type = other DNA
ctacttgggaggctgaggca

SEQ ID NO: 22205 - DNA, 20 bp, synthetic construct
  misc_feature 1..20: note = CRISPR gRNA sequence
  source 1..20: mol_type = other DNA
aaagtgagacttggtctcaa

SEQ ID NO: 22206 - DNA, 20 bp, synthetic construct
  misc_feature 1..20: note = CRISPR gRNA sequence
  source 1..20: mol_type = other DNA
gagacttggtctcaaaaaga

SEQ ID NO: 22207 - DNA, 20 bp, synthetic construct
  misc_feature 1..20: note = CRISPR gRNA sequence
  source 1..20: mol_type = other DNA
ttggtctcaaaaagaaaaga

SEQ ID NO: 22208 - DNA, 20 bp, synthetic construct
  misc_feature 1..20: note = CRISPR gRNA sequence
  source 1..20: mol_type = other DNA
caaaaagaaaagaaaagaaa

SEQ ID NO: 22209 - DNA, 20 bp, synthetic construct
  misc_feature 1..20: note = CRISPR gRNA sequence
  source 1..20: mol_type = other DNA
ttcccctagagcttcccacg

SEQ ID NO: 22210 - DNA, 20 bp, synthetic construct
  misc_feature 1..20: note = CRISPR gRNA sequence
  source 1..20: mol_type = other DNA
gtgcctaattcctactacgc

SEQ ID NO: 22211 - DNA, 20 bp, synthetic construct
  misc_feature 1..20: note = CRISPR gRNA sequence
  source 1..20: mol_type = other DNA
taaaacagtgatcatgctgg

SEQ ID NO: 22212 - DNA, 20 bp, synthetic construct
  misc_feature 1..20: note = CRISPR gRNA sequence
  source 1..20: mol_type = other DNA
agcgagactccatctcaaaa

SEQ ID NO: 22213 - DNA, 20 bp, synthetic construct
  misc_feature 1..20: note = CRISPR gRNA sequence
  source 1..20: mol_type = other DNA
gatggttcccattttccagg

SEQ ID NO: 22214 - DNA, 20 bp, synthetic construct
  misc_feature 1..20: note = CRISPR gRNA sequence
  source 1..20: mol_type = other DNA
tacttaagtggggtggcggg

SEQ ID NO: 22215 - DNA, 20 bp, synthetic construct
  misc_feature 1..20: note = CRISPR gRNA sequence
  source 1..20: mol_type = other DNA
ggggacggaaggactaagga

SEQ ID NO: 22216 - DNA, 20 bp, synthetic construct
  misc_feature 1..20: note = CRISPR gRNA sequence
  source 1..20: mol_type = other DNA
ttacagtgttacctaggaca

SEQ ID NO: 22217 - DNA, 20 bp, synthetic construct
  misc_feature 1..20: note = CRISPR gRNA sequence
  source 1..20: mol_type = other DNA
ctacttgggaggctgaggtg

SEQ ID NO: 22218 - DNA, 20 bp, synthetic construct
  misc_feature 1..20: note = CRISPR gRNA sequence
  source 1..20: mol_type = other DNA
agcgagaccttgtctgaaaa

SEQ ID NO: 22219 - DNA, 20 bp, synthetic construct
  misc_feature 1..20: note = CRISPR gRNA sequence
  source 1..20: mol_type = other DNA
ttgttcattgtgtctcctca

SEQ ID NO: 22220 - DNA, 20 bp, synthetic construct
  misc_feature 1..20: note = CRISPR gRNA sequence
  source 1..20: mol_type = other DNA
taaagctgggtctccagggc

SEQ ID NO: 22221 - DNA, 20 bp, synthetic construct
  misc_feature 1..20: note = CRISPR gRNA sequence
  source 1..20: mol_type = other DNA
taataaatggttgggtaagt

SEQ ID NO: 22222 - DNA, 20 bp, synthetic construct
  misc_feature 1..20: note = CRISPR gRNA sequence
  source 1..20: mol_type = other DNA
gagcggttggatgagggagt

SEQ ID NO: 22223 - DNA, 20 bp, synthetic construct
  misc_feature 1..20: note = CRISPR gRNA sequence
  source 1..20: mol_type = other DNA
gaggatgcagtaggcggaag

SEQ ID NO: 22224 - DNA, 20 bp, synthetic construct
  misc_feature 1..20: note = CRISPR gRNA sequence
  source 1..20: mol_type = other DNA
gagcgagaccctgtctcaaa

SEQ ID NO: 22225 - DNA, 20 bp, synthetic construct
  misc_feature 1..20: note = CRISPR gRNA sequence
  source 1..20: mol_type = other DNA
aaaaaagaaaaaaaacaaaa

SEQ ID NO: 22226 - DNA, 20 bp, synthetic construct
  misc_feature 1..20: note = CRISPR gRNA sequence
  source 1..20: mol_type = other DNA
agaaaaaaaacaaaaaaaga

SEQ ID NO: 22227 - DNA, 20 bp, synthetic construct
  misc_feature 1..20: note = CRISPR gRNA sequence
  source 1..20: mol_type = other DNA
tagagcagacttcaagggga

SEQ ID NO: 22228 - DNA, 20 bp, synthetic construct
  misc_feature 1..20: note = CRISPR gRNA sequence
  source 1..20: mol_type = other DNA
tcctttgaactttttcaata

SEQ ID NO: 22229 - DNA, 20 bp, synthetic construct
  misc_feature 1..20: note = CRISPR gRNA sequence
  source 1..20: mol_type = other DNA
gggaagatagacagataatc

SEQ ID NO: 22230 - DNA, 20 bp, synthetic construct
  misc_feature 1..20: note = CRISPR gRNA sequence
  source 1..20: mol_type = other DNA
tttatttttaactgtgaggg

SEQ ID NO: 22231 - DNA, 20 bp, synthetic construct
  misc_feature 1..20: note = CRISPR gRNA sequence
  source 1..20: mol_type = other DNA
ctactcgggaggctgaggca

SEQ ID NO: 22232 - DNA, 20 bp, synthetic construct
  misc_feature 1..20: note = CRISPR gRNA sequence
  source 1..20: mol_type = other DNA
agcgagactccacctcaaaa

SEQ ID NO: 22233 - DNA, 20 bp, synthetic construct
  misc_feature 1..20: note = CRISPR gRNA sequence
  source 1..20: mol_type = other DNA
actccacctcaaaaaaagaa

SEQ ID NO: 22234 - DNA, 20 bp, synthetic construct
  misc_feature 1..20: note = CRISPR gRNA sequence
  source 1..20: mol_type = other DNA
aaagaaaaagaaaaaaggaa

SEQ ID NO: 22235 - DNA, 20 bp, synthetic construct
  misc_feature 1..20: note = CRISPR gRNA sequence
  source 1..20: mol_type = other DNA
aaaaagaaaaaaggaaaaag

SEQ ID NO: 22236 - DNA, 20 bp, synthetic construct
  misc_feature 1..20: note = CRISPR gRNA sequence
  source 1..20: mol_type = other DNA
agaaaaaaggaaaaagaaag

SEQ ID NO: 22237 - DNA, 20 bp, synthetic construct
  misc_feature 1..20: note = CRISPR gRNA sequence
  source 1..20: mol_type = other DNA
aaaaagaaagaaagaaaggg

SEQ ID NO: 22238 - DNA, 20 bp, synthetic construct
  misc_feature 1..20: note = CRISPR gRNA sequence
  source 1..20: mol_type = other DNA
agaaagaaagaaagggaaag

SEQ ID NO: 22239 - DNA, 20 bp, synthetic construct
  misc_feature 1..20: note = CRISPR gRNA sequence
  source 1..20: mol_type = other DNA
agaaagaaagggaaagaaag

SEQ ID NO: 22240 - DNA, 20 bp, synthetic construct
  misc_feature 1..20: note = CRISPR gRNA sequence
  source 1..20: mol_type = other DNA
aagaaagaaagaaaggaggg

SEQ ID NO: 22241 - DNA, 20 bp, synthetic construct
  misc_feature 1..20: note = CRISPR gRNA sequence
  source 1..20: mol_type = other DNA
aagaaagaaaggagggaaag

SEQ ID NO: 22242 - DNA, 20 bp, synthetic construct
  misc_feature 1..20: note = CRISPR gRNA sequence
  source 1..20: mol_type = other DNA
aagaaaggagggaaagaaag

SEQ ID NO: 22243 - DNA, 20 bp, synthetic construct
  misc_feature 1..20: note = CRISPR gRNA sequence
  source 1..20: mol_type = other DNA
aaggagggaaagaaagaaag

SEQ ID NO: 22244 - DNA, 20 bp, synthetic construct
  misc_feature 1..20: note = CRISPR gRNA sequence
  source 1..20: mol_type = other DNA
aaagaaagaaagaaacaggg

SEQ ID NO: 22245 - DNA, 20 bp, synthetic construct
  misc_feature 1..20: note = CRISPR gRNA sequence
  source 1..20: mol_type = other DNA
aaagaaagaaacagggaaag

SEQ ID NO: 22246 - DNA, 20 bp, synthetic construct
  misc_feature 1..20: note = CRISPR gRNA sequence
  source 1..20: mol_type = other DNA
aagaaacagggaaagaaaga

SEQ ID NO: 22247 - DNA, 20 bp, synthetic construct
  misc_feature 1..20: note = CRISPR gRNA sequence
  source 1..20: mol_type = other DNA
gcctgggcacagtagaagcc

SEQ ID NO: 22248 - DNA, 20 bp, synthetic construct
  misc_feature 1..20: note = CRISPR gRNA sequence
  source 1..20: mol_type = other DNA
agtagaagcctgagaaaatg

SEQ ID NO: 22249 - DNA, 20 bp, synthetic construct
  misc_feature 1..20: note = CRISPR gRNA sequence
  source 1..20: mol_type = other DNA
cagctgaaaataatttaagg

SEQ ID NO: 22250 - DNA, 20 bp, synthetic construct
  misc_feature 1..20: note = CRISPR gRNA sequence
  source 1..20: mol_type = other DNA
gacagagtaagactctgcct

SEQ ID NO: 22251 - DNA, 20 bp, synthetic construct
  misc_feature 1..20: note = CRISPR gRNA sequence
  source 1..20: mol_type = other DNA
gagtaagactctgcctcaag

SEQ ID NO: 22252 - DNA, 20 bp, synthetic construct
  misc_feature 1..20: note = CRISPR gRNA sequence
  source 1..20: mol_type = other DNA
agactctgcctcaagaaaga

SEQ ID NO: 22253 - DNA, 20 bp, synthetic construct
  misc_feature 1..20: note = CRISPR gRNA sequence
  source 1..20: mol_type = other DNA
tcaagaaagaaaagaaaagg

SEQ ID NO: 22254 - DNA, 20 bp, synthetic construct
  misc_feature 1..20: note = CRISPR gRNA sequence
  source 1..20: mol_type = other DNA
gaaggaagggagggaaggaa

SEQ ID NO: 22255 - DNA, 20 bp, synthetic construct
  misc_feature 1..20: note = CRISPR gRNA sequence
  source 1..20: mol_type = other DNA
gaagggagggaaggaaagag

SEQ ID NO: 22256 - DNA, 20 bp, synthetic construct
  misc_feature 1..20: note = CRISPR gRNA sequence
  source 1..20: mol_type = other DNA
agggaaggaaagagaaagaa

SEQ ID NO: 22257 - DNA, 20 bp, synthetic construct
  misc_feature 1..20: note = CRISPR gRNA sequence
  source 1..20: mol_type = other DNA
aagagaaagaaagagaatgg

SEQ ID NO: 22258 - DNA, 20 bp, synthetic construct
  misc_feature 1..20: note = CRISPR gRNA sequence
  source 1..20: mol_type = other DNA
gaaagaaagagaatggaaag

SEQ ID NO: 22259 - DNA, 20 bp, synthetic construct
  misc_feature 1..20: note = CRISPR gRNA sequence
  source 1..20: mol_type = other DNA
aagagaatggaaagaaagaa

SEQ ID NO: 22260 - DNA, 20 bp, synthetic construct
  misc_feature 1..20: note = CRISPR gRNA sequence
  source 1..20: mol_type = other DNA
gaaagaaagaaagagaaagg

SEQ ID NO: 22261 - DNA, 20 bp, synthetic construct
  misc_feature 1..20: note = CRISPR gRNA sequence
  source 1..20: mol_type = other DNA
aaagagaaaggagagaaagg

SEQ ID NO: 22262 - DNA, 20 bp, synthetic construct
  misc_feature 1..20: note = CRISPR gRNA sequence
  source 1..20: mol_type = other DNA
agaaaggagagaaaggaaag

SEQ ID NO: 22263 - DNA, 20 bp, synthetic construct
  misc_feature 1..20: note = CRISPR gRNA sequence
  source 1..20: mol_type = other DNA
aggaaagaaagaaaagaagg

SEQ ID NO: 22264 - DNA, 20 bp, synthetic construct
  misc_feature 1..20: note = CRISPR gRNA sequence
  source 1..20: mol_type = other DNA
aagaaagaaaagaaggaaag

SEQ ID NO: 22265 - DNA, 20 bp, synthetic construct
  misc_feature 1..20: note = CRISPR gRNA sequence
  source 1..20: mol_type = other DNA
aagaaaagaaggaaagaaag

SEQ ID NO: 22266 - DNA, 20 bp, synthetic construct
  misc_feature 1..20: note = CRISPR gRNA sequence
  source 1..20: mol_type = other DNA
aggaaggaagggagagagag

SEQ ID NO: 22267 - DNA, 20 bp, synthetic construct
  misc_feature 1..20: note = CRISPR gRNA sequence
  source 1..20: mol_type = other DNA
aggaagggagagagagagag

SEQ ID NO: 22268 - DNA, 20 bp, synthetic construct
  misc_feature 1..20: note = CRISPR gRNA sequence
  source 1..20: mol_type = other DNA
agggagagagagagagaaag

SEQ ID NO: 22269 - DNA, 20 bp, synthetic construct
  misc_feature 1..20: note = CRISPR gRNA sequence
  source 1..20: mol_type = other DNA
agagagagagagaaagaaag

SEQ ID NO: 22270 - DNA, 20 bp, synthetic construct
  misc_feature 1..20: note = CRISPR gRNA sequence
  source 1..20: mol_type = other DNA
agaaagaaagaaagaaacag

SEQ ID NO: 22271 - DNA, 20 bp, synthetic construct
  misc_feature 1..20: note = CRISPR gRNA sequence
  source 1..20: mol_type = other DNA
agaaagaaagaaacagagag

SEQ ID NO: 22272 - DNA, 20 bp, synthetic construct
  misc_feature 1..20: note = CRISPR gRNA sequence
  source 1..20: mol_type = other DNA
gaaacagagagaaagaaaaa

SEQ ID NO: 22273 - DNA, 20 bp, synthetic construct
  misc_feature 1..20: note = CRISPR gRNA sequence
  source 1..20: mol_type = other DNA
aaggagggagggagggaagg

SEQ ID NO: 22274 - DNA, 20 bp, synthetic construct
  misc_feature 1..20: note = CRISPR gRNA sequence
  source 1..20: mol_type = other DNA
aaagaaaaggaagggaaagg

SEQ ID NO: 22275 - DNA, 20 bp, synthetic construct
  misc_feature 1..20: note = CRISPR gRNA sequence
  source 1..20: mol_type = other DNA
agggaaaggaaagaaagagg

SEQ ID NO: 22276 - DNA, 20 bp, synthetic construct
  misc_feature 1..20: note = CRISPR gRNA sequence
  source 1..20: mol_type = other DNA
gaaagaaagaggaaagaaag

SEQ ID NO: 22277 - DNA, 20 bp, synthetic construct
  misc_feature 1..20: note = CRISPR gRNA sequence
  source 1..20: mol_type = other DNA
gaaagaggaaagaaagagag

SEQ ID NO: 22278 - DNA, 20 bp, synthetic construct
  misc_feature 1..20: note = CRISPR gRNA sequence
  source 1..20: mol_type = other DNA
gaggaaagaaagagagaaag

SEQ ID NO: 22279 - DNA, 20 bp, synthetic construct
  misc_feature 1..20: note = CRISPR gRNA sequence
  source 1..20: mol_type = other DNA
gaaagagagaaagaaagaaa

SEQ ID NO: 22280 - DNA, 20 bp, synthetic construct
  misc_feature 1..20: note = CRISPR gRNA sequence
  source 1..20: mol_type = other DNA
gagagaaagaaagaaagaag

SEQ ID NO: 22281 - DNA, 20 bp, synthetic construct
  misc_feature 1..20: note = CRISPR gRNA sequence
  source 1..20: mol_type = other DNA
gaaagaaagaaagaagaaag

SEQ ID NO: 22282 - DNA, 20 bp, synthetic construct
  misc_feature 1..20: note = CRISPR gRNA sequence
  source 1..20: mol_type = other DNA
aagaaagaagaaagaaagaa

SEQ ID NO: 22283 - DNA, 20 bp, synthetic construct
  misc_feature 1..20: note = CRISPR gRNA sequence
  source 1..20: mol_type = other DNA
aagaaagaaaaagaaagaga

SEQ ID NO: 22284 - DNA, 20 bp, synthetic construct
  misc_feature 1..20: note = CRISPR gRNA sequence
  source 1..20: mol_type = other DNA
aaagaaagagagaagaaagg

SEQ ID NO: 22285 - DNA, 20 bp, synthetic construct
  misc_feature 1..20: note = CRISPR gRNA sequence
  source 1..20: mol_type = other DNA
aaagagagaagaaaggaaag

SEQ ID NO: 22286 - DNA, 20 bp, synthetic construct
  misc_feature 1..20: note = CRISPR gRNA sequence
  source 1..20: mol_type = other DNA
agagaagaaaggaaagaaag

SEQ ID NO: 22287 - DNA, 20 bp, synthetic construct
  misc_feature 1..20: note = CRISPR gRNA sequence
  source 1..20: mol_type = other DNA
caaagtggtgggcaagaggg

SEQ ID NO: 22288 - DNA, 20 bp, synthetic construct
  misc_feature 1..20: note = CRISPR gRNA sequence
  source 1..20: mol_type = other DNA
acacagcgagaccctgtctt

SEQ ID NO: 22289 - DNA, 20 bp, synthetic construct
  misc_feature 1..20: note = CRISPR gRNA sequence
  source 1..20: mol_type = other DNA
agactctggttagccattgc

SEQ ID NO: 22290 - DNA, 20 bp, synthetic construct
  misc_feature 1..20: note = CRISPR gRNA sequence
  source 1..20: mol_type = other DNA
ggaaatgcccatgacaaact

SEQ ID NO: 22291 - DNA, 20 bp, synthetic construct
  misc_feature 1..20: note = CRISPR gRNA sequence
  source 1..20: mol_type = other DNA
tagctcaacctctacctttc

SEQ ID NO: 22292 - DNA, 20 bp, synthetic construct
  misc_feature 1..20: note = CRISPR gRNA sequence
  source 1..20: mol_type = other DNA
acaaaatggagtggaagagg

SEQ ID NO: 22293 - DNA, 20 bp, synthetic construct
  misc_feature 1..20: note = CRISPR gRNA sequence
  source 1..20: mol_type = other DNA
ccatggctttactcttagca

SEQ ID NO: 22294 - DNA, 20 bp, synthetic construct
  misc_feature 1..20: note = CRISPR gRNA sequence
  source 1..20: mol_type = other DNA
gtggcgtgctcagggggtgg

SEQ ID NO: 22295 - DNA, 20 bp, synthetic construct
  misc_feature 1..20: note = CRISPR gRNA sequence
  source 1..20: mol_type = other DNA
gggccttcaaatattgactg

SEQ ID NO: 22296 - DNA, 20 bp, synthetic construct
  misc_feature 1..20: note = CRISPR gRNA sequence
  source 1..20: mol_type = other DNA
catcctcatcttaaaaatgg

SEQ ID NO: 22297 - DNA, 20 bp, synthetic construct
  misc_feature 1..20: note = CRISPR gRNA sequence
  source 1..20: mol_type = other DNA
aggaggcgtgaggcgggtgc

SEQ ID NO: 22298 - DNA, 20 bp, synthetic construct
  misc_feature 1..20: note = CRISPR gRNA sequence
  source 1..20: mol_type = other DNA
aggctggaagatcagcccag

SEQ ID NO: 22299 - DNA, 20 bp, synthetic construct
  misc_feature 1..20: note = CRISPR gRNA sequence
  source 1..20: mol_type = other DNA
aaatttcactcatgtttaaa

SEQ ID NO: 22300 - DNA, 20 bp, synthetic construct
  misc_feature 1..20: note = CRISPR gRNA sequence
  source 1..20: mol_type = other DNA
ctgctccggaggctgaggca

SEQ ID NO: 22301 - DNA, 20 bp, synthetic construct
  misc_feature 1..20: note = CRISPR gRNA sequence
  source 1..20: mol_type = other DNA
attgggggtggagagtggtg

SEQ ID NO: 22302 - DNA, 20 bp, synthetic construct
  misc_feature 1..20: note = CRISPR gRNA sequence
  source 1..20: mol_type = other DNA
agaataaccaggtattgatt

SEQ ID NO: 22303 - DNA, 20 bp, synthetic construct
  misc_feature 1..20: note = CRISPR gRNA sequence
  source 1..20: mol_type = other DNA
agatatttcaggacagagct

SEQ ID NO: 22304 - DNA, 20 bp, synthetic construct
  misc_feature 1..20: note = CRISPR gRNA sequence
  source 1..20: mol_type = other DNA
attaggaaacaagacaaatc

SEQ ID NO: 22305 - DNA, 20 bp, synthetic construct
  misc_feature 1..20: note = CRISPR gRNA sequence
  source 1..20: mol_type = other DNA
gatttttgggaaatagggac

SEQ ID NO: 22306 - DNA, 20 bp, synthetic construct
  misc_feature 1..20: note = CRISPR gRNA sequence
  source 1..20: mol_type = other DNA
aggcagctcaacgaggaact

SEQ ID NO: 22307 - DNA, 20 bp, synthetic construct
  misc_feature 1..20: note = CRISPR gRNA sequence
  source 1..20: mol_type = other DNA
ccttatccacctcccaagag

SEQ ID NO: 22308 - DNA, 20 bp, synthetic construct
  misc_feature 1..20: note = CRISPR gRNA sequence
  source 1..20: mol_type = other DNA
cctccacacggagagctggg

SEQ ID NO: 22309 - DNA, 20 bp, synthetic construct
  misc_feature 1..20: note = CRISPR gRNA sequence
  source 1..20: mol_type = other DNA
agctcctctgggaaggctgc

SEQ ID NO: 22310 - DNA, 20 bp, synthetic construct
  misc_feature 1..20: note = CRISPR gRNA sequence
  source 1..20: mol_type = other DNA
tcctacattgcaggagtatg

SEQ ID NO: 22311 - DNA, 20 bp, synthetic construct
  misc_feature 1..20: note = CRISPR gRNA sequence
  source 1..20: mol_type = other DNA
cgaaacactgcatggcctta

SEQ ID NO: 22312 - DNA, 20 bp, synthetic construct
  misc_feature 1..20: note = CRISPR gRNA sequence
  source 1..20: mol_type = other DNA
aataaaacccaacattaatt

SEQ ID NO: 22313 - DNA, 20 bp, synthetic construct
  misc_feature 1..20: note = CRISPR gRNA sequence
  source 1..20: mol_type = other DNA
ttatcaaatgaaaacataaa

SEQ ID NO: 22314 - DNA, 20 bp, synthetic construct
  misc_feature 1..20: note = CRISPR gRNA sequence
  source 1..20: mol_type = other DNA
gaaaacataaagaagaaaaa

SEQ ID NO: 22315 - DNA, 20 bp, synthetic construct
  misc_feature 1..20: note = CRISPR gRNA sequence
  source 1..20: mol_type = other DNA
cataaagaagaaaaacaaga

SEQ ID NO: 22316 - DNA, 20 bp, synthetic construct
  misc_feature 1..20: note = CRISPR gRNA sequence
  source 1..20: mol_type = other DNA
aagaagaaaaacaagaaaag

SEQ ID NO: 22317 - DNA, 20 bp, synthetic construct
  misc_feature 1..20: note = CRISPR gRNA sequence
  source 1..20: mol_type = other DNA
cagggagtaatgaagtaaat

SEQ ID NO: 22318 - DNA, 20 bp, synthetic construct
  misc_feature 1..20: note = CRISPR gRNA sequence
  source 1..20: mol_type = other DNA
gtaaatgaagaaagcaaaat

SEQ ID NO: 22319 - DNA, 20 bp, synthetic construct
  misc_feature 1..20: note = CRISPR gRNA sequence
  source 1..20: mol_type = other DNA
gctggggaaacagtcacgag

SEQ ID NO: 22320 - DNA, 20 bp, synthetic construct
  misc_feature 1..20: note = CRISPR gRNA sequence
  source 1..20: mol_type = other DNA
aaggaaaaagacacacaagg

SEQ ID NO: 22321 - DNA, 20 bp, synthetic construct
  misc_feature 1..20: note = CRISPR gRNA sequence
  source 1..20: mol_type = other DNA
aggtgacagtttagccaaca

SEQ ID NO: 22322 - DNA, 20 bp, synthetic construct
  misc_feature 1..20: note = CRISPR gRNA sequence
  source 1..20: mol_type = other DNA
tggtcctatgtgctctactt

SEQ ID NO: 22323 - DNA, 20 bp, synthetic construct
  misc_feature 1..20: note = CRISPR gRNA sequence
  source 1..20: mol_type = other DNA
cctggcacacagtggggact

SEQ ID NO: 22324 - DNA, 20 bp, synthetic construct
  misc_feature 1..20: note = CRISPR gRNA sequence
  source 1..20: mol_type = other DNA
ctgctacaaagaagagcaag

SEQ ID NO: 22325 - DNA, 20 bp, synthetic construct
  misc_feature 1..20: note = CRISPR gRNA sequence
  source 1..20: mol_type = other DNA
aggcaccatgacatgaagtc

SEQ ID NO: 22326 - DNA, 20 bp, synthetic construct
  misc_feature 1..20: note = CRISPR gRNA sequence
  source 1..20: mol_type = other DNA
tcatatttcaggatgctgca

SEQ ID NO: 22327 - DNA, 20 bp, synthetic construct
  misc_feature 1..20: note = CRISPR gRNA sequence
  source 1..20: mol_type = other DNA
gcttcaccttccagaagcag

SEQ ID NO: 22328 - DNA, 20 bp, synthetic construct
  misc_feature 1..20: note = CRISPR gRNA sequence
  source 1..20: mol_type = other DNA
cttctcagcctccataactg

SEQ ID NO: 22329 - DNA, 20 bp, synthetic construct
  misc_feature 1..20: note = CRISPR gRNA sequence
  source 1..20: mol_type = other DNA
gtggagatgccactaagggg

SEQ ID NO: 22330 - DNA, 20 bp, synthetic construct
  misc_feature 1..20: note = CRISPR gRNA sequence
  source 1..20: mol_type = other DNA
cctggtaggggctgcatcct

SEQ ID NO: 22331 - DNA, 20 bp, synthetic construct
  misc_feature 1..20: note = CRISPR gRNA sequence
  source 1..20: mol_type = other DNA
taaaaatggagactttgaaa

SEQ ID NO: 22332 - DNA, 20 bp, synthetic construct
  misc_feature 1..20: note = CRISPR gRNA sequence
  source 1..20: mol_type = other DNA
tgaaacgagaaagacctagg

SEQ ID NO: 22333 - DNA, 20 bp, synthetic construct
  misc_feature 1..20: note = CRISPR gRNA sequence
  source 1..20: mol_type = other DNA
aatttcctcatttgtaaaag

SEQ ID NO: 22334 - DNA, 20 bp, synthetic construct
  misc_feature 1..20: note = CRISPR gRNA sequence
  source 1..20: mol_type = other DNA
gggtgtatggtatgggcttt

SEQ ID NO: 22335 - DNA, 20 bp, synthetic construct
  misc_feature 1..20: note = CRISPR gRNA sequence
  source 1..20: mol_type = other DNA
gatggacagaagagcaagaa

SEQ ID NO: 22336 - DNA, 20 bp, synthetic construct
  misc_feature 1..20: note = CRISPR gRNA sequence
  source 1..20: mol_type = other DNA
agcaagaagcagaaatgcgt

SEQ ID NO: 22337 - DNA, 20 bp, synthetic construct
  misc_feature 1..20: note = CRISPR gRNA sequence
  source 1..20: mol_type = other DNA
tgctgacgggagggcaggga

SEQ ID NO: 22338 - DNA, 20 bp, synthetic construct
  misc_feature 1..20: note = CRISPR gRNA sequence
  source 1..20: mol_type = other DNA
tcacagggtgttggaaagag

SEQ ID NO: 22339 - DNA, 20 bp, synthetic construct
  misc_feature 1..20: note = CRISPR gRNA sequence
  source 1..20: mol_type = other DNA
tatgagaagatacccaggag

SEQ ID NO: 22340 - DNA, 20 bp, synthetic construct
  misc_feature 1..20: note = CRISPR gRNA sequence
  source 1..20: mol_type = other DNA
tattatcctcactttgcata

SEQ ID NO: 22341 - DNA, 20 bp, synthetic construct
  misc_feature 1..20: note = CRISPR gRNA sequence
  source 1..20: mol_type = other DNA
tattatgtattaataaaaca

SEQ ID NO: 22342 - DNA, 20 bp, synthetic construct
  misc_feature 1..20: note = CRISPR gRNA sequence
  source 1..20: mol_type = other DNA
attaataaaacaaaagaaaa

SEQ ID NO: 22343 - DNA, 20 bp, synthetic construct
  misc_feature 1..20: note = CRISPR gRNA sequence
  source 1..20: mol_type = other DNA
aaagtattccaccattaaag

SEQ ID NO: 22344 - DNA, 20 bp, synthetic construct
  misc_feature 1..20: note = CRISPR gRNA sequence
  source 1..20: mol_type = other DNA
cactttgggaggctgagaca

SEQ ID NO: 22345 - DNA, 20 bp, synthetic construct
  misc_feature 1..20: note = CRISPR gRNA sequence
  source 1..20: mol_type = other DNA
tatctctattaatttttttt

SEQ ID NO: 22346 - DNA, 20 bp, synthetic construct
  misc_feature 1..20: note = CRISPR gRNA sequence
  source 1..20: mol_type = other DNA
tctattaatttttttttaag

SEQ ID NO: 22347 - DNA, 20 bp, synthetic construct
  misc_feature 1..20: note = CRISPR gRNA sequence
  source 1..20: mol_type = other DNA
ctgcctctggaggctcgagg

SEQ ID NO: 22348 - DNA, 20 bp, synthetic construct
  misc_feature 1..20: note = CRISPR gRNA sequence
  source 1..20: mol_type = other DNA
agctaatttttgtattttta

SEQ ID NO: 22349 - DNA, 20 bp, synthetic construct
  misc_feature 1..20: note = CRISPR gRNA sequence
  source 1..20: mol_type = other DNA
gacatgcagatgaaggctgg

SEQ ID NO: 22350 - DNA, 20 bp, synthetic construct
  misc_feature 1..20: note = CRISPR gRNA sequence
  source 1..20: mol_type = other DNA
tgccctgttctgggcccaga

SEQ ID NO: 22351 - DNA, 20 bp, synthetic construct
  misc_feature 1..20: note = CRISPR gRNA sequence
  source 1..20: mol_type = other DNA
tacattgaagagtaagctca

SEQ ID NO: 22352 - DNA, 20 bp, synthetic construct
  misc_feature 1..20: note = CRISPR gRNA sequence
  source 1..20: mol_type = other DNA
cacagacccccggatgtcac

SEQ ID NO: 22353 - DNA, 20 bp, synthetic construct
  misc_feature 1..20: note = CRISPR gRNA sequence
  source 1..20: mol_type = other DNA
aatctgttctctcagagcag

SEQ ID NO: 22354 - DNA, 20 bp, synthetic construct
  misc_feature 1..20: note = CRISPR gRNA sequence
  source 1..20: mol_type = other DNA
gtgtggttaagcacacagtc

SEQ ID NO: 22355 - DNA, 20 bp, synthetic construct
  misc_feature 1..20: note = CRISPR gRNA sequence
  source 1..20: mol_type = other DNA
gggcatggtggctcacatct

SEQ ID NO: 22356 - DNA, 20 bp, synthetic construct
  misc_feature 1..20: note = CRISPR gRNA sequence
  source 1..20: mol_type = other DNA
tgatagagccagactgtgtc

SEQ ID NO: 22357 - DNA, 20 bp, synthetic construct
  misc_feature 1..20: note = CRISPR gRNA sequence
  source 1..20: mol_type = other DNA
cattggctcaacctggacaa

SEQ ID NO: 22358 - DNA, 20 bp, synthetic construct
  misc_feature 1..20: note = CRISPR gRNA sequence
  source 1..20: mol_type = other DNA
gttttcccaatattagttct

SEQ ID NO: 22359 - DNA, 20 bp, synthetic construct
  misc_feature 1..20: note = CRISPR gRNA sequence
  source 1..20: mol_type = other DNA
ctacttgggaggctgaggca

SEQ ID NO: 22360 - DNA, 20 bp, synthetic construct
  misc_feature 1..20: note = CRISPR gRNA sequence
  source 1..20: mol_type = other DNA
tccgtggcaatgatatagaa

SEQ ID NO: 22361 - DNA, 20 bp, synthetic construct
  misc_feature 1..20: note = CRISPR gRNA sequence
  source 1..20: mol_type = other DNA
accaccttccacatccaact

SEQ ID NO: 22362 - DNA, 20 bp, synthetic construct
  misc_feature 1..20: note = CRISPR gRNA sequence
  source 1..20: mol_type = other DNA
agttaagttgcatggagccc

SEQ ID NO: 22363 - DNA, 20 bp, synthetic construct
  misc_feature 1..20: note = CRISPR gRNA sequence
  source 1..20: mol_type = other DNA
gtagtcctccagataaactc

SEQ ID NO: 22364 - DNA, 20 bp, synthetic construct
  misc_feature 1..20: note = CRISPR gRNA sequence
  source 1..20: mol_type = other DNA
atgattcactgagcaccccg

SEQ ID NO: 22365 - DNA, 20 bp, synthetic construct
  misc_feature 1..20: note = CRISPR gRNA sequence
  source 1..20: mol_type = other DNA
ttactcaacctctctgagtc

SEQ ID NO: 22366 - DNA, 20 bp, synthetic construct
  misc_feature 1..20: note = CRISPR gRNA sequence
  source 1..20: mol_type = other DNA
ggagaacgacctggcatcat

SEQ ID NO: 22367 - DNA, 20 bp, synthetic construct
  misc_feature 1..20: note = CRISPR gRNA sequence
  source 1..20: mol_type = other DNA
ctcttgggtctatatatcct

SEQ ID NO: 22368 - DNA, 20 bp, synthetic construct
  misc_feature 1..20: note = CRISPR gRNA sequence
  source 1..20: mol_type = other DNA
gtagatcctaaaaacatagt

SEQ ID NO: 22369 - DNA, 20 bp, synthetic construct
  misc_feature 1..20: note = CRISPR gRNA sequence
  source 1..20: mol_type = other DNA
catagtacagaatgcaaaag

SEQ ID NO: 22370 - DNA, 20 bp, synthetic construct
  misc_feature 1..20: note = CRISPR gRNA sequence
  source 1..20: mol_type = other DNA
aaaccccatctctactaaaa

SEQ ID NO: 22371 - DNA, 20 bp, synthetic construct
  misc_feature 1..20: note = CRISPR gRNA sequence
  source 1..20: mol_type = other DNA
ttttataagagcacatacaa

SEQ ID NO: 22372 - DNA, 20 bp, synthetic construct
  misc_feature 1..20: note = CRISPR gRNA sequence
  source 1..20: mol_type = other DNA
aaagatacacctgaaatgca

SEQ ID NO: 22373 - DNA, 20 bp, synthetic construct
  misc_feature 1..20: note = CRISPR gRNA sequence
  source 1..20: mol_type = other DNA
ggaaatagggacattaatga

SEQ ID NO: 22374 - DNA, 20 bp, synthetic construct
  misc_feature 1..20: note = CRISPR gRNA sequence
  source 1..20: mol_type = other DNA
tttaaaggcccaggggttga

SEQ ID NO: 22375 - DNA, 20 bp, synthetic construct
  misc_feature 1..20: note = CRISPR gRNA sequence
  source 1..20: mol_type = other DNA
aggcccaggggttgaaaaga

SEQ ID NO: 22376 - DNA, 20 bp, synthetic construct
  misc_feature 1..20: note = CRISPR gRNA sequence
  source 1..20: mol_type = other DNA
tggtacctatagatgttcac

SEQ ID NO: 22377 - DNA, 20 bp, synthetic construct
  misc_feature 1..20: note = CRISPR gRNA sequence
  source 1..20: mol_type = other DNA
cgagacagagagaggactta

SEQ ID NO: 22378 - DNA, 20 bp, synthetic construct
  misc_feature 1..20: note = CRISPR gRNA sequence
  source 1..20: mol_type = other DNA
catagtgaaaccccatctct

SEQ ID NO: 22379 - DNA, 20 bp, synthetic construct
  misc_feature 1..20: note = CRISPR gRNA sequence
  source 1..20: mol_type = other DNA
aaaggatgaatgaatgaatg

SEQ ID NO: 22380 - DNA, 20 bp, synthetic construct
  misc_feature 1..20: note = CRISPR gRNA sequence
  source 1..20: mol_type = other DNA
tcagcagttggaggcaggtt

SEQ ID NO: 22381 - DNA, 20 bp, synthetic construct
  misc_feature 1..20: note = CRISPR gRNA sequence
  source 1..20: mol_type = other DNA
tcatgtatctgtccaaaccc

SEQ ID NO: 22382 - DNA, 20 bp, synthetic construct
  misc_feature 1..20: note = CRISPR gRNA sequence
  source 1..20: mol_type = other DNA
ggggcctggtggtcccagga

SEQ ID NO: 22383 - DNA, 20 bp, synthetic construct
  misc_feature 1..20: note = CRISPR gRNA sequence
  source 1..20: mol_type = other DNA
aggagaccttcggtccctgt

SEQ ID NO: 22384 - DNA, 20 bp, synthetic construct
  misc_feature 1..20: note = CRISPR gRNA sequence
  source 1..20: mol_type = other DNA
tcggcaggcttggctgtgag

SEQ ID NO: 22385 - DNA, 20 bp, synthetic construct
  misc_feature 1..20: note = CRISPR gRNA sequence
  source 1..20: mol_type = other DNA
ttttcttaaattaacttttt

SEQ ID NO: 22386 - DNA, 20 bp, synthetic construct
  misc_feature 1..20: note = CRISPR gRNA sequence
  source 1..20: mol_type = other DNA
acttaaatagaccgatttta

SEQ ID NO: 22387 - DNA, 20 bp, synthetic construct
  misc_feature 1..20: note = CRISPR gRNA sequence
  source 1..20: mol_type = other DNA
aaatatgggatatccacata

SEQ ID NO: 22388 - DNA, 20 bp, synthetic construct
  misc_feature 1..20: note = CRISPR gRNA sequence
  source 1..20: mol_type = other DNA
tattagaatactattccgcc

SEQ ID NO: 22389 - DNA, 20 bp, synthetic construct
  misc_feature 1..20: note = CRISPR gRNA sequence
  source 1..20: mol_type = other DNA
attttaccatgattttacaa

SEQ ID NO: 22390 - DNA, 20 bp, synthetic construct
  misc_feature 1..20: note = CRISPR gRNA sequence
  source 1..20: mol_type = other DNA
cagtatcacttgtggttgaa

SEQ ID NO: 22391 - DNA, 20 bp, synthetic construct
  misc_feature 1..20: note = CRISPR gRNA sequence
  source 1..20: mol_type = other DNA
cttctttaccactttgttaa

SEQ ID NO: 22392 - DNA, 20 bp, synthetic construct
  misc_feature 1..20: note = CRISPR gRNA sequence
  source 1..20: mol_type = other DNA
aactatctatgtccttccta

SEQ ID NO: 22393 - DNA, 20 bp, synthetic construct
  misc_feature 1..20: note = CRISPR gRNA sequence
  source 1..20: mol_type = other DNA
ttttttctctggagtgggga

SEQ ID NO: 22394 - DNA, 20 bp, synthetic construct
  misc_feature 1..20: note = CRISPR gRNA sequence
  source 1..20: mol_type = other DNA
gatgctggccctagggagga

SEQ ID NO: 22395 - DNA, 20 bp, synthetic construct
  misc_feature 1..20: note = CRISPR gRNA sequence
  source 1..20: mol_type = other DNA
ccatacatttcaggggagtc

SEQ ID NO: 22396 - DNA, 20 bp, synthetic construct
  misc_feature 1..20: note = CRISPR gRNA sequence
  source 1..20: mol_type = other DNA
acactccaggaaaattgact

SEQ ID NO: 22397 - DNA, 20 bp, synthetic construct
  misc_feature 1..20: note = CRISPR gRNA sequence
  source 1..20: mol_type = other DNA
tcctcacccccatccccaat

SEQ ID NO: 22398 - DNA, 20 bp, synthetic construct
  misc_feature 1..20: note = CRISPR gRNA sequence
  source 1..20: mol_type = other DNA
tctttactctctccctgtta

SEQ ID NO: 22399 - DNA, 20 bp, synthetic construct
  misc_feature 1..20: note = CRISPR gRNA sequence
  source 1..20: mol_type = other DNA
aggttcatctgtaaaatgga

SEQ ID NO: 22400 - DNA, 20 bp, synthetic construct
  misc_feature 1..20: note = CRISPR gRNA sequence
  source 1..20: mol_type = other DNA
tgtacagaaaaagcacttta

SEQ ID NO: 22401 - DNA, 20 bp, synthetic construct
  misc_feature 1..20: note = CRISPR gRNA sequence
  source 1..20: mol_type = other DNA
tggagaaaccccaactctac

SEQ ID NO: 22402 - DNA, 20 bp, synthetic construct
  misc_feature 1..20: note = CRISPR gRNA sequence
  source 1..20: mol_type = other DNA
gggtcaggttcccttccagg

SEQ ID NO: 22403 - DNA, 20 bp, synthetic construct
  misc_feature 1..20: note = CRISPR gRNA sequence
  source 1..20: mol_type = other DNA
acttatattggcttgggaaa

SEQ ID NO: 22404 - DNA, 20 bp, synthetic construct
  misc_feature 1..20: note = CRISPR gRNA sequence
  source 1..20: mol_type = other DNA
tctgtttgtatgtgctctta

SEQ ID NO: 22405 - DNA, 20 bp, synthetic construct
  misc_feature 1..20: note = CRISPR gRNA sequence
  source 1..20: mol_type = other DNA
agactccccgcctctgggaa

SEQ ID NO: 22406 - DNA, 20 bp, synthetic construct
  misc_feature 1..20: note = CRISPR gRNA sequence
  source 1..20: mol_type = other DNA
tgagcctgtctcttcatctg

SEQ ID NO: 22407 - DNA, 20 bp, synthetic construct
  misc_feature 1..20: note = CRISPR gRNA sequence
  source 1..20: mol_type = other DNA
ttctccagaactaatattgg

SEQ ID NO: 22408 - DNA, 20 bp, synthetic construct
  misc_feature 1..20: note = CRISPR gRNA sequence
  source 1..20: mol_type = other DNA
gcagacccaatgccctgtga

SEQ ID NO: 22409 - DNA, 20 bp, synthetic construct
  misc_feature 1..20: note = CRISPR gRNA sequence
  source 1..20: mol_type = other DNA
gaccagcgtggccaacatgg

SEQ ID NO: 22410 - DNA, 20 bp, synthetic construct
  misc_feature 1..20: note = CRISPR gRNA sequence
  source 1..20: mol_type = other DNA
ccttcactaatgaccaccaa

SEQ ID NO: 22411 - DNA, 20 bp, synthetic construct
  misc_feature 1..20: note = CRISPR gRNA sequence
  source 1..20: mol_type = other DNA
tgtgtgcagtgaacaacctg

SEQ ID NO: 22412 - DNA, 20 bp, synthetic construct
  misc_feature 1..20: note = CRISPR gRNA sequence
  source 1..20: mol_type = other DNA
ttagtccattttttgttgct

SEQ ID NO: 22413 - DNA, 20 bp, synthetic construct
  misc_feature 1..20: note = CRISPR gRNA sequence
  source 1..20: mol_type = other DNA
agtctctcttcctcttctca

SEQ ID NO: 22414 - DNA, 20 bp, synthetic construct
  misc_feature 1..20: note = CRISPR gRNA sequence
  source 1..20: mol_type = other DNA
tcagtagatatctgttgaat

SEQ ID NO: 22415 - DNA, 20 bp, synthetic construct
  misc_feature 1..20: note = CRISPR gRNA sequence
  source 1..20: mol_type = other DNA
tccggccagatgcgcctgga

SEQ ID NO: 22416 - DNA, 20 bp, synthetic construct
  misc_feature 1..20: note = CRISPR gRNA sequence
  source 1..20: mol_type = other DNA
tggtcagatcttttgaagtt

SEQ ID NO: 22417 - DNA, 20 bp, synthetic construct
  misc_feature 1..20: note = CRISPR gRNA sequence
  source 1..20: mol_type = other DNA
gtgagaacttatctccacaa

SEQ ID NO: 22418 - DNA, 20 bp, synthetic construct
  misc_feature 1..20: note = CRISPR gRNA sequence
  source 1..20: mol_type = other DNA
aaaaaagccagaccctgtct

SEQ ID NO: 22419 - DNA, 20 bp, synthetic construct
  misc_feature 1..20: note = CRISPR gRNA sequence
  source 1..20: mol_type = other DNA
agccagaccctgtctcaaaa

SEQ ID NO: 22420 - DNA, 20 bp, synthetic construct
  misc_feature 1..20: note = CRISPR gRNA sequence
  source 1..20: mol_type = other DNA
gaccctgtctcaaaacaaaa

SEQ ID NO: 22421 - DNA, 20 bp, synthetic construct
  misc_feature 1..20: note = CRISPR gRNA sequence
  source 1..20: mol_type = other DNA
aaaacaaaacaaacaaacaa

SEQ ID NO: 22422 - DNA, 20 bp, synthetic construct
  misc_feature 1..20: note = CRISPR gRNA sequence
  source 1..20: mol_type = other DNA
agccgaagcaaaaagggaaa

SEQ ID NO: 22423 - DNA, 20 bp, synthetic construct
  misc_feature 1..20: note = CRISPR gRNA sequence
  source 1..20: mol_type = other DNA
caggcggagcctctagaatt

SEQ ID NO: 22424 - DNA, 20 bp, synthetic construct
  misc_feature 1..20: note = CRISPR gRNA sequence
  source 1..20: mol_type = other DNA
attgaaaactttgctgcatt

SEQ ID NO: 22425 - DNA, 20 bp, synthetic construct
  misc_feature 1..20: note = CRISPR gRNA sequence
  source 1..20: mol_type = other DNA
gctaaggtccagaaggcaga

SEQ ID NO: 22426 - DNA, 20 bp, synthetic construct
  misc_feature 1..20: note = CRISPR gRNA sequence
  source 1..20: mol_type = other DNA
gcctgggactatcctggttt

SEQ ID NO: 22427 - DNA, 20 bp, synthetic construct
  misc_feature 1..20: note = CRISPR gRNA sequence
  source 1..20: mol_type = other DNA
gctgaaaaggggaaatgtct

SEQ ID NO: 22428 - DNA, 20 bp, synthetic construct
  misc_feature 1..20: note = CRISPR gRNA sequence
  source 1..20: mol_type = other DNA
ctgaccctcacagttaaaaa

SEQ ID NO: 22429 - DNA, 20 bp, synthetic construct
  misc_feature 1..20: note = CRISPR gRNA sequence
  source 1..20: mol_type = other DNA
ccccatctctactaaatata

SEQ ID NO: 22430 - DNA, 20 bp, synthetic construct
  misc_feature 1..20: note = CRISPR gRNA sequence
  source 1..20: mol_type = other DNA
attcccctcatggttaaaaa

SEQ ID NO: 22431 - DNA, 20 bp, synthetic construct
  misc_feature 1..20: note = CRISPR gRNA sequence
  source 1..20: mol_type = other DNA
cctggagacccagctttaaa

SEQ ID NO: 22432 - DNA, 20 bp, synthetic construct
  misc_feature 1..20: note = CRISPR gRNA sequence
  source 1..20: mol_type = other DNA
tatcaataaagcattattat

SEQ ID NO: 22433 - DNA, 20 bp, synthetic construct
  misc_feature 1..20: note = CRISPR gRNA sequence
  source 1..20: mol_type = other DNA
aagcattattatcaaaacag

SEQ ID NO: 22434 - DNA, 20 bp, synthetic construct
  misc_feature 1..20: note = CRISPR gRNA sequence
  source 1..20: mol_type = other DNA
tcaaaacagtaaaacttttt

SEQ ID NO: 22435 - DNA, 20 bp, synthetic construct
  misc_feature 1..20: note = CRISPR gRNA sequence
  source 1..20: mol_type = other DNA
cacagggatacagtaatgag

SEQ ID NO: 22436 - DNA, 20 bp, synthetic construct
  misc_feature 1..20: note = CRISPR gRNA sequence
  source 1..20: mol_type = other DNA
gtctggttcataattgtgct

SEQ ID NO: 22437 - DNA, 20 bp, synthetic construct
  misc_feature 1..20: note = CRISPR gRNA sequence
  source 1..20: mol_type = other DNA
catacataaataaaatattg

SEQ ID NO: 22438 - DNA, 20 bp, synthetic construct
  misc_feature 1..20: note = CRISPR gRNA sequence
  source 1..20: mol_type = other DNA
tctccagggttcagagattg

SEQ ID NO: 22439 - DNA, 20 bp, synthetic construct
  misc_feature 1..20: note = CRISPR gRNA sequence
  source 1..20: mol_type = other DNA
cttgattagtttaagcctca

SEQ ID NO: 22440 - DNA, 20 bp, synthetic construct
  misc_feature 1..20: note = CRISPR gRNA sequence
  source 1..20: mol_type = other DNA
tggtcaaacagtgagcccag

SEQ ID NO: 22441 - DNA, 20 bp, synthetic construct
  misc_feature 1..20: note = CRISPR gRNA sequence
  source 1..20: mol_type = other DNA
ggcgaagccctgtctctact

SEQ ID NO: 22442 - DNA, 20 bp, synthetic construct
  misc_feature 1..20: note = CRISPR gRNA sequence
  source 1..20: mol_type = other DNA
ctacttttccattcacactg

SEQ ID NO: 22443 - DNA, 20 bp, synthetic construct
  misc_feature 1..20: note = CRISPR gRNA sequence
  source 1..20: mol_type = other DNA
acagtggcccttctgaccct

SEQ ID NO: 22444 - DNA, 20 bp, synthetic construct
  misc_feature 1..20: note = CRISPR gRNA sequence
  source 1..20: mol_type = other DNA
cctacataaataaaatattg

SEQ ID NO: 22445 - DNA, 20 bp, synthetic construct
  misc_feature 1..20: note = CRISPR gRNA sequence
  source 1..20: mol_type = other DNA
cctgtctctactaaaaatat

SEQ ID NO: 22446 - DNA, 20 bp, synthetic construct
  misc_feature 1..20: note = CRISPR gRNA sequence
  source 1..20: mol_type = other DNA
acagagcgagactccatctc

SEQ ID NO: 22447 - DNA, 20 bp, synthetic construct
  misc_feature 1..20: note = CRISPR gRNA sequence
  source 1..20: mol_type = other DNA
ggttcccattttccaggtaa

SEQ ID NO: 22448 - DNA, 20 bp, synthetic construct
  misc_feature 1..20: note = CRISPR gRNA sequence
  source 1..20: mol_type = other DNA
cacagcgagcccttgtctaa

SEQ ID NO: 22449 - DNA, 20 bp, synthetic construct
  misc_feature 1..20: note = CRISPR gRNA sequence
  source 1..20: mol_type = other DNA
ggggcaggatttggggttgt

SEQ ID NO: 22450 - DNA, 20 bp, synthetic construct
  misc_feature 1..20: note = CRISPR gRNA sequence
  source 1..20: mol_type = other DNA
agtgagactcagtctctaca

SEQ ID NO: 22451 - DNA, 20 bp, synthetic construct
  misc_feature 1..20: note = CRISPR gRNA sequence
  source 1..20: mol_type = other DNA
accctgtctcaaaaaagaaa

SEQ ID NO: 22452 - DNA, 20 bp, synthetic construct
  misc_feature 1..20: note = CRISPR gRNA sequence
  source 1..20: mol_type = other DNA
agcatccttgataaacatta

SEQ ID NO: 22453 - DNA, 20 bp, synthetic construct
  misc_feature 1..20: note = CRISPR gRNA sequence
  source 1..20: mol_type = other DNA
tttagcaccttgtctctgtt

SEQ ID NO: 22454 - DNA, 20 bp, synthetic construct
  misc_feature 1..20: note = CRISPR gRNA sequence
  source 1..20: mol_type = other DNA
gcaagaccccatctccaaaa

SEQ ID NO: 22455 - DNA, 20 bp, synthetic construct
  misc_feature 1..20: note = CRISPR gRNA sequence
  source 1..20: mol_type = other DNA
agcaagatccctgtgtctac

SEQ ID NO: 22456 - DNA, 20 bp, synthetic construct
  misc_feature 1..20: note = CRISPR gRNA sequence
  source 1..20: mol_type = other DNA
tggctttactcttagcataa

SEQ ID NO: 22457 - DNA, 20 bp, synthetic construct
  misc_feature 1..20: note = CRISPR gRNA sequence
  source 1..20: mol_type = other DNA
tgctcagggggtggaaagaa

SEQ ID NO: 22458 - DNA, 20 bp, synthetic construct
  misc_feature 1..20: note = CRISPR gRNA sequence
  source 1..20: mol_type = other DNA
ggtctcttcaagatgtggct

SEQ ID NO: 22459 - DNA, 20 bp, synthetic construct
  misc_feature 1..20: note = CRISPR gRNA sequence
  source 1..20: mol_type = other DNA
atgtattgatgttgcaattt

SEQ ID NO: 22460 - DNA, 20 bp, synthetic construct
  misc_feature 1..20: note = CRISPR gRNA sequence
  source 1..20: mol_type = other DNA
tgatgttgcaatttaaaaac

SEQ ID NO: 22461 - DNA, 20 bp, synthetic construct
  misc_feature 1..20: note = CRISPR gRNA sequence
  source 1..20: mol_type = other DNA
aacatttaaaaaaaataagg

SEQ ID NO: 22462 - DNA, 20 bp, synthetic construct
  misc_feature 1..20: note = CRISPR gRNA sequence
  source 1..20: mol_type = other DNA
gctgacgggggccccaagga

SEQ ID NO: 22463 - DNA, 20 bp, synthetic construct
  misc_feature 1..20: note = CRISPR gRNA sequence
  source 1..20: mol_type = other DNA
tcctctgggaaggctgcaga

SEQ ID NO: 22464 - DNA, 20 bp, synthetic construct
  misc_feature 1..20: note = CRISPR gRNA sequence
  source 1..20: mol_type = other DNA
cacaacatgggtttgagcca

SEQ ID NO: 22465 - DNA, 20 bp, synthetic construct
  misc_feature 1..20: note = CRISPR gRNA sequence
  source 1..20: mol_type = other DNA
catgggtttgagccaaaaaa

SEQ ID NO: 22466 - DNA, 20 bp, synthetic construct
  misc_feature 1..20: note = CRISPR gRNA sequence
  source 1..20: mol_type = other DNA
gtttgagccaaaaaacaaaa

SEQ ID NO: 22467 - DNA, 20 bp, synthetic construct
  misc_feature 1..20: note = CRISPR gRNA sequence
  source 1..20: mol_type = other DNA
agccaaaaaacaaaacaaaa

SEQ ID NO: 22468 - DNA, 20 bp, synthetic construct
  misc_feature 1..20: note = CRISPR gRNA sequence
  source 1..20: mol_type = other DNA
agcactcacagcaacagatt

SEQ ID NO: 22469 - DNA, 20 bp, synthetic construct
  misc_feature 1..20: note = CRISPR gRNA sequence
  source 1..20: mol_type = other DNA
tagagatgtgataagatgaa

SEQ ID NO: 22470 - DNA, 20 bp, synthetic construct
  misc_feature 1..20: note = CRISPR gRNA sequence
  source 1..20: mol_type = other DNA
tttcacttttattgtatctt

SEQ ID NO: 22471 - DNA, 20 bp, synthetic construct
  misc_feature 1..20: note = CRISPR gRNA sequence
  source 1..20: mol_type = other DNA
gtgagccaccacgcctggcc

SEQ ID NO: 22472 - DNA, 20 bp, synthetic construct
  misc_feature 1..20: note = CRISPR gRNA sequence
  source 1..20: mol_type = other DNA
gggggaaatatttatcaaat

SEQ ID NO: 22473 - DNA, 20 bp, synthetic construct
  misc_feature 1..20: note = CRISPR gRNA sequence
  source 1..20: mol_type = other DNA
caaatgaaaacataaagaag

SEQ ID NO: 22474 - DNA, 20 bp, synthetic construct
  misc_feature 1..20: note = CRISPR gRNA sequence
  source 1..20: mol_type = other DNA
taggttgactaagataggag

SEQ ID NO: 22475 - DNA, 20 bp, synthetic construct
  misc_feature 1..20: note = CRISPR gRNA sequence
  source 1..20: mol_type = other DNA
cctatgtgctctactttgag

SEQ ID NO: 22476 - DNA, 20 bp, synthetic construct
  misc_feature 1..20: note = CRISPR gRNA sequence
  source 1..20: mol_type = other DNA
aggatgaggtatgtatccat

SEQ ID NO: 22477 - DNA, 20 bp, synthetic construct
  misc_feature 1..20: note = CRISPR gRNA sequence
  source 1..20: mol_type = other DNA
tcaccttccagaagcagaga

SEQ ID NO: 22478 - DNA, 20 bp, synthetic construct
  misc_feature 1..20: note = CRISPR gRNA sequence
  source 1..20: mol_type = other DNA
acgtgaatgtttgtcttctc

SEQ ID NO: 22479 - DNA, 20 bp, synthetic construct
  misc_feature 1..20: note = CRISPR gRNA sequence
  source 1..20: mol_type = other DNA
agatgccactaaggggggag

SEQ ID NO: 22480 - DNA, 20 bp, synthetic construct
  misc_feature 1..20: note = CRISPR gRNA sequence
  source 1..20: mol_type = other DNA
tatcccacgtctctccccca

SEQ ID NO: 22481 - DNA, 20 bp, synthetic construct
  misc_feature 1..20: note = CRISPR gRNA sequence
  source 1..20: mol_type = other DNA
tatcctcactttgcatatga

SEQ ID NO: 22482 - DNA, 20 bp, synthetic construct
  misc_feature 1..20: note = CRISPR gRNA sequence
  source 1..20: mol_type = other DNA
tgtatcatattatgtattaa

SEQ ID NO: 22483 - DNA, 20 bp, synthetic construct
  misc_feature 1..20: note = CRISPR gRNA sequence
  source 1..20: mol_type = other DNA
tatgtattaataaaacaaaa

SEQ ID NO: 22484 - DNA, 20 bp, synthetic construct
  misc_feature 1..20: note = CRISPR gRNA sequence
  source 1..20: mol_type = other DNA
ataaaacaaaagaaaacaag

SEQ ID NO: 22485 - DNA, 20 bp, synthetic construct
  misc_feature 1..20: note = CRISPR gRNA sequence
  source 1..20: mol_type = other DNA
aaaaccagatatatccacac

SEQ ID NO: 22486 - DNA, 20 bp, synthetic construct
  misc_feature 1..20: note = CRISPR gRNA sequence
  source 1..20: mol_type = other DNA
attcaaaatagccaaaatat

SEQ ID NO: 22487 - DNA, 20 bp, synthetic construct
  misc_feature 1..20: note = CRISPR gRNA sequence
  source 1..20: mol_type = other DNA
ttctatttatttgaaatgac

SEQ ID NO: 22488 - DNA, 20 bp, synthetic construct
  misc_feature 1..20: note = CRISPR gRNA sequence
  source 1..20: mol_type = other DNA
ttacatctcaataaagctgt

SEQ ID NO: 22489 - DNA, 20 bp, synthetic construct
  misc_feature 1..20: note = CRISPR gRNA sequence
  source 1..20: mol_type = other DNA
attgaagagtaagctcatga

SEQ ID NO: 22490 - DNA, 20 bp, synthetic construct
  misc_feature 1..20: note = CRISPR gRNA sequence
  source 1..20: mol_type = other DNA
ccctatctctacaaataaca

SEQ ID NO: 22491 - DNA, 20 bp, synthetic construct
  misc_feature 1..20: note = CRISPR gRNA sequence
  source 1..20: mol_type = other DNA
gtgagataccatctcaaaaa

SEQ ID NO: 22492 - DNA, 20 bp, synthetic construct
  misc_feature 1..20: note = CRISPR gRNA sequence
  source 1..20: mol_type = other DNA
accatctcaaaaaaaaaaca

SEQ ID NO: 22493 - DNA, 20 bp, synthetic construct
  misc_feature 1..20: note = CRISPR gRNA sequence
  source 1..20: mol_type = other DNA
caaaaaaaaaacaaaaaaca

SEQ ID NO: 22494 - DNA, 20 bp, synthetic construct
  misc_feature 1..20: note = CRISPR gRNA sequence
  source 1..20: mol_type = other DNA
acttttcccctctaaagctg

SEQ ID NO: 22495 - DNA, 20 bp, synthetic construct
  misc_feature 1..20: note = CRISPR gRNA sequence
  source 1..20: mol_type = other DNA
atgatattttaggagagaga

SEQ ID NO: 22496 - DNA, 20 bp, synthetic construct
  misc_feature 1..20: note = CRISPR gRNA sequence
  source 1..20: mol_type = other DNA
taagatgtaaactccaaaaa

SEQ ID NO: 22497 - DNA, 20 bp, synthetic construct
  misc_feature 1..20: note = CRISPR gRNA sequence
  source 1..20: mol_type = other DNA
aagcaaggcaagtagatcct

SEQ ID NO: 22498 - DNA, 20 bp, synthetic construct
  misc_feature 1..20: note = CRISPR gRNA sequence
  source 1..20: mol_type = other DNA
gaccagcctggccaaggtgg

SEQ ID NO: 22499 - DNA, 20 bp, synthetic construct
  misc_feature 1..20: note = CRISPR gRNA sequence
  source 1..20: mol_type = other DNA
ccccatctctactaaaaata

SEQ ID NO: 22500 - DNA, 20 bp, synthetic construct
  misc_feature 1..20: note = CRISPR gRNA sequence
  source 1..20: mol_type = other DNA
ctaaaaaaaaaaaaaaaagg

SEQ ID NO: 22501 - DNA, 20 bp, synthetic construct
  misc_feature 1..20: note = CRISPR gRNA sequence
  source 1..20: mol_type = other DNA
aatagggacattaatgaaga

SEQ ID NO: 22502 - DNA, 20 bp, synthetic construct
  misc_feature 1..20: note = CRISPR gRNA sequence
  source 1..20: mol_type = other DNA
aacttcagagcaggaaagtg

SEQ ID NO: 22503 - DNA, 20 bp, synthetic construct
  misc_feature 1..20: note = CRISPR gRNA sequence
  source 1..20: mol_type = other DNA
cataacaacttggaaaatct

SEQ ID NO: 22504 - DNA, 20 bp, synthetic construct
  misc_feature 1..20: note = CRISPR gRNA sequence
  source 1..20: mol_type = other DNA
aattacctgggaagggtgtt

SEQ ID NO: 22505 - DNA, 20 bp, synthetic construct
  misc_feature 1..20: note = CRISPR gRNA sequence
  source 1..20: mol_type = other DNA
aggcggtgtctagagtagcc

SEQ ID NO: 22506 - DNA, 20 bp, synthetic construct
  misc_feature 1..20: note = CRISPR gRNA sequence
  source 1..20: mol_type = other DNA
ttaccatgattttacaaaaa

SEQ ID NO: 22507 - DNA, 20 bp, synthetic construct
  misc_feature 1..20: note = CRISPR gRNA sequence
  source 1..20: mol_type = other DNA
tccatgtataaacggaaaag

SEQ ID NO: 22508 - DNA, 20 bp, synthetic construct
  misc_feature 1..20: note = CRISPR gRNA sequence
  source 1..20: mol_type = other DNA
cagaaggattgaaggaatct

SEQ ID NO: 22509 - DNA, 20 bp, synthetic construct
  misc_feature 1..20: note = CRISPR gRNA sequence
  source 1..20: mol_type = other DNA
tgtgcaccaccatgcccggc

SEQ ID NO: 22510 - DNA, 20 bp, synthetic construct
  misc_feature 1..20: note = CRISPR gRNA sequence
  source 1..20: mol_type = other DNA
gcttgctatgtggcgttaag

SEQ ID NO: 22511 - DNA, 20 bp, synthetic construct
  misc_feature 1..20: note = CRISPR gRNA sequence
  source 1..20: mol_type = other DNA
ctatgtggcgttaagcaaaa

SEQ ID NO: 22512 - DNA, 20 bp, synthetic construct
  misc_feature 1..20: note = CRISPR gRNA sequence
  source 1..20: mol_type = other DNA
tggcgttaagcaaaacaaaa

SEQ ID NO: 22513 - DNA, 20 bp, synthetic construct
  misc_feature 1..20: note = CRISPR gRNA sequence
  source 1..20: mol_type = other DNA
tcaggtaccttccatggatg

SEQ ID NO: 22514 - DNA, 20 bp, synthetic construct
  misc_feature 1..20: note = CRISPR gRNA sequence
  source 1..20: mol_type = other DNA
ctgagctgggcatccgaagg

SEQ ID NO: 22515 - DNA, 20 bp, synthetic construct
  misc_feature 1..20: note = CRISPR gRNA sequence
  source 1..20: mol_type = other DNA
tgagctgggcatccgaaggc

SEQ ID NO: 22516 - DNA, 20 bp, synthetic construct
  misc_feature 1..20: note = CRISPR gRNA sequence
  source 1..20: mol_type = other DNA
agctgggcatccgaaggcat

SEQ ID NO: 22517 - DNA, 20 bp, synthetic construct
  misc_feature 1..20: note = CRISPR gRNA sequence
  source 1..20: mol_type = other DNA
ggcatccgaaggcatccttg

SEQ ID NO: 22518 - DNA, 20 bp, synthetic construct
  misc_feature 1..20: note = CRISPR gRNA sequence
  source 1..20: mol_type = other DNA
ggggaagctgagggcacgag

SEQ ID NO: 22519 - DNA, 20 bp, synthetic construct
  misc_feature 1..20: note = CRISPR gRNA sequence
  source 1..20: mol_type = other DNA
gggaagctgagggcacgagg

SEQ ID NO: 22520 - DNA, 20 bp, synthetic construct
  misc_feature 1..20: note = CRISPR gRNA sequence
  source 1..20: mol_type = other DNA
agggcacgaggaggggctgc

SEQ ID NO: 22521 - DNA, 20 bp, synthetic construct
  misc_feature 1..20: note = CRISPR gRNA sequence
  source 1..20: mol_type = other DNA
ccagactccgggagctgctg

SEQ ID NO: 22522 - DNA, 20 bp, synthetic construct
  misc_feature 1..20: note = CRISPR gRNA sequence
  source 1..20: mol_type = other DNA
cgggagctgctgcctggctg

SEQ ID NO: 22523 - DNA, 20 bp, synthetic construct
  misc_feature 1..20: note = CRISPR gRNA sequence
  source 1..20: mol_type = other DNA
ctgcctggctgggattccta

SEQ ID NO: 22524 - DNA, 20 bp, synthetic construct
  misc_feature 1..20: note = CRISPR gRNA sequence
  source 1..20: mol_type = other DNA
cctggctgggattcctacac

SEQ ID NO: 22525 - DNA, 20 bp, synthetic construct
  misc_feature 1..20: note = CRISPR gRNA sequence
  source 1..20: mol_type = other DNA
gctgggattcctacacaatg

SEQ ID NO: 22526 - DNA, 20 bp, synthetic construct
  misc_feature 1..20: note = CRISPR gRNA sequence
  source 1..20: mol_type = other DNA
ggattcctacacaatgcgtt

SEQ ID NO: 22527 - DNA, 20 bp, synthetic construct
  misc_feature 1..20: note = CRISPR gRNA sequence
  source 1..20: mol_type = other DNA
ctacacaatgcgttgcctgg

SEQ ID NO: 22528 - DNA, 20 bp, synthetic construct
  misc_feature 1..20: note = CRISPR gRNA sequence
  source 1..20: mol_type = other DNA
cacaatgcgttgcctggctc

SEQ ID NO: 22529 - DNA, 20 bp, synthetic construct
  misc_feature 1..20: note = CRISPR gRNA sequence
  source 1..20: mol_type = other DNA
cctggctccacgccctgctg

SEQ ID NO: 22530 - DNA, 20 bp, synthetic construct
  misc_feature 1..20: note = CRISPR gRNA sequence
  source 1..20: mol_type = other DNA
gctccacgccctgctgggtc

SEQ ID NO: 22531 - DNA, 20 bp, synthetic construct
  misc_feature 1..20: note = CRISPR gRNA sequence
  source 1..20: mol_type = other DNA
cacgccctgctgggtcctac

SEQ ID NO: 22532 - DNA, 20 bp, synthetic construct
  misc_feature 1..20: note = CRISPR gRNA sequence
  source 1..20: mol_type = other DNA
ctgggtcctacctgtcagag

SEQ ID NO: 22533 - DNA, 20 bp, synthetic construct
  misc_feature 1..20: note = CRISPR gRNA sequence
  source 1..20: mol_type = other DNA
ggtcctacctgtcagagccc

SEQ ID NO: 22534 - DNA, 20 bp, synthetic construct
  misc_feature 1..20: note = CRISPR gRNA sequence
  source 1..20: mol_type = other DNA
cctgtcagagccccaaggta

SEQ ID NO: 22535 - DNA, 20 bp, synthetic construct
  misc_feature 1..20: note = CRISPR gRNA sequence
  source 1..20: mol_type = other DNA
tcagagccccaaggtaaaaa

SEQ ID NO: 22536 - DNA, 20 bp, synthetic construct
  misc_feature 1..20: note = CRISPR gRNA sequence
  source 1..20: mol_type = other DNA
aatttagcgtgcagtctcag

SEQ ID NO: 22537 - DNA, 20 bp, synthetic construct
  misc_feature 1..20: note = CRISPR gRNA sequence
  source 1..20: mol_type = other DNA
atttagcgtgcagtctcagc

SEQ ID NO: 22538 - DNA, 20 bp, synthetic construct
  misc_feature 1..20: note = CRISPR gRNA sequence
  source 1..20: mol_type = other DNA
agcgtgcagtctcagctggt

SEQ ID NO: 22539 - DNA, 20 bp, synthetic construct
  misc_feature 1..20: note = CRISPR gRNA sequence
  source 1..20: mol_type = other DNA
gcgtgcagtctcagctggtc

SEQ ID NO: 22540 - DNA, 20 bp, synthetic construct
  misc_feature 1..20: note = CRISPR gRNA sequence
  source 1..20: mol_type = other DNA
agctggtcctgccattccag

SEQ ID NO: 22541 - DNA, 20 bp, synthetic construct
  misc_feature 1..20: note = CRISPR gRNA sequence
  source 1..20: mol_type = other DNA
gtcctgccattccagataaa

SEQ ID NO: 22542 - DNA, 20 bp, synthetic construct
  misc_feature 1..20: note = CRISPR gRNA sequence
  source 1..20: mol_type = other DNA
ccattccagataaacagaga

SEQ ID NO: 22543 - DNA, 20 bp, synthetic construct
  misc_feature 1..20: note = CRISPR gRNA sequence
  source 1..20: mol_type = other DNA
cagataaacagagaaaccat

SEQ ID NO: 22544 - DNA, 20 bp, synthetic construct
  misc_feature 1..20: note = CRISPR gRNA sequence
  source 1..20: mol_type = other DNA
tgaattggggatgggggtga

SEQ ID NO: 22545 - DNA, 20 bp, synthetic construct
  misc_feature 1..20: note = CRISPR gRNA sequence
  source 1..20: mol_type = other DNA
aattggggatgggggtgagg

SEQ ID NO: 22546 - DNA, 20 bp, synthetic construct
  misc_feature 1..20: note = CRISPR gRNA sequence
  source 1..20: mol_type = other DNA
gggatgggggtgaggatggg

SEQ ID NO: 22547 - DNA, 20 bp, synthetic construct
  misc_feature 1..20: note = CRISPR gRNA sequence
  source 1..20: mol_type = other DNA
tgtcctgctggggcaggcca

SEQ ID NO: 22548 - DNA, 20 bp, synthetic construct
  misc_feature 1..20: note = CRISPR gRNA sequence
  source 1..20: mol_type = other DNA
ctggggcaggccattggaag

SEQ ID NO: 22549 - DNA, 20 bp, synthetic construct
  misc_feature 1..20: note = CRISPR gRNA sequence
  source 1..20: mol_type = other DNA
gggcaggccattggaagatg

SEQ ID NO: 22550 - DNA, 20 bp, synthetic construct
  misc_feature 1..20: note = CRISPR gRNA sequence
  source 1..20: mol_type = other DNA
gaagatgtgaaagagttgtc

SEQ ID NO: 22551 - DNA, 20 bp, synthetic construct
  misc_feature 1..20: note = CRISPR gRNA sequence
  source 1..20: mol_type = other DNA
tctatttccttccaccggag

SEQ ID NO: 22552 - DNA, 20 bp, synthetic construct
  misc_feature 1..20: note = CRISPR gRNA sequence
  source 1..20: mol_type = other DNA
tttccttccaccggagggag

SEQ ID NO: 22553 - DNA, 20 bp, synthetic construct
  misc_feature 1..20: note = CRISPR gRNA sequence
  source 1..20: mol_type = other DNA
ccttccaccggagggagact

SEQ ID NO: 22554 - DNA, 20 bp, synthetic construct
  misc_feature 1..20: note = CRISPR gRNA sequence
  source 1..20: mol_type = other DNA
cttccaccggagggagactt

SEQ ID NO: 22555 - DNA, 20 bp, synthetic construct
  misc_feature 1..20: note = CRISPR gRNA sequence
  source 1..20: mol_type = other DNA
ccaccggagggagacttcag

SEQ ID NO: 22556 - DNA, 20 bp, synthetic construct
  misc_feature 1..20: note = CRISPR gRNA sequence
  source 1..20: mol_type = other DNA
caccggagggagacttcagg

SEQ ID NO: 22557 - DNA, 20 bp, synthetic construct
  misc_feature 1..20: note = CRISPR gRNA sequence
  source 1..20: mol_type = other DNA
caggtcagccaggtgtctgg

SEQ ID NO: 22558 - DNA, 20 bp, synthetic construct
  misc_feature 1..20: note = CRISPR gRNA sequence
  source 1..20: mol_type = other DNA
aggtcagccaggtgtctgga

SEQ ID NO: 22559 - DNA, 20 bp, synthetic construct
  misc_feature 1..20: note = CRISPR gRNA sequence
  source 1..20: mol_type = other DNA
gagtatgaaccatgtatcag

SEQ ID NO: 22560 - DNA, 20 bp, synthetic construct
  misc_feature 1..20: note = CRISPR gRNA sequence
  source 1..20: mol_type = other DNA
tagaagtcagactttcgggc

SEQ ID NO: 22561 - DNA, 20 bp, synthetic construct
  misc_feature 1..20: note = CRISPR gRNA sequence
  source 1..20: mol_type = other DNA
gaagtcagactttcgggcag

SEQ ID NO: 22562 - DNA, 20 bp, synthetic construct
  misc_feature 1..20: note = CRISPR gRNA sequence
  source 1..20: mol_type = other DNA
tcgggcagtgtgtcactaac

SEQ ID NO: 22563 - DNA, 20 bp, synthetic construct
  misc_feature 1..20: note = CRISPR gRNA sequence
  source 1..20: mol_type = other DNA
cgggcagtgtgtcactaact

SEQ ID NO: 22564 - DNA, 20 bp, synthetic construct
  misc_feature 1..20: note = CRISPR gRNA sequence
  source 1..20: mol_type = other DNA
gggcagtgtgtcactaactc

SEQ ID NO: 22565 - DNA, 20 bp, synthetic construct
  misc_feature 1..20: note = CRISPR gRNA sequence
  source 1..20: mol_type = other DNA
actctcagcatgctggcctg

SEQ ID NO: 22566 - DNA, 20 bp, synthetic construct
  misc_feature 1..20: note = CRISPR gRNA sequence
  source 1..20: mol_type = other DNA
tcagcatgctggcctggctc

SEQ ID NO: 22567 - DNA, 20 bp, synthetic construct
  misc_feature 1..20: note = CRISPR gRNA sequence
  source 1..20: mol_type = other DNA
agcatgctggcctggctcgg

SEQ ID NO: 22568 - DNA, 20 bp, synthetic construct
  misc_feature 1..20: note = CRISPR gRNA sequence
  source 1..20: mol_type = other DNA
gcctggctcggcccacagca

SEQ ID NO: 22569 - DNA, 20 bp, synthetic construct
  misc_feature 1..20: note = CRISPR gRNA sequence
  source 1..20: mol_type = other DNA
gctcggcccacagcaaggtc

SEQ ID NO: 22570 - DNA, 20 bp, synthetic construct
  misc_feature 1..20: note = CRISPR gRNA sequence
  source 1..20: mol_type = other DNA
ggcccacagcaaggtcttct

SEQ ID NO: 22571 - DNA, 20 bp, synthetic construct
  misc_feature 1..20: note = CRISPR gRNA sequence
  source 1..20: mol_type = other DNA
ctcgcctccctttgggtaaa

SEQ ID NO: 22572 - DNA, 20 bp, synthetic construct
  misc_feature 1..20: note = CRISPR gRNA sequence
  source 1..20: mol_type = other DNA
tcgcctccctttgggtaaat

SEQ ID NO: 22573 - DNA, 20 bp, synthetic construct
  misc_feature 1..20: note = CRISPR gRNA sequence
  source 1..20: mol_type = other DNA
gcctccctttgggtaaatac

SEQ ID NO: 22574 - DNA, 20 bp, synthetic construct
  misc_feature 1..20: note = CRISPR gRNA sequence
  source 1..20: mol_type = other DNA
cctttgggtaaatactgagg

SEQ ID NO: 22575 - DNA, 20 bp, synthetic construct
  misc_feature 1..20: note = CRISPR gRNA sequence
  source 1..20: mol_type = other DNA
tgggtaaatactgaggggtg

SEQ ID NO: 22576 - DNA, 20 bp, synthetic construct
  misc_feature 1..20: note = CRISPR gRNA sequence
  source 1..20: mol_type = other DNA
gggtaaatactgaggggtgc

SEQ ID NO: 22577 - DNA, 20 bp, synthetic construct
  misc_feature 1..20: note = CRISPR gRNA sequence
  source 1..20: mol_type = other DNA
ggtaaatactgaggggtgcc

SEQ ID NO: 22578 - DNA, 20 bp, synthetic construct
  misc_feature 1..20: note = CRISPR gRNA sequence
  source 1..20: mol_type = other DNA
aggggtgcctctgcaggacg

SEQ ID NO: 22579 - DNA, 20 bp, synthetic construct
  misc_feature 1..20: note = CRISPR gRNA sequence
  source 1..20: mol_type = other DNA
tgcaggacgggacctctgcc

SEQ ID NO: 22580 - DNA, 20 bp, synthetic construct
  misc_feature 1..20: note = CRISPR gRNA sequence
  source 1..20: mol_type = other DNA
caggacgggacctctgccag

SEQ ID NO: 22581 - DNA, 20 bp, synthetic construct
  misc_feature 1..20: note = CRISPR gRNA sequence
  source 1..20: mol_type = other DNA
tgccagactccactccatac

SEQ ID NO: 22582 - DNA, 20 bp, synthetic construct
  misc_feature 1..20: note = CRISPR gRNA sequence
  source 1..20: mol_type = other DNA
ccagactccactccataccc

SEQ ID NO: 22583 - DNA, 20 bp, synthetic construct
  misc_feature 1..20: note = CRISPR gRNA sequence
  source 1..20: mol_type = other DNA
cactccatacccagagaagc

SEQ ID NO: 22584 - DNA, 20 bp, synthetic construct
  misc_feature 1..20: note = CRISPR gRNA sequence
  source 1..20: mol_type = other DNA
catacccagagaagcaggga

SEQ ID NO: 22585 - DNA, 20 bp, synthetic construct
  misc_feature 1..20: note = CRISPR gRNA sequence
  source 1..20: mol_type = other DNA
gagtcagccttgaggtgtag

SEQ ID NO: 22586 - DNA, 20 bp, synthetic construct
  misc_feature 1..20: note = CRISPR gRNA sequence
  source 1..20: mol_type = other DNA
gaggtgtagctgttgagccc

SEQ ID NO: 22587 - DNA, 20 bp, synthetic construct
  misc_feature 1..20: note = CRISPR gRNA sequence
  source 1..20: mol_type = other DNA
aggtgtagctgttgagccct

SEQ ID NO: 22588 - DNA, 20 bp, synthetic construct
  misc_feature 1..20: note = CRISPR gRNA sequence
  source 1..20: mol_type = other DNA
ttgagccctcagcagctggg

SEQ ID NO: 22589 - DNA, 20 bp, synthetic construct
  misc_feature 1..20: note = CRISPR gRNA sequence
  source 1..20: mol_type = other DNA
agccctcagcagctggggag

SEQ ID NO: 22590 - DNA, 20 bp, synthetic construct
  misc_feature 1..20: note = CRISPR gRNA sequence
  source 1..20: mol_type = other DNA
agcagctggggagagctggc

SEQ ID NO: 22591 - DNA, 20 bp, synthetic construct
  misc_feature 1..20: note = CRISPR gRNA sequence
  source 1..20: mol_type = other DNA
gggagagctggcggatgctg

SEQ ID NO: 22592 - DNA, 20 bp, synthetic construct
  misc_feature 1..20: note = CRISPR gRNA sequence
  source 1..20: mol_type = other DNA
gcggatgctgccctcccccc

SEQ ID NO: 22593 - DNA, 20 bp, synthetic construct
  misc_feature 1..20: note = CRISPR gRNA sequence
  source 1..20: mol_type = other DNA
ccctccccccagtttcctaa

SEQ ID NO: 22594 - DNA, 20 bp, synthetic construct
  misc_feature 1..20: note = CRISPR gRNA sequence
  source 1..20: mol_type = other DNA
cccccagtttcctaatggtg

SEQ ID NO: 22595 - DNA, 20 bp, synthetic construct
  misc_feature 1..20: note = CRISPR gRNA sequence
  source 1..20: mol_type = other DNA
cctaatggtgttgtttaaaa

SEQ ID NO: 22596 - DNA, 20 bp, synthetic construct
  misc_feature 1..20: note = CRISPR gRNA sequence
  source 1..20: mol_type = other DNA
ctaatggtgttgtttaaaaa

SEQ ID NO: 22597 - DNA, 20 bp, synthetic construct
  misc_feature 1..20: note = CRISPR gRNA sequence
  source 1..20: mol_type = other DNA
atggtgttgtttaaaaaggg

SEQ ID NO: 22598 - DNA, 20 bp, synthetic construct
  misc_feature 1..20: note = CRISPR gRNA sequence
  source 1..20: mol_type = other DNA
tttaaaaagggtcaggggac

SEQ ID NO: 22599 - DNA, 20 bp, synthetic construct
  misc_feature 1..20: note = CRISPR gRNA sequence
  source 1..20: mol_type = other DNA
aaaaagggtcaggggacggg

SEQ ID NO: 22600 - DNA, 20 bp, synthetic construct
  misc_feature 1..20: note = CRISPR gRNA sequence
  source 1..20: mol_type = other DNA
aaaagggtcaggggacgggg

SEQ ID NO: 22601 - DNA, 20 bp, synthetic construct
  misc_feature 1..20: note = CRISPR gRNA sequence
  source 1..20: mol_type = other DNA
gcaccggctctgaaggcagc

SEQ ID NO: 22602 - DNA, 20 bp, synthetic construct
  misc_feature 1..20: note = CRISPR gRNA sequence
  source 1..20: mol_type = other DNA
tgaaggcagcatggcagcta

SEQ ID NO: 22603 - DNA, 20 bp, synthetic construct
  misc_feature 1..20: note = CRISPR gRNA sequence
  source 1..20: mol_type = other DNA
aaggcagcatggcagctaca

SEQ ID NO: 22604 - DNA, 20 bp, synthetic construct
  misc_feature 1..20: note = CRISPR gRNA sequence
  source 1..20: mol_type = other DNA
caccgttggctgggaagggt

SEQ ID NO: 22605 - DNA, 20 bp, synthetic construct
  misc_feature 1..20: note = CRISPR gRNA sequence
  source 1..20: mol_type = other DNA
gctgggaagggtgtgcccct

SEQ ID NO: 22606 - DNA, 20 bp, synthetic construct
  misc_feature 1..20: note = CRISPR gRNA sequence
  source 1..20: mol_type = other DNA
ggaagggtgtgcccctgaag

SEQ ID NO: 22607 - DNA, 20 bp, synthetic construct
  misc_feature 1..20: note = CRISPR gRNA sequence
  source 1..20: mol_type = other DNA
aagaagtcgtttacattctc

SEQ ID NO: 22608 - DNA, 20 bp, synthetic construct
  misc_feature 1..20: note = CRISPR gRNA sequence
  source 1..20: mol_type = other DNA
acattctcgagtcaattttc

SEQ ID NO: 22609 - DNA, 20 bp, synthetic construct
  misc_feature 1..20: note = CRISPR gRNA sequence
  source 1..20: mol_type = other DNA
cattctcgagtcaattttcc

SEQ ID NO: 22610 - DNA, 20 bp, synthetic construct
  misc_feature 1..20: note = CRISPR gRNA sequence
  source 1..20: mol_type = other DNA
tcgagtcaattttcctggag

SEQ ID NO: 22611 - DNA, 20 bp, synthetic construct
  misc_feature 1..20: note = CRISPR gRNA sequence
  source 1..20: mol_type = other DNA
gagtcaattttcctggagtg

SEQ ID NO: 22612 - DNA, 20 bp, synthetic construct
  misc_feature 1..20: note = CRISPR gRNA sequence
  source 1..20: mol_type = other DNA
tcctggagtgtacaatggac

SEQ ID NO: 22613 - DNA, 20 bp, synthetic construct
  misc_feature 1..20: note = CRISPR gRNA sequence
  source 1..20: mol_type = other DNA
cctggagtgtacaatggacc

SEQ ID NO: 22614 - DNA, 20 bp, synthetic construct
  misc_feature 1..20: note = CRISPR gRNA sequence
  source 1..20: mol_type = other DNA
ctggagtgtacaatggacct

SEQ ID NO: 22615 - DNA, 20 bp, synthetic construct
  misc_feature 1..20: note = CRISPR gRNA sequence
  source 1..20: mol_type = other DNA
gagtgtacaatggacctgtg

SEQ ID NO: 22616 - DNA, 20 bp, synthetic construct
  misc_feature 1..20: note = CRISPR gRNA sequence
  source 1..20: mol_type = other DNA
tgggaaagcctgtatgaaag

SEQ ID NO: 22617 - DNA, 20 bp, synthetic construct
  misc_feature 1..20: note = CRISPR gRNA sequence
  source 1..20: mol_type = other DNA
tatgaaagggtaatgatgag

SEQ ID NO: 22618 - DNA, 20 bp, synthetic construct
  misc_feature 1..20: note = CRISPR gRNA sequence
  source 1..20: mol_type = other DNA
gcacagtgtccaatatttta

SEQ ID NO: 22619 - DNA, 20 bp, synthetic construct
  misc_feature 1..20: note = CRISPR gRNA sequence
  source 1..20: mol_type = other DNA
tataggaactggaattgagc

SEQ ID NO: 22620 - DNA, 20 bp, synthetic construct
  misc_feature 1..20: note = CRISPR gRNA sequence
  source 1..20: mol_type = other DNA
ataggaactggaattgagct

SEQ ID NO: 22621 - DNA, 20 bp, synthetic construct
  misc_feature 1..20: note = CRISPR gRNA sequence
  source 1..20: mol_type = other DNA
taggaactggaattgagctc

SEQ ID NO: 22622 - DNA, 20 bp, synthetic construct
  misc_feature 1..20: note = CRISPR gRNA sequence
  source 1..20: mol_type = other DNA
gaattgagctcataggagct

SEQ ID NO: 22623 - DNA, 20 bp, synthetic construct
  misc_feature 1..20: note = CRISPR gRNA sequence
  source 1..20: mol_type = other DNA
agctcataggagctcaattt

SEQ ID NO: 22624 - DNA, 20 bp, synthetic construct
  misc_feature 1..20: note = CRISPR gRNA sequence
  source 1..20: mol_type = other DNA
ataggagctcaattttattg

SEQ ID NO: 22625 - DNA, 20 bp, synthetic construct
  misc_feature 1..20: note = CRISPR gRNA sequence
  source 1..20: mol_type = other DNA
aattttattggcattgctgt

SEQ ID NO: 22626 - DNA, 20 bp, synthetic construct
  misc_feature 1..20: note = CRISPR gRNA sequence
  source 1..20: mol_type = other DNA
tattggcattgctgttgttg

SEQ ID NO: 22627 - DNA, 20 bp, synthetic construct
  misc_feature 1..20: note = CRISPR gRNA sequence
  source 1..20: mol_type = other DNA
attggcattgctgttgttgg

SEQ ID NO: 22628 - DNA, 20 bp, synthetic construct
  misc_feature 1..20: note = CRISPR gRNA sequence
  source 1..20: mol_type = other DNA
ttggcattgctgttgttgga

SEQ ID NO: 22629 - DNA, 20 bp, synthetic construct
  misc_feature 1..20: note = CRISPR gRNA sequence
  source 1..20: mol_type = other DNA
gcattgctgttgttggatgg

SEQ ID NO: 22630 - DNA, 20 bp, synthetic construct
  misc_feature 1..20: note = CRISPR gRNA sequence
  source 1..20: mol_type = other DNA
ctgttgttggatggttaaag

SEQ ID NO: 22631 - DNA, 20 bp, synthetic construct
  misc_feature 1..20: note = CRISPR gRNA sequence
  source 1..20: mol_type = other DNA
ttgttggatggttaaagggg

SEQ ID NO: 22632 - DNA, 20 bp, synthetic construct
  misc_feature 1..20: note = CRISPR gRNA sequence
  source 1..20: mol_type = other DNA
ttggatggttaaaggggtgg

SEQ ID NO: 22633 - DNA, 20 bp, synthetic construct
  misc_feature 1..20: note = CRISPR gRNA sequence
  source 1..20: mol_type = other DNA
gatggttaaaggggtggtat

SEQ ID NO: 22634 - DNA, 20 bp, synthetic construct
  misc_feature 1..20: note = CRISPR gRNA sequence
  source 1..20: mol_type = other DNA
aaggggtggtatcccttttc

SEQ ID NO: 22635 - DNA, 20 bp, synthetic construct
  misc_feature 1..20: note = CRISPR gRNA sequence
  source 1..20: mol_type = other DNA
ttctcagactcccctgaaat

SEQ ID NO: 22636 - DNA, 20 bp, synthetic construct
  misc_feature 1..20: note = CRISPR gRNA sequence
  source 1..20: mol_type = other DNA
tctcagactcccctgaaatg

SEQ ID NO: 22637 - DNA, 20 bp, synthetic construct
  misc_feature 1..20: note = CRISPR gRNA sequence
  source 1..20: mol_type = other DNA
ctcagactcccctgaaatgt

SEQ ID NO: 22638 - DNA, 20 bp, synthetic construct
  misc_feature 1..20: note = CRISPR gRNA sequence
  source 1..20: mol_type = other DNA
tcagactcccctgaaatgta

SEQ ID NO: 22639 - DNA, 20 bp, synthetic construct
  misc_feature 1..20: note = CRISPR gRNA sequence
  source 1..20: mol_type = other DNA
agactcccctgaaatgtatg

SEQ ID NO: 22640 - DNA, 20 bp, synthetic construct
  misc_feature 1..20: note = CRISPR gRNA sequence
  source 1..20: mol_type = other DNA
ccctgaaatgtatggtttgc

SEQ ID NO: 22641 - DNA, 20 bp, synthetic construct
  misc_feature 1..20: note = CRISPR gRNA sequence
  source 1..20: mol_type = other DNA
aaatgtatggtttgctttga

SEQ ID NO: 22642 - DNA, 20 bp, synthetic construct
  misc_feature 1..20: note = CRISPR gRNA sequence
  source 1..20: mol_type = other DNA
gctttgaacccagagactga

SEQ ID NO: 22643 - DNA, 20 bp, synthetic construct
  misc_feature 1..20: note = CRISPR gRNA sequence
  source 1..20: mol_type = other DNA
ctttgaacccagagactgat

SEQ ID NO: 22644 - DNA, 20 bp, synthetic construct
  misc_feature 1..20: note = CRISPR gRNA sequence
  source 1..20: mol_type = other DNA
tgaacccagagactgatgac

SEQ ID NO: 22645 - DNA, 20 bp, synthetic construct
  misc_feature 1..20: note = CRISPR gRNA sequence
  source 1..20: mol_type = other DNA
gaacccagagactgatgaca

SEQ ID NO: 22646 - DNA, 20 bp, synthetic construct
  misc_feature 1..20: note = CRISPR gRNA sequence
  source 1..20: mol_type = other DNA
aacccagagactgatgacag

SEQ ID NO: 22647 - DNA, 20 bp, synthetic construct
  misc_feature 1..20: note = CRISPR gRNA sequence
  source 1..20: mol_type = other DNA
atgacaggtctgccggtgtg

SEQ ID NO: 22648 - DNA, 20 bp, synthetic construct
  misc_feature 1..20: note = CRISPR gRNA sequence
  source 1..20: mol_type = other DNA
ccggtgtggttgggtgcagc

SEQ ID NO: 22649 - DNA, 20 bp, synthetic construct
  misc_feature 1..20: note = CRISPR gRNA sequence
  source 1..20: mol_type = other DNA
ggtgcagccttaagttgcta

SEQ ID NO: 22650 - DNA, 20 bp, synthetic construct
  misc_feature 1..20: note = CRISPR gRNA sequence
  source 1..20: mol_type = other DNA
aagttgctacgggaaagtgt

SEQ ID NO: 22651 - DNA, 20 bp, synthetic construct
  misc_feature 1..20: note = CRISPR gRNA sequence
  source 1..20: mol_type = other DNA
agttgctacgggaaagtgtt

SEQ ID NO: 22652 - DNA, 20 bp, synthetic construct
  misc_feature 1..20: note = CRISPR gRNA sequence
  source 1..20: mol_type = other DNA
ctacgggaaagtgttggagg

SEQ ID NO: 22653 - DNA, 20 bp, synthetic construct
  misc_feature 1..20: note = CRISPR gRNA sequence
  source 1..20: mol_type = other DNA
cgggaaagtgttggaggggg

SEQ ID NO: 22654 - DNA, 20 bp, synthetic construct
  misc_feature 1..20: note = CRISPR gRNA sequence
  source 1..20: mol_type = other DNA
gagggggagaagtcagaggt

SEQ ID NO: 22655 - DNA, 20 bp, synthetic construct
  misc_feature 1..20: note = CRISPR gRNA sequence
  source 1..20: mol_type = other DNA
gccccctccctcaattccag

SEQ ID NO: 22656 - DNA, 20 bp, synthetic construct
  misc_feature 1..20: note = CRISPR gRNA sequence
  source 1..20: mol_type = other DNA
ccccctccctcaattccaga

SEQ ID NO: 22657 - DNA, 20 bp, synthetic construct
  misc_feature 1..20: note = CRISPR gRNA sequence
  source 1..20: mol_type = other DNA
cctcaattccagatgaggaa

SEQ ID NO: 22658 - DNA, 20 bp, synthetic construct
  misc_feature 1..20: note = CRISPR gRNA sequence
  source 1..20: mol_type = other DNA
aattccagatgaggaaattc

SEQ ID NO: 22659 - DNA, 20 bp, synthetic construct
  misc_feature 1..20: note = CRISPR gRNA sequence
  source 1..20: mol_type = other DNA
cagatgaggaaattcaggcc

SEQ ID NO: 22660 - DNA, 20 bp, synthetic construct
  misc_feature 1..20: note = CRISPR gRNA sequence
  source 1..20: mol_type = other DNA
aggcctgaaaagggaaagtg

SEQ ID NO: 22661 - DNA, 20 bp, synthetic construct
  misc_feature 1..20: note = CRISPR gRNA sequence
  source 1..20: mol_type = other DNA
aaaagggaaagtgaccacct

SEQ ID NO: 22662 - DNA, 20 bp, synthetic construct
  misc_feature 1..20: note = CRISPR gRNA sequence
  source 1..20: mol_type = other DNA
aaagtctcatgccttggagg

SEQ ID NO: 22663 - DNA, 20 bp, synthetic construct
  misc_feature 1..20: note = CRISPR gRNA sequence
  source 1..20: mol_type = other DNA
atgccttggaggacccagca

SEQ ID NO: 22664 - DNA, 20 bp, synthetic construct
  misc_feature 1..20: note = CRISPR gRNA sequence
  source 1..20: mol_type = other DNA
ggaggacccagcaggaatcc

SEQ ID NO: 22665 - DNA, 20 bp, synthetic construct
  misc_feature 1..20: note = CRISPR gRNA sequence
  source 1..20: mol_type = other DNA
gaggacccagcaggaatcca

SEQ ID NO: 22666 - DNA, 20 bp, synthetic construct
  misc_feature 1..20: note = CRISPR gRNA sequence
  source 1..20: mol_type = other DNA
tgaaaaggaccggcagggct

SEQ ID NO: 22667 - DNA, 20 bp, synthetic construct
  misc_feature 1..20: note = CRISPR gRNA sequence
  source 1..20: mol_type = other DNA
aaaaggaccggcagggctct

SEQ ID NO: 22668 - DNA, 20 bp, synthetic construct
  misc_feature 1..20: note = CRISPR gRNA sequence
  source 1..20: mol_type = other DNA
ttgccacggctgggggtgtg

SEQ ID NO: 22669 - DNA, 20 bp, synthetic construct
  misc_feature 1..20: note = CRISPR gRNA sequence
  source 1..20: mol_type = other DNA
gccacggctgggggtgtggt

SEQ ID NO: 22670 - DNA, 20 bp, synthetic construct
  misc_feature 1..20: note = CRISPR gRNA sequence
  source 1..20: mol_type = other DNA
ccacggctgggggtgtggtc

SEQ ID NO: 22671 - DNA, 20 bp, synthetic construct
  misc_feature 1..20: note = CRISPR gRNA sequence
  source 1..20: mol_type = other DNA
ggggtgtggtcatggtaaca

SEQ ID NO: 22672 - DNA, 20 bp, synthetic construct
  misc_feature 1..20: note = CRISPR gRNA sequence
  source 1..20: mol_type = other DNA
tccatccatggaaggtacct

SEQ ID NO: 22673 - DNA, 20 bp, synthetic construct
  misc_feature 1..20: note = CRISPR gRNA sequence
  source 1..20: mol_type = other DNA
ccatccatggaaggtacctg

SEQ ID NO: 22674 - DNA, 20 bp, synthetic construct
  misc_feature 1..20: note = CRISPR gRNA sequence
  source 1..20: mol_type = other DNA
catccatggaaggtacctga

SEQ ID NO: 22675 - DNA, 20 bp, synthetic construct
  misc_feature 1..20: note = CRISPR gRNA sequence
  source 1..20: mol_type = other DNA
agggattttctcttcctccc

SEQ ID NO: 22676 - DNA, 20 bp, synthetic construct
  misc_feature 1..20: note = CRISPR gRNA sequence
  source 1..20: mol_type = other DNA
tctcttcctccctagggcca

SEQ ID NO: 22677 - DNA, 20 bp, synthetic construct
  misc_feature 1..20: note = CRISPR gRNA sequence
  source 1..20: mol_type = other DNA
ctcttcctccctagggccag

SEQ ID NO: 22678 - DNA, 20 bp, synthetic construct
  misc_feature 1..20: note = CRISPR gRNA sequence
  source 1..20: mol_type = other DNA
tcttcctccctagggccagc

SEQ ID NO: 22679 - DNA, 20 bp, synthetic construct
  misc_feature 1..20: note = CRISPR gRNA sequence
  source 1..20: mol_type = other DNA
ttcctccctagggccagcat

SEQ ID NO: 22680 - DNA, 20 bp, synthetic construct
  misc_feature 1..20: note = CRISPR gRNA sequence
  source 1..20: mol_type = other DNA
cctccctagggccagcatca

SEQ ID NO: 22681 - DNA, 20 bp, synthetic construct
  misc_feature 1..20: note = CRISPR gRNA sequence
  source 1..20: mol_type = other DNA
ctccctagggccagcatcag

SEQ ID NO: 22682 - DNA, 20 bp, synthetic construct
  misc_feature 1..20: note = CRISPR gRNA sequence
  source 1..20: mol_type = other DNA
cctagggccagcatcagagg

SEQ ID NO: 22683 - DNA, 20 bp, synthetic construct
  misc_feature 1..20: note = CRISPR gRNA sequence
  source 1..20: mol_type = other DNA
gggccagcatcagaggagtg

SEQ ID NO: 22684 - DNA, 20 bp, synthetic construct
  misc_feature 1..20: note = CRISPR gRNA sequence
  source 1..20: mol_type = other DNA
agttagctcatctcaggggc

SEQ ID NO: 22685 - DNA, 20 bp, synthetic construct
  misc_feature 1..20: note = CRISPR gRNA sequence
  source 1..20: mol_type = other DNA
gctcatctcaggggccatgt

SEQ ID NO: 22686 - DNA, 20 bp, synthetic construct
  misc_feature 1..20: note = CRISPR gRNA sequence
  source 1..20: mol_type = other DNA
atctcaggggccatgtgccc

SEQ ID NO: 22687 - DNA, 20 bp, synthetic construct
  misc_feature 1..20: note = CRISPR gRNA sequence
  source 1..20: mol_type = other DNA
aggggccatgtgccctcgga

SEQ ID NO: 22688 - DNA, 20 bp, synthetic construct
  misc_feature 1..20: note = CRISPR gRNA sequence
  source 1..20: mol_type = other DNA
ggaggtggtttgccactttc

SEQ ID NO: 22689 - DNA, 20 bp, synthetic construct
  misc_feature 1..20: note = CRISPR gRNA sequence
  source 1..20: mol_type = other DNA
gccactttcacggttggact

SEQ ID NO: 22690 - DNA, 20 bp, synthetic construct
  misc_feature 1..20: note = CRISPR gRNA sequence
  source 1..20: mol_type = other DNA
ccactttcacggttggactg

SEQ ID NO: 22691 - DNA, 20 bp, synthetic construct
  misc_feature 1..20: note = CRISPR gRNA sequence
  source 1..20: mol_type = other DNA
tcacggttggactgagttgg

SEQ ID NO: 22692 - DNA, 20 bp, synthetic construct
  misc_feature 1..20: note = CRISPR gRNA sequence
  source 1..20: mol_type = other DNA
cacggttggactgagttgga

SEQ ID NO: 22693 - DNA, 20 bp, synthetic construct
  misc_feature 1..20: note = CRISPR gRNA sequence
  source 1..20: mol_type = other DNA
acggttggactgagttggag

SEQ ID NO: 22694 - DNA, 20 bp, synthetic construct
  misc_feature 1..20: note = CRISPR gRNA sequence
  source 1..20: mol_type = other DNA
gactgagttggagagaaaca

SEQ ID NO: 22695 - DNA, 20 bp, synthetic construct
  misc_feature 1..20: note = CRISPR gRNA sequence
  source 1..20: mol_type = other DNA
agttggagagaaacagagac

SEQ ID NO: 22696 - DNA, 20 bp, synthetic construct
  misc_feature 1..20: note = CRISPR gRNA sequence
  source 1..20: mol_type = other DNA
gagagaaacagagacccacc

SEQ ID NO: 22697 - DNA, 20 bp, synthetic construct
  misc_feature 1..20: note = CRISPR gRNA sequence
  source 1..20: mol_type = other DNA
cctgcaactcaggacttgca

SEQ ID NO: 22698 - DNA, 20 bp, synthetic construct
  misc_feature 1..20: note = CRISPR gRNA sequence
  source 1..20: mol_type = other DNA
caactcaggacttgcagatc

SEQ ID NO: 22699 - DNA, 20 bp, synthetic construct
  misc_feature 1..20: note = CRISPR gRNA sequence
  source 1..20: mol_type = other DNA
aggacttgcagatcacttgc

SEQ ID NO: 22700 - DNA, 20 bp, synthetic construct
  misc_feature 1..20: note = CRISPR gRNA sequence
  source 1..20: mol_type = other DNA
gcagatcacttgcccaagtg

SEQ ID NO: 22701 - DNA, 20 bp, synthetic construct
  misc_feature 1..20: note = CRISPR gRNA sequence
  source 1..20: mol_type = other DNA
cagatcacttgcccaagtgg

SEQ ID NO: 22702 - DNA, 20 bp, synthetic construct
  misc_feature 1..20: note = CRISPR gRNA sequence
  source 1..20: mol_type = other DNA
gcccaagtggctccctagct

SEQ ID NO: 22703 - DNA, 20 bp, synthetic construct
  misc_feature 1..20: note = CRISPR gRNA sequence
  source 1..20: mol_type = other DNA
cccaagtggctccctagctc

SEQ ID NO: 22704 - DNA, 20 bp, synthetic construct
  misc_feature 1..20: note = CRISPR gRNA sequence
  source 1..20: mol_type = other DNA
cctagctcctggctcctggc

SEQ ID NO: 22705 - DNA, 20 bp, synthetic construct
  misc_feature 1..20: note = CRISPR gRNA sequence
  source 1..20: mol_type = other DNA
gctcctggctcctggcccgg

SEQ ID NO: 22706 - DNA, 20 bp, synthetic construct
  misc_feature 1..20: note = CRISPR gRNA sequence
  source 1..20: mol_type = other DNA
ctggctcctggcccggggcc

SEQ ID NO: 22707 - DNA, 20 bp, synthetic construct
  misc_feature 1..20: note = CRISPR gRNA sequence
  source 1..20: mol_type = other DNA
gctcctggcccggggcctgg

SEQ ID NO: 22708 - DNA, 20 bp, synthetic construct
  misc_feature 1..20: note = CRISPR gRNA sequence
  source 1..20: mol_type = other DNA
ctggcccggggcctgggact

SEQ ID NO: 22709 - DNA, 20 bp, synthetic construct
  misc_feature 1..20: note = CRISPR gRNA sequence
  source 1..20: mol_type = other DNA
gcccggggcctgggactctc

SEQ ID NO: 22710 - DNA, 20 bp, synthetic construct
  misc_feature 1..20: note = CRISPR gRNA sequence
  source 1..20: mol_type = other DNA
ggactctccccgaagtgggg

SEQ ID NO: 22711 - DNA, 20 bp, synthetic construct
  misc_feature 1..20: note = CRISPR gRNA sequence
  source 1..20: mol_type = other DNA
tccccgaagtggggctggcc

SEQ ID NO: 22712 - DNA, 20 bp, synthetic construct
  misc_feature 1..20: note = CRISPR gRNA sequence
  source 1..20: mol_type = other DNA
cccgaagtggggctggccac

SEQ ID NO: 22713 - DNA, 20 bp, synthetic construct
  misc_feature 1..20: note = CRISPR gRNA sequence
  source 1..20: mol_type = other DNA
gccactgtgaggaaccgact

SEQ ID NO: 22714 - DNA, 20 bp, synthetic construct
  misc_feature 1..20: note = CRISPR gRNA sequence
  source 1..20: mol_type = other DNA
tgaggaaccgactggaggca

SEQ ID NO: 22715 - DNA, 20 bp, synthetic construct
  misc_feature 1..20: note = CRISPR gRNA sequence
  source 1..20: mol_type = other DNA
gaggcagggacctcttggat

SEQ ID NO: 22716 - DNA, 20 bp, synthetic construct
  misc_feature 1..20: note = CRISPR gRNA sequence
  source 1..20: mol_type = other DNA
ttggatgccccaggcagttg

SEQ ID NO: 22717 - DNA, 20 bp, synthetic construct
  misc_feature 1..20: note = CRISPR gRNA sequence
  source 1..20: mol_type = other DNA
ggatgccccaggcagttggg

SEQ ID NO: 22718 - DNA, 20 bp, synthetic construct
  misc_feature 1..20: note = CRISPR gRNA sequence
  source 1..20: mol_type = other DNA
gatgccccaggcagttggga

SEQ ID NO: 22719 - DNA, 20 bp, synthetic construct
  misc_feature 1..20: note = CRISPR gRNA sequence
  source 1..20: mol_type = other DNA
ggatgccacttctgataaag

SEQ ID NO: 22720 - DNA, 20 bp, synthetic construct
  misc_feature 1..20: note = CRISPR gRNA sequence
  source 1..20: mol_type = other DNA
ctgataaagcacgtggtggc

SEQ ID NO: 22721 - DNA, 20 bp, synthetic construct
  misc_feature 1..20: note = CRISPR gRNA sequence
  source 1..20: mol_type = other DNA
tgataaagcacgtggtggcc

SEQ ID NO: 22722 - DNA, 20 bp, synthetic construct
  misc_feature 1..20: note = CRISPR gRNA sequence
  source 1..20: mol_type = other DNA
ataaagcacgtggtggccac

SEQ ID NO: 22723 - DNA, 20 bp, synthetic construct
  misc_feature 1..20: note = CRISPR gRNA sequence
  source 1..20: mol_type = other DNA
ggttgctccacagcctggcc

SEQ ID NO: 22724 - DNA, 20 bp, synthetic construct
  misc_feature 1..20: note = CRISPR gRNA sequence
  source 1..20: mol_type = other DNA
gttgctccacagcctggccc

SEQ ID NO: 22725 - DNA, 20 bp, synthetic construct
  misc_feature 1..20: note = CRISPR gRNA sequence
  source 1..20: mol_type = other DNA
ctccacagcctggcccgagc

SEQ ID NO: 22726 - DNA, 20 bp, synthetic construct
  misc_feature 1..20: note = CRISPR gRNA sequence
  source 1..20: mol_type = other DNA
cacagcctggcccgagctca

SEQ ID NO: 22727 - DNA, 20 bp, synthetic construct
  misc_feature 1..20: note = CRISPR gRNA sequence
  source 1..20: mol_type = other DNA
gcccgagctcagcgctgcag

SEQ ID NO: 22728 - DNA, 20 bp, synthetic construct
  misc_feature 1..20: note = CRISPR gRNA sequence
  source 1..20: mol_type = other DNA
agcgctgcagaaagaaagtg

SEQ ID NO: 22729 - DNA, 20 bp, synthetic construct
  misc_feature 1..20: note = CRISPR gRNA sequence
  source 1..20: mol_type = other DNA
cagaaagaaagtgaaaggga

SEQ ID NO: 22730 - DNA, 20 bp, synthetic construct
  misc_feature 1..20: note = CRISPR gRNA sequence
  source 1..20: mol_type = other DNA
cggggaggcggggaggtagg

SEQ ID NO: 22731 - DNA, 20 bp, synthetic construct
  misc_feature 1..20: note = CRISPR gRNA sequence
  source 1..20: mol_type = other DNA
ccacagacttgccgcggccc

SEQ ID NO: 22732 - DNA, 20 bp, synthetic construct
  misc_feature 1..20: note = CRISPR gRNA sequence
  source 1..20: mol_type = other DNA
gccgcggccccagagctggc

SEQ ID NO: 22733 - DNA, 20 bp, synthetic construct
  misc_feature 1..20: note = CRISPR gRNA sequence
  source 1..20: mol_type = other DNA
ccgcggccccagagctggcg

SEQ ID NO: 22734 - DNA, 20 bp, synthetic construct
  misc_feature 1..20: note = CRISPR gRNA sequence
  source 1..20: mol_type = other DNA
gcgggagggagaggccacca

SEQ ID NO: 22735 - DNA, 20 bp, synthetic construct
  misc_feature 1..20: note = CRISPR gRNA sequence
  source 1..20: mol_type = other DNA
ctctgtaacccctaaggtcg

SEQ ID NO: 22736 - DNA, 20 bp, synthetic construct
  misc_feature 1..20: note = CRISPR gRNA sequence
  source 1..20: mol_type = other DNA
tgtaacccctaaggtcgggc

SEQ ID NO: 22737 - DNA, 20 bp, synthetic construct
  misc_feature 1..20: note = CRISPR gRNA sequence
  source 1..20: mol_type = other DNA
taacccctaaggtcgggctg

SEQ ID NO: 22738 - DNA, 20 bp, synthetic construct
  misc_feature 1..20: note = CRISPR gRNA sequence
  source 1..20: mol_type = other DNA
aggtcgggctgagaatcgag

SEQ ID NO: 22739 - DNA, 20 bp, synthetic construct
  misc_feature 1..20: note = CRISPR gRNA sequence
  source 1..20: mol_type = other DNA
agaatcgaggctccgagact

SEQ ID NO: 22740 - DNA, 20 bp, synthetic construct
  misc_feature 1..20: note = CRISPR gRNA sequence
  source 1..20: mol_type = other DNA
cgagactgtcagctacttgc

SEQ ID NO: 22741 - DNA, 20 bp, synthetic construct
  misc_feature 1..20: note = CRISPR gRNA sequence
  source 1..20: mol_type = other DNA
tcagctacttgctcaaggtc

SEQ ID NO: 22742 - DNA, 20 bp, synthetic construct
  misc_feature 1..20: note = CRISPR gRNA sequence
  source 1..20: mol_type = other DNA
cttgctcaaggtcacacagc

SEQ ID NO: 22743 - DNA, 20 bp, synthetic construct
  misc_feature 1..20: note = CRISPR gRNA sequence
  source 1..20: mol_type = other DNA
gctcaaggtcacacagcaag

SEQ ID NO: 22744 - DNA, 20 bp, synthetic construct
  misc_feature 1..20: note = CRISPR gRNA sequence
  source 1..20: mol_type = other DNA
ctcaaggtcacacagcaagt

SEQ ID NO: 22745 - DNA, 20 bp, synthetic construct
  misc_feature 1..20: note = CRISPR gRNA sequence
  source 1..20: mol_type = other DNA
aaggtcacacagcaagtctg

SEQ ID NO: 22746 - DNA, 20 bp, synthetic construct
  misc_feature 1..20: note = CRISPR gRNA sequence
  source 1..20: mol_type = other DNA
ggaggatggggggatggaat

SEQ ID NO: 22747 - DNA, 20 bp, synthetic construct
  misc_feature 1..20: note = CRISPR gRNA sequence
  source 1..20: mol_type = other DNA
gtttccagcatccccgcaac

SEQ ID NO: 22748 - DNA, 20 bp, synthetic construct
  misc_feature 1..20: note = CRISPR gRNA sequence
  source 1..20: mol_type = other DNA
ccagcatccccgcaacgact

SEQ ID NO: 22749 - DNA, 20 bp, synthetic construct
  misc_feature 1..20: note = CRISPR gRNA sequence
  source 1..20: mol_type = other DNA
cagcatccccgcaacgactc

SEQ ID NO: 22750 - DNA, 20 bp, synthetic construct
  misc_feature 1..20: note = CRISPR gRNA sequence
  source 1..20: mol_type = other DNA
tgcgcgggaaccaggagccg

SEQ ID NO: 22751 - DNA, 20 bp, synthetic construct
  misc_feature 1..20: note = CRISPR gRNA sequence
  source 1..20: mol_type = other DNA
cgcgggaaccaggagccggg

SEQ ID NO: 22752 - DNA, 20 bp, synthetic construct
  misc_feature 1..20: note = CRISPR gRNA sequence
  source 1..20: mol_type = other DNA
ggcttgctgtgcccagagct

SEQ ID NO: 22753 - DNA, 20 bp, synthetic construct
  misc_feature 1..20: note = CRISPR gRNA sequence
  source 1..20: mol_type = other DNA
gcttgctgtgcccagagctc

SEQ ID NO: 22754 - DNA, 20 bp, synthetic construct
  misc_feature 1..20: note = CRISPR gRNA sequence
  source 1..20: mol_type = other DNA
gctgtgcccagagctccggg

SEQ ID NO: 22755 - DNA, 20 bp, synthetic construct
  misc_feature 1..20: note = CRISPR gRNA sequence
  source 1..20: mol_type = other DNA
ctgtgcccagagctccgggg

SEQ ID NO: 22756 - DNA, 20 bp, synthetic construct
  misc_feature 1..20: note = CRISPR gRNA sequence
  source 1..20: mol_type = other DNA
tgcccagagctccggggccg

SEQ ID NO: 22757 - DNA, 20 bp, synthetic construct
  misc_feature 1..20: note = CRISPR gRNA sequence
  source 1..20: mol_type = other DNA
cggggccgtgggcgggtggc

SEQ ID NO: 22758 - DNA, 20 bp, synthetic construct
  misc_feature 1..20: note = CRISPR gRNA sequence
  source 1..20: mol_type = other DNA
gcggcagcttctgcagagaa

SEQ ID NO: 22759 - DNA, 20 bp, synthetic construct
  misc_feature 1..20: note = CRISPR gRNA sequence
  source 1..20: mol_type = other DNA
ctgcagagaagccggagcgc

SEQ ID NO: 22760 - DNA, 20 bp, synthetic construct
  misc_feature 1..20: note = CRISPR gRNA sequence
  source 1..20: mol_type = other DNA
tgcagagaagccggagcgca

SEQ ID NO: 22761 - DNA, 20 bp, synthetic construct
  misc_feature 1..20: note = CRISPR gRNA sequence
  source 1..20: mol_type = other DNA
cagagaagccggagcgcaga

SEQ ID NO: 22762 - DNA, 20 bp, synthetic construct
  misc_feature 1..20: note = CRISPR gRNA sequence
  source 1..20: mol_type = other DNA
ggagcgcggagcagacacac

SEQ ID NO: 22763 - DNA, 20 bp, synthetic construct
  misc_feature 1..20: note = CRISPR gRNA sequence
  source 1..20: mol_type = other DNA
ccccggccacccttggccga

SEQ ID NO: 22764 - DNA, 20 bp, synthetic construct
  misc_feature 1..20: note = CRISPR gRNA sequence
  source 1..20: mol_type = other DNA
ggccgactccgcgcgcccgg

SEQ ID NO: 22765 - DNA, 20 bp, synthetic construct
  misc_feature 1..20: note = CRISPR gRNA sequence
  source 1..20: mol_type = other DNA
gccgactccgcgcgcccggg

SEQ ID NO: 22766 - DNA, 20 bp, synthetic construct
  misc_feature 1..20: note = CRISPR gRNA sequence
  source 1..20: mol_type = other DNA
cgcgcgcccgggatcctgca

SEQ ID NO: 22767 - DNA, 20 bp, synthetic construct
  misc_feature 1..20: note = CRISPR gRNA sequence
  source 1..20: mol_type = other DNA
cagaggtgcgcgcccttctt

SEQ ID NO: 22768 - DNA, 20 bp, synthetic construct
  misc_feature 1..20: note = CRISPR gRNA sequence
  source 1..20: mol_type = other DNA
cttgtacgccagactttgga

SEQ ID NO: 22769 - DNA, 20 bp, synthetic construct
  misc_feature 1..20: note = CRISPR gRNA sequence
  source 1..20: mol_type = other DNA
ttgtacgccagactttggac

SEQ ID NO: 22770 - DNA, 20 bp, synthetic construct
  misc_feature 1..20: note = CRISPR gRNA sequence
  source 1..20: mol_type = other DNA
gtacgccagactttggacca

SEQ ID NO: 22771 - DNA, 20 bp, synthetic construct
  misc_feature 1..20: note = CRISPR gRNA sequence
  source 1..20: mol_type = other DNA
tacgccagactttggaccag

SEQ ID NO: 22772 - DNA, 20 bp, synthetic construct
  misc_feature 1..20: note = CRISPR gRNA sequence
  source 1..20: mol_type = other DNA
tggaccagggccgccgttcc

SEQ ID NO: 22773 - DNA, 20 bp, synthetic construct
  misc_feature 1..20: note = CRISPR gRNA sequence
  source 1..20: mol_type = other DNA
ggaccagggccgccgttccc

SEQ ID NO: 22774 - DNA, 20 bp, synthetic construct
  misc_feature 1..20: note = CRISPR gRNA sequence
  source 1..20: mol_type = other DNA
gaccagggccgccgttccct

SEQ ID NO: 22775 - DNA, 20 bp, synthetic construct
  misc_feature 1..20: note = CRISPR gRNA sequence
  source 1..20: mol_type = other DNA
cctgagcttcactttccctg

SEQ ID NO: 22776 - DNA, 20 bp, synthetic construct
  misc_feature 1..20: note = CRISPR gRNA sequence
  source 1..20: mol_type = other DNA
agcttcactttccctgttgg

SEQ ID NO: 22777 - DNA, 20 bp, synthetic construct
  misc_feature 1..20: note = CRISPR gRNA sequence
  source 1..20: mol_type = other DNA
cactttccctgttgggtcat

SEQ ID NO: 22778 - DNA, 20 bp, synthetic construct
  misc_feature 1..20: note = CRISPR gRNA sequence
  source 1..20: mol_type = other DNA
actttccctgttgggtcata

SEQ ID NO: 22779 - DNA, 20 bp, synthetic construct
  misc_feature 1..20: note = CRISPR gRNA sequence
  source 1..20: mol_type = other DNA
tccctgttgggtcatattcc

SEQ ID NO: 22780 - DNA, 20 bp, synthetic construct
  misc_feature 1..20: note = CRISPR gRNA sequence
  source 1..20: mol_type = other DNA
ccctgttgggtcatattcca

SEQ ID NO: 22781 - DNA, 20 bp, synthetic construct
  misc_feature 1..20: note = CRISPR gRNA sequence
  source 1..20: mol_type = other DNA
cctgttgggtcatattccat

SEQ ID NO: 22782 - DNA, 20 bp, synthetic construct
  misc_feature 1..20: note = CRISPR gRNA sequence
  source 1..20: mol_type = other DNA
ttgggtcatattccatctct

SEQ ID NO: 22783 - DNA, 20 bp, synthetic construct
  misc_feature 1..20: note = CRISPR gRNA sequence
  source 1..20: mol_type = other DNA
ggtcatattccatctctaac

SEQ ID NO: 22784 - DNA, 20 bp, synthetic construct
  misc_feature 1..20: note = CRISPR gRNA sequence
  source 1..20: mol_type = other DNA
catctctaactctggaatct

SEQ ID NO: 22785 - DNA, 20 bp, synthetic construct
  misc_feature 1..20: note = CRISPR gRNA sequence
  source 1..20: mol_type = other DNA
taactctggaatcttgggta

SEQ ID NO: 22786 - DNA, 20 bp, synthetic construct
  misc_feature 1..20: note = CRISPR gRNA sequence
  source 1..20: mol_type = other DNA
actctggaatcttgggtatt

SEQ ID NO: 22787 - DNA, 20 bp, synthetic construct
  misc_feature 1..20: note = CRISPR gRNA sequence
  source 1..20: mol_type = other DNA
tggaatcttgggtattgggc

SEQ ID NO: 22788 - DNA, 20 bp, synthetic construct
  misc_feature 1..20: note = CRISPR gRNA sequence
  source 1..20: mol_type = other DNA
gaatcttgggtattgggctc

SEQ ID NO: 22789 - DNA, 20 bp, synthetic construct
  misc_feature 1..20: note = CRISPR gRNA sequence
  source 1..20: mol_type = other DNA
gggtattgggctctccaggc

SEQ ID NO: 22790 - DNA, 20 bp, synthetic construct
  misc_feature 1..20: note = CRISPR gRNA sequence
  source 1..20: mol_type = other DNA
ggtattgggctctccaggcg

SEQ ID NO: 22791 - DNA, 20 bp, synthetic construct
  misc_feature 1..20: note = CRISPR gRNA sequence
  source 1..20: mol_type = other DNA
ggctctccaggcggggggcc

SEQ ID NO: 22792 - DNA, 20 bp, synthetic construct
  misc_feature 1..20: note = CRISPR gRNA sequence
  source 1..20: mol_type = other DNA
tccaggcggggggccctgct

SEQ ID NO: 22793 - DNA, 20 bp, synthetic construct
  misc_feature 1..20: note = CRISPR gRNA sequence
  source 1..20: mol_type = other DNA
caggcggggggccctgctca

SEQ ID NO: 22794 - DNA, 20 bp, synthetic construct
  misc_feature 1..20: note = CRISPR gRNA sequence
  source 1..20: mol_type = other DNA
ctcagggaggcagtagggag

SEQ ID NO: 22795 - DNA, 20 bp, synthetic construct
  misc_feature 1..20: note = CRISPR gRNA sequence
  source 1..20: mol_type = other DNA
agggaggcagtagggagcca

SEQ ID NO: 22796 - DNA, 20 bp, synthetic construct
  misc_feature 1..20: note = CRISPR gRNA sequence
  source 1..20: mol_type = other DNA
taaccagaggatgggataag

SEQ ID NO: 22797 - DNA, 20 bp, synthetic construct
  misc_feature 1..20: note = CRISPR gRNA sequence
  source 1..20: mol_type = other DNA
aaccagaggatgggataagt

SEQ ID NO: 22798 - DNA, 20 bp, synthetic construct
  misc_feature 1..20: note = CRISPR gRNA sequence
  source 1..20: mol_type = other DNA
accagaggatgggataagtc

SEQ ID NO: 22799 - DNA, 20 bp, synthetic construct
  misc_feature 1..20: note = CRISPR gRNA sequence
  source 1..20: mol_type = other DNA
aactctcgttgaacatcttg

SEQ ID NO: 22800 - DNA, 20 bp, synthetic construct
  misc_feature 1..20: note = CRISPR gRNA sequence
  source 1..20: mol_type = other DNA
tcgttgaacatcttggcgaa

SEQ ID NO: 22801 - DNA, 20 bp, synthetic construct
  misc_feature 1..20: note = CRISPR gRNA sequence
  source 1..20: mol_type = other DNA
gttgaacatcttggcgaagg

SEQ ID NO: 22802 - DNA, 20 bp, synthetic construct
  misc_feature 1..20: note = CRISPR gRNA sequence
  source 1..20: mol_type = other DNA
aacatcttggcgaaggtgtg

SEQ ID NO: 22803 - DNA, 20 bp, synthetic construct
  misc_feature 1..20: note = CRISPR gRNA sequence
  source 1..20: mol_type = other DNA
ggcgaaggtgtgtgttgttg

SEQ ID NO: 22804 - DNA, 20 bp, synthetic construct
  misc_feature 1..20: note = CRISPR gRNA sequence
  source 1..20: mol_type = other DNA
gcgaaggtgtgtgttgttgg

SEQ ID NO: 22805 - DNA, 20 bp, synthetic construct
  misc_feature 1..20: note = CRISPR gRNA sequence
  source 1..20: mol_type = other DNA
ttgggaggggtgggggaggg

SEQ ID NO: 22806 - DNA, 20 bp, synthetic construct
  misc_feature 1..20: note = CRISPR gRNA sequence
  source 1..20: mol_type = other DNA
ggaggggtgggggagggatc

SEQ ID NO: 22807 - DNA, 20 bp, synthetic construct
  misc_feature 1..20: note = CRISPR gRNA sequence
  source 1..20: mol_type = other DNA
aaccgatctcttgatctctc

SEQ ID NO: 22808 - DNA, 20 bp, synthetic construct
  misc_feature 1..20: note = CRISPR gRNA sequence
  source 1..20: mol_type = other DNA
ttgatctctcacttctctac

SEQ ID NO: 22809 - DNA, 20 bp, synthetic construct
  misc_feature 1..20: note = CRISPR gRNA sequence
  source 1..20: mol_type = other DNA
gatctctcacttctctacct

SEQ ID NO: 22810 - DNA, 20 bp, synthetic construct
  misc_feature 1..20: note = CRISPR gRNA sequence
  source 1..20: mol_type = other DNA
atctctcacttctctacctc

SEQ ID NO: 22811 - DNA, 20 bp, synthetic construct
  misc_feature 1..20: note = CRISPR gRNA sequence
  source 1..20: mol_type = other DNA
tcacttctctacctcgcttt

SEQ ID NO: 22812 - DNA, 20 bp, synthetic construct
  misc_feature 1..20: note = CRISPR gRNA sequence
  source 1..20: mol_type = other DNA
acttctctacctcgctttgg

SEQ ID NO: 22813 - DNA, 20 bp, synthetic construct
  misc_feature 1..20: note = CRISPR gRNA sequence
  source 1..20: mol_type = other DNA
ctctacctcgctttggggcc

SEQ ID NO: 22814 - DNA, 20 bp, synthetic construct
  misc_feature 1..20: note = CRISPR gRNA sequence
  source 1..20: mol_type = other DNA
tctacctcgctttggggccc

SEQ ID NO: 22815 - DNA, 20 bp, synthetic construct
  misc_feature 1..20: note = CRISPR gRNA sequence
  source 1..20: mol_type = other DNA
tacctcgctttggggccctg

SEQ ID NO: 22816 - DNA, 20 bp, synthetic construct
  misc_feature 1..20: note = CRISPR gRNA sequence
  source 1..20: mol_type = other DNA
cctcgctttggggccctgag

SEQ ID NO: 22817 - DNA, 20 bp, synthetic construct
  misc_feature 1..20: note = CRISPR gRNA sequence
  source 1..20: mol_type = other DNA
gctttggggccctgagtcac

SEQ ID NO: 22818 - DNA, 20 bp, synthetic construct
  misc_feature 1..20: note = CRISPR gRNA sequence
  source 1..20: mol_type = other DNA
tggggccctgagtcacaccc

SEQ ID NO: 22819 - DNA, 20 bp, synthetic construct
  misc_feature 1..20: note = CRISPR gRNA sequence
  source 1..20: mol_type = other DNA
ggggccctgagtcacaccct

SEQ ID NO: 22820 - DNA, 20 bp, synthetic construct
  misc_feature 1..20: note = CRISPR gRNA sequence
  source 1..20: mol_type = other DNA
gggccctgagtcacaccctc

SEQ ID NO: 22821 - DNA, 20 bp, synthetic construct
  misc_feature 1..20: note = CRISPR gRNA sequence
  source 1..20: mol_type = other DNA
agtcacaccctctaaggaga

SEQ ID NO: 22822 - DNA, 20 bp, synthetic construct
  misc_feature 1..20: note = CRISPR gRNA sequence
  source 1..20: mol_type = other DNA
taaggagagaggctaaagcg

SEQ ID NO: 22823 - DNA, 20 bp, synthetic construct
  misc_feature 1..20: note = CRISPR gRNA sequence
  source 1..20: mol_type = other DNA
aggagagaggctaaagcgcc

SEQ ID NO: 22824 - DNA, 20 bp, synthetic construct
  misc_feature 1..20: note = CRISPR gRNA sequence
  source 1..20: mol_type = other DNA
aagcgccccggaaagccagc

SEQ ID NO: 22825 - DNA, 20 bp, synthetic construct
  misc_feature 1..20: note = CRISPR gRNA sequence
  source 1..20: mol_type = other DNA
gatctccctggggtccagga

SEQ ID NO: 22826 - DNA, 20 bp, synthetic construct
  misc_feature 1..20: note = CRISPR gRNA sequence
  source 1..20: mol_type = other DNA
cctggggtccaggaaagccg

SEQ ID NO: 22827 - DNA, 20 bp, synthetic construct
  misc_feature 1..20: note = CRISPR gRNA sequence
  source 1..20: mol_type = other DNA
gggtccaggaaagccggaat

SEQ ID NO: 22828 - DNA, 20 bp, synthetic construct
  misc_feature 1..20: note = CRISPR gRNA sequence
  source 1..20: mol_type = other DNA
agcttagtctggaactctta

SEQ ID NO: 22829 - DNA, 20 bp, synthetic construct
  misc_feature 1..20: note = CRISPR gRNA sequence
  source 1..20: mol_type = other DNA
gcttagtctggaactcttaa

SEQ ID NO: 22830 - DNA, 20 bp, synthetic construct
  misc_feature 1..20: note = CRISPR gRNA sequence
  source 1..20: mol_type = other DNA
agtctggaactcttaaaagc

SEQ ID NO: 22831 - DNA, 20 bp, synthetic construct
  misc_feature 1..20: note = CRISPR gRNA sequence
  source 1..20: mol_type = other DNA
gtctggaactcttaaaagcc

SEQ ID NO: 22832 - DNA, 20 bp, synthetic construct
  misc_feature 1..20: note = CRISPR gRNA sequence
  source 1..20: mol_type = other DNA
gaactcttaaaagccgcggt

SEQ ID NO: 22833 - DNA, 20 bp, synthetic construct
  misc_feature 1..20: note = CRISPR gRNA sequence
  source 1..20: mol_type = other DNA
ttaaaagccgcggtcctcct

SEQ ID NO: 22834 - DNA, 20 bp, synthetic construct
  misc_feature 1..20: note = CRISPR gRNA sequence
  source 1..20: mol_type = other DNA
aaaagccgcggtcctcctga

SEQ ID NO: 22835 - DNA, 20 bp, synthetic construct
  misc_feature 1..20: note = CRISPR gRNA sequence
  source 1..20: mol_type = other DNA
aaagccgcggtcctcctgag

SEQ ID NO: 22836 - DNA, 20 bp, synthetic construct
  misc_feature 1..20: note = CRISPR gRNA sequence
  source 1..20: mol_type = other DNA
ctgagtcccacagcccctct

SEQ ID NO: 22837 - DNA, 20 bp, synthetic construct
  misc_feature 1..20: note = CRISPR gRNA sequence
  source 1..20: mol_type = other DNA
agtcccacagcccctctcca

SEQ ID NO: 22838 - DNA, 20 bp, synthetic construct
  misc_feature 1..20: note = CRISPR gRNA sequence
  source 1..20: mol_type = other DNA
tccaccctaggtggcacagg

SEQ ID NO: 22839 - DNA, 20 bp, synthetic construct
  misc_feature 1..20: note = CRISPR gRNA sequence
  source 1..20: mol_type = other DNA
caccctaggtggcacaggag

SEQ ID NO: 22840 - DNA, 20 bp, synthetic construct
  misc_feature 1..20: note = CRISPR gRNA sequence
  source 1..20: mol_type = other DNA
ggtggcacaggagaggtggc

SEQ ID NO: 22841 - DNA, 20 bp, synthetic construct
  misc_feature 1..20: note = CRISPR gRNA sequence
  source 1..20: mol_type = other DNA
gaagttcaaggcatggctcc

SEQ ID NO: 22842 - DNA, 20 bp, synthetic construct
  misc_feature 1..20: note = CRISPR gRNA sequence
  source 1..20: mol_type = other DNA
aaggcatggctccctcccca

SEQ ID NO: 22843 - DNA, 20 bp, synthetic construct
  misc_feature 1..20: note = CRISPR gRNA sequence
  source 1..20: mol_type = other DNA
cctccccagccgcagcctgg

SEQ ID NO: 22844 - DNA, 20 bp, synthetic construct
  misc_feature 1..20: note = CRISPR gRNA sequence
  source 1..20: mol_type = other DNA
cccagccgcagcctggagtg

SEQ ID NO: 22845 - DNA, 20 bp, synthetic construct
  misc_feature 1..20: note = CRISPR gRNA sequence
  source 1..20: mol_type = other DNA
gagtgtctaactttggcagg

SEQ ID NO: 22846 - DNA, 20 bp, synthetic construct
  misc_feature 1..20: note = CRISPR gRNA sequence
  source 1..20: mol_type = other DNA
actttggcaggaagtcttcc

SEQ ID NO: 22847 - DNA, 20 bp, synthetic construct
  misc_feature 1..20: note = CRISPR gRNA sequence
  source 1..20: mol_type = other DNA
tggcaggaagtcttccgttt

SEQ ID NO: 22848 - DNA, 20 bp, synthetic construct
  misc_feature 1..20: note = CRISPR gRNA sequence
  source 1..20: mol_type = other DNA
ggcaggaagtcttccgtttc

SEQ ID NO: 22849 - DNA, 20 bp, synthetic construct
  misc_feature 1..20: note = CRISPR gRNA sequence
  source 1..20: mol_type = other DNA
gcaggaagtcttccgtttct

SEQ ID NO: 22850 - DNA, 20 bp, synthetic construct
  misc_feature 1..20: note = CRISPR gRNA sequence
  source 1..20: mol_type = other DNA
ccgtttctgctccccactcc

SEQ ID NO: 22851 - DNA, 20 bp, synthetic construct
  misc_feature 1..20: note = CRISPR gRNA sequence
  source 1..20: mol_type = other DNA
cgtttctgctccccactcca

SEQ ID NO: 22852 - DNA, 20 bp, synthetic construct
  misc_feature 1..20: note = CRISPR gRNA sequence
  source 1..20: mol_type = other DNA
ctgctccccactccagagaa

SEQ ID NO: 22853 - DNA, 20 bp, synthetic construct
  misc_feature 1..20: note = CRISPR gRNA sequence
  source 1..20: mol_type = other DNA
tgctccccactccagagaaa

SEQ ID NO: 22854 - DNA, 20 bp, synthetic construct
  misc_feature 1..20: note = CRISPR gRNA sequence
  source 1..20: mol_type = other DNA
ctccccactccagagaaaaa

SEQ ID NO: 22855 - DNA, 20 bp, synthetic construct
  misc_feature 1..20: note = CRISPR gRNA sequence
  source 1..20: mol_type = other DNA
cccactccagagaaaaaata

SEQ ID NO: 22856 - DNA, 20 bp, synthetic construct
  misc_feature 1..20: note = CRISPR gRNA sequence
  source 1..20: mol_type = other DNA
cagagaaaaaataaataaat

SEQ ID NO: 22857 - DNA, 20 bp, synthetic construct
  misc_feature 1..20: note = CRISPR gRNA sequence
  source 1..20: mol_type = other DNA
ctccggagtgagattaagga

SEQ ID NO: 22858 - DNA, 20 bp, synthetic construct
  misc_feature 1..20: note = CRISPR gRNA sequence
  source 1..20: mol_type = other DNA
tccggagtgagattaaggaa

SEQ ID NO: 22859 - DNA, 20 bp, synthetic construct
  misc_feature 1..20: note = CRISPR gRNA sequence
  source 1..20: mol_type = other DNA
cggagtgagattaaggaaac

SEQ ID NO: 22860 - DNA, 20 bp, synthetic construct
  misc_feature 1..20: note = CRISPR gRNA sequence
  source 1..20: mol_type = other DNA
aggaaacaggtacttcttcc

SEQ ID NO: 22861 - DNA, 20 bp, synthetic construct
  misc_feature 1..20: note = CRISPR gRNA sequence
  source 1..20: mol_type = other DNA
cttcctcttggagaaagagg

SEQ ID NO: 22862 - DNA, 20 bp, synthetic construct
  misc_feature 1..20: note = CRISPR gRNA sequence
  source 1..20: mol_type = other DNA
ttcctcttggagaaagagga

SEQ ID NO: 22863 - DNA, 20 bp, synthetic construct
  misc_feature 1..20: note = CRISPR gRNA sequence
  source 1..20: mol_type = other DNA
cctcttggagaaagaggagc

SEQ ID NO: 22864 - DNA, 20 bp, synthetic construct
  misc_feature 1..20: note = CRISPR gRNA sequence
  source 1..20: mol_type = other DNA
ctcttggagaaagaggagcc

SEQ ID NO: 22865 - DNA, 20 bp, synthetic construct
  misc_feature 1..20: note = CRISPR gRNA sequence
  source 1..20: mol_type = other DNA
ttggagaaagaggagccaaa

SEQ ID NO: 22866 - DNA, 20 bp, synthetic construct
  misc_feature 1..20: note = CRISPR gRNA sequence
  source 1..20: mol_type = other DNA
ggagaaagaggagccaaagg

SEQ ID NO: 22867 - DNA, 20 bp, synthetic construct
  misc_feature 1..20: note = CRISPR gRNA sequence
  source 1..20: mol_type = other DNA
gagaaagaggagccaaagga

SEQ ID NO: 22868 - DNA, 20 bp, synthetic construct
  misc_feature 1..20: note = CRISPR gRNA sequence
  source 1..20: mol_type = other DNA
gactccaacaaatgatcacc

SEQ ID NO: 22869 - DNA, 20 bp, synthetic construct
  misc_feature 1..20: note = CRISPR gRNA sequence
  source 1..20: mol_type = other DNA
actccaacaaatgatcacct

SEQ ID NO: 22870 - DNA, 20 bp, synthetic construct
  misc_feature 1..20: note = CRISPR gRNA sequence
  source 1..20: mol_type = other DNA
caacaaatgatcaccttgca

SEQ ID NO: 22871 - DNA, 20 bp, synthetic construct
  misc_feature 1..20: note = CRISPR gRNA sequence
  source 1..20: mol_type = other DNA
gcaaacccccggctccctta

SEQ ID NO: 22872 - DNA, 20 bp, synthetic construct
  misc_feature 1..20: note = CRISPR gRNA sequence
  source 1..20: mol_type = other DNA
caaacccccggctcccttag

SEQ ID NO: 22873 - DNA, 20 bp, synthetic construct
  misc_feature 1..20: note = CRISPR gRNA sequence
  source 1..20: mol_type = other DNA
ccttaggggatgacctggtc

SEQ ID NO: 22874 - DNA, 20 bp, synthetic construct
  misc_feature 1..20: note = CRISPR gRNA sequence
  source 1..20: mol_type = other DNA
aggggatgacctggtctcca

SEQ ID NO: 22875 - DNA, 20 bp, synthetic construct
  misc_feature 1..20: note = CRISPR gRNA sequence
  source 1..20: mol_type = other DNA
ggggatgacctggtctccaa

SEQ ID NO: 22876 - DNA, 20 bp, synthetic construct
  misc_feature 1..20: note = CRISPR gRNA sequence
  source 1..20: mol_type = other DNA
gtctccaacaatctcagagc

SEQ ID NO: 22877 - DNA, 20 bp, synthetic construct
  misc_feature 1..20: note = CRISPR gRNA sequence
  source 1..20: mol_type = other DNA
caacaatctcagagcgtttg

SEQ ID NO: 22878 - DNA, 20 bp, synthetic construct
  misc_feature 1..20: note = CRISPR gRNA sequence
  source 1..20: mol_type = other DNA
agagcgtttggaggcagggt

SEQ ID NO: 22879 - DNA, 20 bp, synthetic construct
  misc_feature 1..20: note = CRISPR gRNA sequence
  source 1..20: mol_type = other DNA
ggaggcagggtctttggaga

SEQ ID NO: 22880 - DNA, 20 bp, synthetic construct
  misc_feature 1..20: note = CRISPR gRNA sequence
  source 1..20: mol_type = other DNA
gaggcagggtctttggagat

SEQ ID NO: 22881 - DNA, 20 bp, synthetic construct
  misc_feature 1..20: note = CRISPR gRNA sequence
  source 1..20: mol_type = other DNA
tggagatgactgagtgggga

SEQ ID NO: 22882 - DNA, 20 bp, synthetic construct
  misc_feature 1..20: note = CRISPR gRNA sequence
  source 1..20: mol_type = other DNA
ggagatgactgagtggggaa

SEQ ID NO: 22883 - DNA, 20 bp, synthetic construct
  misc_feature 1..20: note = CRISPR gRNA sequence
  source 1..20: mol_type = other DNA
gagatgactgagtggggaat

SEQ ID NO: 22884 - DNA, 20 bp, synthetic construct
  misc_feature 1..20: note = CRISPR gRNA sequence
  source 1..20: mol_type = other DNA
agtggggaatcccaggctcc

SEQ ID NO: 22885 - DNA, 20 bp, synthetic construct
  misc_feature 1..20: note = CRISPR gRNA sequence
  source 1..20: mol_type = other DNA
cccacacatgaacatcacct

SEQ ID NO: 22886 - DNA, 20 bp, synthetic construct
  misc_feature 1..20: note = CRISPR gRNA sequence
  source 1..20: mol_type = other DNA
ggatgatcaacctgttcagg

SEQ ID NO: 22887 - DNA, 20 bp, synthetic construct
  misc_feature 1..20: note = CRISPR gRNA sequence
  source 1..20: mol_type = other DNA
ttcaggatgtaggttcccgg

SEQ ID NO: 22888 - DNA, 20 bp, synthetic construct
  misc_feature 1..20: note = CRISPR gRNA sequence
  source 1..20: mol_type = other DNA
aggatgtaggttcccgggct

SEQ ID NO: 22889 - DNA, 20 bp, synthetic construct
  misc_feature 1..20: note = CRISPR gRNA sequence
  source 1..20: mol_type = other DNA
ccgggctcacccccaggccc

SEQ ID NO: 22890 - DNA, 20 bp, synthetic construct
  misc_feature 1..20: note = CRISPR gRNA sequence
  source 1..20: mol_type = other DNA
acccccaggcccggttggct

SEQ ID NO: 22891 - DNA, 20 bp, synthetic construct
  misc_feature 1..20: note = CRISPR gRNA sequence
  source 1..20: mol_type = other DNA
gctaggcctggggtgaggct

SEQ ID NO: 22892 - DNA, 20 bp, synthetic construct
  misc_feature 1..20: note = CRISPR gRNA sequence
  source 1..20: mol_type = other DNA
ggcctggggtgaggctgaga

SEQ ID NO: 22893 - DNA, 20 bp, synthetic construct
  misc_feature 1..20: note = CRISPR gRNA sequence
  source 1..20: mol_type = other DNA
gggtgaggctgagatcctgc

SEQ ID NO: 22894 - DNA, 20 bp, synthetic construct
  misc_feature 1..20: note = CRISPR gRNA sequence
  source 1..20: mol_type = other DNA
agatcctgcaggttaaacca

SEQ ID NO: 22895 - DNA, 20 bp, synthetic construct
  misc_feature 1..20: note = CRISPR gRNA sequence
  source 1..20: mol_type = other DNA
caggttaaaccatctatccc

SEQ ID NO: 22896 - DNA, 20 bp, synthetic construct
  misc_feature 1..20: note = CRISPR gRNA sequence
  source 1..20: mol_type = other DNA
aaccatctatcccaggtgac

SEQ ID NO: 22897 - DNA, 20 bp, synthetic construct
  misc_feature 1..20: note = CRISPR gRNA sequence
  source 1..20: mol_type = other DNA
tcccaggtgactccaatgtt

SEQ ID NO: 22898 - DNA, 20 bp, synthetic construct
  misc_feature 1..20: note = CRISPR gRNA sequence
  source 1..20: mol_type = other DNA
caatgttcgtttgtggggca

SEQ ID NO: 22899 - DNA, 20 bp, synthetic construct
  misc_feature 1..20: note = CRISPR gRNA sequence
  source 1..20: mol_type = other DNA
gtttgtggggcaaaagtccc

SEQ ID NO: 22900 - DNA, 20 bp, synthetic construct
  misc_feature 1..20: note = CRISPR gRNA sequence
  source 1..20: mol_type = other DNA
gtggggcaaaagtccctcaa

SEQ ID NO: 22901 - DNA, 20 bp, synthetic construct
  misc_feature 1..20: note = CRISPR gRNA sequence
  source 1..20: mol_type = other DNA
tggggcaaaagtccctcaag

SEQ ID NO: 22902 - DNA, 20 bp, synthetic construct
  misc_feature 1..20: note = CRISPR gRNA sequence
  source 1..20: mol_type = other DNA
aagtcagagacactgggagg

SEQ ID NO: 22903 - DNA, 20 bp, synthetic construct
  misc_feature 1..20: note = CRISPR gRNA sequence
  source 1..20: mol_type = other DNA
ggaggcgctgatgtggtctc

SEQ ID NO: 22904 - DNA, 20 bp, synthetic construct
  misc_feature 1..20: note = CRISPR gRNA sequence
  source 1..20: mol_type = other DNA
atgtggtctcatctctttac

SEQ ID NO: 22905 - DNA, 20 bp, synthetic construct
  misc_feature 1..20: note = CRISPR gRNA sequence
  source 1..20: mol_type = other DNA
atctctttactctctccctg

SEQ ID NO: 22906 - DNA, 20 bp, synthetic construct
  misc_feature 1..20: note = CRISPR gRNA sequence
  source 1..20: mol_type = other DNA
tttactctctccctgttaca

SEQ ID NO: 22907 - DNA, 20 bp, synthetic construct
  misc_feature 1..20: note = CRISPR gRNA sequence
  source 1..20: mol_type = other DNA
tactctctccctgttacaaa

SEQ ID NO: 22908 - DNA, 20 bp, synthetic construct
  misc_feature 1..20: note = CRISPR gRNA sequence
  source 1..20: mol_type = other DNA
actctctccctgttacaaaa

SEQ ID NO: 22909 - DNA, 20 bp, synthetic construct
  misc_feature 1..20: note = CRISPR gRNA sequence
  source 1..20: mol_type = other DNA
ctctctccctgttacaaaac

SEQ ID NO: 22910 - DNA, 20 bp, synthetic construct
  misc_feature 1..20: note = CRISPR gRNA sequence
  source 1..20: mol_type = other DNA
tctccctgttacaaaacctc

SEQ ID NO: 22911 - DNA, 20 bp, synthetic construct
  misc_feature 1..20: note = CRISPR gRNA sequence
  source 1..20: mol_type = other DNA
tccctgttacaaaacctcta

SEQ ID NO: 22912 - DNA, 20 bp, synthetic construct
  misc_feature 1..20: note = CRISPR gRNA sequence
  source 1..20: mol_type = other DNA
cctgttacaaaacctctatc

SEQ ID NO: 22913 - DNA, 20 bp, synthetic construct
  misc_feature 1..20: note = CRISPR gRNA sequence
  source 1..20: mol_type = other DNA
ttacaaaacctctatcagaa

SEQ ID NO: 22914 - DNA, 20 bp, synthetic construct
  misc_feature 1..20: note = CRISPR gRNA sequence
  source 1..20: mol_type = other DNA
caaaacctctatcagaaaag

SEQ ID NO: 22915 - DNA, 20 bp, synthetic construct
  misc_feature 1..20: note = CRISPR gRNA sequence
  source 1..20: mol_type = other DNA
tatcagaaaaggagtaccag

SEQ ID NO: 22916 - DNA, 20 bp, synthetic construct
  misc_feature 1..20: note = CRISPR gRNA sequence
  source 1..20: mol_type = other DNA
tcagaaaaggagtaccagga

SEQ ID NO: 22917 - DNA, 20 bp, synthetic construct
  misc_feature 1..20: note = CRISPR gRNA sequence
  source 1..20: mol_type = other DNA
tgttttgttttgcttaacgc

SEQ ID NO: 22918 - DNA, 20 bp, synthetic construct
  misc_feature 1..20: note = CRISPR gRNA sequence
  source 1..20: mol_type = other DNA
gttttgttttgcttaacgcc

SEQ ID NO: 22919 - DNA, 20 bp, synthetic construct
  misc_feature 1..20: note = CRISPR gRNA sequence
  source 1..20: mol_type = other DNA
ttttgttttgcttaacgcca

SEQ ID NO: 22920 - DNA, 20 bp, synthetic construct
  misc_feature 1..20: note = CRISPR gRNA sequence
  source 1..20: mol_type = other DNA
tgttttgcttaacgccacat

SEQ ID NO: 22921 - DNA, 20 bp, synthetic construct
  misc_feature 1..20: note = CRISPR gRNA sequence
  source 1..20: mol_type = other DNA
gttttgcttaacgccacata

SEQ ID NO: 22922 - DNA, 20 bp, synthetic construct
  misc_feature 1..20: note = CRISPR gRNA sequence
  source 1..20: mol_type = other DNA
ttttgcttaacgccacatag

SEQ ID NO: 22923 - DNA, 20 bp, synthetic construct
  misc_feature 1..20: note = CRISPR gRNA sequence
  source 1..20: mol_type = other DNA
tgcttaacgccacatagcaa

SEQ ID NO: 22924 - DNA, 20 bp, synthetic construct
  misc_feature 1..20: note = CRISPR gRNA sequence
  source 1..20: mol_type = other DNA
gcttaacgccacatagcaag

SEQ ID NO: 22925 - DNA, 20 bp, synthetic construct
  misc_feature 1..20: note = CRISPR gRNA sequence
  source 1..20: mol_type = other DNA
cttaacgccacatagcaagc

SEQ ID NO: 22926 - DNA, 20 bp, synthetic construct
  misc_feature 1..20: note = CRISPR gRNA sequence
  source 1..20: mol_type = other DNA
aacgccacatagcaagcagt

SEQ ID NO: 22927 - DNA, 20 bp, synthetic construct
  misc_feature 1..20: note = CRISPR gRNA sequence
  source 1..20: mol_type = other DNA
acgccacatagcaagcagtt

SEQ ID NO: 22928 - DNA, 20 bp, synthetic construct
  misc_feature 1..20: note = CRISPR gRNA sequence
  source 1..20: mol_type = other DNA
gcagacgcaggatttgaacc

SEQ ID NO: 22929 - DNA, 20 bp, synthetic construct
  misc_feature 1..20: note = CRISPR gRNA sequence
  source 1..20: mol_type = other DNA
cagacgcaggatttgaaccc

SEQ ID NO: 22930 - DNA, 20 bp, synthetic construct
  misc_feature 1..20: note = CRISPR gRNA sequence
  source 1..20: mol_type = other DNA
gaaccctggtctactgagag

SEQ ID NO: 22931 - DNA, 20 bp, synthetic construct
  misc_feature 1..20: note = CRISPR gRNA sequence
  source 1..20: mol_type = other DNA
aaccctggtctactgagagc

SEQ ID NO: 22932 - DNA, 20 bp, synthetic construct
  misc_feature 1..20: note = CRISPR gRNA sequence
  source 1..20: mol_type = other DNA
gtctactgagagcccagccc

SEQ ID NO: 22933 - DNA, 20 bp, synthetic construct
  misc_feature 1..20: note = CRISPR gRNA sequence
  source 1..20: mol_type = other DNA
ctgagagcccagcccagtgc

SEQ ID NO: 22934 - DNA, 20 bp, synthetic construct
  misc_feature 1..20: note = CRISPR gRNA sequence
  source 1..20: mol_type = other DNA
agagcccagcccagtgcagc

SEQ ID NO: 22935 - DNA, 20 bp, synthetic construct
  misc_feature 1..20: note = CRISPR gRNA sequence
  source 1..20: mol_type = other DNA
cacaaatgcagggcaggtcc

SEQ ID NO: 22936 - DNA, 20 bp, synthetic construct
  misc_feature 1..20: note = CRISPR gRNA sequence
  source 1..20: mol_type = other DNA
ttgatacccagtctgtctga

SEQ ID NO: 22937 - DNA, 20 bp, synthetic construct
  misc_feature 1..20: note = CRISPR gRNA sequence
  source 1..20: mol_type = other DNA
atacccagtctgtctgatgg

SEQ ID NO: 22938 - DNA, 20 bp, synthetic construct
  misc_feature 1..20: note = CRISPR gRNA sequence
  source 1..20: mol_type = other DNA
tctgatggctggggcttggt

SEQ ID NO: 22939 - DNA, 20 bp, synthetic construct
  misc_feature 1..20: note = CRISPR gRNA sequence
  source 1..20: mol_type = other DNA
atggctggggcttggtttca

SEQ ID NO: 22940 - DNA, 20 bp, synthetic construct
  misc_feature 1..20: note = CRISPR gRNA sequence
  source 1..20: mol_type = other DNA
gggcttggtttcatgtccta

SEQ ID NO: 22941 - DNA, 20 bp, synthetic construct
  misc_feature 1..20: note = CRISPR gRNA sequence
  source 1..20: mol_type = other DNA
ggtttcatgtcctaagaccc

SEQ ID NO: 22942 - DNA, 20 bp, synthetic construct
  misc_feature 1..20: note = CRISPR gRNA sequence
  source 1..20: mol_type = other DNA
gtttcatgtcctaagaccca

SEQ ID NO: 22943 - DNA, 20 bp, synthetic construct
  misc_feature 1..20: note = CRISPR gRNA sequence
  source 1..20: mol_type = other DNA
catgtcctaagacccagcct

SEQ ID NO: 22944 - DNA, 20 bp, synthetic construct
  misc_feature 1..20: note = CRISPR gRNA sequence
  source 1..20: mol_type = other DNA
atgtcctaagacccagcctc

SEQ ID NO: 22945 - DNA, 20 bp, synthetic construct
  misc_feature 1..20: note = CRISPR gRNA sequence
  source 1..20: mol_type = other DNA
agacccagcctcagatacct

SEQ ID NO: 22946 - DNA, 20 bp, synthetic construct
  misc_feature 1..20: note = CRISPR gRNA sequence
  source 1..20: mol_type = other DNA
agataccttgagaagagcag

SEQ ID NO: 22947 - DNA, 20 bp, synthetic construct
  misc_feature 1..20: note = CRISPR gRNA sequence
  source 1..20: mol_type = other DNA
gagaagagcagaatcagaaa

SEQ ID NO: 22948 - DNA, 20 bp, synthetic construct
  misc_feature 1..20: note = CRISPR gRNA sequence
  source 1..20: mol_type = other DNA
agaagagcagaatcagaaat

SEQ ID NO: 22949 - DNA, 20 bp, synthetic construct
  misc_feature 1..20: note = CRISPR gRNA sequence
  source 1..20: mol_type = other DNA
acccaaggaaactctggatt

SEQ ID NO: 22950 - DNA, 20 bp, synthetic construct
  misc_feature 1..20: note = CRISPR gRNA sequence
  source 1..20: mol_type = other DNA
tggattagttccaggcaatc

SEQ ID NO: 22951 - DNA, 20 bp, synthetic construct
  misc_feature 1..20: note = CRISPR gRNA sequence
  source 1..20: mol_type = other DNA
gattagttccaggcaatcag

SEQ ID NO: 22952 - DNA, 20 bp, synthetic construct
  misc_feature 1..20: note = CRISPR gRNA sequence
  source 1..20: mol_type = other DNA
gttccaggcaatcagggaag

SEQ ID NO: 22953 - DNA, 20 bp, synthetic construct
  misc_feature 1..20: note = CRISPR gRNA sequence
  source 1..20: mol_type = other DNA
caggcaatcagggaagtggc

SEQ ID NO: 22954 - DNA, 20 bp, synthetic construct
  misc_feature 1..20: note = CRISPR gRNA sequence
  source 1..20: mol_type = other DNA
gagggaggtaggaaacttct

SEQ ID NO: 22955 - DNA, 20 bp, synthetic construct
  misc_feature 1..20: note = CRISPR gRNA sequence
  source 1..20: mol_type = other DNA
ctggacttagcctcagattt

SEQ ID NO: 22956 - DNA, 20 bp, synthetic construct
  misc_feature 1..20: note = CRISPR gRNA sequence
  source 1..20: mol_type = other DNA
tggacttagcctcagatttg

SEQ ID NO: 22957 - DNA, 20 bp, synthetic construct
  misc_feature 1..20: note = CRISPR gRNA sequence
  source 1..20: mol_type = other DNA
gacttagcctcagatttgcc

SEQ ID NO: 22958 - DNA, 20 bp, synthetic construct
  misc_feature 1..20: note = CRISPR gRNA sequence
  source 1..20: mol_type = other DNA
agcctcagatttgccttgag

SEQ ID NO: 22959 - DNA, 20 bp, synthetic construct
  misc_feature 1..20: note = CRISPR gRNA sequence
  source 1..20: mol_type = other DNA
gcctcagatttgccttgagt

SEQ ID NO: 22960 - DNA, 20 bp, synthetic construct
  misc_feature 1..20: note = CRISPR gRNA sequence
  source 1..20: mol_type = other DNA
agatttgccttgagtcacac

SEQ ID NO: 22961 - DNA, 20 bp, synthetic construct
  misc_feature 1..20: note = CRISPR gRNA sequence
  source 1..20: mol_type = other DNA
gccttgagtcacactgacaa

SEQ ID NO: 22962 - DNA, 20 bp, synthetic construct
  misc_feature 1..20: note = CRISPR gRNA sequence
  source 1..20: mol_type = other DNA
ccttgagtcacactgacaag

SEQ ID NO: 22963 - DNA, 20 bp, synthetic construct
  misc_feature 1..20: note = CRISPR gRNA sequence
  source 1..20: mol_type = other DNA
gagtcacactgacaagtgac

SEQ ID NO: 22964 - DNA, 20 bp, synthetic construct
  misc_feature 1..20: note = CRISPR gRNA sequence
  source 1..20: mol_type = other DNA
agtcacactgacaagtgact

SEQ ID NO: 22965 - DNA, 20 bp, synthetic construct
  misc_feature 1..20: note = CRISPR gRNA sequence
  source 1..20: mol_type = other DNA
acaagtgacttcccctctct

SEQ ID NO: 22966 - DNA, 20 bp, synthetic construct
  misc_feature 1..20: note = CRISPR gRNA sequence
  source 1..20: mol_type = other DNA
cccctctctgaggttcatct

SEQ ID NO: 22967 - DNA, 20 bp, synthetic construct
  misc_feature 1..20: note = CRISPR gRNA sequence
  source 1..20: mol_type = other DNA
ccctctctgaggttcatctg

SEQ ID NO: 22968 - DNA, 20 bp, synthetic construct
  misc_feature 1..20: note = CRISPR gRNA sequence
  source 1..20: mol_type = other DNA
tctgaggttcatctgtaaaa

SEQ ID NO: 22969 - DNA, 20 bp, synthetic construct
  misc_feature 1..20: note = CRISPR gRNA sequence
  source 1..20: mol_type = other DNA
tgaggttcatctgtaaaatg

SEQ ID NO: 22970 - DNA, 20 bp, synthetic construct
  misc_feature 1..20: note = CRISPR gRNA sequence
  source 1..20: mol_type = other DNA
aggttcatctgtaaaatgga

SEQ ID NO: 22971 - DNA, 20 bp, synthetic construct
  misc_feature 1..20: note = CRISPR gRNA sequence
  source 1..20: mol_type = other DNA
atctgtaaaatggataaaac

SEQ ID NO: 22972 - DNA, 20 bp, synthetic construct
  misc_feature 1..20: note = CRISPR gRNA sequence
  source 1..20: mol_type = other DNA
taaaatggataaaacatgag

SEQ ID NO: 22973 - DNA, 20 bp, synthetic construct
  misc_feature 1..20: note = CRISPR gRNA sequence
  source 1..20: mol_type = other DNA
gcttgatgatgtctgatgtg

SEQ ID NO: 22974 - DNA, 20 bp, synthetic construct
  misc_feature 1..20: note = CRISPR gRNA sequence
  source 1..20: mol_type = other DNA
cttgatgatgtctgatgtgt

SEQ ID NO: 22975 - DNA, 20 bp, synthetic construct
  misc_feature 1..20: note = CRISPR gRNA sequence
  source 1..20: mol_type = other DNA
gatgatgtctgatgtgtaca

SEQ ID NO: 22976 - DNA, 20 bp, synthetic construct
  misc_feature 1..20: note = CRISPR gRNA sequence
  source 1..20: mol_type = other DNA
atgatgtctgatgtgtacag

SEQ ID NO: 22977 - DNA, 20 bp, synthetic construct
  misc_feature 1..20: note = CRISPR gRNA sequence
  source 1..20: mol_type = other DNA
atgtgtacagaaaaagcact

SEQ ID NO: 22978 - DNA, 20 bp, synthetic construct
  misc_feature 1..20: note = CRISPR gRNA sequence
  source 1..20: mol_type = other DNA
tagaaaaccaccaaagaata

SEQ ID NO: 22979 - DNA, 20 bp, synthetic construct
  misc_feature 1..20: note = CRISPR gRNA sequence
  source 1..20: mol_type = other DNA
agaaaaccaccaaagaatat

SEQ ID NO: 22980 - DNA, 20 bp, synthetic construct
  misc_feature 1..20: note = CRISPR gRNA sequence
  source 1..20: mol_type = other DNA
gaaaaccaccaaagaatatt

SEQ ID NO: 22981 - DNA, 20 bp, synthetic construct
  misc_feature 1..20: note = CRISPR gRNA sequence
  source 1..20: mol_type = other DNA
atgcattgggaataattatt

SEQ ID NO: 22982 - DNA, 20 bp, synthetic construct
  misc_feature 1..20: note = CRISPR gRNA sequence
  source 1..20: mol_type = other DNA
ggaataattattatagatcc

SEQ ID NO: 22983 - DNA, 20 bp, synthetic construct
  misc_feature 1..20: note = CRISPR gRNA sequence
  source 1..20: mol_type = other DNA
ttatagatcctaaagggatt

SEQ ID NO: 22984 - DNA, 20 bp, synthetic construct
  misc_feature 1..20: note = CRISPR gRNA sequence
  source 1..20: mol_type = other DNA
tagatcctaaagggattgtt

SEQ ID NO: 22985 - DNA, 20 bp, synthetic construct
  misc_feature 1..20: note = CRISPR gRNA sequence
  source 1..20: mol_type = other DNA
aagggattgtttagaaagat

SEQ ID NO: 22986 - DNA, 20 bp, synthetic construct
  misc_feature 1..20: note = CRISPR gRNA sequence
  source 1..20: mol_type = other DNA
tttagaaagatcagagaggg

SEQ ID NO: 22987 - DNA, 20 bp, synthetic construct
  misc_feature 1..20: note = CRISPR gRNA sequence
  source 1..20: mol_type = other DNA
agaaagatcagagaggggcc

SEQ ID NO: 22988 - DNA, 20 bp, synthetic construct
  misc_feature 1..20: note = CRISPR gRNA sequence
  source 1..20: mol_type = other DNA
gaaagatcagagaggggccg

SEQ ID NO: 22989 - DNA, 20 bp, synthetic construct
  misc_feature 1..20: note = CRISPR gRNA sequence
  source 1..20: mol_type = other DNA
acacctgtaatcctagcact

SEQ ID NO: 22990 - DNA, 20 bp, synthetic construct
  misc_feature 1..20: note = CRISPR gRNA sequence
  source 1..20: mol_type = other DNA
taatcctagcactttgggag

SEQ ID NO: 22991 - DNA, 20 bp, synthetic construct
  misc_feature 1..20: note = CRISPR gRNA sequence
  source 1..20: mol_type = other DNA
gcactttgggaggccgaggc

SEQ ID NO: 22992 - DNA, 20 bp, synthetic construct
  misc_feature 1..20: note = CRISPR gRNA sequence
  source 1..20: mol_type = other DNA
tgggaggccgaggcgggtgg

SEQ ID NO: 22993 - DNA, 20 bp, synthetic construct
  misc_feature 1..20: note = CRISPR gRNA sequence
  source 1..20: mol_type = other DNA
gggaggccgaggcgggtgga

SEQ ID NO: 22994 - DNA, 20 bp, synthetic construct
  misc_feature 1..20: note = CRISPR gRNA sequence
  source 1..20: mol_type = other DNA
ggaggccgaggcgggtggat

SEQ ID NO: 22995 - DNA, 20 bp, synthetic construct
  misc_feature 1..20: note = CRISPR gRNA sequence
  source 1..20: mol_type = other DNA
cttgaggccaggagttcaag

SEQ ID NO: 22996 - DNA, 20 bp, synthetic construct
  misc_feature 1..20: note = CRISPR gRNA sequence
  source 1..20: mol_type = other DNA
gaggccaggagttcaagacc

SEQ ID NO: 22997 - DNA, 20 bp, synthetic construct
  misc_feature 1..20: note = CRISPR gRNA sequence
  source 1..20: mol_type = other DNA
aggccaggagttcaagacca

SEQ ID NO: 22998 - DNA, 20 bp, synthetic construct
  misc_feature 1..20: note = CRISPR gRNA sequence
  source 1..20: mol_type = other DNA
aagaccagcctgggcaacct

SEQ ID NO: 22999 - DNA, 20 bp, synthetic construct
  misc_feature 1..20: note = CRISPR gRNA sequence
  source 1..20: mol_type = other DNA
ggcaacctggagaaacccca

SEQ ID NO: 23000 - DNA, 20 bp, synthetic construct
  misc_feature 1..20: note = CRISPR gRNA sequence
  source 1..20: mol_type = other DNA
gagaaaccccaactctacta

SEQ ID NO: 23001 - DNA, 20 bp, synthetic construct
  misc_feature 1..20: note = CRISPR gRNA sequence
  source 1..20: mol_type = other DNA
tactaaaacacttttttgtg

SEQ ID NO: 23002 - DNA, 20 bp, synthetic construct
  misc_feature 1..20: note = CRISPR gRNA sequence
  source 1..20: mol_type = other DNA
ctaaaacacttttttgtgtt

SEQ ID NO: 23003 - DNA, 20 bp, synthetic construct
  misc_feature 1..20: note = CRISPR gRNA sequence
  source 1..20: mol_type = other DNA
aaacacttttttgtgtttta

SEQ ID NO: 23004 - DNA, 20 bp, synthetic construct
  misc_feature 1..20: note = CRISPR gRNA sequence
  source 1..20: mol_type = other DNA
ttttgtgttttagccgggca

SEQ ID NO: 23005 - DNA, 20 bp, synthetic construct
  misc_feature 1..20: note = CRISPR gRNA sequence
  source 1..20: mol_type = other DNA
tttgtgttttagccgggcat

SEQ ID NO: 23006 - DNA, 20 bp, synthetic construct
  misc_feature 1..20: note = CRISPR gRNA sequence
  source 1..20: mol_type = other DNA
ttgtgttttagccgggcatg

SEQ ID NO: 23007 - DNA, 20 bp, synthetic construct
  misc_feature 1..20: note = CRISPR gRNA sequence
  source 1..20: mol_type = other DNA
tgtgttttagccgggcatgg

SEQ ID NO: 23008 - DNA, 20 bp, synthetic construct
  misc_feature 1..20: note = CRISPR gRNA sequence
  source 1..20: mol_type = other DNA
gtgttttagccgggcatggt

SEQ ID NO: 23009 - DNA, 20 bp, synthetic construct
  misc_feature 1..20: note = CRISPR gRNA sequence
  source 1..20: mol_type = other DNA
tgttttagccgggcatggtg

SEQ ID NO: 23010 - DNA, 20 bp, synthetic construct
  misc_feature 1..20: note = CRISPR gRNA sequence
  source 1..20: mol_type = other DNA
tagccgggcatggtggtgca

SEQ ID NO: 23011 - DNA, 20 bp, synthetic construct
  misc_feature 1..20: note = CRISPR gRNA sequence
  source 1..20: mol_type = other DNA
agccgggcatggtggtgcac

SEQ ID NO: 23012 - DNA, 20 bp, synthetic construct
  misc_feature 1..20: note = CRISPR gRNA sequence
  source 1..20: mol_type = other DNA
gccgggcatggtggtgcaca

SEQ ID NO: 23013 - DNA, 20 bp, synthetic construct
  misc_feature 1..20: note = CRISPR gRNA sequence
  source 1..20: mol_type = other DNA
taatctcaactacttgggag

SEQ ID NO: 23014 - DNA, 20 bp, synthetic construct
  misc_feature 1..20: note = CRISPR gRNA sequence
  source 1..20: mol_type = other DNA
aactacttgggaggctgagg

SEQ ID NO: 23015 - DNA, 20 bp, synthetic construct
  misc_feature 1..20: note = CRISPR gRNA sequence
  source 1..20: mol_type = other DNA
cttgggaggctgaggcacga

SEQ ID NO: 23016 - DNA, 20 bp, synthetic construct
  misc_feature 1..20: note = CRISPR gRNA sequence
  source 1..20: mol_type = other DNA
gggaggctgaggcacgagaa

SEQ ID NO: 23017 - DNA, 20 bp, synthetic construct
  misc_feature 1..20: note = CRISPR gRNA sequence
  source 1..20: mol_type = other DNA
ggaggctgaggcacgagaat

SEQ ID NO: 23018 - DNA, 20 bp, synthetic construct
  misc_feature 1..20: note = CRISPR gRNA sequence
  source 1..20: mol_type = other DNA
aggcacgagaatcacttgaa

SEQ ID NO: 23019 - DNA, 20 bp, synthetic construct
  misc_feature 1..20: note = CRISPR gRNA sequence
  source 1..20: mol_type = other DNA
gaacccaagaggcggagttt

SEQ ID NO: 23020 - DNA, 20 bp, synthetic construct
  misc_feature 1..20: note = CRISPR gRNA sequence
  source 1..20: mol_type = other DNA
aacccaagaggcggagttta

SEQ ID NO: 23021 - DNA, 20 bp, synthetic construct
  misc_feature 1..20: note = CRISPR gRNA sequence
  source 1..20: mol_type = other DNA
acccgagaggtggaggttac

SEQ ID NO: 23022 - DNA, 20 bp, synthetic construct
  misc_feature 1..20: note = CRISPR gRNA sequence
  source 1..20: mol_type = other DNA
cccgagaggtggaggttacc

SEQ ID NO: 23023 - DNA, 20 bp, synthetic construct
  misc_feature 1..20: note = CRISPR gRNA sequence
  source 1..20: mol_type = other DNA
cccgagagctgagattgcac

SEQ ID NO: 23024 - DNA, 20 bp, synthetic construct
  misc_feature 1..20: note = CRISPR gRNA sequence
  source 1..20: mol_type = other DNA
agattgcaccactgcacgcc

SEQ ID NO: 23025 - DNA, 20 bp, synthetic construct
  misc_feature 1..20: note = CRISPR gRNA sequence
  source 1..20: mol_type = other DNA
caccactgcacgccagcctg

SEQ ID NO: 23026 - DNA, 20 bp, synthetic construct
  misc_feature 1..20: note = CRISPR gRNA sequence
  source 1..20: mol_type = other DNA
cacgccagcctgggcaacag

SEQ ID NO: 23027 - DNA, 20 bp, synthetic construct
  misc_feature 1..20: note = CRISPR gRNA sequence
  source 1..20: mol_type = other DNA
ggcaacagagcaagactgtc

SEQ ID NO: 23028 - DNA, 20 bp, synthetic construct
  misc_feature 1..20: note = CRISPR gRNA sequence
  source 1..20: mol_type = other DNA
tctcaggaaaaaaaaaagag

SEQ ID NO: 23029 - DNA, 20 bp, synthetic construct
  misc_feature 1..20: note = CRISPR gRNA sequence
  source 1..20: mol_type = other DNA
aggaaaaaaaaaagagagag

SEQ ID NO: 23030 - DNA, 20 bp, synthetic construct
  misc_feature 1..20: note = CRISPR gRNA sequence
  source 1..20: mol_type = other DNA
ccaaagaccaagacacacac

SEQ ID NO: 23031 - DNA, 20 bp, synthetic construct
  misc_feature 1..20: note = CRISPR gRNA sequence
  source 1..20: mol_type = other DNA
caaagaccaagacacacaca

SEQ ID NO: 23032 - DNA, 20 bp, synthetic construct
  misc_feature 1..20: note = CRISPR gRNA sequence
  source 1..20: mol_type = other DNA
agaaaggggcattagttacc

SEQ ID NO: 23033 - DNA, 20 bp, synthetic construct
  misc_feature 1..20: note = CRISPR gRNA sequence
  source 1..20: mol_type = other DNA
gttaccaccgattctcatag

SEQ ID NO: 23034 - DNA, 20 bp, synthetic construct
  misc_feature 1..20: note = CRISPR gRNA sequence
  source 1..20: mol_type = other DNA
ccaccgattctcataggaag

SEQ ID NO: 23035 - DNA, 20 bp, synthetic construct
  misc_feature 1..20: note = CRISPR gRNA sequence
  source 1..20: mol_type = other DNA
tcataggaaggacatagata

SEQ ID NO: 23036 - DNA, 20 bp, synthetic construct
  misc_feature 1..20: note = CRISPR gRNA sequence
  source 1..20: mol_type = other DNA
ataggaaggacatagatagt

SEQ ID NO: 23037 - DNA, 20 bp, synthetic construct
  misc_feature 1..20: note = CRISPR gRNA sequence
  source 1..20: mol_type = other DNA
tcagattccttcaatccttc

SEQ ID NO: 23038 - DNA, 20 bp, synthetic construct
  misc_feature 1..20: note = CRISPR gRNA sequence
  source 1..20: mol_type = other DNA
cagattccttcaatccttct

SEQ ID NO: 23039 - DNA, 20 bp, synthetic construct
  misc_feature 1..20: note = CRISPR gRNA sequence
  source 1..20: mol_type = other DNA
agattccttcaatccttctg

SEQ ID NO: 23040 - DNA, 20 bp, synthetic construct
  misc_feature 1..20: note = CRISPR gRNA sequence
  source 1..20: mol_type = other DNA
cttcaatccttctgacatca

SEQ ID NO: 23041 - DNA, 20 bp, synthetic construct
  misc_feature 1..20: note = CRISPR gRNA sequence
  source 1..20: mol_type = other DNA
caatccttctgacatcaagg

SEQ ID NO: 23042 - DNA, 20 bp, synthetic construct
  misc_feature 1..20: note = CRISPR gRNA sequence
  source 1..20: mol_type = other DNA
aatccttctgacatcaagga

SEQ ID NO: 23043 - DNA, 20 bp, synthetic construct
  misc_feature 1..20: note = CRISPR gRNA sequence
  source 1..20: mol_type = other DNA
ctgacatcaaggacaaagtc

SEQ ID NO: 23044 - DNA, 20 bp, synthetic construct
  misc_feature 1..20: note = CRISPR gRNA sequence
  source 1..20: mol_type = other DNA
tgacatcaaggacaaagtct

SEQ ID NO: 23045 - DNA, 20 bp, synthetic construct
  misc_feature 1..20: note = CRISPR gRNA sequence
  source 1..20: mol_type = other DNA
acatcaaggacaaagtctct

SEQ ID NO: 23046 - DNA, 20 bp, synthetic construct
  misc_feature 1..20: note = CRISPR gRNA sequence
  source 1..20: mol_type = other DNA
tgattttccctgatgtttga

SEQ ID NO: 23047 - DNA, 20 bp, synthetic construct
  misc_feature 1..20: note = CRISPR gRNA sequence
  source 1..20: mol_type = other DNA
attttccctgatgtttgaca

SEQ ID NO: 23048 - DNA, 20 bp, synthetic construct
  misc_feature 1..20: note = CRISPR gRNA sequence
  source 1..20: mol_type = other DNA
tccctgatgtttgacagtgc

SEQ ID NO: 23049 - DNA, 20 bp, synthetic construct
  misc_feature 1..20: note = CRISPR gRNA sequence
  source 1..20: mol_type = other DNA
ccctgatgtttgacagtgcc

SEQ ID NO: 23050 - DNA, 20 bp, synthetic construct
  misc_feature 1..20: note = CRISPR gRNA sequence
  source 1..20: mol_type = other DNA
cctgatgtttgacagtgccc

SEQ ID NO: 23051 - DNA, 20 bp, synthetic construct
  misc_feature 1..20: note = CRISPR gRNA sequence
  source 1..20: mol_type = other DNA
atgtttgacagtgccctaat

SEQ ID NO: 23052 - DNA, 20 bp, synthetic construct
  misc_feature 1..20: note = CRISPR gRNA sequence
  source 1..20: mol_type = other DNA
gacagtgccctaatgcttgc

SEQ ID NO: 23053 - DNA, 20 bp, synthetic construct
  misc_feature 1..20: note = CRISPR gRNA sequence
  source 1..20: mol_type = other DNA
acagtgccctaatgcttgct

SEQ ID NO: 23054 - DNA, 20 bp, synthetic construct
  misc_feature 1..20: note = CRISPR gRNA sequence
  source 1..20: mol_type = other DNA
atgcttgctaagatttcttt

SEQ ID NO: 23055 - DNA, 20 bp, synthetic construct
  misc_feature 1..20: note = CRISPR gRNA sequence
  source 1..20: mol_type = other DNA
gctaagatttctttttaaca

SEQ ID NO: 23056 - DNA, 20 bp, synthetic construct
  misc_feature 1..20: note = CRISPR gRNA sequence
  source 1..20: mol_type = other DNA
ctaagatttctttttaacaa

SEQ ID NO: 23057 - DNA, 20 bp, synthetic construct
  misc_feature 1..20: note = CRISPR gRNA sequence
  source 1..20: mol_type = other DNA
agatttctttttaacaaagt

SEQ ID NO: 23058 - DNA, 20 bp, synthetic construct
  misc_feature 1..20: note = CRISPR gRNA sequence
  source 1..20: mol_type = other DNA
ctttttaacaaagtggtaaa

SEQ ID NO: 23059 - DNA, 20 bp, synthetic construct
  misc_feature 1..20: note = CRISPR gRNA sequence
  source 1..20: mol_type = other DNA
tttttaacaaagtggtaaag

SEQ ID NO: 23060 - DNA, 20 bp, synthetic construct
  misc_feature 1..20: note = CRISPR gRNA sequence
  source 1..20: mol_type = other DNA
tttaacaaagtggtaaagaa

SEQ ID NO: 23061 - DNA, 20 bp, synthetic construct
  misc_feature 1..20: note = CRISPR gRNA sequence
  source 1..20: mol_type = other DNA
ttaacaaagtggtaaagaag

SEQ ID NO: 23062 - DNA, 20 bp, synthetic construct
  misc_feature 1..20: note = CRISPR gRNA sequence
  source 1..20: mol_type = other DNA
taacaaagtggtaaagaagc

SEQ ID NO: 23063 - DNA, 20 bp, synthetic construct
  misc_feature 1..20: note = CRISPR gRNA sequence
  source 1..20: mol_type = other DNA
aacaaagtggtaaagaagct

SEQ ID NO: 23064 - DNA, 20 bp, synthetic construct
  misc_feature 1..20: note = CRISPR gRNA sequence
  source 1..20: mol_type = other DNA
acaaagtggtaaagaagctg

SEQ ID NO: 23065 - DNA, 20 bp, synthetic construct
  misc_feature 1..20: note = CRISPR gRNA sequence
  source 1..20: mol_type = other DNA
agattattttagtaacattg

SEQ ID NO: 23066 - DNA, 20 bp, synthetic construct
  misc_feature 1..20: note = CRISPR gRNA sequence
  source 1..20: mol_type = other DNA
ttttagtaacattgtttctt

SEQ ID NO: 23067 - DNA, 20 bp, synthetic construct
  misc_feature 1..20: note = CRISPR gRNA sequence
  source 1..20: mol_type = other DNA
tagtaacattgtttcttttt

SEQ ID NO: 23068 - DNA, 20 bp, synthetic construct
  misc_feature 1..20: note = CRISPR gRNA sequence
  source 1..20: mol_type = other DNA
agtaacattgtttctttttc

SEQ ID NO: 23069 - DNA, 20 bp, synthetic construct
  misc_feature 1..20: note = CRISPR gRNA sequence
  source 1..20: mol_type = other DNA
gtaacattgtttctttttca

SEQ ID NO: 23070 - DNA, 20 bp, synthetic construct
  misc_feature 1..20: note = CRISPR gRNA sequence
  source 1..20: mol_type = other DNA
tttctttttcaaccacaagt

SEQ ID NO: 23071 - DNA, 20 bp, synthetic construct
  misc_feature 1..20: note = CRISPR gRNA sequence
  source 1..20: mol_type = other DNA
ctttttcaaccacaagtgat

SEQ ID NO: 23072 - DNA, 20 bp, synthetic construct
  misc_feature 1..20: note = CRISPR gRNA sequence
  source 1..20: mol_type = other DNA
tttttcaaccacaagtgata

SEQ ID NO: 23073 - DNA, 20 bp, synthetic construct
  misc_feature 1..20: note = CRISPR gRNA sequence
  source 1..20: mol_type = other DNA
tttcaaccacaagtgatact

SEQ ID NO: 23074 - DNA, 20 bp, synthetic construct
  misc_feature 1..20: note = CRISPR gRNA sequence
  source 1..20: mol_type = other DNA
ttcaaccacaagtgatactg

SEQ ID NO: 23075 - DNA, 20 bp, synthetic construct
  misc_feature 1..20: note = CRISPR gRNA sequence
  source 1..20: mol_type = other DNA
tcaaccacaagtgatactgt

SEQ ID NO: 23076 - DNA, 20 bp, synthetic construct
  misc_feature 1..20: note = CRISPR gRNA sequence
  source 1..20: mol_type = other DNA
caaccacaagtgatactgtt

SEQ ID NO: 23077 - DNA, 20 bp, synthetic construct
  misc_feature 1..20: note = CRISPR gRNA sequence
  source 1..20: mol_type = other DNA
aaccacaagtgatactgttg

SEQ ID NO: 23078 - DNA, 20 bp, synthetic construct
  misc_feature 1..20: note = CRISPR gRNA sequence
  source 1..20: mol_type = other DNA
ttggtttggttttgcttttc

SEQ ID NO: 23079 - DNA, 20 bp, synthetic construct
  misc_feature 1..20: note = CRISPR gRNA sequence
  source 1..20: mol_type = other DNA
gtttggttttgcttttccgt

SEQ ID NO: 23080 - DNA, 20 bp, synthetic construct
  misc_feature 1..20: note = CRISPR gRNA sequence
  source 1..20: mol_type = other DNA
ggttttgcttttccgtttat

SEQ ID NO: 23081 - DNA, 20 bp, synthetic construct
  misc_feature 1..20: note = CRISPR gRNA sequence
  source 1..20: mol_type = other DNA
gttttgcttttccgtttata

SEQ ID NO: 23082 - DNA, 20 bp, synthetic construct
  misc_feature 1..20: note = CRISPR gRNA sequence
  source 1..20: mol_type = other DNA
tgcttttccgtttatacatg

SEQ ID NO: 23083 - DNA, 20 bp, synthetic construct
  misc_feature 1..20: note = CRISPR gRNA sequence
  source 1..20: mol_type = other DNA
gcttttccgtttatacatgg

SEQ ID NO: 23084 - DNA, 20 bp, synthetic construct
  misc_feature 1..20: note = CRISPR gRNA sequence
  source 1..20: mol_type = other DNA
cttttccgtttatacatgga

SEQ ID NO: 23085 - DNA, 20 bp, synthetic construct
  misc_feature 1..20: note = CRISPR gRNA sequence
  source 1..20: mol_type = other DNA
ttccgtttatacatggaaaa

SEQ ID NO: 23086 - DNA, 20 bp, synthetic construct
  misc_feature 1..20: note = CRISPR gRNA sequence
  source 1..20: mol_type = other DNA
tccgtttatacatggaaaaa

SEQ ID NO: 23087 - DNA, 20 bp, synthetic construct
  misc_feature 1..20: note = CRISPR gRNA sequence
  source 1..20: mol_type = other DNA
ccgtttatacatggaaaaaa

SEQ ID NO: 23088 - DNA, 20 bp, synthetic construct
  misc_feature 1..20: note = CRISPR gRNA sequence
  source 1..20: mol_type = other DNA
cgtttatacatggaaaaaaa

SEQ ID NO: 23089 - DNA, 20 bp, synthetic construct
  misc_feature 1..20: note = CRISPR gRNA sequence
  source 1..20: mol_type = other DNA
atacatggaaaaaaaagttt

SEQ ID NO: 23090 - DNA, 20 bp, synthetic construct
  misc_feature 1..20: note = CRISPR gRNA sequence
  source 1..20: mol_type = other DNA
tacatggaaaaaaaagtttt

SEQ ID NO: 23091 - DNA, 20 bp, synthetic construct
  misc_feature 1..20: note = CRISPR gRNA sequence
  source 1..20: mol_type = other DNA
tctttttgtaaaatcatggt

SEQ ID NO: 23092 - DNA, 20 bp, synthetic construct
  misc_feature 1..20: note = CRISPR gRNA sequence
  source 1..20: mol_type = other DNA
ctttttgtaaaatcatggta

SEQ ID NO: 23093 - DNA, 20 bp, synthetic construct
  misc_feature 1..20: note = CRISPR gRNA sequence
  source 1..20: mol_type = other DNA
tttttgtaaaatcatggtaa

SEQ ID NO: 23094 - DNA, 20 bp, synthetic construct
  misc_feature 1..20: note = CRISPR gRNA sequence
  source 1..20: mol_type = other DNA
tttgtaaaatcatggtaaaa

SEQ ID NO: 23095 - DNA, 20 bp, synthetic construct
  misc_feature 1..20: note = CRISPR gRNA sequence
  source 1..20: mol_type = other DNA
ttgtaaaatcatggtaaaat

SEQ ID NO: 23096 - DNA, 20 bp, synthetic construct
  misc_feature 1..20: note = CRISPR gRNA sequence
  source 1..20: mol_type = other DNA
tgtaaaatcatggtaaaata

SEQ ID NO: 23097 - DNA, 20 bp, synthetic construct
  misc_feature 1..20: note = CRISPR gRNA sequence
  source 1..20: mol_type = other DNA
gtaaaatcatggtaaaatac

SEQ ID NO: 23098 - DNA, 20 bp, synthetic construct
  misc_feature 1..20: note = CRISPR gRNA sequence
  source 1..20: mol_type = other DNA
taaaatcatggtaaaataca

SEQ ID NO: 23099 - DNA, 20 bp, synthetic construct
  misc_feature 1..20: note = CRISPR gRNA sequence
  source 1..20: mol_type = other DNA
accattttaaccactttcaa

SEQ ID NO: 23100 - DNA, 20 bp, synthetic construct
  misc_feature 1..20: note = CRISPR gRNA sequence
  source 1..20: mol_type = other DNA
ccattttaaccactttcaaa

SEQ ID NO: 23101 - DNA, 20 bp, synthetic construct
  misc_feature 1..20: note = CRISPR gRNA sequence
  source 1..20: mol_type = other DNA
taaccactttcaaatgtaca

SEQ ID NO: 23102 - DNA, 20 bp, synthetic construct
  misc_feature 1..20: note = CRISPR gRNA sequence
  source 1..20: mol_type = other DNA
aaccactttcaaatgtacat

SEQ ID NO: 23103 - DNA, 20 bp, synthetic construct
  misc_feature 1..20: note = CRISPR gRNA sequence
  source 1..20: mol_type = other DNA
accactttcaaatgtacatt

SEQ ID NO: 23104 - DNA, 20 bp, synthetic construct
  misc_feature 1..20: note = CRISPR gRNA sequence
  source 1..20: mol_type = other DNA
tcaaatgtacatttcagtgg

SEQ ID NO: 23105 - DNA, 20 bp, synthetic construct
  misc_feature 1..20: note = CRISPR gRNA sequence
  source 1..20: mol_type = other DNA
caaatgtacatttcagtggc

SEQ ID NO: 23106 - DNA, 20 bp, synthetic construct
  misc_feature 1..20: note = CRISPR gRNA sequence
  source 1..20: mol_type = other DNA
aaatgtacatttcagtggca

SEQ ID NO: 23107 - DNA, 20 bp, synthetic construct
  misc_feature 1..20: note = CRISPR gRNA sequence
  source 1..20: mol_type = other DNA
cagtggcattaaatatttca

SEQ ID NO: 23108 - DNA, 20 bp, synthetic construct
  misc_feature 1..20: note = CRISPR gRNA sequence
  source 1..20: mol_type = other DNA
agtggcattaaatatttcaa

SEQ ID NO: 23109 - DNA, 20 bp, synthetic construct
  misc_feature 1..20: note = CRISPR gRNA sequence
  source 1..20: mol_type = other DNA
aatatttcaaactgttgtgc

SEQ ID NO: 23110 - DNA, 20 bp, synthetic construct
  misc_feature 1..20: note = CRISPR gRNA sequence
  source 1..20: mol_type = other DNA
caaactgttgtgcaacctcc

SEQ ID NO: 23111 - DNA, 20 bp, synthetic construct
  misc_feature 1..20: note = CRISPR gRNA sequence
  source 1..20: mol_type = other DNA
aaactgttgtgcaacctccg

SEQ ID NO: 23112 - DNA, 20 bp, synthetic construct
  misc_feature 1..20: note = CRISPR gRNA sequence
  source 1..20: mol_type = other DNA
ttgtgcaacctccgctacca

SEQ ID NO: 23113 - DNA, 20 bp, synthetic construct
  misc_feature 1..20: note = CRISPR gRNA sequence
  source 1..20: mol_type = other DNA
tgcaacctccgctaccatcc

SEQ ID NO: 23114 - DNA, 20 bp, synthetic construct
  misc_feature 1..20: note = CRISPR gRNA sequence
  source 1..20: mol_type = other DNA
cgctaccatccatctccaga

SEQ ID NO: 23115 - DNA, 20 bp, synthetic construct
  misc_feature 1..20: note = CRISPR gRNA sequence
  source 1..20: mol_type = other DNA
ccatccatctccagaacttt

SEQ ID NO: 23116 - DNA, 20 bp, synthetic construct
  misc_feature 1..20: note = CRISPR gRNA sequence
  source 1..20: mol_type = other DNA
cagaactttttcatcctccc

SEQ ID NO: 23117 - DNA, 20 bp, synthetic construct
  misc_feature 1..20: note = CRISPR gRNA sequence
  source 1..20: mol_type = other DNA
tttcatcctcccaaactgaa

SEQ ID NO: 23118 - DNA, 20 bp, synthetic construct
  misc_feature 1..20: note = CRISPR gRNA sequence
  source 1..20: mol_type = other DNA
ttcatcctcccaaactgaaa

SEQ ID NO: 23119 - DNA, 20 bp, synthetic construct
  misc_feature 1..20: note = CRISPR gRNA sequence
  source 1..20: mol_type = other DNA
tcatcctcccaaactgaaac

SEQ ID NO: 23120 - DNA, 20 bp, synthetic construct
  misc_feature 1..20: note = CRISPR gRNA sequence
  source 1..20: mol_type = other DNA
catcctcccaaactgaaact

SEQ ID NO: 23121 - DNA, 20 bp, synthetic construct
  misc_feature 1..20: note = CRISPR gRNA sequence
  source 1..20: mol_type = other DNA
atcctcccaaactgaaactc

SEQ ID NO: 23122 - DNA, 20 bp, synthetic construct
  misc_feature 1..20: note = CRISPR gRNA sequence
  source 1..20: mol_type = other DNA
ccaaactgaaactctaccca

SEQ ID NO: 23123 - DNA, 20 bp, synthetic construct
  misc_feature 1..20: note = CRISPR gRNA sequence
  source 1..20: mol_type = other DNA
aaactctacccaataagcaa

SEQ ID NO: 23124 - DNA, 20 bp, synthetic construct
  misc_feature 1..20: note = CRISPR gRNA sequence
  source 1..20: mol_type = other DNA
tacccaataagcaataactc

SEQ ID NO: 23125 - DNA, 20 bp, synthetic construct
  misc_feature 1..20: note = CRISPR gRNA sequence
  source 1..20: mol_type = other DNA
cccaataagcaataactccc

SEQ ID NO: 23126 - DNA, 20 bp, synthetic construct
  misc_feature 1..20: note = CRISPR gRNA sequence
  source 1..20: mol_type = other DNA
cccactgccccttccaccca

SEQ ID NO: 23127 - DNA, 20 bp, synthetic construct
  misc_feature 1..20: note = CRISPR gRNA sequence
  source 1..20: mol_type = other DNA
ccccttccacccagctcgtg

SEQ ID NO: 23128 - DNA, 20 bp, synthetic construct
  misc_feature 1..20: note = CRISPR gRNA sequence
  source 1..20: mol_type = other DNA
ccacccagctcgtggtaact

SEQ ID NO: 23129 - DNA, 20 bp, synthetic construct
  misc_feature 1..20: note = CRISPR gRNA sequence
  source 1..20: mol_type = other DNA
cacccagctcgtggtaactc

SEQ ID NO: 23130 - DNA, 20 bp, synthetic construct
  misc_feature 1..20: note = CRISPR gRNA sequence
  source 1..20: mol_type = other DNA
gtggtaactccaacttcctg

SEQ ID NO: 23131 - DNA, 20 bp, synthetic construct
  misc_feature 1..20: note = CRISPR gRNA sequence
  source 1..20: mol_type = other DNA
caacttcctgtctctatgtt

SEQ ID NO: 23132 - DNA, 20 bp, synthetic construct
  misc_feature 1..20: note = CRISPR gRNA sequence
  source 1..20: mol_type = other DNA
cctgtctctatgttttgggc

SEQ ID NO: 23133 - DNA, 20 bp, synthetic construct
  misc_feature 1..20: note = CRISPR gRNA sequence
  source 1..20: mol_type = other DNA
ctgtctctatgttttgggct

SEQ ID NO: 23134 - DNA, 20 bp, synthetic construct
  misc_feature 1..20: note = CRISPR gRNA sequence
  source 1..20: mol_type = other DNA
tctctatgttttgggctact

SEQ ID NO: 23135 - DNA, 20 bp, synthetic construct
  misc_feature 1..20: note = CRISPR gRNA sequence
  source 1..20: mol_type = other DNA
tatgttttgggctactctag

SEQ ID NO: 23136 - DNA, 20 bp, synthetic construct
  misc_feature 1..20: note = CRISPR gRNA sequence
  source 1..20: mol_type = other DNA
tgttttgggctactctagac

SEQ ID NO: 23137 - DNA, 20 bp, synthetic construct
  misc_feature 1..20: note = CRISPR gRNA sequence
  source 1..20: mol_type = other DNA
tgggctactctagacaccgc

SEQ ID NO: 23138 - DNA, 20 bp, synthetic construct
  misc_feature 1..20: note = CRISPR gRNA sequence
  source 1..20: mol_type = other DNA
gggctactctagacaccgcc

SEQ ID NO: 23139 - DNA, 20 bp, synthetic construct
  misc_feature 1..20: note = CRISPR gRNA sequence
  source 1..20: mol_type = other DNA
ggctactctagacaccgcct

SEQ ID NO: 23140 - DNA, 20 bp, synthetic construct
  misc_feature 1..20: note = CRISPR gRNA sequence
  source 1..20: mol_type = other DNA
ctctagacaccgcctataaa

SEQ ID NO: 23141 - DNA, 20 bp, synthetic construct
  misc_feature 1..20: note = CRISPR gRNA sequence
  source 1..20: mol_type = other DNA
tagacaccgcctataaatag

SEQ ID NO: 23142 - DNA, 20 bp, synthetic construct
  misc_feature 1..20: note = CRISPR gRNA sequence
  source 1..20: mol_type = other DNA
gacaccgcctataaatagaa

SEQ ID NO: 23143 - DNA, 20 bp, synthetic construct
  misc_feature 1..20: note = CRISPR gRNA sequence
  source 1..20: mol_type = other DNA
taaatagaattacgtgatat

SEQ ID NO: 23144 - DNA, 20 bp, synthetic construct
  misc_feature 1..20: note = CRISPR gRNA sequence
  source 1..20: mol_type = other DNA
cgtgatatttgtctttttgt

SEQ ID NO: 23145 - DNA, 20 bp, synthetic construct
  misc_feature 1..20: note = CRISPR gRNA sequence
  source 1..20: mol_type = other DNA
gtctttttgtgcctggcttc

SEQ ID NO: 23146 - DNA, 20 bp, synthetic construct
  misc_feature 1..20: note = CRISPR gRNA sequence
  source 1..20: mol_type = other DNA
tctttttgtgcctggcttct

SEQ ID NO: 23147 - DNA, 20 bp, synthetic construct
  misc_feature 1..20: note = CRISPR gRNA sequence
  source 1..20: mol_type = other DNA
tttgtgcctggcttctttca

SEQ ID NO: 23148 - DNA, 20 bp, synthetic construct
  misc_feature 1..20: note = CRISPR gRNA sequence
  source 1..20: mol_type = other DNA
ttgtgcctggcttctttcac

SEQ ID NO: 23149 - DNA, 20 bp, synthetic construct
  misc_feature 1..20: note = CRISPR gRNA sequence
  source 1..20: mol_type = other DNA
tgtgcctggcttctttcact

SEQ ID NO: 23150 - DNA, 20 bp, synthetic construct
  misc_feature 1..20: note = CRISPR gRNA sequence
  source 1..20: mol_type = other DNA
gtgcctggcttctttcactt

SEQ ID NO: 23151 - DNA, 20 bp, synthetic construct
  misc_feature 1..20: note = CRISPR gRNA sequence
  source 1..20: mol_type = other DNA
tgcctggcttctttcactta

SEQ ID NO: 23152 - DNA, 20 bp, synthetic construct
  misc_feature 1..20: note = CRISPR gRNA sequence
  source 1..20: mol_type = other DNA
gcttctttcacttagcataa

SEQ ID NO: 23153 - DNA, 20 bp, synthetic construct
  misc_feature 1..20: note = CRISPR gRNA sequence
  source 1..20: mol_type = other DNA
ctttcacttagcataatgtc

SEQ ID NO: 23154 - DNA, 20 bp, synthetic construct
  misc_feature 1..20: note = CRISPR gRNA sequence
  source 1..20: mol_type = other DNA
tttcacttagcataatgtct

SEQ ID NO: 23155 - DNA, 20 bp, synthetic construct
  misc_feature 1..20: note = CRISPR gRNA sequence
  source 1..20: mol_type = other DNA
tcacttagcataatgtcttc

SEQ ID NO: 23156 - DNA, 20 bp, synthetic construct
  misc_feature 1..20: note = CRISPR gRNA sequence
  source 1..20: mol_type = other DNA
cacttagcataatgtcttcc

SEQ ID NO: 23157 - DNA, 20 bp, synthetic construct
  misc_feature 1..20: note = CRISPR gRNA sequence
  source 1..20: mol_type = other DNA
acttagcataatgtcttcca

SEQ ID NO: 23158 - DNA, 20 bp, synthetic construct
  misc_feature 1..20: note = CRISPR gRNA sequence
  source 1..20: mol_type = other DNA
agcataatgtcttccaggtt

SEQ ID NO: 23159 - DNA, 20 bp, synthetic construct
  misc_feature 1..20: note = CRISPR gRNA sequence
  source 1..20: mol_type = other DNA
gcataatgtcttccaggttc

SEQ ID NO: 23160 - DNA, 20 bp, synthetic construct
  misc_feature 1..20: note = CRISPR gRNA sequence
  source 1..20: mol_type = other DNA
ccaggttcatccatgtcgtg

SEQ ID NO: 23161 - DNA, 20 bp, synthetic construct
  misc_feature 1..20: note = CRISPR gRNA sequence
  source 1..20: mol_type = other DNA
caggttcatccatgtcgtgc

SEQ ID NO: 23162 - DNA, 20 bp, synthetic construct
  misc_feature 1..20: note = CRISPR gRNA sequence
  source 1..20: mol_type = other DNA
atccatgtcgtgccatgtgt

SEQ ID NO: 23163 - DNA, 20 bp, synthetic construct
  misc_feature 1..20: note = CRISPR gRNA sequence
  source 1..20: mol_type = other DNA
ctttctatggcggaatagta

SEQ ID NO: 23164 - DNA, 20 bp, synthetic construct
  misc_feature 1..20: note = CRISPR gRNA sequence
  source 1..20: mol_type = other DNA
tctatggcggaatagtattc

SEQ ID NO: 23165 - DNA, 20 bp, synthetic construct
  misc_feature 1..20: note = CRISPR gRNA sequence
  source 1..20: mol_type = other DNA
ctatggcggaatagtattct

SEQ ID NO: 23166 - DNA, 20 bp, synthetic construct
  misc_feature 1..20: note = CRISPR gRNA sequence
  source 1..20: mol_type = other DNA
tatggcggaatagtattcta

SEQ ID NO: 23167 - DNA, 20 bp, synthetic construct
  misc_feature 1..20: note = CRISPR gRNA sequence
  source 1..20: mol_type = other DNA
tggcggaatagtattctaat

SEQ ID NO: 23168 - DNA, 20 bp, synthetic construct
  misc_feature 1..20: note = CRISPR gRNA sequence
  source 1..20: mol_type = other DNA
taatatgtggatatcccata

SEQ ID NO: 23169 - DNA, 20 bp, synthetic construct
  misc_feature 1..20: note = CRISPR gRNA sequence
  source 1..20: mol_type = other DNA
atatgtggatatcccatatt

SEQ ID NO: 23170 - DNA, 20 bp, synthetic construct
  misc_feature 1..20: note = CRISPR gRNA sequence
  source 1..20: mol_type = other DNA
tgttcatccattcatttgtt

SEQ ID NO: 23171 - DNA, 20 bp, synthetic construct
  misc_feature 1..20: note = CRISPR gRNA sequence
  source 1..20: mol_type = other DNA
gttcatccattcatttgttg

SEQ ID NO: 23172 - DNA, 20 bp, synthetic construct
  misc_feature 1..20: note = CRISPR gRNA sequence
  source 1..20: mol_type = other DNA
ttcatccattcatttgttga

SEQ ID NO: 23173 - DNA, 20 bp, synthetic construct
  misc_feature 1..20: note = CRISPR gRNA sequence
  source 1..20: mol_type = other DNA
atccattcatttgttgatag

SEQ ID NO: 23174 - DNA, 20 bp, synthetic construct
  misc_feature 1..20: note = CRISPR gRNA sequence
  source 1..20: mol_type = other DNA
atttgttgatagacacttgg

SEQ ID NO: 23175 - DNA, 20 bp, synthetic construct
  misc_feature 1..20: note = CRISPR gRNA sequence
  source 1..20: mol_type = other DNA
gttgatagacacttgggttg

SEQ ID NO: 23176 - DNA, 20 bp, synthetic construct
  misc_feature 1..20: note = CRISPR gRNA sequence
  source 1..20: mol_type = other DNA
ttgatagacacttgggttgt

SEQ ID NO: 23177 - DNA, 20 bp, synthetic construct
  misc_feature 1..20: note = CRISPR gRNA sequence
  source 1..20: mol_type = other DNA
atagacacttgggttgttcc

SEQ ID NO: 23178 - DNA, 20 bp, synthetic construct
  misc_feature 1..20: note = CRISPR gRNA sequence
  source 1..20: mol_type = other DNA
gggttgttcctacctcttga

SEQ ID NO: 23179 - DNA, 20 bp, synthetic construct
  misc_feature 1..20: note = CRISPR gRNA sequence
  source 1..20: mol_type = other DNA
ggttgttcctacctcttgac

SEQ ID NO: 23180 - DNA, 20 bp, synthetic construct
  misc_feature 1..20: note = CRISPR gRNA sequence
  source 1..20: mol_type = other DNA
ttcctacctcttgactattg

SEQ ID NO: 23181 - DNA, 20 bp, synthetic construct
  misc_feature 1..20: note = CRISPR gRNA sequence
  source 1..20: mol_type = other DNA
ctacctcttgactattgtga

SEQ ID NO: 23182 - DNA, 20 bp, synthetic construct
  misc_feature 1..20: note = CRISPR gRNA sequence
  source 1..20: mol_type = other DNA
cctcttgactattgtgaata

SEQ ID NO: 23183 - DNA, 20 bp, synthetic construct
  misc_feature 1..20: note = CRISPR gRNA sequence
  source 1..20: mol_type = other DNA
ttgactattgtgaataatct

SEQ ID NO: 23184 - DNA, 20 bp, synthetic construct
  misc_feature 1..20: note = CRISPR gRNA sequence
  source 1..20: mol_type = other DNA
gactattgtgaataatcttg

SEQ ID NO: 23185 - DNA, 20 bp, synthetic construct
  misc_feature 1..20: note = CRISPR gRNA sequence
  source 1..20: mol_type = other DNA
actattgtgaataatcttgc

SEQ ID NO: 23186 - DNA, 20 bp, synthetic construct
  misc_feature 1..20: note = CRISPR gRNA sequence
  source 1..20: mol_type = other DNA
ttgtgaataatcttgctagg

SEQ ID NO: 23187 - DNA, 20 bp, synthetic construct
  misc_feature 1..20: note = CRISPR gRNA sequence
  source 1..20: mol_type = other DNA
tgaataatcttgctaggtac

SEQ ID NO: 23188 - DNA, 20 bp, synthetic construct
  misc_feature 1..20: note = CRISPR gRNA sequence
  source 1..20: mol_type = other DNA
gctaggtacatgggtggaca

SEQ ID NO: 23189 - DNA, 20 bp, synthetic construct
  misc_feature 1..20: note = CRISPR gRNA sequence
  source 1..20: mol_type = other DNA
ctaggtacatgggtggacaa

SEQ ID NO: 23190 - DNA, 20 bp, synthetic construct
  misc_feature 1..20: note = CRISPR gRNA sequence
  source 1..20: mol_type = other DNA
ggtacatgggtggacaaata

SEQ ID NO: 23191 - DNA, 20 bp, synthetic construct
  misc_feature 1..20: note = CRISPR gRNA sequence
  source 1..20: mol_type = other DNA
tctgactccccgctttcaac

SEQ ID NO: 23192 - DNA, 20 bp, synthetic construct
  misc_feature 1..20: note = CRISPR gRNA sequence
  source 1..20: mol_type = other DNA
actccccgctttcaactcta

SEQ ID NO: 23193 - DNA, 20 bp, synthetic construct
  misc_feature 1..20: note = CRISPR gRNA sequence
  source 1..20: mol_type = other DNA
cccgctttcaactctagaaa

SEQ ID NO: 23194 - DNA, 20 bp, synthetic construct
  misc_feature 1..20: note = CRISPR gRNA sequence
  source 1..20: mol_type = other DNA
tcaactctagaaagctttct

SEQ ID NO: 23195 - DNA, 20 bp, synthetic construct
  misc_feature 1..20: note = CRISPR gRNA sequence
  source 1..20: mol_type = other DNA
caactctagaaagctttctt

SEQ ID NO: 23196 - DNA, 20 bp, synthetic construct
  misc_feature 1..20: note = CRISPR gRNA sequence
  source 1..20: mol_type = other DNA
aactctagaaagctttcttt

SEQ ID NO: 23197 - DNA, 20 bp, synthetic construct
  misc_feature 1..20: note = CRISPR gRNA sequence
  source 1..20: mol_type = other DNA
tagaaagctttcttttaaaa

SEQ ID NO: 23198 - DNA, 20 bp, synthetic construct
  misc_feature 1..20: note = CRISPR gRNA sequence
  source 1..20: mol_type = other DNA
gaaagctttcttttaaaatc

SEQ ID NO: 23199 - DNA, 20 bp, synthetic construct
  misc_feature 1..20: note = CRISPR gRNA sequence
  source 1..20: mol_type = other DNA
tcttttaaaatcggtctatt

SEQ ID NO: 23200 - DNA, 20 bp, synthetic construct
  misc_feature 1..20: note = CRISPR gRNA sequence
  source 1..20: mol_type = other DNA
cttttaaaatcggtctattt

SEQ ID NO: 23201 - DNA, 20 bp, synthetic construct
  misc_feature 1..20: note = CRISPR gRNA sequence
  source 1..20: mol_type = other DNA
ttttaaaatcggtctattta

SEQ ID NO: 23202 - DNA, 20 bp, synthetic construct
  misc_feature 1..20: note = CRISPR gRNA sequence
  source 1..20: mol_type = other DNA
ttaaaatcggtctatttaag

SEQ ID NO: 23203 - DNA, 20 bp, synthetic construct
  misc_feature 1..20: note = CRISPR gRNA sequence
  source 1..20: mol_type = other DNA
taaaatcggtctatttaagt

SEQ ID NO: 23204 - DNA, 20 bp, synthetic construct
  misc_feature 1..20: note = CRISPR gRNA sequence
  source 1..20: mol_type = other DNA
aaaatcggtctatttaagtt

SEQ ID NO: 23205 - DNA, 20 bp, synthetic construct
  misc_feature 1..20: note = CRISPR gRNA sequence
  source 1..20: mol_type = other DNA
aaatcggtctatttaagttt

SEQ ID NO: 23206 - DNA, 20 bp, synthetic construct
  misc_feature 1..20: note = CRISPR gRNA sequence
  source 1..20: mol_type = other DNA
tttaagtttctttaaaaagt

SEQ ID NO: 23207 - DNA, 20 bp, synthetic construct
  misc_feature 1..20: note = CRISPR gRNA sequence
  source 1..20: mol_type = other DNA
aagtttctttaaaaagttaa

SEQ ID NO: 23208 - DNA, 20 bp, synthetic construct
  misc_feature 1..20: note = CRISPR gRNA sequence
  source 1..20: mol_type = other DNA
agtttctttaaaaagttaat

SEQ ID NO: 23209 - DNA, 20 bp, synthetic construct
  misc_feature 1..20: note = CRISPR gRNA sequence
  source 1..20: mol_type = other DNA
ctttaaaaagttaatttaag

SEQ ID NO: 23210 - DNA, 20 bp, synthetic construct
  misc_feature 1..20: note = CRISPR gRNA sequence
  source 1..20: mol_type = other DNA
tttaaaaagttaatttaaga

SEQ ID NO: 23211 - DNA, 20 bp, synthetic construct
  misc_feature 1..20: note = CRISPR gRNA sequence
  source 1..20: mol_type = other DNA
taaaaagttaatttaagaaa

SEQ ID NO: 23212 - DNA, 20 bp, synthetic construct
  misc_feature 1..20: note = CRISPR gRNA sequence
  source 1..20: mol_type = other DNA
aaaaagttaatttaagaaaa

SEQ ID NO: 23213 - DNA, 20 bp, synthetic construct
  misc_feature 1..20: note = CRISPR gRNA sequence
  source 1..20: mol_type = other DNA
aaaagttaatttaagaaaaa

SEQ ID NO: 23214 - DNA, 20 bp, synthetic construct
  misc_feature 1..20: note = CRISPR gRNA sequence
  source 1..20: mol_type = other DNA
atttaagaaaaatactaagg

SEQ ID NO: 23215 - DNA, 20 bp, synthetic construct
  misc_feature 1..20: note = CRISPR gRNA sequence
  source 1..20: mol_type = other DNA
aagaaaaatactaaggtaaa

SEQ ID NO: 23216 - DNA, 20 bp, synthetic construct
  misc_feature 1..20: note = CRISPR gRNA sequence
  source 1..20: mol_type = other DNA
agaaaaatactaaggtaaat

SEQ ID NO: 23217 - DNA, 20 bp, synthetic construct
  misc_feature 1..20: note = CRISPR gRNA sequence
  source 1..20: mol_type = other DNA
aggtaaattgtagaacaggt

SEQ ID NO: 23218 - DNA, 20 bp, synthetic construct
  misc_feature 1..20: note = CRISPR gRNA sequence
  source 1..20: mol_type = other DNA
tagaacaggtgatatgtcaa

SEQ ID NO: 23219 - DNA, 20 bp, synthetic construct
  misc_feature 1..20: note = CRISPR gRNA sequence
  source 1..20: mol_type = other DNA
taaagatggaagacgaatgc

SEQ ID NO: 23220 - DNA, 20 bp, synthetic construct
  misc_feature 1..20: note = CRISPR gRNA sequence
  source 1..20: mol_type = other DNA
cagtttgggaaaccggatga

SEQ ID NO: 23221 - DNA, 20 bp, synthetic construct
  misc_feature 1..20: note = CRISPR gRNA sequence
  source 1..20: mol_type = other DNA
gggaaaccggatgagaggaa

SEQ ID NO: 23222 - DNA, 20 bp, synthetic construct
  misc_feature 1..20: note = CRISPR gRNA sequence
  source 1..20: mol_type = other DNA
ggaaaccggatgagaggaaa

SEQ ID NO: 23223 - DNA, 20 bp, synthetic construct
  misc_feature 1..20: note = CRISPR gRNA sequence
  source 1..20: mol_type = other DNA
gaagctattgtaaaatctat

SEQ ID NO: 23224 - DNA, 20 bp, synthetic construct
  misc_feature 1..20: note = CRISPR gRNA sequence
  source 1..20: mol_type = other DNA
ttgtaaaatctatgctgagg

SEQ ID NO: 23225 - DNA, 20 bp, synthetic construct
  misc_feature 1..20: note = CRISPR gRNA sequence
  source 1..20: mol_type = other DNA
taaaatctatgctgagggtc

SEQ ID NO: 23226 - DNA, 20 bp, synthetic construct
  misc_feature 1..20: note = CRISPR gRNA sequence
  source 1..20: mol_type = other DNA
tgctgagggtctggtgacta

SEQ ID NO: 23227 - DNA, 20 bp, synthetic construct
  misc_feature 1..20: note = CRISPR gRNA sequence
  source 1..20: mol_type = other DNA
agggtctggtgactactaga

SEQ ID NO: 23228 - DNA, 20 bp, synthetic construct
  misc_feature 1..20: note = CRISPR gRNA sequence
  source 1..20: mol_type = other DNA
gtgactactagaccaagggc

SEQ ID NO: 23229 - DNA, 20 bp, synthetic construct
  misc_feature 1..20: note = CRISPR gRNA sequence
  source 1..20: mol_type = other DNA
ctagaccaagggcatggcag

SEQ ID NO: 23230 - DNA, 20 bp, synthetic construct
  misc_feature 1..20: note = CRISPR gRNA sequence
  source 1..20: mol_type = other DNA
gaccaagggcatggcagcag

SEQ ID NO: 23231 - DNA, 20 bp, synthetic construct
  misc_feature 1..20: note = CRISPR gRNA sequence
  source 1..20: mol_type = other DNA
aaagacttcaggaaggaaag

SEQ ID NO: 23232 - DNA, 20 bp, synthetic construct
  misc_feature 1..20: note = CRISPR gRNA sequence
  source 1..20: mol_type = other DNA
caggaaggaaagatataaga

SEQ ID NO: 23233 - DNA, 20 bp, synthetic construct
  misc_feature 1..20: note = CRISPR gRNA sequence
  source 1..20: mol_type = other DNA
aggaaggaaagatataagaa

SEQ ID NO: 23234 - DNA, 20 bp, synthetic construct
  misc_feature 1..20: note = CRISPR gRNA sequence
  source 1..20: mol_type = other DNA
agaaaggggcctggtgcagt

SEQ ID NO: 23235 - DNA, 20 bp, synthetic construct
  misc_feature 1..20: note = CRISPR gRNA sequence
  source 1..20: mol_type = other DNA
gtgcagtggctcatgcctgt

SEQ ID NO: 23236 - DNA, 20 bp, synthetic construct
  misc_feature 1..20: note = CRISPR gRNA sequence
  source 1..20: mol_type = other DNA
atgcctgtaattccatcacc

SEQ ID NO: 23237 - DNA, 20 bp, synthetic construct
  misc_feature 1..20: note = CRISPR gRNA sequence
  source 1..20: mol_type = other DNA
taattccatcaccttgggag

SEQ ID NO: 23238 - DNA, 20 bp, synthetic construct
  misc_feature 1..20: note = CRISPR gRNA sequence
  source 1..20: mol_type = other DNA
catcaccttgggaggtcaag

SEQ ID NO: 23239 - DNA, 20 bp, synthetic construct
  misc_feature 1..20: note = CRISPR gRNA sequence
  source 1..20: mol_type = other DNA
gggaggtcaaggcaggatga

SEQ ID NO: 23240 - DNA, 20 bp, synthetic construct
  misc_feature 1..20: note = CRISPR gRNA sequence
  source 1..20: mol_type = other DNA
ggaggtcaaggcaggatgat

SEQ ID NO: 23241 - DNA, 20 bp, synthetic construct
  misc_feature 1..20: note = CRISPR gRNA sequence
  source 1..20: mol_type = other DNA
gagaccaggagttcaagacc

SEQ ID NO: 23242 - DNA, 20 bp, synthetic construct
  misc_feature 1..20: note = CRISPR gRNA sequence
  source 1..20: mol_type = other DNA
agaccaggagttcaagacca

SEQ ID NO: 23243 - DNA, 20 bp, synthetic construct
  misc_feature 1..20: note = CRISPR gRNA sequence
  source 1..20: mol_type = other DNA
aagaccagcctgggcaacag

SEQ ID NO: 23244 - DNA, 20 bp, synthetic construct
  misc_feature 1..20: note = CRISPR gRNA sequence
  source 1..20: mol_type = other DNA
ggcaacagagcaagaccttt

SEQ ID NO: 23245 - DNA, 20 bp, synthetic construct
  misc_feature 1..20: note = CRISPR gRNA sequence
  source 1..20: mol_type = other DNA
tttttaggaaaaaaatatat

SEQ ID NO: 23246 - DNA, 20 bp, synthetic construct
  misc_feature 1..20: note = CRISPR gRNA sequence
  source 1..20: mol_type = other DNA
ttttaggaaaaaaatatata

SEQ ID NO: 23247 - DNA, 20 bp, synthetic construct
  misc_feature 1..20: note = CRISPR gRNA sequence
  source 1..20: mol_type = other DNA
tttaggaaaaaaatatataa

SEQ ID NO: 23248 - DNA, 20 bp, synthetic construct
  misc_feature 1..20: note = CRISPR gRNA sequence
  source 1..20: mol_type = other DNA
ttaggaaaaaaatatataaa

SEQ ID NO: 23249 - DNA, 20 bp, synthetic construct
  misc_feature 1..20: note = CRISPR gRNA sequence
  source 1..20: mol_type = other DNA
taggaaaaaaatatataaat

SEQ ID NO: 23250 - DNA, 20 bp, synthetic construct
  misc_feature 1..20: note = CRISPR gRNA sequence
  source 1..20: mol_type = other DNA
aggaaaaaaatatataaatt

SEQ ID NO: 23251 - DNA, 20 bp, synthetic construct
  misc_feature 1..20: note = CRISPR gRNA sequence
  source 1..20: mol_type = other DNA
ggaaaaaaatatataaatta

SEQ ID NO: 23252 - DNA, 20 bp, synthetic construct
  misc_feature 1..20: note = CRISPR gRNA sequence
  source 1..20: mol_type = other DNA
ataaaaataaatttttgaaa

SEQ ID NO: 23253 - DNA, 20 bp, synthetic construct
  misc_feature 1..20: note = CRISPR gRNA sequence
  source 1..20: mol_type = other DNA
ttgaaaatacagattccagg

SEQ ID NO: 23254 - DNA, 20 bp, synthetic construct
  misc_feature 1..20: note = CRISPR gRNA sequence
  source 1..20: mol_type = other DNA
tgaaaatacagattccaggc

SEQ ID NO: 23255 - DNA, 20 bp, synthetic construct
  misc_feature 1..20: note = CRISPR gRNA sequence
  source 1..20: mol_type = other DNA
gaaaatacagattccaggcc

SEQ ID NO: 23256 - DNA, 20 bp, synthetic construct
  misc_feature 1..20: note = CRISPR gRNA sequence
  source 1..20: mol_type = other DNA
aaaatacagattccaggccg

SEQ ID NO: 23257 - DNA, 20 bp, synthetic construct
  misc_feature 1..20: note = CRISPR gRNA sequence
  source 1..20: mol_type = other DNA
caggccgggcatggtggctc

SEQ ID NO: 23258 - DNA, 20 bp, synthetic construct
  misc_feature 1..20: note = CRISPR gRNA sequence
  source 1..20: mol_type = other DNA
acacctgtaaccccagcact

SEQ ID NO: 23259 - DNA, 20 bp, synthetic construct
  misc_feature 1..20: note = CRISPR gRNA sequence
  source 1..20: mol_type = other DNA
taaccccagcactttgggag

SEQ ID NO: 23260 - DNA, 20 bp, synthetic construct
  misc_feature 1..20: note = CRISPR gRNA sequence
  source 1..20: mol_type = other DNA
tgggaggctgaggccggtgg

SEQ ID NO: 23261 - DNA, 20 bp, synthetic construct
  misc_feature 1..20: note = CRISPR gRNA sequence
  source 1..20: mol_type = other DNA
gggaggctgaggccggtgga

SEQ ID NO: 23262 - DNA, 20 bp, synthetic construct
  misc_feature 1..20: note = CRISPR gRNA sequence
  source 1..20: mol_type = other DNA
ggaggctgaggccggtggat

SEQ ID NO: 23263 - DNA, 20 bp, synthetic construct
  misc_feature 1..20: note = CRISPR gRNA sequence
  source 1..20: mol_type = other DNA
aggccggtggatcacctggg

SEQ ID NO: 23264 - DNA, 20 bp, synthetic construct
  misc_feature 1..20: note = CRISPR gRNA sequence
  source 1..20: mol_type = other DNA
ggatcaggagttcgagacca

SEQ ID NO: 23265 - DNA, 20 bp, synthetic construct
  misc_feature 1..20: note = CRISPR gRNA sequence
  source 1..20: mol_type = other DNA
gagaccagcctgggcaacat

SEQ ID NO: 23266 - DNA, 20 bp, synthetic construct
  misc_feature 1..20: note = CRISPR gRNA sequence
  source 1..20: mol_type = other DNA
ggcaacatggtgaaacaccg

SEQ ID NO: 23267 - DNA, 20 bp, synthetic construct
  misc_feature 1..20: note = CRISPR gRNA sequence
  source 1..20: mol_type = other DNA
tcctaaaaatacaaaattag

SEQ ID NO: 23268 - DNA, 20 bp, synthetic construct
  misc_feature 1..20: note = CRISPR gRNA sequence
  source 1..20: mol_type = other DNA
ctaaaaatacaaaattagcc

SEQ ID NO: 23269 - DNA, 20 bp, synthetic construct
  misc_feature 1..20: note = CRISPR gRNA sequence
  source 1..20: mol_type = other DNA
aaaatacaaaattagccggg

SEQ ID NO: 23270 - DNA, 20 bp, synthetic construct
  misc_feature 1..20: note = CRISPR gRNA sequence
  source 1..20: mol_type = other DNA
gccgggtgtagtggtgcatg

SEQ ID NO: 23271 - DNA, 20 bp, synthetic construct
  misc_feature 1..20: note = CRISPR gRNA sequence
  source 1..20: mol_type = other DNA
taatcccagctactcggtag

SEQ ID NO: 23272 - DNA, 20 bp, synthetic construct
  misc_feature 1..20: note = CRISPR gRNA sequence
  source 1..20: mol_type = other DNA
ctcggtaggctggtggagga

SEQ ID NO: 23273 - DNA, 20 bp, synthetic construct
  misc_feature 1..20: note = CRISPR gRNA sequence
  source 1..20: mol_type = other DNA
ggtaggctggtggaggagaa

SEQ ID NO: 23274 - DNA, 20 bp, synthetic construct
  misc_feature 1..20: note = CRISPR gRNA sequence
  source 1..20: mol_type = other DNA
gtggaggagaatcgcctgaa

SEQ ID NO: 23275 - DNA, 20 bp, synthetic construct
  misc_feature 1..20: note = CRISPR gRNA sequence
  source 1..20: mol_type = other DNA
aacccaggaggcggagattg

SEQ ID NO: 23276 - DNA, 20 bp, synthetic construct
  misc_feature 1..20: note = CRISPR gRNA sequence
  source 1..20: mol_type = other DNA
cggtgagccgagatcacacc

SEQ ID NO: 23277 - DNA, 20 bp, synthetic construct
  misc_feature 1..20: note = CRISPR gRNA sequence
  source 1..20: mol_type = other DNA
cactccagcctgggcaacaa

SEQ ID NO: 23278 - DNA, 20 bp, synthetic construct
  misc_feature 1..20: note = CRISPR gRNA sequence
  source 1..20: mol_type = other DNA
cagcctgggcaacaagagtg

SEQ ID NO: 23279 - DNA, 20 bp, synthetic construct
  misc_feature 1..20: note = CRISPR gRNA sequence
  source 1..20: mol_type = other DNA
ggcaacaagagtgaaactcc

SEQ ID NO: 23280 - DNA, 20 bp, synthetic construct
  misc_feature 1..20: note = CRISPR gRNA sequence
  source 1..20: mol_type = other DNA
cgtctcaaaaaaaatgaaag

SEQ ID NO: 23281 - DNA, 20 bp, synthetic construct
  misc_feature 1..20: note = CRISPR gRNA sequence
  source 1..20: mol_type = other DNA
aaaaaaaatgaaagaaaata

SEQ ID NO: 23282 - DNA, 20 bp, synthetic construct
  misc_feature 1..20: note = CRISPR gRNA sequence
  source 1..20: mol_type = other DNA
ctgggcccggctgcagactc

SEQ ID NO: 23283 - DNA, 20 bp, synthetic construct
  misc_feature 1..20: note = CRISPR gRNA sequence
  source 1..20: mol_type = other DNA
ggcccggctgcagactccct

SEQ ID NO: 23284 - DNA, 20 bp, synthetic construct
  misc_feature 1..20: note = CRISPR gRNA sequence
  source 1..20: mol_type = other DNA
cagactccctgaatagaatc

SEQ ID NO: 23285 - DNA, 20 bp, synthetic construct
  misc_feature 1..20: note = CRISPR gRNA sequence
  source 1..20: mol_type = other DNA
cctgaatagaatcactgggg

SEQ ID NO: 23286 - DNA, 20 bp, synthetic construct
  misc_feature 1..20: note = CRISPR gRNA sequence
  source 1..20: mol_type = other DNA
aatagaatcactgggggtga

SEQ ID NO: 23287 - DNA, 20 bp, synthetic construct
  misc_feature 1..20: note = CRISPR gRNA sequence
  source 1..20: mol_type = other DNA
ggggtgaggcccaggacgct

SEQ ID NO: 23288 - DNA, 20 bp, synthetic construct
  misc_feature 1..20: note = CRISPR gRNA sequence
  source 1..20: mol_type = other DNA
tgtttttaacacccttccca

SEQ ID NO: 23289 - DNA, 20 bp, synthetic construct
  misc_feature 1..20: note = CRISPR gRNA sequence
  source 1..20: mol_type = other DNA
ttaacacccttcccaggtaa

SEQ ID NO: 23290 - DNA, 20 bp, synthetic construct
  misc_feature 1..20: note = CRISPR gRNA sequence
  source 1..20: mol_type = other DNA
taacacccttcccaggtaat

SEQ ID NO: 23291 - DNA, 20 bp, synthetic construct
  misc_feature 1..20: note = CRISPR gRNA sequence
  source 1..20: mol_type = other DNA
aacacccttcccaggtaatt

SEQ ID NO: 23292 - DNA, 20 bp, synthetic construct
  misc_feature 1..20: note = CRISPR gRNA sequence
  source 1..20: mol_type = other DNA
acacccttcccaggtaattc

SEQ ID NO: 23293 - DNA, 20 bp, synthetic construct
  misc_feature 1..20: note = CRISPR gRNA sequence
  source 1..20: mol_type = other DNA
cccaggtaattctcactcac

SEQ ID NO: 23294 - DNA, 20 bp, synthetic construct
  misc_feature 1..20: note = CRISPR gRNA sequence
  source 1..20: mol_type = other DNA
ccaggtaattctcactcaca

SEQ ID NO: 23295 - DNA, 20 bp, synthetic construct
  misc_feature 1..20: note = CRISPR gRNA sequence
  source 1..20: mol_type = other DNA
tcactcacagccaagcctgc

SEQ ID NO: 23296 - DNA, 20 bp, synthetic construct
  misc_feature 1..20: note = CRISPR gRNA sequence
  source 1..20: mol_type = other DNA
actcacagccaagcctgccg

SEQ ID NO: 23297 - DNA, 20 bp, synthetic construct
  misc_feature 1..20: note = CRISPR gRNA sequence
  source 1..20: mol_type = other DNA
acagccaagcctgccgatgg

SEQ ID NO: 23298 - DNA, 20 bp, synthetic construct
  misc_feature 1..20: note = CRISPR gRNA sequence
  source 1..20: mol_type = other DNA
ccgatggctggactccgtag

SEQ ID NO: 23299 - DNA, 20 bp, synthetic construct
  misc_feature 1..20: note = CRISPR gRNA sequence
  source 1..20: mol_type = other DNA
gactccgtagtcagatctca

SEQ ID NO: 23300 - DNA, 20 bp, synthetic construct
  misc_feature 1..20: note = CRISPR gRNA sequence
  source 1..20: mol_type = other DNA
cgtagtcagatctcagcaag

SEQ ID NO: 23301 - DNA, 20 bp, synthetic construct
  misc_feature 1..20: note = CRISPR gRNA sequence
  source 1..20: mol_type = other DNA
agcaagcaggactggctcgt

SEQ ID NO: 23302 - DNA, 20 bp, synthetic construct
  misc_feature 1..20: note = CRISPR gRNA sequence
  source 1..20: mol_type = other DNA
gctcgtggttcatcttgggg

SEQ ID NO: 23303 - DNA, 20 bp, synthetic construct
  misc_feature 1..20: note = CRISPR gRNA sequence
  source 1..20: mol_type = other DNA
gtggttcatcttggggtctc

SEQ ID NO: 23304 - DNA, 20 bp, synthetic construct
  misc_feature 1..20: note = CRISPR gRNA sequence
  source 1..20: mol_type = other DNA
atcttggggtctccagcacc

SEQ ID NO: 23305 - DNA, 20 bp, synthetic construct
  misc_feature 1..20: note = CRISPR gRNA sequence
  source 1..20: mol_type = other DNA
ggggtctccagcacccagca

SEQ ID NO: 23306 - DNA, 20 bp, synthetic construct
  misc_feature 1..20: note = CRISPR gRNA sequence
  source 1..20: mol_type = other DNA
gggtctccagcacccagcag

SEQ ID NO: 23307 - DNA, 20 bp, synthetic construct
  misc_feature 1..20: note = CRISPR gRNA sequence
  source 1..20: mol_type = other DNA
cagcacccagcagagtgctg

SEQ ID NO: 23308 - DNA, 20 bp, synthetic construct
  misc_feature 1..20: note = CRISPR gRNA sequence
  source 1..20: mol_type = other DNA
gcggggggactgtgttaagt

SEQ ID NO: 23309 - DNA, 20 bp, synthetic construct
  misc_feature 1..20: note = CRISPR gRNA sequence
  source 1..20: mol_type = other DNA
tgttaagtagagccggatgg

SEQ ID NO: 23310 - DNA, 20 bp, synthetic construct
  misc_feature 1..20: note = CRISPR gRNA sequence
  source 1..20: mol_type = other DNA
agtagagccggatgggtcag

SEQ ID NO: 23311 - DNA, 20 bp, synthetic construct
  misc_feature 1..20: note = CRISPR gRNA sequence
  source 1..20: mol_type = other DNA
gagtgtggggcctggctttg

SEQ ID NO: 23312 - DNA, 20 bp, synthetic construct
  misc_feature 1..20: note = CRISPR gRNA sequence
  source 1..20: mol_type = other DNA
gctttgctaactgcagtcac

SEQ ID NO: 23313 - DNA, 20 bp, synthetic construct
  misc_feature 1..20: note = CRISPR gRNA sequence
  source 1..20: mol_type = other DNA
tgctaactgcagtcacaaga

SEQ ID NO: 23314 - DNA, 20 bp, synthetic construct
  misc_feature 1..20: note = CRISPR gRNA sequence
  source 1..20: mol_type = other DNA
gctaactgcagtcacaagat

SEQ ID NO: 23315 - DNA, 20 bp, synthetic construct
  misc_feature 1..20: note = CRISPR gRNA sequence
  source 1..20: mol_type = other DNA
ctaactgcagtcacaagatc

SEQ ID NO: 23316 - DNA, 20 bp, synthetic construct
  misc_feature 1..20: note = CRISPR gRNA sequence
  source 1..20: mol_type = other DNA
actgcagtcacaagatcctc

SEQ ID NO: 23317 - DNA, 20 bp, synthetic construct
  misc_feature 1..20: note = CRISPR gRNA sequence
  source 1..20: mol_type = other DNA
cagtcacaagatcctcatca

SEQ ID NO: 23318 - DNA, 20 bp, synthetic construct
  misc_feature 1..20: note = CRISPR gRNA sequence
  source 1..20: mol_type = other DNA
atcactccaccccctacccc

SEQ ID NO: 23319 - DNA, 20 bp, synthetic construct
  misc_feature 1..20: note = CRISPR gRNA sequence
  source 1..20: mol_type = other DNA
caccccctaccccagcacca

SEQ ID NO: 23320 - DNA, 20 bp, synthetic construct
  misc_feature 1..20: note = CRISPR gRNA sequence
  source 1..20: mol_type = other DNA
ccccagcaccagggtcaggt

SEQ ID NO: 23321 - DNA, 20 bp, synthetic construct
  misc_feature 1..20: note = CRISPR gRNA sequence
  source 1..20: mol_type = other DNA
ccttccaggaaaaacttgtt

SEQ ID NO: 23322 - DNA, 20 bp, synthetic construct
  misc_feature 1..20: note = CRISPR gRNA sequence
  source 1..20: mol_type = other DNA
ccaggaaaaacttgttggac

SEQ ID NO: 23323 - DNA, 20 bp, synthetic construct
  misc_feature 1..20: note = CRISPR gRNA sequence
  source 1..20: mol_type = other DNA
caggaaaaacttgttggact

SEQ ID NO: 23324 - DNA, 20 bp, synthetic construct
  misc_feature 1..20: note = CRISPR gRNA sequence
  source 1..20: mol_type = other DNA
gttggactcctttccaggtc

SEQ ID NO: 23325 - DNA, 20 bp, synthetic construct
  misc_feature 1..20: note = CRISPR gRNA sequence
  source 1..20: mol_type = other DNA
ttggactcctttccaggtca

SEQ ID NO: 23326 - DNA, 20 bp, synthetic construct
  misc_feature 1..20: note = CRISPR gRNA sequence
  source 1..20: mol_type = other DNA
gactcctttccaggtcattg

SEQ ID NO: 23327 - DNA, 20 bp, synthetic construct
  misc_feature 1..20: note = CRISPR gRNA sequence
  source 1..20: mol_type = other DNA
ctttccaggtcattgactgc

SEQ ID NO: 23328 - DNA, 20 bp, synthetic construct
  misc_feature 1..20: note = CRISPR gRNA sequence
  source 1..20: mol_type = other DNA
tccaggtcattgactgcagt

SEQ ID NO: 23329 - DNA, 20 bp, synthetic construct
  misc_feature 1..20: note = CRISPR gRNA sequence
  source 1..20: mol_type = other DNA
ccaggtcattgactgcagtt

SEQ ID NO: 23330 - DNA, 20 bp, synthetic construct
  misc_feature 1..20: note = CRISPR gRNA sequence
  source 1..20: mol_type = other DNA
caggtcattgactgcagtta

SEQ ID NO: 23331 - DNA, 20 bp, synthetic construct
  misc_feature 1..20: note = CRISPR gRNA sequence
  source 1..20: mol_type = other DNA
actgcagttaggagtggcat

SEQ ID NO: 23332 - DNA, 20 bp, synthetic construct
  misc_feature 1..20: note = CRISPR gRNA sequence
  source 1..20: mol_type = other DNA
cagttaggagtggcatgcag

SEQ ID NO: 23333 - DNA, 20 bp, synthetic construct
  misc_feature 1..20: note = CRISPR gRNA sequence
  source 1..20: mol_type = other DNA
ggagtggcatgcagaaggga

SEQ ID NO: 23334 - DNA, 20 bp, synthetic construct
  misc_feature 1..20: note = CRISPR gRNA sequence
  source 1..20: mol_type = other DNA
tctggagctgggacagacca

SEQ ID NO: 23335 - DNA, 20 bp, synthetic construct
  misc_feature 1..20: note = CRISPR gRNA sequence
  source 1..20: mol_type = other DNA
gagctgggacagaccaggca

SEQ ID NO: 23336 - DNA, 20 bp, synthetic construct
  misc_feature 1..20: note = CRISPR gRNA sequence
  source 1..20: mol_type = other DNA
ggacagaccaggcaagcggg

SEQ ID NO: 23337 - DNA, 20 bp, synthetic construct
  misc_feature 1..20: note = CRISPR gRNA sequence
  source 1..20: mol_type = other DNA
ttatcccaaccctgcattct

SEQ ID NO: 23338 - DNA, 20 bp, synthetic construct
  misc_feature 1..20: note = CRISPR gRNA sequence
  source 1..20: mol_type = other DNA
atcccaaccctgcattctgg

SEQ ID NO: 23339 - DNA, 20 bp, synthetic construct
  misc_feature 1..20: note = CRISPR gRNA sequence
  source 1..20: mol_type = other DNA
tcccaaccctgcattctgga

SEQ ID NO: 23340 - DNA, 20 bp, synthetic construct
  misc_feature 1..20: note = CRISPR gRNA sequence
  source 1..20: mol_type = other DNA
cattctggacagggaccgaa

SEQ ID NO: 23341 - DNA, 20 bp, synthetic construct
  misc_feature 1..20: note = CRISPR gRNA sequence
  source 1..20: mol_type = other DNA
tggacagggaccgaaggtct

SEQ ID NO: 23342 - DNA, 20 bp, synthetic construct
  misc_feature 1..20: note = CRISPR gRNA sequence
  source 1..20: mol_type = other DNA
gacagggaccgaaggtctcc

SEQ ID NO: 23343 - DNA, 20 bp, synthetic construct
  misc_feature 1..20: note = CRISPR gRNA sequence
  source 1..20: mol_type = other DNA
ctggctgcagctcatacagc

SEQ ID NO: 23344 - DNA, 20 bp, synthetic construct
  misc_feature 1..20: note = CRISPR gRNA sequence
  source 1..20: mol_type = other DNA
gctgcagctcatacagctca

SEQ ID NO: 23345 - DNA, 20 bp, synthetic construct
  misc_feature 1..20: note = CRISPR gRNA sequence
  source 1..20: mol_type = other DNA
cagctcatacagctcatctt

SEQ ID NO: 23346 - DNA, 20 bp, synthetic construct
  misc_feature 1..20: note = CRISPR gRNA sequence
  source 1..20: mol_type = other DNA
atacagctcatcttcattct

SEQ ID NO: 23347 - DNA, 20 bp, synthetic construct
  misc_feature 1..20: note = CRISPR gRNA sequence
  source 1..20: mol_type = other DNA
atcttcattctcatcctggg

SEQ ID NO: 23348 - DNA, 20 bp, synthetic construct
  misc_feature 1..20: note = CRISPR gRNA sequence
  source 1..20: mol_type = other DNA
cattctcatcctgggaccac

SEQ ID NO: 23349 - DNA, 20 bp, synthetic construct
  misc_feature 1..20: note = CRISPR gRNA sequence
  source 1..20: mol_type = other DNA
attctcatcctgggaccacc

SEQ ID NO: 23350 - DNA, 20 bp, synthetic construct
  misc_feature 1..20: note = CRISPR gRNA sequence
  source 1..20: mol_type = other DNA
tcatcctgggaccaccaggc

SEQ ID NO: 23351 - DNA, 20 bp, synthetic construct
  misc_feature 1..20: note = CRISPR gRNA sequence
  source 1..20: mol_type = other DNA
atcctgggaccaccaggccc

SEQ ID NO: 23352 - DNA, 20 bp, synthetic construct
  misc_feature 1..20: note = CRISPR gRNA sequence
  source 1..20: mol_type = other DNA
ggaccaccaggcccctcacc

SEQ ID NO: 23353 - DNA, 20 bp, synthetic construct
  misc_feature 1..20: note = CRISPR gRNA sequence
  source 1..20: mol_type = other DNA
acccacaataactttaccct

SEQ ID NO: 23354 - DNA, 20 bp, synthetic construct
  misc_feature 1..20: note = CRISPR gRNA sequence
  source 1..20: mol_type = other DNA
taccctttactggcaaatgc

SEQ ID NO: 23355 - DNA, 20 bp, synthetic construct
  misc_feature 1..20: note = CRISPR gRNA sequence
  source 1..20: mol_type = other DNA
accctttactggcaaatgca

SEQ ID NO: 23356 - DNA, 20 bp, synthetic construct
  misc_feature 1..20: note = CRISPR gRNA sequence
  source 1..20: mol_type = other DNA
ccctttactggcaaatgcac

SEQ ID NO: 23357 - DNA, 20 bp, synthetic construct
  misc_feature 1..20: note = CRISPR gRNA sequence
  source 1..20: mol_type = other DNA
tactggcaaatgcacaagct

SEQ ID NO: 23358 - DNA, 20 bp, synthetic construct
  misc_feature 1..20: note = CRISPR gRNA sequence
  source 1..20: mol_type = other DNA
actggcaaatgcacaagctg

SEQ ID NO: 23359 - DNA, 20 bp, synthetic construct
  misc_feature 1..20: note = CRISPR gRNA sequence
  source 1..20: mol_type = other DNA
ctggcaaatgcacaagctgg

SEQ ID NO: 23360 - DNA, 20 bp, synthetic construct
  misc_feature 1..20: note = CRISPR gRNA sequence
  source 1..20: mol_type = other DNA
gcaaatgcacaagctggaga

SEQ ID NO: 23361 - DNA, 20 bp, synthetic construct
  misc_feature 1..20: note = CRISPR gRNA sequence
  source 1..20: mol_type = other DNA
gagatgatggcccattcgag

SEQ ID NO: 23362 - DNA, 20 bp, synthetic construct
  misc_feature 1..20: note = CRISPR gRNA sequence
  source 1..20: mol_type = other DNA
gagttttaagattttccaag

SEQ ID NO: 23363 - DNA, 20 bp, synthetic construct
  misc_feature 1..20: note = CRISPR gRNA sequence
  source 1..20: mol_type = other DNA
taagattttccaagttgtta

SEQ ID NO: 23364 - DNA, 20 bp, synthetic construct
  misc_feature 1..20: note = CRISPR gRNA sequence
  source 1..20: mol_type = other DNA
aagattttccaagttgttat

SEQ ID NO: 23365 - DNA, 20 bp, synthetic construct
  misc_feature 1..20: note = CRISPR gRNA sequence
  source 1..20: mol_type = other DNA
agattttccaagttgttatg

SEQ ID NO: 23366 - DNA, 20 bp, synthetic construct
  misc_feature 1..20: note = CRISPR gRNA sequence
  source 1..20: mol_type = other DNA
tccaagttgttatgaggtca

SEQ ID NO: 23367 - DNA, 20 bp, synthetic construct
  misc_feature 1..20: note = CRISPR gRNA sequence
  source 1..20: mol_type = other DNA
ccaagttgttatgaggtcag

SEQ ID NO: 23368 - DNA, 20 bp, synthetic construct
  misc_feature 1..20: note = CRISPR gRNA sequence
  source 1..20: mol_type = other DNA
caagttgttatgaggtcagt

SEQ ID NO: 23369 - DNA, 20 bp, synthetic construct
  misc_feature 1..20: note = CRISPR gRNA sequence
  source 1..20: mol_type = other DNA
ttatgaggtcagtgtcctca

SEQ ID NO: 23370 - DNA, 20 bp, synthetic construct
  misc_feature 1..20: note = CRISPR gRNA sequence
  source 1..20: mol_type = other DNA
tgaggtcagtgtcctcaatc

SEQ ID NO: 23371 - DNA, 20 bp, synthetic construct
  misc_feature 1..20: note = CRISPR gRNA sequence
  source 1..20: mol_type = other DNA
aatcgggacccagagaagat

SEQ ID NO: 23372 - DNA, 20 bp, synthetic construct
  misc_feature 1..20: note = CRISPR gRNA sequence
  source 1..20: mol_type = other DNA
gcctgaactttcagaggggg

SEQ ID NO: 23373 - DNA, 20 bp, synthetic construct
  misc_feature 1..20: note = CRISPR gRNA sequence
  source 1..20: mol_type = other DNA
cctgaactttcagagggggc

SEQ ID NO: 23374 - DNA, 20 bp, synthetic construct
  misc_feature 1..20: note = CRISPR gRNA sequence
  source 1..20: mol_type = other DNA
aactttcagagggggcatct

SEQ ID NO: 23375 - DNA, 20 bp, synthetic construct
  misc_feature 1..20: note = CRISPR gRNA sequence
  source 1..20: mol_type = other DNA
tcagagggggcatctgtggt

SEQ ID NO: 23376 - DNA, 20 bp, synthetic construct
  misc_feature 1..20: note = CRISPR gRNA sequence
  source 1..20: mol_type = other DNA
cagagggggcatctgtggtg

SEQ ID NO: 23377 - DNA, 20 bp, synthetic construct
  misc_feature 1..20: note = CRISPR gRNA sequence
  source 1..20: mol_type = other DNA
agagggggcatctgtggtgt

SEQ ID NO: 23378 - DNA, 20 bp, synthetic construct
  misc_feature 1..20: note = CRISPR gRNA sequence
  source 1..20: mol_type = other DNA
tggtgtcttttgtggggtcc

SEQ ID NO: 23379 - DNA, 20 bp, synthetic construct
  misc_feature 1..20: note = CRISPR gRNA sequence
  source 1..20: mol_type = other DNA
ttgtggggtcctgtaggatt

SEQ ID NO: 23380 - DNA, 20 bp, synthetic construct
  misc_feature 1..20: note = CRISPR gRNA sequence
  source 1..20: mol_type = other DNA
tgtggggtcctgtaggattt

SEQ ID NO: 23381 - DNA, 20 bp, synthetic construct
  misc_feature 1..20: note = CRISPR gRNA sequence
  source 1..20: mol_type = other DNA
gtggggtcctgtaggatttc

SEQ ID NO: 23382 - DNA, 20 bp, synthetic construct
  misc_feature 1..20: note = CRISPR gRNA sequence
  source 1..20: mol_type = other DNA
tggggtcctgtaggatttcc

SEQ ID NO: 23383 - DNA, 20 bp, synthetic construct
  misc_feature 1..20: note = CRISPR gRNA sequence
  source 1..20: mol_type = other DNA
taggatttccacgtccctct

SEQ ID NO: 23384 - DNA, 20 bp, synthetic construct
  misc_feature 1..20: note = CRISPR gRNA sequence
  source 1..20: mol_type = other DNA
ccacgtccctcttggaggaa

SEQ ID NO: 23385 - DNA, 20 bp, synthetic construct
  misc_feature 1..20: note = CRISPR gRNA sequence
  source 1..20: mol_type = other DNA
cacgtccctcttggaggaaa

SEQ ID NO: 23386 - DNA, 20 bp, synthetic construct
  misc_feature 1..20: note = CRISPR gRNA sequence
  source 1..20: mol_type = other DNA
ttggaggaaaaatagaagta

SEQ ID NO: 23387 - DNA, 20 bp, synthetic construct
  misc_feature 1..20: note = CRISPR gRNA sequence
  source 1..20: mol_type = other DNA
ggaggaaaaatagaagtaag

SEQ ID NO: 23388 - DNA, 20 bp, synthetic construct
  misc_feature 1..20: note = CRISPR gRNA sequence
  source 1..20: mol_type = other DNA
gaggaaaaatagaagtaagt

SEQ ID NO: 23389 - DNA, 20 bp, synthetic construct
  misc_feature 1..20: note = CRISPR gRNA sequence
  source 1..20: mol_type = other DNA
tctcaggtcagattgtctgg

SEQ ID NO: 23390 - DNA, 20 bp, synthetic construct
  misc_feature 1..20: note = CRISPR gRNA sequence
  source 1..20: mol_type = other DNA
aggtcagattgtctgggaag

SEQ ID NO: 23391 - DNA, 20 bp, synthetic construct
  misc_feature 1..20: note = CRISPR gRNA sequence
  source 1..20: mol_type = other DNA
tctgggaagccaagtaggag

SEQ ID NO: 23392 - DNA, 20 bp, synthetic construct
  misc_feature 1..20: note = CRISPR gRNA sequence
  source 1..20: mol_type = other DNA
ggaagccaagtaggagatgg

SEQ ID NO: 23393 - DNA, 20 bp, synthetic construct
  misc_feature 1..20: note = CRISPR gRNA sequence
  source 1..20: mol_type = other DNA
gcatataggaggtttactgg

SEQ ID NO: 23394 - DNA, 20 bp, synthetic construct
  misc_feature 1..20: note = CRISPR gRNA sequence
  source 1..20: mol_type = other DNA
catataggaggtttactggg

SEQ ID NO: 23395 - DNA, 20 bp, synthetic construct
  misc_feature 1..20: note = CRISPR gRNA sequence
  source 1..20: mol_type = other DNA
actggggacattcacaggag

SEQ ID NO: 23396 - DNA, 20 bp, synthetic construct
  misc_feature 1..20: note = CRISPR gRNA sequence
  source 1..20: mol_type = other DNA
ctggggacattcacaggagg

SEQ ID NO: 23397 - DNA, 20 bp, synthetic construct
  misc_feature 1..20: note = CRISPR gRNA sequence
  source 1..20: mol_type = other DNA
gggacattcacaggagggaa

SEQ ID NO: 23398 - DNA, 20 bp, synthetic construct
  misc_feature 1..20: note = CRISPR gRNA sequence
  source 1..20: mol_type = other DNA
acaggagggaacacccgaag

SEQ ID NO: 23399 - DNA, 20 bp, synthetic construct
  misc_feature 1..20: note = CRISPR gRNA sequence
  source 1..20: mol_type = other DNA
ggaagcagcaggagttgagg

SEQ ID NO: 23400 - DNA, 20 bp, synthetic construct
  misc_feature 1..20: note = CRISPR gRNA sequence
  source 1..20: mol_type = other DNA
aggtgcaatgcagtcacaac

SEQ ID NO: 23401 - DNA, 20 bp, synthetic construct
  misc_feature 1..20: note = CRISPR gRNA sequence
  source 1..20: mol_type = other DNA
agccaatcccatagggagca

SEQ ID NO: 23402 - DNA, 20 bp, synthetic construct
  misc_feature 1..20: note = CRISPR gRNA sequence
  source 1..20: mol_type = other DNA
gccaatcccatagggagcac

SEQ ID NO: 23403 - DNA, 20 bp, synthetic construct
  misc_feature 1..20: note = CRISPR gRNA sequence
  source 1..20: mol_type = other DNA
aagctgggacagcaaggaag

SEQ ID NO: 23404 - DNA, 20 bp, synthetic construct
  misc_feature 1..20: note = CRISPR gRNA sequence
  source 1..20: mol_type = other DNA
ggacagcaaggaagctagac

SEQ ID NO: 23405 - DNA, 20 bp, synthetic construct
  misc_feature 1..20: note = CRISPR gRNA sequence
  source 1..20: mol_type = other DNA
gaccttcacatccctcatct

SEQ ID NO: 23406 - DNA, 20 bp, synthetic construct
  misc_feature 1..20: note = CRISPR gRNA sequence
  source 1..20: mol_type = other DNA
cacatccctcatctacctcc

SEQ ID NO: 23407 - DNA, 20 bp, synthetic construct
  misc_feature 1..20: note = CRISPR gRNA sequence
  source 1..20: mol_type = other DNA
acatccctcatctacctccg

SEQ ID NO: 23408 - DNA, 20 bp, synthetic construct
  misc_feature 1..20: note = CRISPR gRNA sequence
  source 1..20: mol_type = other DNA
atctacctccgtcctcccat

SEQ ID NO: 23409 - DNA, 20 bp, synthetic construct
  misc_feature 1..20: note = CRISPR gRNA sequence
  source 1..20: mol_type = other DNA
cctccgtcctcccatacagg

SEQ ID NO: 23410 - DNA, 20 bp, synthetic construct
  misc_feature 1..20: note = CRISPR gRNA sequence
  source 1..20: mol_type = other DNA
cgtcctcccatacaggcata

SEQ ID NO: 23411 - DNA, 20 bp, synthetic construct
  misc_feature 1..20: note = CRISPR gRNA sequence
  source 1..20: mol_type = other DNA
ccatacaggcatagcctccc

SEQ ID NO: 23412 - DNA, 20 bp, synthetic construct
  misc_feature 1..20: note = CRISPR gRNA sequence
  source 1..20: mol_type = other DNA
ccccatgatgaacactcagc

SEQ ID NO: 23413 - DNA, 20 bp, synthetic construct
  misc_feature 1..20: note = CRISPR gRNA sequence
  source 1..20: mol_type = other DNA
agcaccagactgatacattt

SEQ ID NO: 23414 - DNA, 20 bp, synthetic construct
  misc_feature 1..20: note = CRISPR gRNA sequence
  source 1..20: mol_type = other DNA
atacatttgttataatcaat

SEQ ID NO: 23415 - DNA, 20 bp, synthetic construct
  misc_feature 1..20: note = CRISPR gRNA sequence
  source 1..20: mol_type = other DNA
gttataatcaatgaacctac

SEQ ID NO: 23416 - DNA, 20 bp, synthetic construct
  misc_feature 1..20: note = CRISPR gRNA sequence
  source 1..20: mol_type = other DNA
ttataatcaatgaacctaca

SEQ ID NO: 23417 - DNA, 20 bp, synthetic construct
  misc_feature 1..20: note = CRISPR gRNA sequence
  source 1..20: mol_type = other DNA
taatcaatgaacctacattg

SEQ ID NO: 23418 - DNA, 20 bp, synthetic construct
  misc_feature 1..20: note = CRISPR gRNA sequence
  source 1..20: mol_type = other DNA
cattgatgcatcattattac

SEQ ID NO: 23419 - DNA, 20 bp, synthetic construct
  misc_feature 1..20: note = CRISPR gRNA sequence
  source 1..20: mol_type = other DNA
atgcatcattattacccaag

SEQ ID NO: 23420 - DNA, 20 bp, synthetic construct
  misc_feature 1..20: note = CRISPR gRNA sequence
  source 1..20: mol_type = other DNA
ttacccaaggtccatggttt

SEQ ID NO: 23421 - DNA, 20 bp, synthetic construct
  misc_feature 1..20: note = CRISPR gRNA sequence
  source 1..20: mol_type = other DNA
cccaaggtccatggtttgtt

SEQ ID NO: 23422 - DNA, 20 bp, synthetic construct
  misc_feature 1..20: note = CRISPR gRNA sequence
  source 1..20: mol_type = other DNA
gtttacatgagggtttactc

SEQ ID NO: 23423 - DNA, 20 bp, synthetic construct
  misc_feature 1..20: note = CRISPR gRNA sequence
  source 1..20: mol_type = other DNA
tttacatgagggtttactct

SEQ ID NO: 23424 - DNA, 20 bp, synthetic construct
  misc_feature 1..20: note = CRISPR gRNA sequence
  source 1..20: mol_type = other DNA
acatgagggtttactcttgg

SEQ ID NO: 23425 - DNA, 20 bp, synthetic construct
  misc_feature 1..20: note = CRISPR gRNA sequence
  source 1..20: mol_type = other DNA
catgagggtttactcttggt

SEQ ID NO: 23426 - DNA, 20 bp, synthetic construct
  misc_feature 1..20: note = CRISPR gRNA sequence
  source 1..20: mol_type = other DNA
actcttggtgttgtacattc

SEQ ID NO: 23427 - DNA, 20 bp, synthetic construct
  misc_feature 1..20: note = CRISPR gRNA sequence
  source 1..20: mol_type = other DNA
ctcttggtgttgtacattct

SEQ ID NO: 23428 - DNA, 20 bp, synthetic construct
  misc_feature 1..20: note = CRISPR gRNA sequence
  source 1..20: mol_type = other DNA
ttggtgttgtacattctgtg

SEQ ID NO: 23429 - DNA, 20 bp, synthetic construct
  misc_feature 1..20: note = CRISPR gRNA sequence
  source 1..20: mol_type = other DNA
ggtgttgtacattctgtggg

SEQ ID NO: 23430 - DNA, 20 bp, synthetic construct
  misc_feature 1..20: note = CRISPR gRNA sequence
  source 1..20: mol_type = other DNA
gtgttgtacattctgtgggt

SEQ ID NO: 23431 - DNA, 20 bp, synthetic construct
  misc_feature 1..20: note = CRISPR gRNA sequence
  source 1..20: mol_type = other DNA
tacattctgtgggtttggac

SEQ ID NO: 23432 - DNA, 20 bp, synthetic construct
  misc_feature 1..20: note = CRISPR gRNA sequence
  source 1..20: mol_type = other DNA
tgtgggtttggacagataca

SEQ ID NO: 23433 - DNA, 20 bp, synthetic construct
  misc_feature 1..20: note = CRISPR gRNA sequence
  source 1..20: mol_type = other DNA
tgggtttggacagatacatg

SEQ ID NO: 23434 - DNA, 20 bp, synthetic construct
  misc_feature 1..20: note = CRISPR gRNA sequence
  source 1..20: mol_type = other DNA
ggacagatacatgatgtaat

SEQ ID NO: 23435 - DNA, 20 bp, synthetic construct
  misc_feature 1..20: note = CRISPR gRNA sequence
  source 1..20: mol_type = other DNA
gacagatacatgatgtaatg

SEQ ID NO: 23436 - DNA, 20 bp, synthetic construct
  misc_feature 1..20: note = CRISPR gRNA sequence
  source 1..20: mol_type = other DNA
tagtatcacacagactcatt

SEQ ID NO: 23437 - DNA, 20 bp, synthetic construct
  misc_feature 1..20: note = CRISPR gRNA sequence
  source 1..20: mol_type = other DNA
atttcacttgtgactgagct

SEQ ID NO: 23438 - DNA, 20 bp, synthetic construct
  misc_feature 1..20: note = CRISPR gRNA sequence
  source 1..20: mol_type = other DNA
cacttgtgactgagcttgtc

SEQ ID NO: 23439 - DNA, 20 bp, synthetic construct
  misc_feature 1..20: note = CRISPR gRNA sequence
  source 1..20: mol_type = other DNA
acttgtgactgagcttgtcc

SEQ ID NO: 23440 - DNA, 20 bp, synthetic construct
  misc_feature 1..20: note = CRISPR gRNA sequence
  source 1..20: mol_type = other DNA
gtgactgagcttgtccttct

SEQ ID NO: 23441 - DNA, 20 bp, synthetic construct
  misc_feature 1..20: note = CRISPR gRNA sequence
  source 1..20: mol_type = other DNA
tgactgagcttgtccttctt

SEQ ID NO: 23442 - DNA, 20 bp, synthetic construct
  misc_feature 1..20: note = CRISPR gRNA sequence
  source 1..20: mol_type = other DNA
agcttgtccttctttcttta

SEQ ID NO: 23443 - DNA, 20 bp, synthetic construct
  misc_feature 1..20: note = CRISPR gRNA sequence
  source 1..20: mol_type = other DNA
gtccttctttctttaacctg

SEQ ID NO: 23444 - DNA, 20 bp, synthetic construct
  misc_feature 1..20: note = CRISPR gRNA sequence
  source 1..20: mol_type = other DNA
tccttctttctttaacctgc

SEQ ID NO: 23445 - DNA, 20 bp, synthetic construct
  misc_feature 1..20: note = CRISPR gRNA sequence
  source 1..20: mol_type = other DNA
ctttctttaacctgcctcca

SEQ ID NO: 23446 - DNA, 20 bp, synthetic construct
  misc_feature 1..20: note = CRISPR gRNA sequence
  source 1..20: mol_type = other DNA
tttctttaacctgcctccaa

SEQ ID NO: 23447 - DNA, 20 bp, synthetic construct
  misc_feature 1..20: note = CRISPR gRNA sequence
  source 1..20: mol_type = other DNA
tctttaacctgcctccaact

SEQ ID NO: 23448 - DNA, 20 bp, synthetic construct
  misc_feature 1..20: note = CRISPR gRNA sequence
  source 1..20: mol_type = other DNA
ctttaacctgcctccaactg

SEQ ID NO: 23449 - DNA, 20 bp, synthetic construct
  misc_feature 1..20: note = CRISPR gRNA sequence
  source 1..20: mol_type = other DNA
tttaacctgcctccaactgc

SEQ ID NO: 23450 - DNA, 20 bp, synthetic construct
  misc_feature 1..20: note = CRISPR gRNA sequence
  source 1..20: mol_type = other DNA
taacctgcctccaactgctg

SEQ ID NO: 23451 - DNA, 20 bp, synthetic construct
  misc_feature 1..20: note = CRISPR gRNA sequence
  source 1..20: mol_type = other DNA
aacctgcctccaactgctga

SEQ ID NO: 23452 - DNA, 20 bp, synthetic construct
  misc_feature 1..20: note = CRISPR gRNA sequence
  source 1..20: mol_type = other DNA
acctgcctccaactgctgag

SEQ ID NO: 23453 - DNA, 20 bp, synthetic construct
  misc_feature 1..20: note = CRISPR gRNA sequence
  source 1..20: mol_type = other DNA
cctccaactgctgagaagcc

SEQ ID NO: 23454 - DNA, 20 bp, synthetic construct
  misc_feature 1..20: note = CRISPR gRNA sequence
  source 1..20: mol_type = other DNA
caactgctgagaagcccttt

SEQ ID NO: 23455 - DNA, 20 bp, synthetic construct
  misc_feature 1..20: note = CRISPR gRNA sequence
  source 1..20: mol_type = other DNA
ctgagaagccctttggctag

SEQ ID NO: 23456 - DNA, 20 bp, synthetic construct
  misc_feature 1..20: note = CRISPR gRNA sequence
  source 1..20: mol_type = other DNA
agaagccctttggctaggga

SEQ ID NO: 23457 - DNA, 20 bp, synthetic construct
  misc_feature 1..20: note = CRISPR gRNA sequence
  source 1..20: mol_type = other DNA
tggctagggattgcagccaa

SEQ ID NO: 23458 - DNA, 20 bp, synthetic construct
  misc_feature 1..20: note = CRISPR gRNA sequence
  source 1..20: mol_type = other DNA
ggctagggattgcagccaat

SEQ ID NO: 23459 - DNA, 20 bp, synthetic construct
  misc_feature 1..20: note = CRISPR gRNA sequence
  source 1..20: mol_type = other DNA
gctagggattgcagccaatt

SEQ ID NO: 23460 - DNA, 20 bp, synthetic construct
  misc_feature 1..20: note = CRISPR gRNA sequence
  source 1..20: mol_type = other DNA
gggattgcagccaattttaa

SEQ ID NO: 23461 - DNA, 20 bp, synthetic construct
  misc_feature 1..20: note = CRISPR gRNA sequence
  source 1..20: mol_type = other DNA
cagccaattttaatttgttt

SEQ ID NO: 23462 - DNA, 20 bp, synthetic construct
  misc_feature 1..20: note = CRISPR gRNA sequence
  source 1..20: mol_type = other DNA
taatttgttttccactttcc

SEQ ID NO: 23463 - DNA, 20 bp, synthetic construct
  misc_feature 1..20: note = CRISPR gRNA sequence
  source 1..20: mol_type = other DNA
aatttgttttccactttcct

SEQ ID NO: 23464 - DNA, 20 bp, synthetic construct
  misc_feature 1..20: note = CRISPR gRNA sequence
  source 1..20: mol_type = other DNA
atttgttttccactttcctg

SEQ ID NO: 23465 - DNA, 20 bp, synthetic construct
  misc_feature 1..20: note = CRISPR gRNA sequence
  source 1..20: mol_type = other DNA
gttttccactttcctgctct

SEQ ID NO: 23466 - DNA, 20 bp, synthetic construct
  misc_feature 1..20: note = CRISPR gRNA sequence
  source 1..20: mol_type = other DNA
ttttccactttcctgctctg

SEQ ID NO: 23467 - DNA, 20 bp, synthetic construct
  misc_feature 1..20: note = CRISPR gRNA sequence
  source 1..20: mol_type = other DNA
tccactttcctgctctgaag

SEQ ID NO: 23468 - DNA, 20 bp, synthetic construct
  misc_feature 1..20: note = CRISPR gRNA sequence
  source 1..20: mol_type = other DNA
ccactttcctgctctgaagt

SEQ ID NO: 23469 - DNA, 20 bp, synthetic construct
  misc_feature 1..20: note = CRISPR gRNA sequence
  source 1..20: mol_type = other DNA
cactttcctgctctgaagtt

SEQ ID NO: 23470 - DNA, 20 bp, synthetic construct
  misc_feature 1..20: note = CRISPR gRNA sequence
  source 1..20: mol_type = other DNA
tcctgctctgaagttacttt

SEQ ID NO: 23471 - DNA, 20 bp, synthetic construct
  misc_feature 1..20: note = CRISPR gRNA sequence
  source 1..20: mol_type = other DNA
cctgctctgaagttactttg

SEQ ID NO: 23472 - DNA, 20 bp, synthetic construct
  misc_feature 1..20: note = CRISPR gRNA sequence
  source 1..20: mol_type = other DNA
ctgctctgaagttactttgt

SEQ ID NO: 23473 - DNA, 20 bp, synthetic construct
  misc_feature 1..20: note = CRISPR gRNA sequence
  source 1..20: mol_type = other DNA
ctctgaagttactttgtttg

SEQ ID NO: 23474 - DNA, 20 bp, synthetic construct
  misc_feature 1..20: note = CRISPR gRNA sequence
  source 1..20: mol_type = other DNA
tgaagttactttgtttgcca

SEQ ID NO: 23475 - DNA, 20 bp, synthetic construct
  misc_feature 1..20: note = CRISPR gRNA sequence
  source 1..20: mol_type = other DNA
aagttactttgtttgccaga

SEQ ID NO: 23476 - DNA, 20 bp, synthetic construct
  misc_feature 1..20: note = CRISPR gRNA sequence
  source 1..20: mol_type = other DNA
ctttgtttgccagaggctgg

SEQ ID NO: 23477 - DNA, 20 bp, synthetic construct
  misc_feature 1..20: note = CRISPR gRNA sequence
  source 1..20: mol_type = other DNA
tgtttgccagaggctggttg

SEQ ID NO: 23478 - DNA, 20 bp, synthetic construct
  misc_feature 1..20: note = CRISPR gRNA sequence
  source 1..20: mol_type = other DNA
gtttgccagaggctggttgg

SEQ ID NO: 23479 - DNA, 20 bp, synthetic construct
  misc_feature 1..20: note = CRISPR gRNA sequence
  source 1..20: mol_type = other DNA
tttgccagaggctggttggt

SEQ ID NO: 23480 - DNA, 20 bp, synthetic construct
  misc_feature 1..20: note = CRISPR gRNA sequence
  source 1..20: mol_type = other DNA
gccagaggctggttggttca

SEQ ID NO: 23481 - DNA, 20 bp, synthetic construct
  misc_feature 1..20: note = CRISPR gRNA sequence
  source 1..20: mol_type = other DNA
ccagaggctggttggttcaa

SEQ ID NO: 23482 - DNA, 20 bp, synthetic construct
  misc_feature 1..20: note = CRISPR gRNA sequence
  source 1..20: mol_type = other DNA
gttggttcaaacccaaaggg

SEQ ID NO: 23483 - DNA, 20 bp, synthetic construct
  misc_feature 1..20: note = CRISPR gRNA sequence
  source 1..20: mol_type = other DNA
gttcaaacccaaagggcagg

SEQ ID NO: 23484 - DNA, 20 bp, synthetic construct
  misc_feature 1..20: note = CRISPR gRNA sequence
  source 1..20: mol_type = other DNA
aaacccaaagggcagggagc

SEQ ID NO: 23485 - DNA, 20 bp, synthetic construct
  misc_feature 1..20: note = CRISPR gRNA sequence
  source 1..20: mol_type = other DNA
caatggaaatccattcaacg

SEQ ID NO: 23486 - DNA, 20 bp, synthetic construct
  misc_feature 1..20: note = CRISPR gRNA sequence
  source 1..20: mol_type = other DNA
aacggtgctggaattgggat

SEQ ID NO: 23487 - DNA, 20 bp, synthetic construct
  misc_feature 1..20: note = CRISPR gRNA sequence
  source 1..20: mol_type = other DNA
gaattgggatggcaaaaagg

SEQ ID NO: 23488 - DNA, 20 bp, synthetic construct
  misc_feature 1..20: note = CRISPR gRNA sequence
  source 1..20: mol_type = other DNA
ggatggcaaaaaggagcagc

SEQ ID NO: 23489 - DNA, 20 bp, synthetic construct
  misc_feature 1..20: note = CRISPR gRNA sequence
  source 1..20: mol_type = other DNA
tttgcatcccacagttccca

SEQ ID NO: 23490 - DNA, 20 bp, synthetic construct
  misc_feature 1..20: note = CRISPR gRNA sequence
  source 1..20: mol_type = other DNA
tgcatcccacagttcccagg

SEQ ID NO: 23491 - DNA, 20 bp, synthetic construct
  misc_feature 1..20: note = CRISPR gRNA sequence
  source 1..20: mol_type = other DNA
gcatcccacagttcccaggg

SEQ ID NO: 23492 - DNA, 20 bp, synthetic construct
  misc_feature 1..20: note = CRISPR gRNA sequence
  source 1..20: mol_type = other DNA
catcccacagttcccaggga

SEQ ID NO: 23493 - DNA, 20 bp, synthetic construct
  misc_feature 1..20: note = CRISPR gRNA sequence
  source 1..20: mol_type = other DNA
ccagggagcttaccattctt

SEQ ID NO: 23494 - DNA, 20 bp, synthetic construct
  misc_feature 1..20: note = CRISPR gRNA sequence
  source 1..20: mol_type = other DNA
accattctttcattcattca

SEQ ID NO: 23495 - DNA, 20 bp, synthetic construct
  misc_feature 1..20: note = CRISPR gRNA sequence
  source 1..20: mol_type = other DNA
ccattctttcattcattcat

SEQ ID NO: 23496 - DNA, 20 bp, synthetic construct
  misc_feature 1..20: note = CRISPR gRNA sequence
  source 1..20: mol_type = other DNA
tttcattcattcattcatcc

SEQ ID NO: 23497 - DNA, 20 bp, synthetic construct
  misc_feature 1..20: note = CRISPR gRNA sequence
  source 1..20: mol_type = other DNA
tcattcattcattcatcctt

SEQ ID NO: 23498 - DNA, 20 bp, synthetic construct
  misc_feature 1..20: note = CRISPR gRNA sequence
  source 1..20: mol_type = other DNA
cattcattcattcatccttt

SEQ ID NO: 23499 - DNA, 20 bp, synthetic construct
  misc_feature 1..20: note = CRISPR gRNA sequence
  source 1..20: mol_type = other DNA
attcattcattcatcctttc

SEQ ID NO: 23500 - DNA, 20 bp, synthetic construct
  misc_feature 1..20: note = CRISPR gRNA sequence
  source 1..20: mol_type = other DNA
attcattcatcctttcattt

SEQ ID NO: 23501 - DNA, 20 bp, synthetic construct
  misc_feature 1..20: note = CRISPR gRNA sequence
  source 1..20: mol_type = other DNA
attcatcctttcatttatga

SEQ ID NO: 23502 - DNA, 20 bp, synthetic construct
  misc_feature 1..20: note = CRISPR gRNA sequence
  source 1..20: mol_type = other DNA
atcctttcatttatgagaca

SEQ ID NO: 23503 - DNA, 20 bp, synthetic construct
  misc_feature 1..20: note = CRISPR gRNA sequence
  source 1..20: mol_type = other DNA
tcatttatgagacaaagtct

SEQ ID NO: 23504 - DNA, 20 bp, synthetic construct
  misc_feature 1..20: note = CRISPR gRNA sequence
  source 1..20: mol_type = other DNA
catttatgagacaaagtctc

SEQ ID NO: 23505 - DNA, 20 bp, synthetic construct
  misc_feature 1..20: note = CRISPR gRNA sequence
  source 1..20: mol_type = other DNA
atttatgagacaaagtctca

SEQ ID NO: 23506 - DNA, 20 bp, synthetic construct
  misc_feature 1..20: note = CRISPR gRNA sequence
  source 1..20: mol_type = other DNA
atgagacaaagtctcactct

SEQ ID NO: 23507 - DNA, 20 bp, synthetic construct
  misc_feature 1..20: note = CRISPR gRNA sequence
  source 1..20: mol_type = other DNA
tgagacaaagtctcactctg

SEQ ID NO: 23508 - DNA, 20 bp, synthetic construct
  misc_feature 1..20: note = CRISPR gRNA sequence
  source 1..20: mol_type = other DNA
actctgttgcccaggttgga

SEQ ID NO: 23509 - DNA, 20 bp, synthetic construct
  misc_feature 1..20: note = CRISPR gRNA sequence
  source 1..20: mol_type = other DNA
tgttgcccaggttggagtgc

SEQ ID NO: 23510 - DNA, 20 bp, synthetic construct
  misc_feature 1..20: note = CRISPR gRNA sequence
  source 1..20: mol_type = other DNA
ttgcccaggttggagtgcag

SEQ ID NO: 23511 - DNA, 20 bp, synthetic construct
  misc_feature 1..20: note = CRISPR gRNA sequence
  source 1..20: mol_type = other DNA
cccaggttggagtgcagtgg

SEQ ID NO: 23512 - DNA, 20 bp, synthetic construct
  misc_feature 1..20: note = CRISPR gRNA sequence
  source 1..20: mol_type = other DNA
gagtgcagtggcacagtcat

SEQ ID NO: 23513 - DNA, 20 bp, synthetic construct
  misc_feature 1..20: note = CRISPR gRNA sequence
  source 1..20: mol_type = other DNA
ctcactgcagcctcaagctc

SEQ ID NO: 23514 - DNA, 20 bp, synthetic construct
  misc_feature 1..20: note = CRISPR gRNA sequence
  source 1..20: mol_type = other DNA
actgcagcctcaagctcctg

SEQ ID NO: 23515 - DNA, 20 bp, synthetic construct
  misc_feature 1..20: note = CRISPR gRNA sequence
  source 1..20: mol_type = other DNA
cagcctcaagctcctgagct

SEQ ID NO: 23516 - DNA, 20 bp, synthetic construct
  misc_feature 1..20: note = CRISPR gRNA sequence
  source 1..20: mol_type = other DNA
aagctcctgagctcaagcca

SEQ ID NO: 23517 - DNA, 20 bp, synthetic construct
  misc_feature 1..20: note = CRISPR gRNA sequence
  source 1..20: mol_type = other DNA
ctgagctcaagccatcctcc

SEQ ID NO: 23518 - DNA, 20 bp, synthetic construct
  misc_feature 1..20: note = CRISPR gRNA sequence
  source 1..20: mol_type = other DNA
agctcaagccatcctcctgc

SEQ ID NO: 23519 - DNA, 20 bp, synthetic construct
  misc_feature 1..20: note = CRISPR gRNA sequence
  source 1..20: mol_type = other DNA
aagccatcctcctgcctcag

SEQ ID NO: 23520 - DNA, 20 bp, synthetic construct
  misc_feature 1..20: note = CRISPR gRNA sequence
  source 1..20: mol_type = other DNA
ctgcctcagcctcccaagta

SEQ ID NO: 23521 - DNA, 20 bp, synthetic construct
  misc_feature 1..20: note = CRISPR gRNA sequence
  source 1..20: mol_type = other DNA
cctcagcctcccaagtagcc

SEQ ID NO: 23522 - DNA, 20 bp, synthetic construct
  misc_feature 1..20: note = CRISPR gRNA sequence
  source 1..20: mol_type = other DNA
agcctcccaagtagccgaga

SEQ ID NO: 23523 - DNA, 20 bp, synthetic construct
  misc_feature 1..20: note = CRISPR gRNA sequence
  source 1..20: mol_type = other DNA
ccaagtagccgagactacaa

SEQ ID NO: 23524 - DNA, 20 bp, synthetic construct
  misc_feature 1..20: note = CRISPR gRNA sequence
  source 1..20: mol_type = other DNA
caagggcactccaccacacc

SEQ ID NO: 23525 - DNA, 20 bp, synthetic construct
  misc_feature 1..20: note = CRISPR gRNA sequence
  source 1..20: mol_type = other DNA
caccacacccagctaatttt

SEQ ID NO: 23526 - DNA, 20 bp, synthetic construct
  misc_feature 1..20: note = CRISPR gRNA sequence
  source 1..20: mol_type = other DNA
atttttgtatcttttatttc

SEQ ID NO: 23527 - DNA, 20 bp, synthetic construct
  misc_feature 1..20: note = CRISPR gRNA sequence
  source 1..20: mol_type = other DNA
ttgtatcttttatttctgaa

SEQ ID NO: 23528 - DNA, 20 bp, synthetic construct
  misc_feature 1..20: note = CRISPR gRNA sequence
  source 1..20: mol_type = other DNA
tgtatcttttatttctgaag

SEQ ID NO: 23529 - DNA, 20 bp, synthetic construct
  misc_feature 1..20: note = CRISPR gRNA sequence
  source 1..20: mol_type = other DNA
gtatcttttatttctgaaga

SEQ ID NO: 23530 - DNA, 20 bp, synthetic construct
  misc_feature 1..20: note = CRISPR gRNA sequence
  source 1..20: mol_type = other DNA
tatcttttatttctgaagag

SEQ ID NO: 23531 - DNA, 20 bp, synthetic construct
  misc_feature 1..20: note = CRISPR gRNA sequence
  source 1..20: mol_type = other DNA
ttatttctgaagagatgggg

SEQ ID NO: 23532 - DNA, 20 bp, synthetic construct
  misc_feature 1..20: note = CRISPR gRNA sequence
  source 1..20: mol_type = other DNA
tatttctgaagagatggggt

SEQ ID NO: 23533 - DNA, 20 bp, synthetic construct
  misc_feature 1..20: note = CRISPR gRNA sequence
  source 1..20: mol_type = other DNA
atttctgaagagatggggtt

SEQ ID NO: 23534 - DNA, 20 bp, synthetic construct
  misc_feature 1..20: note = CRISPR gRNA sequence
  source 1..20: mol_type = other DNA
tttctgaagagatggggttt

SEQ ID NO: 23535 - DNA, 20 bp, synthetic construct
  misc_feature 1..20: note = CRISPR gRNA sequence
  source 1..20: mol_type = other DNA
ctgaagagatggggtttcac

SEQ ID NO: 23536 - DNA, 20 bp, synthetic construct
  misc_feature 1..20: note = CRISPR gRNA sequence
  source 1..20: mol_type = other DNA
tgaagagatggggtttcact

SEQ ID NO: 23537 - DNA, 20 bp, synthetic construct
  misc_feature 1..20: note = CRISPR gRNA sequence
  source 1..20: mol_type = other DNA
aagagatggggtttcactat

SEQ ID NO: 23538 - DNA, 20 bp, synthetic construct
  misc_feature 1..20: note = CRISPR gRNA sequence
  source 1..20: mol_type = other DNA
cactatgttgcccaggctgg

SEQ ID NO: 23539 - DNA, 20 bp, synthetic construct
  misc_feature 1..20: note = CRISPR gRNA sequence
  source 1..20: mol_type = other DNA
actatgttgcccaggctggt

SEQ ID NO: 23540 - DNA, 20 bp, synthetic construct
  misc_feature 1..20: note = CRISPR gRNA sequence
  source 1..20: mol_type = other DNA
tgttgcccaggctggtctca

SEQ ID NO: 23541 - DNA, 20 bp, synthetic construct
  misc_feature 1..20: note = CRISPR gRNA sequence
  source 1..20: mol_type = other DNA
cccaggctggtctcaaactc

SEQ ID NO: 23542 - DNA, 20 bp, synthetic construct
  misc_feature 1..20: note = CRISPR gRNA sequence
  source 1..20: mol_type = other DNA
gtctcaaactcctggcctca

SEQ ID NO: 23543 - DNA, 20 bp, synthetic construct
  misc_feature 1..20: note = CRISPR gRNA sequence
  source 1..20: mol_type = other DNA
aaactcctggcctcaagtca

SEQ ID NO: 23544 - DNA, 20 bp, synthetic construct
  misc_feature 1..20: note = CRISPR gRNA sequence
  source 1..20: mol_type = other DNA
ctggcctcaagtcatcctcc

SEQ ID NO: 23545 - DNA, 20 bp, synthetic construct
  misc_feature 1..20: note = CRISPR gRNA sequence
  source 1..20: mol_type = other DNA
gcctcaagtcatcctccctc

SEQ ID NO: 23546 - DNA, 20 bp, synthetic construct
  misc_feature 1..20: note = CRISPR gRNA sequence
  source 1..20: mol_type = other DNA
aagtcatcctccctcctcag

SEQ ID NO: 23547 - DNA, 20 bp, synthetic construct
  misc_feature 1..20: note = CRISPR gRNA sequence
  source 1..20: mol_type = other DNA
cctcctcagcctcccaaagt

SEQ ID NO: 23548 - DNA, 20 bp, synthetic construct
  misc_feature 1..20: note = CRISPR gRNA sequence
  source 1..20: mol_type = other DNA
ctcagcctcccaaagtgctg

SEQ ID NO: 23549 - DNA, 20 bp, synthetic construct
  misc_feature 1..20: note = CRISPR gRNA sequence
  source 1..20: mol_type = other DNA
agcctcccaaagtgctggga

SEQ ID NO: 23550 - DNA, 20 bp, synthetic construct
  misc_feature 1..20: note = CRISPR gRNA sequence
  source 1..20: mol_type = other DNA
ccaaagtgctgggattacag

SEQ ID NO: 23551 - DNA, 20 bp, synthetic construct
  misc_feature 1..20: note = CRISPR gRNA sequence
  source 1..20: mol_type = other DNA
ggattacaggtgtgatctca

SEQ ID NO: 23552 - DNA, 20 bp, synthetic construct
  misc_feature 1..20: note = CRISPR gRNA sequence
  source 1..20: mol_type = other DNA
caggtgtgatctcagacagc

SEQ ID NO: 23553 - DNA, 20 bp, synthetic construct
  misc_feature 1..20: note = CRISPR gRNA sequence
  source 1..20: mol_type = other DNA
agacagcttacctcttaatc

SEQ ID NO: 23554 - DNA, 20 bp, synthetic construct
  misc_feature 1..20: note = CRISPR gRNA sequence
  source 1..20: mol_type = other DNA
acctcttaatcacctttcca

SEQ ID NO: 23555 - DNA, 20 bp, synthetic construct
  misc_feature 1..20: note = CRISPR gRNA sequence
  source 1..20: mol_type = other DNA
cctcttaatcacctttccat

SEQ ID NO: 23556 - DNA, 20 bp, synthetic construct
  misc_feature 1..20: note = CRISPR gRNA sequence
  source 1..20: mol_type = other DNA
ttaatcacctttccatctga

SEQ ID NO: 23557 - DNA, 20 bp, synthetic construct
  misc_feature 1..20: note = CRISPR gRNA sequence
  source 1..20: mol_type = other DNA
aatcacctttccatctgagc

SEQ ID NO: 23558 - DNA, 20 bp, synthetic construct
  misc_feature 1..20: note = CRISPR gRNA sequence
  source 1..20: mol_type = other DNA
atcacctttccatctgagct

SEQ ID NO: 23559 - DNA, 20 bp, synthetic construct
  misc_feature 1..20: note = CRISPR gRNA sequence
  source 1..20: mol_type = other DNA
tccatctgagctggcagcag

SEQ ID NO: 23560 - DNA, 20 bp, synthetic construct
  misc_feature 1..20: note = CRISPR gRNA sequence
  source 1..20: mol_type = other DNA
ccatctgagctggcagcaga

SEQ ID NO: 23561 - DNA, 20 bp, synthetic construct
  misc_feature 1..20: note = CRISPR gRNA sequence
  source 1..20: mol_type = other DNA
catctgagctggcagcagag

SEQ ID NO: 23562 - DNA, 20 bp, synthetic construct
  misc_feature 1..20: note = CRISPR gRNA sequence
  source 1..20: mol_type = other DNA
agctggcagcagagctggga

SEQ ID NO: 23563 - DNA, 20 bp, synthetic construct
  misc_feature 1..20: note = CRISPR gRNA sequence
  source 1..20: mol_type = other DNA
gcagcagagctgggaaagtg

SEQ ID NO: 23564 - DNA, 20 bp, synthetic construct
  misc_feature 1..20: note = CRISPR gRNA sequence
  source 1..20: mol_type = other DNA
ggaaagtgcacccaacaccc

SEQ ID NO: 23565 - DNA, 20 bp, synthetic construct
  misc_feature 1..20: note = CRISPR gRNA sequence
  source 1..20: mol_type = other DNA
caactttagtgcttcctgct

SEQ ID NO: 23566 - DNA, 20 bp, synthetic construct
  misc_feature 1..20: note = CRISPR gRNA sequence
  source 1..20: mol_type = other DNA
tagtgcttcctgctccttct

SEQ ID NO: 23567 - DNA, 20 bp, synthetic construct
  misc_feature 1..20: note = CRISPR gRNA sequence
  source 1..20: mol_type = other DNA
agtgcttcctgctccttctc

SEQ ID NO: 23568 - DNA, 20 bp, synthetic construct
  misc_feature 1..20: note = CRISPR gRNA sequence
  source 1..20: mol_type = other DNA
gtgcttcctgctccttctct

SEQ ID NO: 23569 - DNA, 20 bp, synthetic construct
  misc_feature 1..20: note = CRISPR gRNA sequence
  source 1..20: mol_type = other DNA
cctgctccttctctgtgtgg

SEQ ID NO: 23570 - DNA, 20 bp, synthetic construct
  misc_feature 1..20: note = CRISPR gRNA sequence
  source 1..20: mol_type = other DNA
ctgctccttctctgtgtgga

SEQ ID NO: 23571 - DNA, 20 bp, synthetic construct
  misc_feature 1..20: note = CRISPR gRNA sequence
  source 1..20: mol_type = other DNA
ctccttctctgtgtggaact

SEQ ID NO: 23572 - DNA, 20 bp, synthetic construct
  misc_feature 1..20: note = CRISPR gRNA sequence
  source 1..20: mol_type = other DNA
cttctctgtgtggaactggc

SEQ ID NO: 23573 - DNA, 20 bp, synthetic construct
  misc_feature 1..20: note = CRISPR gRNA sequence
  source 1..20: mol_type = other DNA
ctctgtgtggaactggcctg

SEQ ID NO: 23574 - DNA, 20 bp, synthetic construct
  misc_feature 1..20: note = CRISPR gRNA sequence
  source 1..20: mol_type = other DNA
tctgtgtggaactggcctgt

SEQ ID NO: 23575 - DNA, 20 bp, synthetic construct
  misc_feature 1..20: note = CRISPR gRNA sequence
  source 1..20: mol_type = other DNA
tgtgtggaactggcctgttt

SEQ ID NO: 23576 - DNA, 20 bp, synthetic construct
  misc_feature 1..20: note = CRISPR gRNA sequence
  source 1..20: mol_type = other DNA
tgtggaactggcctgtttgg

SEQ ID NO: 23577 - DNA, 20 bp, synthetic construct
  misc_feature 1..20: note = CRISPR gRNA sequence
  source 1..20: mol_type = other DNA
gcctgtttgggtacccaggg

SEQ ID NO: 23578 - DNA, 20 bp, synthetic construct
  misc_feature 1..20: note = CRISPR gRNA sequence
  source 1..20: mol_type = other DNA
tttgggtacccagggccagt

SEQ ID NO: 23579 - DNA, 20 bp, synthetic construct
  misc_feature 1..20: note = CRISPR gRNA sequence
  source 1..20: mol_type = other DNA
gggtacccagggccagtccc

SEQ ID NO: 23580 - DNA, 20 bp, synthetic construct
  misc_feature 1..20: note = CRISPR gRNA sequence
  source 1..20: mol_type = other DNA
ggtacccagggccagtcccc

SEQ ID NO: 23581 - DNA, 20 bp, synthetic construct
  misc_feature 1..20: note = CRISPR gRNA sequence
  source 1..20: mol_type = other DNA
caagaccctctgtagaaaaa

SEQ ID NO: 23582 - DNA, 20 bp, synthetic construct
  misc_feature 1..20: note = CRISPR gRNA sequence
  source 1..20: mol_type = other DNA
tgtagaaaaagaccctactg

SEQ ID NO: 23583 - DNA, 20 bp, synthetic construct
  misc_feature 1..20: note = CRISPR gRNA sequence
  source 1..20: mol_type = other DNA
tagaaaaagaccctactgta

SEQ ID NO: 23584 - DNA, 20 bp, synthetic construct
  misc_feature 1..20: note = CRISPR gRNA sequence
  source 1..20: mol_type = other DNA
ctgtacacctcaattccatt

SEQ ID NO: 23585 - DNA, 20 bp, synthetic construct
  misc_feature 1..20: note = CRISPR gRNA sequence
  source 1..20: mol_type = other DNA
tacacctcaattccattgca

SEQ ID NO: 23586 - DNA, 20 bp, synthetic construct
  misc_feature 1..20: note = CRISPR gRNA sequence
  source 1..20: mol_type = other DNA
aattccattgcaggacagga

SEQ ID NO: 23587 - DNA, 20 bp, synthetic construct
  misc_feature 1..20: note = CRISPR gRNA sequence
  source 1..20: mol_type = other DNA
cattgcaggacaggacataa

SEQ ID NO: 23588 - DNA, 20 bp, synthetic construct
  misc_feature 1..20: note = CRISPR gRNA sequence
  source 1..20: mol_type = other DNA
caggacaggacataattgaa

SEQ ID NO: 23589 - DNA, 20 bp, synthetic construct
  misc_feature 1..20: note = CRISPR gRNA sequence
  source 1..20: mol_type = other DNA
aatcctgcctctccctgccc

SEQ ID NO: 23590 - DNA, 20 bp, synthetic construct
  misc_feature 1..20: note = CRISPR gRNA sequence
  source 1..20: mol_type = other DNA
cctctccctgccccagtcac

SEQ ID NO: 23591 - DNA, 20 bp, synthetic construct
  misc_feature 1..20: note = CRISPR gRNA sequence
  source 1..20: mol_type = other DNA
tccctgccccagtcacccat

SEQ ID NO: 23592 - DNA, 20 bp, synthetic construct
  misc_feature 1..20: note = CRISPR gRNA sequence
  source 1..20: mol_type = other DNA
cctgccccagtcacccatcc

SEQ ID NO: 23593 - DNA, 20 bp, synthetic construct
  misc_feature 1..20: note = CRISPR gRNA sequence
  source 1..20: mol_type = other DNA
ccccagtcacccatccctcc

SEQ ID NO: 23594 - DNA, 20 bp, synthetic construct
  misc_feature 1..20: note = CRISPR gRNA sequence
  source 1..20: mol_type = other DNA
ccaagccattatcttgggac

SEQ ID NO: 23595 - DNA, 20 bp, synthetic construct
  misc_feature 1..20: note = CRISPR gRNA sequence
  source 1..20: mol_type = other DNA
tcttgggacctgcaagggcc

SEQ ID NO: 23596 - DNA, 20 bp, synthetic construct
  misc_feature 1..20: note = CRISPR gRNA sequence
  source 1..20: mol_type = other DNA
gggacctgcaagggcctcca

SEQ ID NO: 23597 - DNA, 20 bp, synthetic construct
  misc_feature 1..20: note = CRISPR gRNA sequence
  source 1..20: mol_type = other DNA
ggacctgcaagggcctccaa

SEQ ID NO: 23598 - DNA, 20 bp, synthetic construct
  misc_feature 1..20: note = CRISPR gRNA sequence
  source 1..20: mol_type = other DNA
caagggcctccaagccaagg

SEQ ID NO: 23599 - DNA, 20 bp, synthetic construct
  misc_feature 1..20: note = CRISPR gRNA sequence
  source 1..20: mol_type = other DNA
caagccaagggtggcaaatc

SEQ ID NO: 23600 - DNA, 20 bp, synthetic construct
  misc_feature 1..20: note = CRISPR gRNA sequence
  source 1..20: mol_type = other DNA
tggtaacaattgtgtgtact

SEQ ID NO: 23601 - DNA, 20 bp, synthetic construct
  misc_feature 1..20: note = CRISPR gRNA sequence
  source 1..20: mol_type = other DNA
gtaacaattgtgtgtactct

SEQ ID NO: 23602 - DNA, 20 bp, synthetic construct
  misc_feature 1..20: note = CRISPR gRNA sequence
  source 1..20: mol_type = other DNA
tgtgtactctatatagagac

SEQ ID NO: 23603 - DNA, 20 bp, synthetic construct
  misc_feature 1..20: note = CRISPR gRNA sequence
  source 1..20: mol_type = other DNA
tatatagagacattgtgatg

SEQ ID NO: 23604 - DNA, 20 bp, synthetic construct
  misc_feature 1..20: note = CRISPR gRNA sequence
  source 1..20: mol_type = other DNA
tatagagacattgtgatggt

SEQ ID NO: 23605 - DNA, 20 bp, synthetic construct
  misc_feature 1..20: note = CRISPR gRNA sequence
  source 1..20: mol_type = other DNA
tgatggtgatttagacacac

SEQ ID NO: 23606 - DNA, 20 bp, synthetic construct
  misc_feature 1..20: note = CRISPR gRNA sequence
  source 1..20: mol_type = other DNA
agacacacacacacttatat

SEQ ID NO: 23607 - DNA, 20 bp, synthetic construct
  misc_feature 1..20: note = CRISPR gRNA sequence
  source 1..20: mol_type = other DNA
gacacacacacacttatatt

SEQ ID NO: 23608 - DNA, 20 bp, synthetic construct
  misc_feature 1..20: note = CRISPR gRNA sequence
  source 1..20: mol_type = other DNA
atattggcttgggaaacaaa

SEQ ID NO: 23609 - DNA, 20 bp, synthetic construct
  misc_feature 1..20: note = CRISPR gRNA sequence
  source 1..20: mol_type = other DNA
tattggcttgggaaacaaaa

SEQ ID NO: 23610 - DNA, 20 bp, synthetic construct
  misc_feature 1..20: note = CRISPR gRNA sequence
  source 1..20: mol_type = other DNA
gcttgggaaacaaaacaaat

SEQ ID NO: 23611 - DNA, 20 bp, synthetic construct
  misc_feature 1..20: note = CRISPR gRNA sequence
  source 1..20: mol_type = other DNA
gggaaacaaaacaaataggc

SEQ ID NO: 23612 - DNA, 20 bp, synthetic construct
  misc_feature 1..20: note = CRISPR gRNA sequence
  source 1..20: mol_type = other DNA
ggaaacaaaacaaataggcc

SEQ ID NO: 23613 - DNA, 20 bp, synthetic construct
  misc_feature 1..20: note = CRISPR gRNA sequence
  source 1..20: mol_type = other DNA
tcgactggattcaacttttg

SEQ ID NO: 23614 - DNA, 20 bp, synthetic construct
  misc_feature 1..20: note = CRISPR gRNA sequence
  source 1..20: mol_type = other DNA
gattcaacttttgattttgc

SEQ ID NO: 23615 - DNA, 20 bp, synthetic construct
  misc_feature 1..20: note = CRISPR gRNA sequence
  source 1..20: mol_type = other DNA
aacttttgattttgcagcca

SEQ ID NO: 23616 - DNA, 20 bp, synthetic construct
  misc_feature 1..20: note = CRISPR gRNA sequence
  source 1..20: mol_type = other DNA
ttgattttgcagccaagccc

SEQ ID NO: 23617 - DNA, 20 bp, synthetic construct
  misc_feature 1..20: note = CRISPR gRNA sequence
  source 1..20: mol_type = other DNA
tgattttgcagccaagcccc

SEQ ID NO: 23618 - DNA, 20 bp, synthetic construct
  misc_feature 1..20: note = CRISPR gRNA sequence
  source 1..20: mol_type = other DNA
gattttgcagccaagcccct

SEQ ID NO: 23619 - DNA, 20 bp, synthetic construct
  misc_feature 1..20: note = CRISPR gRNA sequence
  source 1..20: mol_type = other DNA
attttgcagccaagcccctg

SEQ ID NO: 23620 - DNA, 20 bp, synthetic construct
  misc_feature 1..20: note = CRISPR gRNA sequence
  source 1..20: mol_type = other DNA
tgcagccaagcccctgtggc

SEQ ID NO: 23621 - DNA, 20 bp, synthetic construct
  misc_feature 1..20: note = CRISPR gRNA sequence
  source 1..20: mol_type = other DNA
gcagccaagcccctgtggca

SEQ ID NO: 23622 - DNA, 20 bp, synthetic construct
  misc_feature 1..20: note = CRISPR gRNA sequence
  source 1..20: mol_type = other DNA
cagccaagcccctgtggcac

SEQ ID NO: 23623 - DNA, 20 bp, synthetic construct
  misc_feature 1..20: note = CRISPR gRNA sequence
  source 1..20: mol_type = other DNA
tggcacagctgaggagcttg

SEQ ID NO: 23624 - DNA, 20 bp, synthetic construct
  misc_feature 1..20: note = CRISPR gRNA sequence
  source 1..20: mol_type = other DNA
aggagcttgcaggtcagaaa

SEQ ID NO: 23625 - DNA, 20 bp, synthetic construct
  misc_feature 1..20: note = CRISPR gRNA sequence
  source 1..20: mol_type = other DNA
gcaggtcagaaaggggattt

SEQ ID NO: 23626 - DNA, 20 bp, synthetic construct
  misc_feature 1..20: note = CRISPR gRNA sequence
  source 1..20: mol_type = other DNA
caggtcagaaaggggattta

SEQ ID NO: 23627 - DNA, 20 bp, synthetic construct
  misc_feature 1..20: note = CRISPR gRNA sequence
  source 1..20: mol_type = other DNA
agagccaaccaatagcaata

SEQ ID NO: 23628 - DNA, 20 bp, synthetic construct
  misc_feature 1..20: note = CRISPR gRNA sequence
  source 1..20: mol_type = other DNA
gagccaaccaatagcaatat

SEQ ID NO: 23629 - DNA, 20 bp, synthetic construct
  misc_feature 1..20: note = CRISPR gRNA sequence
  source 1..20: mol_type = other DNA
cagacctctcctgacacgaa

SEQ ID NO: 23630 - DNA, 20 bp, synthetic construct
  misc_feature 1..20: note = CRISPR gRNA sequence
  source 1..20: mol_type = other DNA
tcctgacacgaagctcatct

SEQ ID NO: 23631 - DNA, 20 bp, synthetic construct
  misc_feature 1..20: note = CRISPR gRNA sequence
  source 1..20: mol_type = other DNA
ctgacacgaagctcatctga

SEQ ID NO: 23632 - DNA, 20 bp, synthetic construct
  misc_feature 1..20: note = CRISPR gRNA sequence
  source 1..20: mol_type = other DNA
acacgaagctcatctgacct

SEQ ID NO: 23633 - DNA, 20 bp, synthetic construct
  misc_feature 1..20: note = CRISPR gRNA sequence
  source 1..20: mol_type = other DNA
atctgacctcctgcccccat

SEQ ID NO: 23634 - DNA, 20 bp, synthetic construct
  misc_feature 1..20: note = CRISPR gRNA sequence
  source 1..20: mol_type = other DNA
acctcctgcccccattacac

SEQ ID NO: 23635 - DNA, 20 bp, synthetic construct
  misc_feature 1..20: note = CRISPR gRNA sequence
  source 1..20: mol_type = other DNA
ctgcccccattacacacata

SEQ ID NO: 23636 - DNA, 20 bp, synthetic construct
  misc_feature 1..20: note = CRISPR gRNA sequence
  source 1..20: mol_type = other DNA
cccccattacacacatacac

SEQ ID NO: 23637 - DNA, 20 bp, synthetic construct
  misc_feature 1..20: note = CRISPR gRNA sequence
  source 1..20: mol_type = other DNA
cacacatacacatgcacaca

SEQ ID NO: 23638 - DNA, 20 bp, synthetic construct
  misc_feature 1..20: note = CRISPR gRNA sequence
  source 1..20: mol_type = other DNA
ctagtctccctgccttgagg

SEQ ID NO: 23639 - DNA, 20 bp, synthetic construct
  misc_feature 1..20: note = CRISPR gRNA sequence
  source 1..20: mol_type = other DNA
tagtctccctgccttgagga

SEQ ID NO: 23640 - DNA, 20 bp, synthetic construct
  misc_feature 1..20: note = CRISPR gRNA sequence
  source 1..20: mol_type = other DNA
gtctccctgccttgaggaca

SEQ ID NO: 23641 - DNA, 20 bp, synthetic construct
  misc_feature 1..20: note = CRISPR gRNA sequence
  source 1..20: mol_type = other DNA
cctgccttgaggacaaatga

SEQ ID NO: 23642 - DNA, 20 bp, synthetic construct
  misc_feature 1..20: note = CRISPR gRNA sequence
  source 1..20: mol_type = other DNA
ccttgaggacaaatgatcag

SEQ ID NO: 23643 - DNA, 20 bp, synthetic construct
  misc_feature 1..20: note = CRISPR gRNA sequence
  source 1..20: mol_type = other DNA
gaggacaaatgatcagatcc

SEQ ID NO: 23644 - DNA, 20 bp, synthetic construct
  misc_feature 1..20: note = CRISPR gRNA sequence
  source 1..20: mol_type = other DNA
aggacaaatgatcagatcct

SEQ ID NO: 23645 - DNA, 20 bp, synthetic construct
  misc_feature 1..20: note = CRISPR gRNA sequence
  source 1..20: mol_type = other DNA
caactgtttccaggcccata

SEQ ID NO: 23646 - DNA, 20 bp, synthetic construct
  misc_feature 1..20: note = CRISPR gRNA sequence
  source 1..20: mol_type = other DNA
tttccaggcccataagcccc

SEQ ID NO: 23647 - DNA, 20 bp, synthetic construct
  misc_feature 1..20: note = CRISPR gRNA sequence
  source 1..20: mol_type = other DNA
ccaggcccataagcccctga

SEQ ID NO: 23648 - DNA, 20 bp, synthetic construct
  misc_feature 1..20: note = CRISPR gRNA sequence
  source 1..20: mol_type = other DNA
caggcccataagcccctgag

SEQ ID NO: 23649 - DNA, 20 bp, synthetic construct
  misc_feature 1..20: note = CRISPR gRNA sequence
  source 1..20: mol_type = other DNA
agcattgcagtgttgctaca

SEQ ID NO: 23650 - DNA, 20 bp, synthetic construct
  misc_feature 1..20: note = CRISPR gRNA sequence
  source 1..20: mol_type = other DNA
cagtgttgctacatgcctta

SEQ ID NO: 23651 - DNA, 20 bp, synthetic construct
  misc_feature 1..20: note = CRISPR gRNA sequence
  source 1..20: mol_type = other DNA
ctacatgccttagtttcctc

SEQ ID NO: 23652 - DNA, 20 bp, synthetic construct
  misc_feature 1..20: note = CRISPR gRNA sequence
  source 1..20: mol_type = other DNA
catgccttagtttcctctcc

SEQ ID NO: 23653 - DNA, 20 bp, synthetic construct
  misc_feature 1..20: note = CRISPR gRNA sequence
  source 1..20: mol_type = other DNA
agtttcctctccgtctcctg

SEQ ID NO: 23654 - DNA, 20 bp, synthetic construct
  misc_feature 1..20: note = CRISPR gRNA sequence
  source 1..20: mol_type = other DNA
gtttcctctccgtctcctgt

SEQ ID NO: 23655 - DNA, 20 bp, synthetic construct
  misc_feature 1..20: note = CRISPR gRNA sequence
  source 1..20: mol_type = other DNA
cctctccgtctcctgtgacc

SEQ ID NO: 23656 - DNA, 20 bp, synthetic construct
  misc_feature 1..20: note = CRISPR gRNA sequence
  source 1..20: mol_type = other DNA
ctctccgtctcctgtgacct

SEQ ID NO: 23657 - DNA, 20 bp, synthetic construct
  misc_feature 1..20: note = CRISPR gRNA sequence
  source 1..20: mol_type = other DNA
tccgtctcctgtgacctcct

SEQ ID NO: 23658 - DNA, 20 bp, synthetic construct
  misc_feature 1..20: note = CRISPR gRNA sequence
  source 1..20: mol_type = other DNA
cgtctcctgtgacctcctcg

SEQ ID NO: 23659 - DNA, 20 bp, synthetic construct
  misc_feature 1..20: note = CRISPR gRNA sequence
  source 1..20: mol_type = other DNA
ctgtgacctcctcgtgccac

SEQ ID NO: 23660 - DNA, 20 bp, synthetic construct
  misc_feature 1..20: note = CRISPR gRNA sequence
  source 1..20: mol_type = other DNA
tgacctcctcgtgccactcc

SEQ ID NO: 23661 - DNA, 20 bp, synthetic construct
  misc_feature 1..20: note = CRISPR gRNA sequence
  source 1..20: mol_type = other DNA
ctcgtgccactccaggaagt

SEQ ID NO: 23662 - DNA, 20 bp, synthetic construct
  misc_feature 1..20: note = CRISPR gRNA sequence
  source 1..20: mol_type = other DNA
gtgccactccaggaagtgaa

SEQ ID NO: 23663 - DNA, 20 bp, synthetic construct
  misc_feature 1..20: note = CRISPR gRNA sequence
  source 1..20: mol_type = other DNA
caggaagtgaaagtcttgag

SEQ ID NO: 23664 - DNA, 20 bp, synthetic construct
  misc_feature 1..20: note = CRISPR gRNA sequence
  source 1..20: mol_type = other DNA
gagtgagaccagtagtttct

SEQ ID NO: 23665 - DNA, 20 bp, synthetic construct
  misc_feature 1..20: note = CRISPR gRNA sequence
  source 1..20: mol_type = other DNA
agtgagaccagtagtttctc

SEQ ID NO: 23666 - DNA, 20 bp, synthetic construct
  misc_feature 1..20: note = CRISPR gRNA sequence
  source 1..20: mol_type = other DNA
ctcttaagtcctctctctgt

SEQ ID NO: 23667 - DNA, 20 bp, synthetic construct
  misc_feature 1..20: note = CRISPR gRNA sequence
  source 1..20: mol_type = other DNA
tcttaagtcctctctctgtc

SEQ ID NO: 23668 - DNA, 20 bp, synthetic construct
  misc_feature 1..20: note = CRISPR gRNA sequence
  source 1..20: mol_type = other DNA
ttaagtcctctctctgtctc

SEQ ID NO: 23669 - DNA, 20 bp, synthetic construct
  misc_feature 1..20: note = CRISPR gRNA sequence
  source 1..20: mol_type = other DNA
aagtcctctctctgtctcgt

SEQ ID NO: 23670 - DNA, 20 bp, synthetic construct
  misc_feature 1..20: note = CRISPR gRNA sequence
  source 1..20: mol_type = other DNA
agtcctctctctgtctcgtt

SEQ ID NO: 23671 - DNA, 20 bp, synthetic construct
  misc_feature 1..20: note = CRISPR gRNA sequence
  source 1..20: mol_type = other DNA
tctctgtctcgttctcctgg

SEQ ID NO: 23672 - DNA, 20 bp, synthetic construct
  misc_feature 1..20: note = CRISPR gRNA sequence
  source 1..20: mol_type = other DNA
tctgtctcgttctcctggga

SEQ ID NO: 23673 - DNA, 20 bp, synthetic construct
  misc_feature 1..20: note = CRISPR gRNA sequence
  source 1..20: mol_type = other DNA
tgtctcgttctcctgggata

SEQ ID NO: 23674 - DNA, 20 bp, synthetic construct
  misc_feature 1..20: note = CRISPR gRNA sequence
  source 1..20: mol_type = other DNA
tctcgttctcctgggatatc

SEQ ID NO: 23675 - DNA, 20 bp, synthetic construct
  misc_feature 1..20: note = CRISPR gRNA sequence
  source 1..20: mol_type = other DNA
gttctcctgggatatctaca

SEQ ID NO: 23676 - DNA, 20 bp, synthetic construct
  misc_feature 1..20: note = CRISPR gRNA sequence
  source 1..20: mol_type = other DNA
tcctgggatatctacacttg

SEQ ID NO: 23677 - DNA, 20 bp, synthetic construct
  misc_feature 1..20: note = CRISPR gRNA sequence
  source 1..20: mol_type = other DNA
ctgggatatctacacttggt

SEQ ID NO: 23678 - DNA, 20 bp, synthetic construct
  misc_feature 1..20: note = CRISPR gRNA sequence
  source 1..20: mol_type = other DNA
ggatatctacacttggtttg

SEQ ID NO: 23679 - DNA, 20 bp, synthetic construct
  misc_feature 1..20: note = CRISPR gRNA sequence
  source 1..20: mol_type = other DNA
cacttggtttgcaaacagca

SEQ ID NO: 23680 - DNA, 20 bp, synthetic construct
  misc_feature 1..20: note = CRISPR gRNA sequence
  source 1..20: mol_type = other DNA
ggtttgcaaacagcaggctg

SEQ ID NO: 23681 - DNA, 20 bp, synthetic construct
  misc_feature 1..20: note = CRISPR gRNA sequence
  source 1..20: mol_type = other DNA
gtttgcaaacagcaggctgg

SEQ ID NO: 23682 - DNA, 20 bp, synthetic construct
  misc_feature 1..20: note = CRISPR gRNA sequence
  source 1..20: mol_type = other DNA
gcaaacagcaggctggagag

SEQ ID NO: 23683 - DNA, 20 bp, synthetic construct
  misc_feature 1..20: note = CRISPR gRNA sequence
  source 1..20: mol_type = other DNA
caaacagcaggctggagagt

SEQ ID NO: 23684 - DNA, 20 bp, synthetic construct
  misc_feature 1..20: note = CRISPR gRNA sequence
  source 1..20: mol_type = other DNA
gagagtgaggggcttcttcc

SEQ ID NO: 23685 - DNA, 20 bp, synthetic construct
  misc_feature 1..20: note = CRISPR gRNA sequence
  source 1..20: mol_type = other DNA
cttcctctacatccagctcc

SEQ ID NO: 23686 - DNA, 20 bp, synthetic construct
  misc_feature 1..20: note = CRISPR gRNA sequence
  source 1..20: mol_type = other DNA
ttcctctacatccagctcct

SEQ ID NO: 23687 - DNA, 20 bp, synthetic construct
  misc_feature 1..20: note = CRISPR gRNA sequence
  source 1..20: mol_type = other DNA
cctctacatccagctcctcc

SEQ ID NO: 23688 - DNA, 20 bp, synthetic construct
  misc_feature 1..20: note = CRISPR gRNA sequence
  source 1..20: mol_type = other DNA
ctctacatccagctcctccc

SEQ ID NO: 23689 - DNA, 20 bp, synthetic construct
  misc_feature 1..20: note = CRISPR gRNA sequence
  source 1..20: mol_type = other DNA
tacatccagctcctccccca

SEQ ID NO: 23690 - DNA, 20 bp, synthetic construct
  misc_feature 1..20: note = CRISPR gRNA sequence
  source 1..20: mol_type = other DNA
catccagctcctcccccatc

SEQ ID NO: 23691 - DNA, 20 bp, synthetic construct
  misc_feature 1..20: note = CRISPR gRNA sequence
  source 1..20: mol_type = other DNA
ctcccccatcctgctccaag

SEQ ID NO: 23692 - DNA, 20 bp, synthetic construct
  misc_feature 1..20: note = CRISPR gRNA sequence
  source 1..20: mol_type = other DNA
ccccatcctgctccaagtcc

SEQ ID NO: 23693 - DNA, 20 bp, synthetic construct
  misc_feature 1..20: note = CRISPR gRNA sequence
  source 1..20: mol_type = other DNA
ctccaagtccagcatgttcc

SEQ ID NO: 23694 - DNA, 20 bp, synthetic construct
  misc_feature 1..20: note = CRISPR gRNA sequence
  source 1..20: mol_type = other DNA
caagtccagcatgttcctat

SEQ ID NO: 23695 - DNA, 20 bp, synthetic construct
  misc_feature 1..20: note = CRISPR gRNA sequence
  source 1..20: mol_type = other DNA
ctatctcttccccaggaccc

SEQ ID NO: 23696 - DNA, 20 bp, synthetic construct
  misc_feature 1..20: note = CRISPR gRNA sequence
  source 1..20: mol_type = other DNA
tctcttccccaggaccctgg

SEQ ID NO: 23697 - DNA, 20 bp, synthetic construct
  misc_feature 1..20: note = CRISPR gRNA sequence
  source 1..20: mol_type = other DNA
ttccccaggaccctgggctc

SEQ ID NO: 23698 - DNA, 20 bp, synthetic construct
  misc_feature 1..20: note = CRISPR gRNA sequence
  source 1..20: mol_type = other DNA
ccccaggaccctgggctctt

SEQ ID NO: 23699 - DNA, 20 bp, synthetic construct
  misc_feature 1..20: note = CRISPR gRNA sequence
  source 1..20: mol_type = other DNA
cccaggaccctgggctcttg

SEQ ID NO: 23700 - DNA, 20 bp, synthetic construct
  misc_feature 1..20: note = CRISPR gRNA sequence
  source 1..20: mol_type = other DNA
ggctcttgggcacaaatcaa

SEQ ID NO: 23701 - DNA, 20 bp, synthetic construct
  misc_feature 1..20: note = CRISPR gRNA sequence
  source 1..20: mol_type = other DNA
ttgggcacaaatcaagccat

SEQ ID NO: 23702 - DNA, 20 bp, synthetic construct
  misc_feature 1..20: note = CRISPR gRNA sequence
  source 1..20: mol_type = other DNA
gggcacaaatcaagccatca

SEQ ID NO: 23703 - DNA, 20 bp, synthetic construct
  misc_feature 1..20: note = CRISPR gRNA sequence
  source 1..20: mol_type = other DNA
ggcacaaatcaagccatcac

SEQ ID NO: 23704 - DNA, 20 bp, synthetic construct
  misc_feature 1..20: note = CRISPR gRNA sequence
  source 1..20: mol_type = other DNA
tggggtggcaagagcagagg

SEQ ID NO: 23705 - DNA, 20 bp, synthetic construct
  misc_feature 1..20: note = CRISPR gRNA sequence
  source 1..20: mol_type = other DNA
gtttctttgtgaacatctat

SEQ ID NO: 23706 - DNA, 20 bp, synthetic construct
  misc_feature 1..20: note = CRISPR gRNA sequence
  source 1..20: mol_type = other DNA
tttctttgtgaacatctata

SEQ ID NO: 23707 - DNA, 20 bp, synthetic construct
  misc_feature 1..20: note = CRISPR gRNA sequence
  source 1..20: mol_type = other DNA
ctttgtgaacatctataggt

SEQ ID NO: 23708 - DNA, 20 bp, synthetic construct
  misc_feature 1..20: note = CRISPR gRNA sequence
  source 1..20: mol_type = other DNA
tttgtgaacatctataggta

SEQ ID NO: 23709 - DNA, 20 bp, synthetic construct
  misc_feature 1..20: note = CRISPR gRNA sequence
  source 1..20: mol_type = other DNA
tgtgaacatctataggtacc

SEQ ID NO: 23710 - DNA, 20 bp, synthetic construct
  misc_feature 1..20: note = CRISPR gRNA sequence
  source 1..20: mol_type = other DNA
gtgaacatctataggtacca

SEQ ID NO: 23711 - DNA, 20 bp, synthetic construct
  misc_feature 1..20: note = CRISPR gRNA sequence
  source 1..20: mol_type = other DNA
tgaacatctataggtaccag

SEQ ID NO: 23712 - DNA, 20 bp, synthetic construct
  misc_feature 1..20: note = CRISPR gRNA sequence
  source 1..20: mol_type = other DNA
taggtaccaggctctgtgca

SEQ ID NO: 23713 - DNA, 20 bp, synthetic construct
  misc_feature 1..20: note = CRISPR gRNA sequence
  source 1..20: mol_type = other DNA
tgtgcaggccctattgttgg

SEQ ID NO: 23714 - DNA, 20 bp, synthetic construct
  misc_feature 1..20: note = CRISPR gRNA sequence
  source 1..20: mol_type = other DNA
tgcaggccctattgttggtg

SEQ ID NO: 23715 - DNA, 20 bp, synthetic construct
  misc_feature 1..20: note = CRISPR gRNA sequence
  source 1..20: mol_type = other DNA
ttgttggtgagccatagagg

SEQ ID NO: 23716 - DNA, 20 bp, synthetic construct
  misc_feature 1..20: note = CRISPR gRNA sequence
  source 1..20: mol_type = other DNA
ttggtgagccatagaggtac

SEQ ID NO: 23717 - DNA, 20 bp, synthetic construct
  misc_feature 1..20: note = CRISPR gRNA sequence
  source 1..20: mol_type = other DNA
gtgagccatagaggtaccaa

SEQ ID NO: 23718 - DNA, 20 bp, synthetic construct
  misc_feature 1..20: note = CRISPR gRNA sequence
  source 1..20: mol_type = other DNA
accccatgaatcctcctttg

SEQ ID NO: 23719 - DNA, 20 bp, synthetic construct
  misc_feature 1..20: note = CRISPR gRNA sequence
  source 1..20: mol_type = other DNA
ctttgtttcttttcttttca

SEQ ID NO: 23720 - DNA, 20 bp, synthetic construct
  misc_feature 1..20: note = CRISPR gRNA sequence
  source 1..20: mol_type = other DNA
tgtttcttttcttttcaacc

SEQ ID NO: 23721 - DNA, 20 bp, synthetic construct
  misc_feature 1..20: note = CRISPR gRNA sequence
  source 1..20: mol_type = other DNA
gtttcttttcttttcaaccc

SEQ ID NO: 23722 - DNA, 20 bp, synthetic construct
  misc_feature 1..20: note = CRISPR gRNA sequence
  source 1..20: mol_type = other DNA
tttcttttcttttcaacccc

SEQ ID NO: 23723 - DNA, 20 bp, synthetic construct
  misc_feature 1..20: note = CRISPR gRNA sequence
  source 1..20: mol_type = other DNA
cttttcttttcaacccctgg

SEQ ID NO: 23724 - DNA, 20 bp, synthetic construct
  misc_feature 1..20: note = CRISPR gRNA sequence
  source 1..20: mol_type = other DNA
ttttcttttcaacccctggg

SEQ ID NO: 23725 - DNA, 20 bp, synthetic construct
  misc_feature 1..20: note = CRISPR gRNA sequence
  source 1..20: mol_type = other DNA
ttcttttcaacccctgggcc

SEQ ID NO: 23726 - DNA, 20 bp, synthetic construct
  misc_feature 1..20: note = CRISPR gRNA sequence
  source 1..20: mol_type = other DNA
tcttttcaacccctgggcct

SEQ ID NO: 23727 - DNA, 20 bp, synthetic construct
  misc_feature 1..20: note = CRISPR gRNA sequence
  source 1..20: mol_type = other DNA
cttttcaacccctgggcctt

SEQ ID NO: 23728 - DNA, 20 bp, synthetic construct
  misc_feature 1..20: note = CRISPR gRNA sequence
  source 1..20: mol_type = other DNA
ttttcaacccctgggccttt

SEQ ID NO: 23729 - DNA, 20 bp, synthetic construct
  misc_feature 1..20: note = CRISPR gRNA sequence
  source 1..20: mol_type = other DNA
ttcaacccctgggcctttaa

SEQ ID NO: 23730 - DNA, 20 bp, synthetic construct
  misc_feature 1..20: note = CRISPR gRNA sequence
  source 1..20: mol_type = other DNA
tcaacccctgggcctttaaa

SEQ ID NO: 23731 - DNA, 20 bp, synthetic construct
  misc_feature 1..20: note = CRISPR gRNA sequence
  source 1..20: mol_type = other DNA
caacccctgggcctttaaac

SEQ ID NO: 23732 - DNA, 20 bp, synthetic construct
  misc_feature 1..20: note = CRISPR gRNA sequence
  source 1..20: mol_type = other DNA
aacccctgggcctttaaacc

SEQ ID NO: 23733 - DNA, 20 bp, synthetic construct
  misc_feature 1..20: note = CRISPR gRNA sequence
  source 1..20: mol_type = other DNA
ggcctttaaaccttcgatta

SEQ ID NO: 23734 - DNA, 20 bp, synthetic construct
  misc_feature 1..20: note = CRISPR gRNA sequence
  source 1..20: mol_type = other DNA
taaaccttcgattaactgcc

SEQ ID NO: 23735 - DNA, 20 bp, synthetic construct
  misc_feature 1..20: note = CRISPR gRNA sequence
  source 1..20: mol_type = other DNA
aaaccttcgattaactgccc

SEQ ID NO: 23736 - DNA, 20 bp, synthetic construct
  misc_feature 1..20: note = CRISPR gRNA sequence
  source 1..20: mol_type = other DNA
aaccttcgattaactgccca

SEQ ID NO: 23737 - DNA, 20 bp, synthetic construct
  misc_feature 1..20: note = CRISPR gRNA sequence
  source 1..20: mol_type = other DNA
cgattaactgcccagtgcag

SEQ ID NO: 23738 - DNA, 20 bp, synthetic construct
  misc_feature 1..20: note = CRISPR gRNA sequence
  source 1..20: mol_type = other DNA
gattaactgcccagtgcagc

SEQ ID NO: 23739 - DNA, 20 bp, synthetic construct
  misc_feature 1..20: note = CRISPR gRNA sequence
  source 1..20: mol_type = other DNA
actgcccagtgcagcccagg

SEQ ID NO: 23740 - DNA, 20 bp, synthetic construct
  misc_feature 1..20: note = CRISPR gRNA sequence
  source 1..20: mol_type = other DNA
cccagtgcagcccaggtcat

SEQ ID NO: 23741 - DNA, 20 bp, synthetic construct
  misc_feature 1..20: note = CRISPR gRNA sequence
  source 1..20: mol_type = other DNA
tgatctttggttcacatgag

SEQ ID NO: 23742 - DNA, 20 bp, synthetic construct
  misc_feature 1..20: note = CRISPR gRNA sequence
  source 1..20: mol_type = other DNA
tggttcacatgagggttttc

SEQ ID NO: 23743 - DNA, 20 bp, synthetic construct
  misc_feature 1..20: note = CRISPR gRNA sequence
  source 1..20: mol_type = other DNA
ggttcacatgagggttttct

SEQ ID NO: 23744 - DNA, 20 bp, synthetic construct
  misc_feature 1..20: note = CRISPR gRNA sequence
  source 1..20: mol_type = other DNA
gttcacatgagggttttctc

SEQ ID NO: 23745 - DNA, 20 bp, synthetic construct
  misc_feature 1..20: note = CRISPR gRNA sequence
  source 1..20: mol_type = other DNA
acatgagggttttctcttca

SEQ ID NO: 23746 - DNA, 20 bp, synthetic construct
  misc_feature 1..20: note = CRISPR gRNA sequence
  source 1..20: mol_type = other DNA
tctcttcattaatgtcccta

SEQ ID NO: 23747 - DNA, 20 bp, synthetic construct
  misc_feature 1..20: note = CRISPR gRNA sequence
  source 1..20: mol_type = other DNA
ctcttcattaatgtccctat

SEQ ID NO: 23748 - DNA, 20 bp, synthetic construct
  misc_feature 1..20: note = CRISPR gRNA sequence
  source 1..20: mol_type = other DNA
tcttcattaatgtccctatt

SEQ ID NO: 23749 - DNA, 20 bp, synthetic construct
  misc_feature 1..20: note = CRISPR gRNA sequence
  source 1..20: mol_type = other DNA
ttcattaatgtccctatttc

SEQ ID NO: 23750 - DNA, 20 bp, synthetic construct
  misc_feature 1..20: note = CRISPR gRNA sequence
  source 1..20: mol_type = other DNA
cattaatgtccctatttccc

SEQ ID NO: 23751 - DNA, 20 bp, synthetic construct
  misc_feature 1..20: note = CRISPR gRNA sequence
  source 1..20: mol_type = other DNA
attaatgtccctatttccca

SEQ ID NO: 23752 - DNA, 20 bp, synthetic construct
  misc_feature 1..20: note = CRISPR gRNA sequence
  source 1..20: mol_type = other DNA
atgtccctatttcccatact

SEQ ID NO: 23753 - DNA, 20 bp, synthetic construct
  misc_feature 1..20: note = CRISPR gRNA sequence
  source 1..20: mol_type = other DNA
tttcccatactgggtgccca

SEQ ID NO: 23754 - DNA, 20 bp, synthetic construct
  misc_feature 1..20: note = CRISPR gRNA sequence
  source 1..20: mol_type = other DNA
cccatactgggtgcccattc

SEQ ID NO: 23755 - DNA, 20 bp, synthetic construct
  misc_feature 1..20: note = CRISPR gRNA sequence
  source 1..20: mol_type = other DNA
ccatactgggtgcccattct

SEQ ID NO: 23756 - DNA, 20 bp, synthetic construct
  misc_feature 1..20: note = CRISPR gRNA sequence
  source 1..20: mol_type = other DNA
ggtgcccattctaatgcatt

SEQ ID NO: 23757 - DNA, 20 bp, synthetic construct
  misc_feature 1..20: note = CRISPR gRNA sequence
  source 1..20: mol_type = other DNA
taatgcatttcaggtgtatc

SEQ ID NO: 23758 - DNA, 20 bp, synthetic construct
  misc_feature 1..20: note = CRISPR gRNA sequence
  source 1..20: mol_type = other DNA
atgcatttcaggtgtatctt

SEQ ID NO: 23759 - DNA, 20 bp, synthetic construct
  misc_feature 1..20: note = CRISPR gRNA sequence
  source 1..20: mol_type = other DNA
caggtgtatctttctgtttg

SEQ ID NO: 23760 - DNA, 20 bp, synthetic construct
  misc_feature 1..20: note = CRISPR gRNA sequence
  source 1..20: mol_type = other DNA
aggtgtatctttctgtttgt

SEQ ID NO: 23761 - DNA, 20 bp, synthetic construct
  misc_feature 1..20: note = CRISPR gRNA sequence
  source 1..20: mol_type = other DNA
tctgtttgtatgtgctctta

SEQ ID NO: 23762 - DNA, 20 bp, synthetic construct
  misc_feature 1..20: note = CRISPR gRNA sequence
  source 1..20: mol_type = other DNA
ctgtttgtatgtgctcttat

SEQ ID NO: 23763 - DNA, 20 bp, synthetic construct
  misc_feature 1..20: note = CRISPR gRNA sequence
  source 1..20: mol_type = other DNA
tgtttgtatgtgctcttata

SEQ ID NO: 23764 - DNA, 20 bp, synthetic construct
  misc_feature 1..20: note = CRISPR gRNA sequence
  source 1..20: mol_type = other DNA
tttgtatgtgctcttataaa

SEQ ID NO: 23765 - DNA, 20 bp, synthetic construct
  misc_feature 1..20: note = CRISPR gRNA sequence
  source 1..20: mol_type = other DNA
gtatgtgctcttataaaaca

SEQ ID NO: 23766 - DNA, 20 bp, synthetic construct
  misc_feature 1..20: note = CRISPR gRNA sequence
  source 1..20: mol_type = other DNA
tatgtgctcttataaaacat

SEQ ID NO: 23767 - DNA, 20 bp, synthetic construct
  misc_feature 1..20: note = CRISPR gRNA sequence
  source 1..20: mol_type = other DNA
ttataaaacatgttttgcct

SEQ ID NO: 23768 - DNA, 20 bp, synthetic construct
  misc_feature 1..20: note = CRISPR gRNA sequence
  source 1..20: mol_type = other DNA
ataaaacatgttttgccttt

SEQ ID NO: 23769 - DNA, 20 bp, synthetic construct
  misc_feature 1..20: note = CRISPR gRNA sequence
  source 1..20: mol_type = other DNA
taaaacatgttttgcctttt

SEQ ID NO: 23770 - DNA, 20 bp, synthetic construct
  misc_feature 1..20: note = CRISPR gRNA sequence
  source 1..20: mol_type = other DNA
tgcctttttttttttttttt

SEQ ID NO: 23771 - DNA, 20 bp, synthetic construct
  misc_feature 1..20: note = CRISPR gRNA sequence
  source 1..20: mol_type = other DNA
gcctttttttttttttttta

SEQ ID NO: 23772 - DNA, 20 bp, synthetic construct
  misc_feature 1..20: note = CRISPR gRNA sequence
  source 1..20: mol_type = other DNA
ccttttttttttttttttag

SEQ ID NO: 23773 - DNA, 20 bp, synthetic construct
  misc_feature 1..20: note = CRISPR gRNA sequence
  source 1..20: mol_type = other DNA
ttttttttttttttagatgg

SEQ ID NO: 23774 - DNA, 20 bp, synthetic construct
  misc_feature 1..20: note = CRISPR gRNA sequence
  source 1..20: mol_type = other DNA
tttttttttttttagatgga

SEQ ID NO: 23775 - DNA, 20 bp, synthetic construct
  misc_feature 1..20: note = CRISPR gRNA sequence
  source 1..20: mol_type = other DNA
ttttttttttttagatggag

SEQ ID NO: 23776 - DNA, 20 bp, synthetic construct
  misc_feature 1..20: note = CRISPR gRNA sequence
  source 1..20: mol_type = other DNA
tttttttttttagatggagt

SEQ ID NO: 23777 - DNA, 20 bp, synthetic construct
  misc_feature 1..20: note = CRISPR gRNA sequence
  source 1..20: mol_type = other DNA
ttttttttttagatggagtc

SEQ ID NO: 23778 - DNA, 20 bp, synthetic construct
  misc_feature 1..20: note = CRISPR gRNA sequence
  source 1..20: mol_type = other DNA
tttttttttagatggagtct

SEQ ID NO: 23779 - DNA, 20 bp, synthetic construct
  misc_feature 1..20: note = CRISPR gRNA sequence
  source 1..20: mol_type = other DNA
ttttttttagatggagtctc

SEQ ID NO: 23780 - DNA, 20 bp, synthetic construct
  misc_feature 1..20: note = CRISPR gRNA sequence
  source 1..20: mol_type = other DNA
tttttttagatggagtctca

SEQ ID NO: 23781 - DNA, 20 bp, synthetic construct
  misc_feature 1..20: note = CRISPR gRNA sequence
  source 1..20: mol_type = other DNA
ttttttagatggagtctcac

SEQ ID NO: 23782 - DNA, 20 bp, synthetic construct
  misc_feature 1..20: note = CRISPR gRNA sequence
  source 1..20: mol_type = other DNA
tttttagatggagtctcact

SEQ ID NO: 23783 - DNA, 20 bp, synthetic construct
  misc_feature 1..20: note = CRISPR gRNA sequence
  source 1..20: mol_type = other DNA
ttttagatggagtctcactc

SEQ ID NO: 23784 - DNA, 20 bp, synthetic construct
  misc_feature 1..20: note = CRISPR gRNA sequence
  source 1..20: mol_type = other DNA
tttagatggagtctcactct

SEQ ID NO: 23785 - DNA, 20 bp, synthetic construct
  misc_feature 1..20: note = CRISPR gRNA sequence
  source 1..20: mol_type = other DNA
ttagatggagtctcactctg

SEQ ID NO: 23786 - DNA, 20 bp, synthetic construct
  misc_feature 1..20: note = CRISPR gRNA sequence
  source 1..20: mol_type = other DNA
tagatggagtctcactctgt

SEQ ID NO: 23787 - DNA, 20 bp, synthetic construct
  misc_feature 1..20: note = CRISPR gRNA sequence
  source 1..20: mol_type = other DNA
agatggagtctcactctgtc

SEQ ID NO: 23788 - DNA, 20 bp, synthetic construct
  misc_feature 1..20: note = CRISPR gRNA sequence
  source 1..20: mol_type = other DNA
gatggagtctcactctgtca

SEQ ID NO: 23789 - DNA, 20 bp, synthetic construct
  misc_feature 1..20: note = CRISPR gRNA sequence
  source 1..20: mol_type = other DNA
actctgtcacccaggctgag

SEQ ID NO: 23790 - DNA, 20 bp, synthetic construct
  misc_feature 1..20: note = CRISPR gRNA sequence
  source 1..20: mol_type = other DNA
tgtcacccaggctgagtttt

SEQ ID NO: 23791 - DNA, 20 bp, synthetic construct
  misc_feature 1..20: note = CRISPR gRNA sequence
  source 1..20: mol_type = other DNA
tcacccaggctgagttttct

SEQ ID NO: 23792 - DNA, 20 bp, synthetic construct
  misc_feature 1..20: note = CRISPR gRNA sequence
  source 1..20: mol_type = other DNA
agttttctatttttagtaga

SEQ ID NO: 23793 - DNA, 20 bp, synthetic construct
  misc_feature 1..20: note = CRISPR gRNA sequence
  source 1..20: mol_type = other DNA
tctatttttagtagagatgg

SEQ ID NO: 23794 - DNA, 20 bp, synthetic construct
  misc_feature 1..20: note = CRISPR gRNA sequence
  source 1..20: mol_type = other DNA
ctatttttagtagagatggg

SEQ ID NO: 23795 - DNA, 20 bp, synthetic construct
  misc_feature 1..20: note = CRISPR gRNA sequence
  source 1..20: mol_type = other DNA
tatttttagtagagatgggg

SEQ ID NO: 23796 - DNA, 20 bp, synthetic construct
  misc_feature 1..20: note = CRISPR gRNA sequence
  source 1..20: mol_type = other DNA
tttttagtagagatggggtt

SEQ ID NO: 23797 - DNA, 20 bp, synthetic construct
  misc_feature 1..20: note = CRISPR gRNA sequence
  source 1..20: mol_type = other DNA
ttagtagagatggggtttta

SEQ ID NO: 23798 - DNA, 20 bp, synthetic construct
  misc_feature 1..20: note = CRISPR gRNA sequence
  source 1..20: mol_type = other DNA
tagtagagatggggttttac

SEQ ID NO: 23799 - DNA, 20 bp, synthetic construct
  misc_feature 1..20: note = CRISPR gRNA sequence
  source 1..20: mol_type = other DNA
agtagagatggggttttacc

SEQ ID NO: 23800 - DNA, 20 bp, synthetic construct
  misc_feature 1..20: note = CRISPR gRNA sequence
  source 1..20: mol_type = other DNA
gtagagatggggttttacca

SEQ ID NO: 23801 - DNA, 20 bp, synthetic construct
  misc_feature 1..20: note = CRISPR gRNA sequence
  source 1..20: mol_type = other DNA
taccaccttggccaggctgg

SEQ ID NO: 23802 - DNA, 20 bp, synthetic construct
  misc_feature 1..20: note = CRISPR gRNA sequence
  source 1..20: mol_type = other DNA
accaccttggccaggctggt

SEQ ID NO: 23803 - DNA, 20 bp, synthetic construct
  misc_feature 1..20: note = CRISPR gRNA sequence
  source 1..20: mol_type = other DNA
ccaccttggccaggctggtc

SEQ ID NO: 23804 - DNA, 20 bp, synthetic construct
  misc_feature 1..20: note = CRISPR gRNA sequence
  source 1..20: mol_type = other DNA
ggccaggctggtctcaaact

SEQ ID NO: 23805 - DNA, 20 bp, synthetic construct
  misc_feature 1..20: note = CRISPR gRNA sequence
  source 1..20: mol_type = other DNA
gccaggctggtctcaaactc

SEQ ID NO: 23806 - DNA, 20 bp, synthetic construct
  misc_feature 1..20: note = CRISPR gRNA sequence
  source 1..20: mol_type = other DNA
gtctcaaactcctgacctca

SEQ ID NO: 23807 - DNA, 20 bp, synthetic construct
  misc_feature 1..20: note = CRISPR gRNA sequence
  source 1..20: mol_type = other DNA
aaactcctgacctcaggtga

SEQ ID NO: 23808 - DNA, 20 bp, synthetic construct
  misc_feature 1..20: note = CRISPR gRNA sequence
  source 1..20: mol_type = other DNA
ctgacctcaggtgatccacc

SEQ ID NO: 23809 - DNA, 20 bp, synthetic construct
  misc_feature 1..20: note = CRISPR gRNA sequence
  source 1..20: mol_type = other DNA
acctcaggtgatccacccgc

SEQ ID NO: 23810 - DNA, 20 bp, synthetic construct
  misc_feature 1..20: note = CRISPR gRNA sequence
  source 1..20: mol_type = other DNA
aggtgatccacccgcctcgg

SEQ ID NO: 23811 - DNA, 20 bp, synthetic construct
  misc_feature 1..20: note = CRISPR gRNA sequence
  source 1..20: mol_type = other DNA
ggcctcccaaagtgctggaa

SEQ ID NO: 23812 - DNA, 20 bp, synthetic construct
  misc_feature 1..20: note = CRISPR gRNA sequence
  source 1..20: mol_type = other DNA
ccaaagtgctggaattacag

SEQ ID NO: 23813 - DNA, 20 bp, synthetic construct
  misc_feature 1..20: note = CRISPR gRNA sequence
  source 1..20: mol_type = other DNA
gaattacaggtgcgagtcac

SEQ ID NO: 23814 - DNA, 20 bp, synthetic construct
  misc_feature 1..20: note = CRISPR gRNA sequence
  source 1..20: mol_type = other DNA
caggtgcgagtcaccacgcc

SEQ ID NO: 23815 - DNA, 20 bp, synthetic construct
  misc_feature 1..20: note = CRISPR gRNA sequence
  source 1..20: mol_type = other DNA
gccacagtttcttacttttg

SEQ ID NO: 23816 - DNA, 20 bp, synthetic construct
  misc_feature 1..20: note = CRISPR gRNA sequence
  source 1..20: mol_type = other DNA
cttacttttgcattctgtac

SEQ ID NO: 23817 - DNA, 20 bp, synthetic construct
  misc_feature 1..20: note = CRISPR gRNA sequence
  source 1..20: mol_type = other DNA
ttacttttgcattctgtact

SEQ ID NO: 23818 - DNA, 20 bp, synthetic construct
  misc_feature 1..20: note = CRISPR gRNA sequence
  source 1..20: mol_type = other DNA
acttttgcattctgtactat

SEQ ID NO: 23819 - DNA, 20 bp, synthetic construct
  misc_feature 1..20: note = CRISPR gRNA sequence
  source 1..20: mol_type = other DNA
cttttgcattctgtactatg

SEQ ID NO: 23820 - DNA, 20 bp, synthetic construct
  misc_feature 1..20: note = CRISPR gRNA sequence
  source 1..20: mol_type = other DNA
ttgcattctgtactatgttt

SEQ ID NO: 23821 - DNA, 20 bp, synthetic construct
  misc_feature 1..20: note = CRISPR gRNA sequence
  source 1..20: mol_type = other DNA
tgcattctgtactatgtttt

SEQ ID NO: 23822 - DNA, 20 bp, synthetic construct
  misc_feature 1..20: note = CRISPR gRNA sequence
  source 1..20: mol_type = other DNA
gcattctgtactatgttttt

SEQ ID NO: 23823 - DNA, 20 bp, synthetic construct
  misc_feature 1..20: note = CRISPR gRNA sequence
  source 1..20: mol_type = other DNA
cattctgtactatgttttta

SEQ ID NO: 23824 - DNA, 20 bp, synthetic construct
  misc_feature 1..20: note = CRISPR gRNA sequence
  source 1..20: mol_type = other DNA
tgtactatgtttttaggatc

SEQ ID NO: 23825 - DNA, 20 bp, synthetic construct
  misc_feature 1..20: note = CRISPR gRNA sequence
  source 1..20: mol_type = other DNA
tactatgtttttaggatcta

SEQ ID NO: 23826 - DNA, 20 bp, synthetic construct
  misc_feature 1..20: note = CRISPR gRNA sequence
  source 1..20: mol_type = other DNA
tgtttttaggatctacttgc

SEQ ID NO: 23827 - DNA, 20 bp, synthetic construct
  misc_feature 1..20: note = CRISPR gRNA sequence
  source 1..20: mol_type = other DNA
ttaggatctacttgccttgc

SEQ ID NO: 23828 - DNA, 20 bp, synthetic construct
  misc_feature 1..20: note = CRISPR gRNA sequence
  source 1..20: mol_type = other DNA
taggatctacttgccttgct

SEQ ID NO: 23829 - DNA, 20 bp, synthetic construct
  misc_feature 1..20: note = CRISPR gRNA sequence
  source 1..20: mol_type = other DNA
aggatctacttgccttgctt

SEQ ID NO: 23830 - DNA, 20 bp, synthetic construct
  misc_feature 1..20: note = CRISPR gRNA sequence
  source 1..20: mol_type = other DNA
ggatctacttgccttgcttc

SEQ ID NO: 23831 - DNA, 20 bp, synthetic construct
  misc_feature 1..20: note = CRISPR gRNA sequence
  source 1..20: mol_type = other DNA
cttgccttgcttctgatgca

SEQ ID NO: 23832 - DNA, 20 bp, synthetic construct
  misc_feature 1..20: note = CRISPR gRNA sequence
  source 1..20: mol_type = other DNA
gccttgcttctgatgcattt

SEQ ID NO: 23833 - DNA, 20 bp, synthetic construct
  misc_feature 1..20: note = CRISPR gRNA sequence
  source 1..20: mol_type = other DNA
ccttgcttctgatgcatttg

SEQ ID NO: 23834 - DNA, 20 bp, synthetic construct
  misc_feature 1..20: note = CRISPR gRNA sequence
  source 1..20: mol_type = other DNA
gcttctgatgcatttgatct

SEQ ID NO: 23835 - DNA, 20 bp, synthetic construct
  misc_feature 1..20: note = CRISPR gRNA sequence
  source 1..20: mol_type = other DNA
cttctgatgcatttgatctt

SEQ ID NO: 23836 - DNA, 20 bp, synthetic construct
  misc_feature 1..20: note = CRISPR gRNA sequence
  source 1..20: mol_type = other DNA
ctgatgcatttgatctttgc

SEQ ID NO: 23837 - DNA, 20 bp, synthetic construct
  misc_feature 1..20: note = CRISPR gRNA sequence
  source 1..20: mol_type = other DNA
tgatgcatttgatctttgct

SEQ ID NO: 23838 - DNA, 20 bp, synthetic construct
  misc_feature 1..20: note = CRISPR gRNA sequence
  source 1..20: mol_type = other DNA
atgcatttgatctttgcttc

SEQ ID NO: 23839 - DNA, 20 bp, synthetic construct
  misc_feature 1..20: note = CRISPR gRNA sequence
  source 1..20: mol_type = other DNA
gatctttgcttctaatcacg

SEQ ID NO: 23840 - DNA, 20 bp, synthetic construct
  misc_feature 1..20: note = CRISPR gRNA sequence
  source 1..20: mol_type = other DNA
atctttgcttctaatcacgg

SEQ ID NO: 23841 - DNA, 20 bp, synthetic construct
  misc_feature 1..20: note = CRISPR gRNA sequence
  source 1..20: mol_type = other DNA
tgcttctaatcacggacatt

SEQ ID NO: 23842 - DNA, 20 bp, synthetic construct
  misc_feature 1..20: note = CRISPR gRNA sequence
  source 1..20: mol_type = other DNA
gcttctaatcacggacattg

SEQ ID NO: 23843 - DNA, 20 bp, synthetic construct
  misc_feature 1..20: note = CRISPR gRNA sequence
  source 1..20: mol_type = other DNA
cttctaatcacggacattgt

SEQ ID NO: 23844 - DNA, 20 bp, synthetic construct
  misc_feature 1..20: note = CRISPR gRNA sequence
  source 1..20: mol_type = other DNA
ctaatcacggacattgttct

SEQ ID NO: 23845 - DNA, 20 bp, synthetic construct
  misc_feature 1..20: note = CRISPR gRNA sequence
  source 1..20: mol_type = other DNA
taatcacggacattgttctc

SEQ ID NO: 23846 - DNA, 20 bp, synthetic construct
  misc_feature 1..20: note = CRISPR gRNA sequence
  source 1..20: mol_type = other DNA
atcacggacattgttctcta

SEQ ID NO: 23847 - DNA, 20 bp, synthetic construct
  misc_feature 1..20: note = CRISPR gRNA sequence
  source 1..20: mol_type = other DNA
ttctctatggagtgcagggg

SEQ ID NO: 23848 - DNA, 20 bp, synthetic construct
  misc_feature 1..20: note = CRISPR gRNA sequence
  source 1..20: mol_type = other DNA
tctatggagtgcaggggtta

SEQ ID NO: 23849 - DNA, 20 bp, synthetic construct
  misc_feature 1..20: note = CRISPR gRNA sequence
  source 1..20: mol_type = other DNA
tatggagtgcaggggttact

SEQ ID NO: 23850 - DNA, 20 bp, synthetic construct
  misc_feature 1..20: note = CRISPR gRNA sequence
  source 1..20: mol_type = other DNA
tggagtgcaggggttacttt

SEQ ID NO: 23851 - DNA, 20 bp, synthetic construct
  misc_feature 1..20: note = CRISPR gRNA sequence
  source 1..20: mol_type = other DNA
cttttcacctgtccacaccc

SEQ ID NO: 23852 - DNA, 20 bp, synthetic construct
  misc_feature 1..20: note = CRISPR gRNA sequence
  source 1..20: mol_type = other DNA
ttcacctgtccacaccccca

SEQ ID NO: 23853 - DNA, 20 bp, synthetic construct
  misc_feature 1..20: note = CRISPR gRNA sequence
  source 1..20: mol_type = other DNA
tcacctgtccacacccccag

SEQ ID NO: 23854 - DNA, 20 bp, synthetic construct
  misc_feature 1..20: note = CRISPR gRNA sequence
  source 1..20: mol_type = other DNA
cacctgtccacacccccagt

SEQ ID NO: 23855 - DNA, 20 bp, synthetic construct
  misc_feature 1..20: note = CRISPR gRNA sequence
  source 1..20: mol_type = other DNA
acctgtccacacccccagtg

SEQ ID NO: 23856 - DNA, 20 bp, synthetic construct
  misc_feature 1..20: note = CRISPR gRNA sequence
  source 1..20: mol_type = other DNA
tccacacccccagtgatgga

SEQ ID NO: 23857 - DNA, 20 bp, synthetic construct
  misc_feature 1..20: note = CRISPR gRNA sequence
  source 1..20: mol_type = other DNA
ggtgacctccaactctctgt

SEQ ID NO: 23858 - DNA, 20 bp, synthetic construct
  misc_feature 1..20: note = CRISPR gRNA sequence
  source 1..20: mol_type = other DNA
caactctctgtcaccacaaa

SEQ ID NO: 23859 - DNA, 20 bp, synthetic construct
  misc_feature 1..20: note = CRISPR gRNA sequence
  source 1..20: mol_type = other DNA
tctgtcaccacaaataacac

SEQ ID NO: 23860 - DNA, 20 bp, synthetic construct
  misc_feature 1..20: note = CRISPR gRNA sequence
  source 1..20: mol_type = other DNA
tgtcaccacaaataacacag

SEQ ID NO: 23861 - DNA, 20 bp, synthetic construct
  misc_feature 1..20: note = CRISPR gRNA sequence
  source 1..20: mol_type = other DNA
tcaccacaaataacacagca

SEQ ID NO: 23862 - DNA, 20 bp, synthetic construct
  misc_feature 1..20: note = CRISPR gRNA sequence
  source 1..20: mol_type = other DNA
agatgggttctcctggggag

SEQ ID NO: 23863 - DNA, 20 bp, synthetic construct
  misc_feature 1..20: note = CRISPR gRNA sequence
  source 1..20: mol_type = other DNA
tcctggggagttgtgggaac

SEQ ID NO: 23864 - DNA, 20 bp, synthetic construct
  misc_feature 1..20: note = CRISPR gRNA sequence
  source 1..20: mol_type = other DNA
ctggggagttgtgggaacat

SEQ ID NO: 23865 - DNA, 20 bp, synthetic construct
  misc_feature 1..20: note = CRISPR gRNA sequence
  source 1..20: mol_type = other DNA
gggagttgtgggaacatttc

SEQ ID NO: 23866 - DNA, 20 bp, synthetic construct
  misc_feature 1..20: note = CRISPR gRNA sequence
  source 1..20: mol_type = other DNA
tgggaacatttcttcaggat

SEQ ID NO: 23867 - DNA, 20 bp, synthetic construct
  misc_feature 1..20: note = CRISPR gRNA sequence
  source 1..20: mol_type = other DNA
cttcaggatatatagaccca

SEQ ID NO: 23868 - DNA, 20 bp, synthetic construct
  misc_feature 1..20: note = CRISPR gRNA sequence
  source 1..20: mol_type = other DNA
ttcaggatatatagacccaa

SEQ ID NO: 23869 - DNA, 20 bp, synthetic construct
  misc_feature 1..20: note = CRISPR gRNA sequence
  source 1..20: mol_type = other DNA
caggatatatagacccaaga

SEQ ID NO: 23870 - DNA, 20 bp, synthetic construct
  misc_feature 1..20: note = CRISPR gRNA sequence
  source 1..20: mol_type = other DNA
aggatatatagacccaagag

SEQ ID NO: 23871 - DNA, 20 bp, synthetic construct
  misc_feature 1..20: note = CRISPR gRNA sequence
  source 1..20: mol_type = other DNA
aattgccaggtggtaggatc

SEQ ID NO: 23872 - DNA, 20 bp, synthetic construct
  misc_feature 1..20: note = CRISPR gRNA sequence
  source 1..20: mol_type = other DNA
ccaggtggtaggatctacat

SEQ ID NO: 23873 - DNA, 20 bp, synthetic construct
  misc_feature 1..20: note = CRISPR gRNA sequence
  source 1..20: mol_type = other DNA
catatccttagatattctac

SEQ ID NO: 23874 - DNA, 20 bp, synthetic construct
  misc_feature 1..20: note = CRISPR gRNA sequence
  source 1..20: mol_type = other DNA
agatattctacatgatgcca

SEQ ID NO: 23875 - DNA, 20 bp, synthetic construct
  misc_feature 1..20: note = CRISPR gRNA sequence
  source 1..20: mol_type = other DNA
gatattctacatgatgccag

SEQ ID NO: 23876 - DNA, 20 bp, synthetic construct
  misc_feature 1..20: note = CRISPR gRNA sequence
  source 1..20: mol_type = other DNA
tacatgatgccaggtcgttc

SEQ ID NO: 23877 - DNA, 20 bp, synthetic construct
  misc_feature 1..20: note = CRISPR gRNA sequence
  source 1..20: mol_type = other DNA
catgatgccaggtcgttctc

SEQ ID NO: 23878 - DNA, 20 bp, synthetic construct
  misc_feature 1..20: note = CRISPR gRNA sequence
  source 1..20: mol_type = other DNA
tccagagcggccccatccat

SEQ ID NO: 23879 - DNA, 20 bp, synthetic construct
  misc_feature 1..20: note = CRISPR gRNA sequence
  source 1..20: mol_type = other DNA
cagagcggccccatccatct

SEQ ID NO: 23880 - DNA, 20 bp, synthetic construct
  misc_feature 1..20: note = CRISPR gRNA sequence
  source 1..20: mol_type = other DNA
cattcccacaaacccgtgta

SEQ ID NO: 23881 - DNA, 20 bp, synthetic construct
  misc_feature 1..20: note = CRISPR gRNA sequence
  source 1..20: mol_type = other DNA
ccacaaacccgtgtaaccaa

SEQ ID NO: 23882 - DNA, 20 bp, synthetic construct
  misc_feature 1..20: note = CRISPR gRNA sequence
  source 1..20: mol_type = other DNA
ggcatttcccagatgtctaa

SEQ ID NO: 23883 - DNA, 20 bp, synthetic construct
  misc_feature 1..20: note = CRISPR gRNA sequence
  source 1..20: mol_type = other DNA
gcatttcccagatgtctaac

SEQ ID NO: 23884 - DNA, 20 bp, synthetic construct
  misc_feature 1..20: note = CRISPR gRNA sequence
  source 1..20: mol_type = other DNA
cccagatgtctaacttttgc

SEQ ID NO: 23885 - DNA, 20 bp, synthetic construct
  misc_feature 1..20: note = CRISPR gRNA sequence
  source 1..20: mol_type = other DNA
ccagatgtctaacttttgcc

SEQ ID NO: 23886 - DNA, 20 bp, synthetic construct
  misc_feature 1..20: note = CRISPR gRNA sequence
  source 1..20: mol_type = other DNA
acttttgccagttgtacagt

SEQ ID NO: 23887 - DNA, 20 bp, synthetic construct
  misc_feature 1..20: note = CRISPR gRNA sequence
  source 1..20: mol_type = other DNA
ttgccagttgtacagtatca

SEQ ID NO: 23888 - DNA, 20 bp, synthetic construct
  misc_feature 1..20: note = CRISPR gRNA sequence
  source 1..20: mol_type = other DNA
tgccagttgtacagtatcaa

SEQ ID NO: 23889 - DNA, 20 bp, synthetic construct
  misc_feature 1..20: note = CRISPR gRNA sequence
  source 1..20: mol_type = other DNA
gccagttgtacagtatcaag

SEQ ID NO: 23890 - DNA, 20 bp, synthetic construct
  misc_feature 1..20: note = CRISPR gRNA sequence
  source 1..20: mol_type = other DNA
ccagttgtacagtatcaagt

SEQ ID NO: 23891 - DNA, 20 bp, synthetic construct
  misc_feature 1..20: note = CRISPR gRNA sequence
  source 1..20: mol_type = other DNA
tacagtatcaagtgtcactt

SEQ ID NO: 23892 - DNA, 20 bp, synthetic construct
  misc_feature 1..20: note = CRISPR gRNA sequence
  source 1..20: mol_type = other DNA
tgctgttttatttttggagt

SEQ ID NO: 23893 - DNA, 20 bp, synthetic construct
  misc_feature 1..20: note = CRISPR gRNA sequence
  source 1..20: mol_type = other DNA
gctgttttatttttggagtt

SEQ ID NO: 23894 - DNA, 20 bp, synthetic construct
  misc_feature 1..20: note = CRISPR gRNA sequence
  source 1..20: mol_type = other DNA
ctgttttatttttggagttt

SEQ ID NO: 23895 - DNA, 20 bp, synthetic construct
  misc_feature 1..20: note = CRISPR gRNA sequence
  source 1..20: mol_type = other DNA
ttttatttttggagtttaca

SEQ ID NO: 23896 - DNA, 20 bp, synthetic construct
  misc_feature 1..20: note = CRISPR gRNA sequence
  source 1..20: mol_type = other DNA
tatttttggagtttacatct

SEQ ID NO: 23897 - DNA, 20 bp, synthetic construct
  misc_feature 1..20: note = CRISPR gRNA sequence
  source 1..20: mol_type = other DNA
atttttggagtttacatctt

SEQ ID NO: 23898 - DNA, 20 bp, synthetic construct
  misc_feature 1..20: note = CRISPR gRNA sequence
  source 1..20: mol_type = other DNA
tttttggagtttacatctta

SEQ ID NO: 23899 - DNA, 20 bp, synthetic construct
  misc_feature 1..20: note = CRISPR gRNA sequence
  source 1..20: mol_type = other DNA
ttggagtttacatcttagta

SEQ ID NO: 23900 - DNA, 20 bp, synthetic construct
  misc_feature 1..20: note = CRISPR gRNA sequence
  source 1..20: mol_type = other DNA
tggagtttacatcttagtac

SEQ ID NO: 23901 - DNA, 20 bp, synthetic construct
  misc_feature 1..20: note = CRISPR gRNA sequence
  source 1..20: mol_type = other DNA
ggagtttacatcttagtacc

SEQ ID NO: 23902 - DNA, 20 bp, synthetic construct
  misc_feature 1..20: note = CRISPR gRNA sequence
  source 1..20: mol_type = other DNA
gagtttacatcttagtacca

SEQ ID NO: 23903 - DNA, 20 bp, synthetic construct
  misc_feature 1..20: note = CRISPR gRNA sequence
  source 1..20: mol_type = other DNA
acatcttagtaccacttact

SEQ ID NO: 23904 - DNA, 20 bp, synthetic construct
  misc_feature 1..20: note = CRISPR gRNA sequence
  source 1..20: mol_type = other DNA
catcttagtaccacttactc

SEQ ID NO: 23905 - DNA, 20 bp, synthetic construct
  misc_feature 1..20: note = CRISPR gRNA sequence
  source 1..20: mol_type = other DNA
agtaccacttactcgctaag

SEQ ID NO: 23906 - DNA, 20 bp, synthetic construct
  misc_feature 1..20: note = CRISPR gRNA sequence
  source 1..20: mol_type = other DNA
gtaccacttactcgctaagt

SEQ ID NO: 23907 - DNA, 20 bp, synthetic construct
  misc_feature 1..20: note = CRISPR gRNA sequence
  source 1..20: mol_type = other DNA
actcgctaagtcactttagg

SEQ ID NO: 23908 - DNA, 20 bp, synthetic construct
  misc_feature 1..20: note = CRISPR gRNA sequence
  source 1..20: mol_type = other DNA
ctcgctaagtcactttaggt

SEQ ID NO: 23909 - DNA, 20 bp, synthetic construct
  misc_feature 1..20: note = CRISPR gRNA sequence
  source 1..20: mol_type = other DNA
gctaagtcactttaggtaag

SEQ ID NO: 23910 - DNA, 20 bp, synthetic construct
  misc_feature 1..20: note = CRISPR gRNA sequence
  source 1..20: mol_type = other DNA
agtcactttaggtaagtcac

SEQ ID NO: 23911 - DNA, 20 bp, synthetic construct
  misc_feature 1..20: note = CRISPR gRNA sequence
  source 1..20: mol_type = other DNA
taggtaagtcacaacaaccc

SEQ ID NO: 23912 - DNA, 20 bp, synthetic construct
  misc_feature 1..20: note = CRISPR gRNA sequence
  source 1..20: mol_type = other DNA
aggtaagtcacaacaaccca

SEQ ID NO: 23913 - DNA, 20 bp, synthetic construct
  misc_feature 1..20: note = CRISPR gRNA sequence
  source 1..20: mol_type = other DNA
ggtaagtcacaacaacccag

SEQ ID NO: 23914 - DNA, 20 bp, synthetic construct
  misc_feature 1..20: note = CRISPR gRNA sequence
  source 1..20: mol_type = other DNA
tgccaacaaaatgcagtcga

SEQ ID NO: 23915 - DNA, 20 bp, synthetic construct
  misc_feature 1..20: note = CRISPR gRNA sequence
  source 1..20: mol_type = other DNA
tgtgactcagagaggttgag

SEQ ID NO: 23916 - DNA, 20 bp, synthetic construct
  misc_feature 1..20: note = CRISPR gRNA sequence
  source 1..20: mol_type = other DNA
tgactcagagaggttgagta

SEQ ID NO: 23917 - DNA, 20 bp, synthetic construct
  misc_feature 1..20: note = CRISPR gRNA sequence
  source 1..20: mol_type = other DNA
agagaggttgagtaacattt

SEQ ID NO: 23918 - DNA, 20 bp, synthetic construct
  misc_feature 1..20: note = CRISPR gRNA sequence
  source 1..20: mol_type = other DNA
agtaacatttgcaaagtcac

SEQ ID NO: 23919 - DNA, 20 bp, synthetic construct
  misc_feature 1..20: note = CRISPR gRNA sequence
  source 1..20: mol_type = other DNA
gcaaagtcacacagcaagtg

SEQ ID NO: 23920 - DNA, 20 bp, synthetic construct
  misc_feature 1..20: note = CRISPR gRNA sequence
  source 1..20: mol_type = other DNA
caaagtcacacagcaagtgt

SEQ ID NO: 23921 - DNA, 20 bp, synthetic construct
  misc_feature 1..20: note = CRISPR gRNA sequence
  source 1..20: mol_type = other DNA
agatttgaacccagagcctg

SEQ ID NO: 23922 - DNA, 20 bp, synthetic construct
  misc_feature 1..20: note = CRISPR gRNA sequence
  source 1..20: mol_type = other DNA
gaacccagagcctgcaccct

SEQ ID NO: 23923 - DNA, 20 bp, synthetic construct
  misc_feature 1..20: note = CRISPR gRNA sequence
  source 1..20: mol_type = other DNA
aacccagagcctgcaccctt

SEQ ID NO: 23924 - DNA, 20 bp, synthetic construct
  misc_feature 1..20: note = CRISPR gRNA sequence
  source 1..20: mol_type = other DNA
cacccttaaccactatgcta

SEQ ID NO: 23925 - DNA, 20 bp, synthetic construct
  misc_feature 1..20: note = CRISPR gRNA sequence
  source 1..20: mol_type = other DNA
aaccactatgctattattat

SEQ ID NO: 23926 - DNA, 20 bp, synthetic construct
  misc_feature 1..20: note = CRISPR gRNA sequence
  source 1..20: mol_type = other DNA
accactatgctattattatg

SEQ ID NO: 23927 - DNA, 20 bp, synthetic construct
  misc_feature 1..20: note = CRISPR gRNA sequence
  source 1..20: mol_type = other DNA
tgctattattatgttttgtc

SEQ ID NO: 23928 - DNA, 20 bp, synthetic construct
  misc_feature 1..20: note = CRISPR gRNA sequence
  source 1..20: mol_type = other DNA
ttattatgttttgtctctct

SEQ ID NO: 23929 - DNA, 20 bp, synthetic construct
  misc_feature 1..20: note = CRISPR gRNA sequence
  source 1..20: mol_type = other DNA
ttatgttttgtctctctcct

SEQ ID NO: 23930 - DNA, 20 bp, synthetic construct
  misc_feature 1..20: note = CRISPR gRNA sequence
  source 1..20: mol_type = other DNA
tgttttgtctctctcctaaa

SEQ ID NO: 23931 - DNA, 20 bp, synthetic construct
  misc_feature 1..20: note = CRISPR gRNA sequence
  source 1..20: mol_type = other DNA
tgtctctctcctaaaatatc

SEQ ID NO: 23932 - DNA, 20 bp, synthetic construct
  misc_feature 1..20: note = CRISPR gRNA sequence
  source 1..20: mol_type = other DNA
gtctctctcctaaaatatca

SEQ ID NO: 23933 - DNA, 20 bp, synthetic construct
  misc_feature 1..20: note = CRISPR gRNA sequence
  source 1..20: mol_type = other DNA
tctctctcctaaaatatcat

SEQ ID NO: 23934 - DNA, 20 bp, synthetic construct
  misc_feature 1..20: note = CRISPR gRNA sequence
  source 1..20: mol_type = other DNA
tctcctaaaatatcatctgg

SEQ ID NO: 23935 - DNA, 20 bp, synthetic construct
  misc_feature 1..20: note = CRISPR gRNA sequence
  source 1..20: mol_type = other DNA
tcctaaaatatcatctgggt

SEQ ID NO: 23936 - DNA, 20 bp, synthetic construct
  misc_feature 1..20: note = CRISPR gRNA sequence
  source 1..20: mol_type = other DNA
ctaaaatatcatctgggtct

SEQ ID NO: 23937 - DNA, 20 bp, synthetic construct
  misc_feature 1..20: note = CRISPR gRNA sequence
  source 1..20: mol_type = other DNA
aaatatcatctgggtctaca

SEQ ID NO: 23938 - DNA, 20 bp, synthetic construct
  misc_feature 1..20: note = CRISPR gRNA sequence
  source 1..20: mol_type = other DNA
ggtctacattgcaagcctct

SEQ ID NO: 23939 - DNA, 20 bp, synthetic construct
  misc_feature 1..20: note = CRISPR gRNA sequence
  source 1..20: mol_type = other DNA
cattgcaagcctctttggca

SEQ ID NO: 23940 - DNA, 20 bp, synthetic construct
  misc_feature 1..20: note = CRISPR gRNA sequence
  source 1..20: mol_type = other DNA
caagcctctttggcagggac

SEQ ID NO: 23941 - DNA, 20 bp, synthetic construct
  misc_feature 1..20: note = CRISPR gRNA sequence
  source 1..20: mol_type = other DNA
tttggcagggactgtgtggt

SEQ ID NO: 23942 - DNA, 20 bp, synthetic construct
  misc_feature 1..20: note = CRISPR gRNA sequence
  source 1..20: mol_type = other DNA
tggcagggactgtgtggtaa

SEQ ID NO: 23943 - DNA, 20 bp, synthetic construct
  misc_feature 1..20: note = CRISPR gRNA sequence
  source 1..20: mol_type = other DNA
ggcagggactgtgtggtaaa

SEQ ID NO: 23944 - DNA, 20 bp, synthetic construct
  misc_feature 1..20: note = CRISPR gRNA sequence
  source 1..20: mol_type = other DNA
gcagggactgtgtggtaaac

SEQ ID NO: 23945 - DNA, 20 bp, synthetic construct
  misc_feature 1..20: note = CRISPR gRNA sequence
  source 1..20: mol_type = other DNA
tgtggtaaacctctttgggg

SEQ ID NO: 23946 - DNA, 20 bp, synthetic construct
  misc_feature 1..20: note = CRISPR gRNA sequence
  source 1..20: mol_type = other DNA
tttggggccagtaaggaact

SEQ ID NO: 23947 - DNA, 20 bp, synthetic construct
  misc_feature 1..20: note = CRISPR gRNA sequence
  source 1..20: mol_type = other DNA
tggggccagtaaggaactga

SEQ ID NO: 23948 - DNA, 20 bp, synthetic construct
  misc_feature 1..20: note = CRISPR gRNA sequence
  source 1..20: mol_type = other DNA
ggggccagtaaggaactgag

SEQ ID NO: 23949 - DNA, 20 bp, synthetic construct
  misc_feature 1..20: note = CRISPR gRNA sequence
  source 1..20: mol_type = other DNA
gggccagtaaggaactgagc

SEQ ID NO: 23950 - DNA, 20 bp, synthetic construct
  misc_feature 1..20: note = CRISPR gRNA sequence
  source 1..20: mol_type = other DNA
agctcagtgactttcttacg

SEQ ID NO: 23951 - DNA, 20 bp, synthetic construct
  misc_feature 1..20: note = CRISPR gRNA sequence
  source 1..20: mol_type = other DNA
agtgactttcttacggggtg

SEQ ID NO: 23952 - DNA, 20 bp, synthetic construct
  misc_feature 1..20: note = CRISPR gRNA sequence
  source 1..20: mol_type = other DNA
tcttacggggtgctcagtga

SEQ ID NO: 23953 - DNA, 20 bp, synthetic construct
  misc_feature 1..20: note = CRISPR gRNA sequence
  source 1..20: mol_type = other DNA
cttacggggtgctcagtgaa

SEQ ID NO: 23954 - DNA, 20 bp, synthetic construct
  misc_feature 1..20: note = CRISPR gRNA sequence
  source 1..20: mol_type = other DNA
ttacggggtgctcagtgaat

SEQ ID NO: 23955 - DNA, 20 bp, synthetic construct
  misc_feature 1..20: note = CRISPR gRNA sequence
  source 1..20: mol_type = other DNA
acggggtgctcagtgaatca

SEQ ID NO: 23956 - DNA, 20 bp, synthetic construct
  misc_feature 1..20: note = CRISPR gRNA sequence
  source 1..20: mol_type = other DNA
cggggtgctcagtgaatcat

SEQ ID NO: 23957 - DNA, 20 bp, synthetic construct
  misc_feature 1..20: note = CRISPR gRNA sequence
  source 1..20: mol_type = other DNA
agtgaatcattgttttacag

SEQ ID NO: 23958 - DNA, 20 bp, synthetic construct
  misc_feature 1..20: note = CRISPR gRNA sequence
  source 1..20: mol_type = other DNA
ttttacagctttagagggga

SEQ ID NO: 23959 - DNA, 20 bp, synthetic construct
  misc_feature 1..20: note = CRISPR gRNA sequence
  source 1..20: mol_type = other DNA
tacagctttagaggggaaaa

SEQ ID NO: 23960 - DNA, 20 bp, synthetic construct
  misc_feature 1..20: note = CRISPR gRNA sequence
  source 1..20: mol_type = other DNA
acagctttagaggggaaaag

SEQ ID NO: 23961 - DNA, 20 bp, synthetic construct
  misc_feature 1..20: note = CRISPR gRNA sequence
  source 1..20: mol_type = other DNA
cagctttagaggggaaaagt

SEQ ID NO: 23962 - DNA, 20 bp, synthetic construct
  misc_feature 1..20: note = CRISPR gRNA sequence
  source 1..20: mol_type = other DNA
tagaggggaaaagtgagaga

SEQ ID NO: 23963 - DNA, 20 bp, synthetic construct
  misc_feature 1..20: note = CRISPR gRNA sequence
  source 1..20: mol_type = other DNA
agaggggaaaagtgagagat

SEQ ID NO: 23964 - DNA, 20 bp, synthetic construct
  misc_feature 1..20: note = CRISPR gRNA sequence
  source 1..20: mol_type = other DNA
gaggggaaaagtgagagatg

SEQ ID NO: 23965 - DNA, 20 bp, synthetic construct
  misc_feature 1..20: note = CRISPR gRNA sequence
  source 1..20: mol_type = other DNA
cttagagtttatctggagga

SEQ ID NO: 23966 - DNA, 20 bp, synthetic construct
  misc_feature 1..20: note = CRISPR gRNA sequence
  source 1..20: mol_type = other DNA
ttagagtttatctggaggac

SEQ ID NO: 23967 - DNA, 20 bp, synthetic construct
  misc_feature 1..20: note = CRISPR gRNA sequence
  source 1..20: mol_type = other DNA
agagtttatctggaggacta

SEQ ID NO: 23968 - DNA, 20 bp, synthetic construct
  misc_feature 1..20: note = CRISPR gRNA sequence
  source 1..20: mol_type = other DNA
gagtttatctggaggactac

SEQ ID NO: 23969 - DNA, 20 bp, synthetic construct
  misc_feature 1..20: note = CRISPR gRNA sequence
  source 1..20: mol_type = other DNA
atctggaggactacagggtg

SEQ ID NO: 23970 - DNA, 20 bp, synthetic construct
  misc_feature 1..20: note = CRISPR gRNA sequence
  source 1..20: mol_type = other DNA
tctggaggactacagggtgc

SEQ ID NO: 23971 - DNA, 20 bp, synthetic construct
  misc_feature 1..20: note = CRISPR gRNA sequence
  source 1..20: mol_type = other DNA
gaggactacagggtgcatga

SEQ ID NO: 23972 - DNA, 20 bp, synthetic construct
  misc_feature 1..20: note = CRISPR gRNA sequence
  source 1..20: mol_type = other DNA
cagggtgcatgagcaaaagc

SEQ ID NO: 23973 - DNA, 20 bp, synthetic construct
  misc_feature 1..20: note = CRISPR gRNA sequence
  source 1..20: mol_type = other DNA
atttgagctactacccccac

SEQ ID NO: 23974 - DNA, 20 bp, synthetic construct
  misc_feature 1..20: note = CRISPR gRNA sequence
  source 1..20: mol_type = other DNA
gagctactacccccacaaag

SEQ ID NO: 23975 - DNA, 20 bp, synthetic construct
  misc_feature 1..20: note = CRISPR gRNA sequence
  source 1..20: mol_type = other DNA
agctactacccccacaaaga

SEQ ID NO: 23976 - DNA, 20 bp, synthetic construct
  misc_feature 1..20: note = CRISPR gRNA sequence
  source 1..20: mol_type = other DNA
ctacccccacaaagaagctg

SEQ ID NO: 23977 - DNA, 20 bp, synthetic construct
  misc_feature 1..20: note = CRISPR gRNA sequence
  source 1..20: mol_type = other DNA
cccccacaaagaagctgttt

SEQ ID NO: 23978 - DNA, 20 bp, synthetic construct
  misc_feature 1..20: note = CRISPR gRNA sequence
  source 1..20: mol_type = other DNA
tttggggtctggtcatggta

SEQ ID NO: 23979 - DNA, 20 bp, synthetic construct
  misc_feature 1..20: note = CRISPR gRNA sequence
  source 1..20: mol_type = other DNA
ggggtctggtcatggtagat

SEQ ID NO: 23980 - DNA, 20 bp, synthetic construct
  misc_feature 1..20: note = CRISPR gRNA sequence
  source 1..20: mol_type = other DNA
gggtctggtcatggtagata

SEQ ID NO: 23981 - DNA, 20 bp, synthetic construct
  misc_feature 1..20: note = CRISPR gRNA sequence
  source 1..20: mol_type = other DNA
gtcatggtagataggcattc

SEQ ID NO: 23982 - DNA, 20 bp, synthetic construct
  misc_feature 1..20: note = CRISPR gRNA sequence
  source 1..20: mol_type = other DNA
ctaggcccctggcttcccaa

SEQ ID NO: 23983 - DNA, 20 bp, synthetic construct
  misc_feature 1..20: note = CRISPR gRNA sequence
  source 1..20: mol_type = other DNA
ggcccctggcttcccaacac

SEQ ID NO: 23984 - DNA, 20 bp, synthetic construct
  misc_feature 1..20: note = CRISPR gRNA sequence
  source 1..20: mol_type = other DNA
gcttcccaacaccatttggc

SEQ ID NO: 23985 - DNA, 20 bp, synthetic construct
  misc_feature 1..20: note = CRISPR gRNA sequence
  source 1..20: mol_type = other DNA
cccaacaccatttggccccc

SEQ ID NO: 23986 - DNA, 20 bp, synthetic construct
  misc_feature 1..20: note = CRISPR gRNA sequence
  source 1..20: mol_type = other DNA
ccaacaccatttggcccccg

SEQ ID NO: 23987 - DNA, 20 bp, synthetic construct
  misc_feature 1..20: note = CRISPR gRNA sequence
  source 1..20: mol_type = other DNA
ggcccccggaagcagcttgt

SEQ ID NO: 23988 - DNA, 20 bp, synthetic construct
  misc_feature 1..20: note = CRISPR gRNA sequence
  source 1..20: mol_type = other DNA
gcccccggaagcagcttgtc

SEQ ID NO: 23989 - DNA, 20 bp, synthetic construct
  misc_feature 1..20: note = CRISPR gRNA sequence
  source 1..20: mol_type = other DNA
gtcatgaggttggggagcag

SEQ ID NO: 23990 - DNA, 20 bp, synthetic construct
  misc_feature 1..20: note = CRISPR gRNA sequence
  source 1..20: mol_type = other DNA
tcatgaggttggggagcagg

SEQ ID NO: 23991 - DNA, 20 bp, synthetic construct
  misc_feature 1..20: note = CRISPR gRNA sequence
  source 1..20: mol_type = other DNA
gggagcaggttggtgttggg

SEQ ID NO: 23992 - DNA, 20 bp, synthetic construct
  misc_feature 1..20: note = CRISPR gRNA sequence
  source 1..20: mol_type = other DNA
gtgttggggggggccttggg

SEQ ID NO: 23993 - DNA, 20 bp, synthetic construct
  misc_feature 1..20: note = CRISPR gRNA sequence
  source 1..20: mol_type = other DNA
gggggggccttgggggaaag

SEQ ID NO: 23994 - DNA, 20 bp, synthetic construct
  misc_feature 1..20: note = CRISPR gRNA sequence
  source 1..20: mol_type = other DNA
gggggaaaggaaaaggagaa

SEQ ID NO: 23995 - DNA, 20 bp, synthetic construct
  misc_feature 1..20: note = CRISPR gRNA sequence
  source 1..20: mol_type = other DNA
ggggaaaggaaaaggagaag

SEQ ID NO: 23996 - DNA, 20 bp, synthetic construct
  misc_feature 1..20: note = CRISPR gRNA sequence
  source 1..20: mol_type = other DNA
ccaggcaacgaggaatcaga

SEQ ID NO: 23997 - DNA, 20 bp, synthetic construct
  misc_feature 1..20: note = CRISPR gRNA sequence
  source 1..20: mol_type = other DNA
aaaaagactcaattgaaggg

SEQ ID NO: 23998 - DNA, 20 bp, synthetic construct
  misc_feature 1..20: note = CRISPR gRNA sequence
  source 1..20: mol_type = other DNA
aattgaaggggctccaacac

SEQ ID NO: 23999 - DNA, 20 bp, synthetic construct
  misc_feature 1..20: note = CRISPR gRNA sequence
  source 1..20: mol_type = other DNA
aaggggctccaacactcgtt

SEQ ID NO: 24000 - DNA, 20 bp, synthetic construct
  misc_feature 1..20: note = CRISPR gRNA sequence
  source 1..20: mol_type = other DNA
caacactcgttgaaacggag

SEQ ID NO: 24001 - DNA, 20 bp, synthetic construct
  misc_feature 1..20: note = CRISPR gRNA sequence
  source 1..20: mol_type = other DNA
gttgaaacggaggctcagag

SEQ ID NO: 24002 - DNA, 20 bp, synthetic construct
  misc_feature 1..20: note = CRISPR gRNA sequence
  source 1..20: mol_type = other DNA
aaacggaggctcagagggct

SEQ ID NO: 24003 - DNA, 20 bp, synthetic construct
  misc_feature 1..20: note = CRISPR gRNA sequence
  source 1..20: mol_type = other DNA
agagggctaaggtaatgtac

SEQ ID NO: 24004 - DNA, 20 bp, synthetic construct
  misc_feature 1..20: note = CRISPR gRNA sequence
  source 1..20: mol_type = other DNA
aggtaatgtactcaggatca

SEQ ID NO: 24005 - DNA, 20 bp, synthetic construct
  misc_feature 1..20: note = CRISPR gRNA sequence
  source 1..20: mol_type = other DNA
aggatcaaaggcagagcaga

SEQ ID NO: 24006 - DNA, 20 bp, synthetic construct
  misc_feature 1..20: note = CRISPR gRNA sequence
  source 1..20: mol_type = other DNA
aaaccatgtctctaggcaca

SEQ ID NO: 24007 - DNA, 20 bp, synthetic construct
  misc_feature 1..20: note = CRISPR gRNA sequence
  source 1..20: mol_type = other DNA
taggcacacagttcagaggt

SEQ ID NO: 24008 - DNA, 20 bp, synthetic construct
  misc_feature 1..20: note = CRISPR gRNA sequence
  source 1..20: mol_type = other DNA
ggcacacagttcagaggtct

SEQ ID NO: 24009 - DNA, 20 bp, synthetic construct
  misc_feature 1..20: note = CRISPR gRNA sequence
  source 1..20: mol_type = other DNA
agaggtcttcccattattcc

SEQ ID NO: 24010 - DNA, 20 bp, synthetic construct
  misc_feature 1..20: note = CRISPR gRNA sequence
  source 1..20: mol_type = other DNA
cccattattcctcaggagga

SEQ ID NO: 24011 - DNA, 20 bp, synthetic construct
  misc_feature 1..20: note = CRISPR gRNA sequence
  source 1..20: mol_type = other DNA
ccattattcctcaggaggag

SEQ ID NO: 24012 - DNA, 20 bp, synthetic construct
  misc_feature 1..20: note = CRISPR gRNA sequence
  source 1..20: mol_type = other DNA
ttcctcaggaggagaagttc

SEQ ID NO: 24013 - DNA, 20 bp, synthetic construct
  misc_feature 1..20: note = CRISPR gRNA sequence
  source 1..20: mol_type = other DNA
ctcaggaggagaagttcatg

SEQ ID NO: 24014 - DNA, 20 bp, synthetic construct
  misc_feature 1..20: note = CRISPR gRNA sequence
  source 1..20: mol_type = other DNA
aggaggagaagttcatggtc

SEQ ID NO: 24015 - DNA, 20 bp, synthetic construct
  misc_feature 1..20: note = CRISPR gRNA sequence
  source 1..20: mol_type = other DNA
atggtcaagagtagggaagt

SEQ ID NO: 24016 - DNA, 20 bp, synthetic construct
  misc_feature 1..20: note = CRISPR gRNA sequence
  source 1..20: mol_type = other DNA
cttctcaagctttttttttt

SEQ ID NO: 24017 - DNA, 20 bp, synthetic construct
  misc_feature 1..20: note = CRISPR gRNA sequence
  source 1..20: mol_type = other DNA
ctcaagcttttttttttttt

SEQ ID NO: 24018 - DNA, 20 bp, synthetic construct
  misc_feature 1..20: note = CRISPR gRNA sequence
  source 1..20: mol_type = other DNA
tcaagctttttttttttttg

SEQ ID NO: 24019 - DNA, 20 bp, synthetic construct
  misc_feature 1..20: note = CRISPR gRNA sequence
  source 1..20: mol_type = other DNA
aagctttttttttttttgtc

SEQ ID NO: 24020 - DNA, 20 bp, synthetic construct
  misc_feature 1..20: note = CRISPR gRNA sequence
  source 1..20: mol_type = other DNA
tttttttttttgtctgagac

SEQ ID NO: 24021 - DNA, 20 bp, synthetic construct
  misc_feature 1..20: note = CRISPR gRNA sequence
  source 1..20: mol_type = other DNA
ttttttttttgtctgagaca

SEQ ID NO: 24022 - DNA, 20 bp, synthetic construct
  misc_feature 1..20: note = CRISPR gRNA sequence
  source 1..20: mol_type = other DNA
tttttttttgtctgagacag

SEQ ID NO: 24023 - DNA, 20 bp, synthetic construct
  misc_feature 1..20: note = CRISPR gRNA sequence
  source 1..20: mol_type = other DNA
ttttttttgtctgagacaga

SEQ ID NO: 24024 - DNA, 20 bp, synthetic construct
  misc_feature 1..20: note = CRISPR gRNA sequence
  source 1..20: mol_type = other DNA
tttttttgtctgagacagag

SEQ ID NO: 24025 - DNA, 20 bp, synthetic construct
  misc_feature 1..20: note = CRISPR gRNA sequence
  source 1..20: mol_type = other DNA
ttttttgtctgagacagagt

SEQ ID NO: 24026 - DNA, 20 bp, synthetic construct
  misc_feature 1..20: note = CRISPR gRNA sequence
  source 1..20: mol_type = other DNA
tttttgtctgagacagagtc

SEQ ID NO: 24027 - DNA, 20 bp, synthetic construct
  misc_feature 1..20: note = CRISPR gRNA sequence
  source 1..20: mol_type = other DNA
ttttgtctgagacagagtct

SEQ ID NO: 24028 - DNA, 20 bp, synthetic construct
  misc_feature 1..20: note = CRISPR gRNA sequence
  source 1..20: mol_type = other DNA
tttgtctgagacagagtctt

SEQ ID NO: 24029 - DNA, 20 bp, synthetic construct
  misc_feature 1..20: note = CRISPR gRNA sequence
  source 1..20: mol_type = other DNA
ttgtctgagacagagtcttg

SEQ ID NO: 24030 - DNA, 20 bp, synthetic construct
  misc_feature 1..20: note = CRISPR gRNA sequence
  source 1..20: mol_type = other DNA
tgtctgagacagagtcttgc

SEQ ID NO: 24031 - DNA, 20 bp, synthetic construct
  misc_feature 1..20: note = CRISPR gRNA sequence
  source 1..20: mol_type = other DNA
gtctgagacagagtcttgct

SEQ ID NO: 24032 - DNA, 20 bp, synthetic construct
  misc_feature 1..20: note = CRISPR gRNA sequence
  source 1..20: mol_type = other DNA
tctgagacagagtcttgctc

SEQ ID NO: 24033 - DNA, 20 bp, synthetic construct
  misc_feature 1..20: note = CRISPR gRNA sequence
  source 1..20: mol_type = other DNA
agacagagtcttgctctgtc

SEQ ID NO: 24034 - DNA, 20 bp, synthetic construct
  misc_feature 1..20: note = CRISPR gRNA sequence
  source 1..20: mol_type = other DNA
gctctgtcaccgaggctgga

SEQ ID NO: 24035 - DNA, 20 bp, synthetic construct
  misc_feature 1..20: note = CRISPR gRNA sequence
  source 1..20: mol_type = other DNA
ctctgtcaccgaggctggag

SEQ ID NO: 24036 - DNA, 20 bp, synthetic construct
  misc_feature 1..20: note = CRISPR gRNA sequence
  source 1..20: mol_type = other DNA
tgtcaccgaggctggagtgc

SEQ ID NO: 24037 - DNA, 20 bp, synthetic construct
  misc_feature 1..20: note = CRISPR gRNA sequence
  source 1..20: mol_type = other DNA
tcaccgaggctggagtgcag

SEQ ID NO: 24038 - DNA, 20 bp, synthetic construct
  misc_feature 1..20: note = CRISPR gRNA sequence
  source 1..20: mol_type = other DNA
gagtgcagtggcgtgatctc

SEQ ID NO: 24039 - DNA, 20 bp, synthetic construct
  misc_feature 1..20: note = CRISPR gRNA sequence
  source 1..20: mol_type = other DNA
ggctcactgcaacctccgcc

SEQ ID NO: 24040 - DNA, 20 bp, synthetic construct
  misc_feature 1..20: note = CRISPR gRNA sequence
  source 1..20: mol_type = other DNA
actgcaacctccgcctccca

SEQ ID NO: 24041 - DNA, 20 bp, synthetic construct
  misc_feature 1..20: note = CRISPR gRNA sequence
  source 1..20: mol_type = other DNA
caacctccgcctcccaggtt

SEQ ID NO: 24042 - DNA, 20 bp, synthetic construct
  misc_feature 1..20: note = CRISPR gRNA sequence
  source 1..20: mol_type = other DNA
cgcctcccaggttcaagcaa

SEQ ID NO: 24043 - DNA, 20 bp, synthetic construct
  misc_feature 1..20: note = CRISPR gRNA sequence
  source 1..20: mol_type = other DNA
ccaggttcaagcaattttcc

SEQ ID NO: 24044 - DNA, 20 bp, synthetic construct
  misc_feature 1..20: note = CRISPR gRNA sequence
  source 1..20: mol_type = other DNA
aagcaattttcctgcctcag

SEQ ID NO: 24045 - DNA, 20 bp, synthetic construct
  misc_feature 1..20: note = CRISPR gRNA sequence
  source 1..20: mol_type = other DNA
tcctgcctcagcctcccaag

SEQ ID NO: 24046 - DNA, 20 bp, synthetic construct
  misc_feature 1..20: note = CRISPR gRNA sequence
  source 1..20: mol_type = other DNA
cctgcctcagcctcccaagt

SEQ ID NO: 24047 - DNA, 20 bp, synthetic construct
  misc_feature 1..20: note = CRISPR gRNA sequence
  source 1..20: mol_type = other DNA
ctgcctcagcctcccaagta

SEQ ID NO: 24048 - DNA, 20 bp, synthetic construct
  misc_feature 1..20: note = CRISPR gRNA sequence
  source 1..20: mol_type = other DNA
cctcagcctcccaagtagct

SEQ ID NO: 24049 - DNA, 20 bp, synthetic construct
  misc_feature 1..20: note = CRISPR gRNA sequence
  source 1..20: mol_type = other DNA
agcctcccaagtagctggga

SEQ ID NO: 24050 - DNA, 20 bp, synthetic construct
  misc_feature 1..20: note = CRISPR gRNA sequence
  source 1..20: mol_type = other DNA
ccaagtagctgggattatag

SEQ ID NO: 24051 - DNA, 20 bp, synthetic construct
  misc_feature 1..20: note = CRISPR gRNA sequence
  source 1..20: mol_type = other DNA
ggattataggcacccaccac

SEQ ID NO: 24052 - DNA, 20 bp, synthetic construct
  misc_feature 1..20: note = CRISPR gRNA sequence
  source 1..20: mol_type = other DNA
taggcacccaccaccacgcc

SEQ ID NO: 24053 - DNA, 20 bp, synthetic construct
  misc_feature 1..20: note = CRISPR gRNA sequence
  source 1..20: mol_type = other DNA
atttttgtatttttgcagag

SEQ ID NO: 24054 - DNA, 20 bp, synthetic construct
  misc_feature 1..20: note = CRISPR gRNA sequence
  source 1..20: mol_type = other DNA
ttgtatttttgcagagacgg

SEQ ID NO: 24055 - DNA, 20 bp, synthetic construct
  misc_feature 1..20: note = CRISPR gRNA sequence
  source 1..20: mol_type = other DNA
tgtatttttgcagagacggg

SEQ ID NO: 24056 - DNA, 20 bp, synthetic construct
  misc_feature 1..20: note = CRISPR gRNA sequence
  source 1..20: mol_type = other DNA
gtatttttgcagagacgggg

SEQ ID NO: 24057 - DNA, 20 bp, synthetic construct
  misc_feature 1..20: note = CRISPR gRNA sequence
  source 1..20: mol_type = other DNA
tatttttgcagagacggggt

SEQ ID NO: 24058 - DNA, 20 bp, synthetic construct
  misc_feature 1..20: note = CRISPR gRNA sequence
  source 1..20: mol_type = other DNA
ttgcagagacggggtttcac

SEQ ID NO: 24059 - DNA, 20 bp, synthetic construct
  misc_feature 1..20: note = CRISPR gRNA sequence
  source 1..20: mol_type = other DNA
tgcagagacggggtttcacc

SEQ ID NO: 24060 - DNA, 20 bp, synthetic construct
  misc_feature 1..20: note = CRISPR gRNA sequence
  source 1..20: mol_type = other DNA
gcagagacggggtttcacca

SEQ ID NO: 24061 - DNA, 20 bp, synthetic construct
  misc_feature 1..20: note = CRISPR gRNA sequence
  source 1..20: mol_type = other DNA
cagagacggggtttcaccat

SEQ ID NO: 24062 - DNA, 20 bp, synthetic construct
  misc_feature 1..20: note = CRISPR gRNA sequence
  source 1..20: mol_type = other DNA
caccatgctggtcaggctgg

SEQ ID NO: 24063 - DNA, 20 bp, synthetic construct
  misc_feature 1..20: note = CRISPR gRNA sequence
  source 1..20: mol_type = other DNA
accatgctggtcaggctggt

SEQ ID NO: 24064 - DNA, 20 bp, synthetic construct
  misc_feature 1..20: note = CRISPR gRNA sequence
  source 1..20: mol_type = other DNA
gtcaggctggtcttgaactc

SEQ ID NO: 24065 - DNA, 20 bp, synthetic construct
  misc_feature 1..20: note = CRISPR gRNA sequence
  source 1..20: mol_type = other DNA
gtcttgaactcctgacctca

SEQ ID NO: 24066 - DNA, 20 bp, synthetic construct
  misc_feature 1..20: note = CRISPR gRNA sequence
  source 1..20: mol_type = other DNA
gaactcctgacctcaagtaa

SEQ ID NO: 24067 - DNA, 20 bp, synthetic construct
  misc_feature 1..20: note = CRISPR gRNA sequence
  source 1..20: mol_type = other DNA
aactcctgacctcaagtaat

SEQ ID NO: 24068 - DNA, 20 bp, synthetic construct
  misc_feature 1..20: note = CRISPR gRNA sequence
  source 1..20: mol_type = other DNA
ctgacctcaagtaatccgcc

SEQ ID NO: 24069 - DNA, 20 bp, synthetic construct
  misc_feature 1..20: note = CRISPR gRNA sequence
  source 1..20: mol_type = other DNA
acctcaagtaatccgccagc

SEQ ID NO: 24070 - DNA, 20 bp, synthetic construct
  misc_feature 1..20: note = CRISPR gRNA sequence
  source 1..20: mol_type = other DNA
aagtaatccgccagcctcgg

SEQ ID NO: 24071 - DNA, 20 bp, synthetic construct
  misc_feature 1..20: note = CRISPR gRNA sequence
  source 1..20: mol_type = other DNA
ggcctctcaaagtgctagga

SEQ ID NO: 24072 - DNA, 20 bp, synthetic construct
  misc_feature 1..20: note = CRISPR gRNA sequence
  source 1..20: mol_type = other DNA
tcaaagtgctaggattatag

SEQ ID NO: 24073 - DNA, 20 bp, synthetic construct
  misc_feature 1..20: note = CRISPR gRNA sequence
  source 1..20: mol_type = other DNA
aaagtgctaggattataggc

SEQ ID NO: 24074 - DNA, 20 bp, synthetic construct
  misc_feature 1..20: note = CRISPR gRNA sequence
  source 1..20: mol_type = other DNA
ggattataggcgtgagccac

SEQ ID NO: 24075 - DNA, 20 bp, synthetic construct
  misc_feature 1..20: note = CRISPR gRNA sequence
  source 1..20: mol_type = other DNA
taggcgtgagccaccacccc

SEQ ID NO: 24076 - DNA, 20 bp, synthetic construct
  misc_feature 1..20: note = CRISPR gRNA sequence
  source 1..20: mol_type = other DNA
gcctccttctcatgctcttt

SEQ ID NO: 24077 - DNA, 20 bp, synthetic construct
  misc_feature 1..20: note = CRISPR gRNA sequence
  source 1..20: mol_type = other DNA
cttctcatgctctttaatca

SEQ ID NO: 24078 - DNA, 20 bp, synthetic construct
  misc_feature 1..20: note = CRISPR gRNA sequence
  source 1..20: mol_type = other DNA
ctcatgctctttaatcacag

SEQ ID NO: 24079 - DNA, 20 bp, synthetic construct
  misc_feature 1..20: note = CRISPR gRNA sequence
  source 1..20: mol_type = other DNA
tcatgctctttaatcacagt

SEQ ID NO: 24080 - DNA, 20 bp, synthetic construct
  misc_feature 1..20: note = CRISPR gRNA sequence
  source 1..20: mol_type = other DNA
atgctctttaatcacagttc

SEQ ID NO: 24081 - DNA, 20 bp, synthetic construct
  misc_feature 1..20: note = CRISPR gRNA sequence
  source 1..20: mol_type = other DNA
tttaatcacagttcagagca

SEQ ID NO: 24082 - DNA, 20 bp, synthetic construct
  misc_feature 1..20: note = CRISPR gRNA sequence
  source 1..20: mol_type = other DNA
taatcacagttcagagcagt

SEQ ID NO: 24083 - DNA, 20 bp, synthetic construct
  misc_feature 1..20: note = CRISPR gRNA sequence
  source 1..20: mol_type = other DNA
aatcacagttcagagcagtg

SEQ ID NO: 24084 - DNA, 20 bp, synthetic construct
  misc_feature 1..20: note = CRISPR gRNA sequence
  source 1..20: mol_type = other DNA
atcacagttcagagcagtgc

SEQ ID NO: 24085 - DNA, 20 bp, synthetic construct
  misc_feature 1..20: note = CRISPR gRNA sequence
  source 1..20: mol_type = other DNA
agagcagtgctggaggcttt

SEQ ID NO: 24086 - DNA, 20 bp, synthetic construct
  misc_feature 1..20: note = CRISPR gRNA sequence
  source 1..20: mol_type = other DNA
gaggcttttaggggtagcaa

SEQ ID NO: 24087 - DNA, 20 bp, synthetic construct
  misc_feature 1..20: note = CRISPR gRNA sequence
  source 1..20: mol_type = other DNA
ttaggggtagcaaaagagcc

SEQ ID NO: 24088 - DNA, 20 bp, synthetic construct
  misc_feature 1..20: note = CRISPR gRNA sequence
  source 1..20: mol_type = other DNA
taggggtagcaaaagagcct

SEQ ID NO: 24089 - DNA, 20 bp, synthetic construct
  misc_feature 1..20: note = CRISPR gRNA sequence
  source 1..20: mol_type = other DNA
aggggtagcaaaagagcctt

SEQ ID NO: 24090 - DNA, 20 bp, synthetic construct
  misc_feature 1..20: note = CRISPR gRNA sequence
  source 1..20: mol_type = other DNA
ggggtagcaaaagagccttc

SEQ ID NO: 24091 - DNA, 20 bp, synthetic construct
  misc_feature 1..20: note = CRISPR gRNA sequence
  source 1..20: mol_type = other DNA
cttctccctttcagtgcctc

SEQ ID NO: 24092 - DNA, 20 bp, synthetic construct
  misc_feature 1..20: note = CRISPR gRNA sequence
  source 1..20: mol_type = other DNA
ttctccctttcagtgcctcc

SEQ ID NO: 24093 - DNA, 20 bp, synthetic construct
  misc_feature 1..20: note = CRISPR gRNA sequence
  source 1..20: mol_type = other DNA
ctccctttcagtgcctcctt

SEQ ID NO: 24094 - DNA, 20 bp, synthetic construct
  misc_feature 1..20: note = CRISPR gRNA sequence
  source 1..20: mol_type = other DNA
tccctttcagtgcctcctta

SEQ ID NO: 24095 - DNA, 20 bp, synthetic construct
  misc_feature 1..20: note = CRISPR gRNA sequence
  source 1..20: mol_type = other DNA
cctttcagtgcctccttaga

SEQ ID NO: 24096 - DNA, 20 bp, synthetic construct
  misc_feature 1..20: note = CRISPR gRNA sequence
  source 1..20: mol_type = other DNA
tcagtgcctccttagaccct

SEQ ID NO: 24097 - DNA, 20 bp, synthetic construct
  misc_feature 1..20: note = CRISPR gRNA sequence
  source 1..20: mol_type = other DNA
cagtgcctccttagaccctc

SEQ ID NO: 24098 - DNA, 20 bp, synthetic construct
  misc_feature 1..20: note = CRISPR gRNA sequence
  source 1..20: mol_type = other DNA
agtgcctccttagaccctca

SEQ ID NO: 24099 - DNA, 20 bp, synthetic construct
  misc_feature 1..20: note = CRISPR gRNA sequence
  source 1..20: mol_type = other DNA
cttagaccctcaaagataga

SEQ ID NO: 24100 - DNA, 20 bp, synthetic construct
  misc_feature 1..20: note = CRISPR gRNA sequence
  source 1..20: mol_type = other DNA
agaccctcaaagatagactc

SEQ ID NO: 24101 - DNA, 20 bp, synthetic construct
  misc_feature 1..20: note = CRISPR gRNA sequence
  source 1..20: mol_type = other DNA
gaccctcaaagatagactcc

SEQ ID NO: 24102 - DNA, 20 bp, synthetic construct
  misc_feature 1..20: note = CRISPR gRNA sequence
  source 1..20: mol_type = other DNA
aaagatagactccccgcctc

SEQ ID NO: 24103 - DNA, 20 bp, synthetic construct
  misc_feature 1..20: note = CRISPR gRNA sequence
  source 1..20: mol_type = other DNA
cccgcctctgggaagaaaac

SEQ ID NO: 24104 - DNA, 20 bp, synthetic construct
  misc_feature 1..20: note = CRISPR gRNA sequence
  source 1..20: mol_type = other DNA
tgggaagaaaacatctaatg

SEQ ID NO: 24105 - DNA, 20 bp, synthetic construct
  misc_feature 1..20: note = CRISPR gRNA sequence
  source 1..20: mol_type = other DNA
ggaagaaaacatctaatgaa

SEQ ID NO: 24106 - DNA, 20 bp, synthetic construct
  misc_feature 1..20: note = CRISPR gRNA sequence
  source 1..20: mol_type = other DNA
atgaactggacgtaatctca

SEQ ID NO: 24107 - DNA, 20 bp, synthetic construct
  misc_feature 1..20: note = CRISPR gRNA sequence
  source 1..20: mol_type = other DNA
gacgtaatctcagcgcctgc

SEQ ID NO: 24108 - DNA, 20 bp, synthetic construct
  misc_feature 1..20: note = CRISPR gRNA sequence
  source 1..20: mol_type = other DNA
agcgcctgcgtctgtaaaat

SEQ ID NO: 24109 - DNA, 20 bp, synthetic construct
  misc_feature 1..20: note = CRISPR gRNA sequence
  source 1..20: mol_type = other DNA
cgtctgtaaaatggctataa

SEQ ID NO: 24110 - DNA, 20 bp, synthetic construct
  misc_feature 1..20: note = CRISPR gRNA sequence
  source 1..20: mol_type = other DNA
taaaatggctataataacaa

SEQ ID NO: 24111 - DNA, 20 bp, synthetic construct
  misc_feature 1..20: note = CRISPR gRNA sequence
  source 1..20: mol_type = other DNA
taataacaacaatctcccag

SEQ ID NO: 24112 - DNA, 20 bp, synthetic construct
  misc_feature 1..20: note = CRISPR gRNA sequence
  source 1..20: mol_type = other DNA
ccagagttgccgttaacagt

SEQ ID NO: 24113 - DNA, 20 bp, synthetic construct
  misc_feature 1..20: note = CRISPR gRNA sequence
  source 1..20: mol_type = other DNA
ccgttaacagttgaaacaga

SEQ ID NO: 24114 - DNA, 20 bp, synthetic construct
  misc_feature 1..20: note = CRISPR gRNA sequence
  source 1..20: mol_type = other DNA
acagttgaaacagaatagta

SEQ ID NO: 24115 - DNA, 20 bp, synthetic construct
  misc_feature 1..20: note = CRISPR gRNA sequence
  source 1..20: mol_type = other DNA
aaacagaatagtaaatgcaa

SEQ ID NO: 24116 - DNA, 20 bp, synthetic construct
  misc_feature 1..20: note = CRISPR gRNA sequence
  source 1..20: mol_type = other DNA
gcacagccccagacacagag

SEQ ID NO: 24117 - DNA, 20 bp, synthetic construct
  misc_feature 1..20: note = CRISPR gRNA sequence
  source 1..20: mol_type = other DNA
ccctggtcactctcacagag

SEQ ID NO: 24118 - DNA, 20 bp, synthetic construct
  misc_feature 1..20: note = CRISPR gRNA sequence
  source 1..20: mol_type = other DNA
gtcactctcacagaggtaag

SEQ ID NO: 24119 - DNA, 20 bp, synthetic construct
  misc_feature 1..20: note = CRISPR gRNA sequence
  source 1..20: mol_type = other DNA
tcacagaggtaagaagcaca

SEQ ID NO: 24120 - DNA, 20 bp, synthetic construct
  misc_feature 1..20: note = CRISPR gRNA sequence
  source 1..20: mol_type = other DNA
acagaggtaagaagcacatt

SEQ ID NO: 24121 - DNA, 20 bp, synthetic construct
  misc_feature 1..20: note = CRISPR gRNA sequence
  source 1..20: mol_type = other DNA
ataataaaaatggtcatcac

SEQ ID NO: 24122 - DNA, 20 bp, synthetic construct
  misc_feature 1..20: note = CRISPR gRNA sequence
  source 1..20: mol_type = other DNA
tactcaccatgcagaagttg

SEQ ID NO: 24123 - DNA, 20 bp, synthetic construct
  misc_feature 1..20: note = CRISPR gRNA sequence
  source 1..20: mol_type = other DNA
accatgcagaagttgtgctg

SEQ ID NO: 24124 - DNA, 20 bp, synthetic construct
  misc_feature 1..20: note = CRISPR gRNA sequence
  source 1..20: mol_type = other DNA
tgctgccttaagctactgtt

SEQ ID NO: 24125 - DNA, 20 bp, synthetic construct
  misc_feature 1..20: note = CRISPR gRNA sequence
  source 1..20: mol_type = other DNA
ccttaagctactgttcattg

SEQ ID NO: 24126 - DNA, 20 bp, synthetic construct
  misc_feature 1..20: note = CRISPR gRNA sequence
  source 1..20: mol_type = other DNA
aagctactgttcattgagca

SEQ ID NO: 24127 - DNA, 20 bp, synthetic construct
  misc_feature 1..20: note = CRISPR gRNA sequence
  source 1..20: mol_type = other DNA
agctactgttcattgagcac

SEQ ID NO: 24128 - DNA, 20 bp, synthetic construct
  misc_feature 1..20: note = CRISPR gRNA sequence
  source 1..20: mol_type = other DNA
ctgttcattgagcacttact

SEQ ID NO: 24129 - DNA, 20 bp, synthetic construct
  misc_feature 1..20: note = CRISPR gRNA sequence
  source 1..20: mol_type = other DNA
ttcattgagcacttactggt

SEQ ID NO: 24130 - DNA, 20 bp, synthetic construct
  misc_feature 1..20: note = CRISPR gRNA sequence
  source 1..20: mol_type = other DNA
attgagcacttactggtcgc

SEQ ID NO: 24131 - DNA, 20 bp, synthetic construct
  misc_feature 1..20: note = CRISPR gRNA sequence
  source 1..20: mol_type = other DNA
agcacttactggtcgccagt

SEQ ID NO: 24132 - DNA, 20 bp, synthetic construct
  misc_feature 1..20: note = CRISPR gRNA sequence
  source 1..20: mol_type = other DNA
actggtcgccagtccccttt

SEQ ID NO: 24133 - DNA, 20 bp, synthetic construct
  misc_feature 1..20: note = CRISPR gRNA sequence
  source 1..20: mol_type = other DNA
ctggtcgccagtcccctttc

SEQ ID NO: 24134 - DNA, 20 bp, synthetic construct
  misc_feature 1..20: note = CRISPR gRNA sequence
  source 1..20: mol_type = other DNA
gtcgccagtcccctttctaa

SEQ ID NO: 24135 - DNA, 20 bp, synthetic construct
  misc_feature 1..20: note = CRISPR gRNA sequence
  source 1..20: mol_type = other DNA
tctaagggctccatgcaact

SEQ ID NO: 24136 - DNA, 20 bp, synthetic construct
  misc_feature 1..20: note = CRISPR gRNA sequence
  source 1..20: mol_type = other DNA
ctaagggctccatgcaactt

SEQ ID NO: 24137 - DNA, 20 bp, synthetic construct
  misc_feature 1..20: note = CRISPR gRNA sequence
  source 1..20: mol_type = other DNA
taagggctccatgcaactta

SEQ ID NO: 24138 - DNA, 20 bp, synthetic construct
  misc_feature 1..20: note = CRISPR gRNA sequence
  source 1..20: mol_type = other DNA
agggctccatgcaacttaac

SEQ ID NO: 24139 - DNA, 20 bp, synthetic construct
  misc_feature 1..20: note = CRISPR gRNA sequence
  source 1..20: mol_type = other DNA
catgcaacttaactccccta

SEQ ID NO: 24140 - DNA, 20 bp, synthetic construct
  misc_feature 1..20: note = CRISPR gRNA sequence
  source 1..20: mol_type = other DNA
aactcccctaatcctatgag

SEQ ID NO: 24141 - DNA, 20 bp, synthetic construct
  misc_feature 1..20: note = CRISPR gRNA sequence
  source 1..20: mol_type = other DNA
actcccctaatcctatgagt

SEQ ID NO: 24142 - DNA, 20 bp, synthetic construct
  misc_feature 1..20: note = CRISPR gRNA sequence
  source 1..20: mol_type = other DNA
ccctaatcctatgagttgcc

SEQ ID NO: 24143 - DNA, 20 bp, synthetic construct
  misc_feature 1..20: note = CRISPR gRNA sequence
  source 1..20: mol_type = other DNA
atcctatgagttgccaatta

SEQ ID NO: 24144 - DNA, 20 bp, synthetic construct
  misc_feature 1..20: note = CRISPR gRNA sequence
  source 1..20: mol_type = other DNA
tgagttgccaattattatcc

SEQ ID NO: 24145 - DNA, 20 bp, synthetic construct
  misc_feature 1..20: note = CRISPR gRNA sequence
  source 1..20: mol_type = other DNA
ccaattattatcccccactt

SEQ ID NO: 24146 - DNA, 20 bp, synthetic construct
  misc_feature 1..20: note = CRISPR gRNA sequence
  source 1..20: mol_type = other DNA
ttatcccccactttacagat

SEQ ID NO: 24147 - DNA, 20 bp, synthetic construct
  misc_feature 1..20: note = CRISPR gRNA sequence
  source 1..20: mol_type = other DNA
tcccccactttacagataag

SEQ ID NO: 24148 - DNA, 20 bp, synthetic construct
  misc_feature 1..20: note = CRISPR gRNA sequence
  source 1..20: mol_type = other DNA
tacagataaggaaactgagg

SEQ ID NO: 24149 - DNA, 20 bp, synthetic construct
  misc_feature 1..20: note = CRISPR gRNA sequence
  source 1..20: mol_type = other DNA
acagataaggaaactgaggc

SEQ ID NO: 24150 - DNA, 20 bp, synthetic construct
  misc_feature 1..20: note = CRISPR gRNA sequence
  source 1..20: mol_type = other DNA
cagataaggaaactgaggct

SEQ ID NO: 24151 - DNA, 20 bp, synthetic construct
  misc_feature 1..20: note = CRISPR gRNA sequence
  source 1..20: mol_type = other DNA
aggctccaagtggtttaaaa

SEQ ID NO: 24152 - DNA, 20 bp, synthetic construct
  misc_feature 1..20: note = CRISPR gRNA sequence
  source 1..20: mol_type = other DNA
caagtggtttaaaaaatgaa

SEQ ID NO: 24153 - DNA, 20 bp, synthetic construct
  misc_feature 1..20: note = CRISPR gRNA sequence
  source 1..20: mol_type = other DNA
aaaaaatgaacttacccaga

SEQ ID NO: 24154 - DNA, 20 bp, synthetic construct
  misc_feature 1..20: note = CRISPR gRNA sequence
  source 1..20: mol_type = other DNA
aaaaatgaacttacccagat

SEQ ID NO: 24155 - DNA, 20 bp, synthetic construct
  misc_feature 1..20: note = CRISPR gRNA sequence
  source 1..20: mol_type = other DNA
acccagattgtagtgcgttg

SEQ ID NO: 24156 - DNA, 20 bp, synthetic construct
  misc_feature 1..20: note = CRISPR gRNA sequence
  source 1..20: mol_type = other DNA
cccagattgtagtgcgttgg

SEQ ID NO: 24157 - DNA, 20 bp, synthetic construct
  misc_feature 1..20: note = CRISPR gRNA sequence
  source 1..20: mol_type = other DNA
tagtgcgttggtaggtaggg

SEQ ID NO: 24158 - DNA, 20 bp, synthetic construct
  misc_feature 1..20: note = CRISPR gRNA sequence
  source 1..20: mol_type = other DNA
gtaggtagggataacctgaa

SEQ ID NO: 24159 - DNA, 20 bp, synthetic construct
  misc_feature 1..20: note = CRISPR gRNA sequence
  source 1..20: mol_type = other DNA
aaagttgggaaatttcaccc

SEQ ID NO: 24160 - DNA, 20 bp, synthetic construct
  misc_feature 1..20: note = CRISPR gRNA sequence
  source 1..20: mol_type = other DNA
ggaaatttcaccccaaagct

SEQ ID NO: 24161 - DNA, 20 bp, synthetic construct
  misc_feature 1..20: note = CRISPR gRNA sequence
  source 1..20: mol_type = other DNA
caccccaaagctcaccatct

SEQ ID NO: 24162 - DNA, 20 bp, synthetic construct
  misc_feature 1..20: note = CRISPR gRNA sequence
  source 1..20: mol_type = other DNA
accccaaagctcaccatctg

SEQ ID NO: 24163 - DNA, 20 bp, synthetic construct
  misc_feature 1..20: note = CRISPR gRNA sequence
  source 1..20: mol_type = other DNA
accatctgagctccattcat

SEQ ID NO: 24164 - DNA, 20 bp, synthetic construct
  misc_feature 1..20: note = CRISPR gRNA sequence
  source 1..20: mol_type = other DNA
agctccattcatctcccacc

SEQ ID NO: 24165 - DNA, 20 bp, synthetic construct
  misc_feature 1..20: note = CRISPR gRNA sequence
  source 1..20: mol_type = other DNA
cattcatctcccaccagctg

SEQ ID NO: 24166 - DNA, 20 bp, synthetic construct
  misc_feature 1..20: note = CRISPR gRNA sequence
  source 1..20: mol_type = other DNA
atctcccaccagctgagatg

SEQ ID NO: 24167 - DNA, 20 bp, synthetic construct
  misc_feature 1..20: note = CRISPR gRNA sequence
  source 1..20: mol_type = other DNA
ccaccagctgagatggaacg

SEQ ID NO: 24168 - DNA, 20 bp, synthetic construct
  misc_feature 1..20: note = CRISPR gRNA sequence
  source 1..20: mol_type = other DNA
agatggaacgttatgctgtt

SEQ ID NO: 24169 - DNA, 20 bp, synthetic construct
  misc_feature 1..20: note = CRISPR gRNA sequence
  source 1..20: mol_type = other DNA
tgctgttcccagaagagatg

SEQ ID NO: 24170 - DNA, 20 bp, synthetic construct
  misc_feature 1..20: note = CRISPR gRNA sequence
  source 1..20: mol_type = other DNA
ttcccagaagagatgcatgc

SEQ ID NO: 24171 - DNA, 20 bp, synthetic construct
  misc_feature 1..20: note = CRISPR gRNA sequence
  source 1..20: mol_type = other DNA
ccagaagagatgcatgcact

SEQ ID NO: 24172 - DNA, 20 bp, synthetic construct
  misc_feature 1..20: note = CRISPR gRNA sequence
  source 1..20: mol_type = other DNA
atcttcagatagtttaagtc

SEQ ID NO: 24173 - DNA, 20 bp, synthetic construct
  misc_feature 1..20: note = CRISPR gRNA sequence
  source 1..20: mol_type = other DNA
cagatagtttaagtctgagt

SEQ ID NO: 24174 - DNA, 20 bp, synthetic construct
  misc_feature 1..20: note = CRISPR gRNA sequence
  source 1..20: mol_type = other DNA
agatagtttaagtctgagtt

SEQ ID NO: 24175 - DNA, 20 bp, synthetic construct
  misc_feature 1..20: note = CRISPR gRNA sequence
  source 1..20: mol_type = other DNA
aagtctgagttagaacattg

SEQ ID NO: 24176 - DNA, 20 bp, synthetic construct
  misc_feature 1..20: note = CRISPR gRNA sequence
  source 1..20: mol_type = other DNA
agtctgagttagaacattgt

SEQ ID NO: 24177 - DNA, 20 bp, synthetic construct
  misc_feature 1..20: note = CRISPR gRNA sequence
  source 1..20: mol_type = other DNA
agttagaacattgtggcgac

SEQ ID NO: 24178 - DNA, 20 bp, synthetic construct
  misc_feature 1..20: note = CRISPR gRNA sequence
  source 1..20: mol_type = other DNA
gaacattgtggcgacacctg

SEQ ID NO: 24179 - DNA, 20 bp, synthetic construct
  misc_feature 1..20: note = CRISPR gRNA sequence
  source 1..20: mol_type = other DNA
tggcgacacctgatttccct

SEQ ID NO: 24180 - DNA, 20 bp, synthetic construct
  misc_feature 1..20: note = CRISPR gRNA sequence
  source 1..20: mol_type = other DNA
atttccctcgggggagagag

SEQ ID NO: 24181 - DNA, 20 bp, synthetic construct
  misc_feature 1..20: note = CRISPR gRNA sequence
  source 1..20: mol_type = other DNA
ccctcgggggagagagaggt

SEQ ID NO: 24182 - DNA, 20 bp, synthetic construct
  misc_feature 1..20: note = CRISPR gRNA sequence
  source 1..20: mol_type = other DNA
cctcgggggagagagaggtg

SEQ ID NO: 24183 - DNA, 20 bp, synthetic construct
  misc_feature 1..20: note = CRISPR gRNA sequence
  source 1..20: mol_type = other DNA
gggggagagagaggtgaatt

SEQ ID NO: 24184 - DNA, 20 bp, synthetic construct
  misc_feature 1..20: note = CRISPR gRNA sequence
  source 1..20: mol_type = other DNA
ttatttcagacacctgttta

SEQ ID NO: 24185 - DNA, 20 bp, synthetic construct
  misc_feature 1..20: note = CRISPR gRNA sequence
  source 1..20: mol_type = other DNA
tttcagacacctgtttagtg

SEQ ID NO: 24186 - DNA, 20 bp, synthetic construct
  misc_feature 1..20: note = CRISPR gRNA sequence
  source 1..20: mol_type = other DNA
cagacacctgtttagtgtct

SEQ ID NO: 24187 - DNA, 20 bp, synthetic construct
  misc_feature 1..20: note = CRISPR gRNA sequence
  source 1..20: mol_type = other DNA
agacacctgtttagtgtcta

SEQ ID NO: 24188 - DNA, 20 bp, synthetic construct
  misc_feature 1..20: note = CRISPR gRNA sequence
  source 1..20: mol_type = other DNA
tttagtgtctacacttagcc

SEQ ID NO: 24189 - DNA, 20 bp, synthetic construct
  misc_feature 1..20: note = CRISPR gRNA sequence
  source 1..20: mol_type = other DNA
agtgtctacacttagccttt

SEQ ID NO: 24190 - DNA, 20 bp, synthetic construct
  misc_feature 1..20: note = CRISPR gRNA sequence
  source 1..20: mol_type = other DNA
gtgtctacacttagcctttc

SEQ ID NO: 24191 - DNA, 20 bp, synthetic construct
  misc_feature 1..20: note = CRISPR gRNA sequence
  source 1..20: mol_type = other DNA
cacttagcctttcaaatcct

SEQ ID NO: 24192 - DNA, 20 bp, synthetic construct
  misc_feature 1..20: note = CRISPR gRNA sequence
  source 1..20: mol_type = other DNA
agcctttcaaatcctgcatg

SEQ ID NO: 24193 - DNA, 20 bp, synthetic construct
  misc_feature 1..20: note = CRISPR gRNA sequence
  source 1..20: mol_type = other DNA
gcctttcaaatcctgcatgc

SEQ ID NO: 24194 - DNA, 20 bp, synthetic construct
  misc_feature 1..20: note = CRISPR gRNA sequence
  source 1..20: mol_type = other DNA
tcaaatcctgcatgcagtgt

SEQ ID NO: 24195 - DNA, 20 bp, synthetic construct
  misc_feature 1..20: note = CRISPR gRNA sequence
  source 1..20: mol_type = other DNA
caaatcctgcatgcagtgtg

SEQ ID NO: 24196 - DNA, 20 bp, synthetic construct
  misc_feature 1..20: note = CRISPR gRNA sequence
  source 1..20: mol_type = other DNA
aaatcctgcatgcagtgtga

SEQ ID NO: 24197 - DNA, 20 bp, synthetic construct
  misc_feature 1..20: note = CRISPR gRNA sequence
  source 1..20: mol_type = other DNA
catgcagtgtgaagtgggga

SEQ ID NO: 24198 - DNA, 20 bp, synthetic construct
  misc_feature 1..20: note = CRISPR gRNA sequence
  source 1..20: mol_type = other DNA
ttgatggcaaaaagatcagg

SEQ ID NO: 24199 - DNA, 20 bp, synthetic construct
  misc_feature 1..20: note = CRISPR gRNA sequence
  source 1..20: mol_type = other DNA
tgatggcaaaaagatcagga

SEQ ID NO: 24200 - DNA, 20 bp, synthetic construct
  misc_feature 1..20: note = CRISPR gRNA sequence
  source 1..20: mol_type = other DNA
gatggcaaaaagatcaggaa

SEQ ID NO: 24201 - DNA, 20 bp, synthetic construct
  misc_feature 1..20: note = CRISPR gRNA sequence
  source 1..20: mol_type = other DNA
atggcaaaaagatcaggaat

SEQ ID NO: 24202 - DNA, 20 bp, synthetic construct
  misc_feature 1..20: note = CRISPR gRNA sequence
  source 1..20: mol_type = other DNA
tctcgagttggatgtggaag

SEQ ID NO: 24203 - DNA, 20 bp, synthetic construct
  misc_feature 1..20: note = CRISPR gRNA sequence
  source 1..20: mol_type = other DNA
ctcgagttggatgtggaagg

SEQ ID NO: 24204 - DNA, 20 bp, synthetic construct
  misc_feature 1..20: note = CRISPR gRNA sequence
  source 1..20: mol_type = other DNA
tcgagttggatgtggaaggt

SEQ ID NO: 24205 - DNA, 20 bp, synthetic construct
  misc_feature 1..20: note = CRISPR gRNA sequence
  source 1..20: mol_type = other DNA
gagttggatgtggaaggtgg

SEQ ID NO: 24206 - DNA, 20 bp, synthetic construct
  misc_feature 1..20: note = CRISPR gRNA sequence
  source 1..20: mol_type = other DNA
gatgtggaaggtggtggccc

SEQ ID NO: 24207 - DNA, 20 bp, synthetic construct
  misc_feature 1..20: note = CRISPR gRNA sequence
  source 1..20: mol_type = other DNA
caaagaggaccttctaaaaa

SEQ ID NO: 24208 - DNA, 20 bp, synthetic construct
  misc_feature 1..20: note = CRISPR gRNA sequence
  source 1..20: mol_type = other DNA
aaagaggaccttctaaaaat

SEQ ID NO: 24209 - DNA, 20 bp, synthetic construct
  misc_feature 1..20: note = CRISPR gRNA sequence
  source 1..20: mol_type = other DNA
ctaaaaatactgcccattta

SEQ ID NO: 24210 - DNA, 20 bp, synthetic construct
  misc_feature 1..20: note = CRISPR gRNA sequence
  source 1..20: mol_type = other DNA
taaaaatactgcccatttac

SEQ ID NO: 24211 - DNA, 20 bp, synthetic construct
  misc_feature 1..20: note = CRISPR gRNA sequence
  source 1..20: mol_type = other DNA
aaaatactgcccatttacca

SEQ ID NO: 24212 - DNA, 20 bp, synthetic construct
  misc_feature 1..20: note = CRISPR gRNA sequence
  source 1..20: mol_type = other DNA
cccatttaccaaaaagacac

SEQ ID NO: 24213 - DNA, 20 bp, synthetic construct
  misc_feature 1..20: note = CRISPR gRNA sequence
  source 1..20: mol_type = other DNA
accaaaaagacacagaccgc

SEQ ID NO: 24214 - DNA, 20 bp, synthetic construct
  misc_feature 1..20: note = CRISPR gRNA sequence
  source 1..20: mol_type = other DNA
ccaaaaagacacagaccgcg

SEQ ID NO: 24215 - DNA, 20 bp, synthetic construct
  misc_feature 1..20: note = CRISPR gRNA sequence
  source 1..20: mol_type = other DNA
tgccctgcccccacatggct

SEQ ID NO: 24216 - DNA, 20 bp, synthetic construct
  misc_feature 1..20: note = CRISPR gRNA sequence
  source 1..20: mol_type = other DNA
ccctgcccccacatggctcc

SEQ ID NO: 24217 - DNA, 20 bp, synthetic construct
  misc_feature 1..20: note = CRISPR gRNA sequence
  source 1..20: mol_type = other DNA
cccccacatggctcctcaaa

SEQ ID NO: 24218 - DNA, 20 bp, synthetic construct
  misc_feature 1..20: note = CRISPR gRNA sequence
  source 1..20: mol_type = other DNA
ctcaaaaggagaaattgtct

SEQ ID NO: 24219 - DNA, 20 bp, synthetic construct
  misc_feature 1..20: note = CRISPR gRNA sequence
  source 1..20: mol_type = other DNA
aaaaggagaaattgtcttgc

SEQ ID NO: 24220 - DNA, 20 bp, synthetic construct
  misc_feature 1..20: note = CRISPR gRNA sequence
  source 1..20: mol_type = other DNA
tcttgccacccacgccttcc

SEQ ID NO: 24221 - DNA, 20 bp, synthetic construct
  misc_feature 1..20: note = CRISPR gRNA sequence
  source 1..20: mol_type = other DNA
gccacccacgccttccctcg

SEQ ID NO: 24222 - DNA, 20 bp, synthetic construct
  misc_feature 1..20: note = CRISPR gRNA sequence
  source 1..20: mol_type = other DNA
ccacccacgccttccctcgc

SEQ ID NO: 24223 - DNA, 20 bp, synthetic construct
  misc_feature 1..20: note = CRISPR gRNA sequence
  source 1..20: mol_type = other DNA
ccctcgccggggtgctgggg

SEQ ID NO: 24224 - DNA, 20 bp, synthetic construct
  misc_feature 1..20: note = CRISPR gRNA sequence
  source 1..20: mol_type = other DNA
cctcgccggggtgctggggg

SEQ ID NO: 24225 - DNA, 20 bp, synthetic construct
  misc_feature 1..20: note = CRISPR gRNA sequence
  source 1..20: mol_type = other DNA
gccggggtgctggggggcca

SEQ ID NO: 24226 - DNA, 20 bp, synthetic construct
  misc_feature 1..20: note = CRISPR gRNA sequence
  source 1..20: mol_type = other DNA
gggggccaacagcaattcaa

SEQ ID NO: 24227 - DNA, 20 bp, synthetic construct
  misc_feature 1..20: note = CRISPR gRNA sequence
  source 1..20: mol_type = other DNA
aaaaaggctatagagtgggc

SEQ ID NO: 24228 - DNA, 20 bp, synthetic construct
  misc_feature 1..20: note = CRISPR gRNA sequence
  source 1..20: mol_type = other DNA
tagagtgggctgagactttg

SEQ ID NO: 24229 - DNA, 20 bp, synthetic construct
  misc_feature 1..20: note = CRISPR gRNA sequence
  source 1..20: mol_type = other DNA
agactttggagatgggtagt

SEQ ID NO: 24230 - DNA, 20 bp, synthetic construct
  misc_feature 1..20: note = CRISPR gRNA sequence
  source 1..20: mol_type = other DNA
tggagatgggtagtttggtt

SEQ ID NO: 24231 - DNA, 20 bp, synthetic construct
  misc_feature 1..20: note = CRISPR gRNA sequence
  source 1..20: mol_type = other DNA
ggagatgggtagtttggttc

SEQ ID NO: 24232 - DNA, 20 bp, synthetic construct
  misc_feature 1..20: note = CRISPR gRNA sequence
  source 1..20: mol_type = other DNA
gagatgggtagtttggttca

SEQ ID NO: 24233 - DNA, 20 bp, synthetic construct
  misc_feature 1..20: note = CRISPR gRNA sequence
  source 1..20: mol_type = other DNA
ggttcaaatctcagcccact

SEQ ID NO: 24234 - DNA, 20 bp, synthetic construct
  misc_feature 1..20: note = CRISPR gRNA sequence
  source 1..20: mol_type = other DNA
gttcaaatctcagcccacta

SEQ ID NO: 24235 - DNA, 20 bp, synthetic construct
  misc_feature 1..20: note = CRISPR gRNA sequence
  source 1..20: mol_type = other DNA
aaatctcagcccactaatcc

SEQ ID NO: 24236 - DNA, 20 bp, synthetic construct
  misc_feature 1..20: note = CRISPR gRNA sequence
  source 1..20: mol_type = other DNA
agcccactaatccctctgag

SEQ ID NO: 24237 - DNA, 20 bp, synthetic construct
  misc_feature 1..20: note = CRISPR gRNA sequence
  source 1..20: mol_type = other DNA
atccctctgagcctgtctct

SEQ ID NO: 24238 - DNA, 20 bp, synthetic construct
  misc_feature 1..20: note = CRISPR gRNA sequence
  source 1..20: mol_type = other DNA
tgagcctgtctcttcatctg

SEQ ID NO: 24239 - DNA, 20 bp, synthetic construct
  misc_feature 1..20: note = CRISPR gRNA sequence
  source 1..20: mol_type = other DNA
agcctgtctcttcatctgaa

SEQ ID NO: 24240 - DNA, 20 bp, synthetic construct
  misc_feature 1..20: note = CRISPR gRNA sequence
  source 1..20: mol_type = other DNA
tctcttcatctgaaaaacag

SEQ ID NO: 24241 - DNA, 20 bp, synthetic construct
  misc_feature 1..20: note = CRISPR gRNA sequence
  source 1..20: mol_type = other DNA
ttcatctgaaaaacaggaat

SEQ ID NO: 24242 - DNA, 20 bp, synthetic construct
  misc_feature 1..20: note = CRISPR gRNA sequence
  source 1..20: mol_type = other DNA
catctgaaaaacaggaatac

SEQ ID NO: 24243 - DNA, 20 bp, synthetic construct
  misc_feature 1..20: note = CRISPR gRNA sequence
  source 1..20: mol_type = other DNA
atctgaaaaacaggaataca

SEQ ID NO: 24244 - DNA, 20 bp, synthetic construct
  misc_feature 1..20: note = CRISPR gRNA sequence
  source 1..20: mol_type = other DNA
aaaaacaggaatacaaatag

SEQ ID NO: 24245 - DNA, 20 bp, synthetic construct
  misc_feature 1..20: note = CRISPR gRNA sequence
  source 1..20: mol_type = other DNA
atgtgtaagttagaccaaat

SEQ ID NO: 24246 - DNA, 20 bp, synthetic construct
  misc_feature 1..20: note = CRISPR gRNA sequence
  source 1..20: mol_type = other DNA
gaccaaatggggtaatgcct

SEQ ID NO: 24247 - DNA, 20 bp, synthetic construct
  misc_feature 1..20: note = CRISPR gRNA sequence
  source 1..20: mol_type = other DNA
cgagtcatgtcatttggtac

SEQ ID NO: 24248 - DNA, 20 bp, synthetic construct
  misc_feature 1..20: note = CRISPR gRNA sequence
  source 1..20: mol_type = other DNA
ggtacctggcacttgctgga

SEQ ID NO: 24249 - DNA, 20 bp, synthetic construct
  misc_feature 1..20: note = CRISPR gRNA sequence
  source 1..20: mol_type = other DNA
gtacctggcacttgctggac

SEQ ID NO: 24250 - DNA, 20 bp, synthetic construct
  misc_feature 1..20: note = CRISPR gRNA sequence
  source 1..20: mol_type = other DNA
gcacttgctggacactgtga

SEQ ID NO: 24251 - DNA, 20 bp, synthetic construct
  misc_feature 1..20: note = CRISPR gRNA sequence
  source 1..20: mol_type = other DNA
gctggacactgtgaattcta

SEQ ID NO: 24252 - DNA, 20 bp, synthetic construct
  misc_feature 1..20: note = CRISPR gRNA sequence
  source 1..20: mol_type = other DNA
ctggacactgtgaattctag

SEQ ID NO: 24253 - DNA, 20 bp, synthetic construct
  misc_feature 1..20: note = CRISPR gRNA sequence
  source 1..20: mol_type = other DNA
gacactgtgaattctagttc

SEQ ID NO: 24254 - DNA, 20 bp, synthetic construct
  misc_feature 1..20: note = CRISPR gRNA sequence
  source 1..20: mol_type = other DNA
tgaattctagttctatatca

SEQ ID NO: 24255 - DNA, 20 bp, synthetic construct
  misc_feature 1..20: note = CRISPR gRNA sequence
  source 1..20: mol_type = other DNA
tagttctatatcattgccac

SEQ ID NO: 24256 - DNA, 20 bp, synthetic construct
  misc_feature 1..20: note = CRISPR gRNA sequence
  source 1..20: mol_type = other DNA
gttctatatcattgccacgg

SEQ ID NO: 24257 - DNA, 20 bp, synthetic construct
  misc_feature 1..20: note = CRISPR gRNA sequence
  source 1..20: mol_type = other DNA
tatatcattgccacggatga

SEQ ID NO: 24258 - DNA, 20 bp, synthetic construct
  misc_feature 1..20: note = CRISPR gRNA sequence
  source 1..20: mol_type = other DNA
tatcattgccacggatgaag

SEQ ID NO: 24259 - DNA, 20 bp, synthetic construct
  misc_feature 1..20: note = CRISPR gRNA sequence
  source 1..20: mol_type = other DNA
ccacggatgaagagaggctg

SEQ ID NO: 24260 - DNA, 20 bp, synthetic construct
  misc_feature 1..20: note = CRISPR gRNA sequence
  source 1..20: mol_type = other DNA
ccatgcgcagaaacatgctg

SEQ ID NO: 24261 - DNA, 20 bp, synthetic construct
  misc_feature 1..20: note = CRISPR gRNA sequence
  source 1..20: mol_type = other DNA
agagctgggagaaggtgagc

SEQ ID NO: 24262 - DNA, 20 bp, synthetic construct
  misc_feature 1..20: note = CRISPR gRNA sequence
  source 1..20: mol_type = other DNA
ggagaaggtgagctagaggg

SEQ ID NO: 24263 - DNA, 20 bp, synthetic construct
  misc_feature 1..20: note = CRISPR gRNA sequence
  source 1..20: mol_type = other DNA
gagggatacagtccctgccc

SEQ ID NO: 24264 - DNA, 20 bp, synthetic construct
  misc_feature 1..20: note = CRISPR gRNA sequence
  source 1..20: mol_type = other DNA
ccctcagggagagctgaagg

SEQ ID NO: 24265 - DNA, 20 bp, synthetic construct
  misc_feature 1..20: note = CRISPR gRNA sequence
  source 1..20: mol_type = other DNA
agggagagctgaagggctct

SEQ ID NO: 24266 - DNA, 20 bp, synthetic construct
  misc_feature 1..20: note = CRISPR gRNA sequence
  source 1..20: mol_type = other DNA
aagggctctctctcctgcca

SEQ ID NO: 24267 - DNA, 20 bp, synthetic construct
  misc_feature 1..20: note = CRISPR gRNA sequence
  source 1..20: mol_type = other DNA
tctctcctgccacgggatga

SEQ ID NO: 24268 - DNA, 20 bp, synthetic construct
  misc_feature 1..20: note = CRISPR gRNA sequence
  source 1..20: mol_type = other DNA
tctcctgccacgggatgatc

SEQ ID NO: 24269 - DNA, 20 bp, synthetic construct
  misc_feature 1..20: note = CRISPR gRNA sequence
  source 1..20: mol_type = other DNA
tcctgccacgggatgatcag

SEQ ID NO: 24270 - DNA, 20 bp, synthetic construct
  misc_feature 1..20: note = CRISPR gRNA sequence
  source 1..20: mol_type = other DNA
ctgccacgggatgatcaggg

SEQ ID NO: 24271 - DNA, 20 bp, synthetic construct
  misc_feature 1..20: note = CRISPR gRNA sequence
  source 1..20: mol_type = other DNA
ccacgggatgatcagggcca

SEQ ID NO: 24272 - DNA, 20 bp, synthetic construct
  misc_feature 1..20: note = CRISPR gRNA sequence
  source 1..20: mol_type = other DNA
ttccctccatcccgctctgg

SEQ ID NO: 24273 - DNA, 20 bp, synthetic construct
  misc_feature 1..20: note = CRISPR gRNA sequence
  source 1..20: mol_type = other DNA
tccctccatcccgctctggc

SEQ ID NO: 24274 - DNA, 20 bp, synthetic construct
  misc_feature 1..20: note = CRISPR gRNA sequence
  source 1..20: mol_type = other DNA
ccctccatcccgctctggca

SEQ ID NO: 24275 - DNA, 20 bp, synthetic construct
  misc_feature 1..20: note = CRISPR gRNA sequence
  source 1..20: mol_type = other DNA
cctccatcccgctctggcaa

SEQ ID NO: 24276 - DNA, 20 bp, synthetic construct
  misc_feature 1..20: note = CRISPR gRNA sequence
  source 1..20: mol_type = other DNA
catcccgctctggcaatgtg

SEQ ID NO: 24277 - DNA, 20 bp, synthetic construct
  misc_feature 1..20: note = CRISPR gRNA sequence
  source 1..20: mol_type = other DNA
tggcaatgtggtttggagaa

SEQ ID NO: 24278 - DNA, 20 bp, synthetic construct
  misc_feature 1..20: note = CRISPR gRNA sequence
  source 1..20: mol_type = other DNA
gcaatgtggtttggagaaac

SEQ ID NO: 24279 - DNA, 20 bp, synthetic construct
  misc_feature 1..20: note = CRISPR gRNA sequence
  source 1..20: mol_type = other DNA
ggagaaacagtccaatgaag

SEQ ID NO: 24280 - DNA, 20 bp, synthetic construct
  misc_feature 1..20: note = CRISPR gRNA sequence
  source 1..20: mol_type = other DNA
gagaaacagtccaatgaagg

SEQ ID NO: 24281 - DNA, 20 bp, synthetic construct
  misc_feature 1..20: note = CRISPR gRNA sequence
  source 1..20: mol_type = other DNA
tgaagcacttcctaagcatc

SEQ ID NO: 24282 - DNA, 20 bp, synthetic construct
  misc_feature 1..20: note = CRISPR gRNA sequence
  source 1..20: mol_type = other DNA
gaagcacttcctaagcatct

SEQ ID NO: 24283 - DNA, 20 bp, synthetic construct
  misc_feature 1..20: note = CRISPR gRNA sequence
  source 1..20: mol_type = other DNA
aagcacttcctaagcatcta

SEQ ID NO: 24284 - DNA, 20 bp, synthetic construct
  misc_feature 1..20: note = CRISPR gRNA sequence
  source 1..20: mol_type = other DNA
cctaagcatctatagacata

SEQ ID NO: 24285 - DNA, 20 bp, synthetic construct
  misc_feature 1..20: note = CRISPR gRNA sequence
  source 1..20: mol_type = other DNA
ctaagcatctatagacatag

SEQ ID NO: 24286 - DNA, 20 bp, synthetic construct
  misc_feature 1..20: note = CRISPR gRNA sequence
  source 1..20: mol_type = other DNA
agcatctatagacataggaa

SEQ ID NO: 24287 - DNA, 20 bp, synthetic construct
  misc_feature 1..20: note = CRISPR gRNA sequence
  source 1..20: mol_type = other DNA
tagacataggaaacttggct

SEQ ID NO: 24288 - DNA, 20 bp, synthetic construct
  misc_feature 1..20: note = CRISPR gRNA sequence
  source 1..20: mol_type = other DNA
ggctctggggatagaggaag

SEQ ID NO: 24289 - DNA, 20 bp, synthetic construct
  misc_feature 1..20: note = CRISPR gRNA sequence
  source 1..20: mol_type = other DNA
gctctggggatagaggaagg

SEQ ID NO: 24290 - DNA, 20 bp, synthetic construct
  misc_feature 1..20: note = CRISPR gRNA sequence
  source 1..20: mol_type = other DNA
tggggatagaggaaggtccc

SEQ ID NO: 24291 - DNA, 20 bp, synthetic construct
  misc_feature 1..20: note = CRISPR gRNA sequence
  source 1..20: mol_type = other DNA
gggatagaggaaggtcccat

SEQ ID NO: 24292 - DNA, 20 bp, synthetic construct
  misc_feature 1..20: note = CRISPR gRNA sequence
  source 1..20: mol_type = other DNA
aagtagatcttggtgtgact

SEQ ID NO: 24293 - DNA, 20 bp, synthetic construct
  misc_feature 1..20: note = CRISPR gRNA sequence
  source 1..20: mol_type = other DNA
ggtgtgactgggaggcagct

SEQ ID NO: 24294 - DNA, 20 bp, synthetic construct
  misc_feature 1..20: note = CRISPR gRNA sequence
  source 1..20: mol_type = other DNA
gtgtgactgggaggcagctg

SEQ ID NO: 24295 - DNA, 20 bp, synthetic construct
  misc_feature 1..20: note = CRISPR gRNA sequence
  source 1..20: mol_type = other DNA
ggaggcagctgtggcgttgt

SEQ ID NO: 24296 - DNA, 20 bp, synthetic construct
  misc_feature 1..20: note = CRISPR gRNA sequence
  source 1..20: mol_type = other DNA
tggcgttgtggggaaaccta

SEQ ID NO: 24297 - DNA, 20 bp, synthetic construct
  misc_feature 1..20: note = CRISPR gRNA sequence
  source 1..20: mol_type = other DNA
tggggaaacctagagtcttg

SEQ ID NO: 24298 - DNA, 20 bp, synthetic construct
  misc_feature 1..20: note = CRISPR gRNA sequence
  source 1..20: mol_type = other DNA
gagtcttgggcctgaatttc

SEQ ID NO: 24299 - DNA, 20 bp, synthetic construct
  misc_feature 1..20: note = CRISPR gRNA sequence
  source 1..20: mol_type = other DNA
gggcctgaatttcagctttg

SEQ ID NO: 24300 - DNA, 20 bp, synthetic construct
  misc_feature 1..20: note = CRISPR gRNA sequence
  source 1..20: mol_type = other DNA
ggcctgaatttcagctttga

SEQ ID NO: 24301 - DNA, 20 bp, synthetic construct
  misc_feature 1..20: note = CRISPR gRNA sequence
  source 1..20: mol_type = other DNA
aatttcagctttgacaccct

SEQ ID NO: 24302 - DNA, 20 bp, synthetic construct
  misc_feature 1..20: note = CRISPR gRNA sequence
  source 1..20: mol_type = other DNA
cagctttgacaccctctaat

SEQ ID NO: 24303 - DNA, 20 bp, synthetic construct
  misc_feature 1..20: note = CRISPR gRNA sequence
  source 1..20: mol_type = other DNA
agctttgacaccctctaatg

SEQ ID NO: 24304 - DNA, 20 bp, synthetic construct
  misc_feature 1..20: note = CRISPR gRNA sequence
  source 1..20: mol_type = other DNA
tgacaccctctaatgtaatg

SEQ ID NO: 24305 - DNA, 20 bp, synthetic construct
  misc_feature 1..20: note = CRISPR gRNA sequence
  source 1..20: mol_type = other DNA
gacaccctctaatgtaatgg

SEQ ID NO: 24306 - DNA, 20 bp, synthetic construct
  misc_feature 1..20: note = CRISPR gRNA sequence
  source 1..20: mol_type = other DNA
acaccctctaatgtaatggg

SEQ ID NO: 24307 - DNA, 20 bp, synthetic construct
  misc_feature 1..20: note = CRISPR gRNA sequence
  source 1..20: mol_type = other DNA
taatgtaatgggcttccttt

SEQ ID NO: 24308 - DNA, 20 bp, synthetic construct
  misc_feature 1..20: note = CRISPR gRNA sequence
  source 1..20: mol_type = other DNA
atgtaatgggcttcctttga

SEQ ID NO: 24309 - DNA, 20 bp, synthetic construct
  misc_feature 1..20: note = CRISPR gRNA sequence
  source 1..20: mol_type = other DNA
cctttgactgtaggcttccc

SEQ ID NO: 24310 - DNA, 20 bp, synthetic construct
  misc_feature 1..20: note = CRISPR gRNA sequence
  source 1..20: mol_type = other DNA
ctttgactgtaggcttccca

SEQ ID NO: 24311 - DNA, 20 bp, synthetic construct
  misc_feature 1..20: note = CRISPR gRNA sequence
  source 1..20: mol_type = other DNA
tgactgtaggcttcccacat

SEQ ID NO: 24312 - DNA, 20 bp, synthetic construct
  misc_feature 1..20: note = CRISPR gRNA sequence
  source 1..20: mol_type = other DNA
gactgtaggcttcccacata

SEQ ID NO: 24313 - DNA, 20 bp, synthetic construct
  misc_feature 1..20: note = CRISPR gRNA sequence
  source 1..20: mol_type = other DNA
actgtaggcttcccacatag

SEQ ID NO: 24314 - DNA, 20 bp, synthetic construct
  misc_feature 1..20: note = CRISPR gRNA sequence
  source 1..20: mol_type = other DNA
taggcttcccacatagctgg

SEQ ID NO: 24315 - DNA, 20 bp, synthetic construct
  misc_feature 1..20: note = CRISPR gRNA sequence
  source 1..20: mol_type = other DNA
cccacatagctggcacccca

SEQ ID NO: 24316 - DNA, 20 bp, synthetic construct
  misc_feature 1..20: note = CRISPR gRNA sequence
  source 1..20: mol_type = other DNA
ccacatagctggcaccccac

SEQ ID NO: 24317 - DNA, 20 bp, synthetic construct
  misc_feature 1..20: note = CRISPR gRNA sequence
  source 1..20: mol_type = other DNA
gcaccccacacagaactccc

SEQ ID NO: 24318 - DNA, 20 bp, synthetic construct
  misc_feature 1..20: note = CRISPR gRNA sequence
  source 1..20: mol_type = other DNA
ccttggccttctgatgatcc

SEQ ID NO: 24319 - DNA, 20 bp, synthetic construct
  misc_feature 1..20: note = CRISPR gRNA sequence
  source 1..20: mol_type = other DNA
ggccttctgatgatcctgca

SEQ ID NO: 24320 - DNA, 20 bp, synthetic construct
  misc_feature 1..20: note = CRISPR gRNA sequence
  source 1..20: mol_type = other DNA
gccttctgatgatcctgcag

SEQ ID NO: 24321 - DNA, 20 bp, synthetic construct
  misc_feature 1..20: note = CRISPR gRNA sequence
  source 1..20: mol_type = other DNA
ctgatgatcctgcaggacaa

SEQ ID NO: 24322 - DNA, 20 bp, synthetic construct
  misc_feature 1..20: note = CRISPR gRNA sequence
  source 1..20: mol_type = other DNA
tgatgatcctgcaggacaat

SEQ ID NO: 24323 - DNA, 20 bp, synthetic construct
  misc_feature 1..20: note = CRISPR gRNA sequence
  source 1..20: mol_type = other DNA
atgatcctgcaggacaatct

SEQ ID NO: 24324 - DNA, 20 bp, synthetic construct
  misc_feature 1..20: note = CRISPR gRNA sequence
  source 1..20: mol_type = other DNA
caggacaatcttttttgttt

SEQ ID NO: 24325 - DNA, 20 bp, synthetic construct
  misc_feature 1..20: note = CRISPR gRNA sequence
  source 1..20: mol_type = other DNA
ttttgttttttgttttttgt

SEQ ID NO: 24326 - DNA, 20 bp, synthetic construct
  misc_feature 1..20: note = CRISPR gRNA sequence
  source 1..20: mol_type = other DNA
tttgttttttgttttttgtt

SEQ ID NO: 24327 - DNA, 20 bp, synthetic construct
  misc_feature 1..20: note = CRISPR gRNA sequence
  source 1..20: mol_type = other DNA
ttgttttttgttttttgttt

SEQ ID NO: 24328 - DNA, 20 bp, synthetic construct
  misc_feature 1..20: note = CRISPR gRNA sequence
  source 1..20: mol_type = other DNA
tgttttttgttttttgtttt

SEQ ID NO: 24329 - DNA, 20 bp, synthetic construct
  misc_feature 1..20: note = CRISPR gRNA sequence
  source 1..20: mol_type = other DNA
gttttttgttttttgttttt

SEQ ID NO: 24330 - DNA, 20 bp, synthetic construct
  misc_feature 1..20: note = CRISPR gRNA sequence
  source 1..20: mol_type = other DNA
ttttttgttttttgtttttt

SEQ ID NO: 24331 - DNA, 20 bp, synthetic construct
  misc_feature 1..20: note = CRISPR gRNA sequence
  source 1..20: mol_type = other DNA
tttgttttttgttttttttt

SEQ ID NO: 24332 - DNA, 20 bp, synthetic construct
  misc_feature 1..20: note = CRISPR gRNA sequence
  source 1..20: mol_type = other DNA
ttgttttttgtttttttttt

SEQ ID NO: 24333 - DNA, 20 bp, synthetic construct
  misc_feature 1..20: note = CRISPR gRNA sequence
  source 1..20: mol_type = other DNA
tgttttttgttttttttttg

SEQ ID NO: 24334 - DNA, 20 bp, synthetic construct
  misc_feature 1..20: note = CRISPR gRNA sequence
  source 1..20: mol_type = other DNA
gttttttgttttttttttga

SEQ ID NO: 24335 - DNA, 20 bp, synthetic construct
  misc_feature 1..20: note = CRISPR gRNA sequence
  source 1..20: mol_type = other DNA
ttttttgttttttttttgag

SEQ ID NO: 24336 - DNA, 20 bp, synthetic construct
  misc_feature 1..20: note = CRISPR gRNA sequence
  source 1..20: mol_type = other DNA
tttgttttttttttgagatg

SEQ ID NO: 24337 - DNA, 20 bp, synthetic construct
  misc_feature 1..20: note = CRISPR gRNA sequence
  source 1..20: mol_type = other DNA
ttgttttttttttgagatgg

SEQ ID NO: 24338 - DNA, 20 bp, synthetic construct
  misc_feature 1..20: note = CRISPR gRNA sequence
  source 1..20: mol_type = other DNA
tgttttttttttgagatggt

SEQ ID NO: 24339 - DNA, 20 bp, synthetic construct
  misc_feature 1..20: note = CRISPR gRNA sequence
  source 1..20: mol_type = other DNA
gttttttttttgagatggta

SEQ ID NO: 24340 - DNA, 20 bp, synthetic construct
  misc_feature 1..20: note = CRISPR gRNA sequence
  source 1..20: mol_type = other DNA
ttttttttttgagatggtat

SEQ ID NO: 24341 - DNA, 20 bp, synthetic construct
  misc_feature 1..20: note = CRISPR gRNA sequence
  source 1..20: mol_type = other DNA
tttttttgagatggtatctc

SEQ ID NO: 24342 - DNA, 20 bp, synthetic construct
  misc_feature 1..20: note = CRISPR gRNA sequence
  source 1..20: mol_type = other DNA
ttttttgagatggtatctca

SEQ ID NO: 24343 - DNA, 20 bp, synthetic construct
  misc_feature 1..20: note = CRISPR gRNA sequence
  source 1..20: mol_type = other DNA
tttttgagatggtatctcac

SEQ ID NO: 24344 - DNA, 20 bp, synthetic construct
  misc_feature 1..20: note = CRISPR gRNA sequence
  source 1..20: mol_type = other DNA
ttttgagatggtatctcact

SEQ ID NO: 24345 - DNA, 20 bp, synthetic construct
  misc_feature 1..20: note = CRISPR gRNA sequence
  source 1..20: mol_type = other DNA
tttgagatggtatctcactt

SEQ ID NO: 24346 - DNA, 20 bp, synthetic construct
  misc_feature 1..20: note = CRISPR gRNA sequence
  source 1..20: mol_type = other DNA
ttgagatggtatctcacttt

SEQ ID NO: 24347 - DNA, 20 bp, synthetic construct
  misc_feature 1..20: note = CRISPR gRNA sequence
  source 1..20: mol_type = other DNA
tgagatggtatctcactttg

SEQ ID NO: 24348 - DNA, 20 bp, synthetic construct
  misc_feature 1..20: note = CRISPR gRNA sequence
  source 1..20: mol_type = other DNA
gagatggtatctcactttgt

SEQ ID NO: 24349 - DNA, 20 bp, synthetic construct
  misc_feature 1..20: note = CRISPR gRNA sequence
  source 1..20: mol_type = other DNA
agatggtatctcactttgtc

SEQ ID NO: 24350 - DNA, 20 bp, synthetic construct
  misc_feature 1..20: note = CRISPR gRNA sequence
  source 1..20: mol_type = other DNA
actttgtcgcccaggctgga

SEQ ID NO: 24351 - DNA, 20 bp, synthetic construct
  misc_feature 1..20: note = CRISPR gRNA sequence
  source 1..20: mol_type = other DNA
tgtcgcccaggctggagtgc

SEQ ID NO: 24352 - DNA, 20 bp, synthetic construct
  misc_feature 1..20: note = CRISPR gRNA sequence
  source 1..20: mol_type = other DNA
gtcgcccaggctggagtgca

SEQ ID NO: 24353 - DNA, 20 bp, synthetic construct
  misc_feature 1..20: note = CRISPR gRNA sequence
  source 1..20: mol_type = other DNA
tcgcccaggctggagtgcag

SEQ ID NO: 24354 - DNA, 20 bp, synthetic construct
  misc_feature 1..20: note = CRISPR gRNA sequence
  source 1..20: mol_type = other DNA
gagtgcagtggcgcagtctt

SEQ ID NO: 24355 - DNA, 20 bp, synthetic construct
  misc_feature 1..20: note = CRISPR gRNA sequence
  source 1..20: mol_type = other DNA
ggttcactgcagcctctgcc

SEQ ID NO: 24356 - DNA, 20 bp, synthetic construct
  misc_feature 1..20: note = CRISPR gRNA sequence
  source 1..20: mol_type = other DNA
gttcactgcagcctctgcct

SEQ ID NO: 24357 - DNA, 20 bp, synthetic construct
  misc_feature 1..20: note = CRISPR gRNA sequence
  source 1..20: mol_type = other DNA
actgcagcctctgcctccca

SEQ ID NO: 24358 - DNA, 20 bp, synthetic construct
  misc_feature 1..20: note = CRISPR gRNA sequence
  source 1..20: mol_type = other DNA
cagcctctgcctcccaggtt

SEQ ID NO: 24359 - DNA, 20 bp, synthetic construct
  misc_feature 1..20: note = CRISPR gRNA sequence
  source 1..20: mol_type = other DNA
tgcctcccaggttcaagcga

SEQ ID NO: 24360 - DNA, 20 bp, synthetic construct
  misc_feature 1..20: note = CRISPR gRNA sequence
  source 1..20: mol_type = other DNA
cctcccaggttcaagcgatt

SEQ ID NO: 24361 - DNA, 20 bp, synthetic construct
  misc_feature 1..20: note = CRISPR gRNA sequence
  source 1..20: mol_type = other DNA
ccaggttcaagcgattctcc

SEQ ID NO: 24362 - DNA, 20 bp, synthetic construct
  misc_feature 1..20: note = CRISPR gRNA sequence
  source 1..20: mol_type = other DNA
aagcgattctcctgcctcag

SEQ ID NO: 24363 - DNA, 20 bp, synthetic construct
  misc_feature 1..20: note = CRISPR gRNA sequence
  source 1..20: mol_type = other DNA
tcctgcctcagcctcccaag

SEQ ID NO: 24364 - DNA, 20 bp, synthetic construct
  misc_feature 1..20: note = CRISPR gRNA sequence
  source 1..20: mol_type = other DNA
ctgcctcagcctcccaagta

SEQ ID NO: 24365 - DNA, 20 bp, synthetic construct
  misc_feature 1..20: note = CRISPR gRNA sequence
  source 1..20: mol_type = other DNA
cctcagcctcccaagtagct

SEQ ID NO: 24366 - DNA, 20 bp, synthetic construct
  misc_feature 1..20: note = CRISPR gRNA sequence
  source 1..20: mol_type = other DNA
agcctcccaagtagctggga

SEQ ID NO: 24367 - DNA, 20 bp, synthetic construct
  misc_feature 1..20: note = CRISPR gRNA sequence
  source 1..20: mol_type = other DNA
ccaagtagctgggattacag

SEQ ID NO: 24368 - DNA, 20 bp, synthetic construct
  misc_feature 1..20: note = CRISPR gRNA sequence
  source 1..20: mol_type = other DNA
ggattacagaagcacgccac

SEQ ID NO: 24369 - DNA, 20 bp, synthetic construct
  misc_feature 1..20: note = CRISPR gRNA sequence
  source 1..20: mol_type = other DNA
cagaagcacgccaccatgcc

SEQ ID NO: 24370 - DNA, 20 bp, synthetic construct
  misc_feature 1..20: note = CRISPR gRNA sequence
  source 1..20: mol_type = other DNA
gctaattttgtatttttagt

SEQ ID NO: 24371 - DNA, 20 bp, synthetic construct
  misc_feature 1..20: note = CRISPR gRNA sequence
  source 1..20: mol_type = other DNA
attttgtatttttagtagag

SEQ ID NO: 24372 - DNA, 20 bp, synthetic construct
  misc_feature 1..20: note = CRISPR gRNA sequence
  source 1..20: mol_type = other DNA
tgtatttttagtagagacgg

SEQ ID NO: 24373 - DNA, 20 bp, synthetic construct
  misc_feature 1..20: note = CRISPR gRNA sequence
  source 1..20: mol_type = other DNA
gtatttttagtagagacggg

SEQ ID NO: 24374 - DNA, 20 bp, synthetic construct
  misc_feature 1..20: note = CRISPR gRNA sequence
  source 1..20: mol_type = other DNA
tatttttagtagagacggga

SEQ ID NO: 24375 - DNA, 20 bp, synthetic construct
  misc_feature 1..20: note = CRISPR gRNA sequence
  source 1..20: mol_type = other DNA
ttagtagagacgggatttca

SEQ ID NO: 24376 - DNA, 20 bp, synthetic construct
  misc_feature 1..20: note = CRISPR gRNA sequence
  source 1..20: mol_type = other DNA
tagtagagacgggatttcac

SEQ ID NO: 24377 - DNA, 20 bp, synthetic construct
  misc_feature 1..20: note = CRISPR gRNA sequence
  source 1..20: mol_type = other DNA
agtagagacgggatttcacc

SEQ ID NO: 24378 - DNA, 20 bp, synthetic construct
  misc_feature 1..20: note = CRISPR gRNA sequence
  source 1..20: mol_type = other DNA
gtagagacgggatttcacca

SEQ ID NO: 24379 - DNA, 20 bp, synthetic construct
  misc_feature 1..20: note = CRISPR gRNA sequence
  source 1..20: mol_type = other DNA
caccatgttgcccgggctgg

SEQ ID NO: 24380 - DNA, 20 bp, synthetic construct
  misc_feature 1..20: note = CRISPR gRNA sequence
  source 1..20: mol_type = other DNA
accatgttgcccgggctggt

SEQ ID NO: 24381 - DNA, 20 bp, synthetic construct
  misc_feature 1..20: note = CRISPR gRNA sequence
  source 1..20: mol_type = other DNA
cccgggctggtctcaaactc

SEQ ID NO: 24382 - DNA, 20 bp, synthetic construct
  misc_feature 1..20: note = CRISPR gRNA sequence
  source 1..20: mol_type = other DNA
gtctcaaactcctgacctca

SEQ ID NO: 24383 - DNA, 20 bp, synthetic construct
  misc_feature 1..20: note = CRISPR gRNA sequence
  source 1..20: mol_type = other DNA
aaactcctgacctcaagtga

SEQ ID NO: 24384 - DNA, 20 bp, synthetic construct
  misc_feature 1..20: note = CRISPR gRNA sequence
  source 1..20: mol_type = other DNA
ctgacctcaagtgatctgcc

SEQ ID NO: 24385 - DNA, 20 bp, synthetic construct
  misc_feature 1..20: note = CRISPR gRNA sequence
  source 1..20: mol_type = other DNA
acctcaagtgatctgcctgc

SEQ ID NO: 24386 - DNA, 20 bp, synthetic construct
  misc_feature 1..20: note = CRISPR gRNA sequence
  source 1..20: mol_type = other DNA
aagtgatctgcctgcctcgg

SEQ ID NO: 24387 - DNA, 20 bp, synthetic construct
  misc_feature 1..20: note = CRISPR gRNA sequence
  source 1..20: mol_type = other DNA
cctgcctcggcctcccacag

SEQ ID NO: 24388 - DNA, 20 bp, synthetic construct
  misc_feature 1..20: note = CRISPR gRNA sequence
  source 1..20: mol_type = other DNA
cctcggcctcccacagtggt

SEQ ID NO: 24389 - DNA, 20 bp, synthetic construct
  misc_feature 1..20: note = CRISPR gRNA sequence
  source 1..20: mol_type = other DNA
ggcctcccacagtggtgggc

SEQ ID NO: 24390 - DNA, 20 bp, synthetic construct
  misc_feature 1..20: note = CRISPR gRNA sequence
  source 1..20: mol_type = other DNA
ccacagtggtgggctgcaag

SEQ ID NO: 24391 - DNA, 20 bp, synthetic construct
  misc_feature 1..20: note = CRISPR gRNA sequence
  source 1..20: mol_type = other DNA
caaggcaatcttcattctcc

SEQ ID NO: 24392 - DNA, 20 bp, synthetic construct
  misc_feature 1..20: note = CRISPR gRNA sequence
  source 1..20: mol_type = other DNA
cattctccagaactaatatt

SEQ ID NO: 24393 - DNA, 20 bp, synthetic construct
  misc_feature 1..20: note = CRISPR gRNA sequence
  source 1..20: mol_type = other DNA
attctccagaactaatattg

SEQ ID NO: 24394 - DNA, 20 bp, synthetic construct
  misc_feature 1..20: note = CRISPR gRNA sequence
  source 1..20: mol_type = other DNA
tccagaactaatattgggaa

SEQ ID NO: 24395 - DNA, 20 bp, synthetic construct
  misc_feature 1..20: note = CRISPR gRNA sequence
  source 1..20: mol_type = other DNA
cagaactaatattgggaaaa

SEQ ID NO: 24396 - DNA, 20 bp, synthetic construct
  misc_feature 1..20: note = CRISPR gRNA sequence
  source 1..20: mol_type = other DNA
atattgggaaaactgatgtt

SEQ ID NO: 24397 - DNA, 20 bp, synthetic construct
  misc_feature 1..20: note = CRISPR gRNA sequence
  source 1..20: mol_type = other DNA
ggaaaactgatgttcagaga

SEQ ID NO: 24398 - DNA, 20 bp, synthetic construct
  misc_feature 1..20: note = CRISPR gRNA sequence
  source 1..20: mol_type = other DNA
atgttcagagaggtcaagtg

SEQ ID NO: 24399 - DNA, 20 bp, synthetic construct
  misc_feature 1..20: note = CRISPR gRNA sequence
  source 1..20: mol_type = other DNA
agagaggtcaagtgacttgg

SEQ ID NO: 24400 - DNA, 20 bp, synthetic construct
  misc_feature 1..20: note = CRISPR gRNA sequence
  source 1..20: mol_type = other DNA
ggctaaggcatcacagccag

SEQ ID NO: 24401 - DNA, 20 bp, synthetic construct
  misc_feature 1..20: note = CRISPR gRNA sequence
  source 1..20: mol_type = other DNA
gctaaggcatcacagccaga

SEQ ID NO: 24402 - DNA, 20 bp, synthetic construct
  misc_feature 1..20: note = CRISPR gRNA sequence
  source 1..20: mol_type = other DNA
aggcatcacagccagaattc

SEQ ID NO: 24403 - DNA, 20 bp, synthetic construct
  misc_feature 1..20: note = CRISPR gRNA sequence
  source 1..20: mol_type = other DNA
agatgcaagctcctaaacca

SEQ ID NO: 24404 - DNA, 20 bp, synthetic construct
  misc_feature 1..20: note = CRISPR gRNA sequence
  source 1..20: mol_type = other DNA
ctaaaccacatgaccttgga

SEQ ID NO: 24405 - DNA, 20 bp, synthetic construct
  misc_feature 1..20: note = CRISPR gRNA sequence
  source 1..20: mol_type = other DNA
aaccacatgaccttggacaa

SEQ ID NO: 24406 - DNA, 20 bp, synthetic construct
  misc_feature 1..20: note = CRISPR gRNA sequence
  source 1..20: mol_type = other DNA
ggacaagccatttcactgag

SEQ ID NO: 24407 - DNA, 20 bp, synthetic construct
  misc_feature 1..20: note = CRISPR gRNA sequence
  source 1..20: mol_type = other DNA
gacaagccatttcactgagg

SEQ ID NO: 24408 - DNA, 20 bp, synthetic construct
  misc_feature 1..20: note = CRISPR gRNA sequence
  source 1..20: mol_type = other DNA
cactgaggcgtgtgaacctc

SEQ ID NO: 24409 - DNA, 20 bp, synthetic construct
  misc_feature 1..20: note = CRISPR gRNA sequence
  source 1..20: mol_type = other DNA
actgaggcgtgtgaacctcc

SEQ ID NO: 24410 - DNA, 20 bp, synthetic construct
  misc_feature 1..20: note = CRISPR gRNA sequence
  source 1..20: mol_type = other DNA
aggcgtgtgaacctcctcta

SEQ ID NO: 24411 - DNA, 20 bp, synthetic construct
  misc_feature 1..20: note = CRISPR gRNA sequence
  source 1..20: mol_type = other DNA
ctctaagctcaaatgggcat

SEQ ID NO: 24412 - DNA, 20 bp, synthetic construct
  misc_feature 1..20: note = CRISPR gRNA sequence
  source 1..20: mol_type = other DNA
taagctcaaatgggcataac

SEQ ID NO: 24413 - DNA, 20 bp, synthetic construct
  misc_feature 1..20: note = CRISPR gRNA sequence
  source 1..20: mol_type = other DNA
agctcaaatgggcataacac

SEQ ID NO: 24414 - DNA, 20 bp, synthetic construct
  misc_feature 1..20: note = CRISPR gRNA sequence
  source 1..20: mol_type = other DNA
aaatgggcataacactctac

SEQ ID NO: 24415 - DNA, 20 bp, synthetic construct
  misc_feature 1..20: note = CRISPR gRNA sequence
  source 1..20: mol_type = other DNA
taccctgccttttccccaga

SEQ ID NO: 24416 - DNA, 20 bp, synthetic construct
  misc_feature 1..20: note = CRISPR gRNA sequence
  source 1..20: mol_type = other DNA
ccctgccttttccccagagc

SEQ ID NO: 24417 - DNA, 20 bp, synthetic construct
  misc_feature 1..20: note = CRISPR gRNA sequence
  source 1..20: mol_type = other DNA
ccttttccccagagcttttt

SEQ ID NO: 24418 - DNA, 20 bp, synthetic construct
  misc_feature 1..20: note = CRISPR gRNA sequence
  source 1..20: mol_type = other DNA
ttccccagagctttttggga

SEQ ID NO: 24419 - DNA, 20 bp, synthetic construct
  misc_feature 1..20: note = CRISPR gRNA sequence
  source 1..20: mol_type = other DNA
tccccagagctttttgggaa

SEQ ID NO: 24420 - DNA, 20 bp, synthetic construct
  misc_feature 1..20: note = CRISPR gRNA sequence
  source 1..20: mol_type = other DNA
ccccagagctttttgggaac

SEQ ID NO: 24421 - DNA, 20 bp, synthetic construct
  misc_feature 1..20: note = CRISPR gRNA sequence
  source 1..20: mol_type = other DNA
cccagagctttttgggaact

SEQ ID NO: 24422 - DNA, 20 bp, synthetic construct
  misc_feature 1..20: note = CRISPR gRNA sequence
  source 1..20: mol_type = other DNA
tttgggaactcagatggtgt

SEQ ID NO: 24423 - DNA, 20 bp, synthetic construct
  misc_feature 1..20: note = CRISPR gRNA sequence
  source 1..20: mol_type = other DNA
ttgggaactcagatggtgtg

SEQ ID NO: 24424 - DNA, 20 bp, synthetic construct
  misc_feature 1..20: note = CRISPR gRNA sequence
  source 1..20: mol_type = other DNA
tgggaactcagatggtgtgg

SEQ ID NO: 24425 - DNA, 20 bp, synthetic construct
  misc_feature 1..20: note = CRISPR gRNA sequence
  source 1..20: mol_type = other DNA
gggaactcagatggtgtgga

SEQ ID NO: 24426 - DNA, 20 bp, synthetic construct
  misc_feature 1..20: note = CRISPR gRNA sequence
  source 1..20: mol_type = other DNA
ggaactcagatggtgtggag

SEQ ID NO: 24427 - DNA, 20 bp, synthetic construct
  misc_feature 1..20: note = CRISPR gRNA sequence
  source 1..20: mol_type = other DNA
agatggtgtggaggatggag

SEQ ID NO: 24428 - DNA, 20 bp, synthetic construct
  misc_feature 1..20: note = CRISPR gRNA sequence
  source 1..20: mol_type = other DNA
tgagctgcaaatccttgatc

SEQ ID NO: 24429 - DNA, 20 bp, synthetic construct
  misc_feature 1..20: note = CRISPR gRNA sequence
  source 1..20: mol_type = other DNA
caaatccttgatcacccaag

SEQ ID NO: 24430 - DNA, 20 bp, synthetic construct
  misc_feature 1..20: note = CRISPR gRNA sequence
  source 1..20: mol_type = other DNA
gatcacccaagaggaagtgc

SEQ ID NO: 24431 - DNA, 20 bp, synthetic construct
  misc_feature 1..20: note = CRISPR gRNA sequence
  source 1..20: mol_type = other DNA
atcacccaagaggaagtgct

SEQ ID NO: 24432 - DNA, 20 bp, synthetic construct
  misc_feature 1..20: note = CRISPR gRNA sequence
  source 1..20: mol_type = other DNA
aaggtgcaggcttcagtctt

SEQ ID NO: 24433 - DNA, 20 bp, synthetic construct
  misc_feature 1..20: note = CRISPR gRNA sequence
  source 1..20: mol_type = other DNA
aggtgcaggcttcagtctta

SEQ ID NO: 24434 - DNA, 20 bp, synthetic construct
  misc_feature 1..20: note = CRISPR gRNA sequence
  source 1..20: mol_type = other DNA
cagtcttagggaagcaggaa

SEQ ID NO: 24435 - DNA, 20 bp, synthetic construct
  misc_feature 1..20: note = CRISPR gRNA sequence
  source 1..20: mol_type = other DNA
agtcttagggaagcaggaag

SEQ ID NO: 24436 - DNA, 20 bp, synthetic construct
  misc_feature 1..20: note = CRISPR gRNA sequence
  source 1..20: mol_type = other DNA
agggaagcaggaagtggggc

SEQ ID NO: 24437 - DNA, 20 bp, synthetic construct
  misc_feature 1..20: note = CRISPR gRNA sequence
  source 1..20: mol_type = other DNA
gggaagcaggaagtggggcg

SEQ ID NO: 24438 - DNA, 20 bp, synthetic construct
  misc_feature 1..20: note = CRISPR gRNA sequence
  source 1..20: mol_type = other DNA
aaatgtgtattgggggcttc

SEQ ID NO: 24439 - DNA, 20 bp, synthetic construct
  misc_feature 1..20: note = CRISPR gRNA sequence
  source 1..20: mol_type = other DNA
ggggcttctgggagggggtt

SEQ ID NO: 24440 - DNA, 20 bp, synthetic construct
  misc_feature 1..20: note = CRISPR gRNA sequence
  source 1..20: mol_type = other DNA
ctgggagggggtttcttctt

SEQ ID NO: 24441 - DNA, 20 bp, synthetic construct
  misc_feature 1..20: note = CRISPR gRNA sequence
  source 1..20: mol_type = other DNA
tgggagggggtttcttcttg

SEQ ID NO: 24442 - DNA, 20 bp, synthetic construct
  misc_feature 1..20: note = CRISPR gRNA sequence
  source 1..20: mol_type = other DNA
ggagggggtttcttcttgtc

SEQ ID NO: 24443 - DNA, 20 bp, synthetic construct
  misc_feature 1..20: note = CRISPR gRNA sequence
  source 1..20: mol_type = other DNA
cttcttgtccaggttgagcc

SEQ ID NO: 24444 - DNA, 20 bp, synthetic construct
  misc_feature 1..20: note = CRISPR gRNA sequence
  source 1..20: mol_type = other DNA
ttcttgtccaggttgagcca

SEQ ID NO: 24445 - DNA, 20 bp, synthetic construct
  misc_feature 1..20: note = CRISPR gRNA sequence
  source 1..20: mol_type = other DNA
cttgtccaggttgagccaat

SEQ ID NO: 24446 - DNA, 20 bp, synthetic construct
  misc_feature 1..20: note = CRISPR gRNA sequence
  source 1..20: mol_type = other DNA
ttgtccaggttgagccaatg

SEQ ID NO: 24447 - DNA, 20 bp, synthetic construct
  misc_feature 1..20: note = CRISPR gRNA sequence
  source 1..20: mol_type = other DNA
gtccaggttgagccaatgac

SEQ ID NO: 24448 - DNA, 20 bp, synthetic construct
  misc_feature 1..20: note = CRISPR gRNA sequence
  source 1..20: mol_type = other DNA
tccaggttgagccaatgacg

SEQ ID NO: 24449 - DNA, 20 bp, synthetic construct
  misc_feature 1..20: note = CRISPR gRNA sequence
  source 1..20: mol_type = other DNA
agccaatgacgcagatctta

SEQ ID NO: 24450 - DNA, 20 bp, synthetic construct
  misc_feature 1..20: note = CRISPR gRNA sequence
  source 1..20: mol_type = other DNA
aggccctctggtgacttttt

SEQ ID NO: 24451 - DNA, 20 bp, synthetic construct
  misc_feature 1..20: note = CRISPR gRNA sequence
  source 1..20: mol_type = other DNA
ggccctctggtgactttttg

SEQ ID NO: 24452 - DNA, 20 bp, synthetic construct
  misc_feature 1..20: note = CRISPR gRNA sequence
  source 1..20: mol_type = other DNA
tggtgactttttgcccaggc

SEQ ID NO: 24453 - DNA, 20 bp, synthetic construct
  misc_feature 1..20: note = CRISPR gRNA sequence
  source 1..20: mol_type = other DNA
gtgactttttgcccaggcaa

SEQ ID NO: 24454 - DNA, 20 bp, synthetic construct
  misc_feature 1..20: note = CRISPR gRNA sequence
  source 1..20: mol_type = other DNA
tttgcccaggcaacttctca

SEQ ID NO: 24455 - DNA, 20 bp, synthetic construct
  misc_feature 1..20: note = CRISPR gRNA sequence
  source 1..20: mol_type = other DNA
ttgcccaggcaacttctcag

SEQ ID NO: 24456 - DNA, 20 bp, synthetic construct
  misc_feature 1..20: note = CRISPR gRNA sequence
  source 1..20: mol_type = other DNA
tgcccaggcaacttctcagt

SEQ ID NO: 24457 - DNA, 20 bp, synthetic construct
  misc_feature 1..20: note = CRISPR gRNA sequence
  source 1..20: mol_type = other DNA
gcccaggcaacttctcagtg

SEQ ID NO: 24458 - DNA, 20 bp, synthetic construct
  misc_feature 1..20: note = CRISPR gRNA sequence
  source 1..20: mol_type = other DNA
cccaggcaacttctcagtgg

SEQ ID NO: 24459 - DNA, 20 bp, synthetic construct
  misc_feature 1..20: note = CRISPR gRNA sequence
  source 1..20: mol_type = other DNA
ctcagtggtggtgatgggga

SEQ ID NO: 24460 - DNA, 20 bp, synthetic construct
  misc_feature 1..20: note = CRISPR gRNA sequence
  source 1..20: mol_type = other DNA
tcagtggtggtgatggggag

SEQ ID NO: 24461 - DNA, 20 bp, synthetic construct
  misc_feature 1..20: note = CRISPR gRNA sequence
  source 1..20: mol_type = other DNA
agtggtggtgatggggagcg

SEQ ID NO: 24462 - DNA, 20 bp, synthetic construct
  misc_feature 1..20: note = CRISPR gRNA sequence
  source 1..20: mol_type = other DNA
ccctgctggctgtgggggcc

SEQ ID NO: 24463 - DNA, 20 bp, synthetic construct
  misc_feature 1..20: note = CRISPR gRNA sequence
  source 1..20: mol_type = other DNA
ctggctgtgggggccttttt

SEQ ID NO: 24464 - DNA, 20 bp, synthetic construct
  misc_feature 1..20: note = CRISPR gRNA sequence
  source 1..20: mol_type = other DNA
gctgtgggggcctttttttt

SEQ ID NO: 24465 - DNA, 20 bp, synthetic construct
  misc_feature 1..20: note = CRISPR gRNA sequence
  source 1..20: mol_type = other DNA
tgggggcctttttttttttt

SEQ ID NO: 24466 - DNA, 20 bp, synthetic construct
  misc_feature 1..20: note = CRISPR gRNA sequence
  source 1..20: mol_type = other DNA
ttttttttttctgagacaca

SEQ ID NO: 24467 - DNA, 20 bp, synthetic construct
  misc_feature 1..20: note = CRISPR gRNA sequence
  source 1..20: mol_type = other DNA
tttttttttctgagacacag

SEQ ID NO: 24468 - DNA, 20 bp, synthetic construct
  misc_feature 1..20: note = CRISPR gRNA sequence
  source 1..20: mol_type = other DNA
ttttttttctgagacacagt

SEQ ID NO: 24469 - DNA, 20 bp, synthetic construct
  misc_feature 1..20: note = CRISPR gRNA sequence
  source 1..20: mol_type = other DNA
tttttttctgagacacagtc

SEQ ID NO: 24470 - DNA, 20 bp, synthetic construct
  misc_feature 1..20: note = CRISPR gRNA sequence
  source 1..20: mol_type = other DNA
ttttttctgagacacagtct

SEQ ID NO: 24471 - DNA, 20 bp, synthetic construct
  misc_feature 1..20: note = CRISPR gRNA sequence
  source 1..20: mol_type = other DNA
tttttctgagacacagtctg

SEQ ID NO: 24472 - DNA, 20 bp, synthetic construct
  misc_feature 1..20: note = CRISPR gRNA sequence
  source 1..20: mol_type = other DNA
ttttctgagacacagtctgg

SEQ ID NO: 24473 - DNA, 20 bp, synthetic construct
  misc_feature 1..20: note = CRISPR gRNA sequence
  source 1..20: mol_type = other DNA
tttctgagacacagtctggc

SEQ ID NO: 24474 - DNA, 20 bp, synthetic construct
  misc_feature 1..20: note = CRISPR gRNA sequence
  source 1..20: mol_type = other DNA
ttctgagacacagtctggct

SEQ ID NO: 24475 - DNA, 20 bp, synthetic construct
  misc_feature 1..20: note = CRISPR gRNA sequence
  source 1..20: mol_type = other DNA
tctgagacacagtctggctc

SEQ ID NO: 24476 - DNA, 20 bp, synthetic construct
  misc_feature 1..20: note = CRISPR gRNA sequence
  source 1..20: mol_type = other DNA
ctgagacacagtctggctct

SEQ ID NO: 24477 - DNA, 20 bp, synthetic construct
  misc_feature 1..20: note = CRISPR gRNA sequence
  source 1..20: mol_type = other DNA
tgagacacagtctggctcta

SEQ ID NO: 24478 - DNA, 20 bp, synthetic construct
  misc_feature 1..20: note = CRISPR gRNA sequence
  source 1..20: mol_type = other DNA
agacacagtctggctctatc

SEQ ID NO: 24479 - DNA, 20 bp, synthetic construct
  misc_feature 1..20: note = CRISPR gRNA sequence
  source 1..20: mol_type = other DNA
gctctatcacccaggctgga

SEQ ID NO: 24480 - DNA, 20 bp, synthetic construct
  misc_feature 1..20: note = CRISPR gRNA sequence
  source 1..20: mol_type = other DNA
tatcacccaggctggagtgc

SEQ ID NO: 24481 - DNA, 20 bp, synthetic construct
  misc_feature 1..20: note = CRISPR gRNA sequence
  source 1..20: mol_type = other DNA
tcacccaggctggagtgcag

SEQ ID NO: 24482 - DNA, 20 bp, synthetic construct
  misc_feature 1..20: note = CRISPR gRNA sequence
  source 1..20: mol_type = other DNA
gagtgcagtggtgcaatctc

SEQ ID NO: 24483 - DNA, 20 bp, synthetic construct
  misc_feature 1..20: note = CRISPR gRNA sequence
  source 1..20: mol_type = other DNA
agttcactgcagccttgaca

SEQ ID NO: 24484 - DNA, 20 bp, synthetic construct
  misc_feature 1..20: note = CRISPR gRNA sequence
  source 1..20: mol_type = other DNA
actgcagccttgacacctcc

SEQ ID NO: 24485 - DNA, 20 bp, synthetic construct
  misc_feature 1..20: note = CRISPR gRNA sequence
  source 1..20: mol_type = other DNA
cagccttgacacctccccag

SEQ ID NO: 24486 - DNA, 20 bp, synthetic construct
  misc_feature 1..20: note = CRISPR gRNA sequence
  source 1..20: mol_type = other DNA
gacacctccccaggctcaag

SEQ ID NO: 24487 - DNA, 20 bp, synthetic construct
  misc_feature 1..20: note = CRISPR gRNA sequence
  source 1..20: mol_type = other DNA
acacctccccaggctcaagc

SEQ ID NO: 24488 - DNA, 20 bp, synthetic construct
  misc_feature 1..20: note = CRISPR gRNA sequence
  source 1..20: mol_type = other DNA
cccaggctcaagctatcctc

SEQ ID NO: 24489 - DNA, 20 bp, synthetic construct
  misc_feature 1..20: note = CRISPR gRNA sequence
  source 1..20: mol_type = other DNA
aagctatcctcccacctcag

SEQ ID NO: 24490 - DNA, 20 bp, synthetic construct
  misc_feature 1..20: note = CRISPR gRNA sequence
  source 1..20: mol_type = other DNA
tcctcccacctcagcctcct

SEQ ID NO: 24491 - DNA, 20 bp, synthetic construct
  misc_feature 1..20: note = CRISPR gRNA sequence
  source 1..20: mol_type = other DNA
ccacctcagcctcctgagta

SEQ ID NO: 24492 - DNA, 20 bp, synthetic construct
  misc_feature 1..20: note = CRISPR gRNA sequence
  source 1..20: mol_type = other DNA
agcctcctgagtagctggtt

SEQ ID NO: 24493 - DNA, 20 bp, synthetic construct
  misc_feature 1..20: note = CRISPR gRNA sequence
  source 1..20: mol_type = other DNA
ctgagtagctggttctacag

SEQ ID NO: 24494 - DNA, 20 bp, synthetic construct
  misc_feature 1..20: note = CRISPR gRNA sequence
  source 1..20: mol_type = other DNA
agtagctggttctacagatg

SEQ ID NO: 24495 - DNA, 20 bp, synthetic construct
  misc_feature 1..20: note = CRISPR gRNA sequence
  source 1..20: mol_type = other DNA
gttctacagatgcacatcac

SEQ ID NO: 24496 - DNA, 20 bp, synthetic construct
  misc_feature 1..20: note = CRISPR gRNA sequence
  source 1..20: mol_type = other DNA
tacagatgcacatcaccacg

SEQ ID NO: 24497 - DNA, 20 bp, synthetic construct
  misc_feature 1..20: note = CRISPR gRNA sequence
  source 1..20: mol_type = other DNA
cagatgcacatcaccacgcc

SEQ ID NO: 24498 - DNA, 20 bp, synthetic construct
  misc_feature 1..20: note = CRISPR gRNA sequence
  source 1..20: mol_type = other DNA
agttttgtgttatttgtaga

SEQ ID NO: 24499 - DNA, 20 bp, synthetic construct
  misc_feature 1..20: note = CRISPR gRNA sequence
  source 1..20: mol_type = other DNA
tgtgttatttgtagagatag

SEQ ID NO: 24500 - DNA, 20 bp, synthetic construct
  misc_feature 1..20: note = CRISPR gRNA sequence
  source 1..20: mol_type = other DNA
gtgttatttgtagagatagg

SEQ ID NO: 24501 - DNA, 20 bp, synthetic construct
  misc_feature 1..20: note = CRISPR gRNA sequence
  source 1..20: mol_type = other DNA
tgttatttgtagagataggg

SEQ ID NO: 24502 - DNA, 20 bp, synthetic construct
  misc_feature 1..20: note = CRISPR gRNA sequence
  source 1..20: mol_type = other DNA
tttgtagagatagggcttca

SEQ ID NO: 24503 - DNA, 20 bp, synthetic construct
  misc_feature 1..20: note = CRISPR gRNA sequence
  source 1..20: mol_type = other DNA
gtagagatagggcttcacca

SEQ ID NO: 24504 - DNA, 20 bp, synthetic construct
  misc_feature 1..20: note = CRISPR gRNA sequence
  source 1..20: mol_type = other DNA
tagagatagggcttcaccat

SEQ ID NO: 24505 - DNA, 20 bp, synthetic construct
  misc_feature 1..20: note = CRISPR gRNA sequence
  source 1..20: mol_type = other DNA
caccatgttgcccaggctgg

SEQ ID NO: 24506 - DNA, 20 bp, synthetic construct
  misc_feature 1..20: note = CRISPR gRNA sequence
  source 1..20: mol_type = other DNA
accatgttgcccaggctggt

SEQ ID NO: 24507 - DNA, 20 bp, synthetic construct
  misc_feature 1..20: note = CRISPR gRNA sequence
  source 1..20: mol_type = other DNA
cccaggctggtctcaaactc

SEQ ID NO: 24508 - DNA, 20 bp, synthetic construct
  misc_feature 1..20: note = CRISPR gRNA sequence
  source 1..20: mol_type = other DNA
gtctcaaactcctggactga

SEQ ID NO: 24509 - DNA, 20 bp, synthetic construct
  misc_feature 1..20: note = CRISPR gRNA sequence
  source 1..20: mol_type = other DNA
aaactcctggactgaggtga

SEQ ID NO: 24510 - DNA, 20 bp, synthetic construct
  misc_feature 1..20: note = CRISPR gRNA sequence
  source 1..20: mol_type = other DNA
ctggactgaggtgatactcc

SEQ ID NO: 24511 - DNA, 20 bp, synthetic construct
  misc_feature 1..20: note = CRISPR gRNA sequence
  source 1..20: mol_type = other DNA
gactgaggtgatactcctgc

SEQ ID NO: 24512 - DNA, 20 bp, synthetic construct
  misc_feature 1..20: note = CRISPR gRNA sequence
  source 1..20: mol_type = other DNA
aggtgatactcctgccttgg

SEQ ID NO: 24513 - DNA, 20 bp, synthetic construct
  misc_feature 1..20: note = CRISPR gRNA sequence
  source 1..20: mol_type = other DNA
ctgccttggactcccaaagt

SEQ ID NO: 24514 - DNA, 20 bp, synthetic construct
  misc_feature 1..20: note = CRISPR gRNA sequence
  source 1..20: mol_type = other DNA
ccttggactcccaaagtgct

SEQ ID NO: 24515 - DNA, 20 bp, synthetic construct
  misc_feature 1..20: note = CRISPR gRNA sequence
  source 1..20: mol_type = other DNA
ggactcccaaagtgctggaa

SEQ ID NO: 24516 - DNA, 20 bp, synthetic construct
  misc_feature 1..20: note = CRISPR gRNA sequence
  source 1..20: mol_type = other DNA
gactcccaaagtgctggaat

SEQ ID NO: 24517 - DNA, 20 bp, synthetic construct
  misc_feature 1..20: note = CRISPR gRNA sequence
  source 1..20: mol_type = other DNA
ccaaagtgctggaatttcta

SEQ ID NO: 24518 - DNA, 20 bp, synthetic construct
  misc_feature 1..20: note = CRISPR gRNA sequence
  source 1..20: mol_type = other DNA
gaatttctacagatgtgagc

SEQ ID NO: 24519 - DNA, 20 bp, synthetic construct
  misc_feature 1..20: note = CRISPR gRNA sequence
  source 1..20: mol_type = other DNA
ctacagatgtgagccaccat

SEQ ID NO: 24520 - DNA, 20 bp, synthetic construct
  misc_feature 1..20: note = CRISPR gRNA sequence
  source 1..20: mol_type = other DNA
tacagatgtgagccaccatg

SEQ ID NO: 24521 - DNA, 20 bp, synthetic construct
  misc_feature 1..20: note = CRISPR gRNA sequence
  source 1..20: mol_type = other DNA
cagatgtgagccaccatgcc

SEQ ID NO: 24522 - DNA, 20 bp, synthetic construct
  misc_feature 1..20: note = CRISPR gRNA sequence
  source 1..20: mol_type = other DNA
tggggcccttcttgttccta

SEQ ID NO: 24523 - DNA, 20 bp, synthetic construct
  misc_feature 1..20: note = CRISPR gRNA sequence
  source 1..20: mol_type = other DNA
cttgttcctatgaagtctgc

SEQ ID NO: 24524 - DNA, 20 bp, synthetic construct
  misc_feature 1..20: note = CRISPR gRNA sequence
  source 1..20: mol_type = other DNA
ttgttcctatgaagtctgca

SEQ ID NO: 24525 - DNA, 20 bp, synthetic construct
  misc_feature 1..20: note = CRISPR gRNA sequence
  source 1..20: mol_type = other DNA
gttcctatgaagtctgcagg

SEQ ID NO: 24526 - DNA, 20 bp, synthetic construct
  misc_feature 1..20: note = CRISPR gRNA sequence
  source 1..20: mol_type = other DNA
ttcctatgaagtctgcaggg

SEQ ID NO: 24527 - DNA, 20 bp, synthetic construct
  misc_feature 1..20: note = CRISPR gRNA sequence
  source 1..20: mol_type = other DNA
ctatgaagtctgcagggtcc

SEQ ID NO: 24528 - DNA, 20 bp, synthetic construct
  misc_feature 1..20: note = CRISPR gRNA sequence
  source 1..20: mol_type = other DNA
tgaagtctgcagggtcccct

SEQ ID NO: 24529 - DNA, 20 bp, synthetic construct
  misc_feature 1..20: note = CRISPR gRNA sequence
  source 1..20: mol_type = other DNA
cagggtccccttatgcaaaa

SEQ ID NO: 24530 - DNA, 20 bp, synthetic construct
  misc_feature 1..20: note = CRISPR gRNA sequence
  source 1..20: mol_type = other DNA
atgcaaaagaacagaaagct

SEQ ID NO: 24531 - DNA, 20 bp, synthetic construct
  misc_feature 1..20: note = CRISPR gRNA sequence
  source 1..20: mol_type = other DNA
tgcaaaagaacagaaagctc

SEQ ID NO: 24532 - DNA, 20 bp, synthetic construct
  misc_feature 1..20: note = CRISPR gRNA sequence
  source 1..20: mol_type = other DNA
ggcttcacaaagtttgacct

SEQ ID NO: 24533 - DNA, 20 bp, synthetic construct
  misc_feature 1..20: note = CRISPR gRNA sequence
  source 1..20: mol_type = other DNA
cacaaagtttgacctcggaa

SEQ ID NO: 24534 - DNA, 20 bp, synthetic construct
  misc_feature 1..20: note = CRISPR gRNA sequence
  source 1..20: mol_type = other DNA
acaaagtttgacctcggaag

SEQ ID NO: 24535 - DNA, 20 bp, synthetic construct
  misc_feature 1..20: note = CRISPR gRNA sequence
  source 1..20: mol_type = other DNA
gacctcggaagaaatggaag

SEQ ID NO: 24536 - DNA, 20 bp, synthetic construct
  misc_feature 1..20: note = CRISPR gRNA sequence
  source 1..20: mol_type = other DNA
acctcggaagaaatggaagg

SEQ ID NO: 24537 - DNA, 20 bp, synthetic construct
  misc_feature 1..20: note = CRISPR gRNA sequence
  source 1..20: mol_type = other DNA
ggaagaaatggaagggaaag

SEQ ID NO: 24538 - DNA, 20 bp, synthetic construct
  misc_feature 1..20: note = CRISPR gRNA sequence
  source 1..20: mol_type = other DNA
tgtcactctcacaaacgtaa

SEQ ID NO: 24539 - DNA, 20 bp, synthetic construct
  misc_feature 1..20: note = CRISPR gRNA sequence
  source 1..20: mol_type = other DNA
gtcactctcacaaacgtaag

SEQ ID NO: 24540 - DNA, 20 bp, synthetic construct
  misc_feature 1..20: note = CRISPR gRNA sequence
  source 1..20: mol_type = other DNA
tcactctcacaaacgtaaga

SEQ ID NO: 24541 - DNA, 20 bp, synthetic construct
  misc_feature 1..20: note = CRISPR gRNA sequence
  source 1..20: mol_type = other DNA
tcacaaacgtaagaagcaaa

SEQ ID NO: 24542 - DNA, 20 bp, synthetic construct
  misc_feature 1..20: note = CRISPR gRNA sequence
  source 1..20: mol_type = other DNA
acaaacgtaagaagcaaact

SEQ ID NO: 24543 - DNA, 20 bp, synthetic construct
  misc_feature 1..20: note = CRISPR gRNA sequence
  source 1..20: mol_type = other DNA
ataatgatggccatcacaca

SEQ ID NO: 24544 - DNA, 20 bp, synthetic construct
  misc_feature 1..20: note = CRISPR gRNA sequence
  source 1..20: mol_type = other DNA
tactcaccatgtagaagctg

SEQ ID NO: 24545 - DNA, 20 bp, synthetic construct
  misc_feature 1..20: note = CRISPR gRNA sequence
  source 1..20: mol_type = other DNA
accatgtagaagctgtgctg

SEQ ID NO: 24546 - DNA, 20 bp, synthetic construct
  misc_feature 1..20: note = CRISPR gRNA sequence
  source 1..20: mol_type = other DNA
tgctgccttaaacttctgtt

SEQ ID NO: 24547 - DNA, 20 bp, synthetic construct
  misc_feature 1..20: note = CRISPR gRNA sequence
  source 1..20: mol_type = other DNA
ccttaaacttctgttcattc

SEQ ID NO: 24548 - DNA, 20 bp, synthetic construct
  misc_feature 1..20: note = CRISPR gRNA sequence
  source 1..20: mol_type = other DNA
aaacttctgttcattcagca

SEQ ID NO: 24549 - DNA, 20 bp, synthetic construct
  misc_feature 1..20: note = CRISPR gRNA sequence
  source 1..20: mol_type = other DNA
aacttctgttcattcagcac

SEQ ID NO: 24550 - DNA, 20 bp, synthetic construct
  misc_feature 1..20: note = CRISPR gRNA sequence
  source 1..20: mol_type = other DNA
ctgttcattcagcacttact

SEQ ID NO: 24551 - DNA, 20 bp, synthetic construct
  misc_feature 1..20: note = CRISPR gRNA sequence
  source 1..20: mol_type = other DNA
tgttcattcagcacttactg

SEQ ID NO: 24552 - DNA, 20 bp, synthetic construct
  misc_feature 1..20: note = CRISPR gRNA sequence
  source 1..20: mol_type = other DNA
ttcattcagcacttactgat

SEQ ID NO: 24553 - DNA, 20 bp, synthetic construct
  misc_feature 1..20: note = CRISPR gRNA sequence
  source 1..20: mol_type = other DNA
attcagcacttactgattgc

SEQ ID NO: 24554 - DNA, 20 bp, synthetic construct
  misc_feature 1..20: note = CRISPR gRNA sequence
  source 1..20: mol_type = other DNA
agcacttactgattgccagt

SEQ ID NO: 24555 - DNA, 20 bp, synthetic construct
  misc_feature 1..20: note = CRISPR gRNA sequence
  source 1..20: mol_type = other DNA
actgattgccagtcccattg

SEQ ID NO: 24556 - DNA, 20 bp, synthetic construct
  misc_feature 1..20: note = CRISPR gRNA sequence
  source 1..20: mol_type = other DNA
ctgattgccagtcccattgc

SEQ ID NO: 24557 - DNA, 20 bp, synthetic construct
  misc_feature 1..20: note = CRISPR gRNA sequence
  source 1..20: mol_type = other DNA
attgccagtcccattgctaa

SEQ ID NO: 24558 - DNA, 20 bp, synthetic construct
  misc_feature 1..20: note = CRISPR gRNA sequence
  source 1..20: mol_type = other DNA
ccagtcccattgctaagggc

SEQ ID NO: 24559 - DNA, 20 bp, synthetic construct
  misc_feature 1..20: note = CRISPR gRNA sequence
  source 1..20: mol_type = other DNA
ctaagggctccgcgtgactt

SEQ ID NO: 24560 - DNA, 20 bp, synthetic construct
  misc_feature 1..20: note = CRISPR gRNA sequence
  source 1..20: mol_type = other DNA
agggctccgcgtgacttaac

SEQ ID NO: 24561 - DNA, 20 bp, synthetic construct
  misc_feature 1..20: note = CRISPR gRNA sequence
  source 1..20: mol_type = other DNA
cgcgtgacttaactccccta

SEQ ID NO: 24562 - DNA, 20 bp, synthetic construct
  misc_feature 1..20: note = CRISPR gRNA sequence
  source 1..20: mol_type = other DNA
aactcccctaatccttgtga

SEQ ID NO: 24563 - DNA, 20 bp, synthetic construct
  misc_feature 1..20: note = CRISPR gRNA sequence
  source 1..20: mol_type = other DNA
actcccctaatccttgtgag

SEQ ID NO: 24564 - DNA, 20 bp, synthetic construct
  misc_feature 1..20: note = CRISPR gRNA sequence
  source 1..20: mol_type = other DNA
ccctaatccttgtgagttgc

SEQ ID NO: 24565 - DNA, 20 bp, synthetic construct
  misc_feature 1..20: note = CRISPR gRNA sequence
  source 1..20: mol_type = other DNA
atccttgtgagttgccaatt

SEQ ID NO: 24566 - DNA, 20 bp, synthetic construct
  misc_feature 1..20: note = CRISPR gRNA sequence
  source 1..20: mol_type = other DNA
gtgagttgccaattattatt

SEQ ID NO: 24567 - DNA, 20 bp, synthetic construct
  misc_feature 1..20: note = CRISPR gRNA sequence
  source 1..20: mol_type = other DNA
tgagttgccaattattattc

SEQ ID NO: 24568 - DNA, 20 bp, synthetic construct
  misc_feature 1..20: note = CRISPR gRNA sequence
  source 1..20: mol_type = other DNA
ccaattattattcgcatttt

SEQ ID NO: 24569 - DNA, 20 bp, synthetic construct
  misc_feature 1..20: note = CRISPR gRNA sequence
  source 1..20: mol_type = other DNA
ttattcgcattttatagata

SEQ ID NO: 24570 - DNA, 20 bp, synthetic construct
  misc_feature 1..20: note = CRISPR gRNA sequence
  source 1..20: mol_type = other DNA
ttcgcattttatagatatgg

SEQ ID NO: 24571 - DNA, 20 bp, synthetic construct
  misc_feature 1..20: note = CRISPR gRNA sequence
  source 1..20: mol_type = other DNA
gcattttatagatatggaaa

SEQ ID NO: 24572 - DNA, 20 bp, synthetic construct
  misc_feature 1..20: note = CRISPR gRNA sequence
  source 1..20: mol_type = other DNA
tatagatatggaaactgagg

SEQ ID NO: 24573 - DNA, 20 bp, synthetic construct
  misc_feature 1..20: note = CRISPR gRNA sequence
  source 1..20: mol_type = other DNA
atagatatggaaactgaggc

SEQ ID NO: 24574 - DNA, 20 bp, synthetic construct
  misc_feature 1..20: note = CRISPR gRNA sequence
  source 1..20: mol_type = other DNA
tagatatggaaactgaggct

SEQ ID NO: 24575 - DNA, 20 bp, synthetic construct
  misc_feature 1..20: note = CRISPR gRNA sequence
  source 1..20: mol_type = other DNA
aggctccaagtggtttaaaa

SEQ ID NO: 24576 - DNA, 20 bp, synthetic construct
  misc_feature 1..20: note = CRISPR gRNA sequence
  source 1..20: mol_type = other DNA
caagtggtttaaaaaatgaa

SEQ ID NO: 24577 - DNA, 20 bp, synthetic construct
  misc_feature 1..20: note = CRISPR gRNA sequence
  source 1..20: mol_type = other DNA
aaaaaatgaacttgcccagg

SEQ ID NO: 24578 - DNA, 20 bp, synthetic construct
  misc_feature 1..20: note = CRISPR gRNA sequence
  source 1..20: mol_type = other DNA
aaaaatgaacttgcccaggt

SEQ ID NO: 24579 - DNA, 20 bp, synthetic construct
  misc_feature 1..20: note = CRISPR gRNA sequence
  source 1..20: mol_type = other DNA
gcccaggttacagtgtgttg

SEQ ID NO: 24580 - DNA, 20 bp, synthetic construct
  misc_feature 1..20: note = CRISPR gRNA sequence
  source 1..20: mol_type = other DNA
cccaggttacagtgtgttgg

SEQ ID NO: 24581 - DNA, 20 bp, synthetic construct
  misc_feature 1..20: note = CRISPR gRNA sequence
  source 1..20: mol_type = other DNA
cagtgtgttggtaggtaggg

SEQ ID NO: 24582 - DNA, 20 bp, synthetic construct
  misc_feature 1..20: note = CRISPR gRNA sequence
  source 1..20: mol_type = other DNA
gtaggtaggggtagtctcaa

SEQ ID NO: 24583 - DNA, 20 bp, synthetic construct
  misc_feature 1..20: note = CRISPR gRNA sequence
  source 1..20: mol_type = other DNA
aaagttggtaaattttacgc

SEQ ID NO: 24584 - DNA, 20 bp, synthetic construct
  misc_feature 1..20: note = CRISPR gRNA sequence
  source 1..20: mol_type = other DNA
gtaaattttacgccaaagct

SEQ ID NO: 24585 - DNA, 20 bp, synthetic construct
  misc_feature 1..20: note = CRISPR gRNA sequence
  source 1..20: mol_type = other DNA
tacgccaaagctcacgatac

SEQ ID NO: 24586 - DNA, 20 bp, synthetic construct
  misc_feature 1..20: note = CRISPR gRNA sequence
  source 1..20: mol_type = other DNA
acgccaaagctcacgatact

SEQ ID NO: 24587 - DNA, 20 bp, synthetic construct
  misc_feature 1..20: note = CRISPR gRNA sequence
  source 1..20: mol_type = other DNA
cgccaaagctcacgatactt

SEQ ID NO: 24588 - DNA, 20 bp, synthetic construct
  misc_feature 1..20: note = CRISPR gRNA sequence
  source 1..20: mol_type = other DNA
acgatacttgccttctttcc

SEQ ID NO: 24589 - DNA, 20 bp, synthetic construct
  misc_feature 1..20: note = CRISPR gRNA sequence
  source 1..20: mol_type = other DNA
gccttctttcccttctcaat

SEQ ID NO: 24590 - DNA, 20 bp, synthetic construct
  misc_feature 1..20: note = CRISPR gRNA sequence
  source 1..20: mol_type = other DNA
ccttctttcccttctcaatt

SEQ ID NO: 24591 - DNA, 20 bp, synthetic construct
  misc_feature 1..20: note = CRISPR gRNA sequence
  source 1..20: mol_type = other DNA
ctttcccttctcaatttatt

SEQ ID NO: 24592 - DNA, 20 bp, synthetic construct
  misc_feature 1..20: note = CRISPR gRNA sequence
  source 1..20: mol_type = other DNA
tttcccttctcaatttattt

SEQ ID NO: 24593 - DNA, 20 bp, synthetic construct
  misc_feature 1..20: note = CRISPR gRNA sequence
  source 1..20: mol_type = other DNA
tcccttctcaatttatttct

SEQ ID NO: 24594 - DNA, 20 bp, synthetic construct
  misc_feature 1..20: note = CRISPR gRNA sequence
  source 1..20: mol_type = other DNA
cccttctcaatttatttctc

SEQ ID NO: 24595 - DNA, 20 bp, synthetic construct
  misc_feature 1..20: note = CRISPR gRNA sequence
  source 1..20: mol_type = other DNA
ccttctcaatttatttctct

SEQ ID NO: 24596 - DNA, 20 bp, synthetic construct
  misc_feature 1..20: note = CRISPR gRNA sequence
  source 1..20: mol_type = other DNA
ctcaatttatttctctgact

SEQ ID NO: 24597 - DNA, 20 bp, synthetic construct
  misc_feature 1..20: note = CRISPR gRNA sequence
  source 1..20: mol_type = other DNA
tcaatttatttctctgactg

SEQ ID NO: 24598 - DNA, 20 bp, synthetic construct
  misc_feature 1..20: note = CRISPR gRNA sequence
  source 1..20: mol_type = other DNA
aatttatttctctgactgtg

SEQ ID NO: 24599 - DNA, 20 bp, synthetic construct
  misc_feature 1..20: note = CRISPR gRNA sequence
  source 1..20: mol_type = other DNA
atttctctgactgtgtgctt

SEQ ID NO: 24600 - DNA, 20 bp, synthetic construct
  misc_feature 1..20: note = CRISPR gRNA sequence
  source 1..20: mol_type = other DNA
tttctctgactgtgtgctta

SEQ ID NO: 24601 - DNA, 20 bp, synthetic construct
  misc_feature 1..20: note = CRISPR gRNA sequence
  source 1..20: mol_type = other DNA
ctctgactgtgtgcttaacc

SEQ ID NO: 24602 - DNA, 20 bp, synthetic construct
  misc_feature 1..20: note = CRISPR gRNA sequence
  source 1..20: mol_type = other DNA
tctgactgtgtgcttaacca

SEQ ID NO: 24603 - DNA, 20 bp, synthetic construct
  misc_feature 1..20: note = CRISPR gRNA sequence
  source 1..20: mol_type = other DNA
tgactgtgtgcttaaccaca

SEQ ID NO: 24604 - DNA, 20 bp, synthetic construct
  misc_feature 1..20: note = CRISPR gRNA sequence
  source 1..20: mol_type = other DNA
actgtgtgcttaaccacaca

SEQ ID NO: 24605 - DNA, 20 bp, synthetic construct
  misc_feature 1..20: note = CRISPR gRNA sequence
  source 1..20: mol_type = other DNA
tgtgcttaaccacacagcag

SEQ ID NO: 24606 - DNA, 20 bp, synthetic construct
  misc_feature 1..20: note = CRISPR gRNA sequence
  source 1..20: mol_type = other DNA
aaccacacagcagtgtcatc

SEQ ID NO: 24607 - DNA, 20 bp, synthetic construct
  misc_feature 1..20: note = CRISPR gRNA sequence
  source 1..20: mol_type = other DNA
accacacagcagtgtcatcc

SEQ ID NO: 24608 - DNA, 20 bp, synthetic construct
  misc_feature 1..20: note = CRISPR gRNA sequence
  source 1..20: mol_type = other DNA
gaagcagagctcatcaataa

SEQ ID NO: 24609 - DNA, 20 bp, synthetic construct
  misc_feature 1..20: note = CRISPR gRNA sequence
  source 1..20: mol_type = other DNA
aagcagagctcatcaataag

SEQ ID NO: 24610 - DNA, 20 bp, synthetic construct
  misc_feature 1..20: note = CRISPR gRNA sequence
  source 1..20: mol_type = other DNA
atcaataagtgggggtgggc

SEQ ID NO: 24611 - DNA, 20 bp, synthetic construct
  misc_feature 1..20: note = CRISPR gRNA sequence
  source 1..20: mol_type = other DNA
aatgtctccaggctcctccc

SEQ ID NO: 24612 - DNA, 20 bp, synthetic construct
  misc_feature 1..20: note = CRISPR gRNA sequence
  source 1..20: mol_type = other DNA
caggctcctccctgcggtcc

SEQ ID NO: 24613 - DNA, 20 bp, synthetic construct
  misc_feature 1..20: note = CRISPR gRNA sequence
  source 1..20: mol_type = other DNA
ctccctgcggtccctcccac

SEQ ID NO: 24614 - DNA, 20 bp, synthetic construct
  misc_feature 1..20: note = CRISPR gRNA sequence
  source 1..20: mol_type = other DNA
cctgcggtccctcccaccat

SEQ ID NO: 24615 - DNA, 20 bp, synthetic construct
  misc_feature 1..20: note = CRISPR gRNA sequence
  source 1..20: mol_type = other DNA
cggtccctcccaccatcccc

SEQ ID NO: 24616 - DNA, 20 bp, synthetic construct
  misc_feature 1..20: note = CRISPR gRNA sequence
  source 1..20: mol_type = other DNA
ccaccatcccccatctgtga

SEQ ID NO: 24617 - DNA, 20 bp, synthetic construct
  misc_feature 1..20: note = CRISPR gRNA sequence
  source 1..20: mol_type = other DNA
tgataccacctgtgtctcta

SEQ ID NO: 24618 - DNA, 20 bp, synthetic construct
  misc_feature 1..20: note = CRISPR gRNA sequence
  source 1..20: mol_type = other DNA
tgtctctatgcttgagccca

SEQ ID NO: 24619 - DNA, 20 bp, synthetic construct
  misc_feature 1..20: note = CRISPR gRNA sequence
  source 1..20: mol_type = other DNA
tatgcttgagcccagacagg

SEQ ID NO: 24620 - DNA, 20 bp, synthetic construct
  misc_feature 1..20: note = CRISPR gRNA sequence
  source 1..20: mol_type = other DNA
tgcttgagcccagacaggac

SEQ ID NO: 24621 - DNA, 20 bp, synthetic construct
  misc_feature 1..20: note = CRISPR gRNA sequence
  source 1..20: mol_type = other DNA
gagcccagacaggacaaggg

SEQ ID NO: 24622 - DNA, 20 bp, synthetic construct
  misc_feature 1..20: note = CRISPR gRNA sequence
  source 1..20: mol_type = other DNA
agcccagacaggacaagggt

SEQ ID NO: 24623 - DNA, 20 bp, synthetic construct
  misc_feature 1..20: note = CRISPR gRNA sequence
  source 1..20: mol_type = other DNA
cattgggaacattttgactg

SEQ ID NO: 24624 - DNA, 20 bp, synthetic construct
  misc_feature 1..20: note = CRISPR gRNA sequence
  source 1..20: mol_type = other DNA
attgggaacattttgactgg

SEQ ID NO: 24625 - DNA, 20 bp, synthetic construct
  misc_feature 1..20: note = CRISPR gRNA sequence
  source 1..20: mol_type = other DNA
ggaacattttgactgggggg

SEQ ID NO: 24626 - DNA, 20 bp, synthetic construct
  misc_feature 1..20: note = CRISPR gRNA sequence
  source 1..20: mol_type = other DNA
tgactggggggaaagagcac

SEQ ID NO: 24627 - DNA, 20 bp, synthetic construct
  misc_feature 1..20: note = CRISPR gRNA sequence
  source 1..20: mol_type = other DNA
gactggggggaaagagcacc

SEQ ID NO: 24628 - DNA, 20 bp, synthetic construct
  misc_feature 1..20: note = CRISPR gRNA sequence
  source 1..20: mol_type = other DNA
actggggggaaagagcacca

SEQ ID NO: 24629 - DNA, 20 bp, synthetic construct
  misc_feature 1..20: note = CRISPR gRNA sequence
  source 1..20: mol_type = other DNA
gggggaaagagcaccagcct

SEQ ID NO: 24630 - DNA, 20 bp, synthetic construct
  misc_feature 1..20: note = CRISPR gRNA sequence
  source 1..20: mol_type = other DNA
ggagtcttggcagggggagt

SEQ ID NO: 24631 - DNA, 20 bp, synthetic construct
  misc_feature 1..20: note = CRISPR gRNA sequence
  source 1..20: mol_type = other DNA
ggcagggggagtgggggaga

SEQ ID NO: 24632 - DNA, 20 bp, synthetic construct
  misc_feature 1..20: note = CRISPR gRNA sequence
  source 1..20: mol_type = other DNA
gcagggggagtgggggagaa

SEQ ID NO: 24633 - DNA, 20 bp, synthetic construct
  misc_feature 1..20: note = CRISPR gRNA sequence
  source 1..20: mol_type = other DNA
tgaggtcttgtgcaagtcac

SEQ ID NO: 24634 - DNA, 20 bp, synthetic construct
  misc_feature 1..20: note = CRISPR gRNA sequence
  source 1..20: mol_type = other DNA
gtgcaagtcacgtccttccc

SEQ ID NO: 24635 - DNA, 20 bp, synthetic construct
  misc_feature 1..20: note = CRISPR gRNA sequence
  source 1..20: mol_type = other DNA
tgcaagtcacgtccttcccg

SEQ ID NO: 24636 - DNA, 20 bp, synthetic construct
  misc_feature 1..20: note = CRISPR gRNA sequence
  source 1..20: mol_type = other DNA
cccggggtctcagtcttgtc

SEQ ID NO: 24637 - DNA, 20 bp, synthetic construct
  misc_feature 1..20: note = CRISPR gRNA sequence
  source 1..20: mol_type = other DNA
ccggggtctcagtcttgtca

SEQ ID NO: 24638 - DNA, 20 bp, synthetic construct
  misc_feature 1..20: note = CRISPR gRNA sequence
  source 1..20: mol_type = other DNA
agtcttgtcatctgcagagt

SEQ ID NO: 24639 - DNA, 20 bp, synthetic construct
  misc_feature 1..20: note = CRISPR gRNA sequence
  source 1..20: mol_type = other DNA
gtcatctgcagagtgaagga

SEQ ID NO: 24640 - DNA, 20 bp, synthetic construct
  misc_feature 1..20: note = CRISPR gRNA sequence
  source 1..20: mol_type = other DNA
tcatctgcagagtgaaggaa

SEQ ID NO: 24641 - DNA, 20 bp, synthetic construct
  misc_feature 1..20: note = CRISPR gRNA sequence
  source 1..20: mol_type = other DNA
cagagtgaaggaaagaggtc

SEQ ID NO: 24642 - DNA, 20 bp, synthetic construct
  misc_feature 1..20: note = CRISPR gRNA sequence
  source 1..20: mol_type = other DNA
gaaggtccctggcagaccca

SEQ ID NO: 24643 - DNA, 20 bp, synthetic construct
  misc_feature 1..20: note = CRISPR gRNA sequence
  source 1..20: mol_type = other DNA
aaggtccctggcagacccaa

SEQ ID NO: 24644 - DNA, 20 bp, synthetic construct
  misc_feature 1..20: note = CRISPR gRNA sequence
  source 1..20: mol_type = other DNA
gcagacccaatgccctgtga

SEQ ID NO: 24645 - DNA, 20 bp, synthetic construct
  misc_feature 1..20: note = CRISPR gRNA sequence
  source 1..20: mol_type = other DNA
tgagaaaactgagtttgggt

SEQ ID NO: 24646 - DNA, 20 bp, synthetic construct
  misc_feature 1..20: note = CRISPR gRNA sequence
  source 1..20: mol_type = other DNA
agtttgggtaacttattatt

SEQ ID NO: 24647 - DNA, 20 bp, synthetic construct
  misc_feature 1..20: note = CRISPR gRNA sequence
  source 1..20: mol_type = other DNA
gggtaacttattattttata

SEQ ID NO: 24648 - DNA, 20 bp, synthetic construct
  misc_feature 1..20: note = CRISPR gRNA sequence
  source 1..20: mol_type = other DNA
ggtaacttattattttatag

SEQ ID NO: 24649 - DNA, 20 bp, synthetic construct
  misc_feature 1..20: note = CRISPR gRNA sequence
  source 1..20: mol_type = other DNA
attattttatagatatggaa

SEQ ID NO: 24650 - DNA, 20 bp, synthetic construct
  misc_feature 1..20: note = CRISPR gRNA sequence
  source 1..20: mol_type = other DNA
ttattttatagatatggaat

SEQ ID NO: 24651 - DNA, 20 bp, synthetic construct
  misc_feature 1..20: note = CRISPR gRNA sequence
  source 1..20: mol_type = other DNA
ttttatagatatggaattat

SEQ ID NO: 24652 - DNA, 20 bp, synthetic construct
  misc_feature 1..20: note = CRISPR gRNA sequence
  source 1..20: mol_type = other DNA
tatagatatggaattatctt

SEQ ID NO: 24653 - DNA, 20 bp, synthetic construct
  misc_feature 1..20: note = CRISPR gRNA sequence
  source 1..20: mol_type = other DNA
atagatatggaattatctta

SEQ ID NO: 24654 - DNA, 20 bp, synthetic construct
  misc_feature 1..20: note = CRISPR gRNA sequence
  source 1..20: mol_type = other DNA
tagatatggaattatcttat

SEQ ID NO: 24655 - DNA, 20 bp, synthetic construct
  misc_feature 1..20: note = CRISPR gRNA sequence
  source 1..20: mol_type = other DNA
tcttatagaaatgttataga

SEQ ID NO: 24656 - DNA, 20 bp, synthetic construct
  misc_feature 1..20: note = CRISPR gRNA sequence
  source 1..20: mol_type = other DNA
atagaaatgttatagatatg

SEQ ID NO: 24657 - DNA, 20 bp, synthetic construct
  misc_feature 1..20: note = CRISPR gRNA sequence
  source 1..20: mol_type = other DNA
tagaaatgttatagatatgg

SEQ ID NO: 24658 - DNA, 20 bp, synthetic construct
  misc_feature 1..20: note = CRISPR gRNA sequence
  source 1..20: mol_type = other DNA
tagatatggaatcattttat

SEQ ID NO: 24659 - DNA, 20 bp, synthetic construct
  misc_feature 1..20: note = CRISPR gRNA sequence
  source 1..20: mol_type = other DNA
tatagatatggcccaaagtc

SEQ ID NO: 24660 - DNA, 20 bp, synthetic construct
  misc_feature 1..20: note = CRISPR gRNA sequence
  source 1..20: mol_type = other DNA
atagatatggcccaaagtcc

SEQ ID NO: 24661 - DNA, 20 bp, synthetic construct
  misc_feature 1..20: note = CRISPR gRNA sequence
  source 1..20: mol_type = other DNA
tagatatggcccaaagtcca

SEQ ID NO: 24662 - DNA, 20 bp, synthetic construct
  misc_feature 1..20: note = CRISPR gRNA sequence
  source 1..20: mol_type = other DNA
attcacggagttgctaggat

SEQ ID NO: 24663 - DNA, 20 bp, synthetic construct
  misc_feature 1..20: note = CRISPR gRNA sequence
  source 1..20: mol_type = other DNA
acggagttgctaggatcagt

SEQ ID NO: 24664 - DNA, 20 bp, synthetic construct
  misc_feature 1..20: note = CRISPR gRNA sequence
  source 1..20: mol_type = other DNA
ctaggatcagtctggagctc

SEQ ID NO: 24665 - DNA, 20 bp, synthetic construct
  misc_feature 1..20: note = CRISPR gRNA sequence
  source 1..20: mol_type = other DNA
ggatcagtctggagctcttg

SEQ ID NO: 24666 - DNA, 20 bp, synthetic construct
  misc_feature 1..20: note = CRISPR gRNA sequence
  source 1..20: mol_type = other DNA
gagctcttgtcacgagatca

SEQ ID NO: 24667 - DNA, 20 bp, synthetic construct
  misc_feature 1..20: note = CRISPR gRNA sequence
  source 1..20: mol_type = other DNA
ttgtcacgagatcacactgc

SEQ ID NO: 24668 - DNA, 20 bp, synthetic construct
  misc_feature 1..20: note = CRISPR gRNA sequence
  source 1..20: mol_type = other DNA
gtcacgagatcacactgcct

SEQ ID NO: 24669 - DNA, 20 bp, synthetic construct
  misc_feature 1..20: note = CRISPR gRNA sequence
  source 1..20: mol_type = other DNA
tcacgagatcacactgcctc

SEQ ID NO: 24670 - DNA, 20 bp, synthetic construct
  misc_feature 1..20: note = CRISPR gRNA sequence
  source 1..20: mol_type = other DNA
cctcaaagaggaggcagatt

SEQ ID NO: 24671 - DNA, 20 bp, synthetic construct
  misc_feature 1..20: note = CRISPR gRNA sequence
  source 1..20: mol_type = other DNA
aaagaggaggcagattgctg

SEQ ID NO: 24672 - DNA, 20 bp, synthetic construct
  misc_feature 1..20: note = CRISPR gRNA sequence
  source 1..20: mol_type = other DNA
ctgcaatgtaggttcttaat

SEQ ID NO: 24673 - DNA, 20 bp, synthetic construct
  misc_feature 1..20: note = CRISPR gRNA sequence
  source 1..20: mol_type = other DNA
caatgtaggttcttaataaa

SEQ ID NO: 24674 - DNA, 20 bp, synthetic construct
  misc_feature 1..20: note = CRISPR gRNA sequence
  source 1..20: mol_type = other DNA
ttaataaagagcatgggtgg

SEQ ID NO: 24675 - DNA, 20 bp, synthetic construct
  misc_feature 1..20: note = CRISPR gRNA sequence
  source 1..20: mol_type = other DNA
aataaagagcatgggtggaa

SEQ ID NO: 24676 - DNA, 20 bp, synthetic construct
  misc_feature 1..20: note = CRISPR gRNA sequence
  source 1..20: mol_type = other DNA
ataaagagcatgggtggaat

SEQ ID NO: 24677 - DNA, 20 bp, synthetic construct
  misc_feature 1..20: note = CRISPR gRNA sequence
  source 1..20: mol_type = other DNA
gggcaaaggtgtcttttctc

SEQ ID NO: 24678 - DNA, 20 bp, synthetic construct
  misc_feature 1..20: note = CRISPR gRNA sequence
  source 1..20: mol_type = other DNA
ttctcactgctctgagagaa

SEQ ID NO: 24679 - DNA, 20 bp, synthetic construct
  misc_feature 1..20: note = CRISPR gRNA sequence
  source 1..20: mol_type = other DNA
tctcactgctctgagagaac

SEQ ID NO: 24680 - DNA, 20 bp, synthetic construct
  misc_feature 1..20: note = CRISPR gRNA sequence
  source 1..20: mol_type = other DNA
ctcactgctctgagagaaca

SEQ ID NO: 24681 - DNA, 20 bp, synthetic construct
  misc_feature 1..20: note = CRISPR gRNA sequence
  source 1..20: mol_type = other DNA
tcactgctctgagagaacag

SEQ ID NO: 24682 - DNA, 20 bp, synthetic construct
  misc_feature 1..20: note = CRISPR gRNA sequence
  source 1..20: mol_type = other DNA
actgctctgagagaacagat

SEQ ID NO: 24683 - DNA, 20 bp, synthetic construct
  misc_feature 1..20: note = CRISPR gRNA sequence
  source 1..20: mol_type = other DNA
ctctgagagaacagattttg

SEQ ID NO: 24684 - DNA, 20 bp, synthetic construct
  misc_feature 1..20: note = CRISPR gRNA sequence
  source 1..20: mol_type = other DNA
tgagagaacagattttgtgc

SEQ ID NO: 24685 - DNA, 20 bp, synthetic construct
  misc_feature 1..20: note = CRISPR gRNA sequence
  source 1..20: mol_type = other DNA
agagaacagattttgtgcct

SEQ ID NO: 24686 - DNA, 20 bp, synthetic construct
  misc_feature 1..20: note = CRISPR gRNA sequence
  source 1..20: mol_type = other DNA
tgtgcctgtgtccctgacca

SEQ ID NO: 24687 - DNA, 20 bp, synthetic construct
  misc_feature 1..20: note = CRISPR gRNA sequence
  source 1..20: mol_type = other DNA
gtgcctgtgtccctgaccaa

SEQ ID NO: 24688 - DNA, 20 bp, synthetic construct
  misc_feature 1..20: note = CRISPR gRNA sequence
  source 1..20: mol_type = other DNA
tgcctgtgtccctgaccaag

SEQ ID NO: 24689 - DNA, 20 bp, synthetic construct
  misc_feature 1..20: note = CRISPR gRNA sequence
  source 1..20: mol_type = other DNA
tgtccctgaccaaggggctg

SEQ ID NO: 24690 - DNA, 20 bp, synthetic construct
  misc_feature 1..20: note = CRISPR gRNA sequence
  source 1..20: mol_type = other DNA
accaaggggctgggagaggt

SEQ ID NO: 24691 - DNA, 20 bp, synthetic construct
  misc_feature 1..20: note = CRISPR gRNA sequence
  source 1..20: mol_type = other DNA
ggagaggtggagcatctcac

SEQ ID NO: 24692 - DNA, 20 bp, synthetic construct
  misc_feature 1..20: note = CRISPR gRNA sequence
  source 1..20: mol_type = other DNA
acccccaaccatctcccagc

SEQ ID NO: 24693 - DNA, 20 bp, synthetic construct
  misc_feature 1..20: note = CRISPR gRNA sequence
  source 1..20: mol_type = other DNA
ccagctttggccctgctcca

SEQ ID NO: 24694 - DNA, 20 bp, synthetic construct
  misc_feature 1..20: note = CRISPR gRNA sequence
  source 1..20: mol_type = other DNA
tggccctgctccaggaaaag

SEQ ID NO: 24695 - DNA, 20 bp, synthetic construct
  misc_feature 1..20: note = CRISPR gRNA sequence
  source 1..20: mol_type = other DNA
ggccctgctccaggaaaagg

SEQ ID NO: 24696 - DNA, 20 bp, synthetic construct
  misc_feature 1..20: note = CRISPR gRNA sequence
  source 1..20: mol_type = other DNA
gccctgctccaggaaaaggg

SEQ ID NO: 24697 - DNA, 20 bp, synthetic construct
  misc_feature 1..20: note = CRISPR gRNA sequence
  source 1..20: mol_type = other DNA
ctccaggaaaagggcggtgg

SEQ ID NO: 24698 - DNA, 20 bp, synthetic construct
  misc_feature 1..20: note = CRISPR gRNA sequence
  source 1..20: mol_type = other DNA
caggaaaagggcggtggccc

SEQ ID NO: 24699 - DNA, 20 bp, synthetic construct
  misc_feature 1..20: note = CRISPR gRNA sequence
  source 1..20: mol_type = other DNA
tcagttctgcttcctctagt

SEQ ID NO: 24700 - DNA, 20 bp, synthetic construct
  misc_feature 1..20: note = CRISPR gRNA sequence
  source 1..20: mol_type = other DNA
cagttctgcttcctctagtc

SEQ ID NO: 24701 - DNA, 20 bp, synthetic construct
  misc_feature 1..20: note = CRISPR gRNA sequence
  source 1..20: mol_type = other DNA
agttctgcttcctctagtca

SEQ ID NO: 24702 - DNA, 20 bp, synthetic construct
  misc_feature 1..20: note = CRISPR gRNA sequence
  source 1..20: mol_type = other DNA
tgcttcctctagtcatggtt

SEQ ID NO: 24703 - DNA, 20 bp, synthetic construct
  misc_feature 1..20: note = CRISPR gRNA sequence
  source 1..20: mol_type = other DNA
cttcctctagtcatggttgg

SEQ ID NO: 24704 - DNA, 20 bp, synthetic construct
  misc_feature 1..20: note = CRISPR gRNA sequence
  source 1..20: mol_type = other DNA
cctctagtcatggttggctg

SEQ ID NO: 24705 - DNA, 20 bp, synthetic construct
  misc_feature 1..20: note = CRISPR gRNA sequence
  source 1..20: mol_type = other DNA
ctctagtcatggttggctgg

SEQ ID NO: 24706 - DNA, 20 bp, synthetic construct
  misc_feature 1..20: note = CRISPR gRNA sequence
  source 1..20: mol_type = other DNA
tagtcatggttggctgggat

SEQ ID NO: 24707 - DNA, 20 bp, synthetic construct
  misc_feature 1..20: note = CRISPR gRNA sequence
  source 1..20: mol_type = other DNA
gtcatggttggctgggatct

SEQ ID NO: 24708 - DNA, 20 bp, synthetic construct
  misc_feature 1..20: note = CRISPR gRNA sequence
  source 1..20: mol_type = other DNA
gctgggatctcgctgcaagc

SEQ ID NO: 24709 - DNA, 20 bp, synthetic construct
  misc_feature 1..20: note = CRISPR gRNA sequence
  source 1..20: mol_type = other DNA
ggatctcgctgcaagccggt

SEQ ID NO: 24710 - DNA, 20 bp, synthetic construct
  misc_feature 1..20: note = CRISPR gRNA sequence
  source 1..20: mol_type = other DNA
gctgcaagccggttatgttt

SEQ ID NO: 24711 - DNA, 20 bp, synthetic construct
  misc_feature 1..20: note = CRISPR gRNA sequence
  source 1..20: mol_type = other DNA
caagccggttatgtttgggt

SEQ ID NO: 24712 - DNA, 20 bp, synthetic construct
  misc_feature 1..20: note = CRISPR gRNA sequence
  source 1..20: mol_type = other DNA
tgtttgggttcctgcagccc

SEQ ID NO: 24713 - DNA, 20 bp, synthetic construct
  misc_feature 1..20: note = CRISPR gRNA sequence
  source 1..20: mol_type = other DNA
gggttcctgcagcccccgct

SEQ ID NO: 24714 - DNA, 20 bp, synthetic construct
  misc_feature 1..20: note = CRISPR gRNA sequence
  source 1..20: mol_type = other DNA
ggttcctgcagcccccgctc

SEQ ID NO: 24715 - DNA, 20 bp, synthetic construct
  misc_feature 1..20: note = CRISPR gRNA sequence
  source 1..20: mol_type = other DNA
ctgcagcccccgctcaaccg

SEQ ID NO: 24716 - DNA, 20 bp, synthetic construct
  misc_feature 1..20: note = CRISPR gRNA sequence
  source 1..20: mol_type = other DNA
cagcccccgctcaaccgtca

SEQ ID NO: 24717 - DNA, 20 bp, synthetic construct
  misc_feature 1..20: note = CRISPR gRNA sequence
  source 1..20: mol_type = other DNA
aaccgtcatgaacaagtggg

SEQ ID NO: 24718 - DNA, 20 bp, synthetic construct
  misc_feature 1..20: note = CRISPR gRNA sequence
  source 1..20: mol_type = other DNA
ggactggaaagatcattctc

SEQ ID NO: 24719 - DNA, 20 bp, synthetic construct
  misc_feature 1..20: note = CRISPR gRNA sequence
  source 1..20: mol_type = other DNA
gactggaaagatcattctct

SEQ ID NO: 24720 - DNA, 20 bp, synthetic construct
  misc_feature 1..20: note = CRISPR gRNA sequence
  source 1..20: mol_type = other DNA
gaaagatcattctctgtgac

SEQ ID NO: 24721 - DNA, 20 bp, synthetic construct
  misc_feature 1..20: note = CRISPR gRNA sequence
  source 1..20: mol_type = other DNA
tctgtgacatccgggggtct

SEQ ID NO: 24722 - DNA, 20 bp, synthetic construct
  misc_feature 1..20: note = CRISPR gRNA sequence
  source 1..20: mol_type = other DNA
tgtgacatccgggggtctgt

SEQ ID NO: 24723 - DNA, 20 bp, synthetic construct
  misc_feature 1..20: note = CRISPR gRNA sequence
  source 1..20: mol_type = other DNA
tgacatccgggggtctgtgc

SEQ ID NO: 24724 - DNA, 20 bp, synthetic construct
  misc_feature 1..20: note = CRISPR gRNA sequence
  source 1..20: mol_type = other DNA
tgctgagcctctccccaggc

SEQ ID NO: 24725 - DNA, 20 bp, synthetic construct
  misc_feature 1..20: note = CRISPR gRNA sequence
  source 1..20: mol_type = other DNA
agcctctccccaggcagtga

SEQ ID NO: 24726 - DNA, 20 bp, synthetic construct
  misc_feature 1..20: note = CRISPR gRNA sequence
  source 1..20: mol_type = other DNA
tccccaggcagtgaaagctg

SEQ ID NO: 24727 - DNA, 20 bp, synthetic construct
  misc_feature 1..20: note = CRISPR gRNA sequence
  source 1..20: mol_type = other DNA
cccaggcagtgaaagctgtg

SEQ ID NO: 24728 - DNA, 20 bp, synthetic construct
  misc_feature 1..20: note = CRISPR gRNA sequence
  source 1..20: mol_type = other DNA
tggatgcgtgaaagaaaatg

SEQ ID NO: 24729 - DNA, 20 bp, synthetic construct
  misc_feature 1..20: note = CRISPR gRNA sequence
  source 1..20: mol_type = other DNA
tgggccgggtgtggtggctc

SEQ ID NO: 24730 - DNA, 20 bp, synthetic construct
  misc_feature 1..20: note = CRISPR gRNA sequence
  source 1..20: mol_type = other DNA
ggccgggtgtggtggctcac

SEQ ID NO: 24731 - DNA, 20 bp, synthetic construct
  misc_feature 1..20: note = CRISPR gRNA sequence
  source 1..20: mol_type = other DNA
acacctgtaatcccagcact

SEQ ID NO: 24732 - DNA, 20 bp, synthetic construct
  misc_feature 1..20: note = CRISPR gRNA sequence
  source 1..20: mol_type = other DNA
taatcccagcactttgggag

SEQ ID NO: 24733 - DNA, 20 bp, synthetic construct
  misc_feature 1..20: note = CRISPR gRNA sequence
  source 1..20: mol_type = other DNA
tgggaggccaaggcgggtgg

SEQ ID NO: 24734 - DNA, 20 bp, synthetic construct
  misc_feature 1..20: note = CRISPR gRNA sequence
  source 1..20: mol_type = other DNA
gggaggccaaggcgggtgga

SEQ ID NO: 24735 - DNA, 20 bp, synthetic construct
  misc_feature 1..20: note = CRISPR gRNA sequence
  source 1..20: mol_type = other DNA
ggaggccaaggcgggtggat

SEQ ID NO: 24736 - DNA, 20 bp, synthetic construct
  misc_feature 1..20: note = CRISPR gRNA sequence
  source 1..20: mol_type = other DNA
aggtcgggagttcgaaacca

SEQ ID NO: 24737 - DNA, 20 bp, synthetic construct
  misc_feature 1..20: note = CRISPR gRNA sequence
  source 1..20: mol_type = other DNA
gaaaccagcctgaccaacat

SEQ ID NO: 24738 - DNA, 20 bp, synthetic construct
  misc_feature 1..20: note = CRISPR gRNA sequence
  source 1..20: mol_type = other DNA
accaacatggtgaaacccca

SEQ ID NO: 24739 - DNA, 20 bp, synthetic construct
  misc_feature 1..20: note = CRISPR gRNA sequence
  source 1..20: mol_type = other DNA
tactaaaaataaaaaaatta

SEQ ID NO: 24740 - DNA, 20 bp, synthetic construct
  misc_feature 1..20: note = CRISPR gRNA sequence
  source 1..20: mol_type = other DNA
actaaaaataaaaaaattag

SEQ ID NO: 24741 - DNA, 20 bp, synthetic construct
  misc_feature 1..20: note = CRISPR gRNA sequence
  source 1..20: mol_type = other DNA
ctaaaaataaaaaaattagc

SEQ ID NO: 24742 - DNA, 20 bp, synthetic construct
  misc_feature 1..20: note = CRISPR gRNA sequence
  source 1..20: mol_type = other DNA
aaaataaaaaaattagccag

SEQ ID NO: 24743 - DNA, 20 bp, synthetic construct
  misc_feature 1..20: note = CRISPR gRNA sequence
  source 1..20: mol_type = other DNA
gccaggcatggtggcgggtg

SEQ ID NO: 24744 - DNA, 20 bp, synthetic construct
  misc_feature 1..20: note = CRISPR gRNA sequence
  source 1..20: mol_type = other DNA
taatgccagctacttgggag

SEQ ID NO: 24745 - DNA, 20 bp, synthetic construct
  misc_feature 1..20: note = CRISPR gRNA sequence
  source 1..20: mol_type = other DNA
cttgggaggttgaagcagga

SEQ ID NO: 24746 - DNA, 20 bp, synthetic construct
  misc_feature 1..20: note = CRISPR gRNA sequence
  source 1..20: mol_type = other DNA
gggaggttgaagcaggagaa

SEQ ID NO: 24747 - DNA, 20 bp, synthetic construct
  misc_feature 1..20: note = CRISPR gRNA sequence
  source 1..20: mol_type = other DNA
ggaggttgaagcaggagaat

SEQ ID NO: 24748 - DNA, 20 bp, synthetic construct
  misc_feature 1..20: note = CRISPR gRNA sequence
  source 1..20: mol_type = other DNA
aagcaggagaattgcttgaa

SEQ ID NO: 24749 - DNA, 20 bp, synthetic construct
  misc_feature 1..20: note = CRISPR gRNA sequence
  source 1..20: mol_type = other DNA
cttgaatccgggaggcagag

SEQ ID NO: 24750 - DNA, 20 bp, synthetic construct
  misc_feature 1..20: note = CRISPR gRNA sequence
  source 1..20: mol_type = other DNA
gaatccgggaggcagaggtt

SEQ ID NO: 24751 - DNA, 20 bp, synthetic construct
  misc_feature 1..20: note = CRISPR gRNA sequence
  source 1..20: mol_type = other DNA
aatccgggaggcagaggttg

SEQ ID NO: 24752 - DNA, 20 bp, synthetic construct
  misc_feature 1..20: note = CRISPR gRNA sequence
  source 1..20: mol_type = other DNA
cagtgagccaagattgcacc

SEQ ID NO: 24753 - DNA, 20 bp, synthetic construct
  misc_feature 1..20: note = CRISPR gRNA sequence
  source 1..20: mol_type = other DNA
caccactgcactccagcctg

SEQ ID NO: 24754 - DNA, 20 bp, synthetic construct
  misc_feature 1..20: note = CRISPR gRNA sequence
  source 1..20: mol_type = other DNA
cactccagcctgggcgacag

SEQ ID NO: 24755 - DNA, 20 bp, synthetic construct
  misc_feature 1..20: note = CRISPR gRNA sequence
  source 1..20: mol_type = other DNA
cagcctgggcgacagagtga

SEQ ID NO: 24756 - DNA, 20 bp, synthetic construct
  misc_feature 1..20: note = CRISPR gRNA sequence
  source 1..20: mol_type = other DNA
ggcgacagagtgagactctg

SEQ ID NO: 24757 - DNA, 20 bp, synthetic construct
  misc_feature 1..20: note = CRISPR gRNA sequence
  source 1..20: mol_type = other DNA
tgtctcaaaaaaaaaaagaa

SEQ ID NO: 24758 - DNA, 20 bp, synthetic construct
  misc_feature 1..20: note = CRISPR gRNA sequence
  source 1..20: mol_type = other DNA
tctcaaaaaaaaaaagaaaa

SEQ ID NO: 24759 - DNA, 20 bp, synthetic construct
  misc_feature 1..20: note = CRISPR gRNA sequence
  source 1..20: mol_type = other DNA
aaaaaaaaaaagaaaaagaa

SEQ ID NO: 24760 - DNA, 20 bp, synthetic construct
  misc_feature 1..20: note = CRISPR gRNA sequence
  source 1..20: mol_type = other DNA
aggaatggggtggcaagttg

SEQ ID NO: 24761 - DNA, 20 bp, synthetic construct
  misc_feature 1..20: note = CRISPR gRNA sequence
  source 1..20: mol_type = other DNA
agtgtgtgttttctcatgag

SEQ ID NO: 24762 - DNA, 20 bp, synthetic construct
  misc_feature 1..20: note = CRISPR gRNA sequence
  source 1..20: mol_type = other DNA
tctcatgagcttactcttca

SEQ ID NO: 24763 - DNA, 20 bp, synthetic construct
  misc_feature 1..20: note = CRISPR gRNA sequence
  source 1..20: mol_type = other DNA
ctcatgagcttactcttcaa

SEQ ID NO: 24764 - DNA, 20 bp, synthetic construct
  misc_feature 1..20: note = CRISPR gRNA sequence
  source 1..20: mol_type = other DNA
tcatgagcttactcttcaat

SEQ ID NO: 24765 - DNA, 20 bp, synthetic construct
  misc_feature 1..20: note = CRISPR gRNA sequence
  source 1..20: mol_type = other DNA
atgagcttactcttcaatgt

SEQ ID NO: 24766 - DNA, 20 bp, synthetic construct
  misc_feature 1..20: note = CRISPR gRNA sequence
  source 1..20: mol_type = other DNA
actcttcaatgtattctctt

SEQ ID NO: 24767 - DNA, 20 bp, synthetic construct
  misc_feature 1..20: note = CRISPR gRNA sequence
  source 1..20: mol_type = other DNA
ctcttcaatgtattctcttc

SEQ ID NO: 24768 - DNA, 20 bp, synthetic construct
  misc_feature 1..20: note = CRISPR gRNA sequence
  source 1..20: mol_type = other DNA
ttcaatgtattctcttctgg

SEQ ID NO: 24769 - DNA, 20 bp, synthetic construct
  misc_feature 1..20: note = CRISPR gRNA sequence
  source 1..20: mol_type = other DNA
caatgtattctcttctgggc

SEQ ID NO: 24770 - DNA, 20 bp, synthetic construct
  misc_feature 1..20: note = CRISPR gRNA sequence
  source 1..20: mol_type = other DNA
aatgtattctcttctgggcc

SEQ ID NO: 24771 - DNA, 20 bp, synthetic construct
  misc_feature 1..20: note = CRISPR gRNA sequence
  source 1..20: mol_type = other DNA
tcttctgggcccagaacagg

SEQ ID NO: 24772 - DNA, 20 bp, synthetic construct
  misc_feature 1..20: note = CRISPR gRNA sequence
  source 1..20: mol_type = other DNA
ttctgggcccagaacagggc

SEQ ID NO: 24773 - DNA, 20 bp, synthetic construct
  misc_feature 1..20: note = CRISPR gRNA sequence
  source 1..20: mol_type = other DNA
ctgggcccagaacagggcag

SEQ ID NO: 24774 - DNA, 20 bp, synthetic construct
  misc_feature 1..20: note = CRISPR gRNA sequence
  source 1..20: mol_type = other DNA
tgggcccagaacagggcagt

SEQ ID NO: 24775 - DNA, 20 bp, synthetic construct
  misc_feature 1..20: note = CRISPR gRNA sequence
  source 1..20: mol_type = other DNA
ggcccagaacagggcagtag

SEQ ID NO: 24776 - DNA, 20 bp, synthetic construct
  misc_feature 1..20: note = CRISPR gRNA sequence
  source 1..20: mol_type = other DNA
cctctggtcttccagcttca

SEQ ID NO: 24777 - DNA, 20 bp, synthetic construct
  misc_feature 1..20: note = CRISPR gRNA sequence
  source 1..20: mol_type = other DNA
tggtcttccagcttcagggc

SEQ ID NO: 24778 - DNA, 20 bp, synthetic construct
  misc_feature 1..20: note = CRISPR gRNA sequence
  source 1..20: mol_type = other DNA
gtcttccagcttcagggcca

SEQ ID NO: 24779 - DNA, 20 bp, synthetic construct
  misc_feature 1..20: note = CRISPR gRNA sequence
  source 1..20: mol_type = other DNA
ccagcttcagggccagctct

SEQ ID NO: 24780 - DNA, 20 bp, synthetic construct
  misc_feature 1..20: note = CRISPR gRNA sequence
  source 1..20: mol_type = other DNA
cagcttcagggccagctctc

SEQ ID NO: 24781 - DNA, 20 bp, synthetic construct
  misc_feature 1..20: note = CRISPR gRNA sequence
  source 1..20: mol_type = other DNA
cagggccagctctcctctta

SEQ ID NO: 24782 - DNA, 20 bp, synthetic construct
  misc_feature 1..20: note = CRISPR gRNA sequence
  source 1..20: mol_type = other DNA
agggccagctctcctcttac

SEQ ID NO: 24783 - DNA, 20 bp, synthetic construct
  misc_feature 1..20: note = CRISPR gRNA sequence
  source 1..20: mol_type = other DNA
tcctcttacctcctccagga

SEQ ID NO: 24784 - DNA, 20 bp, synthetic construct
  misc_feature 1..20: note = CRISPR gRNA sequence
  source 1..20: mol_type = other DNA
ctcttacctcctccaggaag

SEQ ID NO: 24785 - DNA, 20 bp, synthetic construct
  misc_feature 1..20: note = CRISPR gRNA sequence
  source 1..20: mol_type = other DNA
ttacctcctccaggaagctc

SEQ ID NO: 24786 - DNA, 20 bp, synthetic construct
  misc_feature 1..20: note = CRISPR gRNA sequence
  source 1..20: mol_type = other DNA
acctcctccaggaagctccc

SEQ ID NO: 24787 - DNA, 20 bp, synthetic construct
  misc_feature 1..20: note = CRISPR gRNA sequence
  source 1..20: mol_type = other DNA
cctcctccaggaagctccct

SEQ ID NO: 24788 - DNA, 20 bp, synthetic construct
  misc_feature 1..20: note = CRISPR gRNA sequence
  source 1..20: mol_type = other DNA
ctccaggaagctccctctgt

SEQ ID NO: 24789 - DNA, 20 bp, synthetic construct
  misc_feature 1..20: note = CRISPR gRNA sequence
  source 1..20: mol_type = other DNA
caggaagctccctctgtttc

SEQ ID NO: 24790 - DNA, 20 bp, synthetic construct
  misc_feature 1..20: note = CRISPR gRNA sequence
  source 1..20: mol_type = other DNA
cctctgtttctttccagcct

SEQ ID NO: 24791 - DNA, 20 bp, synthetic construct
  misc_feature 1..20: note = CRISPR gRNA sequence
  source 1..20: mol_type = other DNA
tgtttctttccagccttcat

SEQ ID NO: 24792 - DNA, 20 bp, synthetic construct
  misc_feature 1..20: note = CRISPR gRNA sequence
  source 1..20: mol_type = other DNA
tttctttccagccttcatct

SEQ ID NO: 24793 - DNA, 20 bp, synthetic construct
  misc_feature 1..20: note = CRISPR gRNA sequence
  source 1..20: mol_type = other DNA
ctttccagccttcatctgca

SEQ ID NO: 24794 - DNA, 20 bp, synthetic construct
  misc_feature 1..20: note = CRISPR gRNA sequence
  source 1..20: mol_type = other DNA
tttccagccttcatctgcat

SEQ ID NO: 24795 - DNA, 20 bp, synthetic construct
  misc_feature 1..20: note = CRISPR gRNA sequence
  source 1..20: mol_type = other DNA
tccagccttcatctgcatgt

SEQ ID NO: 24796 - DNA, 20 bp, synthetic construct
  misc_feature 1..20: note = CRISPR gRNA sequence
  source 1..20: mol_type = other DNA
ccagccttcatctgcatgtc

SEQ ID NO: 24797 - DNA, 20 bp, synthetic construct
  misc_feature 1..20: note = CRISPR gRNA sequence
  source 1..20: mol_type = other DNA
cagccttcatctgcatgtca

SEQ ID NO: 24798 - DNA, 20 bp, synthetic construct
  misc_feature 1..20: note = CRISPR gRNA sequence
  source 1..20: mol_type = other DNA
catctgcatgtcatgtgtgg

SEQ ID NO: 24799 - DNA, 20 bp, synthetic construct
  misc_feature 1..20: note = CRISPR gRNA sequence
  source 1..20: mol_type = other DNA
atctgcatgtcatgtgtggt

SEQ ID NO: 24800 - DNA, 20 bp, synthetic construct
  misc_feature 1..20: note = CRISPR gRNA sequence
  source 1..20: mol_type = other DNA
catgtcatgtgtggtgggtt

SEQ ID NO: 24801 - DNA, 20 bp, synthetic construct
  misc_feature 1..20: note = CRISPR gRNA sequence
  source 1..20: mol_type = other DNA
aaaggtggccccccaaaaga

SEQ ID NO: 24802 - DNA, 20 bp, synthetic construct
  misc_feature 1..20: note = CRISPR gRNA sequence
  source 1..20: mol_type = other DNA
gaacctgtcagtgtgacttt

SEQ ID NO: 24803 - DNA, 20 bp, synthetic construct
  misc_feature 1..20: note = CRISPR gRNA sequence
  source 1..20: mol_type = other DNA
tcagtgtgactttatttggg

SEQ ID NO: 24804 - DNA, 20 bp, synthetic construct
  misc_feature 1..20: note = CRISPR gRNA sequence
  source 1..20: mol_type = other DNA
tatttgggaaaagggtcttt

SEQ ID NO: 24805 - DNA, 20 bp, synthetic construct
  misc_feature 1..20: note = CRISPR gRNA sequence
  source 1..20: mol_type = other DNA
atttgggaaaagggtctttg

SEQ ID NO: 24806 - DNA, 20 bp, synthetic construct
  misc_feature 1..20: note = CRISPR gRNA sequence
  source 1..20: mol_type = other DNA
tttgggaaaagggtctttgc

SEQ ID NO: 24807 - DNA, 20 bp, synthetic construct
  misc_feature 1..20: note = CRISPR gRNA sequence
  source 1..20: mol_type = other DNA
gggaaaagggtctttgcaga

SEQ ID NO: 24808 - DNA, 20 bp, synthetic construct
  misc_feature 1..20: note = CRISPR gRNA sequence
  source 1..20: mol_type = other DNA
ggaaaagggtctttgcagat

SEQ ID NO: 24809 - DNA, 20 bp, synthetic construct
  misc_feature 1..20: note = CRISPR gRNA sequence
  source 1..20: mol_type = other DNA
tgcagatagaattaagttaa

SEQ ID NO: 24810 - DNA, 20 bp, synthetic construct
  misc_feature 1..20: note = CRISPR gRNA sequence
  source 1..20: mol_type = other DNA
gcagatagaattaagttaag

SEQ ID NO: 24811 - DNA, 20 bp, synthetic construct
  misc_feature 1..20: note = CRISPR gRNA sequence
  source 1..20: mol_type = other DNA
cagatagaattaagttaagg

SEQ ID NO: 24812 - DNA, 20 bp, synthetic construct
  misc_feature 1..20: note = CRISPR gRNA sequence
  source 1..20: mol_type = other DNA
agttaaggggctgggtgcag

SEQ ID NO: 24813 - DNA, 20 bp, synthetic construct
  misc_feature 1..20: note = CRISPR gRNA sequence
  source 1..20: mol_type = other DNA
aggggctgggtgcagtggct

SEQ ID NO: 24814 - DNA, 20 bp, synthetic construct
  misc_feature 1..20: note = CRISPR gRNA sequence
  source 1..20: mol_type = other DNA
ggtgcagtggctcatgcctg

SEQ ID NO: 24815 - DNA, 20 bp, synthetic construct
  misc_feature 1..20: note = CRISPR gRNA sequence
  source 1..20: mol_type = other DNA
atgcctgtaatcccagcact

SEQ ID NO: 24816 - DNA, 20 bp, synthetic construct
  misc_feature 1..20: note = CRISPR gRNA sequence
  source 1..20: mol_type = other DNA
taatcccagcactttgggaa

SEQ ID NO: 24817 - DNA, 20 bp, synthetic construct
  misc_feature 1..20: note = CRISPR gRNA sequence
  source 1..20: mol_type = other DNA
tgggaagctgagattggagg

SEQ ID NO: 24818 - DNA, 20 bp, synthetic construct
  misc_feature 1..20: note = CRISPR gRNA sequence
  source 1..20: mol_type = other DNA
gggaagctgagattggagga

SEQ ID NO: 24819 - DNA, 20 bp, synthetic construct
  misc_feature 1..20: note = CRISPR gRNA sequence
  source 1..20: mol_type = other DNA
ggaagctgagattggaggat

SEQ ID NO: 24820 - DNA, 20 bp, synthetic construct
  misc_feature 1..20: note = CRISPR gRNA sequence
  source 1..20: mol_type = other DNA
agattggaggatcacctgag

SEQ ID NO: 24821 - DNA, 20 bp, synthetic construct
  misc_feature 1..20: note = CRISPR gRNA sequence
  source 1..20: mol_type = other DNA
gaggatcacctgaggtcagg

SEQ ID NO: 24822 - DNA, 20 bp, synthetic construct
  misc_feature 1..20: note = CRISPR gRNA sequence
  source 1..20: mol_type = other DNA
aggtcaggagttcaagacca

SEQ ID NO: 24823 - DNA, 20 bp, synthetic construct
  misc_feature 1..20: note = CRISPR gRNA sequence
  source 1..20: mol_type = other DNA
aagaccagcgtggccaacat

SEQ ID NO: 24824 - DNA, 20 bp, synthetic construct
  misc_feature 1..20: note = CRISPR gRNA sequence
  source 1..20: mol_type = other DNA
ctactaaaaatacaaaaatt

SEQ ID NO: 24825 - DNA, 20 bp, synthetic construct
  misc_feature 1..20: note = CRISPR gRNA sequence
  source 1..20: mol_type = other DNA
tactaaaaatacaaaaatta

SEQ ID NO: 24826 - DNA, 20 bp, synthetic construct
  misc_feature 1..20: note = CRISPR gRNA sequence
  source 1..20: mol_type = other DNA
ctaaaaatacaaaaattagc

SEQ ID NO: 24827 - DNA, 20 bp, synthetic construct
  misc_feature 1..20: note = CRISPR gRNA sequence
  source 1..20: mol_type = other DNA
aaaatacaaaaattagctgg

SEQ ID NO: 24828 - DNA, 20 bp, synthetic construct
  misc_feature 1..20: note = CRISPR gRNA sequence
  source 1..20: mol_type = other DNA
gctggtcatggtggtgagca

SEQ ID NO: 24829 - DNA, 20 bp, synthetic construct
  misc_feature 1..20: note = CRISPR gRNA sequence
  source 1..20: mol_type = other DNA
gtcatggtggtgagcacctg

SEQ ID NO: 24830 - DNA, 20 bp, synthetic construct
  misc_feature 1..20: note = CRISPR gRNA sequence
  source 1..20: mol_type = other DNA
taatcccagctactcaggag

SEQ ID NO: 24831 - DNA, 20 bp, synthetic construct
  misc_feature 1..20: note = CRISPR gRNA sequence
  source 1..20: mol_type = other DNA
ctcaggagactggggcagga

SEQ ID NO: 24832 - DNA, 20 bp, synthetic construct
  misc_feature 1..20: note = CRISPR gRNA sequence
  source 1..20: mol_type = other DNA
aggagactggggcaggagaa

SEQ ID NO: 24833 - DNA, 20 bp, synthetic construct
  misc_feature 1..20: note = CRISPR gRNA sequence
  source 1..20: mol_type = other DNA
gggcaggagaatcgcttgaa

SEQ ID NO: 24834 - DNA, 20 bp, synthetic construct
  misc_feature 1..20: note = CRISPR gRNA sequence
  source 1..20: mol_type = other DNA
gaactgggaggtggaggttg

SEQ ID NO: 24835 - DNA, 20 bp, synthetic construct
  misc_feature 1..20: note = CRISPR gRNA sequence
  source 1..20: mol_type = other DNA
aactgggaggtggaggttgc

SEQ ID NO: 24836 - DNA, 20 bp, synthetic construct
  misc_feature 1..20: note = CRISPR gRNA sequence
  source 1..20: mol_type = other DNA
ggaggtggaggttgcagtga

SEQ ID NO: 24837 - DNA, 20 bp, synthetic construct
  misc_feature 1..20: note = CRISPR gRNA sequence
  source 1..20: mol_type = other DNA
cagtgagccgatacagcgcc

SEQ ID NO: 24838 - DNA, 20 bp, synthetic construct
  misc_feature 1..20: note = CRISPR gRNA sequence
  source 1..20: mol_type = other DNA
cattccagcctgggcaacag

SEQ ID NO: 24839 - DNA, 20 bp, synthetic construct
  misc_feature 1..20: note = CRISPR gRNA sequence
  source 1..20: mol_type = other DNA
cagcctgggcaacagagcaa

SEQ ID NO: 24840 - DNA, 20 bp, synthetic construct
  misc_feature 1..20: note = CRISPR gRNA sequence
  source 1..20: mol_type = other DNA
ggcaacagagcaagcctctg

SEQ ID NO: 24841 - DNA, 20 bp, synthetic construct
  misc_feature 1..20: note = CRISPR gRNA sequence
  source 1..20: mol_type = other DNA
tgtctcaaaagaaggcaaaa

SEQ ID NO: 24842 - DNA, 20 bp, synthetic construct
  misc_feature 1..20: note = CRISPR gRNA sequence
  source 1..20: mol_type = other DNA
tctcaaaagaaggcaaaaaa

SEQ ID NO: 24843 - DNA, 20 bp, synthetic construct
  misc_feature 1..20: note = CRISPR gRNA sequence
  source 1..20: mol_type = other DNA
aaaagaaggcaaaaaaagaa

SEQ ID NO: 24844 - DNA, 20 bp, synthetic construct
  misc_feature 1..20: note = CRISPR gRNA sequence
  source 1..20: mol_type = other DNA
aagatcttgaaatgacatca

SEQ ID NO: 24845 - DNA, 20 bp, synthetic construct
  misc_feature 1..20: note = CRISPR gRNA sequence
  source 1..20: mol_type = other DNA
gaaatgacatcatcctggat

SEQ ID NO: 24846 - DNA, 20 bp, synthetic construct
  misc_feature 1..20: note = CRISPR gRNA sequence
  source 1..20: mol_type = other DNA
aaatgacatcatcctggatt

SEQ ID NO: 24847 - DNA, 20 bp, synthetic construct
  misc_feature 1..20: note = CRISPR gRNA sequence
  source 1..20: mol_type = other DNA
gattatctaggtgggtccta

SEQ ID NO: 24848 - DNA, 20 bp, synthetic construct
  misc_feature 1..20: note = CRISPR gRNA sequence
  source 1..20: mol_type = other DNA
tctaggtgggtcctaaatcc

SEQ ID NO: 24849 - DNA, 20 bp, synthetic construct
  misc_feature 1..20: note = CRISPR gRNA sequence
  source 1..20: mol_type = other DNA
ggtgggtcctaaatccaatg

SEQ ID NO: 24850 - DNA, 20 bp, synthetic construct
  misc_feature 1..20: note = CRISPR gRNA sequence
  source 1..20: mol_type = other DNA
aatccaatgacaagtgtctt

SEQ ID NO: 24851 - DNA, 20 bp, synthetic construct
  misc_feature 1..20: note = CRISPR gRNA sequence
  source 1..20: mol_type = other DNA
tataagagaaagagacttgc

SEQ ID NO: 24852 - DNA, 20 bp, synthetic construct
  misc_feature 1..20: note = CRISPR gRNA sequence
  source 1..20: mol_type = other DNA
ataagagaaagagacttgct

SEQ ID NO: 24853 - DNA, 20 bp, synthetic construct
  misc_feature 1..20: note = CRISPR gRNA sequence
  source 1..20: mol_type = other DNA
taagagaaagagacttgcta

SEQ ID NO: 24854 - DNA, 20 bp, synthetic construct
  misc_feature 1..20: note = CRISPR gRNA sequence
  source 1..20: mol_type = other DNA
gctacatgaggagtaggtga

SEQ ID NO: 24855 - DNA, 20 bp, synthetic construct
  misc_feature 1..20: note = CRISPR gRNA sequence
  source 1..20: mol_type = other DNA
ctacatgaggagtaggtgat

SEQ ID NO: 24856 - DNA, 20 bp, synthetic construct
  misc_feature 1..20: note = CRISPR gRNA sequence
  source 1..20: mol_type = other DNA
catgaggagtaggtgatgtg

SEQ ID NO: 24857 - DNA, 20 bp, synthetic construct
  misc_feature 1..20: note = CRISPR gRNA sequence
  source 1..20: mol_type = other DNA
aagctgagtttagagtgatg

SEQ ID NO: 24858 - DNA, 20 bp, synthetic construct
  misc_feature 1..20: note = CRISPR gRNA sequence
  source 1..20: mol_type = other DNA
agtttagagtgatgcagcca

SEQ ID NO: 24859 - DNA, 20 bp, synthetic construct
  misc_feature 1..20: note = CRISPR gRNA sequence
  source 1..20: mol_type = other DNA
agagtgatgcagccacaaga

SEQ ID NO: 24860 - DNA, 20 bp, synthetic construct
  misc_feature 1..20: note = CRISPR gRNA sequence
  source 1..20: mol_type = other DNA
gagtgatgcagccacaagac

SEQ ID NO: 24861 - DNA, 20 bp, synthetic construct
  misc_feature 1..20: note = CRISPR gRNA sequence
  source 1..20: mol_type = other DNA
ccagcagctagaggaggcaa

SEQ ID NO: 24862 - DNA, 20 bp, synthetic construct
  misc_feature 1..20: note = CRISPR gRNA sequence
  source 1..20: mol_type = other DNA
gaggaggcaaggaagcattc

SEQ ID NO: 24863 - DNA, 20 bp, synthetic construct
  misc_feature 1..20: note = CRISPR gRNA sequence
  source 1..20: mol_type = other DNA
tcccctcgagcctccagagg

SEQ ID NO: 24864 - DNA, 20 bp, synthetic construct
  misc_feature 1..20: note = CRISPR gRNA sequence
  source 1..20: mol_type = other DNA
ccctcgagcctccagaggca

SEQ ID NO: 24865 - DNA, 20 bp, synthetic construct
  misc_feature 1..20: note = CRISPR gRNA sequence
  source 1..20: mol_type = other DNA
gagcctccagaggcagcgtg

SEQ ID NO: 24866 - DNA, 20 bp, synthetic construct
  misc_feature 1..20: note = CRISPR gRNA sequence
  source 1..20: mol_type = other DNA
cagaggcagcgtggccctgc

SEQ ID NO: 24867 - DNA, 20 bp, synthetic construct
  misc_feature 1..20: note = CRISPR gRNA sequence
  source 1..20: mol_type = other DNA
ctgacaccttggcttcaact

SEQ ID NO: 24868 - DNA, 20 bp, synthetic construct
  misc_feature 1..20: note = CRISPR gRNA sequence
  source 1..20: mol_type = other DNA
acaccttggcttcaacttct

SEQ ID NO: 24869 - DNA, 20 bp, synthetic construct
  misc_feature 1..20: note = CRISPR gRNA sequence
  source 1..20: mol_type = other DNA
ggcttcaacttctggcctcc

SEQ ID NO: 24870 - DNA, 20 bp, synthetic construct
  misc_feature 1..20: note = CRISPR gRNA sequence
  source 1..20: mol_type = other DNA
gcttcaacttctggcctcca

SEQ ID NO: 24871 - DNA, 20 bp, synthetic construct
  misc_feature 1..20: note = CRISPR gRNA sequence
  source 1..20: mol_type = other DNA
caacttctggcctccagaac

SEQ ID NO: 24872 - DNA, 20 bp, synthetic construct
  misc_feature 1..20: note = CRISPR gRNA sequence
  source 1..20: mol_type = other DNA
aacttctggcctccagaacc

SEQ ID NO: 24873 - DNA, 20 bp, synthetic construct
  misc_feature 1..20: note = CRISPR gRNA sequence
  source 1..20: mol_type = other DNA
ctggcctccagaaccatgag

SEQ ID NO: 24874 - DNA, 20 bp, synthetic construct
  misc_feature 1..20: note = CRISPR gRNA sequence
  source 1..20: mol_type = other DNA
tggcctccagaaccatgaga

SEQ ID NO: 24875 - DNA, 20 bp, synthetic construct
  misc_feature 1..20: note = CRISPR gRNA sequence
  source 1..20: mol_type = other DNA
gcctccagaaccatgagaga

SEQ ID NO: 24876 - DNA, 20 bp, synthetic construct
  misc_feature 1..20: note = CRISPR gRNA sequence
  source 1..20: mol_type = other DNA
cagaaccatgagagaataaa

SEQ ID NO: 24877 - DNA, 20 bp, synthetic construct
  misc_feature 1..20: note = CRISPR gRNA sequence
  source 1..20: mol_type = other DNA
ttgttctgagctacctggat

SEQ ID NO: 24878 - DNA, 20 bp, synthetic construct
  misc_feature 1..20: note = CRISPR gRNA sequence
  source 1..20: mol_type = other DNA
ttctgagctacctggatgct

SEQ ID NO: 24879 - DNA, 20 bp, synthetic construct
  misc_feature 1..20: note = CRISPR gRNA sequence
  source 1..20: mol_type = other DNA
tgagctacctggatgctggt

SEQ ID NO: 24880 - DNA, 20 bp, synthetic construct
  misc_feature 1..20: note = CRISPR gRNA sequence
  source 1..20: mol_type = other DNA
agctacctggatgctggtac

SEQ ID NO: 24881 - DNA, 20 bp, synthetic construct
  misc_feature 1..20: note = CRISPR gRNA sequence
  source 1..20: mol_type = other DNA
cctggatgctggtaccttgt

SEQ ID NO: 24882 - DNA, 20 bp, synthetic construct
  misc_feature 1..20: note = CRISPR gRNA sequence
  source 1..20: mol_type = other DNA
gatgctggtaccttgtttca

SEQ ID NO: 24883 - DNA, 20 bp, synthetic construct
  misc_feature 1..20: note = CRISPR gRNA sequence
  source 1..20: mol_type = other DNA
gtaccttgtttcagcagccc

SEQ ID NO: 24884 - DNA, 20 bp, synthetic construct
  misc_feature 1..20: note = CRISPR gRNA sequence
  source 1..20: mol_type = other DNA
gtttcagcagccctgggaaa

SEQ ID NO: 24885 - DNA, 20 bp, synthetic construct
  misc_feature 1..20: note = CRISPR gRNA sequence
  source 1..20: mol_type = other DNA
tttcagcagccctgggaaat

SEQ ID NO: 24886 - DNA, 20 bp, synthetic construct
  misc_feature 1..20: note = CRISPR gRNA sequence
  source 1..20: mol_type = other DNA
cagcagccctgggaaatgaa

SEQ ID NO: 24887 - DNA, 20 bp, synthetic construct
  misc_feature 1..20: note = CRISPR gRNA sequence
  source 1..20: mol_type = other DNA
agcagccctgggaaatgaat

SEQ ID NO: 24888 - DNA, 20 bp, synthetic construct
  misc_feature 1..20: note = CRISPR gRNA sequence
  source 1..20: mol_type = other DNA
ggaaatgaatataccatgga

SEQ ID NO: 24889 - DNA, 20 bp, synthetic construct
  misc_feature 1..20: note = CRISPR gRNA sequence
  source 1..20: mol_type = other DNA
aaccacggatcctggcagga

SEQ ID NO: 24890 - DNA, 20 bp, synthetic construct
  misc_feature 1..20: note = CRISPR gRNA sequence
  source 1..20: mol_type = other DNA
gcaggagccttagagccaca

SEQ ID NO: 24891 - DNA, 20 bp, synthetic construct
  misc_feature 1..20: note = CRISPR gRNA sequence
  source 1..20: mol_type = other DNA
agagccacacagatgagcct

SEQ ID NO: 24892 - DNA, 20 bp, synthetic construct
  misc_feature 1..20: note = CRISPR gRNA sequence
  source 1..20: mol_type = other DNA
gagccacacagatgagcctt

SEQ ID NO: 24893 - DNA, 20 bp, synthetic construct
  misc_feature 1..20: note = CRISPR gRNA sequence
  source 1..20: mol_type = other DNA
cagcttggctttccccagca

SEQ ID NO: 24894 - DNA, 20 bp, synthetic construct
  misc_feature 1..20: note = CRISPR gRNA sequence
  source 1..20: mol_type = other DNA
agcttggctttccccagcaa

SEQ ID NO: 24895 - DNA, 20 bp, synthetic construct
  misc_feature 1..20: note = CRISPR gRNA sequence
  source 1..20: mol_type = other DNA
ggctttccccagcaagagct

SEQ ID NO: 24896 - DNA, 20 bp, synthetic construct
  misc_feature 1..20: note = CRISPR gRNA sequence
  source 1..20: mol_type = other DNA
gctttccccagcaagagcta

SEQ ID NO: 24897 - DNA, 20 bp, synthetic construct
  misc_feature 1..20: note = CRISPR gRNA sequence
  source 1..20: mol_type = other DNA
tccccagcaagagctacatg

SEQ ID NO: 24898 - DNA, 20 bp, synthetic construct
  misc_feature 1..20: note = CRISPR gRNA sequence
  source 1..20: mol_type = other DNA
ccccagcaagagctacatga

SEQ ID NO: 24899 - DNA, 20 bp, synthetic construct
  misc_feature 1..20: note = CRISPR gRNA sequence
  source 1..20: mol_type = other DNA
cccagcaagagctacatgat

SEQ ID NO: 24900 - DNA, 20 bp, synthetic construct
  misc_feature 1..20: note = CRISPR gRNA sequence
  source 1..20: mol_type = other DNA
catgatcttgaggaagctgc

SEQ ID NO: 24901 - DNA, 20 bp, synthetic construct
  misc_feature 1..20: note = CRISPR gRNA sequence
  source 1..20: mol_type = other DNA
gaggaagctgcttgtcttct

SEQ ID NO: 24902 - DNA, 20 bp, synthetic construct
  misc_feature 1..20: note = CRISPR gRNA sequence
  source 1..20: mol_type = other DNA
aggaagctgcttgtcttctc

SEQ ID NO: 24903 - DNA, 20 bp, synthetic construct
  misc_feature 1..20: note = CRISPR gRNA sequence
  source 1..20: mol_type = other DNA
cttgtcttctctgggtctca

SEQ ID NO: 24904 - DNA, 20 bp, synthetic construct
  misc_feature 1..20: note = CRISPR gRNA sequence
  source 1..20: mol_type = other DNA
gtcttctctgggtctcaagt

SEQ ID NO: 24905 - DNA, 20 bp, synthetic construct
  misc_feature 1..20: note = CRISPR gRNA sequence
  source 1..20: mol_type = other DNA
tcttctctgggtctcaagtt

SEQ ID NO: 24906 - DNA, 20 bp, synthetic construct
  misc_feature 1..20: note = CRISPR gRNA sequence
  source 1..20: mol_type = other DNA
ctctgggtctcaagttcttc

SEQ ID NO: 24907 - DNA, 20 bp, synthetic construct
  misc_feature 1..20: note = CRISPR gRNA sequence
  source 1..20: mol_type = other DNA
tctgggtctcaagttcttca

SEQ ID NO: 24908 - DNA, 20 bp, synthetic construct
  misc_feature 1..20: note = CRISPR gRNA sequence
  source 1..20: mol_type = other DNA
tgggtctcaagttcttcatc

SEQ ID NO: 24909 - DNA, 20 bp, synthetic construct
  misc_feature 1..20: note = CRISPR gRNA sequence
  source 1..20: mol_type = other DNA
ggtctcaagttcttcatctg

SEQ ID NO: 24910 - DNA, 20 bp, synthetic construct
  misc_feature 1..20: note = CRISPR gRNA sequence
  source 1..20: mol_type = other DNA
aagttcttcatctgccaatg

SEQ ID NO: 24911 - DNA, 20 bp, synthetic construct
  misc_feature 1..20: note = CRISPR gRNA sequence
  source 1..20: mol_type = other DNA
ttcatctgccaatggagaca

SEQ ID NO: 24912 - DNA, 20 bp, synthetic construct
  misc_feature 1..20: note = CRISPR gRNA sequence
  source 1..20: mol_type = other DNA
catctgccaatggagacaat

SEQ ID NO: 24913 - DNA, 20 bp, synthetic construct
  misc_feature 1..20: note = CRISPR gRNA sequence
  source 1..20: mol_type = other DNA
atctgccaatggagacaata

SEQ ID NO: 24914 - DNA, 20 bp, synthetic construct
  misc_feature 1..20: note = CRISPR gRNA sequence
  source 1..20: mol_type = other DNA
ccaatggagacaataatgct

SEQ ID NO: 24915 - DNA, 20 bp, synthetic construct
  misc_feature 1..20: note = CRISPR gRNA sequence
  source 1..20: mol_type = other DNA
acttcctaggttttaacagc

SEQ ID NO: 24916 - DNA, 20 bp, synthetic construct
  misc_feature 1..20: note = CRISPR gRNA sequence
  source 1..20: mol_type = other DNA
cttcctaggttttaacagct

SEQ ID NO: 24917 - DNA, 20 bp, synthetic construct
  misc_feature 1..20: note = CRISPR gRNA sequence
  source 1..20: mol_type = other DNA
cctaggttttaacagcttta

SEQ ID NO: 24918 - DNA, 20 bp, synthetic construct
  misc_feature 1..20: note = CRISPR gRNA sequence
  source 1..20: mol_type = other DNA
ctaggttttaacagctttat

SEQ ID NO: 24919 - DNA, 20 bp, synthetic construct
  misc_feature 1..20: note = CRISPR gRNA sequence
  source 1..20: mol_type = other DNA
ggttttaacagctttattga

SEQ ID NO: 24920 - DNA, 20 bp, synthetic construct
  misc_feature 1..20: note = CRISPR gRNA sequence
  source 1..20: mol_type = other DNA
taacagctttattgagatgt

SEQ ID NO: 24921 - DNA, 20 bp, synthetic construct
  misc_feature 1..20: note = CRISPR gRNA sequence
  source 1..20: mol_type = other DNA
aacagctttattgagatgta

SEQ ID NO: 24922 - DNA, 20 bp, synthetic construct
  misc_feature 1..20: note = CRISPR gRNA sequence
  source 1..20: mol_type = other DNA
acagctttattgagatgtaa

SEQ ID NO: 24923 - DNA, 20 bp, synthetic construct
  misc_feature 1..20: note = CRISPR gRNA sequence
  source 1..20: mol_type = other DNA
tattgagatgtaattcacat

SEQ ID NO: 24924 - DNA, 20 bp, synthetic construct
  misc_feature 1..20: note = CRISPR gRNA sequence
  source 1..20: mol_type = other DNA
attgagatgtaattcacata

SEQ ID NO: 24925 - DNA, 20 bp, synthetic construct
  misc_feature 1..20: note = CRISPR gRNA sequence
  source 1..20: mol_type = other DNA
ttgagatgtaattcacatat

SEQ ID NO: 24926 - DNA, 20 bp, synthetic construct
  misc_feature 1..20: note = CRISPR gRNA sequence
  source 1..20: mol_type = other DNA
agatgtaattcacatataca

SEQ ID NO: 24927 - DNA, 20 bp, synthetic construct
  misc_feature 1..20: note = CRISPR gRNA sequence
  source 1..20: mol_type = other DNA
acatatacaatttgcccact

SEQ ID NO: 24928 - DNA, 20 bp, synthetic construct
  misc_feature 1..20: note = CRISPR gRNA sequence
  source 1..20: mol_type = other DNA
gcccacttaaaaagtacagt

SEQ ID NO: 24929 - DNA, 20 bp, synthetic construct
  misc_feature 1..20: note = CRISPR gRNA sequence
  source 1..20: mol_type = other DNA
cccacttaaaaagtacagtt

SEQ ID NO: 24930 - DNA, 20 bp, synthetic construct
  misc_feature 1..20: note = CRISPR gRNA sequence
  source 1..20: mol_type = other DNA
aaaaagtacagttcatgcct

SEQ ID NO: 24931 - DNA, 20 bp, synthetic construct
  misc_feature 1..20: note = CRISPR gRNA sequence
  source 1..20: mol_type = other DNA
aaaagtacagttcatgcctg

SEQ ID NO: 24932 - DNA, 20 bp, synthetic construct
  misc_feature 1..20: note = CRISPR gRNA sequence
  source 1..20: mol_type = other DNA
atgcctgtaatcccaacact

SEQ ID NO: 24933 - DNA, 20 bp, synthetic construct
  misc_feature 1..20: note = CRISPR gRNA sequence
  source 1..20: mol_type = other DNA
taatcccaacactttgggag

SEQ ID NO: 24934 - DNA, 20 bp, synthetic construct
  misc_feature 1..20: note = CRISPR gRNA sequence
  source 1..20: mol_type = other DNA
tgggaggccgaggagacagg

SEQ ID NO: 24935 - DNA, 20 bp, synthetic construct
  misc_feature 1..20: note = CRISPR gRNA sequence
  source 1..20: mol_type = other DNA
gggaggccgaggagacaggc

SEQ ID NO: 24936 - DNA, 20 bp, synthetic construct
  misc_feature 1..20: note = CRISPR gRNA sequence
  source 1..20: mol_type = other DNA
ggaggccgaggagacaggcg

SEQ ID NO: 24937 - DNA, 20 bp, synthetic construct
  misc_feature 1..20: note = CRISPR gRNA sequence
  source 1..20: mol_type = other DNA
gaggtcaggagtttgagaac

SEQ ID NO: 24938 - DNA, 20 bp, synthetic construct
  misc_feature 1..20: note = CRISPR gRNA sequence
  source 1..20: mol_type = other DNA
aggtcaggagtttgagaaca

SEQ ID NO: 24939 - DNA, 20 bp, synthetic construct
  misc_feature 1..20: note = CRISPR gRNA sequence
  source 1..20: mol_type = other DNA
gagaacagcctggccaaaat

SEQ ID NO: 24940 - DNA, 20 bp, synthetic construct
  misc_feature 1..20: note = CRISPR gRNA sequence
  source 1..20: mol_type = other DNA
agaacagcctggccaaaatg

SEQ ID NO: 24941 - DNA, 20 bp, synthetic construct
  misc_feature 1..20: note = CRISPR gRNA sequence
  source 1..20: mol_type = other DNA
gccaaaatggtgaaacactg

SEQ ID NO: 24942 - DNA, 20 bp, synthetic construct
  misc_feature 1..20: note = CRISPR gRNA sequence
  source 1..20: mol_type = other DNA
tctctactaaaaatgcaaaa

SEQ ID NO: 24943 - DNA, 20 bp, synthetic construct
  misc_feature 1..20: note = CRISPR gRNA sequence
  source 1..20: mol_type = other DNA
tactaaaaatgcaaaaatta

SEQ ID NO: 24944 - DNA, 20 bp, synthetic construct
  misc_feature 1..20: note = CRISPR gRNA sequence
  source 1..20: mol_type = other DNA
ctaaaaatgcaaaaattagc

SEQ ID NO: 24945 - DNA, 20 bp, synthetic construct
  misc_feature 1..20: note = CRISPR gRNA sequence
  source 1..20: mol_type = other DNA
aaaatgcaaaaattagccgg

SEQ ID NO: 24946 - DNA, 20 bp, synthetic construct
  misc_feature 1..20: note = CRISPR gRNA sequence
  source 1..20: mol_type = other DNA
gccgggtgtggtggtgggtg

SEQ ID NO: 24947 - DNA, 20 bp, synthetic construct
  misc_feature 1..20: note = CRISPR gRNA sequence
  source 1..20: mol_type = other DNA
taatcccagctgctcaggag

SEQ ID NO: 24948 - DNA, 20 bp, synthetic construct
  misc_feature 1..20: note = CRISPR gRNA sequence
  source 1..20: mol_type = other DNA
ctcaggaggctgaggcagaa

SEQ ID NO: 24949 - DNA, 20 bp, synthetic construct
  misc_feature 1..20: note = CRISPR gRNA sequence
  source 1..20: mol_type = other DNA
aggaggctgaggcagaagaa

SEQ ID NO: 24950 - DNA, 20 bp, synthetic construct
  misc_feature 1..20: note = CRISPR gRNA sequence
  source 1..20: mol_type = other DNA
aggcagaagaatggcttgaa

SEQ ID NO: 24951 - DNA, 20 bp, synthetic construct
  misc_feature 1..20: note = CRISPR gRNA sequence
  source 1..20: mol_type = other DNA
gaacctgggaggcagacgtt

SEQ ID NO: 24952 - DNA, 20 bp, synthetic construct
  misc_feature 1..20: note = CRISPR gRNA sequence
  source 1..20: mol_type = other DNA
aacctgggaggcagacgttg

SEQ ID NO: 24953 - DNA, 20 bp, synthetic construct
  misc_feature 1..20: note = CRISPR gRNA sequence
  source 1..20: mol_type = other DNA
ggaggcagacgttgcagtga

SEQ ID NO: 24954 - DNA, 20 bp, synthetic construct
  misc_feature 1..20: note = CRISPR gRNA sequence
  source 1..20: mol_type = other DNA
cagtgagccaagattgcacc

SEQ ID NO: 24955 - DNA, 20 bp, synthetic construct
  misc_feature 1..20: note = CRISPR gRNA sequence
  source 1..20: mol_type = other DNA
cacccctgcactccagcctg

SEQ ID NO: 24956 - DNA, 20 bp, synthetic construct
  misc_feature 1..20: note = CRISPR gRNA sequence
  source 1..20: mol_type = other DNA
cactccagcctgggtgacag

SEQ ID NO: 24957 - DNA, 20 bp, synthetic construct
  misc_feature 1..20: note = CRISPR gRNA sequence
  source 1..20: mol_type = other DNA
cagcctgggtgacagagact

SEQ ID NO: 24958 - DNA, 20 bp, synthetic construct
  misc_feature 1..20: note = CRISPR gRNA sequence
  source 1..20: mol_type = other DNA
ggtgacagagactccgtctt

SEQ ID NO: 24959 - DNA, 20 bp, synthetic construct
  misc_feature 1..20: note = CRISPR gRNA sequence
  source 1..20: mol_type = other DNA
cgtcttaaaaaaaaaaaaaa

SEQ ID NO: 24960 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 24961 - DNA, 20 bp, synthetic construct
  misc_feature 1..20: note = CRISPR gRNA sequence
  source 1..20: mol_type = other DNA
aaaaaaaaaaaaaaaaaaaa

SEQ ID NO: 24962 - DNA, 20 bp, synthetic construct
  misc_feature 1..20: note = CRISPR gRNA sequence
  source 1..20: mol_type = other DNA
agtgttcttttgggaatact

SEQ ID NO: 24963 - DNA, 20 bp, synthetic construct
  misc_feature 1..20: note = CRISPR gRNA sequence
  source 1..20: mol_type = other DNA
ttttgggaatactcagagag

SEQ ID NO: 24964 - DNA, 20 bp, synthetic construct
  misc_feature 1..20: note = CRISPR gRNA sequence
  source 1..20: mol_type = other DNA
ttgggaatactcagagagtt

SEQ ID NO: 24965 - DNA, 20 bp, synthetic construct
  misc_feature 1..20: note = CRISPR gRNA sequence
  source 1..20: mol_type = other DNA
tgggaatactcagagagttg

SEQ ID NO: 24966 - DNA, 20 bp, synthetic construct
  misc_feature 1..20: note = CRISPR gRNA sequence
  source 1..20: mol_type = other DNA
gggaatactcagagagttgt

SEQ ID NO: 24967 - DNA, 20 bp, synthetic construct
  misc_feature 1..20: note = CRISPR gRNA sequence
  source 1..20: mol_type = other DNA
ggaatactcagagagttgtg

SEQ ID NO: 24968 - DNA, 20 bp, synthetic construct
  misc_feature 1..20: note = CRISPR gRNA sequence
  source 1..20: mol_type = other DNA
agagagttgtgtgaccatct

SEQ ID NO: 24969 - DNA, 20 bp, synthetic construct
  misc_feature 1..20: note = CRISPR gRNA sequence
  source 1..20: mol_type = other DNA
tgtgaccatctcccatcccc

SEQ ID NO: 24970 - DNA, 20 bp, synthetic construct
  misc_feature 1..20: note = CRISPR gRNA sequence
  source 1..20: mol_type = other DNA
ccatccccacagtcaatttt

SEQ ID NO: 24971 - DNA, 20 bp, synthetic construct
  misc_feature 1..20: note = CRISPR gRNA sequence
  source 1..20: mol_type = other DNA
tagcacatttcatcaccccc

SEQ ID NO: 24972 - DNA, 20 bp, synthetic construct
  misc_feature 1..20: note = CRISPR gRNA sequence
  source 1..20: mol_type = other DNA
agcacatttcatcaccccct

SEQ ID NO: 24973 - DNA, 20 bp, synthetic construct
  misc_feature 1..20: note = CRISPR gRNA sequence
  source 1..20: mol_type = other DNA
gcacatttcatcacccccta

SEQ ID NO: 24974 - DNA, 20 bp, synthetic construct
  misc_feature 1..20: note = CRISPR gRNA sequence
  source 1..20: mol_type = other DNA
catcaccccctaaagaaact

SEQ ID NO: 24975 - DNA, 20 bp, synthetic construct
  misc_feature 1..20: note = CRISPR gRNA sequence
  source 1..20: mol_type = other DNA
atcaccccctaaagaaactc

SEQ ID NO: 24976 - DNA, 20 bp, synthetic construct
  misc_feature 1..20: note = CRISPR gRNA sequence
  source 1..20: mol_type = other DNA
aagaaactccagacccatca

SEQ ID NO: 24977 - DNA, 20 bp, synthetic construct
  misc_feature 1..20: note = CRISPR gRNA sequence
  source 1..20: mol_type = other DNA
cagacccatcagcagttgtt

SEQ ID NO: 24978 - DNA, 20 bp, synthetic construct
  misc_feature 1..20: note = CRISPR gRNA sequence
  source 1..20: mol_type = other DNA
ttccccatttccttccaaaa

SEQ ID NO: 24979 - DNA, 20 bp, synthetic construct
  misc_feature 1..20: note = CRISPR gRNA sequence
  source 1..20: mol_type = other DNA
cccatttccttccaaaatcc

SEQ ID NO: 24980 - DNA, 20 bp, synthetic construct
  misc_feature 1..20: note = CRISPR gRNA sequence
  source 1..20: mol_type = other DNA
ccttccaaaatccctctctg

SEQ ID NO: 24981 - DNA, 20 bp, synthetic construct
  misc_feature 1..20: note = CRISPR gRNA sequence
  source 1..20: mol_type = other DNA
cttccaaaatccctctctgc

SEQ ID NO: 24982 - DNA, 20 bp, synthetic construct
  misc_feature 1..20: note = CRISPR gRNA sequence
  source 1..20: mol_type = other DNA
ccaaaatccctctctgccaa

SEQ ID NO: 24983 - DNA, 20 bp, synthetic construct
  misc_feature 1..20: note = CRISPR gRNA sequence
  source 1..20: mol_type = other DNA
caaaatccctctctgccaag

SEQ ID NO: 24984 - DNA, 20 bp, synthetic construct
  misc_feature 1..20: note = CRISPR gRNA sequence
  source 1..20: mol_type = other DNA
tctgccaagccctaggcaac

SEQ ID NO: 24985 - DNA, 20 bp, synthetic construct
  misc_feature 1..20: note = CRISPR gRNA sequence
  source 1..20: mol_type = other DNA
tgccaagccctaggcaacca

SEQ ID NO: 24986 - DNA, 20 bp, synthetic construct
  misc_feature 1..20: note = CRISPR gRNA sequence
  source 1..20: mol_type = other DNA
ccaagccctaggcaaccact

SEQ ID NO: 24987 - DNA, 20 bp, synthetic construct
  misc_feature 1..20: note = CRISPR gRNA sequence
  source 1..20: mol_type = other DNA
ggcaaccactaatatgcttt

SEQ ID NO: 24988 - DNA, 20 bp, synthetic construct
  misc_feature 1..20: note = CRISPR gRNA sequence
  source 1..20: mol_type = other DNA
atatgctttctttcttaaaa

SEQ ID NO: 24989 - DNA, 20 bp, synthetic construct
  misc_feature 1..20: note = CRISPR gRNA sequence
  source 1..20: mol_type = other DNA
tctttcttaaaaaaaaatta

SEQ ID NO: 24990 - DNA, 20 bp, synthetic construct
  misc_feature 1..20: note = CRISPR gRNA sequence
  source 1..20: mol_type = other DNA
ctttcttaaaaaaaaattaa

SEQ ID NO: 24991 - DNA, 20 bp, synthetic construct
  misc_feature 1..20: note = CRISPR gRNA sequence
  source 1..20: mol_type = other DNA
tttcttaaaaaaaaattaat

SEQ ID NO: 24992 - DNA, 20 bp, synthetic construct
  misc_feature 1..20: note = CRISPR gRNA sequence
  source 1..20: mol_type = other DNA
tcttaaaaaaaaattaatag

SEQ ID NO: 24993 - DNA, 20 bp, synthetic construct
  misc_feature 1..20: note = CRISPR gRNA sequence
  source 1..20: mol_type = other DNA
cttaaaaaaaaattaataga

SEQ ID NO: 24994 - DNA, 20 bp, synthetic construct
  misc_feature 1..20: note = CRISPR gRNA sequence
  source 1..20: mol_type = other DNA
ttaaaaaaaaattaatagag

SEQ ID NO: 24995 - DNA, 20 bp, synthetic construct
  misc_feature 1..20: note = CRISPR gRNA sequence
  source 1..20: mol_type = other DNA
aaaaaaaaattaatagagat

SEQ ID NO: 24996 - DNA, 20 bp, synthetic construct
  misc_feature 1..20: note = CRISPR gRNA sequence
  source 1..20: mol_type = other DNA
aaaaaaaattaatagagata

SEQ ID NO: 24997 - DNA, 20 bp, synthetic construct
  misc_feature 1..20: note = CRISPR gRNA sequence
  source 1..20: mol_type = other DNA
atagagataggcttttgcta

SEQ ID NO: 24998 - DNA, 20 bp, synthetic construct
  misc_feature 1..20: note = CRISPR gRNA sequence
  source 1..20: mol_type = other DNA
ttgctatgttgcccaggctg

SEQ ID NO: 24999 - DNA, 20 bp, synthetic construct
  misc_feature 1..20: note = CRISPR gRNA sequence
  source 1..20: mol_type = other DNA
tgctatgttgcccaggctgg

SEQ ID NO: 25000 - DNA, 20 bp, synthetic construct
  misc_feature 1..20: note = CRISPR gRNA sequence
  source 1..20: mol_type = other DNA
gctatgttgcccaggctggt

SEQ ID NO: 25001 - DNA, 20 bp, synthetic construct
  misc_feature 1..20: note = CRISPR gRNA sequence
  source 1..20: mol_type = other DNA
ctatgttgcccaggctggtc

SEQ ID NO: 25002 - DNA, 20 bp, synthetic construct
  misc_feature 1..20: note = CRISPR gRNA sequence
  source 1..20: mol_type = other DNA
tgttgcccaggctggtcttg

SEQ ID NO: 25003 - DNA, 20 bp, synthetic construct
  misc_feature 1..20: note = CRISPR gRNA sequence
  source 1..20: mol_type = other DNA
cccaggctggtcttgaacac

SEQ ID NO: 25004 - DNA, 20 bp, synthetic construct
  misc_feature 1..20: note = CRISPR gRNA sequence
  source 1..20: mol_type = other DNA
gtcttgaacacctgggctca

SEQ ID NO: 25005 - DNA, 20 bp, synthetic construct
  misc_feature 1..20: note = CRISPR gRNA sequence
  source 1..20: mol_type = other DNA
gaacacctgggctcaagcga

SEQ ID NO: 25006 - DNA, 20 bp, synthetic construct
  misc_feature 1..20: note = CRISPR gRNA sequence
  source 1..20: mol_type = other DNA
aacacctgggctcaagcgat

SEQ ID NO: 25007 - DNA, 20 bp, synthetic construct
  misc_feature 1..20: note = CRISPR gRNA sequence
  source 1..20: mol_type = other DNA
ggctcaagcgattctcctgt

SEQ ID NO: 25008 - DNA, 20 bp, synthetic construct
  misc_feature 1..20: note = CRISPR gRNA sequence
  source 1..20: mol_type = other DNA
aagcgattctcctgtctcag

SEQ ID NO: 25009 - DNA, 20 bp, synthetic construct
  misc_feature 1..20: note = CRISPR gRNA sequence
  source 1..20: mol_type = other DNA
tcctgtctcagcctcccaaa

SEQ ID NO: 25010 - DNA, 20 bp, synthetic construct
  misc_feature 1..20: note = CRISPR gRNA sequence
  source 1..20: mol_type = other DNA
ctgtctcagcctcccaaagt

SEQ ID NO: 25011 - DNA, 20 bp, synthetic construct
  misc_feature 1..20: note = CRISPR gRNA sequence
  source 1..20: mol_type = other DNA
tctcagcctcccaaagtgct

SEQ ID NO: 25012 - DNA, 20 bp, synthetic construct
  misc_feature 1..20: note = CRISPR gRNA sequence
  source 1..20: mol_type = other DNA
agcctcccaaagtgctggga

SEQ ID NO: 25013 - DNA, 20 bp, synthetic construct
  misc_feature 1..20: note = CRISPR gRNA sequence
  source 1..20: mol_type = other DNA
ccaaagtgctgggatttcag

SEQ ID NO: 25014 - DNA, 20 bp, synthetic construct
  misc_feature 1..20: note = CRISPR gRNA sequence
  source 1..20: mol_type = other DNA
ggatttcaggcatgagccac

SEQ ID NO: 25015 - DNA, 20 bp, synthetic construct
  misc_feature 1..20: note = CRISPR gRNA sequence
  source 1..20: mol_type = other DNA
caggcatgagccaccacgcc

SEQ ID NO: 25016 - DNA, 20 bp, synthetic construct
  misc_feature 1..20: note = CRISPR gRNA sequence
  source 1..20: mol_type = other DNA
aggcatgagccaccacgccc

SEQ ID NO: 25017 - DNA, 20 bp, synthetic construct
  misc_feature 1..20: note = CRISPR gRNA sequence
  source 1..20: mol_type = other DNA
ctactttatgtctccatgga

SEQ ID NO: 25018 - DNA, 20 bp, synthetic construct
  misc_feature 1..20: note = CRISPR gRNA sequence
  source 1..20: mol_type = other DNA
ctttatgtctccatggattt

SEQ ID NO: 25019 - DNA, 20 bp, synthetic construct
  misc_feature 1..20: note = CRISPR gRNA sequence
  source 1..20: mol_type = other DNA
tatgtctccatggatttgcc

SEQ ID NO: 25020 - DNA, 20 bp, synthetic construct
  misc_feature 1..20: note = CRISPR gRNA sequence
  source 1..20: mol_type = other DNA
atgtctccatggatttgcct

SEQ ID NO: 25021 - DNA, 20 bp, synthetic construct
  misc_feature 1..20: note = CRISPR gRNA sequence
  source 1..20: mol_type = other DNA
tgtctccatggatttgcctg

SEQ ID NO: 25022 - DNA, 20 bp, synthetic construct
  misc_feature 1..20: note = CRISPR gRNA sequence
  source 1..20: mol_type = other DNA
catggatttgcctgttttgg

SEQ ID NO: 25023 - DNA, 20 bp, synthetic construct
  misc_feature 1..20: note = CRISPR gRNA sequence
  source 1..20: mol_type = other DNA
gcctgttttggtcatttcaa

SEQ ID NO: 25024 - DNA, 20 bp, synthetic construct
  misc_feature 1..20: note = CRISPR gRNA sequence
  source 1..20: mol_type = other DNA
cctgttttggtcatttcaaa

SEQ ID NO: 25025 - DNA, 20 bp, synthetic construct
  misc_feature 1..20: note = CRISPR gRNA sequence
  source 1..20: mol_type = other DNA
ttttggtcatttcaaataaa

SEQ ID NO: 25026 - DNA, 20 bp, synthetic construct
  misc_feature 1..20: note = CRISPR gRNA sequence
  source 1..20: mol_type = other DNA
tggtcatttcaaataaatag

SEQ ID NO: 25027 - DNA, 20 bp, synthetic construct
  misc_feature 1..20: note = CRISPR gRNA sequence
  source 1..20: mol_type = other DNA
ggtcatttcaaataaataga

SEQ ID NO: 25028 - DNA, 20 bp, synthetic construct
  misc_feature 1..20: note = CRISPR gRNA sequence
  source 1..20: mol_type = other DNA
gtcatttcaaataaatagaa

SEQ ID NO: 25029 - DNA, 20 bp, synthetic construct
  misc_feature 1..20: note = CRISPR gRNA sequence
  source 1..20: mol_type = other DNA
caaataaatagaatcataca

SEQ ID NO: 25030 - DNA, 20 bp, synthetic construct
  misc_feature 1..20: note = CRISPR gRNA sequence
  source 1..20: mol_type = other DNA
aaataaatagaatcatacaa

SEQ ID NO: 25031 - DNA, 20 bp, synthetic construct
  misc_feature 1..20: note = CRISPR gRNA sequence
  source 1..20: mol_type = other DNA
tgtgtccggcttcttcactt

SEQ ID NO: 25032 - DNA, 20 bp, synthetic construct
  misc_feature 1..20: note = CRISPR gRNA sequence
  source 1..20: mol_type = other DNA
gtgtccggcttcttcactta

SEQ ID NO: 25033 - DNA, 20 bp, synthetic construct
  misc_feature 1..20: note = CRISPR gRNA sequence
  source 1..20: mol_type = other DNA
tgtccggcttcttcacttag

SEQ ID NO: 25034 - DNA, 20 bp, synthetic construct
  misc_feature 1..20: note = CRISPR gRNA sequence
  source 1..20: mol_type = other DNA
cttcacttagcatttttttt

SEQ ID NO: 25035 - DNA, 20 bp, synthetic construct
  misc_feature 1..20: note = CRISPR gRNA sequence
  source 1..20: mol_type = other DNA
ttcacttagcatttttttta

SEQ ID NO: 25036 - DNA, 20 bp, synthetic construct
  misc_feature 1..20: note = CRISPR gRNA sequence
  source 1..20: mol_type = other DNA
cacttagcattttttttaag

SEQ ID NO: 25037 - DNA, 20 bp, synthetic construct
  misc_feature 1..20: note = CRISPR gRNA sequence
  source 1..20: mol_type = other DNA
acttagcattttttttaagg

SEQ ID NO: 25038 - DNA, 20 bp, synthetic construct
  misc_feature 1..20: note = CRISPR gRNA sequence
  source 1..20: mol_type = other DNA
agcattttttttaaggttca

SEQ ID NO: 25039 - DNA, 20 bp, synthetic construct
  misc_feature 1..20: note = CRISPR gRNA sequence
  source 1..20: mol_type = other DNA
gcattttttttaaggttcat

SEQ ID NO: 25040 - DNA, 20 bp, synthetic construct
  misc_feature 1..20: note = CRISPR gRNA sequence
  source 1..20: mol_type = other DNA
tttttaaggttcatccatgt

SEQ ID NO: 25041 - DNA, 20 bp, synthetic construct
  misc_feature 1..20: note = CRISPR gRNA sequence
  source 1..20: mol_type = other DNA
ttttaaggttcatccatgtt

SEQ ID NO: 25042 - DNA, 20 bp, synthetic construct
  misc_feature 1..20: note = CRISPR gRNA sequence
  source 1..20: mol_type = other DNA
tttaaggttcatccatgttc

SEQ ID NO: 25043 - DNA, 20 bp, synthetic construct
  misc_feature 1..20: note = CRISPR gRNA sequence
  source 1..20: mol_type = other DNA
ttaaggttcatccatgttcc

SEQ ID NO: 25044 - DNA, 20 bp, synthetic construct
  misc_feature 1..20: note = CRISPR gRNA sequence
  source 1..20: mol_type = other DNA
taaggttcatccatgttcca

SEQ ID NO: 25045 - DNA, 20 bp, synthetic construct
  misc_feature 1..20: note = CRISPR gRNA sequence
  source 1..20: mol_type = other DNA
aaggttcatccatgttccag

SEQ ID NO: 25046 - DNA, 20 bp, synthetic construct
  misc_feature 1..20: note = CRISPR gRNA sequence
  source 1..20: mol_type = other DNA
aggttcatccatgttccagc

SEQ ID NO: 25047 - DNA, 20 bp, synthetic construct
  misc_feature 1..20: note = CRISPR gRNA sequence
  source 1..20: mol_type = other DNA
atccatgttccagcatgtat

SEQ ID NO: 25048 - DNA, 20 bp, synthetic construct
  misc_feature 1..20: note = CRISPR gRNA sequence
  source 1..20: mol_type = other DNA
cagcatgtatcagtgctttc

SEQ ID NO: 25049 - DNA, 20 bp, synthetic construct
  misc_feature 1..20: note = CRISPR gRNA sequence
  source 1..20: mol_type = other DNA
tctccctttaatggtggaat

SEQ ID NO: 25050 - DNA, 20 bp, synthetic construct
  misc_feature 1..20: note = CRISPR gRNA sequence
  source 1..20: mol_type = other DNA
ctccctttaatggtggaata

SEQ ID NO: 25051 - DNA, 20 bp, synthetic construct
  misc_feature 1..20: note = CRISPR gRNA sequence
  source 1..20: mol_type = other DNA
tccctttaatggtggaatac

SEQ ID NO: 25052 - DNA, 20 bp, synthetic construct
  misc_feature 1..20: note = CRISPR gRNA sequence
  source 1..20: mol_type = other DNA
cctttaatggtggaatactt

SEQ ID NO: 25053 - DNA, 20 bp, synthetic construct
  misc_feature 1..20: note = CRISPR gRNA sequence
  source 1..20: mol_type = other DNA
taatggtggaatactttatt

SEQ ID NO: 25054 - DNA, 20 bp, synthetic construct
  misc_feature 1..20: note = CRISPR gRNA sequence
  source 1..20: mol_type = other DNA
aatggtggaatactttattg

SEQ ID NO: 25055 - DNA, 20 bp, synthetic construct
  misc_feature 1..20: note = CRISPR gRNA sequence
  source 1..20: mol_type = other DNA
atggtggaatactttattgt

SEQ ID NO: 25056 - DNA, 20 bp, synthetic construct
  misc_feature 1..20: note = CRISPR gRNA sequence
  source 1..20: mol_type = other DNA
tattgtatagataagcaaca

SEQ ID NO: 25057 - DNA, 20 bp, synthetic construct
  misc_feature 1..20: note = CRISPR gRNA sequence
  source 1..20: mol_type = other DNA
attgtatagataagcaacat

SEQ ID NO: 25058 - DNA, 20 bp, synthetic construct
  misc_feature 1..20: note = CRISPR gRNA sequence
  source 1..20: mol_type = other DNA
ttgtatagataagcaacatt

SEQ ID NO: 25059 - DNA, 20 bp, synthetic construct
  misc_feature 1..20: note = CRISPR gRNA sequence
  source 1..20: mol_type = other DNA
tatagataagcaacattttg

SEQ ID NO: 25060 - DNA, 20 bp, synthetic construct
  misc_feature 1..20: note = CRISPR gRNA sequence
  source 1..20: mol_type = other DNA
tgtttatccatttatttttt

SEQ ID NO: 25061 - DNA, 20 bp, synthetic construct
  misc_feature 1..20: note = CRISPR gRNA sequence
  source 1..20: mol_type = other DNA
gtttatccatttattttttg

SEQ ID NO: 25062 - DNA, 20 bp, synthetic construct
  misc_feature 1..20: note = CRISPR gRNA sequence
  source 1..20: mol_type = other DNA
tttatccatttattttttgg

SEQ ID NO: 25063 - DNA, 20 bp, synthetic construct
  misc_feature 1..20: note = CRISPR gRNA sequence
  source 1..20: mol_type = other DNA
atccatttattttttggtgg

SEQ ID NO: 25064 - DNA, 20 bp, synthetic construct
  misc_feature 1..20: note = CRISPR gRNA sequence
  source 1..20: mol_type = other DNA
tccatttattttttggtgga

SEQ ID NO: 25065 - DNA, 20 bp, synthetic construct
  misc_feature 1..20: note = CRISPR gRNA sequence
  source 1..20: mol_type = other DNA
attttttggtggatatttgg

SEQ ID NO: 25066 - DNA, 20 bp, synthetic construct
  misc_feature 1..20: note = CRISPR gRNA sequence
  source 1..20: mol_type = other DNA
ttttttggtggatatttggg

SEQ ID NO: 25067 - DNA, 20 bp, synthetic construct
  misc_feature 1..20: note = CRISPR gRNA sequence
  source 1..20: mol_type = other DNA
tttggtggatatttgggctg

SEQ ID NO: 25068 - DNA, 20 bp, synthetic construct
  misc_feature 1..20: note = CRISPR gRNA sequence
  source 1..20: mol_type = other DNA
ttggtggatatttgggctgt

SEQ ID NO: 25069 - DNA, 20 bp, synthetic construct
  misc_feature 1..20: note = CRISPR gRNA sequence
  source 1..20: mol_type = other DNA
tggtggatatttgggctgtt

SEQ ID NO: 25070 - DNA, 20 bp, synthetic construct
  misc_feature 1..20: note = CRISPR gRNA sequence
  source 1..20: mol_type = other DNA
ggtggatatttgggctgttt

SEQ ID NO: 25071 - DNA, 20 bp, synthetic construct
  misc_feature 1..20: note = CRISPR gRNA sequence
  source 1..20: mol_type = other DNA
gtggatatttgggctgtttt

SEQ ID NO: 25072 - DNA, 20 bp, synthetic construct
  misc_feature 1..20: note = CRISPR gRNA sequence
  source 1..20: mol_type = other DNA
gggctgtttttatattttgg

SEQ ID NO: 25073 - DNA, 20 bp, synthetic construct
  misc_feature 1..20: note = CRISPR gRNA sequence
  source 1..20: mol_type = other DNA
ggctgtttttatattttggc

SEQ ID NO: 25074 - DNA, 20 bp, synthetic construct
  misc_feature 1..20: note = CRISPR gRNA sequence
  source 1..20: mol_type = other DNA
tttttatattttggctattt

SEQ ID NO: 25075 - DNA, 20 bp, synthetic construct
  misc_feature 1..20: note = CRISPR gRNA sequence
  source 1..20: mol_type = other DNA
ttatattttggctattttga

SEQ ID NO: 25076 - DNA, 20 bp, synthetic construct
  misc_feature 1..20: note = CRISPR gRNA sequence
  source 1..20: mol_type = other DNA
tatattttggctattttgaa

SEQ ID NO: 25077 - DNA, 20 bp, synthetic construct
  misc_feature 1..20: note = CRISPR gRNA sequence
  source 1..20: mol_type = other DNA
atattttggctattttgaat

SEQ ID NO: 25078 - DNA, 20 bp, synthetic construct
  misc_feature 1..20: note = CRISPR gRNA sequence
  source 1..20: mol_type = other DNA
tattttggctattttgaatt

SEQ ID NO: 25079 - DNA, 20 bp, synthetic construct
  misc_feature 1..20: note = CRISPR gRNA sequence
  source 1..20: mol_type = other DNA
tggctattttgaattatcct

SEQ ID NO: 25080 - DNA, 20 bp, synthetic construct
  misc_feature 1..20: note = CRISPR gRNA sequence
  source 1..20: mol_type = other DNA
ggctattttgaattatcctt

SEQ ID NO: 25081 - DNA, 20 bp, synthetic construct
  misc_feature 1..20: note = CRISPR gRNA sequence
  source 1..20: mol_type = other DNA
gctattttgaattatccttc

SEQ ID NO: 25082 - DNA, 20 bp, synthetic construct
  misc_feature 1..20: note = CRISPR gRNA sequence
  source 1..20: mol_type = other DNA
ttttgaattatccttctgtg

SEQ ID NO: 25083 - DNA, 20 bp, synthetic construct
  misc_feature 1..20: note = CRISPR gRNA sequence
  source 1..20: mol_type = other DNA
tgaattatccttctgtgaac

SEQ ID NO: 25084 - DNA, 20 bp, synthetic construct
  misc_feature 1..20: note = CRISPR gRNA sequence
  source 1..20: mol_type = other DNA
gaattatccttctgtgaaca

SEQ ID NO: 25085 - DNA, 20 bp, synthetic construct
  misc_feature 1..20: note = CRISPR gRNA sequence
  source 1..20: mol_type = other DNA
aattatccttctgtgaacat

SEQ ID NO: 25086 - DNA, 20 bp, synthetic construct
  misc_feature 1..20: note = CRISPR gRNA sequence
  source 1..20: mol_type = other DNA
tccttctgtgaacattcgtg

SEQ ID NO: 25087 - DNA, 20 bp, synthetic construct
  misc_feature 1..20: note = CRISPR gRNA sequence
  source 1..20: mol_type = other DNA
ctgtgaacattcgtgtatag

SEQ ID NO: 25088 - DNA, 20 bp, synthetic construct
  misc_feature 1..20: note = CRISPR gRNA sequence
  source 1..20: mol_type = other DNA
tgtgaacattcgtgtatagg

SEQ ID NO: 25089 - DNA, 20 bp, synthetic construct
  misc_feature 1..20: note = CRISPR gRNA sequence
  source 1..20: mol_type = other DNA
tgaacattcgtgtataggtt

SEQ ID NO: 25090 - DNA, 20 bp, synthetic construct
  misc_feature 1..20: note = CRISPR gRNA sequence
  source 1..20: mol_type = other DNA
gtgtataggtttttgtgtgg

SEQ ID NO: 25091 - DNA, 20 bp, synthetic construct
  misc_feature 1..20: note = CRISPR gRNA sequence
  source 1..20: mol_type = other DNA
ttgtgtggatatatctggtt

SEQ ID NO: 25092 - DNA, 20 bp, synthetic construct
  misc_feature 1..20: note = CRISPR gRNA sequence
  source 1..20: mol_type = other DNA
tgtgtggatatatctggttt

SEQ ID NO: 25093 - DNA, 20 bp, synthetic construct
  misc_feature 1..20: note = CRISPR gRNA sequence
  source 1..20: mol_type = other DNA
gtgtggatatatctggtttt

SEQ ID NO: 25094 - DNA, 20 bp, synthetic construct
  misc_feature 1..20: note = CRISPR gRNA sequence
  source 1..20: mol_type = other DNA
tgtggatatatctggttttt

SEQ ID NO: 25095 - DNA, 20 bp, synthetic construct
  misc_feature 1..20: note = CRISPR gRNA sequence
  source 1..20: mol_type = other DNA
gtttttcttgttttcttttg

SEQ ID NO: 25096 - DNA, 20 bp, synthetic construct
  misc_feature 1..20: note = CRISPR gRNA sequence
  source 1..20: mol_type = other DNA
ttcttgttttcttttgtttt

SEQ ID NO: 25097 - DNA, 20 bp, synthetic construct
  misc_feature 1..20: note = CRISPR gRNA sequence
  source 1..20: mol_type = other DNA
tcttgttttcttttgtttta

SEQ ID NO: 25098 - DNA, 20 bp, synthetic construct
  misc_feature 1..20: note = CRISPR gRNA sequence
  source 1..20: mol_type = other DNA
cttgttttcttttgttttat

SEQ ID NO: 25099 - DNA, 20 bp, synthetic construct
  misc_feature 1..20: note = CRISPR gRNA sequence
  source 1..20: mol_type = other DNA
ttgttttcttttgttttatt

SEQ ID NO: 25100 - DNA, 20 bp, synthetic construct
  misc_feature 1..20: note = CRISPR gRNA sequence
  source 1..20: mol_type = other DNA
gttttcttttgttttattaa

SEQ ID NO: 25101 - DNA, 20 bp, synthetic construct
  misc_feature 1..20: note = CRISPR gRNA sequence
  source 1..20: mol_type = other DNA
ttttcttttgttttattaat

SEQ ID NO: 25102 - DNA, 20 bp, synthetic construct
  misc_feature 1..20: note = CRISPR gRNA sequence
  source 1..20: mol_type = other DNA
tcttttgttttattaataca

SEQ ID NO: 25103 - DNA, 20 bp, synthetic construct
  misc_feature 1..20: note = CRISPR gRNA sequence
  source 1..20: mol_type = other DNA
cttttgttttattaatacat

SEQ ID NO: 25104 - DNA, 20 bp, synthetic construct
  misc_feature 1..20: note = CRISPR gRNA sequence
  source 1..20: mol_type = other DNA
ttttgttttattaatacata

SEQ ID NO: 25105 - DNA, 20 bp, synthetic construct
  misc_feature 1..20: note = CRISPR gRNA sequence
  source 1..20: mol_type = other DNA
ttgttttattaatacataat

SEQ ID NO: 25106 - DNA, 20 bp, synthetic construct
  misc_feature 1..20: note = CRISPR gRNA sequence
  source 1..20: mol_type = other DNA
tgttttattaatacataata

SEQ ID NO: 25107 - DNA, 20 bp, synthetic construct
  misc_feature 1..20: note = CRISPR gRNA sequence
  source 1..20: mol_type = other DNA
gttttattaatacataatat

SEQ ID NO: 25108 - DNA, 20 bp, synthetic construct
  misc_feature 1..20: note = CRISPR gRNA sequence
  source 1..20: mol_type = other DNA
ttttattaatacataatatg

SEQ ID NO: 25109 - DNA, 20 bp, synthetic construct
  misc_feature 1..20: note = CRISPR gRNA sequence
  source 1..20: mol_type = other DNA
tattaatacataatatgata

SEQ ID NO: 25110 - DNA, 20 bp, synthetic construct
  misc_feature 1..20: note = CRISPR gRNA sequence
  source 1..20: mol_type = other DNA
attaatacataatatgatac

SEQ ID NO: 25111 - DNA, 20 bp, synthetic construct
  misc_feature 1..20: note = CRISPR gRNA sequence
  source 1..20: mol_type = other DNA
ttaatacataatatgataca

SEQ ID NO: 25112 - DNA, 20 bp, synthetic construct
  misc_feature 1..20: note = CRISPR gRNA sequence
  source 1..20: mol_type = other DNA
atacataatatgatacatat

SEQ ID NO: 25113 - DNA, 20 bp, synthetic construct
  misc_feature 1..20: note = CRISPR gRNA sequence
  source 1..20: mol_type = other DNA
atggggtatatgtgaatatt

SEQ ID NO: 25114 - DNA, 20 bp, synthetic construct
  misc_feature 1..20: note = CRISPR gRNA sequence
  source 1..20: mol_type = other DNA
tggggtatatgtgaatattt

SEQ ID NO: 25115 - DNA, 20 bp, synthetic construct
  misc_feature 1..20: note = CRISPR gRNA sequence
  source 1..20: mol_type = other DNA
attacatgcatagaaggtat

SEQ ID NO: 25116 - DNA, 20 bp, synthetic construct
  misc_feature 1..20: note = CRISPR gRNA sequence
  source 1..20: mol_type = other DNA
ttacatgcatagaaggtata

SEQ ID NO: 25117 - DNA, 20 bp, synthetic construct
  misc_feature 1..20: note = CRISPR gRNA sequence
  source 1..20: mol_type = other DNA
catgcatagaaggtataatg

SEQ ID NO: 25118 - DNA, 20 bp, synthetic construct
  misc_feature 1..20: note = CRISPR gRNA sequence
  source 1..20: mol_type = other DNA
gaggtatccacatttgggat

SEQ ID NO: 25119 - DNA, 20 bp, synthetic construct
  misc_feature 1..20: note = CRISPR gRNA sequence
  source 1..20: mol_type = other DNA
aggtatccacatttgggatt

SEQ ID NO: 25120 - DNA, 20 bp, synthetic construct
  misc_feature 1..20: note = CRISPR gRNA sequence
  source 1..20: mol_type = other DNA
gggattgtttaaagattaaa

SEQ ID NO: 25121 - DNA, 20 bp, synthetic construct
  misc_feature 1..20: note = CRISPR gRNA sequence
  source 1..20: mol_type = other DNA
ggattgtttaaagattaaat

SEQ ID NO: 25122 - DNA, 20 bp, synthetic construct
  misc_feature 1..20: note = CRISPR gRNA sequence
  source 1..20: mol_type = other DNA
tttaaagattaaatgaaata

SEQ ID NO: 25123 - DNA, 20 bp, synthetic construct
  misc_feature 1..20: note = CRISPR gRNA sequence
  source 1..20: mol_type = other DNA
aaagattaaatgaaatagtg

SEQ ID NO: 25124 - DNA, 20 bp, synthetic construct
  misc_feature 1..20: note = CRISPR gRNA sequence
  source 1..20: mol_type = other DNA
aagattaaatgaaatagtgt

SEQ ID NO: 25125 - DNA, 20 bp, synthetic construct
  misc_feature 1..20: note = CRISPR gRNA sequence
  source 1..20: mol_type = other DNA
aatgaaatagtgttaaaagt

SEQ ID NO: 25126 - DNA, 20 bp, synthetic construct
  misc_feature 1..20: note = CRISPR gRNA sequence
  source 1..20: mol_type = other DNA
aaagtatttaatatgccctt

SEQ ID NO: 25127 - DNA, 20 bp, synthetic construct
  misc_feature 1..20: note = CRISPR gRNA sequence
  source 1..20: mol_type = other DNA
aatatgcccttcaacaaatg

SEQ ID NO: 25128 - DNA, 20 bp, synthetic construct
  misc_feature 1..20: note = CRISPR gRNA sequence
  source 1..20: mol_type = other DNA
atatgcccttcaacaaatga

SEQ ID NO: 25129 - DNA, 20 bp, synthetic construct
  misc_feature 1..20: note = CRISPR gRNA sequence
  source 1..20: mol_type = other DNA
caacaaatgatgaggaaatc

SEQ ID NO: 25130 - DNA, 20 bp, synthetic construct
  misc_feature 1..20: note = CRISPR gRNA sequence
  source 1..20: mol_type = other DNA
aacaaatgatgaggaaatct

SEQ ID NO: 25131 - DNA, 20 bp, synthetic construct
  misc_feature 1..20: note = CRISPR gRNA sequence
  source 1..20: mol_type = other DNA
agaatctgctcagactcctt

SEQ ID NO: 25132 - DNA, 20 bp, synthetic construct
  misc_feature 1..20: note = CRISPR gRNA sequence
  source 1..20: mol_type = other DNA
gaatctgctcagactccttc

SEQ ID NO: 25133 - DNA, 20 bp, synthetic construct
  misc_feature 1..20: note = CRISPR gRNA sequence
  source 1..20: mol_type = other DNA
ctcagactccttcagtttac

SEQ ID NO: 25134 - DNA, 20 bp, synthetic construct
  misc_feature 1..20: note = CRISPR gRNA sequence
  source 1..20: mol_type = other DNA
agactccttcagtttacata

SEQ ID NO: 25135 - DNA, 20 bp, synthetic construct
  misc_feature 1..20: note = CRISPR gRNA sequence
  source 1..20: mol_type = other DNA
cttcagtttacatattagga

SEQ ID NO: 25136 - DNA, 20 bp, synthetic construct
  misc_feature 1..20: note = CRISPR gRNA sequence
  source 1..20: mol_type = other DNA
cagtttacatattaggaaac

SEQ ID NO: 25137 - DNA, 20 bp, synthetic construct
  misc_feature 1..20: note = CRISPR gRNA sequence
  source 1..20: mol_type = other DNA
agtttacatattaggaaact

SEQ ID NO: 25138 - DNA, 20 bp, synthetic construct
  misc_feature 1..20: note = CRISPR gRNA sequence
  source 1..20: mol_type = other DNA
acatattaggaaactgaggc

SEQ ID NO: 25139 - DNA, 20 bp, synthetic construct
  misc_feature 1..20: note = CRISPR gRNA sequence
  source 1..20: mol_type = other DNA
catattaggaaactgaggca

SEQ ID NO: 25140 - DNA, 20 bp, synthetic construct
  misc_feature 1..20: note = CRISPR gRNA sequence
  source 1..20: mol_type = other DNA
ggaaactgaggcacagaaag

SEQ ID NO: 25141 - DNA, 20 bp, synthetic construct
  misc_feature 1..20: note = CRISPR gRNA sequence
  source 1..20: mol_type = other DNA
aggcacagaaaggagcagag

SEQ ID NO: 25142 - DNA, 20 bp, synthetic construct
  misc_feature 1..20: note = CRISPR gRNA sequence
  source 1..20: mol_type = other DNA
gctcaagtccacccaaagca

SEQ ID NO: 25143 - DNA, 20 bp, synthetic construct
  misc_feature 1..20: note = CRISPR gRNA sequence
  source 1..20: mol_type = other DNA
ctcaagtccacccaaagcag

SEQ ID NO: 25144 - DNA, 20 bp, synthetic construct
  misc_feature 1..20: note = CRISPR gRNA sequence
  source 1..20: mol_type = other DNA
aagtccacccaaagcagtag

SEQ ID NO: 25145 - DNA, 20 bp, synthetic construct
  misc_feature 1..20: note = CRISPR gRNA sequence
  source 1..20: mol_type = other DNA
tggttaaatgcaggacttca

SEQ ID NO: 25146 - DNA, 20 bp, synthetic construct
  misc_feature 1..20: note = CRISPR gRNA sequence
  source 1..20: mol_type = other DNA
aatgcaggacttcagtcaga

SEQ ID NO: 25147 - DNA, 20 bp, synthetic construct
  misc_feature 1..20: note = CRISPR gRNA sequence
  source 1..20: mol_type = other DNA
cagtcagactgtctgggttc

SEQ ID NO: 25148 - DNA, 20 bp, synthetic construct
  misc_feature 1..20: note = CRISPR gRNA sequence
  source 1..20: mol_type = other DNA
agtcagactgtctgggttca

SEQ ID NO: 25149 - DNA, 20 bp, synthetic construct
  misc_feature 1..20: note = CRISPR gRNA sequence
  source 1..20: mol_type = other DNA
tctgggttcaaatcctggtt

SEQ ID NO: 25150 - DNA, 20 bp, synthetic construct
  misc_feature 1..20: note = CRISPR gRNA sequence
  source 1..20: mol_type = other DNA
ggttcaaatcctggttccac

SEQ ID NO: 25151 - DNA, 20 bp, synthetic construct
  misc_feature 1..20: note = CRISPR gRNA sequence
  source 1..20: mol_type = other DNA
aaatcctggttccacttgga

SEQ ID NO: 25152 - DNA, 20 bp, synthetic construct
  misc_feature 1..20: note = CRISPR gRNA sequence
  source 1..20: mol_type = other DNA
gttccacttggacatgggtt

SEQ ID NO: 25153 - DNA, 20 bp, synthetic construct
  misc_feature 1..20: note = CRISPR gRNA sequence
  source 1..20: mol_type = other DNA
cacttggacatgggtttcct

SEQ ID NO: 25154 - DNA, 20 bp, synthetic construct
  misc_feature 1..20: note = CRISPR gRNA sequence
  source 1..20: mol_type = other DNA
ggacatgggtttccttacat

SEQ ID NO: 25155 - DNA, 20 bp, synthetic construct
  misc_feature 1..20: note = CRISPR gRNA sequence
  source 1..20: mol_type = other DNA
gacatgggtttccttacata

SEQ ID NO: 25156 - DNA, 20 bp, synthetic construct
  misc_feature 1..20: note = CRISPR gRNA sequence
  source 1..20: mol_type = other DNA
ccttacataaatcacttcac

SEQ ID NO: 25157 - DNA, 20 bp, synthetic construct
  misc_feature 1..20: note = CRISPR gRNA sequence
  source 1..20: mol_type = other DNA
cttacataaatcacttcacc

SEQ ID NO: 25158 - DNA, 20 bp, synthetic construct
  misc_feature 1..20: note = CRISPR gRNA sequence
  source 1..20: mol_type = other DNA
acataaatcacttcacctct

SEQ ID NO: 25159 - DNA, 20 bp, synthetic construct
  misc_feature 1..20: note = CRISPR gRNA sequence
  source 1..20: mol_type = other DNA
cataaatcacttcacctctc

SEQ ID NO: 25160 - DNA, 20 bp, synthetic construct
  misc_feature 1..20: note = CRISPR gRNA sequence
  source 1..20: mol_type = other DNA
cacctctctgagcctcagtt

SEQ ID NO: 25161 - DNA, 20 bp, synthetic construct
  misc_feature 1..20: note = CRISPR gRNA sequence
  source 1..20: mol_type = other DNA
acctctctgagcctcagttt

SEQ ID NO: 25162 - DNA, 20 bp, synthetic construct
  misc_feature 1..20: note = CRISPR gRNA sequence
  source 1..20: mol_type = other DNA
tctgagcctcagttttctca

SEQ ID NO: 25163 - DNA, 20 bp, synthetic construct
  misc_feature 1..20: note = CRISPR gRNA sequence
  source 1..20: mol_type = other DNA
tgagcctcagttttctcata

SEQ ID NO: 25164 - DNA, 20 bp, synthetic construct
  misc_feature 1..20: note = CRISPR gRNA sequence
  source 1..20: mol_type = other DNA
agcctcagttttctcatatg

SEQ ID NO: 25165 - DNA, 20 bp, synthetic construct
  misc_feature 1..20: note = CRISPR gRNA sequence
  source 1..20: mol_type = other DNA
agttttctcatatgcaaagt

SEQ ID NO: 25166 - DNA, 20 bp, synthetic construct
  misc_feature 1..20: note = CRISPR gRNA sequence
  source 1..20: mol_type = other DNA
tctcatatgcaaagtgagga

SEQ ID NO: 25167 - DNA, 20 bp, synthetic construct
  misc_feature 1..20: note = CRISPR gRNA sequence
  source 1..20: mol_type = other DNA
ctcatatgcaaagtgaggat

SEQ ID NO: 25168 - DNA, 20 bp, synthetic construct
  misc_feature 1..20: note = CRISPR gRNA sequence
  source 1..20: mol_type = other DNA
tcatatgcaaagtgaggata

SEQ ID NO: 25169 - DNA, 20 bp, synthetic construct
  misc_feature 1..20: note = CRISPR gRNA sequence
  source 1..20: mol_type = other DNA
atatgcaaagtgaggataat

SEQ ID NO: 25170 - DNA, 20 bp, synthetic construct
  misc_feature 1..20: note = CRISPR gRNA sequence
  source 1..20: mol_type = other DNA
ccttacatggttactgatat

SEQ ID NO: 25171 - DNA, 20 bp, synthetic construct
  misc_feature 1..20: note = CRISPR gRNA sequence
  source 1..20: mol_type = other DNA
cttacatggttactgatatg

SEQ ID NO: 25172 - DNA, 20 bp, synthetic construct
  misc_feature 1..20: note = CRISPR gRNA sequence
  source 1..20: mol_type = other DNA
acatggttactgatatgagt

SEQ ID NO: 25173 - DNA, 20 bp, synthetic construct
  misc_feature 1..20: note = CRISPR gRNA sequence
  source 1..20: mol_type = other DNA
catggttactgatatgagta

SEQ ID NO: 25174 - DNA, 20 bp, synthetic construct
  misc_feature 1..20: note = CRISPR gRNA sequence
  source 1..20: mol_type = other DNA
ctgatatgagtattaaatgt

SEQ ID NO: 25175 - DNA, 20 bp, synthetic construct
  misc_feature 1..20: note = CRISPR gRNA sequence
  source 1..20: mol_type = other DNA
atatgagtattaaatgtgcc

SEQ ID NO: 25176 - DNA, 20 bp, synthetic construct
  misc_feature 1..20: note = CRISPR gRNA sequence
  source 1..20: mol_type = other DNA
aatgtgccagctcatgtgcc

SEQ ID NO: 25177 - DNA, 20 bp, synthetic construct
  misc_feature 1..20: note = CRISPR gRNA sequence
  source 1..20: mol_type = other DNA
atgtgcctggcgtataggag

SEQ ID NO: 25178 - DNA, 20 bp, synthetic construct
  misc_feature 1..20: note = CRISPR gRNA sequence
  source 1..20: mol_type = other DNA
gcgtataggaggtgctttat

SEQ ID NO: 25179 - DNA, 20 bp, synthetic construct
  misc_feature 1..20: note = CRISPR gRNA sequence
  source 1..20: mol_type = other DNA
tataaaccttagctgttacc

SEQ ID NO: 25180 - DNA, 20 bp, synthetic construct
  misc_feature 1..20: note = CRISPR gRNA sequence
  source 1..20: mol_type = other DNA
ataaaccttagctgttacca

SEQ ID NO: 25181 - DNA, 20 bp, synthetic construct
  misc_feature 1..20: note = CRISPR gRNA sequence
  source 1..20: mol_type = other DNA
taaaccttagctgttaccac

SEQ ID NO: 25182 - DNA, 20 bp, synthetic construct
  misc_feature 1..20: note = CRISPR gRNA sequence
  source 1..20: mol_type = other DNA
agctgttaccactcatggca

SEQ ID NO: 25183 - DNA, 20 bp, synthetic construct
  misc_feature 1..20: note = CRISPR gRNA sequence
  source 1..20: mol_type = other DNA
gctgttaccactcatggcat

SEQ ID NO: 25184 - DNA, 20 bp, synthetic construct
  misc_feature 1..20: note = CRISPR gRNA sequence
  source 1..20: mol_type = other DNA
ttaccactcatggcattgcc

SEQ ID NO: 25185 - DNA, 20 bp, synthetic construct
  misc_feature 1..20: note = CRISPR gRNA sequence
  source 1..20: mol_type = other DNA
ccactcatggcattgccaaa

SEQ ID NO: 25186 - DNA, 20 bp, synthetic construct
  misc_feature 1..20: note = CRISPR gRNA sequence
  source 1..20: mol_type = other DNA
atggcattgccaaatgtggg

SEQ ID NO: 25187 - DNA, 20 bp, synthetic construct
  misc_feature 1..20: note = CRISPR gRNA sequence
  source 1..20: mol_type = other DNA
ccaaatgtgggacgggtctc

SEQ ID NO: 25188 - DNA, 20 bp, synthetic construct
  misc_feature 1..20: note = CRISPR gRNA sequence
  source 1..20: mol_type = other DNA
ctgactctctggtgtgagat

SEQ ID NO: 25189 - DNA, 20 bp, synthetic construct
  misc_feature 1..20: note = CRISPR gRNA sequence
  source 1..20: mol_type = other DNA
actctctggtgtgagattga

SEQ ID NO: 25190 - DNA, 20 bp, synthetic construct
  misc_feature 1..20: note = CRISPR gRNA sequence
  source 1..20: mol_type = other DNA
tctggtgtgagattgatgga

SEQ ID NO: 25191 - DNA, 20 bp, synthetic construct
  misc_feature 1..20: note = CRISPR gRNA sequence
  source 1..20: mol_type = other DNA
tggtgtgagattgatggaat

SEQ ID NO: 25192 - DNA, 20 bp, synthetic construct
  misc_feature 1..20: note = CRISPR gRNA sequence
  source 1..20: mol_type = other DNA
gtgtgagattgatggaatcc

SEQ ID NO: 25193 - DNA, 20 bp, synthetic construct
  misc_feature 1..20: note = CRISPR gRNA sequence
  source 1..20: mol_type = other DNA
atggaatccacactttccag

SEQ ID NO: 25194 - DNA, 20 bp, synthetic construct
  misc_feature 1..20: note = CRISPR gRNA sequence
  source 1..20: mol_type = other DNA
tccagttcccttttctacct

SEQ ID NO: 25195 - DNA, 20 bp, synthetic construct
  misc_feature 1..20: note = CRISPR gRNA sequence
  source 1..20: mol_type = other DNA
ccagttcccttttctacctc

SEQ ID NO: 25196 - DNA, 20 bp, synthetic construct
  misc_feature 1..20: note = CRISPR gRNA sequence
  source 1..20: mol_type = other DNA
cagttcccttttctacctcc

SEQ ID NO: 25197 - DNA, 20 bp, synthetic construct
  misc_feature 1..20: note = CRISPR gRNA sequence
  source 1..20: mol_type = other DNA
ccttttctacctcctgggta

SEQ ID NO: 25198 - DNA, 20 bp, synthetic construct
  misc_feature 1..20: note = CRISPR gRNA sequence
  source 1..20: mol_type = other DNA
ttctacctcctgggtatctt

SEQ ID NO: 25199 - DNA, 20 bp, synthetic construct
  misc_feature 1..20: note = CRISPR gRNA sequence
  source 1..20: mol_type = other DNA
tctacctcctgggtatcttc

SEQ ID NO: 25200 - DNA, 20 bp, synthetic construct
  misc_feature 1..20: note = CRISPR gRNA sequence
  source 1..20: mol_type = other DNA
ctacctcctgggtatcttct

SEQ ID NO: 25201 - DNA, 20 bp, synthetic construct
  misc_feature 1..20: note = CRISPR gRNA sequence
  source 1..20: mol_type = other DNA
tacctcctgggtatcttctc

SEQ ID NO: 25202 - DNA, 20 bp, synthetic construct
  misc_feature 1..20: note = CRISPR gRNA sequence
  source 1..20: mol_type = other DNA
cctcctgggtatcttctcat

SEQ ID NO: 25203 - DNA, 20 bp, synthetic construct
  misc_feature 1..20: note = CRISPR gRNA sequence
  source 1..20: mol_type = other DNA
ctgggtatcttctcatatgg

SEQ ID NO: 25204 - DNA, 20 bp, synthetic construct
  misc_feature 1..20: note = CRISPR gRNA sequence
  source 1..20: mol_type = other DNA
ggtatcttctcatatggttg

SEQ ID NO: 25205 - DNA, 20 bp, synthetic construct
  misc_feature 1..20: note = CRISPR gRNA sequence
  source 1..20: mol_type = other DNA
ctcatatggttgtaagttcc

SEQ ID NO: 25206 - DNA, 20 bp, synthetic construct
  misc_feature 1..20: note = CRISPR gRNA sequence
  source 1..20: mol_type = other DNA
tcatatggttgtaagttcct

SEQ ID NO: 25207 - DNA, 20 bp, synthetic construct
  misc_feature 1..20: note = CRISPR gRNA sequence
  source 1..20: mol_type = other DNA
atatggttgtaagttccttg

SEQ ID NO: 25208 - DNA, 20 bp, synthetic construct
  misc_feature 1..20: note = CRISPR gRNA sequence
  source 1..20: mol_type = other DNA
taagttccttggaggaaggg

SEQ ID NO: 25209 - DNA, 20 bp, synthetic construct
  misc_feature 1..20: note = CRISPR gRNA sequence
  source 1..20: mol_type = other DNA
cttggaggaagggaatgtgg

SEQ ID NO: 25210 - DNA, 20 bp, synthetic construct
  misc_feature 1..20: note = CRISPR gRNA sequence
  source 1..20: mol_type = other DNA
ggaggaagggaatgtggctt

SEQ ID NO: 25211 - DNA, 20 bp, synthetic construct
  misc_feature 1..20: note = CRISPR gRNA sequence
  source 1..20: mol_type = other DNA
gaggaagggaatgtggcttg

SEQ ID NO: 25212 - DNA, 20 bp, synthetic construct
  misc_feature 1..20: note = CRISPR gRNA sequence
  source 1..20: mol_type = other DNA
gctctctccaccacgctgag

SEQ ID NO: 25213 - DNA, 20 bp, synthetic construct
  misc_feature 1..20: note = CRISPR gRNA sequence
  source 1..20: mol_type = other DNA
ctctctccaccacgctgagc

SEQ ID NO: 25214 - DNA, 20 bp, synthetic construct
  misc_feature 1..20: note = CRISPR gRNA sequence
  source 1..20: mol_type = other DNA
tctccaccacgctgagcata

SEQ ID NO: 25215 - DNA, 20 bp, synthetic construct
  misc_feature 1..20: note = CRISPR gRNA sequence
  source 1..20: mol_type = other DNA
tccaccacgctgagcatata

SEQ ID NO: 25216 - DNA, 20 bp, synthetic construct
  misc_feature 1..20: note = CRISPR gRNA sequence
  source 1..20: mol_type = other DNA
caccacgctgagcatataag

SEQ ID NO: 25217 - DNA, 20 bp, synthetic construct
  misc_feature 1..20: note = CRISPR gRNA sequence
  source 1..20: mol_type = other DNA
agcatataagaggtgctgaa

SEQ ID NO: 25218 - DNA, 20 bp, synthetic construct
  misc_feature 1..20: note = CRISPR gRNA sequence
  source 1..20: mol_type = other DNA
aatgagcgcttttattcact

SEQ ID NO: 25219 - DNA, 20 bp, synthetic construct
  misc_feature 1..20: note = CRISPR gRNA sequence
  source 1..20: mol_type = other DNA
ttattcactcctctcatccc

SEQ ID NO: 25220 - DNA, 20 bp, synthetic construct
  misc_feature 1..20: note = CRISPR gRNA sequence
  source 1..20: mol_type = other DNA
tattcactcctctcatcccc

SEQ ID NO: 25221 - DNA, 20 bp, synthetic construct
  misc_feature 1..20: note = CRISPR gRNA sequence
  source 1..20: mol_type = other DNA
attcactcctctcatcccca

SEQ ID NO: 25222 - DNA, 20 bp, synthetic construct
  misc_feature 1..20: note = CRISPR gRNA sequence
  source 1..20: mol_type = other DNA
ttcactcctctcatccccag

SEQ ID NO: 25223 - DNA, 20 bp, synthetic construct
  misc_feature 1..20: note = CRISPR gRNA sequence
  source 1..20: mol_type = other DNA
actcctctcatccccagccc

SEQ ID NO: 25224 - DNA, 20 bp, synthetic construct
  misc_feature 1..20: note = CRISPR gRNA sequence
  source 1..20: mol_type = other DNA
ctctcatccccagccctcac

SEQ ID NO: 25225 - DNA, 20 bp, synthetic construct
  misc_feature 1..20: note = CRISPR gRNA sequence
  source 1..20: mol_type = other DNA
tcatccccagccctcaccag

SEQ ID NO: 25226 - DNA, 20 bp, synthetic construct
  misc_feature 1..20: note = CRISPR gRNA sequence
  source 1..20: mol_type = other DNA
atccccagccctcaccagct

SEQ ID NO: 25227 - DNA, 20 bp, synthetic construct
  misc_feature 1..20: note = CRISPR gRNA sequence
  source 1..20: mol_type = other DNA
accagctgggagttgttgta

SEQ ID NO: 25228 - DNA, 20 bp, synthetic construct
  misc_feature 1..20: note = CRISPR gRNA sequence
  source 1..20: mol_type = other DNA
ggagttgttgtaggtgtcaa

SEQ ID NO: 25229 - DNA, 20 bp, synthetic construct
  misc_feature 1..20: note = CRISPR gRNA sequence
  source 1..20: mol_type = other DNA
ttgtaggtgtcaattttctg

SEQ ID NO: 25230 - DNA, 20 bp, synthetic construct
  misc_feature 1..20: note = CRISPR gRNA sequence
  source 1..20: mol_type = other DNA
taggtgtcaattttctgcct

SEQ ID NO: 25231 - DNA, 20 bp, synthetic construct
  misc_feature 1..20: note = CRISPR gRNA sequence
  source 1..20: mol_type = other DNA
tctgcctctttccaacaccc

SEQ ID NO: 25232 - DNA, 20 bp, synthetic construct
  misc_feature 1..20: note = CRISPR gRNA sequence
  source 1..20: mol_type = other DNA
ctgcctctttccaacaccct

SEQ ID NO: 25233 - DNA, 20 bp, synthetic construct
  misc_feature 1..20: note = CRISPR gRNA sequence
  source 1..20: mol_type = other DNA
tgcctctttccaacaccctg

SEQ ID NO: 25234 - DNA, 20 bp, synthetic construct
  misc_feature 1..20: note = CRISPR gRNA sequence
  source 1..20: mol_type = other DNA
cctctttccaacaccctgtg

SEQ ID NO: 25235 - DNA, 20 bp, synthetic construct
  misc_feature 1..20: note = CRISPR gRNA sequence
  source 1..20: mol_type = other DNA
tttccaacaccctgtgaggt

SEQ ID NO: 25236 - DNA, 20 bp, synthetic construct
  misc_feature 1..20: note = CRISPR gRNA sequence
  source 1..20: mol_type = other DNA
tccaacaccctgtgaggtga

SEQ ID NO: 25237 - DNA, 20 bp, synthetic construct
  misc_feature 1..20: note = CRISPR gRNA sequence
  source 1..20: mol_type = other DNA
ccaacaccctgtgaggtgac

SEQ ID NO: 25238 - DNA, 20 bp, synthetic construct
  misc_feature 1..20: note = CRISPR gRNA sequence
  source 1..20: mol_type = other DNA
caacaccctgtgaggtgact

SEQ ID NO: 25239 - DNA, 20 bp, synthetic construct
  misc_feature 1..20: note = CRISPR gRNA sequence
  source 1..20: mol_type = other DNA
tgaggtgactgagcattgtc

SEQ ID NO: 25240 - DNA, 20 bp, synthetic construct
  misc_feature 1..20: note = CRISPR gRNA sequence
  source 1..20: mol_type = other DNA
agcattgtcttccctcccag

SEQ ID NO: 25241 - DNA, 20 bp, synthetic construct
  misc_feature 1..20: note = CRISPR gRNA sequence
  source 1..20: mol_type = other DNA
tcttccctcccaggcagctc

SEQ ID NO: 25242 - DNA, 20 bp, synthetic construct
  misc_feature 1..20: note = CRISPR gRNA sequence
  source 1..20: mol_type = other DNA
ccctcccaggcagctcacag

SEQ ID NO: 25243 - DNA, 20 bp, synthetic construct
  misc_feature 1..20: note = CRISPR gRNA sequence
  source 1..20: mol_type = other DNA
cctcccaggcagctcacagt

SEQ ID NO: 25244 - DNA, 20 bp, synthetic construct
  misc_feature 1..20: note = CRISPR gRNA sequence
  source 1..20: mol_type = other DNA
ccaggcagctcacagtgtgc

SEQ ID NO: 25245 - DNA, 20 bp, synthetic construct
  misc_feature 1..20: note = CRISPR gRNA sequence
  source 1..20: mol_type = other DNA
acagtgtgccaccatggagt

SEQ ID NO: 25246 - DNA, 20 bp, synthetic construct
  misc_feature 1..20: note = CRISPR gRNA sequence
  source 1..20: mol_type = other DNA
gggcccctagaaggtggcta

SEQ ID NO: 25247 - DNA, 20 bp, synthetic construct
  misc_feature 1..20: note = CRISPR gRNA sequence
  source 1..20: mol_type = other DNA
gaaggtggctacctggagct

SEQ ID NO: 25248 - DNA, 20 bp, synthetic construct
  misc_feature 1..20: note = CRISPR gRNA sequence
  source 1..20: mol_type = other DNA
cctggagcttcttaacagcg

SEQ ID NO: 25249 - DNA, 20 bp, synthetic construct
  misc_feature 1..20: note = CRISPR gRNA sequence
  source 1..20: mol_type = other DNA
gagcttcttaacagcgatgc

SEQ ID NO: 25250 - DNA, 20 bp, synthetic construct
  misc_feature 1..20: note = CRISPR gRNA sequence
  source 1..20: mol_type = other DNA
cttaacagcgatgctgaccc

SEQ ID NO: 25251 - DNA, 20 bp, synthetic construct
  misc_feature 1..20: note = CRISPR gRNA sequence
  source 1..20: mol_type = other DNA
ttaacagcgatgctgacccc

SEQ ID NO: 25252 - DNA, 20 bp, synthetic construct
  misc_feature 1..20: note = CRISPR gRNA sequence
  source 1..20: mol_type = other DNA
aacagcgatgctgaccccct

SEQ ID NO: 25253 - DNA, 20 bp, synthetic construct
  misc_feature 1..20: note = CRISPR gRNA sequence
  source 1..20: mol_type = other DNA
acagcgatgctgaccccctg

SEQ ID NO: 25254 - DNA, 20 bp, synthetic construct
  misc_feature 1..20: note = CRISPR gRNA sequence
  source 1..20: mol_type = other DNA
accccctgtgcctctaccac

SEQ ID NO: 25255 - DNA, 20 bp, synthetic construct
  misc_feature 1..20: note = CRISPR gRNA sequence
  source 1..20: mol_type = other DNA
tgcctctaccacttctatga

SEQ ID NO: 25256 - DNA, 20 bp, synthetic construct
  misc_feature 1..20: note = CRISPR gRNA sequence
  source 1..20: mol_type = other DNA
taccacttctatgaccagat

SEQ ID NO: 25257 - DNA, 20 bp, synthetic construct
  misc_feature 1..20: note = CRISPR gRNA sequence
  source 1..20: mol_type = other DNA
ccacttctatgaccagatgg

SEQ ID NO: 25258 - DNA, 20 bp, synthetic construct
  misc_feature 1..20: note = CRISPR gRNA sequence
  source 1..20: mol_type = other DNA
ctatgaccagatggacctgg

SEQ ID NO: 25259 - DNA, 20 bp, synthetic construct
  misc_feature 1..20: note = CRISPR gRNA sequence
  source 1..20: mol_type = other DNA
tatgaccagatggacctggc

SEQ ID NO: 25260 - DNA, 20 bp, synthetic construct
  misc_feature 1..20: note = CRISPR gRNA sequence
  source 1..20: mol_type = other DNA
tgaccagatggacctggctg

SEQ ID NO: 25261 - DNA, 20 bp, synthetic construct
  misc_feature 1..20: note = CRISPR gRNA sequence
  source 1..20: mol_type = other DNA
gctggagaagaagagattga

SEQ ID NO: 25262 - DNA, 20 bp, synthetic construct
  misc_feature 1..20: note = CRISPR gRNA sequence
  source 1..20: mol_type = other DNA
gagaagaagagattgagctc

SEQ ID NO: 25263 - DNA, 20 bp, synthetic construct
  misc_feature 1..20: note = CRISPR gRNA sequence
  source 1..20: mol_type = other DNA
agctctactcaggtgggccc

SEQ ID NO: 25264 - DNA, 20 bp, synthetic construct
  misc_feature 1..20: note = CRISPR gRNA sequence
  source 1..20: mol_type = other DNA
tactcaggtgggccctcctc

SEQ ID NO: 25265 - DNA, 20 bp, synthetic construct
  misc_feature 1..20: note = CRISPR gRNA sequence
  source 1..20: mol_type = other DNA
ctcaggtgggccctcctccc

SEQ ID NO: 25266 - DNA, 20 bp, synthetic construct
  misc_feature 1..20: note = CRISPR gRNA sequence
  source 1..20: mol_type = other DNA
aggtgggccctcctccctct

SEQ ID NO: 25267 - DNA, 20 bp, synthetic construct
  misc_feature 1..20: note = CRISPR gRNA sequence
  source 1..20: mol_type = other DNA
ctccctctggtctcttccgg

SEQ ID NO: 25268 - DNA, 20 bp, synthetic construct
  misc_feature 1..20: note = CRISPR gRNA sequence
  source 1..20: mol_type = other DNA
cctctggtctcttccggtat

SEQ ID NO: 25269 - DNA, 20 bp, synthetic construct
  misc_feature 1..20: note = CRISPR gRNA sequence
  source 1..20: mol_type = other DNA
tggtctcttccggtatcccc

SEQ ID NO: 25270 - DNA, 20 bp, synthetic construct
  misc_feature 1..20: note = CRISPR gRNA sequence
  source 1..20: mol_type = other DNA
gtctcttccggtatccccca

SEQ ID NO: 25271 - DNA, 20 bp, synthetic construct
  misc_feature 1..20: note = CRISPR gRNA sequence
  source 1..20: mol_type = other DNA
ttccggtatcccccacccct

SEQ ID NO: 25272 - DNA, 20 bp, synthetic construct
  misc_feature 1..20: note = CRISPR gRNA sequence
  source 1..20: mol_type = other DNA
ccggtatcccccacccctca

SEQ ID NO: 25273 - DNA, 20 bp, synthetic construct
  misc_feature 1..20: note = CRISPR gRNA sequence
  source 1..20: mol_type = other DNA
cggtatcccccacccctcag

SEQ ID NO: 25274 - DNA, 20 bp, synthetic construct
  misc_feature 1..20: note = CRISPR gRNA sequence
  source 1..20: mol_type = other DNA
agcttgctgtagagacggca

SEQ ID NO: 25275 - DNA, 20 bp, synthetic construct
  misc_feature 1..20: note = CRISPR gRNA sequence
  source 1..20: mol_type = other DNA
gctgtagagacggcaatcag

SEQ ID NO: 25276 - DNA, 20 bp, synthetic construct
  misc_feature 1..20: note = CRISPR gRNA sequence
  source 1..20: mol_type = other DNA
ctgtagagacggcaatcagg

SEQ ID NO: 25277 - DNA, 20 bp, synthetic construct
  misc_feature 1..20: note = CRISPR gRNA sequence
  source 1..20: mol_type = other DNA
tagagacggcaatcagggga

SEQ ID NO: 25278 - DNA, 20 bp, synthetic construct
  misc_feature 1..20: note = CRISPR gRNA sequence
  source 1..20: mol_type = other DNA
tggtccctgccctcccgtca

SEQ ID NO: 25279 - DNA, 20 bp, synthetic construct
  misc_feature 1..20: note = CRISPR gRNA sequence
  source 1..20: mol_type = other DNA
gtccctgccctcccgtcagc

SEQ ID NO: 25280 - DNA, 20 bp, synthetic construct
  misc_feature 1..20: note = CRISPR gRNA sequence
  source 1..20: mol_type = other DNA
ccctcccgtcagcaccacgg

SEQ ID NO: 25281 - DNA, 20 bp, synthetic construct
  misc_feature 1..20: note = CRISPR gRNA sequence
  source 1..20: mol_type = other DNA
ccgtcagcaccacggacagc

SEQ ID NO: 25282 - DNA, 20 bp, synthetic construct
  misc_feature 1..20: note = CRISPR gRNA sequence
  source 1..20: mol_type = other DNA
ccacgtctgtgggacgctct

SEQ ID NO: 25283 - DNA, 20 bp, synthetic construct
  misc_feature 1..20: note = CRISPR gRNA sequence
  source 1..20: mol_type = other DNA
tgggacgctctctgcagatg

SEQ ID NO: 25284 - DNA, 20 bp, synthetic construct
  misc_feature 1..20: note = CRISPR gRNA sequence
  source 1..20: mol_type = other DNA
tctgcagatggggatgatct

SEQ ID NO: 25285 - DNA, 20 bp, synthetic construct
  misc_feature 1..20: note = CRISPR gRNA sequence
  source 1..20: mol_type = other DNA
tgcagatggggatgatctcc

SEQ ID NO: 25286 - DNA, 20 bp, synthetic construct
  misc_feature 1..20: note = CRISPR gRNA sequence
  source 1..20: mol_type = other DNA
cagatggggatgatctccca

SEQ ID NO: 25287 - DNA, 20 bp, synthetic construct
  misc_feature 1..20: note = CRISPR gRNA sequence
  source 1..20: mol_type = other DNA
ccagccctgccccgcctctc

SEQ ID NO: 25288 - DNA, 20 bp, synthetic construct
  misc_feature 1..20: note = CRISPR gRNA sequence
  source 1..20: mol_type = other DNA
ccccgcctctccctcgttcc

SEQ ID NO: 25289 - DNA, 20 bp, synthetic construct
  misc_feature 1..20: note = CRISPR gRNA sequence
  source 1..20: mol_type = other DNA
tccctcgttccccaccagcc

SEQ ID NO: 25290 - DNA, 20 bp, synthetic construct
  misc_feature 1..20: note = CRISPR gRNA sequence
  source 1..20: mol_type = other DNA
cctcgttccccaccagccct

SEQ ID NO: 25291 - DNA, 20 bp, synthetic construct
  misc_feature 1..20: note = CRISPR gRNA sequence
  source 1..20: mol_type = other DNA
gttccccaccagccctcttt

SEQ ID NO: 25292 - DNA, 20 bp, synthetic construct
  misc_feature 1..20: note = CRISPR gRNA sequence
  source 1..20: mol_type = other DNA
cccaccagccctctttccag

SEQ ID NO: 25293 - DNA, 20 bp, synthetic construct
  misc_feature 1..20: note = CRISPR gRNA sequence
  source 1..20: mol_type = other DNA
tttccagaaatttccttctt

SEQ ID NO: 25294 - DNA, 20 bp, synthetic construct
  misc_feature 1..20: note = CRISPR gRNA sequence
  source 1..20: mol_type = other DNA
tccagaaatttccttcttca

SEQ ID NO: 25295 - DNA, 20 bp, synthetic construct
  misc_feature 1..20: note = CRISPR gRNA sequence
  source 1..20: mol_type = other DNA
ccagaaatttccttcttcat

SEQ ID NO: 25296 - DNA, 20 bp, synthetic construct
  misc_feature 1..20: note = CRISPR gRNA sequence
  source 1..20: mol_type = other DNA
cagaaatttccttcttcatc

SEQ ID NO: 25297 - DNA, 20 bp, synthetic construct
  misc_feature 1..20: note = CRISPR gRNA sequence
  source 1..20: mol_type = other DNA
ccttcttcatccaagggact

SEQ ID NO: 25298 - DNA, 20 bp, synthetic construct
  misc_feature 1..20: note = CRISPR gRNA sequence
  source 1..20: mol_type = other DNA
cttcttcatccaagggactt

SEQ ID NO: 25299 - DNA, 20 bp, synthetic construct
  misc_feature 1..20: note = CRISPR gRNA sequence
  source 1..20: mol_type = other DNA
cttcatccaagggacttttc

SEQ ID NO: 25300 - DNA, 20 bp, synthetic construct
  misc_feature 1..20: note = CRISPR gRNA sequence
  source 1..20: mol_type = other DNA
ttcatccaagggacttttcc

SEQ ID NO: 25301 - DNA, 20 bp, synthetic construct
  misc_feature 1..20: note = CRISPR gRNA sequence
  source 1..20: mol_type = other DNA
catccaagggacttttcctc

SEQ ID NO: 25302 - DNA, 20 bp, synthetic construct
  misc_feature 1..20: note = CRISPR gRNA sequence
  source 1..20: mol_type = other DNA
atccaagggacttttcctcc

SEQ ID NO: 25303 - DNA, 20 bp, synthetic construct
  misc_feature 1..20: note = CRISPR gRNA sequence
  source 1..20: mol_type = other DNA
ttcctcccagaacccgacac

SEQ ID NO: 25304 - DNA, 20 bp, synthetic construct
  misc_feature 1..20: note = CRISPR gRNA sequence
  source 1..20: mol_type = other DNA
tcctcccagaacccgacaca

SEQ ID NO: 25305 - DNA, 20 bp, synthetic construct
  misc_feature 1..20: note = CRISPR gRNA sequence
  source 1..20: mol_type = other DNA
cctcccagaacccgacacag

SEQ ID NO: 25306 - DNA, 20 bp, synthetic construct
  misc_feature 1..20: note = CRISPR gRNA sequence
  source 1..20: mol_type = other DNA
ctcccagaacccgacacaga

SEQ ID NO: 25307 - DNA, 20 bp, synthetic construct
  misc_feature 1..20: note = CRISPR gRNA sequence
  source 1..20: mol_type = other DNA
ccagaacccgacacagacac

SEQ ID NO: 25308 - DNA, 20 bp, synthetic construct
  misc_feature 1..20: note = CRISPR gRNA sequence
  source 1..20: mol_type = other DNA
cgaccagttcagcaggctgt

SEQ ID NO: 25309 - DNA, 20 bp, synthetic construct
  misc_feature 1..20: note = CRISPR gRNA sequence
  source 1..20: mol_type = other DNA
agcaggctgttgtgtgacat

SEQ ID NO: 25310 - DNA, 20 bp, synthetic construct
  misc_feature 1..20: note = CRISPR gRNA sequence
  source 1..20: mol_type = other DNA
ttgtgtgacatggaaggtga

SEQ ID NO: 25311 - DNA, 20 bp, synthetic construct
  misc_feature 1..20: note = CRISPR gRNA sequence
  source 1..20: mol_type = other DNA
tgtgacatggaaggtgatga

SEQ ID NO: 25312 - DNA, 20 bp, synthetic construct
  misc_feature 1..20: note = CRISPR gRNA sequence
  source 1..20: mol_type = other DNA
atgccaatatcggtgaggaa

SEQ ID NO: 25313 - DNA, 20 bp, synthetic construct
  misc_feature 1..20: note = CRISPR gRNA sequence
  source 1..20: mol_type = other DNA
tgccaatatcggtgaggaag

SEQ ID NO: 25314 - DNA, 20 bp, synthetic construct
  misc_feature 1..20: note = CRISPR gRNA sequence
  source 1..20: mol_type = other DNA
agcccagaaaaggacaatca

SEQ ID NO: 25315 - DNA, 20 bp, synthetic construct
  misc_feature 1..20: note = CRISPR gRNA sequence
  source 1..20: mol_type = other DNA
tttgctgccacttgtcaata

SEQ ID NO: 25316 - DNA, 20 bp, synthetic construct
  misc_feature 1..20: note = CRISPR gRNA sequence
  source 1..20: mol_type = other DNA
tgctgccacttgtcaatatc

SEQ ID NO: 25317 - DNA, 20 bp, synthetic construct
  misc_feature 1..20: note = CRISPR gRNA sequence
  source 1..20: mol_type = other DNA
gctgccacttgtcaatatca

SEQ ID NO: 25318 - DNA, 20 bp, synthetic construct
  misc_feature 1..20: note = CRISPR gRNA sequence
  source 1..20: mol_type = other DNA
ctgccacttgtcaatatcac

SEQ ID NO: 25319 - DNA, 20 bp, synthetic construct
  misc_feature 1..20: note = CRISPR gRNA sequence
  source 1..20: mol_type = other DNA
ccacttgtcaatatcaccca

SEQ ID NO: 25320 - DNA, 20 bp, synthetic construct
  misc_feature 1..20: note = CRISPR gRNA sequence
  source 1..20: mol_type = other DNA
gtcaatatcacccattcatc

SEQ ID NO: 25321 - DNA, 20 bp, synthetic construct
  misc_feature 1..20: note = CRISPR gRNA sequence
  source 1..20: mol_type = other DNA
tcaatatcacccattcatca

SEQ ID NO: 25322 - DNA, 20 bp, synthetic construct
  misc_feature 1..20: note = CRISPR gRNA sequence
  source 1..20: mol_type = other DNA
atcatgagccacgtcagtcc

SEQ ID NO: 25323 - DNA, 20 bp, synthetic construct
  misc_feature 1..20: note = CRISPR gRNA sequence
  source 1..20: mol_type = other DNA
ccacagaaatcattgcaagg

SEQ ID NO: 25324 - DNA, 20 bp, synthetic construct
  misc_feature 1..20: note = CRISPR gRNA sequence
  source 1..20: mol_type = other DNA
caagggggatgcggagcaat

SEQ ID NO: 25325 - DNA, 20 bp, synthetic construct
  misc_feature 1..20: note = CRISPR gRNA sequence
  source 1..20: mol_type = other DNA
gaggaacggagactccaggg

SEQ ID NO: 25326 - DNA, 20 bp, synthetic construct
  misc_feature 1..20: note = CRISPR gRNA sequence
  source 1..20: mol_type = other DNA
cagggaagagaggggagatg

SEQ ID NO: 25327 - DNA, 20 bp, synthetic construct
  misc_feature 1..20: note = CRISPR gRNA sequence
  source 1..20: mol_type = other DNA
cactaatgaccaccaagaaa

SEQ ID NO: 25328 - DNA, 20 bp, synthetic construct
  misc_feature 1..20: note = CRISPR gRNA sequence
  source 1..20: mol_type = other DNA
actaatgaccaccaagaaaa

SEQ ID NO: 25329 - DNA, 20 bp, synthetic construct
  misc_feature 1..20: note = CRISPR gRNA sequence
  source 1..20: mol_type = other DNA
atgaccaccaagaaaacaaa

SEQ ID NO: 25330 - DNA, 20 bp, synthetic construct
  misc_feature 1..20: note = CRISPR gRNA sequence
  source 1..20: mol_type = other DNA
atgtttacatcctccacctc

SEQ ID NO: 25331 - DNA, 20 bp, synthetic construct
  misc_feature 1..20: note = CRISPR gRNA sequence
  source 1..20: mol_type = other DNA
acatcctccacctccatttc

SEQ ID NO: 25332 - DNA, 20 bp, synthetic construct
  misc_feature 1..20: note = CRISPR gRNA sequence
  source 1..20: mol_type = other DNA
catcctccacctccatttct

SEQ ID NO: 25333 - DNA, 20 bp, synthetic construct
  misc_feature 1..20: note = CRISPR gRNA sequence
  source 1..20: mol_type = other DNA
cacctccatttctatacgca

SEQ ID NO: 25334 - DNA, 20 bp, synthetic construct
  misc_feature 1..20: note = CRISPR gRNA sequence
  source 1..20: mol_type = other DNA
catttctatacgcatttctg

SEQ ID NO: 25335 - DNA, 20 bp, synthetic construct
  misc_feature 1..20: note = CRISPR gRNA sequence
  source 1..20: mol_type = other DNA
ctatacgcatttctgcttct

SEQ ID NO: 25336 - DNA, 20 bp, synthetic construct
  misc_feature 1..20: note = CRISPR gRNA sequence
  source 1..20: mol_type = other DNA
tatacgcatttctgcttctt

SEQ ID NO: 25337 - DNA, 20 bp, synthetic construct
  misc_feature 1..20: note = CRISPR gRNA sequence
  source 1..20: mol_type = other DNA
tacgcatttctgcttcttgc

SEQ ID NO: 25338 - DNA, 20 bp, synthetic construct
  misc_feature 1..20: note = CRISPR gRNA sequence
  source 1..20: mol_type = other DNA
ctgcttcttgctcttctgtc

SEQ ID NO: 25339 - DNA, 20 bp, synthetic construct
  misc_feature 1..20: note = CRISPR gRNA sequence
  source 1..20: mol_type = other DNA
tgcttcttgctcttctgtcc

SEQ ID NO: 25340 - DNA, 20 bp, synthetic construct
  misc_feature 1..20: note = CRISPR gRNA sequence
  source 1..20: mol_type = other DNA
cttcttgctcttctgtccat

SEQ ID NO: 25341 - DNA, 20 bp, synthetic construct
  misc_feature 1..20: note = CRISPR gRNA sequence
  source 1..20: mol_type = other DNA
cttgctcttctgtccatcct

SEQ ID NO: 25342 - DNA, 20 bp, synthetic construct
  misc_feature 1..20: note = CRISPR gRNA sequence
  source 1..20: mol_type = other DNA
ttgctcttctgtccatcctt

SEQ ID NO: 25343 - DNA, 20 bp, synthetic construct
  misc_feature 1..20: note = CRISPR gRNA sequence
  source 1..20: mol_type = other DNA
gctcttctgtccatcctttc

SEQ ID NO: 25344 - DNA, 20 bp, synthetic construct
  misc_feature 1..20: note = CRISPR gRNA sequence
  source 1..20: mol_type = other DNA
ctcttctgtccatcctttct

SEQ ID NO: 25345 - DNA, 20 bp, synthetic construct
  misc_feature 1..20: note = CRISPR gRNA sequence
  source 1..20: mol_type = other DNA
ttctgtccatcctttctaca

SEQ ID NO: 25346 - DNA, 20 bp, synthetic construct
  misc_feature 1..20: note = CRISPR gRNA sequence
  source 1..20: mol_type = other DNA
ctgtccatcctttctacaaa

SEQ ID NO: 25347 - DNA, 20 bp, synthetic construct
  misc_feature 1..20: note = CRISPR gRNA sequence
  source 1..20: mol_type = other DNA
tgtccatcctttctacaaag

SEQ ID NO: 25348 - DNA, 20 bp, synthetic construct
  misc_feature 1..20: note = CRISPR gRNA sequence
  source 1..20: mol_type = other DNA
tccatcctttctacaaagcc

SEQ ID NO: 25349 - DNA, 20 bp, synthetic construct
  misc_feature 1..20: note = CRISPR gRNA sequence
  source 1..20: mol_type = other DNA
tctacaaagcccataccata

SEQ ID NO: 25350 - DNA, 20 bp, synthetic construct
  misc_feature 1..20: note = CRISPR gRNA sequence
  source 1..20: mol_type = other DNA
ctacaaagcccataccatac

SEQ ID NO: 25351 - DNA, 20 bp, synthetic construct
  misc_feature 1..20: note = CRISPR gRNA sequence
  source 1..20: mol_type = other DNA
tacaaagcccataccataca

SEQ ID NO: 25352 - DNA, 20 bp, synthetic construct
  misc_feature 1..20: note = CRISPR gRNA sequence
  source 1..20: mol_type = other DNA
caaagcccataccatacacc

SEQ ID NO: 25353 - DNA, 20 bp, synthetic construct
  misc_feature 1..20: note = CRISPR gRNA sequence
  source 1..20: mol_type = other DNA
tcccttttcctcccagctcc

SEQ ID NO: 25354 - DNA, 20 bp, synthetic construct
  misc_feature 1..20: note = CRISPR gRNA sequence
  source 1..20: mol_type = other DNA
cccttttcctcccagctcct

SEQ ID NO: 25355 - DNA, 20 bp, synthetic construct
  misc_feature 1..20: note = CRISPR gRNA sequence
  source 1..20: mol_type = other DNA
ccttttcctcccagctcctt

SEQ ID NO: 25356 - DNA, 20 bp, synthetic construct
  misc_feature 1..20: note = CRISPR gRNA sequence
  source 1..20: mol_type = other DNA
ttcctcccagctccttagcc

SEQ ID NO: 25357 - DNA, 20 bp, synthetic construct
  misc_feature 1..20: note = CRISPR gRNA sequence
  source 1..20: mol_type = other DNA
tcctcccagctccttagcca

SEQ ID NO: 25358 - DNA, 20 bp, synthetic construct
  misc_feature 1..20: note = CRISPR gRNA sequence
  source 1..20: mol_type = other DNA
cctcccagctccttagccaa

SEQ ID NO: 25359 - DNA, 20 bp, synthetic construct
  misc_feature 1..20: note = CRISPR gRNA sequence
  source 1..20: mol_type = other DNA
ctcccagctccttagccaag

SEQ ID NO: 25360 - DNA, 20 bp, synthetic construct
  misc_feature 1..20: note = CRISPR gRNA sequence
  source 1..20: mol_type = other DNA
ccagctccttagccaagcta

SEQ ID NO: 25361 - DNA, 20 bp, synthetic construct
  misc_feature 1..20: note = CRISPR gRNA sequence
  source 1..20: mol_type = other DNA
cttagccaagctactctagt

SEQ ID NO: 25362 - DNA, 20 bp, synthetic construct
  misc_feature 1..20: note = CRISPR gRNA sequence
  source 1..20: mol_type = other DNA
agccaagctactctagtatt

SEQ ID NO: 25363 - DNA, 20 bp, synthetic construct
  misc_feature 1..20: note = CRISPR gRNA sequence
  source 1..20: mol_type = other DNA
gccaagctactctagtattt

SEQ ID NO: 25364 - DNA, 20 bp, synthetic construct
  misc_feature 1..20: note = CRISPR gRNA sequence
  source 1..20: mol_type = other DNA
ctctagtatttgtaataact

SEQ ID NO: 25365 - DNA, 20 bp, synthetic construct
  misc_feature 1..20: note = CRISPR gRNA sequence
  source 1..20: mol_type = other DNA
tagtatttgtaataactagc

SEQ ID NO: 25366 - DNA, 20 bp, synthetic construct
  misc_feature 1..20: note = CRISPR gRNA sequence
  source 1..20: mol_type = other DNA
gtatttgtaataactagcat

SEQ ID NO: 25367 - DNA, 20 bp, synthetic construct
  misc_feature 1..20: note = CRISPR gRNA sequence
  source 1..20: mol_type = other DNA
gtaataactagcatttactg

SEQ ID NO: 25368 - DNA, 20 bp, synthetic construct
  misc_feature 1..20: note = CRISPR gRNA sequence
  source 1..20: mol_type = other DNA
taataactagcatttactgg

SEQ ID NO: 25369 - DNA, 20 bp, synthetic construct
  misc_feature 1..20: note = CRISPR gRNA sequence
  source 1..20: mol_type = other DNA
gcatttactggatactcata

SEQ ID NO: 25370 - DNA, 20 bp, synthetic construct
  misc_feature 1..20: note = CRISPR gRNA sequence
  source 1..20: mol_type = other DNA
actggatactcatagtatgc

SEQ ID NO: 25371 - DNA, 20 bp, synthetic construct
  misc_feature 1..20: note = CRISPR gRNA sequence
  source 1..20: mol_type = other DNA
ctggatactcatagtatgct

SEQ ID NO: 25372 - DNA, 20 bp, synthetic construct
  misc_feature 1..20: note = CRISPR gRNA sequence
  source 1..20: mol_type = other DNA
gatactcatagtatgctcat

SEQ ID NO: 25373 - DNA, 20 bp, synthetic construct
  misc_feature 1..20: note = CRISPR gRNA sequence
  source 1..20: mol_type = other DNA
atagtatgctcattgctgtc

SEQ ID NO: 25374 - DNA, 20 bp, synthetic construct
  misc_feature 1..20: note = CRISPR gRNA sequence
  source 1..20: mol_type = other DNA
attgctgtccatacattatc

SEQ ID NO: 25375 - DNA, 20 bp, synthetic construct
  misc_feature 1..20: note = CRISPR gRNA sequence
  source 1..20: mol_type = other DNA
ctgtccatacattatcatct

SEQ ID NO: 25376 - DNA, 20 bp, synthetic construct
  misc_feature 1..20: note = CRISPR gRNA sequence
  source 1..20: mol_type = other DNA
tccatacattatcatctgga

SEQ ID NO: 25377 - DNA, 20 bp, synthetic construct
  misc_feature 1..20: note = CRISPR gRNA sequence
  source 1..20: mol_type = other DNA
tcatctggaatccttacaac

SEQ ID NO: 25378 - DNA, 20 bp, synthetic construct
  misc_feature 1..20: note = CRISPR gRNA sequence
  source 1..20: mol_type = other DNA
gaatccttacaacaacaaag

SEQ ID NO: 25379 - DNA, 20 bp, synthetic construct
  misc_feature 1..20: note = CRISPR gRNA sequence
  source 1..20: mol_type = other DNA
acaacaacaaaggaaataca

SEQ ID NO: 25380 - DNA, 20 bp, synthetic construct
  misc_feature 1..20: note = CRISPR gRNA sequence
  source 1..20: mol_type = other DNA
caacaacaaaggaaatacat

SEQ ID NO: 25381 - DNA, 20 bp, synthetic construct
  misc_feature 1..20: note = CRISPR gRNA sequence
  source 1..20: mol_type = other DNA
ttagtttctgtcttttacaa

SEQ ID NO: 25382 - DNA, 20 bp, synthetic construct
  misc_feature 1..20: note = CRISPR gRNA sequence
  source 1..20: mol_type = other DNA
gtttctgtcttttacaaatg

SEQ ID NO: 25383 - DNA, 20 bp, synthetic construct
  misc_feature 1..20: note = CRISPR gRNA sequence
  source 1..20: mol_type = other DNA
ctgtcttttacaaatgagga

SEQ ID NO: 25384 - DNA, 20 bp, synthetic construct
  misc_feature 1..20: note = CRISPR gRNA sequence
  source 1..20: mol_type = other DNA
tgtcttttacaaatgaggaa

SEQ ID NO: 25385 - DNA, 20 bp, synthetic construct
  misc_feature 1..20: note = CRISPR gRNA sequence
  source 1..20: mol_type = other DNA
tcttttacaaatgaggaaat

SEQ ID NO: 25386 - DNA, 20 bp, synthetic construct
  misc_feature 1..20: note = CRISPR gRNA sequence
  source 1..20: mol_type = other DNA
ttacaaatgaggaaattgag

SEQ ID NO: 25387 - DNA, 20 bp, synthetic construct
  misc_feature 1..20: note = CRISPR gRNA sequence
  source 1..20: mol_type = other DNA
tacaaatgaggaaattgagg

SEQ ID NO: 25388 - DNA, 20 bp, synthetic construct
  misc_feature 1..20: note = CRISPR gRNA sequence
  source 1..20: mol_type = other DNA
acaaatgaggaaattgaggt

SEQ ID NO: 25389 - DNA, 20 bp, synthetic construct
  misc_feature 1..20: note = CRISPR gRNA sequence
  source 1..20: mol_type = other DNA
caaatgaggaaattgaggtt

SEQ ID NO: 25390 - DNA, 20 bp, synthetic construct
  misc_feature 1..20: note = CRISPR gRNA sequence
  source 1..20: mol_type = other DNA
aggtttagagaggtgaaacg

SEQ ID NO: 25391 - DNA, 20 bp, synthetic construct
  misc_feature 1..20: note = CRISPR gRNA sequence
  source 1..20: mol_type = other DNA
agagaggtgaaacgacctac

SEQ ID NO: 25392 - DNA, 20 bp, synthetic construct
  misc_feature 1..20: note = CRISPR gRNA sequence
  source 1..20: mol_type = other DNA
gagaggtgaaacgacctacc

SEQ ID NO: 25393 - DNA, 20 bp, synthetic construct
  misc_feature 1..20: note = CRISPR gRNA sequence
  source 1..20: mol_type = other DNA
cccaagtttgcattagagat

SEQ ID NO: 25394 - DNA, 20 bp, synthetic construct
  misc_feature 1..20: note = CRISPR gRNA sequence
  source 1..20: mol_type = other DNA
gcattagagatagtaatgta

SEQ ID NO: 25395 - DNA, 20 bp, synthetic construct
  misc_feature 1..20: note = CRISPR gRNA sequence
  source 1..20: mol_type = other DNA
cattagagatagtaatgtac

SEQ ID NO: 25396 - DNA, 20 bp, synthetic construct
  misc_feature 1..20: note = CRISPR gRNA sequence
  source 1..20: mol_type = other DNA
gagatagtaatgtacagatc

SEQ ID NO: 25397 - DNA, 20 bp, synthetic construct
  misc_feature 1..20: note = CRISPR gRNA sequence
  source 1..20: mol_type = other DNA
aaattctaacctaggtcttt

SEQ ID NO: 25398 - DNA, 20 bp, synthetic construct
  misc_feature 1..20: note = CRISPR gRNA sequence
  source 1..20: mol_type = other DNA
taacctaggtctttctcgtt

SEQ ID NO: 25399 - DNA, 20 bp, synthetic construct
  misc_feature 1..20: note = CRISPR gRNA sequence
  source 1..20: mol_type = other DNA
acctaggtctttctcgtttc

SEQ ID NO: 25400 - DNA, 20 bp, synthetic construct
  misc_feature 1..20: note = CRISPR gRNA sequence
  source 1..20: mol_type = other DNA
ggtctttctcgtttcaaagt

SEQ ID NO: 25401 - DNA, 20 bp, synthetic construct
  misc_feature 1..20: note = CRISPR gRNA sequence
  source 1..20: mol_type = other DNA
tctcgtttcaaagtctccat

SEQ ID NO: 25402 - DNA, 20 bp, synthetic construct
  misc_feature 1..20: note = CRISPR gRNA sequence
  source 1..20: mol_type = other DNA
ctcgtttcaaagtctccatt

SEQ ID NO: 25403 - DNA, 20 bp, synthetic construct
  misc_feature 1..20: note = CRISPR gRNA sequence
  source 1..20: mol_type = other DNA
tcgtttcaaagtctccattt

SEQ ID NO: 25404 - DNA, 20 bp, synthetic construct
  misc_feature 1..20: note = CRISPR gRNA sequence
  source 1..20: mol_type = other DNA
gtttcaaagtctccattttt

SEQ ID NO: 25405 - DNA, 20 bp, synthetic construct
  misc_feature 1..20: note = CRISPR gRNA sequence
  source 1..20: mol_type = other DNA
caaagtctccatttttaacc

SEQ ID NO: 25406 - DNA, 20 bp, synthetic construct
  misc_feature 1..20: note = CRISPR gRNA sequence
  source 1..20: mol_type = other DNA
aaagtctccatttttaacca

SEQ ID NO: 25407 - DNA, 20 bp, synthetic construct
  misc_feature 1..20: note = CRISPR gRNA sequence
  source 1..20: mol_type = other DNA
catttttaaccacaaaaaaa

SEQ ID NO: 25408 - DNA, 20 bp, synthetic construct
  misc_feature 1..20: note = CRISPR gRNA sequence
  source 1..20: mol_type = other DNA
ttaaccacaaaaaaagaaag

SEQ ID NO: 25409 - DNA, 20 bp, synthetic construct
  misc_feature 1..20: note = CRISPR gRNA sequence
  source 1..20: mol_type = other DNA
taaccacaaaaaaagaaagt

SEQ ID NO: 25410 - DNA, 20 bp, synthetic construct
  misc_feature 1..20: note = CRISPR gRNA sequence
  source 1..20: mol_type = other DNA
aaccacaaaaaaagaaagtg

SEQ ID NO: 25411 - DNA, 20 bp, synthetic construct
  misc_feature 1..20: note = CRISPR gRNA sequence
  source 1..20: mol_type = other DNA
accacaaaaaaagaaagtgt

SEQ ID NO: 25412 - DNA, 20 bp, synthetic construct
  misc_feature 1..20: note = CRISPR gRNA sequence
  source 1..20: mol_type = other DNA
gggttggaagatttgctaag

SEQ ID NO: 25413 - DNA, 20 bp, synthetic construct
  misc_feature 1..20: note = CRISPR gRNA sequence
  source 1..20: mol_type = other DNA
gaagatttgctaaggcttaa

SEQ ID NO: 25414 - DNA, 20 bp, synthetic construct
  misc_feature 1..20: note = CRISPR gRNA sequence
  source 1..20: mol_type = other DNA
gctaaggcttaagcagagaa

SEQ ID NO: 25415 - DNA, 20 bp, synthetic construct
  misc_feature 1..20: note = CRISPR gRNA sequence
  source 1..20: mol_type = other DNA
ctaaggcttaagcagagaag

SEQ ID NO: 25416 - DNA, 20 bp, synthetic construct
  misc_feature 1..20: note = CRISPR gRNA sequence
  source 1..20: mol_type = other DNA
aggcttaagcagagaagcta

SEQ ID NO: 25417 - DNA, 20 bp, synthetic construct
  misc_feature 1..20: note = CRISPR gRNA sequence
  source 1..20: mol_type = other DNA
aagcagagaagctaatttgt

SEQ ID NO: 25418 - DNA, 20 bp, synthetic construct
  misc_feature 1..20: note = CRISPR gRNA sequence
  source 1..20: mol_type = other DNA
agcagagaagctaatttgta

SEQ ID NO: 25419 - DNA, 20 bp, synthetic construct
  misc_feature 1..20: note = CRISPR gRNA sequence
  source 1..20: mol_type = other DNA
atttgtagccttaagaagag

SEQ ID NO: 25420 - DNA, 20 bp, synthetic construct
  misc_feature 1..20: note = CRISPR gRNA sequence
  source 1..20: mol_type = other DNA
gtagccttaagaagagctac

SEQ ID NO: 25421 - DNA, 20 bp, synthetic construct
  misc_feature 1..20: note = CRISPR gRNA sequence
  source 1..20: mol_type = other DNA
tagccttaagaagagctaca

SEQ ID NO: 25422 - DNA, 20 bp, synthetic construct
  misc_feature 1..20: note = CRISPR gRNA sequence
  source 1..20: mol_type = other DNA
aagaagagctacagctttca

SEQ ID NO: 25423 - DNA, 20 bp, synthetic construct
  misc_feature 1..20: note = CRISPR gRNA sequence
  source 1..20: mol_type = other DNA
agaagagctacagctttcag

SEQ ID NO: 25424 - DNA, 20 bp, synthetic construct
  misc_feature 1..20: note = CRISPR gRNA sequence
  source 1..20: mol_type = other DNA
cagctttcagacaagggcag

SEQ ID NO: 25425 - DNA, 20 bp, synthetic construct
  misc_feature 1..20: note = CRISPR gRNA sequence
  source 1..20: mol_type = other DNA
tcagacaagggcaggactct

SEQ ID NO: 25426 - DNA, 20 bp, synthetic construct
  misc_feature 1..20: note = CRISPR gRNA sequence
  source 1..20: mol_type = other DNA
cagacaagggcaggactctt

SEQ ID NO: 25427 - DNA, 20 bp, synthetic construct
  misc_feature 1..20: note = CRISPR gRNA sequence
  source 1..20: mol_type = other DNA
agacaagggcaggactcttg

SEQ ID NO: 25428 - DNA, 20 bp, synthetic construct
  misc_feature 1..20: note = CRISPR gRNA sequence
  source 1..20: mol_type = other DNA
ttggggagaggtggtggtgg

SEQ ID NO: 25429 - DNA, 20 bp, synthetic construct
  misc_feature 1..20: note = CRISPR gRNA sequence
  source 1..20: mol_type = other DNA
ggggagaggtggtggtggtg

SEQ ID NO: 25430 - DNA, 20 bp, synthetic construct
  misc_feature 1..20: note = CRISPR gRNA sequence
  source 1..20: mol_type = other DNA
gggagaggtggtggtggtgt

SEQ ID NO: 25431 - DNA, 20 bp, synthetic construct
  misc_feature 1..20: note = CRISPR gRNA sequence
  source 1..20: mol_type = other DNA
ctgctagtggtttgtttttt

SEQ ID NO: 25432 - DNA, 20 bp, synthetic construct
  misc_feature 1..20: note = CRISPR gRNA sequence
  source 1..20: mol_type = other DNA
ctagtggtttgttttttggg

SEQ ID NO: 25433 - DNA, 20 bp, synthetic construct
  misc_feature 1..20: note = CRISPR gRNA sequence
  source 1..20: mol_type = other DNA
gtggtttgttttttggggga

SEQ ID NO: 25434 - DNA, 20 bp, synthetic construct
  misc_feature 1..20: note = CRISPR gRNA sequence
  source 1..20: mol_type = other DNA
gttttttgggggagagacgt

SEQ ID NO: 25435 - DNA, 20 bp, synthetic construct
  misc_feature 1..20: note = CRISPR gRNA sequence
  source 1..20: mol_type = other DNA
ttttttgggggagagacgtg

SEQ ID NO: 25436 - DNA, 20 bp, synthetic construct
  misc_feature 1..20: note = CRISPR gRNA sequence
  source 1..20: mol_type = other DNA
tttgggggagagacgtggga

SEQ ID NO: 25437 - DNA, 20 bp, synthetic construct
  misc_feature 1..20: note = CRISPR gRNA sequence
  source 1..20: mol_type = other DNA
ttgggggagagacgtgggat

SEQ ID NO: 25438 - DNA, 20 bp, synthetic construct
  misc_feature 1..20: note = CRISPR gRNA sequence
  source 1..20: mol_type = other DNA
tgggggagagacgtgggata

SEQ ID NO: 25439 - DNA, 20 bp, synthetic construct
  misc_feature 1..20: note = CRISPR gRNA sequence
  source 1..20: mol_type = other DNA
gggggagagacgtgggatag

SEQ ID NO: 25440 - DNA, 20 bp, synthetic construct
  misc_feature 1..20: note = CRISPR gRNA sequence
  source 1..20: mol_type = other DNA
ggggagagacgtgggataga

SEQ ID NO: 25441 - DNA, 20 bp, synthetic construct
  misc_feature 1..20: note = CRISPR gRNA sequence
  source 1..20: mol_type = other DNA
ttctcaccagcatcaccacc

SEQ ID NO: 25442 - DNA, 20 bp, synthetic construct
  misc_feature 1..20: note = CRISPR gRNA sequence
  source 1..20: mol_type = other DNA
ctcaccagcatcaccaccac

SEQ ID NO: 25443 - DNA, 20 bp, synthetic construct
  misc_feature 1..20: note = CRISPR gRNA sequence
  source 1..20: mol_type = other DNA
tcaccagcatcaccaccacc

SEQ ID NO: 25444 - DNA, 20 bp, synthetic construct
  misc_feature 1..20: note = CRISPR gRNA sequence
  source 1..20: mol_type = other DNA
accagcatcaccaccacctc

SEQ ID NO: 25445 - DNA, 20 bp, synthetic construct
  misc_feature 1..20: note = CRISPR gRNA sequence
  source 1..20: mol_type = other DNA
atacagagcctatgttgaaa

SEQ ID NO: 25446 - DNA, 20 bp, synthetic construct
  misc_feature 1..20: note = CRISPR gRNA sequence
  source 1..20: mol_type = other DNA
tgttgaaatagaaaaaagtg

SEQ ID NO: 25447 - DNA, 20 bp, synthetic construct
  misc_feature 1..20: note = CRISPR gRNA sequence
  source 1..20: mol_type = other DNA
aaatagaaaaaagtggcctt

SEQ ID NO: 25448 - DNA, 20 bp, synthetic construct
  misc_feature 1..20: note = CRISPR gRNA sequence
  source 1..20: mol_type = other DNA
tttctggaggatgcagcccc

SEQ ID NO: 25449 - DNA, 20 bp, synthetic construct
  misc_feature 1..20: note = CRISPR gRNA sequence
  source 1..20: mol_type = other DNA
ttctggaggatgcagcccct

SEQ ID NO: 25450 - DNA, 20 bp, synthetic construct
  misc_feature 1..20: note = CRISPR gRNA sequence
  source 1..20: mol_type = other DNA
tctggaggatgcagccccta

SEQ ID NO: 25451 - DNA, 20 bp, synthetic construct
  misc_feature 1..20: note = CRISPR gRNA sequence
  source 1..20: mol_type = other DNA
ctggaggatgcagcccctac

SEQ ID NO: 25452 - DNA, 20 bp, synthetic construct
  misc_feature 1..20: note = CRISPR gRNA sequence
  source 1..20: mol_type = other DNA
tggaggatgcagcccctacc

SEQ ID NO: 25453 - DNA, 20 bp, synthetic construct
  misc_feature 1..20: note = CRISPR gRNA sequence
  source 1..20: mol_type = other DNA
gaggatgcagcccctaccag

SEQ ID NO: 25454 - DNA, 20 bp, synthetic construct
  misc_feature 1..20: note = CRISPR gRNA sequence
  source 1..20: mol_type = other DNA
ccaggaagtaactgcttggc

SEQ ID NO: 25455 - DNA, 20 bp, synthetic construct
  misc_feature 1..20: note = CRISPR gRNA sequence
  source 1..20: mol_type = other DNA
cttggctagcaaagtgcaag

SEQ ID NO: 25456 - DNA, 20 bp, synthetic construct
  misc_feature 1..20: note = CRISPR gRNA sequence
  source 1..20: mol_type = other DNA
ggctagcaaagtgcaagccg

SEQ ID NO: 25457 - DNA, 20 bp, synthetic construct
  misc_feature 1..20: note = CRISPR gRNA sequence
  source 1..20: mol_type = other DNA
gctagcaaagtgcaagccgg

SEQ ID NO: 25458 - DNA, 20 bp, synthetic construct
  misc_feature 1..20: note = CRISPR gRNA sequence
  source 1..20: mol_type = other DNA
gcaaagtgcaagccggagtc

SEQ ID NO: 25459 - DNA, 20 bp, synthetic construct
  misc_feature 1..20: note = CRISPR gRNA sequence
  source 1..20: mol_type = other DNA
cccccattttccttgttggc

SEQ ID NO: 25460 - DNA, 20 bp, synthetic construct
  misc_feature 1..20: note = CRISPR gRNA sequence
  source 1..20: mol_type = other DNA
tccttgttggcttgggcacc

SEQ ID NO: 25461 - DNA, 20 bp, synthetic construct
  misc_feature 1..20: note = CRISPR gRNA sequence
  source 1..20: mol_type = other DNA
ccttgttggcttgggcacct

SEQ ID NO: 25462 - DNA, 20 bp, synthetic construct
  misc_feature 1..20: note = CRISPR gRNA sequence
  source 1..20: mol_type = other DNA
cttgttggcttgggcacctg

SEQ ID NO: 25463 - DNA, 20 bp, synthetic construct
  misc_feature 1..20: note = CRISPR gRNA sequence
  source 1..20: mol_type = other DNA
gttggcttgggcacctgtgt

SEQ ID NO: 25464 - DNA, 20 bp, synthetic construct
  misc_feature 1..20: note = CRISPR gRNA sequence
  source 1..20: mol_type = other DNA
ttggcttgggcacctgtgtg

SEQ ID NO: 25465 - DNA, 20 bp, synthetic construct
  misc_feature 1..20: note = CRISPR gRNA sequence
  source 1..20: mol_type = other DNA
gcttgggcacctgtgtgcag

SEQ ID NO: 25466 - DNA, 20 bp, synthetic construct
  misc_feature 1..20: note = CRISPR gRNA sequence
  source 1..20: mol_type = other DNA
gggcacctgtgtgcagtgaa

SEQ ID NO: 25467 - DNA, 20 bp, synthetic construct
  misc_feature 1..20: note = CRISPR gRNA sequence
  source 1..20: mol_type = other DNA
ggcacctgtgtgcagtgaac

SEQ ID NO: 25468 - DNA, 20 bp, synthetic construct
  misc_feature 1..20: note = CRISPR gRNA sequence
  source 1..20: mol_type = other DNA
tgtgcagtgaacaacctgca

SEQ ID NO: 25469 - DNA, 20 bp, synthetic construct
  misc_feature 1..20: note = CRISPR gRNA sequence
  source 1..20: mol_type = other DNA
caaaactcttcttagtggtc

SEQ ID NO: 25470 - DNA, 20 bp, synthetic construct
  misc_feature 1..20: note = CRISPR gRNA sequence
  source 1..20: mol_type = other DNA
ttcttagtggtcttcttcct

SEQ ID NO: 25471 - DNA, 20 bp, synthetic construct
  misc_feature 1..20: note = CRISPR gRNA sequence
  source 1..20: mol_type = other DNA
cttagtggtcttcttcctgc

SEQ ID NO: 25472 - DNA, 20 bp, synthetic construct
  misc_feature 1..20: note = CRISPR gRNA sequence
  source 1..20: mol_type = other DNA
ttagtggtcttcttcctgcc

SEQ ID NO: 25473 - DNA, 20 bp, synthetic construct
  misc_feature 1..20: note = CRISPR gRNA sequence
  source 1..20: mol_type = other DNA
agtggtcttcttcctgccaa

SEQ ID NO: 25474 - DNA, 20 bp, synthetic construct
  misc_feature 1..20: note = CRISPR gRNA sequence
  source 1..20: mol_type = other DNA
gtggtcttcttcctgccaac

SEQ ID NO: 25475 - DNA, 20 bp, synthetic construct
  misc_feature 1..20: note = CRISPR gRNA sequence
  source 1..20: mol_type = other DNA
cttcctgccaacccaggaac

SEQ ID NO: 25476 - DNA, 20 bp, synthetic construct
  misc_feature 1..20: note = CRISPR gRNA sequence
  source 1..20: mol_type = other DNA
ttcctgccaacccaggaaca

SEQ ID NO: 25477 - DNA, 20 bp, synthetic construct
  misc_feature 1..20: note = CRISPR gRNA sequence
  source 1..20: mol_type = other DNA
cctgccaacccaggaacagc

SEQ ID NO: 25478 - DNA, 20 bp, synthetic construct
  misc_feature 1..20: note = CRISPR gRNA sequence
  source 1..20: mol_type = other DNA
ctgccaacccaggaacagca

SEQ ID NO: 25479 - DNA, 20 bp, synthetic construct
  misc_feature 1..20: note = CRISPR gRNA sequence
  source 1..20: mol_type = other DNA
ccaacccaggaacagcagca

SEQ ID NO: 25480 - DNA, 20 bp, synthetic construct
  misc_feature 1..20: note = CRISPR gRNA sequence
  source 1..20: mol_type = other DNA
agcagttctgtgcttgatcc

SEQ ID NO: 25481 - DNA, 20 bp, synthetic construct
  misc_feature 1..20: note = CRISPR gRNA sequence
  source 1..20: mol_type = other DNA
tgtgcttgatccaaatgtgg

SEQ ID NO: 25482 - DNA, 20 bp, synthetic construct
  misc_feature 1..20: note = CRISPR gRNA sequence
  source 1..20: mol_type = other DNA
tgcttgatccaaatgtggcc

SEQ ID NO: 25483 - DNA, 20 bp, synthetic construct
  misc_feature 1..20: note = CRISPR gRNA sequence
  source 1..20: mol_type = other DNA
gatccaaatgtggccaattt

SEQ ID NO: 25484 - DNA, 20 bp, synthetic construct
  misc_feature 1..20: note = CRISPR gRNA sequence
  source 1..20: mol_type = other DNA
atccaaatgtggccaatttt

SEQ ID NO: 25485 - DNA, 20 bp, synthetic construct
  misc_feature 1..20: note = CRISPR gRNA sequence
  source 1..20: mol_type = other DNA
ttccccagagcacagtgtat

SEQ ID NO: 25486 - DNA, 20 bp, synthetic construct
  misc_feature 1..20: note = CRISPR gRNA sequence
  source 1..20: mol_type = other DNA
tccccagagcacagtgtatt

SEQ ID NO: 25487 - DNA, 20 bp, synthetic construct
  misc_feature 1..20: note = CRISPR gRNA sequence
  source 1..20: mol_type = other DNA
ccccagagcacagtgtattg

SEQ ID NO: 25488 - DNA, 20 bp, synthetic construct
  misc_feature 1..20: note = CRISPR gRNA sequence
  source 1..20: mol_type = other DNA
cccagagcacagtgtattga

SEQ ID NO: 25489 - DNA, 20 bp, synthetic construct
  misc_feature 1..20: note = CRISPR gRNA sequence
  source 1..20: mol_type = other DNA
aaaatcataccaaggaagaa

SEQ ID NO: 25490 - DNA, 20 bp, synthetic construct
  misc_feature 1..20: note = CRISPR gRNA sequence
  source 1..20: mol_type = other DNA
gtaattgttcatgtttcaga

SEQ ID NO: 25491 - DNA, 20 bp, synthetic construct
  misc_feature 1..20: note = CRISPR gRNA sequence
  source 1..20: mol_type = other DNA
ttcatgtttcagaaattaca

SEQ ID NO: 25492 - DNA, 20 bp, synthetic construct
  misc_feature 1..20: note = CRISPR gRNA sequence
  source 1..20: mol_type = other DNA
atgtttcagaaattacagaa

SEQ ID NO: 25493 - DNA, 20 bp, synthetic construct
  misc_feature 1..20: note = CRISPR gRNA sequence
  source 1..20: mol_type = other DNA
cagaaattacagaactgaga

SEQ ID NO: 25494 - DNA, 20 bp, synthetic construct
  misc_feature 1..20: note = CRISPR gRNA sequence
  source 1..20: mol_type = other DNA
agaaattacagaactgagag

SEQ ID NO: 25495 - DNA, 20 bp, synthetic construct
  misc_feature 1..20: note = CRISPR gRNA sequence
  source 1..20: mol_type = other DNA
cagaactgagagcttgactg

SEQ ID NO: 25496 - DNA, 20 bp, synthetic construct
  misc_feature 1..20: note = CRISPR gRNA sequence
  source 1..20: mol_type = other DNA
agagcttgactgcttccttc

SEQ ID NO: 25497 - DNA, 20 bp, synthetic construct
  misc_feature 1..20: note = CRISPR gRNA sequence
  source 1..20: mol_type = other DNA
gactgcttccttcccttcct

SEQ ID NO: 25498 - DNA, 20 bp, synthetic construct
  misc_feature 1..20: note = CRISPR gRNA sequence
  source 1..20: mol_type = other DNA
actgcttccttcccttcctg

SEQ ID NO: 25499 - DNA, 20 bp, synthetic construct
  misc_feature 1..20: note = CRISPR gRNA sequence
  source 1..20: mol_type = other DNA
cttccttcccttcctgggga

SEQ ID NO: 25500 - DNA, 20 bp, synthetic construct
  misc_feature 1..20: note = CRISPR gRNA sequence
  source 1..20: mol_type = other DNA
ccttcccttcctggggattt

SEQ ID NO: 25501 - DNA, 20 bp, synthetic construct
  misc_feature 1..20: note = CRISPR gRNA sequence
  source 1..20: mol_type = other DNA
cttcccttcctggggattta

SEQ ID NO: 25502 - DNA, 20 bp, synthetic construct
  misc_feature 1..20: note = CRISPR gRNA sequence
  source 1..20: mol_type = other DNA
cccttcctggggatttacat

SEQ ID NO: 25503 - DNA, 20 bp, synthetic construct
  misc_feature 1..20: note = CRISPR gRNA sequence
  source 1..20: mol_type = other DNA
ccttcctggggatttacatg

SEQ ID NO: 25504 - DNA, 20 bp, synthetic construct
  misc_feature 1..20: note = CRISPR gRNA sequence
  source 1..20: mol_type = other DNA
cctggggatttacatggggg

SEQ ID NO: 25505 - DNA, 20 bp, synthetic construct
  misc_feature 1..20: note = CRISPR gRNA sequence
  source 1..20: mol_type = other DNA
ctggggatttacatggggga

SEQ ID NO: 25506 - DNA, 20 bp, synthetic construct
  misc_feature 1..20: note = CRISPR gRNA sequence
  source 1..20: mol_type = other DNA
gggatttacatgggggaagc

SEQ ID NO: 25507 - DNA, 20 bp, synthetic construct
  misc_feature 1..20: note = CRISPR gRNA sequence
  source 1..20: mol_type = other DNA
acatgggggaagcagaagtg

SEQ ID NO: 25508 - DNA, 20 bp, synthetic construct
  misc_feature 1..20: note = CRISPR gRNA sequence
  source 1..20: mol_type = other DNA
catgggggaagcagaagtga

SEQ ID NO: 25509 - DNA, 20 bp, synthetic construct
  misc_feature 1..20: note = CRISPR gRNA sequence
  source 1..20: mol_type = other DNA
gggctgaggacattcacatt

SEQ ID NO: 25510 - DNA, 20 bp, synthetic construct
  misc_feature 1..20: note = CRISPR gRNA sequence
  source 1..20: mol_type = other DNA
aggacattcacatttcctca

SEQ ID NO: 25511 - DNA, 20 bp, synthetic construct
  misc_feature 1..20: note = CRISPR gRNA sequence
  source 1..20: mol_type = other DNA
acatttcctcacaactggag

SEQ ID NO: 25512 - DNA, 20 bp, synthetic construct
  misc_feature 1..20: note = CRISPR gRNA sequence
  source 1..20: mol_type = other DNA
cctcacaactggaggcagtc

SEQ ID NO: 25513 - DNA, 20 bp, synthetic construct
  misc_feature 1..20: note = CRISPR gRNA sequence
  source 1..20: mol_type = other DNA
ctcacaactggaggcagtca

SEQ ID NO: 25514 - DNA, 20 bp, synthetic construct
  misc_feature 1..20: note = CRISPR gRNA sequence
  source 1..20: mol_type = other DNA
acaactggaggcagtcatta

SEQ ID NO: 25515 - DNA, 20 bp, synthetic construct
  misc_feature 1..20: note = CRISPR gRNA sequence
  source 1..20: mol_type = other DNA
gaggcagtcattaaggattt

SEQ ID NO: 25516 - DNA, 20 bp, synthetic construct
  misc_feature 1..20: note = CRISPR gRNA sequence
  source 1..20: mol_type = other DNA
aggatttgggcatgtcatag

SEQ ID NO: 25517 - DNA, 20 bp, synthetic construct
  misc_feature 1..20: note = CRISPR gRNA sequence
  source 1..20: mol_type = other DNA
gggcatgtcataggatttgg

SEQ ID NO: 25518 - DNA, 20 bp, synthetic construct
  misc_feature 1..20: note = CRISPR gRNA sequence
  source 1..20: mol_type = other DNA
ggcatgtcataggatttggg

SEQ ID NO: 25519 - DNA, 20 bp, synthetic construct
  misc_feature 1..20: note = CRISPR gRNA sequence
  source 1..20: mol_type = other DNA
gggtgtttttctcccccctt

SEQ ID NO: 25520 - DNA, 20 bp, synthetic construct
  misc_feature 1..20: note = CRISPR gRNA sequence
  source 1..20: mol_type = other DNA
ggtgtttttctcccccctta

SEQ ID NO: 25521 - DNA, 20 bp, synthetic construct
  misc_feature 1..20: note = CRISPR gRNA sequence
  source 1..20: mol_type = other DNA
ttctccccccttagtggcat

SEQ ID NO: 25522 - DNA, 20 bp, synthetic construct
  misc_feature 1..20: note = CRISPR gRNA sequence
  source 1..20: mol_type = other DNA
tctccccccttagtggcatc

SEQ ID NO: 25523 - DNA, 20 bp, synthetic construct
  misc_feature 1..20: note = CRISPR gRNA sequence
  source 1..20: mol_type = other DNA
ctccccccttagtggcatct

SEQ ID NO: 25524 - DNA, 20 bp, synthetic construct
  misc_feature 1..20: note = CRISPR gRNA sequence
  source 1..20: mol_type = other DNA
tccccccttagtggcatctc

SEQ ID NO: 25525 - DNA, 20 bp, synthetic construct
  misc_feature 1..20: note = CRISPR gRNA sequence
  source 1..20: mol_type = other DNA
cccccttagtggcatctcca

SEQ ID NO: 25526 - DNA, 20 bp, synthetic construct
  misc_feature 1..20: note = CRISPR gRNA sequence
  source 1..20: mol_type = other DNA
agtggcatctccacaggcag

SEQ ID NO: 25527 - DNA, 20 bp, synthetic construct
  misc_feature 1..20: note = CRISPR gRNA sequence
  source 1..20: mol_type = other DNA
gtggcatctccacaggcagc

SEQ ID NO: 25528 - DNA, 20 bp, synthetic construct
  misc_feature 1..20: note = CRISPR gRNA sequence
  source 1..20: mol_type = other DNA
cacaggcagcgaaagctgtc

SEQ ID NO: 25529 - DNA, 20 bp, synthetic construct
  misc_feature 1..20: note = CRISPR gRNA sequence
  source 1..20: mol_type = other DNA
tctaagcaaataggtgaggc

SEQ ID NO: 25530 - DNA, 20 bp, synthetic construct
  misc_feature 1..20: note = CRISPR gRNA sequence
  source 1..20: mol_type = other DNA
agcaaataggtgaggcagtg

SEQ ID NO: 25531 - DNA, 20 bp, synthetic construct
  misc_feature 1..20: note = CRISPR gRNA sequence
  source 1..20: mol_type = other DNA
gtccattttttgttgcttaa

SEQ ID NO: 25532 - DNA, 20 bp, synthetic construct
  misc_feature 1..20: note = CRISPR gRNA sequence
  source 1..20: mol_type = other DNA
tttgttgcttaaaacaacat

SEQ ID NO: 25533 - DNA, 20 bp, synthetic construct
  misc_feature 1..20: note = CRISPR gRNA sequence
  source 1..20: mol_type = other DNA
ttgttgcttaaaacaacata

SEQ ID NO: 25534 - DNA, 20 bp, synthetic construct
  misc_feature 1..20: note = CRISPR gRNA sequence
  source 1..20: mol_type = other DNA
tgttgcttaaaacaacatac

SEQ ID NO: 25535 - DNA, 20 bp, synthetic construct
  misc_feature 1..20: note = CRISPR gRNA sequence
  source 1..20: mol_type = other DNA
gttgcttaaaacaacatacc

SEQ ID NO: 25536 - DNA, 20 bp, synthetic construct
  misc_feature 1..20: note = CRISPR gRNA sequence
  source 1..20: mol_type = other DNA
ttgcttaaaacaacatacct

SEQ ID NO: 25537 - DNA, 20 bp, synthetic construct
  misc_feature 1..20: note = CRISPR gRNA sequence
  source 1..20: mol_type = other DNA
cttaaaacaacatacctgac

SEQ ID NO: 25538 - DNA, 20 bp, synthetic construct
  misc_feature 1..20: note = CRISPR gRNA sequence
  source 1..20: mol_type = other DNA
aaaacaacatacctgacact

SEQ ID NO: 25539 - DNA, 20 bp, synthetic construct
  misc_feature 1..20: note = CRISPR gRNA sequence
  source 1..20: mol_type = other DNA
aaacaacatacctgacactg

SEQ ID NO: 25540 - DNA, 20 bp, synthetic construct
  misc_feature 1..20: note = CRISPR gRNA sequence
  source 1..20: mol_type = other DNA
acactgagtaatttataaag

SEQ ID NO: 25541 - DNA, 20 bp, synthetic construct
  misc_feature 1..20: note = CRISPR gRNA sequence
  source 1..20: mol_type = other DNA
agtaatttataaagaaaaaa

SEQ ID NO: 25542 - DNA, 20 bp, synthetic construct
  misc_feature 1..20: note = CRISPR gRNA sequence
  source 1..20: mol_type = other DNA
ataaagaaaaaaaatatttc

SEQ ID NO: 25543 - DNA, 20 bp, synthetic construct
  misc_feature 1..20: note = CRISPR gRNA sequence
  source 1..20: mol_type = other DNA
taaagaaaaaaaatatttct

SEQ ID NO: 25544 - DNA, 20 bp, synthetic construct
  misc_feature 1..20: note = CRISPR gRNA sequence
  source 1..20: mol_type = other DNA
cttacagttatggaggctga

SEQ ID NO: 25545 - DNA, 20 bp, synthetic construct
  misc_feature 1..20: note = CRISPR gRNA sequence
  source 1..20: mol_type = other DNA
ttacagttatggaggctgag

SEQ ID NO: 25546 - DNA, 20 bp, synthetic construct
  misc_feature 1..20: note = CRISPR gRNA sequence
  source 1..20: mol_type = other DNA
acagttatggaggctgagaa

SEQ ID NO: 25547 - DNA, 20 bp, synthetic construct
  misc_feature 1..20: note = CRISPR gRNA sequence
  source 1..20: mol_type = other DNA
cagttatggaggctgagaag

SEQ ID NO: 25548 - DNA, 20 bp, synthetic construct
  misc_feature 1..20: note = CRISPR gRNA sequence
  source 1..20: mol_type = other DNA
tggaggctgagaagtccaag

SEQ ID NO: 25549 - DNA, 20 bp, synthetic construct
  misc_feature 1..20: note = CRISPR gRNA sequence
  source 1..20: mol_type = other DNA
agaagtccaaggttaggggc

SEQ ID NO: 25550 - DNA, 20 bp, synthetic construct
  misc_feature 1..20: note = CRISPR gRNA sequence
  source 1..20: mol_type = other DNA
ggggctgcatctggtgaggg

SEQ ID NO: 25551 - DNA, 20 bp, synthetic construct
  misc_feature 1..20: note = CRISPR gRNA sequence
  source 1..20: mol_type = other DNA
catctggtgagggccttctt

SEQ ID NO: 25552 - DNA, 20 bp, synthetic construct
  misc_feature 1..20: note = CRISPR gRNA sequence
  source 1..20: mol_type = other DNA
gtgagggccttcttactggt

SEQ ID NO: 25553 - DNA, 20 bp, synthetic construct
  misc_feature 1..20: note = CRISPR gRNA sequence
  source 1..20: mol_type = other DNA
cttactggtgaggactctct

SEQ ID NO: 25554 - DNA, 20 bp, synthetic construct
  misc_feature 1..20: note = CRISPR gRNA sequence
  source 1..20: mol_type = other DNA
ttactggtgaggactctctg

SEQ ID NO: 25555 - DNA, 20 bp, synthetic construct
  misc_feature 1..20: note = CRISPR gRNA sequence
  source 1..20: mol_type = other DNA
actggtgaggactctctgca

SEQ ID NO: 25556 - DNA, 20 bp, synthetic construct
  misc_feature 1..20: note = CRISPR gRNA sequence
  source 1..20: mol_type = other DNA
ctggtgaggactctctgcag

SEQ ID NO: 25557 - DNA, 20 bp, synthetic construct
  misc_feature 1..20: note = CRISPR gRNA sequence
  source 1..20: mol_type = other DNA
gtgaggactctctgcagagt

SEQ ID NO: 25558 - DNA, 20 bp, synthetic construct
  misc_feature 1..20: note = CRISPR gRNA sequence
  source 1..20: mol_type = other DNA
tctgcagagtcccaaggcag

SEQ ID NO: 25559 - DNA, 20 bp, synthetic construct
  misc_feature 1..20: note = CRISPR gRNA sequence
  source 1..20: mol_type = other DNA
tgcagagtcccaaggcagtg

SEQ ID NO: 25560 - DNA, 20 bp, synthetic construct
  misc_feature 1..20: note = CRISPR gRNA sequence
  source 1..20: mol_type = other DNA
cagagtcccaaggcagtgtg

SEQ ID NO: 25561 - DNA, 20 bp, synthetic construct
  misc_feature 1..20: note = CRISPR gRNA sequence
  source 1..20: mol_type = other DNA
cggtgtgatagtctctcttc

SEQ ID NO: 25562 - DNA, 20 bp, synthetic construct
  misc_feature 1..20: note = CRISPR gRNA sequence
  source 1..20: mol_type = other DNA
ggtgtgatagtctctcttcc

SEQ ID NO: 25563 - DNA, 20 bp, synthetic construct
  misc_feature 1..20: note = CRISPR gRNA sequence
  source 1..20: mol_type = other DNA
tcttcctcttctcataaaac

SEQ ID NO: 25564 - DNA, 20 bp, synthetic construct
  misc_feature 1..20: note = CRISPR gRNA sequence
  source 1..20: mol_type = other DNA
ttcctcttctcataaaacca

SEQ ID NO: 25565 - DNA, 20 bp, synthetic construct
  misc_feature 1..20: note = CRISPR gRNA sequence
  source 1..20: mol_type = other DNA
cctcttctcataaaaccact

SEQ ID NO: 25566 - DNA, 20 bp, synthetic construct
  misc_feature 1..20: note = CRISPR gRNA sequence
  source 1..20: mol_type = other DNA
ctcttctcataaaaccacta

SEQ ID NO: 25567 - DNA, 20 bp, synthetic construct
  misc_feature 1..20: note = CRISPR gRNA sequence
  source 1..20: mol_type = other DNA
ttctcataaaaccactagtc

SEQ ID NO: 25568 - DNA, 20 bp, synthetic construct
  misc_feature 1..20: note = CRISPR gRNA sequence
  source 1..20: mol_type = other DNA
ctcataaaaccactagtctt

SEQ ID NO: 25569 - DNA, 20 bp, synthetic construct
  misc_feature 1..20: note = CRISPR gRNA sequence
  source 1..20: mol_type = other DNA
tcataaaaccactagtctta

SEQ ID NO: 25570 - DNA, 20 bp, synthetic construct
  misc_feature 1..20: note = CRISPR gRNA sequence
  source 1..20: mol_type = other DNA
ataaaaccactagtcttact

SEQ ID NO: 25571 - DNA, 20 bp, synthetic construct
  misc_feature 1..20: note = CRISPR gRNA sequence
  source 1..20: mol_type = other DNA
gtcttactcccacgacaacc

SEQ ID NO: 25572 - DNA, 20 bp, synthetic construct
  misc_feature 1..20: note = CRISPR gRNA sequence
  source 1..20: mol_type = other DNA
actcccacgacaacccatta

SEQ ID NO: 25573 - DNA, 20 bp, synthetic construct
  misc_feature 1..20: note = CRISPR gRNA sequence
  source 1..20: mol_type = other DNA
ctcccacgacaacccattaa

SEQ ID NO: 25574 - DNA, 20 bp, synthetic construct
  misc_feature 1..20: note = CRISPR gRNA sequence
  source 1..20: mol_type = other DNA
ccacgacaacccattaactt

SEQ ID NO: 25575 - DNA, 20 bp, synthetic construct
  misc_feature 1..20: note = CRISPR gRNA sequence
  source 1..20: mol_type = other DNA
acttattaacctgtttatcc

SEQ ID NO: 25576 - DNA, 20 bp, synthetic construct
  misc_feature 1..20: note = CRISPR gRNA sequence
  source 1..20: mol_type = other DNA
attaacctgtttatccacta

SEQ ID NO: 25577 - DNA, 20 bp, synthetic construct
  misc_feature 1..20: note = CRISPR gRNA sequence
  source 1..20: mol_type = other DNA
ttaacctgtttatccactaa

SEQ ID NO: 25578 - DNA, 20 bp, synthetic construct
  misc_feature 1..20: note = CRISPR gRNA sequence
  source 1..20: mol_type = other DNA
acctgtttatccactaatcc

SEQ ID NO: 25579 - DNA, 20 bp, synthetic construct
  misc_feature 1..20: note = CRISPR gRNA sequence
  source 1..20: mol_type = other DNA
tttatccactaatccatgaa

SEQ ID NO: 25580 - DNA, 20 bp, synthetic construct
  misc_feature 1..20: note = CRISPR gRNA sequence
  source 1..20: mol_type = other DNA
atccactaatccatgaacgg

SEQ ID NO: 25581 - DNA, 20 bp, synthetic construct
  misc_feature 1..20: note = CRISPR gRNA sequence
  source 1..20: mol_type = other DNA
tccactaatccatgaacgga

SEQ ID NO: 25582 - DNA, 20 bp, synthetic construct
  misc_feature 1..20: note = CRISPR gRNA sequence
  source 1..20: mol_type = other DNA
atccatgaacggattaaccc

SEQ ID NO: 25583 - DNA, 20 bp, synthetic construct
  misc_feature 1..20: note = CRISPR gRNA sequence
  source 1..20: mol_type = other DNA
acccattcatcaaggaaaag

SEQ ID NO: 25584 - DNA, 20 bp, synthetic construct
  misc_feature 1..20: note = CRISPR gRNA sequence
  source 1..20: mol_type = other DNA
atcaaggaaaagccccagtc

SEQ ID NO: 25585 - DNA, 20 bp, synthetic construct
  misc_feature 1..20: note = CRISPR gRNA sequence
  source 1..20: mol_type = other DNA
ttaaaggccccacctctcaa

SEQ ID NO: 25586 - DNA, 20 bp, synthetic construct
  misc_feature 1..20: note = CRISPR gRNA sequence
  source 1..20: mol_type = other DNA
aaaggccccacctctcaata

SEQ ID NO: 25587 - DNA, 20 bp, synthetic construct
  misc_feature 1..20: note = CRISPR gRNA sequence
  source 1..20: mol_type = other DNA
aaggccccacctctcaatac

SEQ ID NO: 25588 - DNA, 20 bp, synthetic construct
  misc_feature 1..20: note = CRISPR gRNA sequence
  source 1..20: mol_type = other DNA
tcaatactgccacatagggg

SEQ ID NO: 25589 - DNA, 20 bp, synthetic construct
  misc_feature 1..20: note = CRISPR gRNA sequence
  source 1..20: mol_type = other DNA
aatactgccacataggggat

SEQ ID NO: 25590 - DNA, 20 bp, synthetic construct
  misc_feature 1..20: note = CRISPR gRNA sequence
  source 1..20: mol_type = other DNA
ccacataggggattacattt

SEQ ID NO: 25591 - DNA, 20 bp, synthetic construct
  misc_feature 1..20: note = CRISPR gRNA sequence
  source 1..20: mol_type = other DNA
catttatacatgagttttgg

SEQ ID NO: 25592 - DNA, 20 bp, synthetic construct
  misc_feature 1..20: note = CRISPR gRNA sequence
  source 1..20: mol_type = other DNA
atacatgagttttggagaag

SEQ ID NO: 25593 - DNA, 20 bp, synthetic construct
  misc_feature 1..20: note = CRISPR gRNA sequence
  source 1..20: mol_type = other DNA
tacatgagttttggagaaga

SEQ ID NO: 25594 - DNA, 20 bp, synthetic construct
  misc_feature 1..20: note = CRISPR gRNA sequence
  source 1..20: mol_type = other DNA
tggagaagacaaacattcac

SEQ ID NO: 25595 - DNA, 20 bp, synthetic construct
  misc_feature 1..20: note = CRISPR gRNA sequence
  source 1..20: mol_type = other DNA
ggagaagacaaacattcacg

SEQ ID NO: 25596 - DNA, 20 bp, synthetic construct
  misc_feature 1..20: note = CRISPR gRNA sequence
  source 1..20: mol_type = other DNA
gagaagacaaacattcacgt

SEQ ID NO: 25597 - DNA, 20 bp, synthetic construct
  misc_feature 1..20: note = CRISPR gRNA sequence
  source 1..20: mol_type = other DNA
acgtcataacaggcagcttc

SEQ ID NO: 25598 - DNA, 20 bp, synthetic construct
  misc_feature 1..20: note = CRISPR gRNA sequence
  source 1..20: mol_type = other DNA
cacccaagtctgctcctcaa

SEQ ID NO: 25599 - DNA, 20 bp, synthetic construct
  misc_feature 1..20: note = CRISPR gRNA sequence
  source 1..20: mol_type = other DNA
acccaagtctgctcctcaag

SEQ ID NO: 25600 - DNA, 20 bp, synthetic construct
  misc_feature 1..20: note = CRISPR gRNA sequence
  source 1..20: mol_type = other DNA
ctcctcaagtctgtgggttt

SEQ ID NO: 25601 - DNA, 20 bp, synthetic construct
  misc_feature 1..20: note = CRISPR gRNA sequence
  source 1..20: mol_type = other DNA
ctcaagtctgtgggttttct

SEQ ID NO: 25602 - DNA, 20 bp, synthetic construct
  misc_feature 1..20: note = CRISPR gRNA sequence
  source 1..20: mol_type = other DNA
aagtctgtgggttttctctc

SEQ ID NO: 25603 - DNA, 20 bp, synthetic construct
  misc_feature 1..20: note = CRISPR gRNA sequence
  source 1..20: mol_type = other DNA
tgggttttctctctgcttct

SEQ ID NO: 25604 - DNA, 20 bp, synthetic construct
  misc_feature 1..20: note = CRISPR gRNA sequence
  source 1..20: mol_type = other DNA
tctctctgcttctggaaggt

SEQ ID NO: 25605 - DNA, 20 bp, synthetic construct
  misc_feature 1..20: note = CRISPR gRNA sequence
  source 1..20: mol_type = other DNA
ctctctgcttctggaaggtg

SEQ ID NO: 25606 - DNA, 20 bp, synthetic construct
  misc_feature 1..20: note = CRISPR gRNA sequence
  source 1..20: mol_type = other DNA
tctctgcttctggaaggtga

SEQ ID NO: 25607 - DNA, 20 bp, synthetic construct
  misc_feature 1..20: note = CRISPR gRNA sequence
  source 1..20: mol_type = other DNA
tctgcttctggaaggtgaag

SEQ ID NO: 25608 - DNA, 20 bp, synthetic construct
  misc_feature 1..20: note = CRISPR gRNA sequence
  source 1..20: mol_type = other DNA
tgcttctggaaggtgaagcc

SEQ ID NO: 25609 - DNA, 20 bp, synthetic construct
  misc_feature 1..20: note = CRISPR gRNA sequence
  source 1..20: mol_type = other DNA
cttctggaaggtgaagccca

SEQ ID NO: 25610 - DNA, 20 bp, synthetic construct
  misc_feature 1..20: note = CRISPR gRNA sequence
  source 1..20: mol_type = other DNA
ctggaaggtgaagcccaggc

SEQ ID NO: 25611 - DNA, 20 bp, synthetic construct
  misc_feature 1..20: note = CRISPR gRNA sequence
  source 1..20: mol_type = other DNA
tggaaggtgaagcccaggcc

SEQ ID NO: 25612 - DNA, 20 bp, synthetic construct
  misc_feature 1..20: note = CRISPR gRNA sequence
  source 1..20: mol_type = other DNA
gaaggtgaagcccaggcctg

SEQ ID NO: 25613 - DNA, 20 bp, synthetic construct
  misc_feature 1..20: note = CRISPR gRNA sequence
  source 1..20: mol_type = other DNA
ggcaagtattcttttgcagc

SEQ ID NO: 25614 - DNA, 20 bp, synthetic construct
  misc_feature 1..20: note = CRISPR gRNA sequence
  source 1..20: mol_type = other DNA
ttttgcagcatcctgaaata

SEQ ID NO: 25615 - DNA, 20 bp, synthetic construct
  misc_feature 1..20: note = CRISPR gRNA sequence
  source 1..20: mol_type = other DNA
ttgcagcatcctgaaatatg

SEQ ID NO: 25616 - DNA, 20 bp, synthetic construct
  misc_feature 1..20: note = CRISPR gRNA sequence
  source 1..20: mol_type = other DNA
tgcagcatcctgaaatatga

SEQ ID NO: 25617 - DNA, 20 bp, synthetic construct
  misc_feature 1..20: note = CRISPR gRNA sequence
  source 1..20: mol_type = other DNA
gcagcatcctgaaatatgac

SEQ ID NO: 25618 - DNA, 20 bp, synthetic construct
  misc_feature 1..20: note = CRISPR gRNA sequence
  source 1..20: mol_type = other DNA
cagcatcctgaaatatgacc

SEQ ID NO: 25619 - DNA, 20 bp, synthetic construct
  misc_feature 1..20: note = CRISPR gRNA sequence
  source 1..20: mol_type = other DNA
aaatatgaccttagcttcta

SEQ ID NO: 25620 - DNA, 20 bp, synthetic construct
  misc_feature 1..20: note = CRISPR gRNA sequence
  source 1..20: mol_type = other DNA
agcttctaaatgtgtaaaat

SEQ ID NO: 25621 - DNA, 20 bp, synthetic construct
  misc_feature 1..20: note = CRISPR gRNA sequence
  source 1..20: mol_type = other DNA
gcttctaaatgtgtaaaatg

SEQ ID NO: 25622 - DNA, 20 bp, synthetic construct
  misc_feature 1..20: note = CRISPR gRNA sequence
  source 1..20: mol_type = other DNA
ctaaatgtgtaaaatggaga

SEQ ID NO: 25623 - DNA, 20 bp, synthetic construct
  misc_feature 1..20: note = CRISPR gRNA sequence
  source 1..20: mol_type = other DNA
taaatgtgtaaaatggagat

SEQ ID NO: 25624 - DNA, 20 bp, synthetic construct
  misc_feature 1..20: note = CRISPR gRNA sequence
  source 1..20: mol_type = other DNA
aatgtgtaaaatggagataa

SEQ ID NO: 25625 - DNA, 20 bp, synthetic construct
  misc_feature 1..20: note = CRISPR gRNA sequence
  source 1..20: mol_type = other DNA
taagactgaataagttacaa

SEQ ID NO: 25626 - DNA, 20 bp, synthetic construct
  misc_feature 1..20: note = CRISPR gRNA sequence
  source 1..20: mol_type = other DNA
aataagttacaatgtgtaaa

SEQ ID NO: 25627 - DNA, 20 bp, synthetic construct
  misc_feature 1..20: note = CRISPR gRNA sequence
  source 1..20: mol_type = other DNA
caatgtgtaaagcatttaga

SEQ ID NO: 25628 - DNA, 20 bp, synthetic construct
  misc_feature 1..20: note = CRISPR gRNA sequence
  source 1..20: mol_type = other DNA
agaaaaggaatttgcacaga

SEQ ID NO: 25629 - DNA, 20 bp, synthetic construct
  misc_feature 1..20: note = CRISPR gRNA sequence
  source 1..20: mol_type = other DNA
gaaaaggaatttgcacagag

SEQ ID NO: 25630 - DNA, 20 bp, synthetic construct
  misc_feature 1..20: note = CRISPR gRNA sequence
  source 1..20: mol_type = other DNA
gcacagagtaagcattcagt

SEQ ID NO: 25631 - DNA, 20 bp, synthetic construct
  misc_feature 1..20: note = CRISPR gRNA sequence
  source 1..20: mol_type = other DNA
cacagagtaagcattcagta

SEQ ID NO: 25632 - DNA, 20 bp, synthetic construct
  misc_feature 1..20: note = CRISPR gRNA sequence
  source 1..20: mol_type = other DNA
agtagatgttaggtactacc

SEQ ID NO: 25633 - DNA, 20 bp, synthetic construct
  misc_feature 1..20: note = CRISPR gRNA sequence
  source 1..20: mol_type = other DNA
ggtactaccccacaaccacc

SEQ ID NO: 25634 - DNA, 20 bp, synthetic construct
  misc_feature 1..20: note = CRISPR gRNA sequence
  source 1..20: mol_type = other DNA
ccccacaaccaccgttatca

SEQ ID NO: 25635 - DNA, 20 bp, synthetic construct
  misc_feature 1..20: note = CRISPR gRNA sequence
  source 1..20: mol_type = other DNA
tcattattatcaccatcatt

SEQ ID NO: 25636 - DNA, 20 bp, synthetic construct
  misc_feature 1..20: note = CRISPR gRNA sequence
  source 1..20: mol_type = other DNA
ttatcaccatcattattatc

SEQ ID NO: 25637 - DNA, 20 bp, synthetic construct
  misc_feature 1..20: note = CRISPR gRNA sequence
  source 1..20: mol_type = other DNA
tcaccatcattattatcatc

SEQ ID NO: 25638 - DNA, 20 bp, synthetic construct
  misc_feature 1..20: note = CRISPR gRNA sequence
  source 1..20: mol_type = other DNA
ttatcatcttcattttcatc

SEQ ID NO: 25639 - DNA, 20 bp, synthetic construct
  misc_feature 1..20: note = CRISPR gRNA sequence
  source 1..20: mol_type = other DNA
tcatcttcattttcatcacc

SEQ ID NO: 25640 - DNA, 20 bp, synthetic construct
  misc_feature 1..20: note = CRISPR gRNA sequence
  source 1..20: mol_type = other DNA
cattttcatcaccttcatta

SEQ ID NO: 25641 - DNA, 20 bp, synthetic construct
  misc_feature 1..20: note = CRISPR gRNA sequence
  source 1..20: mol_type = other DNA
attttcatcaccttcattat

SEQ ID NO: 25642 - DNA, 20 bp, synthetic construct
  misc_feature 1..20: note = CRISPR gRNA sequence
  source 1..20: mol_type = other DNA
tcatcaccttcattatggcc

SEQ ID NO: 25643 - DNA, 20 bp, synthetic construct
  misc_feature 1..20: note = CRISPR gRNA sequence
  source 1..20: mol_type = other DNA
catcaccttcattatggcca

SEQ ID NO: 25644 - DNA, 20 bp, synthetic construct
  misc_feature 1..20: note = CRISPR gRNA sequence
  source 1..20: mol_type = other DNA
atcaccttcattatggccat

SEQ ID NO: 25645 - DNA, 20 bp, synthetic construct
  misc_feature 1..20: note = CRISPR gRNA sequence
  source 1..20: mol_type = other DNA
cattatggccatcattccat

SEQ ID NO: 25646 - DNA, 20 bp, synthetic construct
  misc_feature 1..20: note = CRISPR gRNA sequence
  source 1..20: mol_type = other DNA
attatggccatcattccatt

SEQ ID NO: 25647 - DNA, 20 bp, synthetic construct
  misc_feature 1..20: note = CRISPR gRNA sequence
  source 1..20: mol_type = other DNA
tggccatcattccattcctc

SEQ ID NO: 25648 - DNA, 20 bp, synthetic construct
  misc_feature 1..20: note = CRISPR gRNA sequence
  source 1..20: mol_type = other DNA
cattcctcagctcagaagcc

SEQ ID NO: 25649 - DNA, 20 bp, synthetic construct
  misc_feature 1..20: note = CRISPR gRNA sequence
  source 1..20: mol_type = other DNA
ctcagctcagaagccttcta

SEQ ID NO: 25650 - DNA, 20 bp, synthetic construct
  misc_feature 1..20: note = CRISPR gRNA sequence
  source 1..20: mol_type = other DNA
agctcagaagccttctatgg

SEQ ID NO: 25651 - DNA, 20 bp, synthetic construct
  misc_feature 1..20: note = CRISPR gRNA sequence
  source 1..20: mol_type = other DNA
agaagccttctatggctccc

SEQ ID NO: 25652 - DNA, 20 bp, synthetic construct
  misc_feature 1..20: note = CRISPR gRNA sequence
  source 1..20: mol_type = other DNA
ctatggctccccattgctta

SEQ ID NO: 25653 - DNA, 20 bp, synthetic construct
  misc_feature 1..20: note = CRISPR gRNA sequence
  source 1..20: mol_type = other DNA
tatggctccccattgcttat

SEQ ID NO: 25654 - DNA, 20 bp, synthetic construct
  misc_feature 1..20: note = CRISPR gRNA sequence
  source 1..20: mol_type = other DNA
tggctccccattgcttataa

SEQ ID NO: 25655 - DNA, 20 bp, synthetic construct
  misc_feature 1..20: note = CRISPR gRNA sequence
  source 1..20: mol_type = other DNA
cccattgcttataaaatcaa

SEQ ID NO: 25656 - DNA, 20 bp, synthetic construct
  misc_feature 1..20: note = CRISPR gRNA sequence
  source 1..20: mol_type = other DNA
cttataaaatcaagtcctaa

SEQ ID NO: 25657 - DNA, 20 bp, synthetic construct
  misc_feature 1..20: note = CRISPR gRNA sequence
  source 1..20: mol_type = other DNA
ataaaatcaagtcctaactt

SEQ ID NO: 25658 - DNA, 20 bp, synthetic construct
  misc_feature 1..20: note = CRISPR gRNA sequence
  source 1..20: mol_type = other DNA
taaaatcaagtcctaacttt

SEQ ID NO: 25659 - DNA, 20 bp, synthetic construct
  misc_feature 1..20: note = CRISPR gRNA sequence
  source 1..20: mol_type = other DNA
actttccccagcatgaaact

SEQ ID NO: 25660 - DNA, 20 bp, synthetic construct
  misc_feature 1..20: note = CRISPR gRNA sequence
  source 1..20: mol_type = other DNA
tccccagcatgaaacttcta

SEQ ID NO: 25661 - DNA, 20 bp, synthetic construct
  misc_feature 1..20: note = CRISPR gRNA sequence
  source 1..20: mol_type = other DNA
ccccagcatgaaacttctac

SEQ ID NO: 25662 - DNA, 20 bp, synthetic construct
  misc_feature 1..20: note = CRISPR gRNA sequence
  source 1..20: mol_type = other DNA
cccagcatgaaacttctacc

SEQ ID NO: 25663 - DNA, 20 bp, synthetic construct
  misc_feature 1..20: note = CRISPR gRNA sequence
  source 1..20: mol_type = other DNA
ctaccaccgtcacctatctc

SEQ ID NO: 25664 - DNA, 20 bp, synthetic construct
  misc_feature 1..20: note = CRISPR gRNA sequence
  source 1..20: mol_type = other DNA
taccaccgtcacctatctct

SEQ ID NO: 25665 - DNA, 20 bp, synthetic construct
  misc_feature 1..20: note = CRISPR gRNA sequence
  source 1..20: mol_type = other DNA
ccaccgtcacctatctctca

SEQ ID NO: 25666 - DNA, 20 bp, synthetic construct
  misc_feature 1..20: note = CRISPR gRNA sequence
  source 1..20: mol_type = other DNA
tctctcagggtttcctaaac

SEQ ID NO: 25667 - DNA, 20 bp, synthetic construct
  misc_feature 1..20: note = CRISPR gRNA sequence
  source 1..20: mol_type = other DNA
tcagggtttcctaaacatac

SEQ ID NO: 25668 - DNA, 20 bp, synthetic construct
  misc_feature 1..20: note = CRISPR gRNA sequence
  source 1..20: mol_type = other DNA
agggtttcctaaacatactc

SEQ ID NO: 25669 - DNA, 20 bp, synthetic construct
  misc_feature 1..20: note = CRISPR gRNA sequence
  source 1..20: mol_type = other DNA
cctaaacatactctgaacaa

SEQ ID NO: 25670 - DNA, 20 bp, synthetic construct
  misc_feature 1..20: note = CRISPR gRNA sequence
  source 1..20: mol_type = other DNA
ctaaacatactctgaacaag

SEQ ID NO: 25671 - DNA, 20 bp, synthetic construct
  misc_feature 1..20: note = CRISPR gRNA sequence
  source 1..20: mol_type = other DNA
aacatactctgaacaagttt

SEQ ID NO: 25672 - DNA, 20 bp, synthetic construct
  misc_feature 1..20: note = CRISPR gRNA sequence
  source 1..20: mol_type = other DNA
tgaacaagtttcctcactct

SEQ ID NO: 25673 - DNA, 20 bp, synthetic construct
  misc_feature 1..20: note = CRISPR gRNA sequence
  source 1..20: mol_type = other DNA
aacaagtttcctcactctgc

SEQ ID NO: 25674 - DNA, 20 bp, synthetic construct
  misc_feature 1..20: note = CRISPR gRNA sequence
  source 1..20: mol_type = other DNA
cctcactctgccactgtgac

SEQ ID NO: 25675 - DNA, 20 bp, synthetic construct
  misc_feature 1..20: note = CRISPR gRNA sequence
  source 1..20: mol_type = other DNA
ctcactctgccactgtgacc

SEQ ID NO: 25676 - DNA, 20 bp, synthetic construct
  misc_feature 1..20: note = CRISPR gRNA sequence
  source 1..20: mol_type = other DNA
actctgccactgtgacccag

SEQ ID NO: 25677 - DNA, 20 bp, synthetic construct
  misc_feature 1..20: note = CRISPR gRNA sequence
  source 1..20: mol_type = other DNA
tgccactgtgacccagaaag

SEQ ID NO: 25678 - DNA, 20 bp, synthetic construct
  misc_feature 1..20: note = CRISPR gRNA sequence
  source 1..20: mol_type = other DNA
ccactgtgacccagaaagct

SEQ ID NO: 25679 - DNA, 20 bp, synthetic construct
  misc_feature 1..20: note = CRISPR gRNA sequence
  source 1..20: mol_type = other DNA
tgacccagaaagctatctgt

SEQ ID NO: 25680 - DNA, 20 bp, synthetic construct
  misc_feature 1..20: note = CRISPR gRNA sequence
  source 1..20: mol_type = other DNA
tctgttctccttctcccaga

SEQ ID NO: 25681 - DNA, 20 bp, synthetic construct
  misc_feature 1..20: note = CRISPR gRNA sequence
  source 1..20: mol_type = other DNA
ttctccttctcccagactct

SEQ ID NO: 25682 - DNA, 20 bp, synthetic construct
  misc_feature 1..20: note = CRISPR gRNA sequence
  source 1..20: mol_type = other DNA
tccttctcccagactctgcc

SEQ ID NO: 25683 - DNA, 20 bp, synthetic construct
  misc_feature 1..20: note = CRISPR gRNA sequence
  source 1..20: mol_type = other DNA
cttctcccagactctgcctc

SEQ ID NO: 25684 - DNA, 20 bp, synthetic construct
  misc_feature 1..20: note = CRISPR gRNA sequence
  source 1..20: mol_type = other DNA
ctcccagactctgcctcatc

SEQ ID NO: 25685 - DNA, 20 bp, synthetic construct
  misc_feature 1..20: note = CRISPR gRNA sequence
  source 1..20: mol_type = other DNA
tcccagactctgcctcatct

SEQ ID NO: 25686 - DNA, 20 bp, synthetic construct
  misc_feature 1..20: note = CRISPR gRNA sequence
  source 1..20: mol_type = other DNA
ccagactctgcctcatcttt

SEQ ID NO: 25687 - DNA, 20 bp, synthetic construct
  misc_feature 1..20: note = CRISPR gRNA sequence
  source 1..20: mol_type = other DNA
tgcctcatctttcaaggcct

SEQ ID NO: 25688 - DNA, 20 bp, synthetic construct
  misc_feature 1..20: note = CRISPR gRNA sequence
  source 1..20: mol_type = other DNA
cctcatctttcaaggcctgg

SEQ ID NO: 25689 - DNA, 20 bp, synthetic construct
  misc_feature 1..20: note = CRISPR gRNA sequence
  source 1..20: mol_type = other DNA
atctttcaaggcctggttcc

SEQ ID NO: 25690 - DNA, 20 bp, synthetic construct
  misc_feature 1..20: note = CRISPR gRNA sequence
  source 1..20: mol_type = other DNA
tcaaggcctggttccaggat

SEQ ID NO: 25691 - DNA, 20 bp, synthetic construct
  misc_feature 1..20: note = CRISPR gRNA sequence
  source 1..20: mol_type = other DNA
caaggcctggttccaggatc

SEQ ID NO: 25692 - DNA, 20 bp, synthetic construct
  misc_feature 1..20: note = CRISPR gRNA sequence
  source 1..20: mol_type = other DNA
aaggcctggttccaggatcc

SEQ ID NO: 25693 - DNA, 20 bp, synthetic construct
  misc_feature 1..20: note = CRISPR gRNA sequence
  source 1..20: mol_type = other DNA
gttccaggatcccttcctcc

SEQ ID NO: 25694 - DNA, 20 bp, synthetic construct
  misc_feature 1..20: note = CRISPR gRNA sequence
  source 1..20: mol_type = other DNA
caggatcccttcctccagga

SEQ ID NO: 25695 - DNA, 20 bp, synthetic construct
  misc_feature 1..20: note = CRISPR gRNA sequence
  source 1..20: mol_type = other DNA
cctccaggaagccttccctg

SEQ ID NO: 25696 - DNA, 20 bp, synthetic construct
  misc_feature 1..20: note = CRISPR gRNA sequence
  source 1..20: mol_type = other DNA
ctccaggaagccttccctga

SEQ ID NO: 25697 - DNA, 20 bp, synthetic construct
  misc_feature 1..20: note = CRISPR gRNA sequence
  source 1..20: mol_type = other DNA
caggaagccttccctgattg

SEQ ID NO: 25698 - DNA, 20 bp, synthetic construct
  misc_feature 1..20: note = CRISPR gRNA sequence
  source 1..20: mol_type = other DNA
ccctgattgccctattccac

SEQ ID NO: 25699 - DNA, 20 bp, synthetic construct
  misc_feature 1..20: note = CRISPR gRNA sequence
  source 1..20: mol_type = other DNA
cctgattgccctattccacc

SEQ ID NO: 25700 - DNA, 20 bp, synthetic construct
  misc_feature 1..20: note = CRISPR gRNA sequence
  source 1..20: mol_type = other DNA
attgccctattccaccatac

SEQ ID NO: 25701 - DNA, 20 bp, synthetic construct
  misc_feature 1..20: note = CRISPR gRNA sequence
  source 1..20: mol_type = other DNA
ccctattccaccatacacct

SEQ ID NO: 25702 - DNA, 20 bp, synthetic construct
  misc_feature 1..20: note = CRISPR gRNA sequence
  source 1..20: mol_type = other DNA
ttccaccatacacctttttt

SEQ ID NO: 25703 - DNA, 20 bp, synthetic construct
  misc_feature 1..20: note = CRISPR gRNA sequence
  source 1..20: mol_type = other DNA
caccatacaccttttttctc

SEQ ID NO: 25704 - DNA, 20 bp, synthetic construct
  misc_feature 1..20: note = CRISPR gRNA sequence
  source 1..20: mol_type = other DNA
ttttctcggacttcatgtca

SEQ ID NO: 25705 - DNA, 20 bp, synthetic construct
  misc_feature 1..20: note = CRISPR gRNA sequence
  source 1..20: mol_type = other DNA
tttctcggacttcatgtcat

SEQ ID NO: 25706 - DNA, 20 bp, synthetic construct
  misc_feature 1..20: note = CRISPR gRNA sequence
  source 1..20: mol_type = other DNA
ttctcggacttcatgtcatg

SEQ ID NO: 25707 - DNA, 20 bp, synthetic construct
  misc_feature 1..20: note = CRISPR gRNA sequence
  source 1..20: mol_type = other DNA
tctcggacttcatgtcatgg

SEQ ID NO: 25708 - DNA, 20 bp, synthetic construct
  misc_feature 1..20: note = CRISPR gRNA sequence
  source 1..20: mol_type = other DNA
ctcggacttcatgtcatggt

SEQ ID NO: 25709 - DNA, 20 bp, synthetic construct
  misc_feature 1..20: note = CRISPR gRNA sequence
  source 1..20: mol_type = other DNA
tcggacttcatgtcatggtg

SEQ ID NO: 25710 - DNA, 20 bp, synthetic construct
  misc_feature 1..20: note = CRISPR gRNA sequence
  source 1..20: mol_type = other DNA
ggacttcatgtcatggtgcc

SEQ ID NO: 25711 - DNA, 20 bp, synthetic construct
  misc_feature 1..20: note = CRISPR gRNA sequence
  source 1..20: mol_type = other DNA
catgtcatggtgcctatatt

SEQ ID NO: 25712 - DNA, 20 bp, synthetic construct
  misc_feature 1..20: note = CRISPR gRNA sequence
  source 1..20: mol_type = other DNA
atgtcatggtgcctatattc

SEQ ID NO: 25713 - DNA, 20 bp, synthetic construct
  misc_feature 1..20: note = CRISPR gRNA sequence
  source 1..20: mol_type = other DNA
tattccaagggctctgagcc

SEQ ID NO: 25714 - DNA, 20 bp, synthetic construct
  misc_feature 1..20: note = CRISPR gRNA sequence
  source 1..20: mol_type = other DNA
caagggctctgagccatgta

SEQ ID NO: 25715 - DNA, 20 bp, synthetic construct
  misc_feature 1..20: note = CRISPR gRNA sequence
  source 1..20: mol_type = other DNA
tgagccatgtacccctttat

SEQ ID NO: 25716 - DNA, 20 bp, synthetic construct
  misc_feature 1..20: note = CRISPR gRNA sequence
  source 1..20: mol_type = other DNA
agccatgtacccctttatat

SEQ ID NO: 25717 - DNA, 20 bp, synthetic construct
  misc_feature 1..20: note = CRISPR gRNA sequence
  source 1..20: mol_type = other DNA
tatatagttaccactattta

SEQ ID NO: 25718 - DNA, 20 bp, synthetic construct
  misc_feature 1..20: note = CRISPR gRNA sequence
  source 1..20: mol_type = other DNA
atatagttaccactatttac

SEQ ID NO: 25719 - DNA, 20 bp, synthetic construct
  misc_feature 1..20: note = CRISPR gRNA sequence
  source 1..20: mol_type = other DNA
tatagttaccactatttact

SEQ ID NO: 25720 - DNA, 20 bp, synthetic construct
  misc_feature 1..20: note = CRISPR gRNA sequence
  source 1..20: mol_type = other DNA
ccactatttactgagtgcct

SEQ ID NO: 25721 - DNA, 20 bp, synthetic construct
  misc_feature 1..20: note = CRISPR gRNA sequence
  source 1..20: mol_type = other DNA
tttactgagtgcctactgta

SEQ ID NO: 25722 - DNA, 20 bp, synthetic construct
  misc_feature 1..20: note = CRISPR gRNA sequence
  source 1..20: mol_type = other DNA
actgagtgcctactgtatac

SEQ ID NO: 25723 - DNA, 20 bp, synthetic construct
  misc_feature 1..20: note = CRISPR gRNA sequence
  source 1..20: mol_type = other DNA
ctgagtgcctactgtatacc

SEQ ID NO: 25724 - DNA, 20 bp, synthetic construct
  misc_feature 1..20: note = CRISPR gRNA sequence
  source 1..20: mol_type = other DNA
agtgcctactgtataccagc

SEQ ID NO: 25725 - DNA, 20 bp, synthetic construct
  misc_feature 1..20: note = CRISPR gRNA sequence
  source 1..20: mol_type = other DNA
ctgtataccagctactgtgt

SEQ ID NO: 25726 - DNA, 20 bp, synthetic construct
  misc_feature 1..20: note = CRISPR gRNA sequence
  source 1..20: mol_type = other DNA
tataccagctactgtgttgg

SEQ ID NO: 25727 - DNA, 20 bp, synthetic construct
  misc_feature 1..20: note = CRISPR gRNA sequence
  source 1..20: mol_type = other DNA
ctgtgttggatgctctagat

SEQ ID NO: 25728 - DNA, 20 bp, synthetic construct
  misc_feature 1..20: note = CRISPR gRNA sequence
  source 1..20: mol_type = other DNA
tgttggatgctctagatgta

SEQ ID NO: 25729 - DNA, 20 bp, synthetic construct
  misc_feature 1..20: note = CRISPR gRNA sequence
  source 1..20: mol_type = other DNA
gatgctctagatgtagaacc

SEQ ID NO: 25730 - DNA, 20 bp, synthetic construct
  misc_feature 1..20: note = CRISPR gRNA sequence
  source 1..20: mol_type = other DNA
tagatgtagaacctctaatt

SEQ ID NO: 25731 - DNA, 20 bp, synthetic construct
  misc_feature 1..20: note = CRISPR gRNA sequence
  source 1..20: mol_type = other DNA
gatgtagaacctctaattat

SEQ ID NO: 25732 - DNA, 20 bp, synthetic construct
  misc_feature 1..20: note = CRISPR gRNA sequence
  source 1..20: mol_type = other DNA
taattatcaccatcgattcc

SEQ ID NO: 25733 - DNA, 20 bp, synthetic construct
  misc_feature 1..20: note = CRISPR gRNA sequence
  source 1..20: mol_type = other DNA
attatcaccatcgattcctg

SEQ ID NO: 25734 - DNA, 20 bp, synthetic construct
  misc_feature 1..20: note = CRISPR gRNA sequence
  source 1..20: mol_type = other DNA
tcaccatcgattcctgggta

SEQ ID NO: 25735 - DNA, 20 bp, synthetic construct
  misc_feature 1..20: note = CRISPR gRNA sequence
  source 1..20: mol_type = other DNA
ctgggtagtaggcattattt

SEQ ID NO: 25736 - DNA, 20 bp, synthetic construct
  misc_feature 1..20: note = CRISPR gRNA sequence
  source 1..20: mol_type = other DNA
ggtagtaggcattatttatt

SEQ ID NO: 25737 - DNA, 20 bp, synthetic construct
  misc_feature 1..20: note = CRISPR gRNA sequence
  source 1..20: mol_type = other DNA
tttattcatcttacacagat

SEQ ID NO: 25738 - DNA, 20 bp, synthetic construct
  misc_feature 1..20: note = CRISPR gRNA sequence
  source 1..20: mol_type = other DNA
attcatcttacacagatgag

SEQ ID NO: 25739 - DNA, 20 bp, synthetic construct
  misc_feature 1..20: note = CRISPR gRNA sequence
  source 1..20: mol_type = other DNA
ttcatcttacacagatgaga

SEQ ID NO: 25740 - DNA, 20 bp, synthetic construct
  misc_feature 1..20: note = CRISPR gRNA sequence
  source 1..20: mol_type = other DNA
atcttacacagatgagaaaa

SEQ ID NO: 25741 - DNA, 20 bp, synthetic construct
  misc_feature 1..20: note = CRISPR gRNA sequence
  source 1..20: mol_type = other DNA
acacagatgagaaaatggag

SEQ ID NO: 25742 - DNA, 20 bp, synthetic construct
  misc_feature 1..20: note = CRISPR gRNA sequence
  source 1..20: mol_type = other DNA
cacagatgagaaaatggagg

SEQ ID NO: 25743 - DNA, 20 bp, synthetic construct
  misc_feature 1..20: note = CRISPR gRNA sequence
  source 1..20: mol_type = other DNA
aataagtagcccaagattgc

SEQ ID NO: 25744 - DNA, 20 bp, synthetic construct
  misc_feature 1..20: note = CRISPR gRNA sequence
  source 1..20: mol_type = other DNA
cacagctagtagggctagtg

SEQ ID NO: 25745 - DNA, 20 bp, synthetic construct
  misc_feature 1..20: note = CRISPR gRNA sequence
  source 1..20: mol_type = other DNA
gtagggctagtggaaagtag

SEQ ID NO: 25746 - DNA, 20 bp, synthetic construct
  misc_feature 1..20: note = CRISPR gRNA sequence
  source 1..20: mol_type = other DNA
gtggaaagtagaggtggaat

SEQ ID NO: 25747 - DNA, 20 bp, synthetic construct
  misc_feature 1..20: note = CRISPR gRNA sequence
  source 1..20: mol_type = other DNA
gaactcaaatcctgcagtaa

SEQ ID NO: 25748 - DNA, 20 bp, synthetic construct
  misc_feature 1..20: note = CRISPR gRNA sequence
  source 1..20: mol_type = other DNA
aactcaaatcctgcagtaac

SEQ ID NO: 25749 - DNA, 20 bp, synthetic construct
  misc_feature 1..20: note = CRISPR gRNA sequence
  source 1..20: mol_type = other DNA
aaatcctgcagtaactctac

SEQ ID NO: 25750 - DNA, 20 bp, synthetic construct
  misc_feature 1..20: note = CRISPR gRNA sequence
  source 1..20: mol_type = other DNA
cagtaactctaccattctgc

SEQ ID NO: 25751 - DNA, 20 bp, synthetic construct
  misc_feature 1..20: note = CRISPR gRNA sequence
  source 1..20: mol_type = other DNA
taccattctgccttgctctt

SEQ ID NO: 25752 - DNA, 20 bp, synthetic construct
  misc_feature 1..20: note = CRISPR gRNA sequence
  source 1..20: mol_type = other DNA
ccattctgccttgctcttct

SEQ ID NO: 25753 - DNA, 20 bp, synthetic construct
  misc_feature 1..20: note = CRISPR gRNA sequence
  source 1..20: mol_type = other DNA
tgccttgctcttctttgtag

SEQ ID NO: 25754 - DNA, 20 bp, synthetic construct
  misc_feature 1..20: note = CRISPR gRNA sequence
  source 1..20: mol_type = other DNA
ccttgctcttctttgtagca

SEQ ID NO: 25755 - DNA, 20 bp, synthetic construct
  misc_feature 1..20: note = CRISPR gRNA sequence
  source 1..20: mol_type = other DNA
gctcttctttgtagcagtag

SEQ ID NO: 25756 - DNA, 20 bp, synthetic construct
  misc_feature 1..20: note = CRISPR gRNA sequence
  source 1..20: mol_type = other DNA
ctcttctttgtagcagtaga

SEQ ID NO: 25757 - DNA, 20 bp, synthetic construct
  misc_feature 1..20: note = CRISPR gRNA sequence
  source 1..20: mol_type = other DNA
ttctttgtagcagtagataa

SEQ ID NO: 25758 - DNA, 20 bp, synthetic construct
  misc_feature 1..20: note = CRISPR gRNA sequence
  source 1..20: mol_type = other DNA
ctttgtagcagtagataagt

SEQ ID NO: 25759 - DNA, 20 bp, synthetic construct
  misc_feature 1..20: note = CRISPR gRNA sequence
  source 1..20: mol_type = other DNA
tttgtagcagtagataagtt

SEQ ID NO: 25760 - DNA, 20 bp, synthetic construct
  misc_feature 1..20: note = CRISPR gRNA sequence
  source 1..20: mol_type = other DNA
tgtagcagtagataagtttt

SEQ ID NO: 25761 - DNA, 20 bp, synthetic construct
  misc_feature 1..20: note = CRISPR gRNA sequence
  source 1..20: mol_type = other DNA
gtagcagtagataagttttc

SEQ ID NO: 25762 - DNA, 20 bp, synthetic construct
  misc_feature 1..20: note = CRISPR gRNA sequence
  source 1..20: mol_type = other DNA
tagcagtagataagttttca

SEQ ID NO: 25763 - DNA, 20 bp, synthetic construct
  misc_feature 1..20: note = CRISPR gRNA sequence
  source 1..20: mol_type = other DNA
tcatggatacatacctcatc

SEQ ID NO: 25764 - DNA, 20 bp, synthetic construct
  misc_feature 1..20: note = CRISPR gRNA sequence
  source 1..20: mol_type = other DNA
catggatacatacctcatcc

SEQ ID NO: 25765 - DNA, 20 bp, synthetic construct
  misc_feature 1..20: note = CRISPR gRNA sequence
  source 1..20: mol_type = other DNA
atggatacatacctcatcct

SEQ ID NO: 25766 - DNA, 20 bp, synthetic construct
  misc_feature 1..20: note = CRISPR gRNA sequence
  source 1..20: mol_type = other DNA
atccttttgattagattaag

SEQ ID NO: 25767 - DNA, 20 bp, synthetic construct
  misc_feature 1..20: note = CRISPR gRNA sequence
  source 1..20: mol_type = other DNA
ttgattagattaagggcccc

SEQ ID NO: 25768 - DNA, 20 bp, synthetic construct
  misc_feature 1..20: note = CRISPR gRNA sequence
  source 1..20: mol_type = other DNA
tgattagattaagggcccct

SEQ ID NO: 25769 - DNA, 20 bp, synthetic construct
  misc_feature 1..20: note = CRISPR gRNA sequence
  source 1..20: mol_type = other DNA
gattagattaagggcccctg

SEQ ID NO: 25770 - DNA, 20 bp, synthetic construct
  misc_feature 1..20: note = CRISPR gRNA sequence
  source 1..20: mol_type = other DNA
attagattaagggcccctgg

SEQ ID NO: 25771 - DNA, 20 bp, synthetic construct
  misc_feature 1..20: note = CRISPR gRNA sequence
  source 1..20: mol_type = other DNA
gattaagggcccctggagtg

SEQ ID NO: 25772 - DNA, 20 bp, synthetic construct
  misc_feature 1..20: note = CRISPR gRNA sequence
  source 1..20: mol_type = other DNA
agggcccctggagtgtcagt

SEQ ID NO: 25773 - DNA, 20 bp, synthetic construct
  misc_feature 1..20: note = CRISPR gRNA sequence
  source 1..20: mol_type = other DNA
gagtgtcagtgttcattcat

SEQ ID NO: 25774 - DNA, 20 bp, synthetic construct
  misc_feature 1..20: note = CRISPR gRNA sequence
  source 1..20: mol_type = other DNA
attcatttgtttgatcattc

SEQ ID NO: 25775 - DNA, 20 bp, synthetic construct
  misc_feature 1..20: note = CRISPR gRNA sequence
  source 1..20: mol_type = other DNA
atttgtttgatcattcattc

SEQ ID NO: 25776 - DNA, 20 bp, synthetic construct
  misc_feature 1..20: note = CRISPR gRNA sequence
  source 1..20: mol_type = other DNA
gtttgatcattcattcattc

SEQ ID NO: 25777 - DNA, 20 bp, synthetic construct
  misc_feature 1..20: note = CRISPR gRNA sequence
  source 1..20: mol_type = other DNA
tttgatcattcattcattca

SEQ ID NO: 25778 - DNA, 20 bp, synthetic construct
  misc_feature 1..20: note = CRISPR gRNA sequence
  source 1..20: mol_type = other DNA
gatcattcattcattcaaca

SEQ ID NO: 25779 - DNA, 20 bp, synthetic construct
  misc_feature 1..20: note = CRISPR gRNA sequence
  source 1..20: mol_type = other DNA
atcattcattcattcaacaa

SEQ ID NO: 25780 - DNA, 20 bp, synthetic construct
  misc_feature 1..20: note = CRISPR gRNA sequence
  source 1..20: mol_type = other DNA
attcattcaacaaacatttc

SEQ ID NO: 25781 - DNA, 20 bp, synthetic construct
  misc_feature 1..20: note = CRISPR gRNA sequence
  source 1..20: mol_type = other DNA
attcaacaaacatttcttga

SEQ ID NO: 25782 - DNA, 20 bp, synthetic construct
  misc_feature 1..20: note = CRISPR gRNA sequence
  source 1..20: mol_type = other DNA
aacaaacatttcttgagtcc

SEQ ID NO: 25783 - DNA, 20 bp, synthetic construct
  misc_feature 1..20: note = CRISPR gRNA sequence
  source 1..20: mol_type = other DNA
cttgagtccccactgtgtgc

SEQ ID NO: 25784 - DNA, 20 bp, synthetic construct
  misc_feature 1..20: note = CRISPR gRNA sequence
  source 1..20: mol_type = other DNA
ttgagtccccactgtgtgcc

SEQ ID NO: 25785 - DNA, 20 bp, synthetic construct
  misc_feature 1..20: note = CRISPR gRNA sequence
  source 1..20: mol_type = other DNA
gagtccccactgtgtgccag

SEQ ID NO: 25786 - DNA, 20 bp, synthetic construct
  misc_feature 1..20: note = CRISPR gRNA sequence
  source 1..20: mol_type = other DNA
agtccccactgtgtgccagg

SEQ ID NO: 25787 - DNA, 20 bp, synthetic construct
  misc_feature 1..20: note = CRISPR gRNA sequence
  source 1..20: mol_type = other DNA
tgtgccaggcccagaggttc

SEQ ID NO: 25788 - DNA, 20 bp, synthetic construct
  misc_feature 1..20: note = CRISPR gRNA sequence
  source 1..20: mol_type = other DNA
cccagcccaaggcctggcac

SEQ ID NO: 25789 - DNA, 20 bp, synthetic construct
  misc_feature 1..20: note = CRISPR gRNA sequence
  source 1..20: mol_type = other DNA
gcacacagtgggccttcagt

SEQ ID NO: 25790 - DNA, 20 bp, synthetic construct
  misc_feature 1..20: note = CRISPR gRNA sequence
  source 1..20: mol_type = other DNA
cagttagaccttgttgattg

SEQ ID NO: 25791 - DNA, 20 bp, synthetic construct
  misc_feature 1..20: note = CRISPR gRNA sequence
  source 1..20: mol_type = other DNA
agttagaccttgttgattga

SEQ ID NO: 25792 - DNA, 20 bp, synthetic construct
  misc_feature 1..20: note = CRISPR gRNA sequence
  source 1..20: mol_type = other DNA
gaccttgttgattgactgcg

SEQ ID NO: 25793 - DNA, 20 bp, synthetic construct
  misc_feature 1..20: note = CRISPR gRNA sequence
  source 1..20: mol_type = other DNA
gttgattgactgcgcttttc

SEQ ID NO: 25794 - DNA, 20 bp, synthetic construct
  misc_feature 1..20: note = CRISPR gRNA sequence
  source 1..20: mol_type = other DNA
ttgattgactgcgcttttcc

SEQ ID NO: 25795 - DNA, 20 bp, synthetic construct
  misc_feature 1..20: note = CRISPR gRNA sequence
  source 1..20: mol_type = other DNA
attgactgcgcttttccttg

SEQ ID NO: 25796 - DNA, 20 bp, synthetic construct
  misc_feature 1..20: note = CRISPR gRNA sequence
  source 1..20: mol_type = other DNA
actgcgcttttccttgtctg

SEQ ID NO: 25797 - DNA, 20 bp, synthetic construct
  misc_feature 1..20: note = CRISPR gRNA sequence
  source 1..20: mol_type = other DNA
cgcttttccttgtctgggca

SEQ ID NO: 25798 - DNA, 20 bp, synthetic construct
  misc_feature 1..20: note = CRISPR gRNA sequence
  source 1..20: mol_type = other DNA
ttccttgtctgggcagcgga

SEQ ID NO: 25799 - DNA, 20 bp, synthetic construct
  misc_feature 1..20: note = CRISPR gRNA sequence
  source 1..20: mol_type = other DNA
tccttgtctgggcagcggaa

SEQ ID NO: 25800 - DNA, 20 bp, synthetic construct
  misc_feature 1..20: note = CRISPR gRNA sequence
  source 1..20: mol_type = other DNA
ccttgtctgggcagcggaac

SEQ ID NO: 25801 - DNA, 20 bp, synthetic construct
  misc_feature 1..20: note = CRISPR gRNA sequence
  source 1..20: mol_type = other DNA
cttgtctgggcagcggaact

SEQ ID NO: 25802 - DNA, 20 bp, synthetic construct
  misc_feature 1..20: note = CRISPR gRNA sequence
  source 1..20: mol_type = other DNA
gtctgggcagcggaactgga

SEQ ID NO: 25803 - DNA, 20 bp, synthetic construct
  misc_feature 1..20: note = CRISPR gRNA sequence
  source 1..20: mol_type = other DNA
tctgggcagcggaactggac

SEQ ID NO: 25804 - DNA, 20 bp, synthetic construct
  misc_feature 1..20: note = CRISPR gRNA sequence
  source 1..20: mol_type = other DNA
ggcagcggaactggaccagt

SEQ ID NO: 25805 - DNA, 20 bp, synthetic construct
  misc_feature 1..20: note = CRISPR gRNA sequence
  source 1..20: mol_type = other DNA
gaccagtatgtcttccagga

SEQ ID NO: 25806 - DNA, 20 bp, synthetic construct
  misc_feature 1..20: note = CRISPR gRNA sequence
  source 1..20: mol_type = other DNA
ccaggactcccagctggagg

SEQ ID NO: 25807 - DNA, 20 bp, synthetic construct
  misc_feature 1..20: note = CRISPR gRNA sequence
  source 1..20: mol_type = other DNA
caggactcccagctggaggg

SEQ ID NO: 25808 - DNA, 20 bp, synthetic construct
  misc_feature 1..20: note = CRISPR gRNA sequence
  source 1..20: mol_type = other DNA
ccagctggagggcctgagca

SEQ ID NO: 25809 - DNA, 20 bp, synthetic construct
  misc_feature 1..20: note = CRISPR gRNA sequence
  source 1..20: mol_type = other DNA
gagggcctgagcaaggacat

SEQ ID NO: 25810 - DNA, 20 bp, synthetic construct
  misc_feature 1..20: note = CRISPR gRNA sequence
  source 1..20: mol_type = other DNA
agcaaggacattttcagtaa

SEQ ID NO: 25811 - DNA, 20 bp, synthetic construct
  misc_feature 1..20: note = CRISPR gRNA sequence
  source 1..20: mol_type = other DNA
tcagtaagtttgtggtgggt

SEQ ID NO: 25812 - DNA, 20 bp, synthetic construct
  misc_feature 1..20: note = CRISPR gRNA sequence
  source 1..20: mol_type = other DNA
cagtaagtttgtggtgggtg

SEQ ID NO: 25813 - DNA, 20 bp, synthetic construct
  misc_feature 1..20: note = CRISPR gRNA sequence
  source 1..20: mol_type = other DNA
agtaagtttgtggtgggtgg

SEQ ID NO: 25814 - DNA, 20 bp, synthetic construct
  misc_feature 1..20: note = CRISPR gRNA sequence
  source 1..20: mol_type = other DNA
gtggtgggtggggaggtctt

SEQ ID NO: 25815 - DNA, 20 bp, synthetic construct
  misc_feature 1..20: note = CRISPR gRNA sequence
  source 1..20: mol_type = other DNA
tggtgggtggggaggtcttg

SEQ ID NO: 25816 - DNA, 20 bp, synthetic construct
  misc_feature 1..20: note = CRISPR gRNA sequence
  source 1..20: mol_type = other DNA
ggctcagcctgcatttcctg

SEQ ID NO: 25817 - DNA, 20 bp, synthetic construct
  misc_feature 1..20: note = CRISPR gRNA sequence
  source 1..20: mol_type = other DNA
gctcagcctgcatttcctgc

SEQ ID NO: 25818 - DNA, 20 bp, synthetic construct
  misc_feature 1..20: note = CRISPR gRNA sequence
  source 1..20: mol_type = other DNA
agcctgcatttcctgccttg

SEQ ID NO: 25819 - DNA, 20 bp, synthetic construct
  misc_feature 1..20: note = CRISPR gRNA sequence
  source 1..20: mol_type = other DNA
catttcctgccttgttccct

SEQ ID NO: 25820 - DNA, 20 bp, synthetic construct
  misc_feature 1..20: note = CRISPR gRNA sequence
  source 1..20: mol_type = other DNA
cctgccttgttccctggggg

SEQ ID NO: 25821 - DNA, 20 bp, synthetic construct
  misc_feature 1..20: note = CRISPR gRNA sequence
  source 1..20: mol_type = other DNA
ctgccttgttccctgggggg

SEQ ID NO: 25822 - DNA, 20 bp, synthetic construct
  misc_feature 1..20: note = CRISPR gRNA sequence
  source 1..20: mol_type = other DNA
ccttgttccctggggggtgc

SEQ ID NO: 25823 - DNA, 20 bp, synthetic construct
  misc_feature 1..20: note = CRISPR gRNA sequence
  source 1..20: mol_type = other DNA
gttccctggggggtgcccta

SEQ ID NO: 25824 - DNA, 20 bp, synthetic construct
  misc_feature 1..20: note = CRISPR gRNA sequence
  source 1..20: mol_type = other DNA
ttccctggggggtgccctaa

SEQ ID NO: 25825 - DNA, 20 bp, synthetic construct
  misc_feature 1..20: note = CRISPR gRNA sequence
  source 1..20: mol_type = other DNA
cctggggggtgccctaatac

SEQ ID NO: 25826 - DNA, 20 bp, synthetic construct
  misc_feature 1..20: note = CRISPR gRNA sequence
  source 1..20: mol_type = other DNA
gggggtgccctaatacctga

SEQ ID NO: 25827 - DNA, 20 bp, synthetic construct
  misc_feature 1..20: note = CRISPR gRNA sequence
  source 1..20: mol_type = other DNA
atacctgacgaccattcatt

SEQ ID NO: 25828 - DNA, 20 bp, synthetic construct
  misc_feature 1..20: note = CRISPR gRNA sequence
  source 1..20: mol_type = other DNA
acgaccattcattgatgggc

SEQ ID NO: 25829 - DNA, 20 bp, synthetic construct
  misc_feature 1..20: note = CRISPR gRNA sequence
  source 1..20: mol_type = other DNA
attgatgggcagtcagaccc

SEQ ID NO: 25830 - DNA, 20 bp, synthetic construct
  misc_feature 1..20: note = CRISPR gRNA sequence
  source 1..20: mol_type = other DNA
atgggcagtcagacccctct

SEQ ID NO: 25831 - DNA, 20 bp, synthetic construct
  misc_feature 1..20: note = CRISPR gRNA sequence
  source 1..20: mol_type = other DNA
tccccaaggtgggtacaata

SEQ ID NO: 25832 - DNA, 20 bp, synthetic construct
  misc_feature 1..20: note = CRISPR gRNA sequence
  source 1..20: mol_type = other DNA
cccaaggtgggtacaataga

SEQ ID NO: 25833 - DNA, 20 bp, synthetic construct
  misc_feature 1..20: note = CRISPR gRNA sequence
  source 1..20: mol_type = other DNA
accttgggctttcattgatt

SEQ ID NO: 25834 - DNA, 20 bp, synthetic construct
  misc_feature 1..20: note = CRISPR gRNA sequence
  source 1..20: mol_type = other DNA
gggctttcattgattgtgtg

SEQ ID NO: 25835 - DNA, 20 bp, synthetic construct
  misc_feature 1..20: note = CRISPR gRNA sequence
  source 1..20: mol_type = other DNA
ggctttcattgattgtgtga

SEQ ID NO: 25836 - DNA, 20 bp, synthetic construct
  misc_feature 1..20: note = CRISPR gRNA sequence
  source 1..20: mol_type = other DNA
tcattgattgtgtgagttgg

SEQ ID NO: 25837 - DNA, 20 bp, synthetic construct
  misc_feature 1..20: note = CRISPR gRNA sequence
  source 1..20: mol_type = other DNA
cattgattgtgtgagttggt

SEQ ID NO: 25838 - DNA, 20 bp, synthetic construct
  misc_feature 1..20: note = CRISPR gRNA sequence
  source 1..20: mol_type = other DNA
attgattgtgtgagttggtc

SEQ ID NO: 25839 - DNA, 20 bp, synthetic construct
  misc_feature 1..20: note = CRISPR gRNA sequence
  source 1..20: mol_type = other DNA
attgtgtgagttggtctctg

SEQ ID NO: 25840 - DNA, 20 bp, synthetic construct
  misc_feature 1..20: note = CRISPR gRNA sequence
  source 1..20: mol_type = other DNA
tgtgagttggtctctggttt

SEQ ID NO: 25841 - DNA, 20 bp, synthetic construct
  misc_feature 1..20: note = CRISPR gRNA sequence
  source 1..20: mol_type = other DNA
gtctctggtttttctcaaag

SEQ ID NO: 25842 - DNA, 20 bp, synthetic construct
  misc_feature 1..20: note = CRISPR gRNA sequence
  source 1..20: mol_type = other DNA
tggtttttctcaaagtagag

SEQ ID NO: 25843 - DNA, 20 bp, synthetic construct
  misc_feature 1..20: note = CRISPR gRNA sequence
  source 1..20: mol_type = other DNA
gtttttctcaaagtagagca

SEQ ID NO: 25844 - DNA, 20 bp, synthetic construct
  misc_feature 1..20: note = CRISPR gRNA sequence
  source 1..20: mol_type = other DNA
ttctcaaagtagagcacata

SEQ ID NO: 25845 - DNA, 20 bp, synthetic construct
  misc_feature 1..20: note = CRISPR gRNA sequence
  source 1..20: mol_type = other DNA
tctcaaagtagagcacatag

SEQ ID NO: 25846 - DNA, 20 bp, synthetic construct
  misc_feature 1..20: note = CRISPR gRNA sequence
  source 1..20: mol_type = other DNA
ctcaaagtagagcacatagg

SEQ ID NO: 25847 - DNA, 20 bp, synthetic construct
  misc_feature 1..20: note = CRISPR gRNA sequence
  source 1..20: mol_type = other DNA
tcaaagtagagcacatagga

SEQ ID NO: 25848 - DNA, 20 bp, synthetic construct
  misc_feature 1..20: note = CRISPR gRNA sequence
  source 1..20: mol_type = other DNA
aaagtagagcacataggacc

SEQ ID NO: 25849 - DNA, 20 bp, synthetic construct
  misc_feature 1..20: note = CRISPR gRNA sequence
  source 1..20: mol_type = other DNA
ggcagaaaagtcagaaaaga

SEQ ID NO: 25850 - DNA, 20 bp, synthetic construct
  misc_feature 1..20: note = CRISPR gRNA sequence
  source 1..20: mol_type = other DNA
cctgatccaacctagccttg

SEQ ID NO: 25851 - DNA, 20 bp, synthetic construct
  misc_feature 1..20: note = CRISPR gRNA sequence
  source 1..20: mol_type = other DNA
atccaacctagccttgcttg

SEQ ID NO: 25852 - DNA, 20 bp, synthetic construct
  misc_feature 1..20: note = CRISPR gRNA sequence
  source 1..20: mol_type = other DNA
gccttgcttgagacctggcc

SEQ ID NO: 25853 - DNA, 20 bp, synthetic construct
  misc_feature 1..20: note = CRISPR gRNA sequence
  source 1..20: mol_type = other DNA
gcttgagacctggcctttcc

SEQ ID NO: 25854 - DNA, 20 bp, synthetic construct
  misc_feature 1..20: note = CRISPR gRNA sequence
  source 1..20: mol_type = other DNA
cttgagacctggcctttcct

SEQ ID NO: 25855 - DNA, 20 bp, synthetic construct
  misc_feature 1..20: note = CRISPR gRNA sequence
  source 1..20: mol_type = other DNA
gagacctggcctttccttga

SEQ ID NO: 25856 - DNA, 20 bp, synthetic construct
  misc_feature 1..20: note = CRISPR gRNA sequence
  source 1..20: mol_type = other DNA
agacctggcctttccttgac

SEQ ID NO: 25857 - DNA, 20 bp, synthetic construct
  misc_feature 1..20: note = CRISPR gRNA sequence
  source 1..20: mol_type = other DNA
gcctttccttgactccaaag

SEQ ID NO: 25858 - DNA, 20 bp, synthetic construct
  misc_feature 1..20: note = CRISPR gRNA sequence
  source 1..20: mol_type = other DNA
tccttgactccaaagcctgc

SEQ ID NO: 25859 - DNA, 20 bp, synthetic construct
  misc_feature 1..20: note = CRISPR gRNA sequence
  source 1..20: mol_type = other DNA
ccttgactccaaagcctgct

SEQ ID NO: 25860 - DNA, 20 bp, synthetic construct
  misc_feature 1..20: note = CRISPR gRNA sequence
  source 1..20: mol_type = other DNA
cttgactccaaagcctgctg

SEQ ID NO: 25861 - DNA, 20 bp, synthetic construct
  misc_feature 1..20: note = CRISPR gRNA sequence
  source 1..20: mol_type = other DNA
gactccaaagcctgctgtgg

SEQ ID NO: 25862 - DNA, 20 bp, synthetic construct
  misc_feature 1..20: note = CRISPR gRNA sequence
  source 1..20: mol_type = other DNA
actccaaagcctgctgtggg

SEQ ID NO: 25863 - DNA, 20 bp, synthetic construct
  misc_feature 1..20: note = CRISPR gRNA sequence
  source 1..20: mol_type = other DNA
caaagcctgctgtgggtcca

SEQ ID NO: 25864 - DNA, 20 bp, synthetic construct
  misc_feature 1..20: note = CRISPR gRNA sequence
  source 1..20: mol_type = other DNA
ctgtgggtccaacttgcttc

SEQ ID NO: 25865 - DNA, 20 bp, synthetic construct
  misc_feature 1..20: note = CRISPR gRNA sequence
  source 1..20: mol_type = other DNA
tgggtccaacttgcttccct

SEQ ID NO: 25866 - DNA, 20 bp, synthetic construct
  misc_feature 1..20: note = CRISPR gRNA sequence
  source 1..20: mol_type = other DNA
gcttccctcgctaagtcctg

SEQ ID NO: 25867 - DNA, 20 bp, synthetic construct
  misc_feature 1..20: note = CRISPR gRNA sequence
  source 1..20: mol_type = other DNA
cttccctcgctaagtcctgt

SEQ ID NO: 25868 - DNA, 20 bp, synthetic construct
  misc_feature 1..20: note = CRISPR gRNA sequence
  source 1..20: mol_type = other DNA
ccctcgctaagtcctgtctg

SEQ ID NO: 25869 - DNA, 20 bp, synthetic construct
  misc_feature 1..20: note = CRISPR gRNA sequence
  source 1..20: mol_type = other DNA
cctcgctaagtcctgtctgg

SEQ ID NO: 25870 - DNA, 20 bp, synthetic construct
  misc_feature 1..20: note = CRISPR gRNA sequence
  source 1..20: mol_type = other DNA
gctaagtcctgtctggttgg

SEQ ID NO: 25871 - DNA, 20 bp, synthetic construct
  misc_feature 1..20: note = CRISPR gRNA sequence
  source 1..20: mol_type = other DNA
agtcctgtctggttgggagg

SEQ ID NO: 25872 - DNA, 20 bp, synthetic construct
  misc_feature 1..20: note = CRISPR gRNA sequence
  source 1..20: mol_type = other DNA
tctggttgggaggcccttta

SEQ ID NO: 25873 - DNA, 20 bp, synthetic construct
  misc_feature 1..20: note = CRISPR gRNA sequence
  source 1..20: mol_type = other DNA
gttgggaggccctttaaaag

SEQ ID NO: 25874 - DNA, 20 bp, synthetic construct
  misc_feature 1..20: note = CRISPR gRNA sequence
  source 1..20: mol_type = other DNA
ggaggccctttaaaagccaa

SEQ ID NO: 25875 - DNA, 20 bp, synthetic construct
  misc_feature 1..20: note = CRISPR gRNA sequence
  source 1..20: mol_type = other DNA
taaaagccaacaggagcctt

SEQ ID NO: 25876 - DNA, 20 bp, synthetic construct
  misc_feature 1..20: note = CRISPR gRNA sequence
  source 1..20: mol_type = other DNA
aaaagccaacaggagcctta

SEQ ID NO: 25877 - DNA, 20 bp, synthetic construct
  misc_feature 1..20: note = CRISPR gRNA sequence
  source 1..20: mol_type = other DNA
aaagccaacaggagccttaa

SEQ ID NO: 25878 - DNA, 20 bp, synthetic construct
  misc_feature 1..20: note = CRISPR gRNA sequence
  source 1..20: mol_type = other DNA
aaaatgtacatctgattatt

SEQ ID NO: 25879 - DNA, 20 bp, synthetic construct
  misc_feature 1..20: note = CRISPR gRNA sequence
  source 1..20: mol_type = other DNA
aaatgtacatctgattattt

SEQ ID NO: 25880 - DNA, 20 bp, synthetic construct
  misc_feature 1..20: note = CRISPR gRNA sequence
  source 1..20: mol_type = other DNA
attatttcatggccctgata

SEQ ID NO: 25881 - DNA, 20 bp, synthetic construct
  misc_feature 1..20: note = CRISPR gRNA sequence
  source 1..20: mol_type = other DNA
tttcatggccctgataaccc

SEQ ID NO: 25882 - DNA, 20 bp, synthetic construct
  misc_feature 1..20: note = CRISPR gRNA sequence
  source 1..20: mol_type = other DNA
catggccctgataaccctcc

SEQ ID NO: 25883 - DNA, 20 bp, synthetic construct
  misc_feature 1..20: note = CRISPR gRNA sequence
  source 1..20: mol_type = other DNA
atggccctgataaccctcca

SEQ ID NO: 25884 - DNA, 20 bp, synthetic construct
  misc_feature 1..20: note = CRISPR gRNA sequence
  source 1..20: mol_type = other DNA
ataaccctccaatggctaca

SEQ ID NO: 25885 - DNA, 20 bp, synthetic construct
  misc_feature 1..20: note = CRISPR gRNA sequence
  source 1..20: mol_type = other DNA
caatggctacaaaatacatg

SEQ ID NO: 25886 - DNA, 20 bp, synthetic construct
  misc_feature 1..20: note = CRISPR gRNA sequence
  source 1..20: mol_type = other DNA
caaaatacatgccacaaggc

SEQ ID NO: 25887 - DNA, 20 bp, synthetic construct
  misc_feature 1..20: note = CRISPR gRNA sequence
  source 1..20: mol_type = other DNA
tatggcccttcctccctctc

SEQ ID NO: 25888 - DNA, 20 bp, synthetic construct
  misc_feature 1..20: note = CRISPR gRNA sequence
  source 1..20: mol_type = other DNA
cctccctctccaaacccact

SEQ ID NO: 25889 - DNA, 20 bp, synthetic construct
  misc_feature 1..20: note = CRISPR gRNA sequence
  source 1..20: mol_type = other DNA
ctccctctccaaacccacta

SEQ ID NO: 25890 - DNA, 20 bp, synthetic construct
  misc_feature 1..20: note = CRISPR gRNA sequence
  source 1..20: mol_type = other DNA
cctctccaaacccactatga

SEQ ID NO: 25891 - DNA, 20 bp, synthetic construct
  misc_feature 1..20: note = CRISPR gRNA sequence
  source 1..20: mol_type = other DNA
tccaaacccactatgagaca

SEQ ID NO: 25892 - DNA, 20 bp, synthetic construct
  misc_feature 1..20: note = CRISPR gRNA sequence
  source 1..20: mol_type = other DNA
caaacccactatgagacacc

SEQ ID NO: 25893 - DNA, 20 bp, synthetic construct
  misc_feature 1..20: note = CRISPR gRNA sequence
  source 1..20: mol_type = other DNA
tgagacaccacacttcagcc

SEQ ID NO: 25894 - DNA, 20 bp, synthetic construct
  misc_feature 1..20: note = CRISPR gRNA sequence
  source 1..20: mol_type = other DNA
cagccaccaccagcttctcc

SEQ ID NO: 25895 - DNA, 20 bp, synthetic construct
  misc_feature 1..20: note = CRISPR gRNA sequence
  source 1..20: mol_type = other DNA
agccaccaccagcttctcca

SEQ ID NO: 25896 - DNA, 20 bp, synthetic construct
  misc_feature 1..20: note = CRISPR gRNA sequence
  source 1..20: mol_type = other DNA
ctccactcctataacccatg

SEQ ID NO: 25897 - DNA, 20 bp, synthetic construct
  misc_feature 1..20: note = CRISPR gRNA sequence
  source 1..20: mol_type = other DNA
tccactcctataacccatgt

SEQ ID NO: 25898 - DNA, 20 bp, synthetic construct
  misc_feature 1..20: note = CRISPR gRNA sequence
  source 1..20: mol_type = other DNA
cactcctataacccatgtgc

SEQ ID NO: 25899 - DNA, 20 bp, synthetic construct
  misc_feature 1..20: note = CRISPR gRNA sequence
  source 1..20: mol_type = other DNA
ctataacccatgtgcccttt

SEQ ID NO: 25900 - DNA, 20 bp, synthetic construct
  misc_feature 1..20: note = CRISPR gRNA sequence
  source 1..20: mol_type = other DNA
taacccatgtgccctttcaa

SEQ ID NO: 25901 - DNA, 20 bp, synthetic construct
  misc_feature 1..20: note = CRISPR gRNA sequence
  source 1..20: mol_type = other DNA
tcaagcctcggggcctttgc

SEQ ID NO: 25902 - DNA, 20 bp, synthetic construct
  misc_feature 1..20: note = CRISPR gRNA sequence
  source 1..20: mol_type = other DNA
caagcctcggggcctttgca

SEQ ID NO: 25903 - DNA, 20 bp, synthetic construct
  misc_feature 1..20: note = CRISPR gRNA sequence
  source 1..20: mol_type = other DNA
aagcctcggggcctttgcag

SEQ ID NO: 25904 - DNA, 20 bp, synthetic construct
  misc_feature 1..20: note = CRISPR gRNA sequence
  source 1..20: mol_type = other DNA
ggggcctttgcagttgctat

SEQ ID NO: 25905 - DNA, 20 bp, synthetic construct
  misc_feature 1..20: note = CRISPR gRNA sequence
  source 1..20: mol_type = other DNA
tgcagttgctatagtctcta

SEQ ID NO: 25906 - DNA, 20 bp, synthetic construct
  misc_feature 1..20: note = CRISPR gRNA sequence
  source 1..20: mol_type = other DNA
gcagttgctatagtctctat

SEQ ID NO: 25907 - DNA, 20 bp, synthetic construct
  misc_feature 1..20: note = CRISPR gRNA sequence
  source 1..20: mol_type = other DNA
cagttgctatagtctctatc

SEQ ID NO: 25908 - DNA, 20 bp, synthetic construct
  misc_feature 1..20: note = CRISPR gRNA sequence
  source 1..20: mol_type = other DNA
ctatagtctctatctggaat

SEQ ID NO: 25909 - DNA, 20 bp, synthetic construct
  misc_feature 1..20: note = CRISPR gRNA sequence
  source 1..20: mol_type = other DNA
tagtctctatctggaatgcc

SEQ ID NO: 25910 - DNA, 20 bp, synthetic construct
  misc_feature 1..20: note = CRISPR gRNA sequence
  source 1..20: mol_type = other DNA
tatctggaatgcccttcccc

SEQ ID NO: 25911 - DNA, 20 bp, synthetic construct
  misc_feature 1..20: note = CRISPR gRNA sequence
  source 1..20: mol_type = other DNA
tctggaatgcccttccccca

SEQ ID NO: 25912 - DNA, 20 bp, synthetic construct
  misc_feature 1..20: note = CRISPR gRNA sequence
  source 1..20: mol_type = other DNA
gaatgcccttcccccagttc

SEQ ID NO: 25913 - DNA, 20 bp, synthetic construct
  misc_feature 1..20: note = CRISPR gRNA sequence
  source 1..20: mol_type = other DNA
cccccagttcttcccatggc

SEQ ID NO: 25914 - DNA, 20 bp, synthetic construct
  misc_feature 1..20: note = CRISPR gRNA sequence
  source 1..20: mol_type = other DNA
ccccagttcttcccatggct

SEQ ID NO: 25915 - DNA, 20 bp, synthetic construct
  misc_feature 1..20: note = CRISPR gRNA sequence
  source 1..20: mol_type = other DNA
ttcccatggctgactccttt

SEQ ID NO: 25916 - DNA, 20 bp, synthetic construct
  misc_feature 1..20: note = CRISPR gRNA sequence
  source 1..20: mol_type = other DNA
cccatggctgactcctttga

SEQ ID NO: 25917 - DNA, 20 bp, synthetic construct
  misc_feature 1..20: note = CRISPR gRNA sequence
  source 1..20: mol_type = other DNA
ccatggctgactcctttgaa

SEQ ID NO: 25918 - DNA, 20 bp, synthetic construct
  misc_feature 1..20: note = CRISPR gRNA sequence
  source 1..20: mol_type = other DNA
actcctttgaatctttctgg

SEQ ID NO: 25919 - DNA, 20 bp, synthetic construct
  misc_feature 1..20: note = CRISPR gRNA sequence
  source 1..20: mol_type = other DNA
ctttgaatctttctggtgtt

SEQ ID NO: 25920 - DNA, 20 bp, synthetic construct
  misc_feature 1..20: note = CRISPR gRNA sequence
  source 1..20: mol_type = other DNA
tgaatctttctggtgttggc

SEQ ID NO: 25921 - DNA, 20 bp, synthetic construct
  misc_feature 1..20: note = CRISPR gRNA sequence
  source 1..20: mol_type = other DNA
gaatctttctggtgttggct

SEQ ID NO: 25922 - DNA, 20 bp, synthetic construct
  misc_feature 1..20: note = CRISPR gRNA sequence
  source 1..20: mol_type = other DNA
aatctttctggtgttggcta

SEQ ID NO: 25923 - DNA, 20 bp, synthetic construct
  misc_feature 1..20: note = CRISPR gRNA sequence
  source 1..20: mol_type = other DNA
tctggtgttggctaaactgt

SEQ ID NO: 25924 - DNA, 20 bp, synthetic construct
  misc_feature 1..20: note = CRISPR gRNA sequence
  source 1..20: mol_type = other DNA
ctggtgttggctaaactgtc

SEQ ID NO: 25925 - DNA, 20 bp, synthetic construct
  misc_feature 1..20: note = CRISPR gRNA sequence
  source 1..20: mol_type = other DNA
tggtgttggctaaactgtca

SEQ ID NO: 25926 - DNA, 20 bp, synthetic construct
  misc_feature 1..20: note = CRISPR gRNA sequence
  source 1..20: mol_type = other DNA
gtgttggctaaactgtcacc

SEQ ID NO: 25927 - DNA, 20 bp, synthetic construct
  misc_feature 1..20: note = CRISPR gRNA sequence
  source 1..20: mol_type = other DNA
gctaaactgtcacctcttcc

SEQ ID NO: 25928 - DNA, 20 bp, synthetic construct
  misc_feature 1..20: note = CRISPR gRNA sequence
  source 1..20: mol_type = other DNA
aactgtcacctcttcctgga

SEQ ID NO: 25929 - DNA, 20 bp, synthetic construct
  misc_feature 1..20: note = CRISPR gRNA sequence
  source 1..20: mol_type = other DNA
tcacctcttcctggaaccct

SEQ ID NO: 25930 - DNA, 20 bp, synthetic construct
  misc_feature 1..20: note = CRISPR gRNA sequence
  source 1..20: mol_type = other DNA
ttcctggaacccttctctga

SEQ ID NO: 25931 - DNA, 20 bp, synthetic construct
  misc_feature 1..20: note = CRISPR gRNA sequence
  source 1..20: mol_type = other DNA
cctggaacccttctctgacc

SEQ ID NO: 25932 - DNA, 20 bp, synthetic construct
  misc_feature 1..20: note = CRISPR gRNA sequence
  source 1..20: mol_type = other DNA
ctggaacccttctctgacca

SEQ ID NO: 25933 - DNA, 20 bp, synthetic construct
  misc_feature 1..20: note = CRISPR gRNA sequence
  source 1..20: mol_type = other DNA
gaacccttctctgaccatcc

SEQ ID NO: 25934 - DNA, 20 bp, synthetic construct
  misc_feature 1..20: note = CRISPR gRNA sequence
  source 1..20: mol_type = other DNA
ctctgaccatccttccatgt

SEQ ID NO: 25935 - DNA, 20 bp, synthetic construct
  misc_feature 1..20: note = CRISPR gRNA sequence
  source 1..20: mol_type = other DNA
tctgaccatccttccatgta

SEQ ID NO: 25936 - DNA, 20 bp, synthetic construct
  misc_feature 1..20: note = CRISPR gRNA sequence
  source 1..20: mol_type = other DNA
tgaccatccttccatgtaga

SEQ ID NO: 25937 - DNA, 20 bp, synthetic construct
  misc_feature 1..20: note = CRISPR gRNA sequence
  source 1..20: mol_type = other DNA
accatccttccatgtagatt

SEQ ID NO: 25938 - DNA, 20 bp, synthetic construct
  misc_feature 1..20: note = CRISPR gRNA sequence
  source 1..20: mol_type = other DNA
ccatgtagattagctcagtt

SEQ ID NO: 25939 - DNA, 20 bp, synthetic construct
  misc_feature 1..20: note = CRISPR gRNA sequence
  source 1..20: mol_type = other DNA
catgtagattagctcagtta

SEQ ID NO: 25940 - DNA, 20 bp, synthetic construct
  misc_feature 1..20: note = CRISPR gRNA sequence
  source 1..20: mol_type = other DNA
gctcagttattctcaccttg

SEQ ID NO: 25941 - DNA, 20 bp, synthetic construct
  misc_feature 1..20: note = CRISPR gRNA sequence
  source 1..20: mol_type = other DNA
agttattctcaccttgtgtg

SEQ ID NO: 25942 - DNA, 20 bp, synthetic construct
  misc_feature 1..20: note = CRISPR gRNA sequence
  source 1..20: mol_type = other DNA
ttctcaccttgtgtgtcttt

SEQ ID NO: 25943 - DNA, 20 bp, synthetic construct
  misc_feature 1..20: note = CRISPR gRNA sequence
  source 1..20: mol_type = other DNA
tcaccttgtgtgtctttttc

SEQ ID NO: 25944 - DNA, 20 bp, synthetic construct
  misc_feature 1..20: note = CRISPR gRNA sequence
  source 1..20: mol_type = other DNA
accttgtgtgtctttttcct

SEQ ID NO: 25945 - DNA, 20 bp, synthetic construct
  misc_feature 1..20: note = CRISPR gRNA sequence
  source 1..20: mol_type = other DNA
gtgtgtctttttccttgcag

SEQ ID NO: 25946 - DNA, 20 bp, synthetic construct
  misc_feature 1..20: note = CRISPR gRNA sequence
  source 1..20: mol_type = other DNA
tgtgtctttttccttgcagt

SEQ ID NO: 25947 - DNA, 20 bp, synthetic construct
  misc_feature 1..20: note = CRISPR gRNA sequence
  source 1..20: mol_type = other DNA
tttccttgcagtttagcact

SEQ ID NO: 25948 - DNA, 20 bp, synthetic construct
  misc_feature 1..20: note = CRISPR gRNA sequence
  source 1..20: mol_type = other DNA
ttccttgcagtttagcactc

SEQ ID NO: 25949 - DNA, 20 bp, synthetic construct
  misc_feature 1..20: note = CRISPR gRNA sequence
  source 1..20: mol_type = other DNA
tccttgcagtttagcactca

SEQ ID NO: 25950 - DNA, 20 bp, synthetic construct
  misc_feature 1..20: note = CRISPR gRNA sequence
  source 1..20: mol_type = other DNA
ccttgcagtttagcactcat

SEQ ID NO: 25951 - DNA, 20 bp, synthetic construct
  misc_feature 1..20: note = CRISPR gRNA sequence
  source 1..20: mol_type = other DNA
cttgcagtttagcactcatt

SEQ ID NO: 25952 - DNA, 20 bp, synthetic construct
  misc_feature 1..20: note = CRISPR gRNA sequence
  source 1..20: mol_type = other DNA
gcagtttagcactcattacc

SEQ ID NO: 25953 - DNA, 20 bp, synthetic construct
  misc_feature 1..20: note = CRISPR gRNA sequence
  source 1..20: mol_type = other DNA
cagtttagcactcattacca

SEQ ID NO: 25954 - DNA, 20 bp, synthetic construct
  misc_feature 1..20: note = CRISPR gRNA sequence
  source 1..20: mol_type = other DNA
agcactcattaccatctgga

SEQ ID NO: 25955 - DNA, 20 bp, synthetic construct
  misc_feature 1..20: note = CRISPR gRNA sequence
  source 1..20: mol_type = other DNA
gcactcattaccatctggac

SEQ ID NO: 25956 - DNA, 20 bp, synthetic construct
  misc_feature 1..20: note = CRISPR gRNA sequence
  source 1..20: mol_type = other DNA
attaccatctggacatattt

SEQ ID NO: 25957 - DNA, 20 bp, synthetic construct
  misc_feature 1..20: note = CRISPR gRNA sequence
  source 1..20: mol_type = other DNA
ccatctggacatattttacg

SEQ ID NO: 25958 - DNA, 20 bp, synthetic construct
  misc_feature 1..20: note = CRISPR gRNA sequence
  source 1..20: mol_type = other DNA
gacatattttacgccttgct

SEQ ID NO: 25959 - DNA, 20 bp, synthetic construct
  misc_feature 1..20: note = CRISPR gRNA sequence
  source 1..20: mol_type = other DNA
tacgccttgctctcccactg

SEQ ID NO: 25960 - DNA, 20 bp, synthetic construct
  misc_feature 1..20: note = CRISPR gRNA sequence
  source 1..20: mol_type = other DNA
acgccttgctctcccactgt

SEQ ID NO: 25961 - DNA, 20 bp, synthetic construct
  misc_feature 1..20: note = CRISPR gRNA sequence
  source 1..20: mol_type = other DNA
cgccttgctctcccactgtg

SEQ ID NO: 25962 - DNA, 20 bp, synthetic construct
  misc_feature 1..20: note = CRISPR gRNA sequence
  source 1..20: mol_type = other DNA
gctctcccactgtgaggaca

SEQ ID NO: 25963 - DNA, 20 bp, synthetic construct
  misc_feature 1..20: note = CRISPR gRNA sequence
  source 1..20: mol_type = other DNA
ctctcccactgtgaggacag

SEQ ID NO: 25964 - DNA, 20 bp, synthetic construct
  misc_feature 1..20: note = CRISPR gRNA sequence
  source 1..20: mol_type = other DNA
tcccactgtgaggacaggga

SEQ ID NO: 25965 - DNA, 20 bp, synthetic construct
  misc_feature 1..20: note = CRISPR gRNA sequence
  source 1..20: mol_type = other DNA
ccactgtgaggacagggacc

SEQ ID NO: 25966 - DNA, 20 bp, synthetic construct
  misc_feature 1..20: note = CRISPR gRNA sequence
  source 1..20: mol_type = other DNA
tgaggacagggaccttgtct

SEQ ID NO: 25967 - DNA, 20 bp, synthetic construct
  misc_feature 1..20: note = CRISPR gRNA sequence
  source 1..20: mol_type = other DNA
gtctttcttgctcgtgactg

SEQ ID NO: 25968 - DNA, 20 bp, synthetic construct
  misc_feature 1..20: note = CRISPR gRNA sequence
  source 1..20: mol_type = other DNA
tctttcttgctcgtgactgt

SEQ ID NO: 25969 - DNA, 20 bp, synthetic construct
  misc_feature 1..20: note = CRISPR gRNA sequence
  source 1..20: mol_type = other DNA
tcttgctcgtgactgtttcc

SEQ ID NO: 25970 - DNA, 20 bp, synthetic construct
  misc_feature 1..20: note = CRISPR gRNA sequence
  source 1..20: mol_type = other DNA
cttgctcgtgactgtttccc

SEQ ID NO: 25971 - DNA, 20 bp, synthetic construct
  misc_feature 1..20: note = CRISPR gRNA sequence
  source 1..20: mol_type = other DNA
ttgctcgtgactgtttcccc

SEQ ID NO: 25972 - DNA, 20 bp, synthetic construct
  misc_feature 1..20: note = CRISPR gRNA sequence
  source 1..20: mol_type = other DNA
gctcgtgactgtttccccag

SEQ ID NO: 25973 - DNA, 20 bp, synthetic construct
  misc_feature 1..20: note = CRISPR gRNA sequence
  source 1..20: mol_type = other DNA
ctcgtgactgtttccccagc

SEQ ID NO: 25974 - DNA, 20 bp, synthetic construct
  misc_feature 1..20: note = CRISPR gRNA sequence
  source 1..20: mol_type = other DNA
gtgactgtttccccagcatc

SEQ ID NO: 25975 - DNA, 20 bp, synthetic construct
  misc_feature 1..20: note = CRISPR gRNA sequence
  source 1..20: mol_type = other DNA
tttccccagcatctagtgca

SEQ ID NO: 25976 - DNA, 20 bp, synthetic construct
  misc_feature 1..20: note = CRISPR gRNA sequence
  source 1..20: mol_type = other DNA
ccccagcatctagtgcagtg

SEQ ID NO: 25977 - DNA, 20 bp, synthetic construct
  misc_feature 1..20: note = CRISPR gRNA sequence
  source 1..20: mol_type = other DNA
cccagcatctagtgcagtgc

SEQ ID NO: 25978 - DNA, 20 bp, synthetic construct
  misc_feature 1..20: note = CRISPR gRNA sequence
  source 1..20: mol_type = other DNA
gtgcagtgcctggtatgcag

SEQ ID NO: 25979 - DNA, 20 bp, synthetic construct
  misc_feature 1..20: note = CRISPR gRNA sequence
  source 1..20: mol_type = other DNA
gtatgcagtagcacctcagt

SEQ ID NO: 25980 - DNA, 20 bp, synthetic construct
  misc_feature 1..20: note = CRISPR gRNA sequence
  source 1..20: mol_type = other DNA
agtagatatctgttgaatga

SEQ ID NO: 25981 - DNA, 20 bp, synthetic construct
  misc_feature 1..20: note = CRISPR gRNA sequence
  source 1..20: mol_type = other DNA
ttgaatgaaaacatctgtaa

SEQ ID NO: 25982 - DNA, 20 bp, synthetic construct
  misc_feature 1..20: note = CRISPR gRNA sequence
  source 1..20: mol_type = other DNA
aatgaaaacatctgtaaaat

SEQ ID NO: 25983 - DNA, 20 bp, synthetic construct
  misc_feature 1..20: note = CRISPR gRNA sequence
  source 1..20: mol_type = other DNA
taaaatgggtgtaacagtta

SEQ ID NO: 25984 - DNA, 20 bp, synthetic construct
  misc_feature 1..20: note = CRISPR gRNA sequence
  source 1..20: mol_type = other DNA
actgagtacttattatgggt

SEQ ID NO: 25985 - DNA, 20 bp, synthetic construct
  misc_feature 1..20: note = CRISPR gRNA sequence
  source 1..20: mol_type = other DNA
agtacttattatgggtctga

SEQ ID NO: 25986 - DNA, 20 bp, synthetic construct
  misc_feature 1..20: note = CRISPR gRNA sequence
  source 1..20: mol_type = other DNA
attatgggtctgaccatgtg

SEQ ID NO: 25987 - DNA, 20 bp, synthetic construct
  misc_feature 1..20: note = CRISPR gRNA sequence
  source 1..20: mol_type = other DNA
ttatgggtctgaccatgtgt

SEQ ID NO: 25988 - DNA, 20 bp, synthetic construct
  misc_feature 1..20: note = CRISPR gRNA sequence
  source 1..20: mol_type = other DNA
tgggtctgaccatgtgtaag

SEQ ID NO: 25989 - DNA, 20 bp, synthetic construct
  misc_feature 1..20: note = CRISPR gRNA sequence
  source 1..20: mol_type = other DNA
accatgtgtaagtcctgtat

SEQ ID NO: 25990 - DNA, 20 bp, synthetic construct
  misc_feature 1..20: note = CRISPR gRNA sequence
  source 1..20: mol_type = other DNA
tatctatttattcagttctt

SEQ ID NO: 25991 - DNA, 20 bp, synthetic construct
  misc_feature 1..20: note = CRISPR gRNA sequence
  source 1..20: mol_type = other DNA
tttattcagttcttaaacag

SEQ ID NO: 25992 - DNA, 20 bp, synthetic construct
  misc_feature 1..20: note = CRISPR gRNA sequence
  source 1..20: mol_type = other DNA
attcagttcttaaacaggtg

SEQ ID NO: 25993 - DNA, 20 bp, synthetic construct
  misc_feature 1..20: note = CRISPR gRNA sequence
  source 1..20: mol_type = other DNA
ttcagttcttaaacaggtga

SEQ ID NO: 25994 - DNA, 20 bp, synthetic construct
  misc_feature 1..20: note = CRISPR gRNA sequence
  source 1..20: mol_type = other DNA
agttcttaaacaggtgaatc

SEQ ID NO: 25995 - DNA, 20 bp, synthetic construct
  misc_feature 1..20: note = CRISPR gRNA sequence
  source 1..20: mol_type = other DNA
ttaaacaggtgaatcgcaca

SEQ ID NO: 25996 - DNA, 20 bp, synthetic construct
  misc_feature 1..20: note = CRISPR gRNA sequence
  source 1..20: mol_type = other DNA
aaacaggtgaatcgcacaca

SEQ ID NO: 25997 - DNA, 20 bp, synthetic construct
  misc_feature 1..20: note = CRISPR gRNA sequence
  source 1..20: mol_type = other DNA
aacaggtgaatcgcacacag

SEQ ID NO: 25998 - DNA, 20 bp, synthetic construct
  misc_feature 1..20: note = CRISPR gRNA sequence
  source 1..20: mol_type = other DNA
taaaagtgcaaagaatattc

SEQ ID NO: 25999 - DNA, 20 bp, synthetic construct
  misc_feature 1..20: note = CRISPR gRNA sequence
  source 1..20: mol_type = other DNA
aaaagtgcaaagaatattca

SEQ ID NO: 26000 - DNA, 20 bp, synthetic construct
  misc_feature 1..20: note = CRISPR gRNA sequence
  source 1..20: mol_type = other DNA
aaagtgcaaagaatattcag

SEQ ID NO: 26001 - DNA, 20 bp, synthetic construct
  misc_feature 1..20: note = CRISPR gRNA sequence
  source 1..20: mol_type = other DNA
agtgaaggctgggcgcagcg

SEQ ID NO: 26002 - DNA, 20 bp, synthetic construct
  misc_feature 1..20: note = CRISPR gRNA sequence
  source 1..20: mol_type = other DNA
ggcgcagcggctcacacctg

SEQ ID NO: 26003 - DNA, 20 bp, synthetic construct
  misc_feature 1..20: note = CRISPR gRNA sequence
  source 1..20: mol_type = other DNA
acacctgtaatcccagcagt

SEQ ID NO: 26004 - DNA, 20 bp, synthetic construct
  misc_feature 1..20: note = CRISPR gRNA sequence
  source 1..20: mol_type = other DNA
taatcccagcagtttgggag

SEQ ID NO: 26005 - DNA, 20 bp, synthetic construct
  misc_feature 1..20: note = CRISPR gRNA sequence
  source 1..20: mol_type = other DNA
gggaggccaagggggacgga

SEQ ID NO: 26006 - DNA, 20 bp, synthetic construct
  misc_feature 1..20: note = CRISPR gRNA sequence
  source 1..20: mol_type = other DNA
ggaggccaagggggacggat

SEQ ID NO: 26007 - DNA, 20 bp, synthetic construct
  misc_feature 1..20: note = CRISPR gRNA sequence
  source 1..20: mol_type = other DNA
gaggtcaggagtttgatacc

SEQ ID NO: 26008 - DNA, 20 bp, synthetic construct
  misc_feature 1..20: note = CRISPR gRNA sequence
  source 1..20: mol_type = other DNA
aggtcaggagtttgatacct

SEQ ID NO: 26009 - DNA, 20 bp, synthetic construct
  misc_feature 1..20: note = CRISPR gRNA sequence
  source 1..20: mol_type = other DNA
gatacctgcctggccaacat

SEQ ID NO: 26010 - DNA, 20 bp, synthetic construct
  misc_feature 1..20: note = CRISPR gRNA sequence
  source 1..20: mol_type = other DNA
atacctgcctggccaacatg

SEQ ID NO: 26011 - DNA, 20 bp, synthetic construct
  misc_feature 1..20: note = CRISPR gRNA sequence
  source 1..20: mol_type = other DNA
cctggccaacatggtgaaac

SEQ ID NO: 26012 - DNA, 20 bp, synthetic construct
  misc_feature 1..20: note = CRISPR gRNA sequence
  source 1..20: mol_type = other DNA
gccaacatggtgaaaccgcg

SEQ ID NO: 26013 - DNA, 20 bp, synthetic construct
  misc_feature 1..20: note = CRISPR gRNA sequence
  source 1..20: mol_type = other DNA
taccaaaaaatacaaaaatt

SEQ ID NO: 26014 - DNA, 20 bp, synthetic construct
  misc_feature 1..20: note = CRISPR gRNA sequence
  source 1..20: mol_type = other DNA
ccaaaaaatacaaaaattag

SEQ ID NO: 26015 - DNA, 20 bp, synthetic construct
  misc_feature 1..20: note = CRISPR gRNA sequence
  source 1..20: mol_type = other DNA
gccgggtgtggtggtgcacg

SEQ ID NO: 26016 - DNA, 20 bp, synthetic construct
  misc_feature 1..20: note = CRISPR gRNA sequence
  source 1..20: mol_type = other DNA
taatcccagctactcgggag

SEQ ID NO: 26017 - DNA, 20 bp, synthetic construct
  misc_feature 1..20: note = CRISPR gRNA sequence
  source 1..20: mol_type = other DNA
ctcgggaggctgaggcagga

SEQ ID NO: 26018 - DNA, 20 bp, synthetic construct
  misc_feature 1..20: note = CRISPR gRNA sequence
  source 1..20: mol_type = other DNA
gggaggctgaggcaggagaa

SEQ ID NO: 26019 - DNA, 20 bp, synthetic construct
  misc_feature 1..20: note = CRISPR gRNA sequence
  source 1..20: mol_type = other DNA
aggcaggagaatcgcttgaa

SEQ ID NO: 26020 - DNA, 20 bp, synthetic construct
  misc_feature 1..20: note = CRISPR gRNA sequence
  source 1..20: mol_type = other DNA
gaacccaggaggtggaggtt

SEQ ID NO: 26021 - DNA, 20 bp, synthetic construct
  misc_feature 1..20: note = CRISPR gRNA sequence
  source 1..20: mol_type = other DNA
aacccaggaggtggaggttg

SEQ ID NO: 26022 - DNA, 20 bp, synthetic construct
  misc_feature 1..20: note = CRISPR gRNA sequence
  source 1..20: mol_type = other DNA
cagtgagctaagatcacgcc

SEQ ID NO: 26023 - DNA, 20 bp, synthetic construct
  misc_feature 1..20: note = CRISPR gRNA sequence
  source 1..20: mol_type = other DNA
agatcacgccactgcactcc

SEQ ID NO: 26024 - DNA, 20 bp, synthetic construct
  misc_feature 1..20: note = CRISPR gRNA sequence
  source 1..20: mol_type = other DNA
cactccagcctgggtggcag

SEQ ID NO: 26025 - DNA, 20 bp, synthetic construct
  misc_feature 1..20: note = CRISPR gRNA sequence
  source 1..20: mol_type = other DNA
cagcctgggtggcagagtaa

SEQ ID NO: 26026 - DNA, 20 bp, synthetic construct
  misc_feature 1..20: note = CRISPR gRNA sequence
  source 1..20: mol_type = other DNA
ggtggcagagtaagactctg

SEQ ID NO: 26027 - DNA, 20 bp, synthetic construct
  misc_feature 1..20: note = CRISPR gRNA sequence
  source 1..20: mol_type = other DNA
tgtctcaaacaacaacaacc

SEQ ID NO: 26028 - DNA, 20 bp, synthetic construct
  misc_feature 1..20: note = CRISPR gRNA sequence
  source 1..20: mol_type = other DNA
tctcaaacaacaacaaccaa

SEQ ID NO: 26029 - DNA, 20 bp, synthetic construct
  misc_feature 1..20: note = CRISPR gRNA sequence
  source 1..20: mol_type = other DNA
aaacaacaacaaccaaaaga

SEQ ID NO: 26030 - DNA, 20 bp, synthetic construct
  misc_feature 1..20: note = CRISPR gRNA sequence
  source 1..20: mol_type = other DNA
agtgaaaaaaaaatctccct

SEQ ID NO: 26031 - DNA, 20 bp, synthetic construct
  misc_feature 1..20: note = CRISPR gRNA sequence
  source 1..20: mol_type = other DNA
cctcccactcctgttctgta

SEQ ID NO: 26032 - DNA, 20 bp, synthetic construct
  misc_feature 1..20: note = CRISPR gRNA sequence
  source 1..20: mol_type = other DNA
ccactcctgttctgtagtcc

SEQ ID NO: 26033 - DNA, 20 bp, synthetic construct
  misc_feature 1..20: note = CRISPR gRNA sequence
  source 1..20: mol_type = other DNA
ctgttctgtagtccctcagt

SEQ ID NO: 26034 - DNA, 20 bp, synthetic construct
  misc_feature 1..20: note = CRISPR gRNA sequence
  source 1..20: mol_type = other DNA
ttctgtagtccctcagtttt

SEQ ID NO: 26035 - DNA, 20 bp, synthetic construct
  misc_feature 1..20: note = CRISPR gRNA sequence
  source 1..20: mol_type = other DNA
tgtagtccctcagttttgct

SEQ ID NO: 26036 - DNA, 20 bp, synthetic construct
  misc_feature 1..20: note = CRISPR gRNA sequence
  source 1..20: mol_type = other DNA
tagtccctcagttttgctcc

SEQ ID NO: 26037 - DNA, 20 bp, synthetic construct
  misc_feature 1..20: note = CRISPR gRNA sequence
  source 1..20: mol_type = other DNA
agttttgctcctatcttagt

SEQ ID NO: 26038 - DNA, 20 bp, synthetic construct
  misc_feature 1..20: note = CRISPR gRNA sequence
  source 1..20: mol_type = other DNA
tgctcctatcttagtcaacc

SEQ ID NO: 26039 - DNA, 20 bp, synthetic construct
  misc_feature 1..20: note = CRISPR gRNA sequence
  source 1..20: mol_type = other DNA
gctcctatcttagtcaacct

SEQ ID NO: 26040 - DNA, 20 bp, synthetic construct
  misc_feature 1..20: note = CRISPR gRNA sequence
  source 1..20: mol_type = other DNA
ctcctatcttagtcaaccta

SEQ ID NO: 26041 - DNA, 20 bp, synthetic construct
  misc_feature 1..20: note = CRISPR gRNA sequence
  source 1..20: mol_type = other DNA
ctatcttagtcaacctatgt

SEQ ID NO: 26042 - DNA, 20 bp, synthetic construct
  misc_feature 1..20: note = CRISPR gRNA sequence
  source 1..20: mol_type = other DNA
tcttagtcaacctatgtgac

SEQ ID NO: 26043 - DNA, 20 bp, synthetic construct
  misc_feature 1..20: note = CRISPR gRNA sequence
  source 1..20: mol_type = other DNA
agtcaacctatgtgaccagc

SEQ ID NO: 26044 - DNA, 20 bp, synthetic construct
  misc_feature 1..20: note = CRISPR gRNA sequence
  source 1..20: mol_type = other DNA
gtcaacctatgtgaccagct

SEQ ID NO: 26045 - DNA, 20 bp, synthetic construct
  misc_feature 1..20: note = CRISPR gRNA sequence
  source 1..20: mol_type = other DNA
tgtgaccagcttcctttttg

SEQ ID NO: 26046 - DNA, 20 bp, synthetic construct
  misc_feature 1..20: note = CRISPR gRNA sequence
  source 1..20: mol_type = other DNA
cctttttgccttgtcagaaa

SEQ ID NO: 26047 - DNA, 20 bp, synthetic construct
  misc_feature 1..20: note = CRISPR gRNA sequence
  source 1..20: mol_type = other DNA
ctttttgccttgtcagaaat

SEQ ID NO: 26048 - DNA, 20 bp, synthetic construct
  misc_feature 1..20: note = CRISPR gRNA sequence
  source 1..20: mol_type = other DNA
tttgccttgtcagaaataaa

SEQ ID NO: 26049 - DNA, 20 bp, synthetic construct
  misc_feature 1..20: note = CRISPR gRNA sequence
  source 1..20: mol_type = other DNA
ttgccttgtcagaaataaag

SEQ ID NO: 26050 - DNA, 20 bp, synthetic construct
  misc_feature 1..20: note = CRISPR gRNA sequence
  source 1..20: mol_type = other DNA
tgccttgtcagaaataaagc

SEQ ID NO: 26051 - DNA, 20 bp, synthetic construct
  misc_feature 1..20: note = CRISPR gRNA sequence
  source 1..20: mol_type = other DNA
gccttgtcagaaataaagcg

SEQ ID NO: 26052 - DNA, 20 bp, synthetic construct
  misc_feature 1..20: note = CRISPR gRNA sequence
  source 1..20: mol_type = other DNA
ccttgtcagaaataaagcga

SEQ ID NO: 26053 - DNA, 20 bp, synthetic construct
  misc_feature 1..20: note = CRISPR gRNA sequence
  source 1..20: mol_type = other DNA
gtcagaaataaagcgagctc

SEQ ID NO: 26054 - DNA, 20 bp, synthetic construct
  misc_feature 1..20: note = CRISPR gRNA sequence
  source 1..20: mol_type = other DNA
tcagaaataaagcgagctcc

SEQ ID NO: 26055 - DNA, 20 bp, synthetic construct
  misc_feature 1..20: note = CRISPR gRNA sequence
  source 1..20: mol_type = other DNA
ctgtatttgctttaattttc

SEQ ID NO: 26056 - DNA, 20 bp, synthetic construct
  misc_feature 1..20: note = CRISPR gRNA sequence
  source 1..20: mol_type = other DNA
tatttgctttaattttccat

SEQ ID NO: 26057 - DNA, 20 bp, synthetic construct
  misc_feature 1..20: note = CRISPR gRNA sequence
  source 1..20: mol_type = other DNA
gctttaattttccatgcaaa

SEQ ID NO: 26058 - DNA, 20 bp, synthetic construct
  misc_feature 1..20: note = CRISPR gRNA sequence
  source 1..20: mol_type = other DNA
ctttaattttccatgcaaat

SEQ ID NO: 26059 - DNA, 20 bp, synthetic construct
  misc_feature 1..20: note = CRISPR gRNA sequence
  source 1..20: mol_type = other DNA
taattttccatgcaaatgac

SEQ ID NO: 26060 - DNA, 20 bp, synthetic construct
  misc_feature 1..20: note = CRISPR gRNA sequence
  source 1..20: mol_type = other DNA
aattttccatgcaaatgacc

SEQ ID NO: 26061 - DNA, 20 bp, synthetic construct
  misc_feature 1..20: note = CRISPR gRNA sequence
  source 1..20: mol_type = other DNA
attttccatgcaaatgacca

SEQ ID NO: 26062 - DNA, 20 bp, synthetic construct
  misc_feature 1..20: note = CRISPR gRNA sequence
  source 1..20: mol_type = other DNA
tccatgcaaatgaccacatt

SEQ ID NO: 26063 - DNA, 20 bp, synthetic construct
  misc_feature 1..20: note = CRISPR gRNA sequence
  source 1..20: mol_type = other DNA
ccatgcaaatgaccacattt

SEQ ID NO: 26064 - DNA, 20 bp, synthetic construct
  misc_feature 1..20: note = CRISPR gRNA sequence
  source 1..20: mol_type = other DNA
catgcaaatgaccacatttt

SEQ ID NO: 26065 - DNA, 20 bp, synthetic construct
  misc_feature 1..20: note = CRISPR gRNA sequence
  source 1..20: mol_type = other DNA
tatttacactattctgcatt

SEQ ID NO: 26066 - DNA, 20 bp, synthetic construct
  misc_feature 1..20: note = CRISPR gRNA sequence
  source 1..20: mol_type = other DNA
atttacactattctgcattt

SEQ ID NO: 26067 - DNA, 20 bp, synthetic construct
  misc_feature 1..20: note = CRISPR gRNA sequence
  source 1..20: mol_type = other DNA
tttacactattctgcatttt

SEQ ID NO: 26068 - DNA, 20 bp, synthetic construct
  misc_feature 1..20: note = CRISPR gRNA sequence
  source 1..20: mol_type = other DNA
acactattctgcattttgct

SEQ ID NO: 26069 - DNA, 20 bp, synthetic construct
  misc_feature 1..20: note = CRISPR gRNA sequence
  source 1..20: mol_type = other DNA
cactattctgcattttgctt

SEQ ID NO: 26070 - DNA, 20 bp, synthetic construct
  misc_feature 1..20: note = CRISPR gRNA sequence
  source 1..20: mol_type = other DNA
ttctgcattttgctttcttc

SEQ ID NO: 26071 - DNA, 20 bp, synthetic construct
  misc_feature 1..20: note = CRISPR gRNA sequence
  source 1..20: mol_type = other DNA
tgcattttgctttcttcatt

SEQ ID NO: 26072 - DNA, 20 bp, synthetic construct
  misc_feature 1..20: note = CRISPR gRNA sequence
  source 1..20: mol_type = other DNA
cattttgctttcttcattta

SEQ ID NO: 26073 - DNA, 20 bp, synthetic construct
  misc_feature 1..20: note = CRISPR gRNA sequence
  source 1..20: mol_type = other DNA
tgctttcttcatttacttca

SEQ ID NO: 26074 - DNA, 20 bp, synthetic construct
  misc_feature 1..20: note = CRISPR gRNA sequence
  source 1..20: mol_type = other DNA
gctttcttcatttacttcat

SEQ ID NO: 26075 - DNA, 20 bp, synthetic construct
  misc_feature 1..20: note = CRISPR gRNA sequence
  source 1..20: mol_type = other DNA
ctttcttcatttacttcatt

SEQ ID NO: 26076 - DNA, 20 bp, synthetic construct
  misc_feature 1..20: note = CRISPR gRNA sequence
  source 1..20: mol_type = other DNA
tcttcatttacttcattact

SEQ ID NO: 26077 - DNA, 20 bp, synthetic construct
  misc_feature 1..20: note = CRISPR gRNA sequence
  source 1..20: mol_type = other DNA
cttcatttacttcattactc

SEQ ID NO: 26078 - DNA, 20 bp, synthetic construct
  misc_feature 1..20: note = CRISPR gRNA sequence
  source 1..20: mol_type = other DNA
ttcatttacttcattactcc

SEQ ID NO: 26079 - DNA, 20 bp, synthetic construct
  misc_feature 1..20: note = CRISPR gRNA sequence
  source 1..20: mol_type = other DNA
catttacttcattactccct

SEQ ID NO: 26080 - DNA, 20 bp, synthetic construct
  misc_feature 1..20: note = CRISPR gRNA sequence
  source 1..20: mol_type = other DNA
atttacttcattactccctg

SEQ ID NO: 26081 - DNA, 20 bp, synthetic construct
  misc_feature 1..20: note = CRISPR gRNA sequence
  source 1..20: mol_type = other DNA
acttcattactccctgtctg

SEQ ID NO: 26082 - DNA, 20 bp, synthetic construct
  misc_feature 1..20: note = CRISPR gRNA sequence
  source 1..20: mol_type = other DNA
cttcattactccctgtctgg

SEQ ID NO: 26083 - DNA, 20 bp, synthetic construct
  misc_feature 1..20: note = CRISPR gRNA sequence
  source 1..20: mol_type = other DNA
cattactccctgtctgggag

SEQ ID NO: 26084 - DNA, 20 bp, synthetic construct
  misc_feature 1..20: note = CRISPR gRNA sequence
  source 1..20: mol_type = other DNA
attactccctgtctgggagg

SEQ ID NO: 26085 - DNA, 20 bp, synthetic construct
  misc_feature 1..20: note = CRISPR gRNA sequence
  source 1..20: mol_type = other DNA
ctccctgtctgggaggtcac

SEQ ID NO: 26086 - DNA, 20 bp, synthetic construct
  misc_feature 1..20: note = CRISPR gRNA sequence
  source 1..20: mol_type = other DNA
cctgtctgggaggtcacgtt

SEQ ID NO: 26087 - DNA, 20 bp, synthetic construct
  misc_feature 1..20: note = CRISPR gRNA sequence
  source 1..20: mol_type = other DNA
tctgggaggtcacgttccat

SEQ ID NO: 26088 - DNA, 20 bp, synthetic construct
  misc_feature 1..20: note = CRISPR gRNA sequence
  source 1..20: mol_type = other DNA
ggaggtcacgttccatatta

SEQ ID NO: 26089 - DNA, 20 bp, synthetic construct
  misc_feature 1..20: note = CRISPR gRNA sequence
  source 1..20: mol_type = other DNA
catattattgagggagagga

SEQ ID NO: 26090 - DNA, 20 bp, synthetic construct
  misc_feature 1..20: note = CRISPR gRNA sequence
  source 1..20: mol_type = other DNA
ttgagggagaggacacggtc

SEQ ID NO: 26091 - DNA, 20 bp, synthetic construct
  misc_feature 1..20: note = CRISPR gRNA sequence
  source 1..20: mol_type = other DNA
agggagaggacacggtccta

SEQ ID NO: 26092 - DNA, 20 bp, synthetic construct
  misc_feature 1..20: note = CRISPR gRNA sequence
  source 1..20: mol_type = other DNA
tcttcagcagcttctttatt

SEQ ID NO: 26093 - DNA, 20 bp, synthetic construct
  misc_feature 1..20: note = CRISPR gRNA sequence
  source 1..20: mol_type = other DNA
cagcagcttctttattttct

SEQ ID NO: 26094 - DNA, 20 bp, synthetic construct
  misc_feature 1..20: note = CRISPR gRNA sequence
  source 1..20: mol_type = other DNA
agcagcttctttattttctt

SEQ ID NO: 26095 - DNA, 20 bp, synthetic construct
  misc_feature 1..20: note = CRISPR gRNA sequence
  source 1..20: mol_type = other DNA
ctttattttctttcttttct

SEQ ID NO: 26096 - DNA, 20 bp, synthetic construct
  misc_feature 1..20: note = CRISPR gRNA sequence
  source 1..20: mol_type = other DNA
tttattttctttcttttctt

SEQ ID NO: 26097 - DNA, 20 bp, synthetic construct
  misc_feature 1..20: note = CRISPR gRNA sequence
  source 1..20: mol_type = other DNA
tattttctttcttttcttgt

SEQ ID NO: 26098 - DNA, 20 bp, synthetic construct
  misc_feature 1..20: note = CRISPR gRNA sequence
  source 1..20: mol_type = other DNA
attttctttcttttcttgtt

SEQ ID NO: 26099 - DNA, 20 bp, synthetic construct
  misc_feature 1..20: note = CRISPR gRNA sequence
  source 1..20: mol_type = other DNA
ttttctttcttttcttgttt

SEQ ID NO: 26100 - DNA, 20 bp, synthetic construct
  misc_feature 1..20: note = CRISPR gRNA sequence
  source 1..20: mol_type = other DNA
tctttcttttcttgtttttc

SEQ ID NO: 26101 - DNA, 20 bp, synthetic construct
  misc_feature 1..20: note = CRISPR gRNA sequence
  source 1..20: mol_type = other DNA
ctttcttttcttgtttttct

SEQ ID NO: 26102 - DNA, 20 bp, synthetic construct
  misc_feature 1..20: note = CRISPR gRNA sequence
  source 1..20: mol_type = other DNA
tttcttttcttgtttttctt

SEQ ID NO: 26103 - DNA, 20 bp, synthetic construct
  misc_feature 1..20: note = CRISPR gRNA sequence
  source 1..20: mol_type = other DNA
tcttttcttgtttttcttct

SEQ ID NO: 26104 - DNA, 20 bp, synthetic construct
  misc_feature 1..20: note = CRISPR gRNA sequence
  source 1..20: mol_type = other DNA
cttttcttgtttttcttctt

SEQ ID NO: 26105 - DNA, 20 bp, synthetic construct
  misc_feature 1..20: note = CRISPR gRNA sequence
  source 1..20: mol_type = other DNA
ttttcttgtttttcttcttt

SEQ ID NO: 26106 - DNA, 20 bp, synthetic construct
  misc_feature 1..20: note = CRISPR gRNA sequence
  source 1..20: mol_type = other DNA
ttcttgtttttcttctttat

SEQ ID NO: 26107 - DNA, 20 bp, synthetic construct
  misc_feature 1..20: note = CRISPR gRNA sequence
  source 1..20: mol_type = other DNA
tcttgtttttcttctttatg

SEQ ID NO: 26108 - DNA, 20 bp, synthetic construct
  misc_feature 1..20: note = CRISPR gRNA sequence
  source 1..20: mol_type = other DNA
cttgtttttcttctttatgt

SEQ ID NO: 26109 - DNA, 20 bp, synthetic construct
  misc_feature 1..20: note = CRISPR gRNA sequence
  source 1..20: mol_type = other DNA
ttgtttttcttctttatgtt

SEQ ID NO: 26110 - DNA, 20 bp, synthetic construct
  misc_feature 1..20: note = CRISPR gRNA sequence
  source 1..20: mol_type = other DNA
gtttttcttctttatgtttt

SEQ ID NO: 26111 - DNA, 20 bp, synthetic construct
  misc_feature 1..20: note = CRISPR gRNA sequence
  source 1..20: mol_type = other DNA
tttttcttctttatgttttc

SEQ ID NO: 26112 - DNA, 20 bp, synthetic construct
  misc_feature 1..20: note = CRISPR gRNA sequence
  source 1..20: mol_type = other DNA
ttcttctttatgttttcatt

SEQ ID NO: 26113 - DNA, 20 bp, synthetic construct
  misc_feature 1..20: note = CRISPR gRNA sequence
  source 1..20: mol_type = other DNA
tcttctttatgttttcattt

SEQ ID NO: 26114 - DNA, 20 bp, synthetic construct
  misc_feature 1..20: note = CRISPR gRNA sequence
  source 1..20: mol_type = other DNA
cttctttatgttttcatttg

SEQ ID NO: 26115 - DNA, 20 bp, synthetic construct
  misc_feature 1..20: note = CRISPR gRNA sequence
  source 1..20: mol_type = other DNA
ttctttatgttttcatttga

SEQ ID NO: 26116 - DNA, 20 bp, synthetic construct
  misc_feature 1..20: note = CRISPR gRNA sequence
  source 1..20: mol_type = other DNA
ctttatgttttcatttgata

SEQ ID NO: 26117 - DNA, 20 bp, synthetic construct
  misc_feature 1..20: note = CRISPR gRNA sequence
  source 1..20: mol_type = other DNA
tttatgttttcatttgataa

SEQ ID NO: 26118 - DNA, 20 bp, synthetic construct
  misc_feature 1..20: note = CRISPR gRNA sequence
  source 1..20: mol_type = other DNA
tatgttttcatttgataaat

SEQ ID NO: 26119 - DNA, 20 bp, synthetic construct
  misc_feature 1..20: note = CRISPR gRNA sequence
  source 1..20: mol_type = other DNA
atgttttcatttgataaata

SEQ ID NO: 26120 - DNA, 20 bp, synthetic construct
  misc_feature 1..20: note = CRISPR gRNA sequence
  source 1..20: mol_type = other DNA
tgttttcatttgataaatat

SEQ ID NO: 26121 - DNA, 20 bp, synthetic construct
  misc_feature 1..20: note = CRISPR gRNA sequence
  source 1..20: mol_type = other DNA
tcatttgataaatatttccc

SEQ ID NO: 26122 - DNA, 20 bp, synthetic construct
  misc_feature 1..20: note = CRISPR gRNA sequence
  source 1..20: mol_type = other DNA
catttgataaatatttcccc

SEQ ID NO: 26123 - DNA, 20 bp, synthetic construct
  misc_feature 1..20: note = CRISPR gRNA sequence
  source 1..20: mol_type = other DNA
atttgataaatatttccccc

SEQ ID NO: 26124 - DNA, 20 bp, synthetic construct
  misc_feature 1..20: note = CRISPR gRNA sequence
  source 1..20: mol_type = other DNA
gataaatatttccccccaag

SEQ ID NO: 26125 - DNA, 20 bp, synthetic construct
  misc_feature 1..20: note = CRISPR gRNA sequence
  source 1..20: mol_type = other DNA
ataaatatttccccccaaga

SEQ ID NO: 26126 - DNA, 20 bp, synthetic construct
  misc_feature 1..20: note = CRISPR gRNA sequence
  source 1..20: mol_type = other DNA
ccccccaagattttattgtg

SEQ ID NO: 26127 - DNA, 20 bp, synthetic construct
  misc_feature 1..20: note = CRISPR gRNA sequence
  source 1..20: mol_type = other DNA
cccccaagattttattgtga

SEQ ID NO: 26128 - DNA, 20 bp, synthetic construct
  misc_feature 1..20: note = CRISPR gRNA sequence
  source 1..20: mol_type = other DNA
tattgtgaaagttttcggcc

SEQ ID NO: 26129 - DNA, 20 bp, synthetic construct
  misc_feature 1..20: note = CRISPR gRNA sequence
  source 1..20: mol_type = other DNA
attgtgaaagttttcggcca

SEQ ID NO: 26130 - DNA, 20 bp, synthetic construct
  misc_feature 1..20: note = CRISPR gRNA sequence
  source 1..20: mol_type = other DNA
ttgtgaaagttttcggccag

SEQ ID NO: 26131 - DNA, 20 bp, synthetic construct
  misc_feature 1..20: note = CRISPR gRNA sequence
  source 1..20: mol_type = other DNA
tgaaagttttcggccaggcg

SEQ ID NO: 26132 - DNA, 20 bp, synthetic construct
  misc_feature 1..20: note = CRISPR gRNA sequence
  source 1..20: mol_type = other DNA
tcggccaggcgtggtggctc

SEQ ID NO: 26133 - DNA, 20 bp, synthetic construct
  misc_feature 1..20: note = CRISPR gRNA sequence
  source 1..20: mol_type = other DNA
cggccaggcgtggtggctca

SEQ ID NO: 26134 - DNA, 20 bp, synthetic construct
  misc_feature 1..20: note = CRISPR gRNA sequence
  source 1..20: mol_type = other DNA
ggccaggcgtggtggctcac

SEQ ID NO: 26135 - DNA, 20 bp, synthetic construct
  misc_feature 1..20: note = CRISPR gRNA sequence
  source 1..20: mol_type = other DNA
acatctgtaatcccagcact

SEQ ID NO: 26136 - DNA, 20 bp, synthetic construct
  misc_feature 1..20: note = CRISPR gRNA sequence
  source 1..20: mol_type = other DNA
taatcccagcactttgggag

SEQ ID NO: 26137 - DNA, 20 bp, synthetic construct
  misc_feature 1..20: note = CRISPR gRNA sequence
  source 1..20: mol_type = other DNA
tgggaggccaaggctggcag

SEQ ID NO: 26138 - DNA, 20 bp, synthetic construct
  misc_feature 1..20: note = CRISPR gRNA sequence
  source 1..20: mol_type = other DNA
gggaggccaaggctggcaga

SEQ ID NO: 26139 - DNA, 20 bp, synthetic construct
  misc_feature 1..20: note = CRISPR gRNA sequence
  source 1..20: mol_type = other DNA
ggaggccaaggctggcagat

SEQ ID NO: 26140 - DNA, 20 bp, synthetic construct
  misc_feature 1..20: note = CRISPR gRNA sequence
  source 1..20: mol_type = other DNA
gcagatcacctgaggtcaag

SEQ ID NO: 26141 - DNA, 20 bp, synthetic construct
  misc_feature 1..20: note = CRISPR gRNA sequence
  source 1..20: mol_type = other DNA
aggtcaagagtttgagacca

SEQ ID NO: 26142 - DNA, 20 bp, synthetic construct
  misc_feature 1..20: note = CRISPR gRNA sequence
  source 1..20: mol_type = other DNA
gagaccagcctggccaacat

SEQ ID NO: 26143 - DNA, 20 bp, synthetic construct
  misc_feature 1..20: note = CRISPR gRNA sequence
  source 1..20: mol_type = other DNA
agaccagcctggccaacatg

SEQ ID NO: 26144 - DNA, 20 bp, synthetic construct
  misc_feature 1..20: note = CRISPR gRNA sequence
  source 1..20: mol_type = other DNA
gccaacatggtgaaacccca

SEQ ID NO: 26145 - DNA, 20 bp, synthetic construct
  misc_feature 1..20: note = CRISPR gRNA sequence
  source 1..20: mol_type = other DNA
tactaaaaatacaaaaatta

SEQ ID NO: 26146 - DNA, 20 bp, synthetic construct
  misc_feature 1..20: note = CRISPR gRNA sequence
  source 1..20: mol_type = other DNA
ctaaaaatacaaaaattagc

SEQ ID NO: 26147 - DNA, 20 bp, synthetic construct
  misc_feature 1..20: note = CRISPR gRNA sequence
  source 1..20: mol_type = other DNA
aaaatacaaaaattagccag

SEQ ID NO: 26148 - DNA, 20 bp, synthetic construct
  misc_feature 1..20: note = CRISPR gRNA sequence
  source 1..20: mol_type = other DNA
gccaggcgtggtggcgaaca

SEQ ID NO: 26149 - DNA, 20 bp, synthetic construct
  misc_feature 1..20: note = CRISPR gRNA sequence
  source 1..20: mol_type = other DNA
taatcccagctaccagggag

SEQ ID NO: 26150 - DNA, 20 bp, synthetic construct
  misc_feature 1..20: note = CRISPR gRNA sequence
  source 1..20: mol_type = other DNA
ccagggaggctagggtggga

SEQ ID NO: 26151 - DNA, 20 bp, synthetic construct
  misc_feature 1..20: note = CRISPR gRNA sequence
  source 1..20: mol_type = other DNA
gggtgggagaatcgcttgaa

SEQ ID NO: 26152 - DNA, 20 bp, synthetic construct
  misc_feature 1..20: note = CRISPR gRNA sequence
  source 1..20: mol_type = other DNA
gaacctaagaagcagaggtt

SEQ ID NO: 26153 - DNA, 20 bp, synthetic construct
  misc_feature 1..20: note = CRISPR gRNA sequence
  source 1..20: mol_type = other DNA
aacctaagaagcagaggttg

SEQ ID NO: 26154 - DNA, 20 bp, synthetic construct
  misc_feature 1..20: note = CRISPR gRNA sequence
  source 1..20: mol_type = other DNA
agaagcagaggttgcagtga

SEQ ID NO: 26155 - DNA, 20 bp, synthetic construct
  misc_feature 1..20: note = CRISPR gRNA sequence
  source 1..20: mol_type = other DNA
cagtgagccaagattgcgcc

SEQ ID NO: 26156 - DNA, 20 bp, synthetic construct
  misc_feature 1..20: note = CRISPR gRNA sequence
  source 1..20: mol_type = other DNA
cgccagtgcactccagcctg

SEQ ID NO: 26157 - DNA, 20 bp, synthetic construct
  misc_feature 1..20: note = CRISPR gRNA sequence
  source 1..20: mol_type = other DNA
cagcctgggcaacagagcta

SEQ ID NO: 26158 - DNA, 20 bp, synthetic construct
  misc_feature 1..20: note = CRISPR gRNA sequence
  source 1..20: mol_type = other DNA
ggcaacagagctagactctg

SEQ ID NO: 26159 - DNA, 20 bp, synthetic construct
  misc_feature 1..20: note = CRISPR gRNA sequence
  source 1..20: mol_type = other DNA
gactctgtttcaaaaaaaaa

SEQ ID NO: 26160 - DNA, 20 bp, synthetic construct
  misc_feature 1..20: note = CRISPR gRNA sequence
  source 1..20: mol_type = other DNA
tgtttcaaaaaaaaaaaaaa

SEQ ID NO: 26161 - DNA, 20 bp, synthetic construct
  misc_feature 1..20: note = CRISPR gRNA sequence
  source 1..20: mol_type = other DNA
tttcaaaaaaaaaaaaaaat

SEQ ID NO: 26162 - DNA, 20 bp, synthetic construct
  misc_feature 1..20: note = CRISPR gRNA sequence
  source 1..20: mol_type = other DNA
caaaaaaaaaaaaaaatgtt

SEQ ID NO: 26163 - DNA, 20 bp, synthetic construct
  misc_feature 1..20: note = CRISPR gRNA sequence
  source 1..20: mol_type = other DNA
aaaaaaaaaaaaaaatgttt

SEQ ID NO: 26164 - DNA, 20 bp, synthetic construct
  misc_feature 1..20: note = CRISPR gRNA sequence
  source 1..20: mol_type = other DNA
tcaagatacaataaaagtga

SEQ ID NO: 26165 - DNA, 20 bp, synthetic construct
  misc_feature 1..20: note = CRISPR gRNA sequence
  source 1..20: mol_type = other DNA
caagatacaataaaagtgaa

SEQ ID NO: 26166 - DNA, 20 bp, synthetic construct
  misc_feature 1..20: note = CRISPR gRNA sequence
  source 1..20: mol_type = other DNA
aagatacaataaaagtgaaa

SEQ ID NO: 26167 - DNA, 20 bp, synthetic construct
  misc_feature 1..20: note = CRISPR gRNA sequence
  source 1..20: mol_type = other DNA
tgaaggtccatatacccacc

SEQ ID NO: 26168 - DNA, 20 bp, synthetic construct
  misc_feature 1..20: note = CRISPR gRNA sequence
  source 1..20: mol_type = other DNA
tgattctacaattaatgttg

SEQ ID NO: 26169 - DNA, 20 bp, synthetic construct
  misc_feature 1..20: note = CRISPR gRNA sequence
  source 1..20: mol_type = other DNA
gattctacaattaatgttgg

SEQ ID NO: 26170 - DNA, 20 bp, synthetic construct
  misc_feature 1..20: note = CRISPR gRNA sequence
  source 1..20: mol_type = other DNA
attctacaattaatgttggg

SEQ ID NO: 26171 - DNA, 20 bp, synthetic construct
  misc_feature 1..20: note = CRISPR gRNA sequence
  source 1..20: mol_type = other DNA
tacaattaatgttgggtttt

SEQ ID NO: 26172 - DNA, 20 bp, synthetic construct
  misc_feature 1..20: note = CRISPR gRNA sequence
  source 1..20: mol_type = other DNA
caattaatgttgggttttat

SEQ ID NO: 26173 - DNA, 20 bp, synthetic construct
  misc_feature 1..20: note = CRISPR gRNA sequence
  source 1..20: mol_type = other DNA
atgttgggttttattcatct

SEQ ID NO: 26174 - DNA, 20 bp, synthetic construct
  misc_feature 1..20: note = CRISPR gRNA sequence
  source 1..20: mol_type = other DNA
ggttttattcatcttatcac

SEQ ID NO: 26175 - DNA, 20 bp, synthetic construct
  misc_feature 1..20: note = CRISPR gRNA sequence
  source 1..20: mol_type = other DNA
tattcatcttatcacatctc

SEQ ID NO: 26176 - DNA, 20 bp, synthetic construct
  misc_feature 1..20: note = CRISPR gRNA sequence
  source 1..20: mol_type = other DNA
attcatcttatcacatctct

SEQ ID NO: 26177 - DNA, 20 bp, synthetic construct
  misc_feature 1..20: note = CRISPR gRNA sequence
  source 1..20: mol_type = other DNA
ttcatcttatcacatctcta

SEQ ID NO: 26178 - DNA, 20 bp, synthetic construct
  misc_feature 1..20: note = CRISPR gRNA sequence
  source 1..20: mol_type = other DNA
atcttatcacatctctattc

SEQ ID NO: 26179 - DNA, 20 bp, synthetic construct
  misc_feature 1..20: note = CRISPR gRNA sequence
  source 1..20: mol_type = other DNA
atcacatctctattcatctg

SEQ ID NO: 26180 - DNA, 20 bp, synthetic construct
  misc_feature 1..20: note = CRISPR gRNA sequence
  source 1..20: mol_type = other DNA
tcacatctctattcatctgt

SEQ ID NO: 26181 - DNA, 20 bp, synthetic construct
  misc_feature 1..20: note = CRISPR gRNA sequence
  source 1..20: mol_type = other DNA
tattcatctgtccatccctc

SEQ ID NO: 26182 - DNA, 20 bp, synthetic construct
  misc_feature 1..20: note = CRISPR gRNA sequence
  source 1..20: mol_type = other DNA
ttcatctgtccatccctcta

SEQ ID NO: 26183 - DNA, 20 bp, synthetic construct
  misc_feature 1..20: note = CRISPR gRNA sequence
  source 1..20: mol_type = other DNA
atctgtccatccctctatcc

SEQ ID NO: 26184 - DNA, 20 bp, synthetic construct
  misc_feature 1..20: note = CRISPR gRNA sequence
  source 1..20: mol_type = other DNA
tccatccctctatccatcca

SEQ ID NO: 26185 - DNA, 20 bp, synthetic construct
  misc_feature 1..20: note = CRISPR gRNA sequence
  source 1..20: mol_type = other DNA
tatccatccacacacccatt

SEQ ID NO: 26186 - DNA, 20 bp, synthetic construct
  misc_feature 1..20: note = CRISPR gRNA sequence
  source 1..20: mol_type = other DNA
tccatccacacacccattca

SEQ ID NO: 26187 - DNA, 20 bp, synthetic construct
  misc_feature 1..20: note = CRISPR gRNA sequence
  source 1..20: mol_type = other DNA
attatatttttggtacattt

SEQ ID NO: 26188 - DNA, 20 bp, synthetic construct
  misc_feature 1..20: note = CRISPR gRNA sequence
  source 1..20: mol_type = other DNA
tatttttggtacatttcaat

SEQ ID NO: 26189 - DNA, 20 bp, synthetic construct
  misc_feature 1..20: note = CRISPR gRNA sequence
  source 1..20: mol_type = other DNA
ttggtacatttcaatgtaca

SEQ ID NO: 26190 - DNA, 20 bp, synthetic construct
  misc_feature 1..20: note = CRISPR gRNA sequence
  source 1..20: mol_type = other DNA
tggtacatttcaatgtacat

SEQ ID NO: 26191 - DNA, 20 bp, synthetic construct
  misc_feature 1..20: note = CRISPR gRNA sequence
  source 1..20: mol_type = other DNA
ggtacatttcaatgtacatt

SEQ ID NO: 26192 - DNA, 20 bp, synthetic construct
  misc_feature 1..20: note = CRISPR gRNA sequence
  source 1..20: mol_type = other DNA
gtacatttcaatgtacattt

SEQ ID NO: 26193 - DNA, 20 bp, synthetic construct
  misc_feature 1..20: note = CRISPR gRNA sequence
  source 1..20: mol_type = other DNA
caatgtacatttcaaatgta

SEQ ID NO: 26194 - DNA, 20 bp, synthetic construct
  misc_feature 1..20: note = CRISPR gRNA sequence
  source 1..20: mol_type = other DNA
aatgtacatttcaaatgtaa

SEQ ID NO: 26195 - DNA, 20 bp, synthetic construct
  misc_feature 1..20: note = CRISPR gRNA sequence
  source 1..20: mol_type = other DNA
caaatgtaaattgcagattt

SEQ ID NO: 26196 - DNA, 20 bp, synthetic construct
  misc_feature 1..20: note = CRISPR gRNA sequence
  source 1..20: mol_type = other DNA
aaatgtaaattgcagattta

SEQ ID NO: 26197 - DNA, 20 bp, synthetic construct
  misc_feature 1..20: note = CRISPR gRNA sequence
  source 1..20: mol_type = other DNA
cagatttacactcccctcgt

SEQ ID NO: 26198 - DNA, 20 bp, synthetic construct
  misc_feature 1..20: note = CRISPR gRNA sequence
  source 1..20: mol_type = other DNA
acactcccctcgtgtacttc

SEQ ID NO: 26199 - DNA, 20 bp, synthetic construct
  misc_feature 1..20: note = CRISPR gRNA sequence
  source 1..20: mol_type = other DNA
cactcccctcgtgtacttca

SEQ ID NO: 26200 - DNA, 20 bp, synthetic construct
  misc_feature 1..20: note = CRISPR gRNA sequence
  source 1..20: mol_type = other DNA
ccctcgtgtacttcagcatc

SEQ ID NO: 26201 - DNA, 20 bp, synthetic construct
  misc_feature 1..20: note = CRISPR gRNA sequence
  source 1..20: mol_type = other DNA
gtgtacttcagcatcctttc

SEQ ID NO: 26202 - DNA, 20 bp, synthetic construct
  misc_feature 1..20: note = CRISPR gRNA sequence
  source 1..20: mol_type = other DNA
cagcatcctttcttttaagg

SEQ ID NO: 26203 - DNA, 20 bp, synthetic construct
  misc_feature 1..20: note = CRISPR gRNA sequence
  source 1..20: mol_type = other DNA
agcatcctttcttttaaggc

SEQ ID NO: 26204 - DNA, 20 bp, synthetic construct
  misc_feature 1..20: note = CRISPR gRNA sequence
  source 1..20: mol_type = other DNA
tcttttaaggccatgcagtg

SEQ ID NO: 26205 - DNA, 20 bp, synthetic construct
  misc_feature 1..20: note = CRISPR gRNA sequence
  source 1..20: mol_type = other DNA
cttttaaggccatgcagtgt

SEQ ID NO: 26206 - DNA, 20 bp, synthetic construct
  misc_feature 1..20: note = CRISPR gRNA sequence
  source 1..20: mol_type = other DNA
ttttaaggccatgcagtgtt

SEQ ID NO: 26207 - DNA, 20 bp, synthetic construct
  misc_feature 1..20: note = CRISPR gRNA sequence
  source 1..20: mol_type = other DNA
ttaaggccatgcagtgtttc

SEQ ID NO: 26208 - DNA, 20 bp, synthetic construct
  misc_feature 1..20: note = CRISPR gRNA sequence
  source 1..20: mol_type = other DNA
taaggccatgcagtgtttcg

SEQ ID NO: 26209 - DNA, 20 bp, synthetic construct
  misc_feature 1..20: note = CRISPR gRNA sequence
  source 1..20: mol_type = other DNA
aaggccatgcagtgtttcgt

SEQ ID NO: 26210 - DNA, 20 bp, synthetic construct
  misc_feature 1..20: note = CRISPR gRNA sequence
  source 1..20: mol_type = other DNA
aggccatgcagtgtttcgtt

SEQ ID NO: 26211 - DNA, 20 bp, synthetic construct
  misc_feature 1..20: note = CRISPR gRNA sequence
  source 1..20: mol_type = other DNA
cgttgggtagatgaaccata

SEQ ID NO: 26212 - DNA, 20 bp, synthetic construct
  misc_feature 1..20: note = CRISPR gRNA sequence
  source 1..20: mol_type = other DNA
gttgggtagatgaaccataa

SEQ ID NO: 26213 - DNA, 20 bp, synthetic construct
  misc_feature 1..20: note = CRISPR gRNA sequence
  source 1..20: mol_type = other DNA
ggtagatgaaccataatttg

SEQ ID NO: 26214 - DNA, 20 bp, synthetic construct
  misc_feature 1..20: note = CRISPR gRNA sequence
  source 1..20: mol_type = other DNA
gtttaagcagtcccttgcta

SEQ ID NO: 26215 - DNA, 20 bp, synthetic construct
  misc_feature 1..20: note = CRISPR gRNA sequence
  source 1..20: mol_type = other DNA
tttaagcagtcccttgctaa

SEQ ID NO: 26216 - DNA, 20 bp, synthetic construct
  misc_feature 1..20: note = CRISPR gRNA sequence
  source 1..20: mol_type = other DNA
aagcagtcccttgctaaggg

SEQ ID NO: 26217 - DNA, 20 bp, synthetic construct
  misc_feature 1..20: note = CRISPR gRNA sequence
  source 1..20: mol_type = other DNA
agcagtcccttgctaaggga

SEQ ID NO: 26218 - DNA, 20 bp, synthetic construct
  misc_feature 1..20: note = CRISPR gRNA sequence
  source 1..20: mol_type = other DNA
gctaagggacacgtgggttt

SEQ ID NO: 26219 - DNA, 20 bp, synthetic construct
  misc_feature 1..20: note = CRISPR gRNA sequence
  source 1..20: mol_type = other DNA
ctaagggacacgtgggtttt

SEQ ID NO: 26220 - DNA, 20 bp, synthetic construct
  misc_feature 1..20: note = CRISPR gRNA sequence
  source 1..20: mol_type = other DNA
agggacacgtgggtttttaa

SEQ ID NO: 26221 - DNA, 20 bp, synthetic construct
  misc_feature 1..20: note = CRISPR gRNA sequence
  source 1..20: mol_type = other DNA
ttaatctgttgctgtgagtg

SEQ ID NO: 26222 - DNA, 20 bp, synthetic construct
  misc_feature 1..20: note = CRISPR gRNA sequence
  source 1..20: mol_type = other DNA
taatctgttgctgtgagtgc

SEQ ID NO: 26223 - DNA, 20 bp, synthetic construct
  misc_feature 1..20: note = CRISPR gRNA sequence
  source 1..20: mol_type = other DNA
aatctgttgctgtgagtgct

SEQ ID NO: 26224 - DNA, 20 bp, synthetic construct
  misc_feature 1..20: note = CRISPR gRNA sequence
  source 1..20: mol_type = other DNA
atctgttgctgtgagtgctt

SEQ ID NO: 26225 - DNA, 20 bp, synthetic construct
  misc_feature 1..20: note = CRISPR gRNA sequence
  source 1..20: mol_type = other DNA
ttgctgtgagtgcttgatac

SEQ ID NO: 26226 - DNA, 20 bp, synthetic construct
  misc_feature 1..20: note = CRISPR gRNA sequence
  source 1..20: mol_type = other DNA
ctgtgagtgcttgatactca

SEQ ID NO: 26227 - DNA, 20 bp, synthetic construct
  misc_feature 1..20: note = CRISPR gRNA sequence
  source 1..20: mol_type = other DNA
tgagtgcttgatactcactc

SEQ ID NO: 26228 - DNA, 20 bp, synthetic construct
  misc_feature 1..20: note = CRISPR gRNA sequence
  source 1..20: mol_type = other DNA
gatactcactcactgatttc

SEQ ID NO: 26229 - DNA, 20 bp, synthetic construct
  misc_feature 1..20: note = CRISPR gRNA sequence
  source 1..20: mol_type = other DNA
atactcactcactgatttct

SEQ ID NO: 26230 - DNA, 20 bp, synthetic construct
  misc_feature 1..20: note = CRISPR gRNA sequence
  source 1..20: mol_type = other DNA
actcactgatttctggcata

SEQ ID NO: 26231 - DNA, 20 bp, synthetic construct
  misc_feature 1..20: note = CRISPR gRNA sequence
  source 1..20: mol_type = other DNA
actgatttctggcatactcc

SEQ ID NO: 26232 - DNA, 20 bp, synthetic construct
  misc_feature 1..20: note = CRISPR gRNA sequence
  source 1..20: mol_type = other DNA
atttctggcatactcctgca

SEQ ID NO: 26233 - DNA, 20 bp, synthetic construct
  misc_feature 1..20: note = CRISPR gRNA sequence
  source 1..20: mol_type = other DNA
ctggcatactcctgcaatgt

SEQ ID NO: 26234 - DNA, 20 bp, synthetic construct
  misc_feature 1..20: note = CRISPR gRNA sequence
  source 1..20: mol_type = other DNA
tggcatactcctgcaatgta

SEQ ID NO: 26235 - DNA, 20 bp, synthetic construct
  misc_feature 1..20: note = CRISPR gRNA sequence
  source 1..20: mol_type = other DNA
gcatactcctgcaatgtagg

SEQ ID NO: 26236 - DNA, 20 bp, synthetic construct
  misc_feature 1..20: note = CRISPR gRNA sequence
  source 1..20: mol_type = other DNA
ctgcaatgtaggaaccacca

SEQ ID NO: 26237 - DNA, 20 bp, synthetic construct
  misc_feature 1..20: note = CRISPR gRNA sequence
  source 1..20: mol_type = other DNA
caatgtaggaaccaccaccc

SEQ ID NO: 26238 - DNA, 20 bp, synthetic construct
  misc_feature 1..20: note = CRISPR gRNA sequence
  source 1..20: mol_type = other DNA
catagatgtgagatcaaagg

SEQ ID NO: 26239 - DNA, 20 bp, synthetic construct
  misc_feature 1..20: note = CRISPR gRNA sequence
  source 1..20: mol_type = other DNA
atagatgtgagatcaaaggt

SEQ ID NO: 26240 - DNA, 20 bp, synthetic construct
  misc_feature 1..20: note = CRISPR gRNA sequence
  source 1..20: mol_type = other DNA
agagaagctgcattgcaaag

SEQ ID NO: 26241 - DNA, 20 bp, synthetic construct
  misc_feature 1..20: note = CRISPR gRNA sequence
  source 1..20: mol_type = other DNA
cattgcaaaggcacacagct

SEQ ID NO: 26242 - DNA, 20 bp, synthetic construct
  misc_feature 1..20: note = CRISPR gRNA sequence
  source 1..20: mol_type = other DNA
caaaggcacacagctaggaa

SEQ ID NO: 26243 - DNA, 20 bp, synthetic construct
  misc_feature 1..20: note = CRISPR gRNA sequence
  source 1..20: mol_type = other DNA
ggaagcggttcaaaagcagg

SEQ ID NO: 26244 - DNA, 20 bp, synthetic construct
  misc_feature 1..20: note = CRISPR gRNA sequence
  source 1..20: mol_type = other DNA
aaaagcaggttcctttgttt

SEQ ID NO: 26245 - DNA, 20 bp, synthetic construct
  misc_feature 1..20: note = CRISPR gRNA sequence
  source 1..20: mol_type = other DNA
ctttgttttgttttgttttg

SEQ ID NO: 26246 - DNA, 20 bp, synthetic construct
  misc_feature 1..20: note = CRISPR gRNA sequence
  source 1..20: mol_type = other DNA
tgttttgttttgttttgttt

SEQ ID NO: 26247 - DNA, 20 bp, synthetic construct
  misc_feature 1..20: note = CRISPR gRNA sequence
  source 1..20: mol_type = other DNA
gttttgttttgttttgtttt

SEQ ID NO: 26248 - DNA, 20 bp, synthetic construct
  misc_feature 1..20: note = CRISPR gRNA sequence
  source 1..20: mol_type = other DNA
ttttgttttgttttgttttt

SEQ ID NO: 26249 - DNA, 20 bp, synthetic construct
  misc_feature 1..20: note = CRISPR gRNA sequence
  source 1..20: mol_type = other DNA
tgttttgttttgttttttgg

SEQ ID NO: 26250 - DNA, 20 bp, synthetic construct
  misc_feature 1..20: note = CRISPR gRNA sequence
  source 1..20: mol_type = other DNA
gttttgttttgttttttggc

SEQ ID NO: 26251 - DNA, 20 bp, synthetic construct
  misc_feature 1..20: note = CRISPR gRNA sequence
  source 1..20: mol_type = other DNA
ttttgttttgttttttggct

SEQ ID NO: 26252 - DNA, 20 bp, synthetic construct
  misc_feature 1..20: note = CRISPR gRNA sequence
  source 1..20: mol_type = other DNA
tgttttgttttttggctcaa

SEQ ID NO: 26253 - DNA, 20 bp, synthetic construct
  misc_feature 1..20: note = CRISPR gRNA sequence
  source 1..20: mol_type = other DNA
gttttgttttttggctcaaa

SEQ ID NO: 26254 - DNA, 20 bp, synthetic construct
  misc_feature 1..20: note = CRISPR gRNA sequence
  source 1..20: mol_type = other DNA
ttttgttttttggctcaaac

SEQ ID NO: 26255 - DNA, 20 bp, synthetic construct
  misc_feature 1..20: note = CRISPR gRNA sequence
  source 1..20: mol_type = other DNA
tgttttttggctcaaaccca

SEQ ID NO: 26256 - DNA, 20 bp, synthetic construct
  misc_feature 1..20: note = CRISPR gRNA sequence
  source 1..20: mol_type = other DNA
gttttttggctcaaacccat

SEQ ID NO: 26257 - DNA, 20 bp, synthetic construct
  misc_feature 1..20: note = CRISPR gRNA sequence
  source 1..20: mol_type = other DNA
ttttttggctcaaacccatg

SEQ ID NO: 26258 - DNA, 20 bp, synthetic construct
  misc_feature 1..20: note = CRISPR gRNA sequence
  source 1..20: mol_type = other DNA
tttggctcaaacccatgttg

SEQ ID NO: 26259 - DNA, 20 bp, synthetic construct
  misc_feature 1..20: note = CRISPR gRNA sequence
  source 1..20: mol_type = other DNA
ttggctcaaacccatgttgt

SEQ ID NO: 26260 - DNA, 20 bp, synthetic construct
  misc_feature 1..20: note = CRISPR gRNA sequence
  source 1..20: mol_type = other DNA
tggctcaaacccatgttgtg

SEQ ID NO: 26261 - DNA, 20 bp, synthetic construct
  misc_feature 1..20: note = CRISPR gRNA sequence
  source 1..20: mol_type = other DNA
ggctcaaacccatgttgtgt

SEQ ID NO: 26262 - DNA, 20 bp, synthetic construct
  misc_feature 1..20: note = CRISPR gRNA sequence
  source 1..20: mol_type = other DNA
gctcaaacccatgttgtgtc

SEQ ID NO: 26263 - DNA, 20 bp, synthetic construct
  misc_feature 1..20: note = CRISPR gRNA sequence
  source 1..20: mol_type = other DNA
aaacccatgttgtgtcccca

SEQ ID NO: 26264 - DNA, 20 bp, synthetic construct
  misc_feature 1..20: note = CRISPR gRNA sequence
  source 1..20: mol_type = other DNA
tgtccccatttgtgactcgg

SEQ ID NO: 26265 - DNA, 20 bp, synthetic construct
  misc_feature 1..20: note = CRISPR gRNA sequence
  source 1..20: mol_type = other DNA
gtgactcggcctcttctgct

SEQ ID NO: 26266 - DNA, 20 bp, synthetic construct
  misc_feature 1..20: note = CRISPR gRNA sequence
  source 1..20: mol_type = other DNA
tgactcggcctcttctgctg

SEQ ID NO: 26267 - DNA, 20 bp, synthetic construct
  misc_feature 1..20: note = CRISPR gRNA sequence
  source 1..20: mol_type = other DNA
ggcctcttctgctgctacac

SEQ ID NO: 26268 - DNA, 20 bp, synthetic construct
  misc_feature 1..20: note = CRISPR gRNA sequence
  source 1..20: mol_type = other DNA
ttctgctgctacactgcctg

SEQ ID NO: 26269 - DNA, 20 bp, synthetic construct
  misc_feature 1..20: note = CRISPR gRNA sequence
  source 1..20: mol_type = other DNA
ctgctgctacactgcctggt

SEQ ID NO: 26270 - DNA, 20 bp, synthetic construct
  misc_feature 1..20: note = CRISPR gRNA sequence
  source 1..20: mol_type = other DNA
tgctgctacactgcctggta

SEQ ID NO: 26271 - DNA, 20 bp, synthetic construct
  misc_feature 1..20: note = CRISPR gRNA sequence
  source 1..20: mol_type = other DNA
ctgctacactgcctggtatg

SEQ ID NO: 26272 - DNA, 20 bp, synthetic construct
  misc_feature 1..20: note = CRISPR gRNA sequence
  source 1..20: mol_type = other DNA
ctacactgcctggtatggtt

SEQ ID NO: 26273 - DNA, 20 bp, synthetic construct
  misc_feature 1..20: note = CRISPR gRNA sequence
  source 1..20: mol_type = other DNA
cactgcctggtatggtttga

SEQ ID NO: 26274 - DNA, 20 bp, synthetic construct
  misc_feature 1..20: note = CRISPR gRNA sequence
  source 1..20: mol_type = other DNA
cctggtatggtttgagatgg

SEQ ID NO: 26275 - DNA, 20 bp, synthetic construct
  misc_feature 1..20: note = CRISPR gRNA sequence
  source 1..20: mol_type = other DNA
gtatggtttgagatggggtt

SEQ ID NO: 26276 - DNA, 20 bp, synthetic construct
  misc_feature 1..20: note = CRISPR gRNA sequence
  source 1..20: mol_type = other DNA
gagatggggtttgggttcaa

SEQ ID NO: 26277 - DNA, 20 bp, synthetic construct
  misc_feature 1..20: note = CRISPR gRNA sequence
  source 1..20: mol_type = other DNA
agatggggtttgggttcaag

SEQ ID NO: 26278 - DNA, 20 bp, synthetic construct
  misc_feature 1..20: note = CRISPR gRNA sequence
  source 1..20: mol_type = other DNA
gggttcaagccaaggagctg

SEQ ID NO: 26279 - DNA, 20 bp, synthetic construct
  misc_feature 1..20: note = CRISPR gRNA sequence
  source 1..20: mol_type = other DNA
ggttcaagccaaggagctgg

SEQ ID NO: 26280 - DNA, 20 bp, synthetic construct
  misc_feature 1..20: note = CRISPR gRNA sequence
  source 1..20: mol_type = other DNA
aagccaaggagctggggttg

SEQ ID NO: 26281 - DNA, 20 bp, synthetic construct
  misc_feature 1..20: note = CRISPR gRNA sequence
  source 1..20: mol_type = other DNA
gggttggaatgttagagcga

SEQ ID NO: 26282 - DNA, 20 bp, synthetic construct
  misc_feature 1..20: note = CRISPR gRNA sequence
  source 1..20: mol_type = other DNA
gaatgttagagcgaggggag

SEQ ID NO: 26283 - DNA, 20 bp, synthetic construct
  misc_feature 1..20: note = CRISPR gRNA sequence
  source 1..20: mol_type = other DNA
gagcgaggggaggaaaatgg

SEQ ID NO: 26284 - DNA, 20 bp, synthetic construct
  misc_feature 1..20: note = CRISPR gRNA sequence
  source 1..20: mol_type = other DNA
cccagccttgaagttaaggc

SEQ ID NO: 26285 - DNA, 20 bp, synthetic construct
  misc_feature 1..20: note = CRISPR gRNA sequence
  source 1..20: mol_type = other DNA
gaagttaaggccgtatagcc

SEQ ID NO: 26286 - DNA, 20 bp, synthetic construct
  misc_feature 1..20: note = CRISPR gRNA sequence
  source 1..20: mol_type = other DNA
aagttaaggccgtatagcct

SEQ ID NO: 26287 - DNA, 20 bp, synthetic construct
  misc_feature 1..20: note = CRISPR gRNA sequence
  source 1..20: mol_type = other DNA
aggccgtatagcctgctaga

SEQ ID NO: 26288 - DNA, 20 bp, synthetic construct
  misc_feature 1..20: note = CRISPR gRNA sequence
  source 1..20: mol_type = other DNA
ctagagtcctgagccccttc

SEQ ID NO: 26289 - DNA, 20 bp, synthetic construct
  misc_feature 1..20: note = CRISPR gRNA sequence
  source 1..20: mol_type = other DNA
gagtcctgagccccttctgg

SEQ ID NO: 26290 - DNA, 20 bp, synthetic construct
  misc_feature 1..20: note = CRISPR gRNA sequence
  source 1..20: mol_type = other DNA
agccccttctggcttgggac

SEQ ID NO: 26291 - DNA, 20 bp, synthetic construct
  misc_feature 1..20: note = CRISPR gRNA sequence
  source 1..20: mol_type = other DNA
ctggcttgggacatcctctc

SEQ ID NO: 26292 - DNA, 20 bp, synthetic construct
  misc_feature 1..20: note = CRISPR gRNA sequence
  source 1..20: mol_type = other DNA
tggcttgggacatcctctcc

SEQ ID NO: 26293 - DNA, 20 bp, synthetic construct
  misc_feature 1..20: note = CRISPR gRNA sequence
  source 1..20: mol_type = other DNA
gcttgggacatcctctccct

SEQ ID NO: 26294 - DNA, 20 bp, synthetic construct
  misc_feature 1..20: note = CRISPR gRNA sequence
  source 1..20: mol_type = other DNA
gggacatcctctccctgggg

SEQ ID NO: 26295 - DNA, 20 bp, synthetic construct
  misc_feature 1..20: note = CRISPR gRNA sequence
  source 1..20: mol_type = other DNA
ggacatcctctccctggggc

SEQ ID NO: 26296 - DNA, 20 bp, synthetic construct
  misc_feature 1..20: note = CRISPR gRNA sequence
  source 1..20: mol_type = other DNA
tccctggggcagctgatcac

SEQ ID NO: 26297 - DNA, 20 bp, synthetic construct
  misc_feature 1..20: note = CRISPR gRNA sequence
  source 1..20: mol_type = other DNA
cctggggcagctgatcacat

SEQ ID NO: 26298 - DNA, 20 bp, synthetic construct
  misc_feature 1..20: note = CRISPR gRNA sequence
  source 1..20: mol_type = other DNA
gggcagctgatcacatgttt

SEQ ID NO: 26299 - DNA, 20 bp, synthetic construct
  misc_feature 1..20: note = CRISPR gRNA sequence
  source 1..20: mol_type = other DNA
atcacatgttttctctgcag

SEQ ID NO: 26300 - DNA, 20 bp, synthetic construct
  misc_feature 1..20: note = CRISPR gRNA sequence
  source 1..20: mol_type = other DNA
tctctgcagccttcccagag

SEQ ID NO: 26301 - DNA, 20 bp, synthetic construct
  misc_feature 1..20: note = CRISPR gRNA sequence
  source 1..20: mol_type = other DNA
ctctgcagccttcccagagg

SEQ ID NO: 26302 - DNA, 20 bp, synthetic construct
  misc_feature 1..20: note = CRISPR gRNA sequence
  source 1..20: mol_type = other DNA
tctgcagccttcccagagga

SEQ ID NO: 26303 - DNA, 20 bp, synthetic construct
  misc_feature 1..20: note = CRISPR gRNA sequence
  source 1..20: mol_type = other DNA
tgcagccttcccagaggagc

SEQ ID NO: 26304 - DNA, 20 bp, synthetic construct
  misc_feature 1..20: note = CRISPR gRNA sequence
  source 1..20: mol_type = other DNA
cagccttcccagaggagctt

SEQ ID NO: 26305 - DNA, 20 bp, synthetic construct
  misc_feature 1..20: note = CRISPR gRNA sequence
  source 1..20: mol_type = other DNA
cccagaggagcttccggcag

SEQ ID NO: 26306 - DNA, 20 bp, synthetic construct
  misc_feature 1..20: note = CRISPR gRNA sequence
  source 1..20: mol_type = other DNA
ccagaggagcttccggcaga

SEQ ID NO: 26307 - DNA, 20 bp, synthetic construct
  misc_feature 1..20: note = CRISPR gRNA sequence
  source 1..20: mol_type = other DNA
ccggcagacctgaagcactg

SEQ ID NO: 26308 - DNA, 20 bp, synthetic construct
  misc_feature 1..20: note = CRISPR gRNA sequence
  source 1..20: mol_type = other DNA
cggcagacctgaagcactgg

SEQ ID NO: 26309 - DNA, 20 bp, synthetic construct
  misc_feature 1..20: note = CRISPR gRNA sequence
  source 1..20: mol_type = other DNA
aagcactggaagccaggtgt

SEQ ID NO: 26310 - DNA, 20 bp, synthetic construct
  misc_feature 1..20: note = CRISPR gRNA sequence
  source 1..20: mol_type = other DNA
gaagccaggtgtgcagggca

SEQ ID NO: 26311 - DNA, 20 bp, synthetic construct
  misc_feature 1..20: note = CRISPR gRNA sequence
  source 1..20: mol_type = other DNA
gggttgggaagggtggatgc

SEQ ID NO: 26312 - DNA, 20 bp, synthetic construct
  misc_feature 1..20: note = CRISPR gRNA sequence
  source 1..20: mol_type = other DNA
ggaagggtggatgccttggg

SEQ ID NO: 26313 - DNA, 20 bp, synthetic construct
  misc_feature 1..20: note = CRISPR gRNA sequence
  source 1..20: mol_type = other DNA
ggggaggggatggaagagat

SEQ ID NO: 26314 - DNA, 20 bp, synthetic construct
  misc_feature 1..20: note = CRISPR gRNA sequence
  source 1..20: mol_type = other DNA
gggaggggatggaagagatt

SEQ ID NO: 26315 - DNA, 20 bp, synthetic construct
  misc_feature 1..20: note = CRISPR gRNA sequence
  source 1..20: mol_type = other DNA
aactcctggcccaagtctga

SEQ ID NO: 26316 - DNA, 20 bp, synthetic construct
  misc_feature 1..20: note = CRISPR gRNA sequence
  source 1..20: mol_type = other DNA
ctggcccaagtctgatgggg

SEQ ID NO: 26317 - DNA, 20 bp, synthetic construct
  misc_feature 1..20: note = CRISPR gRNA sequence
  source 1..20: mol_type = other DNA
gcccaagtctgatggggatg

SEQ ID NO: 26318 - DNA, 20 bp, synthetic construct
  misc_feature 1..20: note = CRISPR gRNA sequence
  source 1..20: mol_type = other DNA
atggggatggtgcatggtgc

SEQ ID NO: 26319 - DNA, 20 bp, synthetic construct
  misc_feature 1..20: note = CRISPR gRNA sequence
  source 1..20: mol_type = other DNA
cccttctttgggtagaggct

SEQ ID NO: 26320 - DNA, 20 bp, synthetic construct
  misc_feature 1..20: note = CRISPR gRNA sequence
  source 1..20: mol_type = other DNA
ctttgggtagaggctgagag

SEQ ID NO: 26321 - DNA, 20 bp, synthetic construct
  misc_feature 1..20: note = CRISPR gRNA sequence
  source 1..20: mol_type = other DNA
tttgggtagaggctgagagc

SEQ ID NO: 26322 - DNA, 20 bp, synthetic construct
  misc_feature 1..20: note = CRISPR gRNA sequence
  source 1..20: mol_type = other DNA
tgggtagaggctgagagctt

SEQ ID NO: 26323 - DNA, 20 bp, synthetic construct
  misc_feature 1..20: note = CRISPR gRNA sequence
  source 1..20: mol_type = other DNA
gggtagaggctgagagcttg

SEQ ID NO: 26324 - DNA, 20 bp, synthetic construct
  misc_feature 1..20: note = CRISPR gRNA sequence
  source 1..20: mol_type = other DNA
ggtagaggctgagagcttgg

SEQ ID NO: 26325 - DNA, 20 bp, synthetic construct
  misc_feature 1..20: note = CRISPR gRNA sequence
  source 1..20: mol_type = other DNA
agagcttggggtcccttaga

SEQ ID NO: 26326 - DNA, 20 bp, synthetic construct
  misc_feature 1..20: note = CRISPR gRNA sequence
  source 1..20: mol_type = other DNA
ggggtcccttagagtcctct

SEQ ID NO: 26327 - DNA, 20 bp, synthetic construct
  misc_feature 1..20: note = CRISPR gRNA sequence
  source 1..20: mol_type = other DNA
gggtcccttagagtcctcta

SEQ ID NO: 26328 - DNA, 20 bp, synthetic construct
  misc_feature 1..20: note = CRISPR gRNA sequence
  source 1..20: mol_type = other DNA
agagtcctctaaggggctca

SEQ ID NO: 26329 - DNA, 20 bp, synthetic construct
  misc_feature 1..20: note = CRISPR gRNA sequence
  source 1..20: mol_type = other DNA
gagtcctctaaggggctcac

SEQ ID NO: 26330 - DNA, 20 bp, synthetic construct
  misc_feature 1..20: note = CRISPR gRNA sequence
  source 1..20: mol_type = other DNA
taaggggctcacgactgttt

SEQ ID NO: 26331 - DNA, 20 bp, synthetic construct
  misc_feature 1..20: note = CRISPR gRNA sequence
  source 1..20: mol_type = other DNA
aggggctcacgactgtttgt

SEQ ID NO: 26332 - DNA, 20 bp, synthetic construct
  misc_feature 1..20: note = CRISPR gRNA sequence
  source 1..20: mol_type = other DNA
acgactgtttgtggaaggtg

SEQ ID NO: 26333 - DNA, 20 bp, synthetic construct
  misc_feature 1..20: note = CRISPR gRNA sequence
  source 1..20: mol_type = other DNA
tttgtggaaggtggtagggg

SEQ ID NO: 26334 - DNA, 20 bp, synthetic construct
  misc_feature 1..20: note = CRISPR gRNA sequence
  source 1..20: mol_type = other DNA
gtggaaggtggtaggggctt

SEQ ID NO: 26335 - DNA, 20 bp, synthetic construct
  misc_feature 1..20: note = CRISPR gRNA sequence
  source 1..20: mol_type = other DNA
tggaaggtggtaggggcttg

SEQ ID NO: 26336 - DNA, 20 bp, synthetic construct
  misc_feature 1..20: note = CRISPR gRNA sequence
  source 1..20: mol_type = other DNA
ggagctaacagattgttcat

SEQ ID NO: 26337 - DNA, 20 bp, synthetic construct
  misc_feature 1..20: note = CRISPR gRNA sequence
  source 1..20: mol_type = other DNA
gagctaacagattgttcata

SEQ ID NO: 26338 - DNA, 20 bp, synthetic construct
  misc_feature 1..20: note = CRISPR gRNA sequence
  source 1..20: mol_type = other DNA
acagattgttcataggttct

SEQ ID NO: 26339 - DNA, 20 bp, synthetic construct
  misc_feature 1..20: note = CRISPR gRNA sequence
  source 1..20: mol_type = other DNA
ttcataggttctattctgcc

SEQ ID NO: 26340 - DNA, 20 bp, synthetic construct
  misc_feature 1..20: note = CRISPR gRNA sequence
  source 1..20: mol_type = other DNA
ataggttctattctgcccca

SEQ ID NO: 26341 - DNA, 20 bp, synthetic construct
  misc_feature 1..20: note = CRISPR gRNA sequence
  source 1..20: mol_type = other DNA
tattctgccccagctctccg

SEQ ID NO: 26342 - DNA, 20 bp, synthetic construct
  misc_feature 1..20: note = CRISPR gRNA sequence
  source 1..20: mol_type = other DNA
ttctgccccagctctccgtg

SEQ ID NO: 26343 - DNA, 20 bp, synthetic construct
  misc_feature 1..20: note = CRISPR gRNA sequence
  source 1..20: mol_type = other DNA
tgccccagctctccgtgtgg

SEQ ID NO: 26344 - DNA, 20 bp, synthetic construct
  misc_feature 1..20: note = CRISPR gRNA sequence
  source 1..20: mol_type = other DNA
ccccagctctccgtgtggag

SEQ ID NO: 26345 - DNA, 20 bp, synthetic construct
  misc_feature 1..20: note = CRISPR gRNA sequence
  source 1..20: mol_type = other DNA
tccgtgtggaggccctaggg

SEQ ID NO: 26346 - DNA, 20 bp, synthetic construct
  misc_feature 1..20: note = CRISPR gRNA sequence
  source 1..20: mol_type = other DNA
cgtgtggaggccctagggtc

SEQ ID NO: 26347 - DNA, 20 bp, synthetic construct
  misc_feature 1..20: note = CRISPR gRNA sequence
  source 1..20: mol_type = other DNA
gggtcctgctcagcatagct

SEQ ID NO: 26348 - DNA, 20 bp, synthetic construct
  misc_feature 1..20: note = CRISPR gRNA sequence
  source 1..20: mol_type = other DNA
ctcagcatagctctcagagc

SEQ ID NO: 26349 - DNA, 20 bp, synthetic construct
  misc_feature 1..20: note = CRISPR gRNA sequence
  source 1..20: mol_type = other DNA
agcatagctctcagagccaa

SEQ ID NO: 26350 - DNA, 20 bp, synthetic construct
  misc_feature 1..20: note = CRISPR gRNA sequence
  source 1..20: mol_type = other DNA
tcagagccaagtcacaagga

SEQ ID NO: 26351 - DNA, 20 bp, synthetic construct
  misc_feature 1..20: note = CRISPR gRNA sequence
  source 1..20: mol_type = other DNA
agagccaagtcacaaggaga

SEQ ID NO: 26352 - DNA, 20 bp, synthetic construct
  misc_feature 1..20: note = CRISPR gRNA sequence
  source 1..20: mol_type = other DNA
ggggactgcctggcacagag

SEQ ID NO: 26353 - DNA, 20 bp, synthetic construct
  misc_feature 1..20: note = CRISPR gRNA sequence
  source 1..20: mol_type = other DNA
cctggcacagagcagttgct

SEQ ID NO: 26354 - DNA, 20 bp, synthetic construct
  misc_feature 1..20: note = CRISPR gRNA sequence
  source 1..20: mol_type = other DNA
gcacagagcagttgctgatc

SEQ ID NO: 26355 - DNA, 20 bp, synthetic construct
  misc_feature 1..20: note = CRISPR gRNA sequence
  source 1..20: mol_type = other DNA
ctgatcaacacagctgcagc

SEQ ID NO: 26356 - DNA, 20 bp, synthetic construct
  misc_feature 1..20: note = CRISPR gRNA sequence
  source 1..20: mol_type = other DNA
atcaacacagctgcagccag

SEQ ID NO: 26357 - DNA, 20 bp, synthetic construct
  misc_feature 1..20: note = CRISPR gRNA sequence
  source 1..20: mol_type = other DNA
cagccagggctgagaagatg

SEQ ID NO: 26358 - DNA, 20 bp, synthetic construct
  misc_feature 1..20: note = CRISPR gRNA sequence
  source 1..20: mol_type = other DNA
agaagatgacaagcatttcc

SEQ ID NO: 26359 - DNA, 20 bp, synthetic construct
  misc_feature 1..20: note = CRISPR gRNA sequence
  source 1..20: mol_type = other DNA
cctctgtcaggagagacatc

SEQ ID NO: 26360 - DNA, 20 bp, synthetic construct
  misc_feature 1..20: note = CRISPR gRNA sequence
  source 1..20: mol_type = other DNA
ctctgtcaggagagacatcc

SEQ ID NO: 26361 - DNA, 20 bp, synthetic construct
  misc_feature 1..20: note = CRISPR gRNA sequence
  source 1..20: mol_type = other DNA
tgtcaggagagacatccatg

SEQ ID NO: 26362 - DNA, 20 bp, synthetic construct
  misc_feature 1..20: note = CRISPR gRNA sequence
  source 1..20: mol_type = other DNA
tcaggagagacatccatgcc

SEQ ID NO: 26363 - DNA, 20 bp, synthetic construct
  misc_feature 1..20: note = CRISPR gRNA sequence
  source 1..20: mol_type = other DNA
cagggccctccccatcccag

SEQ ID NO: 26364 - DNA, 20 bp, synthetic construct
  misc_feature 1..20: note = CRISPR gRNA sequence
  source 1..20: mol_type = other DNA
cccatcccaggaaggcccct

SEQ ID NO: 26365 - DNA, 20 bp, synthetic construct
  misc_feature 1..20: note = CRISPR gRNA sequence
  source 1..20: mol_type = other DNA
caagcacccagtctctaaca

SEQ ID NO: 26366 - DNA, 20 bp, synthetic construct
  misc_feature 1..20: note = CRISPR gRNA sequence
  source 1..20: mol_type = other DNA
taacacagcccacttcctca

SEQ ID NO: 26367 - DNA, 20 bp, synthetic construct
  misc_feature 1..20: note = CRISPR gRNA sequence
  source 1..20: mol_type = other DNA
acacagcccacttcctcaca

SEQ ID NO: 26368 - DNA, 20 bp, synthetic construct
  misc_feature 1..20: note = CRISPR gRNA sequence
  source 1..20: mol_type = other DNA
cctcacagctgagcccccca

SEQ ID NO: 26369 - DNA, 20 bp, synthetic construct
  misc_feature 1..20: note = CRISPR gRNA sequence
  source 1..20: mol_type = other DNA
ctcacagctgagccccccac

SEQ ID NO: 26370 - DNA, 20 bp, synthetic construct
  misc_feature 1..20: note = CRISPR gRNA sequence
  source 1..20: mol_type = other DNA
acagctgagccccccactgt

SEQ ID NO: 26371 - DNA, 20 bp, synthetic construct
  misc_feature 1..20: note = CRISPR gRNA sequence
  source 1..20: mol_type = other DNA
agccccccactgtggtgact

SEQ ID NO: 26372 - DNA, 20 bp, synthetic construct
  misc_feature 1..20: note = CRISPR gRNA sequence
  source 1..20: mol_type = other DNA
tggtgactggcagtctccta

SEQ ID NO: 26373 - DNA, 20 bp, synthetic construct
  misc_feature 1..20: note = CRISPR gRNA sequence
  source 1..20: mol_type = other DNA
gcagtctcctagtgagacca

SEQ ID NO: 26374 - DNA, 20 bp, synthetic construct
  misc_feature 1..20: note = CRISPR gRNA sequence
  source 1..20: mol_type = other DNA
ctagtgagaccagtgagcga

SEQ ID NO: 26375 - DNA, 20 bp, synthetic construct
  misc_feature 1..20: note = CRISPR gRNA sequence
  source 1..20: mol_type = other DNA
gtgagaccagtgagcgactg

SEQ ID NO: 26376 - DNA, 20 bp, synthetic construct
  misc_feature 1..20: note = CRISPR gRNA sequence
  source 1..20: mol_type = other DNA
ctccaccctgccctgcctgc

SEQ ID NO: 26377 - DNA, 20 bp, synthetic construct
  misc_feature 1..20: note = CRISPR gRNA sequence
  source 1..20: mol_type = other DNA
caccctgccctgcctgccac

SEQ ID NO: 26378 - DNA, 20 bp, synthetic construct
  misc_feature 1..20: note = CRISPR gRNA sequence
  source 1..20: mol_type = other DNA
ccctgcctgccactgcctgc

SEQ ID NO: 26379 - DNA, 20 bp, synthetic construct
  misc_feature 1..20: note = CRISPR gRNA sequence
  source 1..20: mol_type = other DNA
cctgccactgcctgcgctgt

SEQ ID NO: 26380 - DNA, 20 bp, synthetic construct
  misc_feature 1..20: note = CRISPR gRNA sequence
  source 1..20: mol_type = other DNA
ccactgcctgcgctgttcaa

SEQ ID NO: 26381 - DNA, 20 bp, synthetic construct
  misc_feature 1..20: note = CRISPR gRNA sequence
  source 1..20: mol_type = other DNA
cctgcgctgttcaaccagga

SEQ ID NO: 26382 - DNA, 20 bp, synthetic construct
  misc_feature 1..20: note = CRISPR gRNA sequence
  source 1..20: mol_type = other DNA
cgctgttcaaccaggagcca

SEQ ID NO: 26383 - DNA, 20 bp, synthetic construct
  misc_feature 1..20: note = CRISPR gRNA sequence
  source 1..20: mol_type = other DNA
ttcaaccaggagccagcctc

SEQ ID NO: 26384 - DNA, 20 bp, synthetic construct
  misc_feature 1..20: note = CRISPR gRNA sequence
  source 1..20: mol_type = other DNA
aaccaggagccagcctccgg

SEQ ID NO: 26385 - DNA, 20 bp, synthetic construct
  misc_feature 1..20: note = CRISPR gRNA sequence
  source 1..20: mol_type = other DNA
cggccagatgcgcctggaga

SEQ ID NO: 26386 - DNA, 20 bp, synthetic construct
  misc_feature 1..20: note = CRISPR gRNA sequence
  source 1..20: mol_type = other DNA
gagaaaaccgaccagattcc

SEQ ID NO: 26387 - DNA, 20 bp, synthetic construct
  misc_feature 1..20: note = CRISPR gRNA sequence
  source 1..20: mol_type = other DNA
ccagtatgttagggggcttg

SEQ ID NO: 26388 - DNA, 20 bp, synthetic construct
  misc_feature 1..20: note = CRISPR gRNA sequence
  source 1..20: mol_type = other DNA
gggggcttggagagagtggg

SEQ ID NO: 26389 - DNA, 20 bp, synthetic construct
  misc_feature 1..20: note = CRISPR gRNA sequence
  source 1..20: mol_type = other DNA
ggagagagtgggctttctcc

SEQ ID NO: 26390 - DNA, 20 bp, synthetic construct
  misc_feature 1..20: note = CRISPR gRNA sequence
  source 1..20: mol_type = other DNA
gagagagtgggctttctccc

SEQ ID NO: 26391 - DNA, 20 bp, synthetic construct
  misc_feature 1..20: note = CRISPR gRNA sequence
  source 1..20: mol_type = other DNA
tctccctcttgggaggtgga

SEQ ID NO: 26392 - DNA, 20 bp, synthetic construct
  misc_feature 1..20: note = CRISPR gRNA sequence
  source 1..20: mol_type = other DNA
ctccctcttgggaggtggat

SEQ ID NO: 26393 - DNA, 20 bp, synthetic construct
  misc_feature 1..20: note = CRISPR gRNA sequence
  source 1..20: mol_type = other DNA
tccctcttgggaggtggata

SEQ ID NO: 26394 - DNA, 20 bp, synthetic construct
  misc_feature 1..20: note = CRISPR gRNA sequence
  source 1..20: mol_type = other DNA
cctcttgggaggtggataag

SEQ ID NO: 26395 - DNA, 20 bp, synthetic construct
  misc_feature 1..20: note = CRISPR gRNA sequence
  source 1..20: mol_type = other DNA
ttgggaggtggataaggagt

SEQ ID NO: 26396 - DNA, 20 bp, synthetic construct
  misc_feature 1..20: note = CRISPR gRNA sequence
  source 1..20: mol_type = other DNA
gggaggtggataaggagttg

SEQ ID NO: 26397 - DNA, 20 bp, synthetic construct
  misc_feature 1..20: note = CRISPR gRNA sequence
  source 1..20: mol_type = other DNA
ggaggtggataaggagttga

SEQ ID NO: 26398 - DNA, 20 bp, synthetic construct
  misc_feature 1..20: note = CRISPR gRNA sequence
  source 1..20: mol_type = other DNA
acactaaggcagggactgtc

SEQ ID NO: 26399 - DNA, 20 bp, synthetic construct
  misc_feature 1..20: note = CRISPR gRNA sequence
  source 1..20: mol_type = other DNA
aggcagggactgtcaggaac

SEQ ID NO: 26400 - DNA, 20 bp, synthetic construct
  misc_feature 1..20: note = CRISPR gRNA sequence
  source 1..20: mol_type = other DNA
tcaggaactggacctcacct

SEQ ID NO: 26401 - DNA, 20 bp, synthetic construct
  misc_feature 1..20: note = CRISPR gRNA sequence
  source 1..20: mol_type = other DNA
gacctcacctctccccaacc

SEQ ID NO: 26402 - DNA, 20 bp, synthetic construct
  misc_feature 1..20: note = CRISPR gRNA sequence
  source 1..20: mol_type = other DNA
acctctccccaaccctatca

SEQ ID NO: 26403 - DNA, 20 bp, synthetic construct
  misc_feature 1..20: note = CRISPR gRNA sequence
  source 1..20: mol_type = other DNA
tccccaaccctatcagtgtc

SEQ ID NO: 26404 - DNA, 20 bp, synthetic construct
  misc_feature 1..20: note = CRISPR gRNA sequence
  source 1..20: mol_type = other DNA
cccaaccctatcagtgtcac

SEQ ID NO: 26405 - DNA, 20 bp, synthetic construct
  misc_feature 1..20: note = CRISPR gRNA sequence
  source 1..20: mol_type = other DNA
tcagtgtcactcacctctgc

SEQ ID NO: 26406 - DNA, 20 bp, synthetic construct
  misc_feature 1..20: note = CRISPR gRNA sequence
  source 1..20: mol_type = other DNA
acctctgccccagccagttt

SEQ ID NO: 26407 - DNA, 20 bp, synthetic construct
  misc_feature 1..20: note = CRISPR gRNA sequence
  source 1..20: mol_type = other DNA
tgccccagccagttttatcc

SEQ ID NO: 26408 - DNA, 20 bp, synthetic construct
  misc_feature 1..20: note = CRISPR gRNA sequence
  source 1..20: mol_type = other DNA
ccccagccagttttatcctt

SEQ ID NO: 26409 - DNA, 20 bp, synthetic construct
  misc_feature 1..20: note = CRISPR gRNA sequence
  source 1..20: mol_type = other DNA
tatccttggggcccccgtca

SEQ ID NO: 26410 - DNA, 20 bp, synthetic construct
  misc_feature 1..20: note = CRISPR gRNA sequence
  source 1..20: mol_type = other DNA
atccttggggcccccgtcag

SEQ ID NO: 26411 - DNA, 20 bp, synthetic construct
  misc_feature 1..20: note = CRISPR gRNA sequence
  source 1..20: mol_type = other DNA
tccttggggcccccgtcagc

SEQ ID NO: 26412 - DNA, 20 bp, synthetic construct
  misc_feature 1..20: note = CRISPR gRNA sequence
  source 1..20: mol_type = other DNA
ggggcccccgtcagctcaat

SEQ ID NO: 26413 - DNA, 20 bp, synthetic construct
  misc_feature 1..20: note = CRISPR gRNA sequence
  source 1..20: mol_type = other DNA
gggcccccgtcagctcaatc

SEQ ID NO: 26414 - DNA, 20 bp, synthetic construct
  misc_feature 1..20: note = CRISPR gRNA sequence
  source 1..20: mol_type = other DNA
aatccctggcagagaacatg

SEQ ID NO: 26415 - DNA, 20 bp, synthetic construct
  misc_feature 1..20: note = CRISPR gRNA sequence
  source 1..20: mol_type = other DNA
gcagagaacatgcctcagaa

SEQ ID NO: 26416 - DNA, 20 bp, synthetic construct
  misc_feature 1..20: note = CRISPR gRNA sequence
  source 1..20: mol_type = other DNA
agaaggaaacacatccgtgc

SEQ ID NO: 26417 - DNA, 20 bp, synthetic construct
  misc_feature 1..20: note = CRISPR gRNA sequence
  source 1..20: mol_type = other DNA
caccaattagagcattcacc

SEQ ID NO: 26418 - DNA, 20 bp, synthetic construct
  misc_feature 1..20: note = CRISPR gRNA sequence
  source 1..20: mol_type = other DNA
gagcattcacctgccagcct

SEQ ID NO: 26419 - DNA, 20 bp, synthetic construct
  misc_feature 1..20: note = CRISPR gRNA sequence
  source 1..20: mol_type = other DNA
acctgccagccttattcgtt

SEQ ID NO: 26420 - DNA, 20 bp, synthetic construct
  misc_feature 1..20: note = CRISPR gRNA sequence
  source 1..20: mol_type = other DNA
ccagccttattcgttcatca

SEQ ID NO: 26421 - DNA, 20 bp, synthetic construct
  misc_feature 1..20: note = CRISPR gRNA sequence
  source 1..20: mol_type = other DNA
attcgttcatcagctcttca

SEQ ID NO: 26422 - DNA, 20 bp, synthetic construct
  misc_feature 1..20: note = CRISPR gRNA sequence
  source 1..20: mol_type = other DNA
ttcgttcatcagctcttcat

SEQ ID NO: 26423 - DNA, 20 bp, synthetic construct
  misc_feature 1..20: note = CRISPR gRNA sequence
  source 1..20: mol_type = other DNA
gttcatcagctcttcatgga

SEQ ID NO: 26424 - DNA, 20 bp, synthetic construct
  misc_feature 1..20: note = CRISPR gRNA sequence
  source 1..20: mol_type = other DNA
atcagctcttcatggagccc

SEQ ID NO: 26425 - DNA, 20 bp, synthetic construct
  misc_feature 1..20: note = CRISPR gRNA sequence
  source 1..20: mol_type = other DNA
ttcatggagccccttctctg

SEQ ID NO: 26426 - DNA, 20 bp, synthetic construct
  misc_feature 1..20: note = CRISPR gRNA sequence
  source 1..20: mol_type = other DNA
catggagccccttctctgtg

SEQ ID NO: 26427 - DNA, 20 bp, synthetic construct
  misc_feature 1..20: note = CRISPR gRNA sequence
  source 1..20: mol_type = other DNA
atggagccccttctctgtgc

SEQ ID NO: 26428 - DNA, 20 bp, synthetic construct
  misc_feature 1..20: note = CRISPR gRNA sequence
  source 1..20: mol_type = other DNA
ctctgtgccaactgctctgc

SEQ ID NO: 26429 - DNA, 20 bp, synthetic construct
  misc_feature 1..20: note = CRISPR gRNA sequence
  source 1..20: mol_type = other DNA
tctgtgccaactgctctgct

SEQ ID NO: 26430 - DNA, 20 bp, synthetic construct
  misc_feature 1..20: note = CRISPR gRNA sequence
  source 1..20: mol_type = other DNA
tgtgccaactgctctgctag

SEQ ID NO: 26431 - DNA, 20 bp, synthetic construct
  misc_feature 1..20: note = CRISPR gRNA sequence
  source 1..20: mol_type = other DNA
tgccaactgctctgctaggt

SEQ ID NO: 26432 - DNA, 20 bp, synthetic construct
  misc_feature 1..20: note = CRISPR gRNA sequence
  source 1..20: mol_type = other DNA
ctctgctaggtgctaagaat

SEQ ID NO: 26433 - DNA, 20 bp, synthetic construct
  misc_feature 1..20: note = CRISPR gRNA sequence
  source 1..20: mol_type = other DNA
tgctaggtgctaagaattcc

SEQ ID NO: 26434 - DNA, 20 bp, synthetic construct
  misc_feature 1..20: note = CRISPR gRNA sequence
  source 1..20: mol_type = other DNA
ctaggtgctaagaattccat

SEQ ID NO: 26435 - DNA, 20 bp, synthetic construct
  misc_feature 1..20: note = CRISPR gRNA sequence
  source 1..20: mol_type = other DNA
ggtgctaagaattccatcag

SEQ ID NO: 26436 - DNA, 20 bp, synthetic construct
  misc_feature 1..20: note = CRISPR gRNA sequence
  source 1..20: mol_type = other DNA
agaattccatcagggcagga

SEQ ID NO: 26437 - DNA, 20 bp, synthetic construct
  misc_feature 1..20: note = CRISPR gRNA sequence
  source 1..20: mol_type = other DNA
catcagggcaggacagaaac

SEQ ID NO: 26438 - DNA, 20 bp, synthetic construct
  misc_feature 1..20: note = CRISPR gRNA sequence
  source 1..20: mol_type = other DNA
ctgctcttagggaaattagg

SEQ ID NO: 26439 - DNA, 20 bp, synthetic construct
  misc_feature 1..20: note = CRISPR gRNA sequence
  source 1..20: mol_type = other DNA
ctcttagggaaattagggcc

SEQ ID NO: 26440 - DNA, 20 bp, synthetic construct
  misc_feature 1..20: note = CRISPR gRNA sequence
  source 1..20: mol_type = other DNA
ttagggaaattagggccctt

SEQ ID NO: 26441 - DNA, 20 bp, synthetic construct
  misc_feature 1..20: note = CRISPR gRNA sequence
  source 1..20: mol_type = other DNA
agggaaattagggcccttta

SEQ ID NO: 26442 - DNA, 20 bp, synthetic construct
  misc_feature 1..20: note = CRISPR gRNA sequence
  source 1..20: mol_type = other DNA
gggaaattagggccctttag

SEQ ID NO: 26443 - DNA, 20 bp, synthetic construct
  misc_feature 1..20: note = CRISPR gRNA sequence
  source 1..20: mol_type = other DNA
gggccctttaggggggtcag

SEQ ID NO: 26444 - DNA, 20 bp, synthetic construct
  misc_feature 1..20: note = CRISPR gRNA sequence
  source 1..20: mol_type = other DNA
taggggggtcagacattaat

SEQ ID NO: 26445 - DNA, 20 bp, synthetic construct
  misc_feature 1..20: note = CRISPR gRNA sequence
  source 1..20: mol_type = other DNA
aggggggtcagacattaatc

SEQ ID NO: 26446 - DNA, 20 bp, synthetic construct
  misc_feature 1..20: note = CRISPR gRNA sequence
  source 1..20: mol_type = other DNA
ggggggtcagacattaatca

SEQ ID NO: 26447 - DNA, 20 bp, synthetic construct
  misc_feature 1..20: note = CRISPR gRNA sequence
  source 1..20: mol_type = other DNA
atcaaataagcaaaagcaga

SEQ ID NO: 26448 - DNA, 20 bp, synthetic construct
  misc_feature 1..20: note = CRISPR gRNA sequence
  source 1..20: mol_type = other DNA
tgcaagatcccacctcactg

SEQ ID NO: 26449 - DNA, 20 bp, synthetic construct
  misc_feature 1..20: note = CRISPR gRNA sequence
  source 1..20: mol_type = other DNA
actgcctttgtctcttgcag

SEQ ID NO: 26450 - DNA, 20 bp, synthetic construct
  misc_feature 1..20: note = CRISPR gRNA sequence
  source 1..20: mol_type = other DNA
cctttgtctcttgcagtgcc

SEQ ID NO: 26451 - DNA, 20 bp, synthetic construct
  misc_feature 1..20: note = CRISPR gRNA sequence
  source 1..20: mol_type = other DNA
tgtctcttgcagtgcctttc

SEQ ID NO: 26452 - DNA, 20 bp, synthetic construct
  misc_feature 1..20: note = CRISPR gRNA sequence
  source 1..20: mol_type = other DNA
gtctcttgcagtgcctttct

SEQ ID NO: 26453 - DNA, 20 bp, synthetic construct
  misc_feature 1..20: note = CRISPR gRNA sequence
  source 1..20: mol_type = other DNA
tctcttgcagtgcctttctc

SEQ ID NO: 26454 - DNA, 20 bp, synthetic construct
  misc_feature 1..20: note = CRISPR gRNA sequence
  source 1..20: mol_type = other DNA
ttgcagtgcctttctccagt

SEQ ID NO: 26455 - DNA, 20 bp, synthetic construct
  misc_feature 1..20: note = CRISPR gRNA sequence
  source 1..20: mol_type = other DNA
gcagtgcctttctccagttc

SEQ ID NO: 26456 - DNA, 20 bp, synthetic construct
  misc_feature 1..20: note = CRISPR gRNA sequence
  source 1..20: mol_type = other DNA
cagtgcctttctccagttcc

SEQ ID NO: 26457 - DNA, 20 bp, synthetic construct
  misc_feature 1..20: note = CRISPR gRNA sequence
  source 1..20: mol_type = other DNA
tctccagttcctcgttgagc

SEQ ID NO: 26458 - DNA, 20 bp, synthetic construct
  misc_feature 1..20: note = CRISPR gRNA sequence
  source 1..20: mol_type = other DNA
ctccagttcctcgttgagct

SEQ ID NO: 26459 - DNA, 20 bp, synthetic construct
  misc_feature 1..20: note = CRISPR gRNA sequence
  source 1..20: mol_type = other DNA
tccagttcctcgttgagctg

SEQ ID NO: 26460 - DNA, 20 bp, synthetic construct
  misc_feature 1..20: note = CRISPR gRNA sequence
  source 1..20: mol_type = other DNA
cagttcctcgttgagctgcc

SEQ ID NO: 26461 - DNA, 20 bp, synthetic construct
  misc_feature 1..20: note = CRISPR gRNA sequence
  source 1..20: mol_type = other DNA
ctcgttgagctgcctgaatc

SEQ ID NO: 26462 - DNA, 20 bp, synthetic construct
  misc_feature 1..20: note = CRISPR gRNA sequence
  source 1..20: mol_type = other DNA
gttgagctgcctgaatctcc

SEQ ID NO: 26463 - DNA, 20 bp, synthetic construct
  misc_feature 1..20: note = CRISPR gRNA sequence
  source 1..20: mol_type = other DNA
agctgcctgaatctccctga

SEQ ID NO: 26464 - DNA, 20 bp, synthetic construct
  misc_feature 1..20: note = CRISPR gRNA sequence
  source 1..20: mol_type = other DNA
cctgaatctccctgagggac

SEQ ID NO: 26465 - DNA, 20 bp, synthetic construct
  misc_feature 1..20: note = CRISPR gRNA sequence
  source 1..20: mol_type = other DNA
aatctccctgagggacccat

SEQ ID NO: 26466 - DNA, 20 bp, synthetic construct
  misc_feature 1..20: note = CRISPR gRNA sequence
  source 1..20: mol_type = other DNA
cctgagggacccatccagtt

SEQ ID NO: 26467 - DNA, 20 bp, synthetic construct
  misc_feature 1..20: note = CRISPR gRNA sequence
  source 1..20: mol_type = other DNA
agggacccatccagtttgtc

SEQ ID NO: 26468 - DNA, 20 bp, synthetic construct
  misc_feature 1..20: note = CRISPR gRNA sequence
  source 1..20: mol_type = other DNA
gtccccaccatctccactct

SEQ ID NO: 26469 - DNA, 20 bp, synthetic construct
  misc_feature 1..20: note = CRISPR gRNA sequence
  source 1..20: mol_type = other DNA
tccccaccatctccactctg

SEQ ID NO: 26470 - DNA, 20 bp, synthetic construct
  misc_feature 1..20: note = CRISPR gRNA sequence
  source 1..20: mol_type = other DNA
cactctgccccatgggctct

SEQ ID NO: 26471 - DNA, 20 bp, synthetic construct
  misc_feature 1..20: note = CRISPR gRNA sequence
  source 1..20: mol_type = other DNA
tgccccatgggctctggcaa

SEQ ID NO: 26472 - DNA, 20 bp, synthetic construct
  misc_feature 1..20: note = CRISPR gRNA sequence
  source 1..20: mol_type = other DNA
ccccatgggctctggcaaat

SEQ ID NO: 26473 - DNA, 20 bp, synthetic construct
  misc_feature 1..20: note = CRISPR gRNA sequence
  source 1..20: mol_type = other DNA
tggcaaatctctgaggctgg

SEQ ID NO: 26474 - DNA, 20 bp, synthetic construct
  misc_feature 1..20: note = CRISPR gRNA sequence
  source 1..20: mol_type = other DNA
gcaaatctctgaggctggaa

SEQ ID NO: 26475 - DNA, 20 bp, synthetic construct
  misc_feature 1..20: note = CRISPR gRNA sequence
  source 1..20: mol_type = other DNA
tgaggctggaacaggggtct

SEQ ID NO: 26476 - DNA, 20 bp, synthetic construct
  misc_feature 1..20: note = CRISPR gRNA sequence
  source 1..20: mol_type = other DNA
aggctggaacaggggtctcc

SEQ ID NO: 26477 - DNA, 20 bp, synthetic construct
  misc_feature 1..20: note = CRISPR gRNA sequence
  source 1..20: mol_type = other DNA
gaacaggggtctccagtata

SEQ ID NO: 26478 - DNA, 20 bp, synthetic construct
  misc_feature 1..20: note = CRISPR gRNA sequence
  source 1..20: mol_type = other DNA
cagtatattcatctaccatg

SEQ ID NO: 26479 - DNA, 20 bp, synthetic construct
  misc_feature 1..20: note = CRISPR gRNA sequence
  source 1..20: mol_type = other DNA
atctaccatggtgagtgcgg

SEQ ID NO: 26480 - DNA, 20 bp, synthetic construct
  misc_feature 1..20: note = CRISPR gRNA sequence
  source 1..20: mol_type = other DNA
ccatggtgagtgcggggcct

SEQ ID NO: 26481 - DNA, 20 bp, synthetic construct
  misc_feature 1..20: note = CRISPR gRNA sequence
  source 1..20: mol_type = other DNA
gctccccgaccacctctccc

SEQ ID NO: 26482 - DNA, 20 bp, synthetic construct
  misc_feature 1..20: note = CRISPR gRNA sequence
  source 1..20: mol_type = other DNA
cccgaccacctctccctcct

SEQ ID NO: 26483 - DNA, 20 bp, synthetic construct
  misc_feature 1..20: note = CRISPR gRNA sequence
  source 1..20: mol_type = other DNA
tccctcctacctgactgctc

SEQ ID NO: 26484 - DNA, 20 bp, synthetic construct
  misc_feature 1..20: note = CRISPR gRNA sequence
  source 1..20: mol_type = other DNA
cctcctacctgactgctccc

SEQ ID NO: 26485 - DNA, 20 bp, synthetic construct
  misc_feature 1..20: note = CRISPR gRNA sequence
  source 1..20: mol_type = other DNA
ctacctgactgctccctgac

SEQ ID NO: 26486 - DNA, 20 bp, synthetic construct
  misc_feature 1..20: note = CRISPR gRNA sequence
  source 1..20: mol_type = other DNA
cctgactgctccctgacctc

SEQ ID NO: 26487 - DNA, 20 bp, synthetic construct
  misc_feature 1..20: note = CRISPR gRNA sequence
  source 1..20: mol_type = other DNA
actgctccctgacctcatcc

SEQ ID NO: 26488 - DNA, 20 bp, synthetic construct
  misc_feature 1..20: note = CRISPR gRNA sequence
  source 1..20: mol_type = other DNA
ctccctgacctcatcctccc

SEQ ID NO: 26489 - DNA, 20 bp, synthetic construct
  misc_feature 1..20: note = CRISPR gRNA sequence
  source 1..20: mol_type = other DNA
cctgacctcatcctccccat

SEQ ID NO: 26490 - DNA, 20 bp, synthetic construct
  misc_feature 1..20: note = CRISPR gRNA sequence
  source 1..20: mol_type = other DNA
acctcatcctccccatactc

SEQ ID NO: 26491 - DNA, 20 bp, synthetic construct
  misc_feature 1..20: note = CRISPR gRNA sequence
  source 1..20: mol_type = other DNA
atcctccccatactccatgc

SEQ ID NO: 26492 - DNA, 20 bp, synthetic construct
  misc_feature 1..20: note = CRISPR gRNA sequence
  source 1..20: mol_type = other DNA
cccatactccatgcacttgg

SEQ ID NO: 26493 - DNA, 20 bp, synthetic construct
  misc_feature 1..20: note = CRISPR gRNA sequence
  source 1..20: mol_type = other DNA
catgcacttggcagtggtgc

SEQ ID NO: 26494 - DNA, 20 bp, synthetic construct
  misc_feature 1..20: note = CRISPR gRNA sequence
  source 1..20: mol_type = other DNA
ggcagtggtgccctagcacc

SEQ ID NO: 26495 - DNA, 20 bp, synthetic construct
  misc_feature 1..20: note = CRISPR gRNA sequence
  source 1..20: mol_type = other DNA
gcagtggtgccctagcacct

SEQ ID NO: 26496 - DNA, 20 bp, synthetic construct
  misc_feature 1..20: note = CRISPR gRNA sequence
  source 1..20: mol_type = other DNA
gcaccttctcatgatcctcc

SEQ ID NO: 26497 - DNA, 20 bp, synthetic construct
  misc_feature 1..20: note = CRISPR gRNA sequence
  source 1..20: mol_type = other DNA
ctcatgatcctccctcccca

SEQ ID NO: 26498 - DNA, 20 bp, synthetic construct
  misc_feature 1..20: note = CRISPR gRNA sequence
  source 1..20: mol_type = other DNA
tcatgatcctccctccccag

SEQ ID NO: 26499 - DNA, 20 bp, synthetic construct
  misc_feature 1..20: note = CRISPR gRNA sequence
  source 1..20: mol_type = other DNA
atgatcctccctccccagca

SEQ ID NO: 26500 - DNA, 20 bp, synthetic construct
  misc_feature 1..20: note = CRISPR gRNA sequence
  source 1..20: mol_type = other DNA
cctccccagcacaactttct

SEQ ID NO: 26501 - DNA, 20 bp, synthetic construct
  misc_feature 1..20: note = CRISPR gRNA sequence
  source 1..20: mol_type = other DNA
cccagcacaactttctctgt

SEQ ID NO: 26502 - DNA, 20 bp, synthetic construct
  misc_feature 1..20: note = CRISPR gRNA sequence
  source 1..20: mol_type = other DNA
tctctgtccctatttcccaa

SEQ ID NO: 26503 - DNA, 20 bp, synthetic construct
  misc_feature 1..20: note = CRISPR gRNA sequence
  source 1..20: mol_type = other DNA
ctctgtccctatttcccaaa

SEQ ID NO: 26504 - DNA, 20 bp, synthetic construct
  misc_feature 1..20: note = CRISPR gRNA sequence
  source 1..20: mol_type = other DNA
tctgtccctatttcccaaaa

SEQ ID NO: 26505 - DNA, 20 bp, synthetic construct
  misc_feature 1..20: note = CRISPR gRNA sequence
  source 1..20: mol_type = other DNA
tgtccctatttcccaaaaat

SEQ ID NO: 26506 - DNA, 20 bp, synthetic construct
  misc_feature 1..20: note = CRISPR gRNA sequence
  source 1..20: mol_type = other DNA
tccctatttcccaaaaatca

SEQ ID NO: 26507 - DNA, 20 bp, synthetic construct
  misc_feature 1..20: note = CRISPR gRNA sequence
  source 1..20: mol_type = other DNA
tttcccaaaaatcaaagcag

SEQ ID NO: 26508 - DNA, 20 bp, synthetic construct
  misc_feature 1..20: note = CRISPR gRNA sequence
  source 1..20: mol_type = other DNA
cccaaaaatcaaagcagaag

SEQ ID NO: 26509 - DNA, 20 bp, synthetic construct
  misc_feature 1..20: note = CRISPR gRNA sequence
  source 1..20: mol_type = other DNA
ccaaaaatcaaagcagaaga

SEQ ID NO: 26510 - DNA, 20 bp, synthetic construct
  misc_feature 1..20: note = CRISPR gRNA sequence
  source 1..20: mol_type = other DNA
ctgaggtggtctgggtgcat

SEQ ID NO: 26511 - DNA, 20 bp, synthetic construct
  misc_feature 1..20: note = CRISPR gRNA sequence
  source 1..20: mol_type = other DNA
aggtggtctgggtgcatgac

SEQ ID NO: 26512 - DNA, 20 bp, synthetic construct
  misc_feature 1..20: note = CRISPR gRNA sequence
  source 1..20: mol_type = other DNA
ggtgcatgaccaagagtggt

SEQ ID NO: 26513 - DNA, 20 bp, synthetic construct
  misc_feature 1..20: note = CRISPR gRNA sequence
  source 1..20: mol_type = other DNA
tgtggccttccatatgttgc

SEQ ID NO: 26514 - DNA, 20 bp, synthetic construct
  misc_feature 1..20: note = CRISPR gRNA sequence
  source 1..20: mol_type = other DNA
ccatatgttgctttcccctt

SEQ ID NO: 26515 - DNA, 20 bp, synthetic construct
  misc_feature 1..20: note = CRISPR gRNA sequence
  source 1..20: mol_type = other DNA
catatgttgctttccccttc

SEQ ID NO: 26516 - DNA, 20 bp, synthetic construct
  misc_feature 1..20: note = CRISPR gRNA sequence
  source 1..20: mol_type = other DNA
ctttccccttctgaccctta

SEQ ID NO: 26517 - DNA, 20 bp, synthetic construct
  misc_feature 1..20: note = CRISPR gRNA sequence
  source 1..20: mol_type = other DNA
tccccttctgacccttagtt

SEQ ID NO: 26518 - DNA, 20 bp, synthetic construct
  misc_feature 1..20: note = CRISPR gRNA sequence
  source 1..20: mol_type = other DNA
ccccttctgacccttagttt

SEQ ID NO: 26519 - DNA, 20 bp, synthetic construct
  misc_feature 1..20: note = CRISPR gRNA sequence
  source 1..20: mol_type = other DNA
cccttctgacccttagtttt

SEQ ID NO: 26520 - DNA, 20 bp, synthetic construct
  misc_feature 1..20: note = CRISPR gRNA sequence
  source 1..20: mol_type = other DNA
ctgacccttagtttttcctt

SEQ ID NO: 26521 - DNA, 20 bp, synthetic construct
  misc_feature 1..20: note = CRISPR gRNA sequence
  source 1..20: mol_type = other DNA
tgacccttagtttttcctta

SEQ ID NO: 26522 - DNA, 20 bp, synthetic construct
  misc_feature 1..20: note = CRISPR gRNA sequence
  source 1..20: mol_type = other DNA
acccttagtttttccttatt

SEQ ID NO: 26523 - DNA, 20 bp, synthetic construct
  misc_feature 1..20: note = CRISPR gRNA sequence
  source 1..20: mol_type = other DNA
agtttttccttatttttttt

SEQ ID NO: 26524 - DNA, 20 bp, synthetic construct
  misc_feature 1..20: note = CRISPR gRNA sequence
  source 1..20: mol_type = other DNA
gtttttccttatttttttta

SEQ ID NO: 26525 - DNA, 20 bp, synthetic construct
  misc_feature 1..20: note = CRISPR gRNA sequence
  source 1..20: mol_type = other DNA
ttccttattttttttaaatg

SEQ ID NO: 26526 - DNA, 20 bp, synthetic construct
  misc_feature 1..20: note = CRISPR gRNA sequence
  source 1..20: mol_type = other DNA
tccttattttttttaaatgt

SEQ ID NO: 26527 - DNA, 20 bp, synthetic construct
  misc_feature 1..20: note = CRISPR gRNA sequence
  source 1..20: mol_type = other DNA
ccttattttttttaaatgtt

SEQ ID NO: 26528 - DNA, 20 bp, synthetic construct
  misc_feature 1..20: note = CRISPR gRNA sequence
  source 1..20: mol_type = other DNA
cttattttttttaaatgttt

SEQ ID NO: 26529 - DNA, 20 bp, synthetic construct
  misc_feature 1..20: note = CRISPR gRNA sequence
  source 1..20: mol_type = other DNA
attttttttaaatgtttttg

SEQ ID NO: 26530 - DNA, 20 bp, synthetic construct
  misc_feature 1..20: note = CRISPR gRNA sequence
  source 1..20: mol_type = other DNA
ttttttttaaatgtttttgt

SEQ ID NO: 26531 - DNA, 20 bp, synthetic construct
  misc_feature 1..20: note = CRISPR gRNA sequence
  source 1..20: mol_type = other DNA
tttttaaatgtttttgtttt

SEQ ID NO: 26532 - DNA, 20 bp, synthetic construct
  misc_feature 1..20: note = CRISPR gRNA sequence
  source 1..20: mol_type = other DNA
ttttaaatgtttttgttttt

SEQ ID NO: 26533 - DNA, 20 bp, synthetic construct
  misc_feature 1..20: note = CRISPR gRNA sequence
  source 1..20: mol_type = other DNA
tttaaatgtttttgttttta

SEQ ID NO: 26534 - DNA, 20 bp, synthetic construct
  misc_feature 1..20: note = CRISPR gRNA sequence
  source 1..20: mol_type = other DNA
ttaaatgtttttgtttttaa

SEQ ID NO: 26535 - DNA, 20 bp, synthetic construct
  misc_feature 1..20: note = CRISPR gRNA sequence
  source 1..20: mol_type = other DNA
taaatgtttttgtttttaaa

SEQ ID NO: 26536 - DNA, 20 bp, synthetic construct
  misc_feature 1..20: note = CRISPR gRNA sequence
  source 1..20: mol_type = other DNA
aaatgtttttgtttttaaat

SEQ ID NO: 26537 - DNA, 20 bp, synthetic construct
  misc_feature 1..20: note = CRISPR gRNA sequence
  source 1..20: mol_type = other DNA
aatgtttttgtttttaaatt

SEQ ID NO: 26538 - DNA, 20 bp, synthetic construct
  misc_feature 1..20: note = CRISPR gRNA sequence
  source 1..20: mol_type = other DNA
ttgtttttaaattgcaacat

SEQ ID NO: 26539 - DNA, 20 bp, synthetic construct
  misc_feature 1..20: note = CRISPR gRNA sequence
  source 1..20: mol_type = other DNA
tgtttttaaattgcaacatc

SEQ ID NO: 26540 - DNA, 20 bp, synthetic construct
  misc_feature 1..20: note = CRISPR gRNA sequence
  source 1..20: mol_type = other DNA
gtttttaaattgcaacatca

SEQ ID NO: 26541 - DNA, 20 bp, synthetic construct
  misc_feature 1..20: note = CRISPR gRNA sequence
  source 1..20: mol_type = other DNA
tttttaaattgcaacatcaa

SEQ ID NO: 26542 - DNA, 20 bp, synthetic construct
  misc_feature 1..20: note = CRISPR gRNA sequence
  source 1..20: mol_type = other DNA
ttaaattgcaacatcaatac

SEQ ID NO: 26543 - DNA, 20 bp, synthetic construct
  misc_feature 1..20: note = CRISPR gRNA sequence
  source 1..20: mol_type = other DNA
taaattgcaacatcaataca

SEQ ID NO: 26544 - DNA, 20 bp, synthetic construct
  misc_feature 1..20: note = CRISPR gRNA sequence
  source 1..20: mol_type = other DNA
aaattgcaacatcaatacat

SEQ ID NO: 26545 - DNA, 20 bp, synthetic construct
  misc_feature 1..20: note = CRISPR gRNA sequence
  source 1..20: mol_type = other DNA
aattgcaacatcaatacatg

SEQ ID NO: 26546 - DNA, 20 bp, synthetic construct
  misc_feature 1..20: note = CRISPR gRNA sequence
  source 1..20: mol_type = other DNA
caacatcaatacatgctcac

SEQ ID NO: 26547 - DNA, 20 bp, synthetic construct
  misc_feature 1..20: note = CRISPR gRNA sequence
  source 1..20: mol_type = other DNA
actaataagctaatgacaag

SEQ ID NO: 26548 - DNA, 20 bp, synthetic construct
  misc_feature 1..20: note = CRISPR gRNA sequence
  source 1..20: mol_type = other DNA
ataagctaatgacaagtgat

SEQ ID NO: 26549 - DNA, 20 bp, synthetic construct
  misc_feature 1..20: note = CRISPR gRNA sequence
  source 1..20: mol_type = other DNA
atgacaagtgatgtttacaa

SEQ ID NO: 26550 - DNA, 20 bp, synthetic construct
  misc_feature 1..20: note = CRISPR gRNA sequence
  source 1..20: mol_type = other DNA
acaagaattcactgtctctc

SEQ ID NO: 26551 - DNA, 20 bp, synthetic construct
  misc_feature 1..20: note = CRISPR gRNA sequence
  source 1..20: mol_type = other DNA
caagaattcactgtctctct

SEQ ID NO: 26552 - DNA, 20 bp, synthetic construct
  misc_feature 1..20: note = CRISPR gRNA sequence
  source 1..20: mol_type = other DNA
actgtctctctcactctttt

SEQ ID NO: 26553 - DNA, 20 bp, synthetic construct
  misc_feature 1..20: note = CRISPR gRNA sequence
  source 1..20: mol_type = other DNA
tctctctcactcttttagta

SEQ ID NO: 26554 - DNA, 20 bp, synthetic construct
  misc_feature 1..20: note = CRISPR gRNA sequence
  source 1..20: mol_type = other DNA
tctcactcttttagtatact

SEQ ID NO: 26555 - DNA, 20 bp, synthetic construct
  misc_feature 1..20: note = CRISPR gRNA sequence
  source 1..20: mol_type = other DNA
tcactcttttagtatactga

SEQ ID NO: 26556 - DNA, 20 bp, synthetic construct
  misc_feature 1..20: note = CRISPR gRNA sequence
  source 1..20: mol_type = other DNA
actcttttagtatactgatg

SEQ ID NO: 26557 - DNA, 20 bp, synthetic construct
  misc_feature 1..20: note = CRISPR gRNA sequence
  source 1..20: mol_type = other DNA
ttttagtatactgatgtgaa

SEQ ID NO: 26558 - DNA, 20 bp, synthetic construct
  misc_feature 1..20: note = CRISPR gRNA sequence
  source 1..20: mol_type = other DNA
ttagtatactgatgtgaata

SEQ ID NO: 26559 - DNA, 20 bp, synthetic construct
  misc_feature 1..20: note = CRISPR gRNA sequence
  source 1..20: mol_type = other DNA
tagtatactgatgtgaatag

SEQ ID NO: 26560 - DNA, 20 bp, synthetic construct
  misc_feature 1..20: note = CRISPR gRNA sequence
  source 1..20: mol_type = other DNA
agtatactgatgtgaatagt

SEQ ID NO: 26561 - DNA, 20 bp, synthetic construct
  misc_feature 1..20: note = CRISPR gRNA sequence
  source 1..20: mol_type = other DNA
gtatactgatgtgaatagtt

SEQ ID NO: 26562 - DNA, 20 bp, synthetic construct
  misc_feature 1..20: note = CRISPR gRNA sequence
  source 1..20: mol_type = other DNA
atgtgaatagtttggtgtgc

SEQ ID NO: 26563 - DNA, 20 bp, synthetic construct
  misc_feature 1..20: note = CRISPR gRNA sequence
  source 1..20: mol_type = other DNA
ggtgtgcatccttgcatagc

SEQ ID NO: 26564 - DNA, 20 bp, synthetic construct
  misc_feature 1..20: note = CRISPR gRNA sequence
  source 1..20: mol_type = other DNA
gtgtgcatccttgcatagct

SEQ ID NO: 26565 - DNA, 20 bp, synthetic construct
  misc_feature 1..20: note = CRISPR gRNA sequence
  source 1..20: mol_type = other DNA
gcatagctttctctgatttg

SEQ ID NO: 26566 - DNA, 20 bp, synthetic construct
  misc_feature 1..20: note = CRISPR gRNA sequence
  source 1..20: mol_type = other DNA
catagctttctctgatttgt

SEQ ID NO: 26567 - DNA, 20 bp, synthetic construct
  misc_feature 1..20: note = CRISPR gRNA sequence
  source 1..20: mol_type = other DNA
tctctgatttgtcttgtttc

SEQ ID NO: 26568 - DNA, 20 bp, synthetic construct
  misc_feature 1..20: note = CRISPR gRNA sequence
  source 1..20: mol_type = other DNA
ctctgatttgtcttgtttcc

SEQ ID NO: 26569 - DNA, 20 bp, synthetic construct
  misc_feature 1..20: note = CRISPR gRNA sequence
  source 1..20: mol_type = other DNA
tctgatttgtcttgtttcct

SEQ ID NO: 26570 - DNA, 20 bp, synthetic construct
  misc_feature 1..20: note = CRISPR gRNA sequence
  source 1..20: mol_type = other DNA
tgatttgtcttgtttcctaa

SEQ ID NO: 26571 - DNA, 20 bp, synthetic construct
  misc_feature 1..20: note = CRISPR gRNA sequence
  source 1..20: mol_type = other DNA
atttgtcttgtttcctaatc

SEQ ID NO: 26572 - DNA, 20 bp, synthetic construct
  misc_feature 1..20: note = CRISPR gRNA sequence
  source 1..20: mol_type = other DNA
gtcttgtttcctaatcagta

SEQ ID NO: 26573 - DNA, 20 bp, synthetic construct
  misc_feature 1..20: note = CRISPR gRNA sequence
  source 1..20: mol_type = other DNA
tcttgtttcctaatcagtaa

SEQ ID NO: 26574 - DNA, 20 bp, synthetic construct
  misc_feature 1..20: note = CRISPR gRNA sequence
  source 1..20: mol_type = other DNA
gtttcctaatcagtaaaatg

SEQ ID NO: 26575 - DNA, 20 bp, synthetic construct
  misc_feature 1..20: note = CRISPR gRNA sequence
  source 1..20: mol_type = other DNA
tttcctaatcagtaaaatgg

SEQ ID NO: 26576 - DNA, 20 bp, synthetic construct
  misc_feature 1..20: note = CRISPR gRNA sequence
  source 1..20: mol_type = other DNA
cctaatcagtaaaatggtcc

SEQ ID NO: 26577 - DNA, 20 bp, synthetic construct
  misc_feature 1..20: note = CRISPR gRNA sequence
  source 1..20: mol_type = other DNA
ctaatcagtaaaatggtccc

SEQ ID NO: 26578 - DNA, 20 bp, synthetic construct
  misc_feature 1..20: note = CRISPR gRNA sequence
  source 1..20: mol_type = other DNA
atcagtaaaatggtccctac

SEQ ID NO: 26579 - DNA, 20 bp, synthetic construct
  misc_feature 1..20: note = CRISPR gRNA sequence
  source 1..20: mol_type = other DNA
ctgacccaccacactgaggg

SEQ ID NO: 26580 - DNA, 20 bp, synthetic construct
  misc_feature 1..20: note = CRISPR gRNA sequence
  source 1..20: mol_type = other DNA
acccaccacactgaggggtt

SEQ ID NO: 26581 - DNA, 20 bp, synthetic construct
  misc_feature 1..20: note = CRISPR gRNA sequence
  source 1..20: mol_type = other DNA
aggggttgtgacttgtctca

SEQ ID NO: 26582 - DNA, 20 bp, synthetic construct
  misc_feature 1..20: note = CRISPR gRNA sequence
  source 1..20: mol_type = other DNA
tgacttgtctcagggaaggt

SEQ ID NO: 26583 - DNA, 20 bp, synthetic construct
  misc_feature 1..20: note = CRISPR gRNA sequence
  source 1..20: mol_type = other DNA
gtctcagggaaggtgtgttt

SEQ ID NO: 26584 - DNA, 20 bp, synthetic construct
  misc_feature 1..20: note = CRISPR gRNA sequence
  source 1..20: mol_type = other DNA
tctcagggaaggtgtgtttg

SEQ ID NO: 26585 - DNA, 20 bp, synthetic construct
  misc_feature 1..20: note = CRISPR gRNA sequence
  source 1..20: mol_type = other DNA
agggaaggtgtgtttgggct

SEQ ID NO: 26586 - DNA, 20 bp, synthetic construct
  misc_feature 1..20: note = CRISPR gRNA sequence
  source 1..20: mol_type = other DNA
gggctgtcagggatgagacc

SEQ ID NO: 26587 - DNA, 20 bp, synthetic construct
  misc_feature 1..20: note = CRISPR gRNA sequence
  source 1..20: mol_type = other DNA
ggctgtcagggatgagacca

SEQ ID NO: 26588 - DNA, 20 bp, synthetic construct
  misc_feature 1..20: note = CRISPR gRNA sequence
  source 1..20: mol_type = other DNA
tcagggatgagaccaggagg

SEQ ID NO: 26589 - DNA, 20 bp, synthetic construct
  misc_feature 1..20: note = CRISPR gRNA sequence
  source 1..20: mol_type = other DNA
ccactcaagtccagagcatc

SEQ ID NO: 26590 - DNA, 20 bp, synthetic construct
  misc_feature 1..20: note = CRISPR gRNA sequence
  source 1..20: mol_type = other DNA
cactcaagtccagagcatcc

SEQ ID NO: 26591 - DNA, 20 bp, synthetic construct
  misc_feature 1..20: note = CRISPR gRNA sequence
  source 1..20: mol_type = other DNA
aagtccagagcatccattcc

SEQ ID NO: 26592 - DNA, 20 bp, synthetic construct
  misc_feature 1..20: note = CRISPR gRNA sequence
  source 1..20: mol_type = other DNA
ctggttgcaagacagtttca

SEQ ID NO: 26593 - DNA, 20 bp, synthetic construct
  misc_feature 1..20: note = CRISPR gRNA sequence
  source 1..20: mol_type = other DNA
gttgcaagacagtttcagta

SEQ ID NO: 26594 - DNA, 20 bp, synthetic construct
  misc_feature 1..20: note = CRISPR gRNA sequence
  source 1..20: mol_type = other DNA
caagacagtttcagtataac

SEQ ID NO: 26595 - DNA, 20 bp, synthetic construct
  misc_feature 1..20: note = CRISPR gRNA sequence
  source 1..20: mol_type = other DNA
cagtataacgcactggtatc

SEQ ID NO: 26596 - DNA, 20 bp, synthetic construct
  misc_feature 1..20: note = CRISPR gRNA sequence
  source 1..20: mol_type = other DNA
agtataacgcactggtatct

SEQ ID NO: 26597 - DNA, 20 bp, synthetic construct
  misc_feature 1..20: note = CRISPR gRNA sequence
  source 1..20: mol_type = other DNA
gtatctcagaagcagagaag

SEQ ID NO: 26598 - DNA, 20 bp, synthetic construct
  misc_feature 1..20: note = CRISPR gRNA sequence
  source 1..20: mol_type = other DNA
agaagcagagaagcagttcc

SEQ ID NO: 26599 - DNA, 20 bp, synthetic construct
  misc_feature 1..20: note = CRISPR gRNA sequence
  source 1..20: mol_type = other DNA
ctgatatctaggaaaatgag

SEQ ID NO: 26600 - DNA, 20 bp, synthetic construct
  misc_feature 1..20: note = CRISPR gRNA sequence
  source 1..20: mol_type = other DNA
atatctaggaaaatgagcac

SEQ ID NO: 26601 - DNA, 20 bp, synthetic construct
  misc_feature 1..20: note = CRISPR gRNA sequence
  source 1..20: mol_type = other DNA
ggaaaatgagcactgaccac

SEQ ID NO: 26602 - DNA, 20 bp, synthetic construct
  misc_feature 1..20: note = CRISPR gRNA sequence
  source 1..20: mol_type = other DNA
accacacagcaggaagagtg

SEQ ID NO: 26603 - DNA, 20 bp, synthetic construct
  misc_feature 1..20: note = CRISPR gRNA sequence
  source 1..20: mol_type = other DNA
ccctaagttccttatgagct

SEQ ID NO: 26604 - DNA, 20 bp, synthetic construct
  misc_feature 1..20: note = CRISPR gRNA sequence
  source 1..20: mol_type = other DNA
agttccttatgagctaattg

SEQ ID NO: 26605 - DNA, 20 bp, synthetic construct
  misc_feature 1..20: note = CRISPR gRNA sequence
  source 1..20: mol_type = other DNA
cttatgagctaattgcaccc

SEQ ID NO: 26606 - DNA, 20 bp, synthetic construct
  misc_feature 1..20: note = CRISPR gRNA sequence
  source 1..20: mol_type = other DNA
atgagctaattgcacccatt

SEQ ID NO: 26607 - DNA, 20 bp, synthetic construct
  misc_feature 1..20: note = CRISPR gRNA sequence
  source 1..20: mol_type = other DNA
tgagctaattgcacccattt

SEQ ID NO: 26608 - DNA, 20 bp, synthetic construct
  misc_feature 1..20: note = CRISPR gRNA sequence
  source 1..20: mol_type = other DNA
attgcacccatttcacagat

SEQ ID NO: 26609 - DNA, 20 bp, synthetic construct
  misc_feature 1..20: note = CRISPR gRNA sequence
  source 1..20: mol_type = other DNA
cacccatttcacagattgga

SEQ ID NO: 26610 - DNA, 20 bp, synthetic construct
  misc_feature 1..20: note = CRISPR gRNA sequence
  source 1..20: mol_type = other DNA
cacagattggaaaagcaagg

SEQ ID NO: 26611 - DNA, 20 bp, synthetic construct
  misc_feature 1..20: note = CRISPR gRNA sequence
  source 1..20: mol_type = other DNA
acagattggaaaagcaaggt

SEQ ID NO: 26612 - DNA, 20 bp, synthetic construct
  misc_feature 1..20: note = CRISPR gRNA sequence
  source 1..20: mol_type = other DNA
gaaaagcaaggttccaggag

SEQ ID NO: 26613 - DNA, 20 bp, synthetic construct
  misc_feature 1..20: note = CRISPR gRNA sequence
  source 1..20: mol_type = other DNA
caggagctagatgtaactcc

SEQ ID NO: 26614 - DNA, 20 bp, synthetic construct
  misc_feature 1..20: note = CRISPR gRNA sequence
  source 1..20: mol_type = other DNA
gatgtaactccagagctctt

SEQ ID NO: 26615 - DNA, 20 bp, synthetic construct
  misc_feature 1..20: note = CRISPR gRNA sequence
  source 1..20: mol_type = other DNA
cagagctctttcttcagctc

SEQ ID NO: 26616 - DNA, 20 bp, synthetic construct
  misc_feature 1..20: note = CRISPR gRNA sequence
  source 1..20: mol_type = other DNA
tttcttcagctctgtcctga

SEQ ID NO: 26617 - DNA, 20 bp, synthetic construct
  misc_feature 1..20: note = CRISPR gRNA sequence
  source 1..20: mol_type = other DNA
tcttcagctctgtcctgaaa

SEQ ID NO: 26618 - DNA, 20 bp, synthetic construct
  misc_feature 1..20: note = CRISPR gRNA sequence
  source 1..20: mol_type = other DNA
cttcagctctgtcctgaaat

SEQ ID NO: 26619 - DNA, 20 bp, synthetic construct
  misc_feature 1..20: note = CRISPR gRNA sequence
  source 1..20: mol_type = other DNA
ttcagctctgtcctgaaata

SEQ ID NO: 26620 - DNA, 20 bp, synthetic construct
  misc_feature 1..20: note = CRISPR gRNA sequence
  source 1..20: mol_type = other DNA
cagctctgtcctgaaatatc

SEQ ID NO: 26621 - DNA, 20 bp, synthetic construct
  misc_feature 1..20: note = CRISPR gRNA sequence
  source 1..20: mol_type = other DNA
agctctgtcctgaaatatct

SEQ ID NO: 26622 - DNA, 20 bp, synthetic construct
  misc_feature 1..20: note = CRISPR gRNA sequence
  source 1..20: mol_type = other DNA
tgtcctgaaatatcttcctt

SEQ ID NO: 26623 - DNA, 20 bp, synthetic construct
  misc_feature 1..20: note = CRISPR gRNA sequence
  source 1..20: mol_type = other DNA
tcctgaaatatcttcctttg

SEQ ID NO: 26624 - DNA, 20 bp, synthetic construct
  misc_feature 1..20: note = CRISPR gRNA sequence
  source 1..20: mol_type = other DNA
aaatatcttcctttggaagt

SEQ ID NO: 26625 - DNA, 20 bp, synthetic construct
  misc_feature 1..20: note = CRISPR gRNA sequence
  source 1..20: mol_type = other DNA
cctttggaagttctactctc

SEQ ID NO: 26626 - DNA, 20 bp, synthetic construct
  misc_feature 1..20: note = CRISPR gRNA sequence
  source 1..20: mol_type = other DNA
ctttggaagttctactctct

SEQ ID NO: 26627 - DNA, 20 bp, synthetic construct
  misc_feature 1..20: note = CRISPR gRNA sequence
  source 1..20: mol_type = other DNA
tggaagttctactctcttct

SEQ ID NO: 26628 - DNA, 20 bp, synthetic construct
  misc_feature 1..20: note = CRISPR gRNA sequence
  source 1..20: mol_type = other DNA
ggaagttctactctcttctc

SEQ ID NO: 26629 - DNA, 20 bp, synthetic construct
  misc_feature 1..20: note = CRISPR gRNA sequence
  source 1..20: mol_type = other DNA
gaagttctactctcttctct

SEQ ID NO: 26630 - DNA, 20 bp, synthetic construct
  misc_feature 1..20: note = CRISPR gRNA sequence
  source 1..20: mol_type = other DNA
tactctcttctctccagact

SEQ ID NO: 26631 - DNA, 20 bp, synthetic construct
  misc_feature 1..20: note = CRISPR gRNA sequence
  source 1..20: mol_type = other DNA
ctctcttctctccagacttc

SEQ ID NO: 26632 - DNA, 20 bp, synthetic construct
  misc_feature 1..20: note = CRISPR gRNA sequence
  source 1..20: mol_type = other DNA
tcttctctccagacttcctg

SEQ ID NO: 26633 - DNA, 20 bp, synthetic construct
  misc_feature 1..20: note = CRISPR gRNA sequence
  source 1..20: mol_type = other DNA
ttctctccagacttcctgag

SEQ ID NO: 26634 - DNA, 20 bp, synthetic construct
  misc_feature 1..20: note = CRISPR gRNA sequence
  source 1..20: mol_type = other DNA
ctctccagacttcctgagct

SEQ ID NO: 26635 - DNA, 20 bp, synthetic construct
  misc_feature 1..20: note = CRISPR gRNA sequence
  source 1..20: mol_type = other DNA
tctccagacttcctgagctc

SEQ ID NO: 26636 - DNA, 20 bp, synthetic construct
  misc_feature 1..20: note = CRISPR gRNA sequence
  source 1..20: mol_type = other DNA
tccagacttcctgagctcca

SEQ ID NO: 26637 - DNA, 20 bp, synthetic construct
  misc_feature 1..20: note = CRISPR gRNA sequence
  source 1..20: mol_type = other DNA
cagacttcctgagctccaca

SEQ ID NO: 26638 - DNA, 20 bp, synthetic construct
  misc_feature 1..20: note = CRISPR gRNA sequence
  source 1..20: mol_type = other DNA
cctgagctccacagcccagt

SEQ ID NO: 26639 - DNA, 20 bp, synthetic construct
  misc_feature 1..20: note = CRISPR gRNA sequence
  source 1..20: mol_type = other DNA
ctgagctccacagcccagtt

SEQ ID NO: 26640 - DNA, 20 bp, synthetic construct
  misc_feature 1..20: note = CRISPR gRNA sequence
  source 1..20: mol_type = other DNA
agctccacagcccagtttgg

SEQ ID NO: 26641 - DNA, 20 bp, synthetic construct
  misc_feature 1..20: note = CRISPR gRNA sequence
  source 1..20: mol_type = other DNA
cacagcccagtttggagtag

SEQ ID NO: 26642 - DNA, 20 bp, synthetic construct
  misc_feature 1..20: note = CRISPR gRNA sequence
  source 1..20: mol_type = other DNA
ggagtaggggtgacccaagt

SEQ ID NO: 26643 - DNA, 20 bp, synthetic construct
  misc_feature 1..20: note = CRISPR gRNA sequence
  source 1..20: mol_type = other DNA
gagtaggggtgacccaagtg

SEQ ID NO: 26644 - DNA, 20 bp, synthetic construct
  misc_feature 1..20: note = CRISPR gRNA sequence
  source 1..20: mol_type = other DNA
ctggaatcaatacctggtta

SEQ ID NO: 26645 - DNA, 20 bp, synthetic construct
  misc_feature 1..20: note = CRISPR gRNA sequence
  source 1..20: mol_type = other DNA
tggaatcaatacctggttat

SEQ ID NO: 26646 - DNA, 20 bp, synthetic construct
  misc_feature 1..20: note = CRISPR gRNA sequence
  source 1..20: mol_type = other DNA
gaatcaatacctggttattc

SEQ ID NO: 26647 - DNA, 20 bp, synthetic construct
  misc_feature 1..20: note = CRISPR gRNA sequence
  source 1..20: mol_type = other DNA
gttattctcacaccactctc

SEQ ID NO: 26648 - DNA, 20 bp, synthetic construct
  misc_feature 1..20: note = CRISPR gRNA sequence
  source 1..20: mol_type = other DNA
ttctcacaccactctccacc

SEQ ID NO: 26649 - DNA, 20 bp, synthetic construct
  misc_feature 1..20: note = CRISPR gRNA sequence
  source 1..20: mol_type = other DNA
tcacaccactctccaccccc

SEQ ID NO: 26650 - DNA, 20 bp, synthetic construct
  misc_feature 1..20: note = CRISPR gRNA sequence
  source 1..20: mol_type = other DNA
acaccactctccacccccaa

SEQ ID NO: 26651 - DNA, 20 bp, synthetic construct
  misc_feature 1..20: note = CRISPR gRNA sequence
  source 1..20: mol_type = other DNA
tccacccccaatgtaggtga

SEQ ID NO: 26652 - DNA, 20 bp, synthetic construct
  misc_feature 1..20: note = CRISPR gRNA sequence
  source 1..20: mol_type = other DNA
cacccccaatgtaggtgagg

SEQ ID NO: 26653 - DNA, 20 bp, synthetic construct
  misc_feature 1..20: note = CRISPR gRNA sequence
  source 1..20: mol_type = other DNA
ccagtggattcactgtccac

SEQ ID NO: 26654 - DNA, 20 bp, synthetic construct
  misc_feature 1..20: note = CRISPR gRNA sequence
  source 1..20: mol_type = other DNA
actgtccacggcctcccaac

SEQ ID NO: 26655 - DNA, 20 bp, synthetic construct
  misc_feature 1..20: note = CRISPR gRNA sequence
  source 1..20: mol_type = other DNA
tccacggcctcccaacatct

SEQ ID NO: 26656 - DNA, 20 bp, synthetic construct
  misc_feature 1..20: note = CRISPR gRNA sequence
  source 1..20: mol_type = other DNA
ccaacatctccagaccggcc

SEQ ID NO: 26657 - DNA, 20 bp, synthetic construct
  misc_feature 1..20: note = CRISPR gRNA sequence
  source 1..20: mol_type = other DNA
cagaccggccaggctccacc

SEQ ID NO: 26658 - DNA, 20 bp, synthetic construct
  misc_feature 1..20: note = CRISPR gRNA sequence
  source 1..20: mol_type = other DNA
caccagccccttcgctccat

SEQ ID NO: 26659 - DNA, 20 bp, synthetic construct
  misc_feature 1..20: note = CRISPR gRNA sequence
  source 1..20: mol_type = other DNA
cgctccatcagccactgacc

SEQ ID NO: 26660 - DNA, 20 bp, synthetic construct
  misc_feature 1..20: note = CRISPR gRNA sequence
  source 1..20: mol_type = other DNA
gctccatcagccactgacct

SEQ ID NO: 26661 - DNA, 20 bp, synthetic construct
  misc_feature 1..20: note = CRISPR gRNA sequence
  source 1..20: mol_type = other DNA
catcagccactgacctgccc

SEQ ID NO: 26662 - DNA, 20 bp, synthetic construct
  misc_feature 1..20: note = CRISPR gRNA sequence
  source 1..20: mol_type = other DNA
acctgcccagcatgcctgaa

SEQ ID NO: 26663 - DNA, 20 bp, synthetic construct
  misc_feature 1..20: note = CRISPR gRNA sequence
  source 1..20: mol_type = other DNA
cccagcatgcctgaacctgc

SEQ ID NO: 26664 - DNA, 20 bp, synthetic construct
  misc_feature 1..20: note = CRISPR gRNA sequence
  source 1..20: mol_type = other DNA
aacctgccctgacctcccga

SEQ ID NO: 26665 - DNA, 20 bp, synthetic construct
  misc_feature 1..20: note = CRISPR gRNA sequence
  source 1..20: mol_type = other DNA
ccctgacctcccgagcaaac

SEQ ID NO: 26666 - DNA, 20 bp, synthetic construct
  misc_feature 1..20: note = CRISPR gRNA sequence
  source 1..20: mol_type = other DNA
acctcccgagcaaacatgac

SEQ ID NO: 26667 - DNA, 20 bp, synthetic construct
  misc_feature 1..20: note = CRISPR gRNA sequence
  source 1..20: mol_type = other DNA
ccgagcaaacatgacaggta

SEQ ID NO: 26668 - DNA, 20 bp, synthetic construct
  misc_feature 1..20: note = CRISPR gRNA sequence
  source 1..20: mol_type = other DNA
agggcctgtgagaggtacta

SEQ ID NO: 26669 - DNA, 20 bp, synthetic construct
  misc_feature 1..20: note = CRISPR gRNA sequence
  source 1..20: mol_type = other DNA
gggcctgtgagaggtactag

SEQ ID NO: 26670 - DNA, 20 bp, synthetic construct
  misc_feature 1..20: note = CRISPR gRNA sequence
  source 1..20: mol_type = other DNA
tgagaggtactagaagcagg

SEQ ID NO: 26671 - DNA, 20 bp, synthetic construct
  misc_feature 1..20: note = CRISPR gRNA sequence
  source 1..20: mol_type = other DNA
gaagcaggatcgaggccctg

SEQ ID NO: 26672 - DNA, 20 bp, synthetic construct
  misc_feature 1..20: note = CRISPR gRNA sequence
  source 1..20: mol_type = other DNA
gggaaggaattgtctcaaat

SEQ ID NO: 26673 - DNA, 20 bp, synthetic construct
  misc_feature 1..20: note = CRISPR gRNA sequence
  source 1..20: mol_type = other DNA
tctcaaataagatccacaag

SEQ ID NO: 26674 - DNA, 20 bp, synthetic construct
  misc_feature 1..20: note = CRISPR gRNA sequence
  source 1..20: mol_type = other DNA
aaataagatccacaagcaaa

SEQ ID NO: 26675 - DNA, 20 bp, synthetic construct
  misc_feature 1..20: note = CRISPR gRNA sequence
  source 1..20: mol_type = other DNA
cctgtagggacaacaggtca

SEQ ID NO: 26676 - DNA, 20 bp, synthetic construct
  misc_feature 1..20: note = CRISPR gRNA sequence
  source 1..20: mol_type = other DNA
tagggacaacaggtcatgtt

SEQ ID NO: 26677 - DNA, 20 bp, synthetic construct
  misc_feature 1..20: note = CRISPR gRNA sequence
  source 1..20: mol_type = other DNA
aggggtcagtcgggacaggg

SEQ ID NO: 26678 - DNA, 20 bp, synthetic construct
  misc_feature 1..20: note = CRISPR gRNA sequence
  source 1..20: mol_type = other DNA
ggggtcagtcgggacaggga

SEQ ID NO: 26679 - DNA, 20 bp, synthetic construct
  misc_feature 1..20: note = CRISPR gRNA sequence
  source 1..20: mol_type = other DNA
cagggagtggaggcatggtt

SEQ ID NO: 26680 - DNA, 20 bp, synthetic construct
  misc_feature 1..20: note = CRISPR gRNA sequence
  source 1..20: mol_type = other DNA
tgggggaatggacagctaga

SEQ ID NO: 26681 - DNA, 20 bp, synthetic construct
  misc_feature 1..20: note = CRISPR gRNA sequence
  source 1..20: mol_type = other DNA
gagaatccacatcccatcca

SEQ ID NO: 26682 - DNA, 20 bp, synthetic construct
  misc_feature 1..20: note = CRISPR gRNA sequence
  source 1..20: mol_type = other DNA
cagctgcttgttacccagca

SEQ ID NO: 26683 - DNA, 20 bp, synthetic construct
  misc_feature 1..20: note = CRISPR gRNA sequence
  source 1..20: mol_type = other DNA
agctgcttgttacccagcag

SEQ ID NO: 26684 - DNA, 20 bp, synthetic construct
  misc_feature 1..20: note = CRISPR gRNA sequence
  source 1..20: mol_type = other DNA
cttgttacccagcagaaaag

SEQ ID NO: 26685 - DNA, 20 bp, synthetic construct
  misc_feature 1..20: note = CRISPR gRNA sequence
  source 1..20: mol_type = other DNA
gttacccagcagaaaagcca

SEQ ID NO: 26686 - DNA, 20 bp, synthetic construct
  misc_feature 1..20: note = CRISPR gRNA sequence
  source 1..20: mol_type = other DNA
ttacccagcagaaaagccag

SEQ ID NO: 26687 - DNA, 20 bp, synthetic construct
  misc_feature 1..20: note = CRISPR gRNA sequence
  source 1..20: mol_type = other DNA
cccagcagaaaagccagaca

SEQ ID NO: 26688 - DNA, 20 bp, synthetic construct
  misc_feature 1..20: note = CRISPR gRNA sequence
  source 1..20: mol_type = other DNA
ttgaagttgaaaaccctgat

SEQ ID NO: 26689 - DNA, 20 bp, synthetic construct
  misc_feature 1..20: note = CRISPR gRNA sequence
  source 1..20: mol_type = other DNA
tgaagttgaaaaccctgatt

SEQ ID NO: 26690 - DNA, 20 bp, synthetic construct
  misc_feature 1..20: note = CRISPR gRNA sequence
  source 1..20: mol_type = other DNA
gaagttgaaaaccctgattt

SEQ ID NO: 26691 - DNA, 20 bp, synthetic construct
  misc_feature 1..20: note = CRISPR gRNA sequence
  source 1..20: mol_type = other DNA
aagttgaaaaccctgatttt

SEQ ID NO: 26692 - DNA, 20 bp, synthetic construct
  misc_feature 1..20: note = CRISPR gRNA sequence
  source 1..20: mol_type = other DNA
aaaaccctgatttttacata

SEQ ID NO: 26693 - DNA, 20 bp, synthetic construct
  misc_feature 1..20: note = CRISPR gRNA sequence
  source 1..20: mol_type = other DNA
atttttacatagatattgtg

SEQ ID NO: 26694 - DNA, 20 bp, synthetic construct
  misc_feature 1..20: note = CRISPR gRNA sequence
  source 1..20: mol_type = other DNA
ttacatagatattgtgattt

SEQ ID NO: 26695 - DNA, 20 bp, synthetic construct
  misc_feature 1..20: note = CRISPR gRNA sequence
  source 1..20: mol_type = other DNA
tacatagatattgtgatttt

SEQ ID NO: 26696 - DNA, 20 bp, synthetic construct
  misc_feature 1..20: note = CRISPR gRNA sequence
  source 1..20: mol_type = other DNA
acatagatattgtgattttt

SEQ ID NO: 26697 - DNA, 20 bp, synthetic construct
  misc_feature 1..20: note = CRISPR gRNA sequence
  source 1..20: mol_type = other DNA
catagatattgtgatttttt

SEQ ID NO: 26698 - DNA, 20 bp, synthetic construct
  misc_feature 1..20: note = CRISPR gRNA sequence
  source 1..20: mol_type = other DNA
tgattttttaatttttattt

SEQ ID NO: 26699 - DNA, 20 bp, synthetic construct
  misc_feature 1..20: note = CRISPR gRNA sequence
  source 1..20: mol_type = other DNA
tttaatttttattttattat

SEQ ID NO: 26700 - DNA, 20 bp, synthetic construct
  misc_feature 1..20: note = CRISPR gRNA sequence
  source 1..20: mol_type = other DNA
ttaatttttattttattatt

SEQ ID NO: 26701 - DNA, 20 bp, synthetic construct
  misc_feature 1..20: note = CRISPR gRNA sequence
  source 1..20: mol_type = other DNA
taatttttattttattattt

SEQ ID NO: 26702 - DNA, 20 bp, synthetic construct
  misc_feature 1..20: note = CRISPR gRNA sequence
  source 1..20: mol_type = other DNA
aatttttattttattattta

SEQ ID NO: 26703 - DNA, 20 bp, synthetic construct
  misc_feature 1..20: note = CRISPR gRNA sequence
  source 1..20: mol_type = other DNA
atttttattttattatttat

SEQ ID NO: 26704 - DNA, 20 bp, synthetic construct
  misc_feature 1..20: note = CRISPR gRNA sequence
  source 1..20: mol_type = other DNA
ttattttattatttatttat

SEQ ID NO: 26705 - DNA, 20 bp, synthetic construct
  misc_feature 1..20: note = CRISPR gRNA sequence
  source 1..20: mol_type = other DNA
tattttattatttatttatt

SEQ ID NO: 26706 - DNA, 20 bp, synthetic construct
  misc_feature 1..20: note = CRISPR gRNA sequence
  source 1..20: mol_type = other DNA
attttattatttatttattg

SEQ ID NO: 26707 - DNA, 20 bp, synthetic construct
  misc_feature 1..20: note = CRISPR gRNA sequence
  source 1..20: mol_type = other DNA
ttttattatttatttattgt

SEQ ID NO: 26708 - DNA, 20 bp, synthetic construct
  misc_feature 1..20: note = CRISPR gRNA sequence
  source 1..20: mol_type = other DNA
tattatttatttattgttga

SEQ ID NO: 26709 - DNA, 20 bp, synthetic construct
  misc_feature 1..20: note = CRISPR gRNA sequence
  source 1..20: mol_type = other DNA
attatttatttattgttgag

SEQ ID NO: 26710 - DNA, 20 bp, synthetic construct
  misc_feature 1..20: note = CRISPR gRNA sequence
  source 1..20: mol_type = other DNA
ttatttatttattgttgaga

SEQ ID NO: 26711 - DNA, 20 bp, synthetic construct
  misc_feature 1..20: note = CRISPR gRNA sequence
  source 1..20: mol_type = other DNA
tttatttattgttgagatgg

SEQ ID NO: 26712 - DNA, 20 bp, synthetic construct
  misc_feature 1..20: note = CRISPR gRNA sequence
  source 1..20: mol_type = other DNA
atttattgttgagatggagt

SEQ ID NO: 26713 - DNA, 20 bp, synthetic construct
  misc_feature 1..20: note = CRISPR gRNA sequence
  source 1..20: mol_type = other DNA
tttattgttgagatggagtc

SEQ ID NO: 26714 - DNA, 20 bp, synthetic construct
  misc_feature 1..20: note = CRISPR gRNA sequence
  source 1..20: mol_type = other DNA
attgttgagatggagtctca

SEQ ID NO: 26715 - DNA, 20 bp, synthetic construct
  misc_feature 1..20: note = CRISPR gRNA sequence
  source 1..20: mol_type = other DNA
ttgttgagatggagtctcac

SEQ ID NO: 26716 - DNA, 20 bp, synthetic construct
  misc_feature 1..20: note = CRISPR gRNA sequence
  source 1..20: mol_type = other DNA
ttgagatggagtctcactct

SEQ ID NO: 26717 - DNA, 20 bp, synthetic construct
  misc_feature 1..20: note = CRISPR gRNA sequence
  source 1..20: mol_type = other DNA
agatggagtctcactctgtt

SEQ ID NO: 26718 - DNA, 20 bp, synthetic construct
  misc_feature 1..20: note = CRISPR gRNA sequence
  source 1..20: mol_type = other DNA
actctgttgcccaggctaga

SEQ ID NO: 26719 - DNA, 20 bp, synthetic construct
  misc_feature 1..20: note = CRISPR gRNA sequence
  source 1..20: mol_type = other DNA
tgttgcccaggctagagtgc

SEQ ID NO: 26720 - DNA, 20 bp, synthetic construct
  misc_feature 1..20: note = CRISPR gRNA sequence
  source 1..20: mol_type = other DNA
ttgcccaggctagagtgcag

SEQ ID NO: 26721 - DNA, 20 bp, synthetic construct
  misc_feature 1..20: note = CRISPR gRNA sequence
  source 1..20: mol_type = other DNA
cccaggctagagtgcagtgg

SEQ ID NO: 26722 - DNA, 20 bp, synthetic construct
  misc_feature 1..20: note = CRISPR gRNA sequence
  source 1..20: mol_type = other DNA
gagtgcagtggtgcgatctc

SEQ ID NO: 26723 - DNA, 20 bp, synthetic construct
  misc_feature 1..20: note = CRISPR gRNA sequence
  source 1..20: mol_type = other DNA
agatcactgcaacctccgcc

SEQ ID NO: 26724 - DNA, 20 bp, synthetic construct
  misc_feature 1..20: note = CRISPR gRNA sequence
  source 1..20: mol_type = other DNA
caacctccgccctacaggtt

SEQ ID NO: 26725 - DNA, 20 bp, synthetic construct
  misc_feature 1..20: note = CRISPR gRNA sequence
  source 1..20: mol_type = other DNA
cgccctacaggttcaagtga

SEQ ID NO: 26726 - DNA, 20 bp, synthetic construct
  misc_feature 1..20: note = CRISPR gRNA sequence
  source 1..20: mol_type = other DNA
caggttcaagtgattctcct

SEQ ID NO: 26727 - DNA, 20 bp, synthetic construct
  misc_feature 1..20: note = CRISPR gRNA sequence
  source 1..20: mol_type = other DNA
aagtgattctcctgcctcag

SEQ ID NO: 26728 - DNA, 20 bp, synthetic construct
  misc_feature 1..20: note = CRISPR gRNA sequence
  source 1..20: mol_type = other DNA
tcctgcctcagcctccggag

SEQ ID NO: 26729 - DNA, 20 bp, synthetic construct
  misc_feature 1..20: note = CRISPR gRNA sequence
  source 1..20: mol_type = other DNA
ctgcctcagcctccggagca

SEQ ID NO: 26730 - DNA, 20 bp, synthetic construct
  misc_feature 1..20: note = CRISPR gRNA sequence
  source 1..20: mol_type = other DNA
cctcagcctccggagcagct

SEQ ID NO: 26731 - DNA, 20 bp, synthetic construct
  misc_feature 1..20: note = CRISPR gRNA sequence
  source 1..20: mol_type = other DNA
agcctccggagcagctggaa

SEQ ID NO: 26732 - DNA, 20 bp, synthetic construct
  misc_feature 1..20: note = CRISPR gRNA sequence
  source 1..20: mol_type = other DNA
cggagcagctggaattacag

SEQ ID NO: 26733 - DNA, 20 bp, synthetic construct
  misc_feature 1..20: note = CRISPR gRNA sequence
  source 1..20: mol_type = other DNA
gaattacaggtgtgcaccgt

SEQ ID NO: 26734 - DNA, 20 bp, synthetic construct
  misc_feature 1..20: note = CRISPR gRNA sequence
  source 1..20: mol_type = other DNA
caggtgtgcaccgtcacacc

SEQ ID NO: 26735 - DNA, 20 bp, synthetic construct
  misc_feature 1..20: note = CRISPR gRNA sequence
  source 1..20: mol_type = other DNA
ttgtaatttcagtagagaca

SEQ ID NO: 26736 - DNA, 20 bp, synthetic construct
  misc_feature 1..20: note = CRISPR gRNA sequence
  source 1..20: mol_type = other DNA
tgtaatttcagtagagacaa

SEQ ID NO: 26737 - DNA, 20 bp, synthetic construct
  misc_feature 1..20: note = CRISPR gRNA sequence
  source 1..20: mol_type = other DNA
gtaatttcagtagagacaag

SEQ ID NO: 26738 - DNA, 20 bp, synthetic construct
  misc_feature 1..20: note = CRISPR gRNA sequence
  source 1..20: mol_type = other DNA
taatttcagtagagacaagt

SEQ ID NO: 26739 - DNA, 20 bp, synthetic construct
  misc_feature 1..20: note = CRISPR gRNA sequence
  source 1..20: mol_type = other DNA
cagtagagacaagtttaacc

SEQ ID NO: 26740 - DNA, 20 bp, synthetic construct
  misc_feature 1..20: note = CRISPR gRNA sequence
  source 1..20: mol_type = other DNA
agtagagacaagtttaacca

SEQ ID NO: 26741 - DNA, 20 bp, synthetic construct
  misc_feature 1..20: note = CRISPR gRNA sequence
  source 1..20: mol_type = other DNA
aaccatgttggccaggctgg

SEQ ID NO: 26742 - DNA, 20 bp, synthetic construct
  misc_feature 1..20: note = CRISPR gRNA sequence
  source 1..20: mol_type = other DNA
accatgttggccaggctggt

SEQ ID NO: 26743 - DNA, 20 bp, synthetic construct
  misc_feature 1..20: note = CRISPR gRNA sequence
  source 1..20: mol_type = other DNA
gccaggctggtctcgaactc

SEQ ID NO: 26744 - DNA, 20 bp, synthetic construct
  misc_feature 1..20: note = CRISPR gRNA sequence
  source 1..20: mol_type = other DNA
gtctcgaactcctgatctca

SEQ ID NO: 26745 - DNA, 20 bp, synthetic construct
  misc_feature 1..20: note = CRISPR gRNA sequence
  source 1..20: mol_type = other DNA
gaactcctgatctcaagtga

SEQ ID NO: 26746 - DNA, 20 bp, synthetic construct
  misc_feature 1..20: note = CRISPR gRNA sequence
  source 1..20: mol_type = other DNA
ctgatctcaagtgatccacc

SEQ ID NO: 26747 - DNA, 20 bp, synthetic construct
  misc_feature 1..20: note = CRISPR gRNA sequence
  source 1..20: mol_type = other DNA
atctcaagtgatccacctgc

SEQ ID NO: 26748 - DNA, 20 bp, synthetic construct
  misc_feature 1..20: note = CRISPR gRNA sequence
  source 1..20: mol_type = other DNA
aagtgatccacctgcctcga

SEQ ID NO: 26749 - DNA, 20 bp, synthetic construct
  misc_feature 1..20: note = CRISPR gRNA sequence
  source 1..20: mol_type = other DNA
cctcgacctcccaaagtgct

SEQ ID NO: 26750 - DNA, 20 bp, synthetic construct
  misc_feature 1..20: note = CRISPR gRNA sequence
  source 1..20: mol_type = other DNA
gacctcccaaagtgctggga

SEQ ID NO: 26751 - DNA, 20 bp, synthetic construct
  misc_feature 1..20: note = CRISPR gRNA sequence
  source 1..20: mol_type = other DNA
ccaaagtgctgggattacag

SEQ ID NO: 26752 - DNA, 20 bp, synthetic construct
  misc_feature 1..20: note = CRISPR gRNA sequence
  source 1..20: mol_type = other DNA
ggattacaggtgtgagccac

SEQ ID NO: 26753 - DNA, 20 bp, synthetic construct
  misc_feature 1..20: note = CRISPR gRNA sequence
  source 1..20: mol_type = other DNA
caggtgtgagccactgcacc

SEQ ID NO: 26754 - DNA, 20 bp, synthetic construct
  misc_feature 1..20: note = CRISPR gRNA sequence
  source 1..20: mol_type = other DNA
cacccagcctgatattgcga

SEQ ID NO: 26755 - DNA, 20 bp, synthetic construct
  misc_feature 1..20: note = CRISPR gRNA sequence
  source 1..20: mol_type = other DNA
atattgcgattttctttttt

SEQ ID NO: 26756 - DNA, 20 bp, synthetic construct
  misc_feature 1..20: note = CRISPR gRNA sequence
  source 1..20: mol_type = other DNA
cgattttcttttttaaacat

SEQ ID NO: 26757 - DNA, 20 bp, synthetic construct
  misc_feature 1..20: note = CRISPR gRNA sequence
  source 1..20: mol_type = other DNA
tcttttttaaacatgagtga

SEQ ID NO: 26758 - DNA, 20 bp, synthetic construct
  misc_feature 1..20: note = CRISPR gRNA sequence
  source 1..20: mol_type = other DNA
cttttttaaacatgagtgaa

SEQ ID NO: 26759 - DNA, 20 bp, synthetic construct
  misc_feature 1..20: note = CRISPR gRNA sequence
  source 1..20: mol_type = other DNA
ttttttaaacatgagtgaaa

SEQ ID NO: 26760 - DNA, 20 bp, synthetic construct
  misc_feature 1..20: note = CRISPR gRNA sequence
  source 1..20: mol_type = other DNA
ttttaaacatgagtgaaatt

SEQ ID NO: 26761 - DNA, 20 bp, synthetic construct
  misc_feature 1..20: note = CRISPR gRNA sequence
  source 1..20: mol_type = other DNA
tttaaacatgagtgaaattt

SEQ ID NO: 26762 - DNA, 20 bp, synthetic construct
  misc_feature 1..20: note = CRISPR gRNA sequence
  source 1..20: mol_type = other DNA
ttaaacatgagtgaaatttt

SEQ ID NO: 26763 - DNA, 20 bp, synthetic construct
  misc_feature 1..20: note = CRISPR gRNA sequence
  source 1..20: mol_type = other DNA
taaacatgagtgaaattttt

SEQ ID NO: 26764 - DNA, 20 bp, synthetic construct
  misc_feature 1..20: note = CRISPR gRNA sequence
  source 1..20: mol_type = other DNA
aaacatgagtgaaattttta

SEQ ID NO: 26765 - DNA, 20 bp, synthetic construct
  misc_feature 1..20: note = CRISPR gRNA sequence
  source 1..20: mol_type = other DNA
aacatgagtgaaatttttaa

SEQ ID NO: 26766 - DNA, 20 bp, synthetic construct
  misc_feature 1..20: note = CRISPR gRNA sequence
  source 1..20: mol_type = other DNA
ttaaaagtacagttggccaa

SEQ ID NO: 26767 - DNA, 20 bp, synthetic construct
  misc_feature 1..20: note = CRISPR gRNA sequence
  source 1..20: mol_type = other DNA
taaaagtacagttggccaaa

SEQ ID NO: 26768 - DNA, 20 bp, synthetic construct
  misc_feature 1..20: note = CRISPR gRNA sequence
  source 1..20: mol_type = other DNA
aaaagtacagttggccaaag

SEQ ID NO: 26769 - DNA, 20 bp, synthetic construct
  misc_feature 1..20: note = CRISPR gRNA sequence
  source 1..20: mol_type = other DNA
aaagtacagttggccaaaga

SEQ ID NO: 26770 - DNA, 20 bp, synthetic construct
  misc_feature 1..20: note = CRISPR gRNA sequence
  source 1..20: mol_type = other DNA
gccaaagaaagacatatttg

SEQ ID NO: 26771 - DNA, 20 bp, synthetic construct
  misc_feature 1..20: note = CRISPR gRNA sequence
  source 1..20: mol_type = other DNA
gagttagatacagcctcagg

SEQ ID NO: 26772 - DNA, 20 bp, synthetic construct
  misc_feature 1..20: note = CRISPR gRNA sequence
  source 1..20: mol_type = other DNA
agttagatacagcctcaggc

SEQ ID NO: 26773 - DNA, 20 bp, synthetic construct
  misc_feature 1..20: note = CRISPR gRNA sequence
  source 1..20: mol_type = other DNA
gatacagcctcaggccgcta

SEQ ID NO: 26774 - DNA, 20 bp, synthetic construct
  misc_feature 1..20: note = CRISPR gRNA sequence
  source 1..20: mol_type = other DNA
aggccgctatcttataacct

SEQ ID NO: 26775 - DNA, 20 bp, synthetic construct
  misc_feature 1..20: note = CRISPR gRNA sequence
  source 1..20: mol_type = other DNA
tcttataacctccatcttgg

SEQ ID NO: 26776 - DNA, 20 bp, synthetic construct
  misc_feature 1..20: note = CRISPR gRNA sequence
  source 1..20: mol_type = other DNA
ataacctccatcttgggaaa

SEQ ID NO: 26777 - DNA, 20 bp, synthetic construct
  misc_feature 1..20: note = CRISPR gRNA sequence
  source 1..20: mol_type = other DNA
taacctccatcttgggaaac

SEQ ID NO: 26778 - DNA, 20 bp, synthetic construct
  misc_feature 1..20: note = CRISPR gRNA sequence
  source 1..20: mol_type = other DNA
catcttgggaaactcagccc

SEQ ID NO: 26779 - DNA, 20 bp, synthetic construct
  misc_feature 1..20: note = CRISPR gRNA sequence
  source 1..20: mol_type = other DNA
gggaaactcagcccatgaag

SEQ ID NO: 26780 - DNA, 20 bp, synthetic construct
  misc_feature 1..20: note = CRISPR gRNA sequence
  source 1..20: mol_type = other DNA
ggaaactcagcccatgaagg

SEQ ID NO: 26781 - DNA, 20 bp, synthetic construct
  misc_feature 1..20: note = CRISPR gRNA sequence
  source 1..20: mol_type = other DNA
agcccatgaaggctgtaagg

SEQ ID NO: 26782 - DNA, 20 bp, synthetic construct
  misc_feature 1..20: note = CRISPR gRNA sequence
  source 1..20: mol_type = other DNA
taaggactaagtggcccaga

SEQ ID NO: 26783 - DNA, 20 bp, synthetic construct
  misc_feature 1..20: note = CRISPR gRNA sequence
  source 1..20: mol_type = other DNA
agtggcccagagggaggggg

SEQ ID NO: 26784 - DNA, 20 bp, synthetic construct
  misc_feature 1..20: note = CRISPR gRNA sequence
  source 1..20: mol_type = other DNA
accctaaatctggcacctgc

SEQ ID NO: 26785 - DNA, 20 bp, synthetic construct
  misc_feature 1..20: note = CRISPR gRNA sequence
  source 1..20: mol_type = other DNA
aatctggcacctgcttctcc

SEQ ID NO: 26786 - DNA, 20 bp, synthetic construct
  misc_feature 1..20: note = CRISPR gRNA sequence
  source 1..20: mol_type = other DNA
gcacctgcttctccatctcc

SEQ ID NO: 26787 - DNA, 20 bp, synthetic construct
  misc_feature 1..20: note = CRISPR gRNA sequence
  source 1..20: mol_type = other DNA
cttctccatctccagagcac

SEQ ID NO: 26788 - DNA, 20 bp, synthetic construct
  misc_feature 1..20: note = CRISPR gRNA sequence
  source 1..20: mol_type = other DNA
ctccatctccagagcacaag

SEQ ID NO: 26789 - DNA, 20 bp, synthetic construct
  misc_feature 1..20: note = CRISPR gRNA sequence
  source 1..20: mol_type = other DNA
tccatctccagagcacaaga

SEQ ID NO: 26790 - DNA, 20 bp, synthetic construct
  misc_feature 1..20: note = CRISPR gRNA sequence
  source 1..20: mol_type = other DNA
catctccagagcacaagacg

SEQ ID NO: 26791 - DNA, 20 bp, synthetic construct
  misc_feature 1..20: note = CRISPR gRNA sequence
  source 1..20: mol_type = other DNA
cagagcacaagacgtccccc

SEQ ID NO: 26792 - DNA, 20 bp, synthetic construct
  misc_feature 1..20: note = CRISPR gRNA sequence
  source 1..20: mol_type = other DNA
gagaggtctccaacaagctt

SEQ ID NO: 26793 - DNA, 20 bp, synthetic construct
  misc_feature 1..20: note = CRISPR gRNA sequence
  source 1..20: mol_type = other DNA
caacaagcttccaaaatggc

SEQ ID NO: 26794 - DNA, 20 bp, synthetic construct
  misc_feature 1..20: note = CRISPR gRNA sequence
  source 1..20: mol_type = other DNA
ccaaaatggcctggtgagtg

SEQ ID NO: 26795 - DNA, 20 bp, synthetic construct
  misc_feature 1..20: note = CRISPR gRNA sequence
  source 1..20: mol_type = other DNA
caaaatggcctggtgagtga

SEQ ID NO: 26796 - DNA, 20 bp, synthetic construct
  misc_feature 1..20: note = CRISPR gRNA sequence
  source 1..20: mol_type = other DNA
gtgagtgatgcgggatctct

SEQ ID NO: 26797 - DNA, 20 bp, synthetic construct
  misc_feature 1..20: note = CRISPR gRNA sequence
  source 1..20: mol_type = other DNA
tctgccctgggtggtggaga

SEQ ID NO: 26798 - DNA, 20 bp, synthetic construct
  misc_feature 1..20: note = CRISPR gRNA sequence
  source 1..20: mol_type = other DNA
tgccctgggtggtggagatg

SEQ ID NO: 26799 - DNA, 20 bp, synthetic construct
  misc_feature 1..20: note = CRISPR gRNA sequence
  source 1..20: mol_type = other DNA
ccctgggtggtggagatgga

SEQ ID NO: 26800 - DNA, 20 bp, synthetic construct
  misc_feature 1..20: note = CRISPR gRNA sequence
  source 1..20: mol_type = other DNA
ggtggtggagatggaagccc

SEQ ID NO: 26801 - DNA, 20 bp, synthetic construct
  misc_feature 1..20: note = CRISPR gRNA sequence
  source 1..20: mol_type = other DNA
gcttcacattgctcattcac

SEQ ID NO: 26802 - DNA, 20 bp, synthetic construct
  misc_feature 1..20: note = CRISPR gRNA sequence
  source 1..20: mol_type = other DNA
cacattgctcattcacttga

SEQ ID NO: 26803 - DNA, 20 bp, synthetic construct
  misc_feature 1..20: note = CRISPR gRNA sequence
  source 1..20: mol_type = other DNA
acattgctcattcacttgac

SEQ ID NO: 26804 - DNA, 20 bp, synthetic construct
  misc_feature 1..20: note = CRISPR gRNA sequence
  source 1..20: mol_type = other DNA
ctcattcacttgacacttat

SEQ ID NO: 26805 - DNA, 20 bp, synthetic construct
  misc_feature 1..20: note = CRISPR gRNA sequence
  source 1..20: mol_type = other DNA
attcacttgacacttattca

SEQ ID NO: 26806 - DNA, 20 bp, synthetic construct
  misc_feature 1..20: note = CRISPR gRNA sequence
  source 1..20: mol_type = other DNA
acttgacacttattcaaccc

SEQ ID NO: 26807 - DNA, 20 bp, synthetic construct
  misc_feature 1..20: note = CRISPR gRNA sequence
  source 1..20: mol_type = other DNA
gacacttattcaaccccttc

SEQ ID NO: 26808 - DNA, 20 bp, synthetic construct
  misc_feature 1..20: note = CRISPR gRNA sequence
  source 1..20: mol_type = other DNA
acacttattcaaccccttct

SEQ ID NO: 26809 - DNA, 20 bp, synthetic construct
  misc_feature 1..20: note = CRISPR gRNA sequence
  source 1..20: mol_type = other DNA
attcaaccccttctttgttg

SEQ ID NO: 26810 - DNA, 20 bp, synthetic construct
  misc_feature 1..20: note = CRISPR gRNA sequence
  source 1..20: mol_type = other DNA
ttcaaccccttctttgttgg

SEQ ID NO: 26811 - DNA, 20 bp, synthetic construct
  misc_feature 1..20: note = CRISPR gRNA sequence
  source 1..20: mol_type = other DNA
aaccccttctttgttggctc

SEQ ID NO: 26812 - DNA, 20 bp, synthetic construct
  misc_feature 1..20: note = CRISPR gRNA sequence
  source 1..20: mol_type = other DNA
ctttgttggctcacacactc

SEQ ID NO: 26813 - DNA, 20 bp, synthetic construct
  misc_feature 1..20: note = CRISPR gRNA sequence
  source 1..20: mol_type = other DNA
tttgttggctcacacactca

SEQ ID NO: 26814 - DNA, 20 bp, synthetic construct
  misc_feature 1..20: note = CRISPR gRNA sequence
  source 1..20: mol_type = other DNA
tgttggctcacacactcatt

SEQ ID NO: 26815 - DNA, 20 bp, synthetic construct
  misc_feature 1..20: note = CRISPR gRNA sequence
  source 1..20: mol_type = other DNA
gttggctcacacactcattt

SEQ ID NO: 26816 - DNA, 20 bp, synthetic construct
  misc_feature 1..20: note = CRISPR gRNA sequence
  source 1..20: mol_type = other DNA
ttggctcacacactcattta

SEQ ID NO: 26817 - DNA, 20 bp, synthetic construct
  misc_feature 1..20: note = CRISPR gRNA sequence
  source 1..20: mol_type = other DNA
gctcacacactcatttattt

SEQ ID NO: 26818 - DNA, 20 bp, synthetic construct
  misc_feature 1..20: note = CRISPR gRNA sequence
  source 1..20: mol_type = other DNA
acacactcatttatttattc

SEQ ID NO: 26819 - DNA, 20 bp, synthetic construct
  misc_feature 1..20: note = CRISPR gRNA sequence
  source 1..20: mol_type = other DNA
atttatttattcattcattc

SEQ ID NO: 26820 - DNA, 20 bp, synthetic construct
  misc_feature 1..20: note = CRISPR gRNA sequence
  source 1..20: mol_type = other DNA
atttattcattcattcattc

SEQ ID NO: 26821 - DNA, 20 bp, synthetic construct
  misc_feature 1..20: note = CRISPR gRNA sequence
  source 1..20: mol_type = other DNA
tttattcattcattcattca

SEQ ID NO: 26822 - DNA, 20 bp, synthetic construct
  misc_feature 1..20: note = CRISPR gRNA sequence
  source 1..20: mol_type = other DNA
attcattcattcattcattc

SEQ ID NO: 26823 - DNA, 20 bp, synthetic construct
  misc_feature 1..20: note = CRISPR gRNA sequence
  source 1..20: mol_type = other DNA
ttcattcattcattcattca

SEQ ID NO: 26824 - DNA, 20 bp, synthetic construct
  misc_feature 1..20: note = CRISPR gRNA sequence
  source 1..20: mol_type = other DNA
attcattcattcattcactt

SEQ ID NO: 26825 - DNA, 20 bp, synthetic construct
  misc_feature 1..20: note = CRISPR gRNA sequence
  source 1..20: mol_type = other DNA
attcattcattcacttattt

SEQ ID NO: 26826 - DNA, 20 bp, synthetic construct
  misc_feature 1..20: note = CRISPR gRNA sequence
  source 1..20: mol_type = other DNA
attcattcacttatttgatt

SEQ ID NO: 26827 - DNA, 20 bp, synthetic construct
  misc_feature 1..20: note = CRISPR gRNA sequence
  source 1..20: mol_type = other DNA
attcacttatttgattatgc

SEQ ID NO: 26828 - DNA, 20 bp, synthetic construct
  misc_feature 1..20: note = CRISPR gRNA sequence
  source 1..20: mol_type = other DNA
acttatttgattatgccatc

SEQ ID NO: 26829 - DNA, 20 bp, synthetic construct
  misc_feature 1..20: note = CRISPR gRNA sequence
  source 1..20: mol_type = other DNA
atttgattatgccatcattt

SEQ ID NO: 26830 - DNA, 20 bp, synthetic construct
  misc_feature 1..20: note = CRISPR gRNA sequence
  source 1..20: mol_type = other DNA
tttgattatgccatcatttc

SEQ ID NO: 26831 - DNA, 20 bp, synthetic construct
  misc_feature 1..20: note = CRISPR gRNA sequence
  source 1..20: mol_type = other DNA
gattatgccatcatttcacc

SEQ ID NO: 26832 - DNA, 20 bp, synthetic construct
  misc_feature 1..20: note = CRISPR gRNA sequence
  source 1..20: mol_type = other DNA
attatgccatcatttcacca

SEQ ID NO: 26833 - DNA, 20 bp, synthetic construct
  misc_feature 1..20: note = CRISPR gRNA sequence
  source 1..20: mol_type = other DNA
tgccatcatttcaccattca

SEQ ID NO: 26834 - DNA, 20 bp, synthetic construct
  misc_feature 1..20: note = CRISPR gRNA sequence
  source 1..20: mol_type = other DNA
caccattcactccaccactc

SEQ ID NO: 26835 - DNA, 20 bp, synthetic construct
  misc_feature 1..20: note = CRISPR gRNA sequence
  source 1..20: mol_type = other DNA
accattcactccaccactcc

SEQ ID NO: 26836 - DNA, 20 bp, synthetic construct
  misc_feature 1..20: note = CRISPR gRNA sequence
  source 1..20: mol_type = other DNA
actccaccactccctcaaat

SEQ ID NO: 26837 - DNA, 20 bp, synthetic construct
  misc_feature 1..20: note = CRISPR gRNA sequence
  source 1..20: mol_type = other DNA
caccactccctcaaataata

SEQ ID NO: 26838 - DNA, 20 bp, synthetic construct
  misc_feature 1..20: note = CRISPR gRNA sequence
  source 1..20: mol_type = other DNA
cctcaaataatatttattgc

SEQ ID NO: 26839 - DNA, 20 bp, synthetic construct
  misc_feature 1..20: note = CRISPR gRNA sequence
  source 1..20: mol_type = other DNA
aaataatatttattgccctt

SEQ ID NO: 26840 - DNA, 20 bp, synthetic construct
  misc_feature 1..20: note = CRISPR gRNA sequence
  source 1..20: mol_type = other DNA
attgcccttcaataagcctg

SEQ ID NO: 26841 - DNA, 20 bp, synthetic construct
  misc_feature 1..20: note = CRISPR gRNA sequence
  source 1..20: mol_type = other DNA
ttgcccttcaataagcctgc

SEQ ID NO: 26842 - DNA, 20 bp, synthetic construct
  misc_feature 1..20: note = CRISPR gRNA sequence
  source 1..20: mol_type = other DNA
cccttcaataagcctgcact

SEQ ID NO: 26843 - DNA, 20 bp, synthetic construct
  misc_feature 1..20: note = CRISPR gRNA sequence
  source 1..20: mol_type = other DNA
caataagcctgcactgggtg

SEQ ID NO: 26844 - DNA, 20 bp, synthetic construct
  misc_feature 1..20: note = CRISPR gRNA sequence
  source 1..20: mol_type = other DNA
aataagcctgcactgggtgt

SEQ ID NO: 26845 - DNA, 20 bp, synthetic construct
  misc_feature 1..20: note = CRISPR gRNA sequence
  source 1..20: mol_type = other DNA
cactgggtgttaacacttca

SEQ ID NO: 26846 - DNA, 20 bp, synthetic construct
  misc_feature 1..20: note = CRISPR gRNA sequence
  source 1..20: mol_type = other DNA
ggtgttaacacttcattgtc

SEQ ID NO: 26847 - DNA, 20 bp, synthetic construct
  misc_feature 1..20: note = CRISPR gRNA sequence
  source 1..20: mol_type = other DNA
acacttcattgtcaggctga

SEQ ID NO: 26848 - DNA, 20 bp, synthetic construct
  misc_feature 1..20: note = CRISPR gRNA sequence
  source 1..20: mol_type = other DNA
cattgtcaggctgagagaat

SEQ ID NO: 26849 - DNA, 20 bp, synthetic construct
  misc_feature 1..20: note = CRISPR gRNA sequence
  source 1..20: mol_type = other DNA
attgtcaggctgagagaatg

SEQ ID NO: 26850 - DNA, 20 bp, synthetic construct
  misc_feature 1..20: note = CRISPR gRNA sequence
  source 1..20: mol_type = other DNA
tcaggctgagagaatgaatg

SEQ ID NO: 26851 - DNA, 20 bp, synthetic construct
  misc_feature 1..20: note = CRISPR gRNA sequence
  source 1..20: mol_type = other DNA
agagaatgaatgaggggcaa

SEQ ID NO: 26852 - DNA, 20 bp, synthetic construct
  misc_feature 1..20: note = CRISPR gRNA sequence
  source 1..20: mol_type = other DNA
atgaggatgggagcaatgga

SEQ ID NO: 26853 - DNA, 20 bp, synthetic construct
  misc_feature 1..20: note = CRISPR gRNA sequence
  source 1..20: mol_type = other DNA
ctaaattactaaatgcttac

SEQ ID NO: 26854 - DNA, 20 bp, synthetic construct
  misc_feature 1..20: note = CRISPR gRNA sequence
  source 1..20: mol_type = other DNA
aattactaaatgcttactct

SEQ ID NO: 26855 - DNA, 20 bp, synthetic construct
  misc_feature 1..20: note = CRISPR gRNA sequence
  source 1..20: mol_type = other DNA
ctaaatgcttactctcacat

SEQ ID NO: 26856 - DNA, 20 bp, synthetic construct
  misc_feature 1..20: note = CRISPR gRNA sequence
  source 1..20: mol_type = other DNA
aatgcttactctcacatact

SEQ ID NO: 26857 - DNA, 20 bp, synthetic construct
  misc_feature 1..20: note = CRISPR gRNA sequence
  source 1..20: mol_type = other DNA
actctcacatactggtctaa

SEQ ID NO: 26858 - DNA, 20 bp, synthetic construct
  misc_feature 1..20: note = CRISPR gRNA sequence
  source 1..20: mol_type = other DNA
ctctcacatactggtctaag

SEQ ID NO: 26859 - DNA, 20 bp, synthetic construct
  misc_feature 1..20: note = CRISPR gRNA sequence
  source 1..20: mol_type = other DNA
tcacatactggtctaagcat

SEQ ID NO: 26860 - DNA, 20 bp, synthetic construct
  misc_feature 1..20: note = CRISPR gRNA sequence
  source 1..20: mol_type = other DNA
acatactggtctaagcatgt

SEQ ID NO: 26861 - DNA, 20 bp, synthetic construct
  misc_feature 1..20: note = CRISPR gRNA sequence
  source 1..20: mol_type = other DNA
gtctaagcatgttaggtatg

SEQ ID NO: 26862 - DNA, 20 bp, synthetic construct
  misc_feature 1..20: note = CRISPR gRNA sequence
  source 1..20: mol_type = other DNA
agcatgttaggtatgctaaa

SEQ ID NO: 26863 - DNA, 20 bp, synthetic construct
  misc_feature 1..20: note = CRISPR gRNA sequence
  source 1..20: mol_type = other DNA
ggtatgctaaatcattaaca

SEQ ID NO: 26864 - DNA, 20 bp, synthetic construct
  misc_feature 1..20: note = CRISPR gRNA sequence
  source 1..20: mol_type = other DNA
aatcattaacatctcacaca

SEQ ID NO: 26865 - DNA, 20 bp, synthetic construct
  misc_feature 1..20: note = CRISPR gRNA sequence
  source 1..20: mol_type = other DNA
acatctcacacaatcccaat

SEQ ID NO: 26866 - DNA, 20 bp, synthetic construct
  misc_feature 1..20: note = CRISPR gRNA sequence
  source 1..20: mol_type = other DNA
acacaatcccaatattatcc

SEQ ID NO: 26867 - DNA, 20 bp, synthetic construct
  misc_feature 1..20: note = CRISPR gRNA sequence
  source 1..20: mol_type = other DNA
tccccattttccagatgagg

SEQ ID NO: 26868 - DNA, 20 bp, synthetic construct
  misc_feature 1..20: note = CRISPR gRNA sequence
  source 1..20: mol_type = other DNA
tccagatgaggctactgagg

SEQ ID NO: 26869 - DNA, 20 bp, synthetic construct
  misc_feature 1..20: note = CRISPR gRNA sequence
  source 1..20: mol_type = other DNA
ccagatgaggctactgaggc

SEQ ID NO: 26870 - DNA, 20 bp, synthetic construct
  misc_feature 1..20: note = CRISPR gRNA sequence
  source 1..20: mol_type = other DNA
cagatgaggctactgaggca

SEQ ID NO: 26871 - DNA, 20 bp, synthetic construct
  misc_feature 1..20: note = CRISPR gRNA sequence
  source 1..20: mol_type = other DNA
ctgaggcatggtgggatgta

SEQ ID NO: 26872 - DNA, 20 bp, synthetic construct
  misc_feature 1..20: note = CRISPR gRNA sequence
  source 1..20: mol_type = other DNA
aggcatggtgggatgtatag

SEQ ID NO: 26873 - DNA, 20 bp, synthetic construct
  misc_feature 1..20: note = CRISPR gRNA sequence
  source 1..20: mol_type = other DNA
agaattgctccagcaagtgg

SEQ ID NO: 26874 - DNA, 20 bp, synthetic construct
  misc_feature 1..20: note = CRISPR gRNA sequence
  source 1..20: mol_type = other DNA
ctccagcaagtggtagaacc

SEQ ID NO: 26875 - DNA, 20 bp, synthetic construct
  misc_feature 1..20: note = CRISPR gRNA sequence
  source 1..20: mol_type = other DNA
cagcaagtggtagaaccggg

SEQ ID NO: 26876 - DNA, 20 bp, synthetic construct
  misc_feature 1..20: note = CRISPR gRNA sequence
  source 1..20: mol_type = other DNA
gaacccagacacgtgggctc

SEQ ID NO: 26877 - DNA, 20 bp, synthetic construct
  misc_feature 1..20: note = CRISPR gRNA sequence
  source 1..20: mol_type = other DNA
aacccagacacgtgggctcc

SEQ ID NO: 26878 - DNA, 20 bp, synthetic construct
  misc_feature 1..20: note = CRISPR gRNA sequence
  source 1..20: mol_type = other DNA
cactgtcttaactcttaaca

SEQ ID NO: 26879 - DNA, 20 bp, synthetic construct
  misc_feature 1..20: note = CRISPR gRNA sequence
  source 1..20: mol_type = other DNA
tcttaactcttaacactccc

SEQ ID NO: 26880 - DNA, 20 bp, synthetic construct
  misc_feature 1..20: note = CRISPR gRNA sequence
  source 1..20: mol_type = other DNA
aactcttaacactccctccc

SEQ ID NO: 26881 - DNA, 20 bp, synthetic construct
  misc_feature 1..20: note = CRISPR gRNA sequence
  source 1..20: mol_type = other DNA
actcttaacactccctccca

SEQ ID NO: 26882 - DNA, 20 bp, synthetic construct
  misc_feature 1..20: note = CRISPR gRNA sequence
  source 1..20: mol_type = other DNA
ttaacactccctcccatgac

SEQ ID NO: 26883 - DNA, 20 bp, synthetic construct
  misc_feature 1..20: note = CRISPR gRNA sequence
  source 1..20: mol_type = other DNA
aacactccctcccatgacct

SEQ ID NO: 26884 - DNA, 20 bp, synthetic construct
  misc_feature 1..20: note = CRISPR gRNA sequence
  source 1..20: mol_type = other DNA
acactccctcccatgacctc

SEQ ID NO: 26885 - DNA, 20 bp, synthetic construct
  misc_feature 1..20: note = CRISPR gRNA sequence
  source 1..20: mol_type = other DNA
cctcccatgacctccccatg

SEQ ID NO: 26886 - DNA, 20 bp, synthetic construct
  misc_feature 1..20: note = CRISPR gRNA sequence
  source 1..20: mol_type = other DNA
ccatgacctccccatggtga

SEQ ID NO: 26887 - DNA, 20 bp, synthetic construct
  misc_feature 1..20: note = CRISPR gRNA sequence
  source 1..20: mol_type = other DNA
cccatggtgagtgagtagtg

SEQ ID NO: 26888 - DNA, 20 bp, synthetic construct
  misc_feature 1..20: note = CRISPR gRNA sequence
  source 1..20: mol_type = other DNA
agtgagtaaatgaaggaatg

SEQ ID NO: 26889 - DNA, 20 bp, synthetic construct
  misc_feature 1..20: note = CRISPR gRNA sequence
  source 1..20: mol_type = other DNA
gtgagtaaatgaaggaatga

SEQ ID NO: 26890 - DNA, 20 bp, synthetic construct
  misc_feature 1..20: note = CRISPR gRNA sequence
  source 1..20: mol_type = other DNA
atgcctgtaatcccagcact

SEQ ID NO: 26891 - DNA, 20 bp, synthetic construct
  misc_feature 1..20: note = CRISPR gRNA sequence
  source 1..20: mol_type = other DNA
tgcctgtaatcccagcactt

SEQ ID NO: 26892 - DNA, 20 bp, synthetic construct
  misc_feature 1..20: note = CRISPR gRNA sequence
  source 1..20: mol_type = other DNA
taatcccagcactttgggag

SEQ ID NO: 26893 - DNA, 20 bp, synthetic construct
  misc_feature 1..20: note = CRISPR gRNA sequence
  source 1..20: mol_type = other DNA
tgggaggccaaggcaggtgg

SEQ ID NO: 26894 - DNA, 20 bp, synthetic construct
  misc_feature 1..20: note = CRISPR gRNA sequence
  source 1..20: mol_type = other DNA
gggaggccaaggcaggtgga

SEQ ID NO: 26895 - DNA, 20 bp, synthetic construct
  misc_feature 1..20: note = CRISPR gRNA sequence
  source 1..20: mol_type = other DNA
ggaggccaaggcaggtggat

SEQ ID NO: 26896 - DNA, 20 bp, synthetic construct
  misc_feature 1..20: note = CRISPR gRNA sequence
  source 1..20: mol_type = other DNA
aggtcaggagttcgagacca

SEQ ID NO: 26897 - DNA, 20 bp, synthetic construct
  misc_feature 1..20: note = CRISPR gRNA sequence
  source 1..20: mol_type = other DNA
gagaccagcctggccaacat

SEQ ID NO: 26898 - DNA, 20 bp, synthetic construct
  misc_feature 1..20: note = CRISPR gRNA sequence
  source 1..20: mol_type = other DNA
gccaacatagtgaaaccccg

SEQ ID NO: 26899 - DNA, 20 bp, synthetic construct
  misc_feature 1..20: note = CRISPR gRNA sequence
  source 1..20: mol_type = other DNA
cattaaaaaatacaaaaatt

SEQ ID NO: 26900 - DNA, 20 bp, synthetic construct
  misc_feature 1..20: note = CRISPR gRNA sequence
  source 1..20: mol_type = other DNA
aaaaatacaaaaattagcca

SEQ ID NO: 26901 - DNA, 20 bp, synthetic construct
  misc_feature 1..20: note = CRISPR gRNA sequence
  source 1..20: mol_type = other DNA
gccagacgtggtagtgggtg

SEQ ID NO: 26902 - DNA, 20 bp, synthetic construct
  misc_feature 1..20: note = CRISPR gRNA sequence
  source 1..20: mol_type = other DNA
taatcccagctacttggcag

SEQ ID NO: 26903 - DNA, 20 bp, synthetic construct
  misc_feature 1..20: note = CRISPR gRNA sequence
  source 1..20: mol_type = other DNA
cttggcaggccgaggcagga

SEQ ID NO: 26904 - DNA, 20 bp, synthetic construct
  misc_feature 1..20: note = CRISPR gRNA sequence
  source 1..20: mol_type = other DNA
ggcaggccgaggcaggagaa

SEQ ID NO: 26905 - DNA, 20 bp, synthetic construct
  misc_feature 1..20: note = CRISPR gRNA sequence
  source 1..20: mol_type = other DNA
gcaggccgaggcaggagaat

SEQ ID NO: 26906 - DNA, 20 bp, synthetic construct
  misc_feature 1..20: note = CRISPR gRNA sequence
  source 1..20: mol_type = other DNA
aacccaggaggtggaggttg

SEQ ID NO: 26907 - DNA, 20 bp, synthetic construct
  misc_feature 1..20: note = CRISPR gRNA sequence
  source 1..20: mol_type = other DNA
ccgtgagctgagattgcgcc

SEQ ID NO: 26908 - DNA, 20 bp, synthetic construct
  misc_feature 1..20: note = CRISPR gRNA sequence
  source 1..20: mol_type = other DNA
agattgcgccagtgcactcc

SEQ ID NO: 26909 - DNA, 20 bp, synthetic construct
  misc_feature 1..20: note = CRISPR gRNA sequence
  source 1..20: mol_type = other DNA
cgccagtgcactccagcctg

SEQ ID NO: 26910 - DNA, 20 bp, synthetic construct
  misc_feature 1..20: note = CRISPR gRNA sequence
  source 1..20: mol_type = other DNA
cagcctggggcacagggcag

SEQ ID NO: 26911 - DNA, 20 bp, synthetic construct
  misc_feature 1..20: note = CRISPR gRNA sequence
  source 1..20: mol_type = other DNA
gggcacagggcaggatccat

SEQ ID NO: 26912 - DNA, 20 bp, synthetic construct
  misc_feature 1..20: note = CRISPR gRNA sequence
  source 1..20: mol_type = other DNA
aaaaaaaaaaaagagagaaa

SEQ ID NO: 26913 - DNA, 20 bp, synthetic construct
  misc_feature 1..20: note = CRISPR gRNA sequence
  source 1..20: mol_type = other DNA
aaaggagtggacacttaaac

SEQ ID NO: 26914 - DNA, 20 bp, synthetic construct
  misc_feature 1..20: note = CRISPR gRNA sequence
  source 1..20: mol_type = other DNA
aaacaagagagacgatgagt

SEQ ID NO: 26915 - DNA, 20 bp, synthetic construct
  misc_feature 1..20: note = CRISPR gRNA sequence
  source 1..20: mol_type = other DNA
aacaagagagacgatgagtg

SEQ ID NO: 26916 - DNA, 20 bp, synthetic construct
  misc_feature 1..20: note = CRISPR gRNA sequence
  source 1..20: mol_type = other DNA
atgaatgagtggtgggtgac

SEQ ID NO: 26917 - DNA, 20 bp, synthetic construct
  misc_feature 1..20: note = CRISPR gRNA sequence
  source 1..20: mol_type = other DNA
aatgaagcaaatgatgaaga

SEQ ID NO: 26918 - DNA, 20 bp, synthetic construct
  misc_feature 1..20: note = CRISPR gRNA sequence
  source 1..20: mol_type = other DNA
tatgggggccagatgtggtg

SEQ ID NO: 26919 - DNA, 20 bp, synthetic construct
  misc_feature 1..20: note = CRISPR gRNA sequence
  source 1..20: mol_type = other DNA
acacctgtaatcccagcact

SEQ ID NO: 26920 - DNA, 20 bp, synthetic construct
  misc_feature 1..20: note = CRISPR gRNA sequence
  source 1..20: mol_type = other DNA
taatcccagcactttgggag

SEQ ID NO: 26921 - DNA, 20 bp, synthetic construct
  misc_feature 1..20: note = CRISPR gRNA sequence
  source 1..20: mol_type = other DNA
tgggaggccaaggcggaacg

SEQ ID NO: 26922 - DNA, 20 bp, synthetic construct
  misc_feature 1..20: note = CRISPR gRNA sequence
  source 1..20: mol_type = other DNA
gggaggccaaggcggaacga

SEQ ID NO: 26923 - DNA, 20 bp, synthetic construct
  misc_feature 1..20: note = CRISPR gRNA sequence
  source 1..20: mol_type = other DNA
ggaggccaaggcggaacgat

SEQ ID NO: 26924 - DNA, 20 bp, synthetic construct
  misc_feature 1..20: note = CRISPR gRNA sequence
  source 1..20: mol_type = other DNA
cttgagcccaggagctcaag

SEQ ID NO: 26925 - DNA, 20 bp, synthetic construct
  misc_feature 1..20: note = CRISPR gRNA sequence
  source 1..20: mol_type = other DNA
gagcccaggagctcaagacc

SEQ ID NO: 26926 - DNA, 20 bp, synthetic construct
  misc_feature 1..20: note = CRISPR gRNA sequence
  source 1..20: mol_type = other DNA
agcccaggagctcaagacca

SEQ ID NO: 26927 - DNA, 20 bp, synthetic construct
  misc_feature 1..20: note = CRISPR gRNA sequence
  source 1..20: mol_type = other DNA
aagaccagcctgggcaaaat

SEQ ID NO: 26928 - DNA, 20 bp, synthetic construct
  misc_feature 1..20: note = CRISPR gRNA sequence
  source 1..20: mol_type = other DNA
ggcaaaatagtgagaactta

SEQ ID NO: 26929 - DNA, 20 bp, synthetic construct
  misc_feature 1..20: note = CRISPR gRNA sequence
  source 1..20: mol_type = other DNA
atctccacaaaaaaacaaaa

SEQ ID NO: 26930 - DNA, 20 bp, synthetic construct
  misc_feature 1..20: note = CRISPR gRNA sequence
  source 1..20: mol_type = other DNA
tctccacaaaaaaacaaaaa

SEQ ID NO: 26931 - DNA, 20 bp, synthetic construct
  misc_feature 1..20: note = CRISPR gRNA sequence
  source 1..20: mol_type = other DNA
cacaaaaaaacaaaaaagaa

SEQ ID NO: 26932 - DNA, 20 bp, synthetic construct
  misc_feature 1..20: note = CRISPR gRNA sequence
  source 1..20: mol_type = other DNA
gccaggcatggcagtgggcg

SEQ ID NO: 26933 - DNA, 20 bp, synthetic construct
  misc_feature 1..20: note = CRISPR gRNA sequence
  source 1..20: mol_type = other DNA
tagtcccagctactcaggag

SEQ ID NO: 26934 - DNA, 20 bp, synthetic construct
  misc_feature 1..20: note = CRISPR gRNA sequence
  source 1..20: mol_type = other DNA
ctcaggaggctgaggtggga

SEQ ID NO: 26935 - DNA, 20 bp, synthetic construct
  misc_feature 1..20: note = CRISPR gRNA sequence
  source 1..20: mol_type = other DNA
aggaggctgaggtgggagga

SEQ ID NO: 26936 - DNA, 20 bp, synthetic construct
  misc_feature 1..20: note = CRISPR gRNA sequence
  source 1..20: mol_type = other DNA
aggtgggaggattgcttgag

SEQ ID NO: 26937 - DNA, 20 bp, synthetic construct
  misc_feature 1..20: note = CRISPR gRNA sequence
  source 1..20: mol_type = other DNA
cttgagcctgtgaggttgaa

SEQ ID NO: 26938 - DNA, 20 bp, synthetic construct
  misc_feature 1..20: note = CRISPR gRNA sequence
  source 1..20: mol_type = other DNA
gagcctgtgaggttgaagct

SEQ ID NO: 26939 - DNA, 20 bp, synthetic construct
  misc_feature 1..20: note = CRISPR gRNA sequence
  source 1..20: mol_type = other DNA
agcctgtgaggttgaagctg

SEQ ID NO: 26940 - DNA, 20 bp, synthetic construct
  misc_feature 1..20: note = CRISPR gRNA sequence
  source 1..20: mol_type = other DNA
tgaggttgaagctgtggtgg

SEQ ID NO: 26941 - DNA, 20 bp, synthetic construct
  misc_feature 1..20: note = CRISPR gRNA sequence
  source 1..20: mol_type = other DNA
aagctgtggtggaccatgat

SEQ ID NO: 26942 - DNA, 20 bp, synthetic construct
  misc_feature 1..20: note = CRISPR gRNA sequence
  source 1..20: mol_type = other DNA
tggtggaccatgattgtgcc

SEQ ID NO: 26943 - DNA, 20 bp, synthetic construct
  misc_feature 1..20: note = CRISPR gRNA sequence
  source 1..20: mol_type = other DNA
tgccattgcacgccagcctg

SEQ ID NO: 26944 - DNA, 20 bp, synthetic construct
  misc_feature 1..20: note = CRISPR gRNA sequence
  source 1..20: mol_type = other DNA
cacgccagcctgggcgacat

SEQ ID NO: 26945 - DNA, 20 bp, synthetic construct
  misc_feature 1..20: note = CRISPR gRNA sequence
  source 1..20: mol_type = other DNA
ggcgacatagtgagacccca

SEQ ID NO: 26946 - DNA, 20 bp, synthetic construct
  misc_feature 1..20: note = CRISPR gRNA sequence
  source 1..20: mol_type = other DNA
tacaaaaaaatcaaaaaatt

SEQ ID NO: 26947 - DNA, 20 bp, synthetic construct
  misc_feature 1..20: note = CRISPR gRNA sequence
  source 1..20: mol_type = other DNA
caaaaaaatcaaaaaattat

SEQ ID NO: 26948 - DNA, 20 bp, synthetic construct
  misc_feature 1..20: note = CRISPR gRNA sequence
  source 1..20: mol_type = other DNA
tctgggcatggtgtcacatg

SEQ ID NO: 26949 - DNA, 20 bp, synthetic construct
  misc_feature 1..20: note = CRISPR gRNA sequence
  source 1..20: mol_type = other DNA
ggcatggtgtcacatgtctg

SEQ ID NO: 26950 - DNA, 20 bp, synthetic construct
  misc_feature 1..20: note = CRISPR gRNA sequence
  source 1..20: mol_type = other DNA
tggtcccagctacttgggag

SEQ ID NO: 26951 - DNA, 20 bp, synthetic construct
  misc_feature 1..20: note = CRISPR gRNA sequence
  source 1..20: mol_type = other DNA
cttgggaggtggagtcagga

SEQ ID NO: 26952 - DNA, 20 bp, synthetic construct
  misc_feature 1..20: note = CRISPR gRNA sequence
  source 1..20: mol_type = other DNA
gggaggtggagtcaggagga

SEQ ID NO: 26953 - DNA, 20 bp, synthetic construct
  misc_feature 1..20: note = CRISPR gRNA sequence
  source 1..20: mol_type = other DNA
ggaggtggagtcaggaggat

SEQ ID NO: 26954 - DNA, 20 bp, synthetic construct
  misc_feature 1..20: note = CRISPR gRNA sequence
  source 1..20: mol_type = other DNA
aggttgcagcgagctgtgat

SEQ ID NO: 26955 - DNA, 20 bp, synthetic construct
  misc_feature 1..20: note = CRISPR gRNA sequence
  source 1..20: mol_type = other DNA
cagcgagctgtgatcacacc

SEQ ID NO: 26956 - DNA, 20 bp, synthetic construct
  misc_feature 1..20: note = CRISPR gRNA sequence
  source 1..20: mol_type = other DNA
tgatcacaccactgcattcc

SEQ ID NO: 26957 - DNA, 20 bp, synthetic construct
  misc_feature 1..20: note = CRISPR gRNA sequence
  source 1..20: mol_type = other DNA
cattccagcctgggcaaaaa

SEQ ID NO: 26958 - DNA, 20 bp, synthetic construct
  misc_feature 1..20: note = CRISPR gRNA sequence
  source 1..20: mol_type = other DNA
cagcctgggcaaaaaagcca

SEQ ID NO: 26959 - DNA, 20 bp, synthetic construct
  misc_feature 1..20: note = CRISPR gRNA sequence
  source 1..20: mol_type = other DNA
ggcaaaaaagccagaccctg

SEQ ID NO: 26960 - DNA, 20 bp, synthetic construct
  misc_feature 1..20: note = CRISPR gRNA sequence
  source 1..20: mol_type = other DNA
tctcaaaacaaaacaaaaca

SEQ ID NO: 26961 - DNA, 20 bp, synthetic construct
  misc_feature 1..20: note = CRISPR gRNA sequence
  source 1..20: mol_type = other DNA
aaaacaaaacaaaacaaaca

SEQ ID NO: 26962 - DNA, 20 bp, synthetic construct
  misc_feature 1..20: note = CRISPR gRNA sequence
  source 1..20: mol_type = other DNA
tgtggggaacagatgtaaat

SEQ ID NO: 26963 - DNA, 20 bp, synthetic construct
  misc_feature 1..20: note = CRISPR gRNA sequence
  source 1..20: mol_type = other DNA
gccttgtggtggctggccct

SEQ ID NO: 26964 - DNA, 20 bp, synthetic construct
  misc_feature 1..20: note = CRISPR gRNA sequence
  source 1..20: mol_type = other DNA
gtggtggctggccctggccc

SEQ ID NO: 26965 - DNA, 20 bp, synthetic construct
  misc_feature 1..20: note = CRISPR gRNA sequence
  source 1..20: mol_type = other DNA
tggtggctggccctggccct

SEQ ID NO: 26966 - DNA, 20 bp, synthetic construct
  misc_feature 1..20: note = CRISPR gRNA sequence
  source 1..20: mol_type = other DNA
gccctggccctgcctctcac

SEQ ID NO: 26967 - DNA, 20 bp, synthetic construct
  misc_feature 1..20: note = CRISPR gRNA sequence
  source 1..20: mol_type = other DNA
gccctgcctctcacataccc

SEQ ID NO: 26968 - DNA, 20 bp, synthetic construct
  misc_feature 1..20: note = CRISPR gRNA sequence
  source 1..20: mol_type = other DNA
cctctcacatacccccaccc

SEQ ID NO: 26969 - DNA, 20 bp, synthetic construct
  misc_feature 1..20: note = CRISPR gRNA sequence
  source 1..20: mol_type = other DNA
tcacatacccccaccctgac

SEQ ID NO: 26970 - DNA, 20 bp, synthetic construct
  misc_feature 1..20: note = CRISPR gRNA sequence
  source 1..20: mol_type = other DNA
acatacccccaccctgacac

SEQ ID NO: 26971 - DNA, 20 bp, synthetic construct
  misc_feature 1..20: note = CRISPR gRNA sequence
  source 1..20: mol_type = other DNA
acacgcccctggcctttgca

SEQ ID NO: 26972 - DNA, 20 bp, synthetic construct
  misc_feature 1..20: note = CRISPR gRNA sequence
  source 1..20: mol_type = other DNA
gcctttgcagagccggtgga

SEQ ID NO: 26973 - DNA, 20 bp, synthetic construct
  misc_feature 1..20: note = CRISPR gRNA sequence
  source 1..20: mol_type = other DNA
tgcagagccggtggagcagt

SEQ ID NO: 26974 - DNA, 20 bp, synthetic construct
  misc_feature 1..20: note = CRISPR gRNA sequence
  source 1..20: mol_type = other DNA
gcagagccggtggagcagtt

SEQ ID NO: 26975 - DNA, 20 bp, synthetic construct
  misc_feature 1..20: note = CRISPR gRNA sequence
  source 1..20: mol_type = other DNA
cagagccggtggagcagttc

SEQ ID NO: 26976 - DNA, 20 bp, synthetic construct
  misc_feature 1..20: note = CRISPR gRNA sequence
  source 1..20: mol_type = other DNA
taccgctcactgcaggacac

SEQ ID NO: 26977 - DNA, 20 bp, synthetic construct
  misc_feature 1..20: note = CRISPR gRNA sequence
  source 1..20: mol_type = other DNA
ccgctcactgcaggacacgt

SEQ ID NO: 26978 - DNA, 20 bp, synthetic construct
  misc_feature 1..20: note = CRISPR gRNA sequence
  source 1..20: mol_type = other DNA
actgcaggacacgtatggtg

SEQ ID NO: 26979 - DNA, 20 bp, synthetic construct
  misc_feature 1..20: note = CRISPR gRNA sequence
  source 1..20: mol_type = other DNA
caggacacgtatggtgccga

SEQ ID NO: 26980 - DNA, 20 bp, synthetic construct
  misc_feature 1..20: note = CRISPR gRNA sequence
  source 1..20: mol_type = other DNA
gtggaggtggatctggtgca

SEQ ID NO: 26981 - DNA, 20 bp, synthetic construct
  misc_feature 1..20: note = CRISPR gRNA sequence
  source 1..20: mol_type = other DNA
gtgcaggccaggctggagag

SEQ ID NO: 26982 - DNA, 20 bp, synthetic construct
  misc_feature 1..20: note = CRISPR gRNA sequence
  source 1..20: mol_type = other DNA
gagaggagcagcagcaagag

SEQ ID NO: 26983 - DNA, 20 bp, synthetic construct
  misc_feature 1..20: note = CRISPR gRNA sequence
  source 1..20: mol_type = other DNA
gagcgggaactggccacccc

SEQ ID NO: 26984 - DNA, 20 bp, synthetic construct
  misc_feature 1..20: note = CRISPR gRNA sequence
  source 1..20: mol_type = other DNA
gccaccccggactgggcaga

SEQ ID NO: 26985 - DNA, 20 bp, synthetic construct
  misc_feature 1..20: note = CRISPR gRNA sequence
  source 1..20: mol_type = other DNA
ggcagaacggcagctggccc

SEQ ID NO: 26986 - DNA, 20 bp, synthetic construct
  misc_feature 1..20: note = CRISPR gRNA sequence
  source 1..20: mol_type = other DNA
gcccaaggaggcctggctga

SEQ ID NO: 26987 - DNA, 20 bp, synthetic construct
  misc_feature 1..20: note = CRISPR gRNA sequence
  source 1..20: mol_type = other DNA
gctgaggtgctgttggctgc

SEQ ID NO: 26988 - DNA, 20 bp, synthetic construct
  misc_feature 1..20: note = CRISPR gRNA sequence
  source 1..20: mol_type = other DNA
aggtgctgttggctgccaag

SEQ ID NO: 26989 - DNA, 20 bp, synthetic construct
  misc_feature 1..20: note = CRISPR gRNA sequence
  source 1..20: mol_type = other DNA
ttggctgccaaggagcaccg

SEQ ID NO: 26990 - DNA, 20 bp, synthetic construct
  misc_feature 1..20: note = CRISPR gRNA sequence
  source 1..20: mol_type = other DNA
gctgccaaggagcaccggcg

SEQ ID NO: 26991 - DNA, 20 bp, synthetic construct
  misc_feature 1..20: note = CRISPR gRNA sequence
  source 1..20: mol_type = other DNA
ccaaggagcaccggcggccg

SEQ ID NO: 26992 - DNA, 20 bp, synthetic construct
  misc_feature 1..20: note = CRISPR gRNA sequence
  source 1..20: mol_type = other DNA
ctgtgctgggcaaagctggt

SEQ ID NO: 26993 - DNA, 20 bp, synthetic construct
  misc_feature 1..20: note = CRISPR gRNA sequence
  source 1..20: mol_type = other DNA
tgctgggcaaagctggtcag

SEQ ID NO: 26994 - DNA, 20 bp, synthetic construct
  misc_feature 1..20: note = CRISPR gRNA sequence
  source 1..20: mol_type = other DNA
ggcaaagctggtcagggcaa

SEQ ID NO: 26995 - DNA, 20 bp, synthetic construct
  misc_feature 1..20: note = CRISPR gRNA sequence
  source 1..20: mol_type = other DNA
gtcagggcaagagctattgg

SEQ ID NO: 26996 - DNA, 20 bp, synthetic construct
  misc_feature 1..20: note = CRISPR gRNA sequence
  source 1..20: mol_type = other DNA
ttgggctggggcagtgagcc

SEQ ID NO: 26997 - DNA, 20 bp, synthetic construct
  misc_feature 1..20: note = CRISPR gRNA sequence
  source 1..20: mol_type = other DNA
ggctggggcagtgagccggg

SEQ ID NO: 26998 - DNA, 20 bp, synthetic construct
  misc_feature 1..20: note = CRISPR gRNA sequence
  source 1..20: mol_type = other DNA
gggcagtgagccgggcctgg

SEQ ID NO: 26999 - DNA, 20 bp, synthetic construct
  misc_feature 1..20: note = CRISPR gRNA sequence
  source 1..20: mol_type = other DNA
ggcttgtggccggcttcccc

SEQ ID NO: 27000 - DNA, 20 bp, synthetic construct
  misc_feature 1..20: note = CRISPR gRNA sequence
  source 1..20: mol_type = other DNA
gtggccggcttccccagtac

SEQ ID NO: 27001 - DNA, 20 bp, synthetic construct
  misc_feature 1..20: note = CRISPR gRNA sequence
  source 1..20: mol_type = other DNA
tggccggcttccccagtacg

SEQ ID NO: 27002 - DNA, 20 bp, synthetic construct
  misc_feature 1..20: note = CRISPR gRNA sequence
  source 1..20: mol_type = other DNA
ccccagtacgactttgtctt

SEQ ID NO: 27003 - DNA, 20 bp, synthetic construct
  misc_feature 1..20: note = CRISPR gRNA sequence
  source 1..20: mol_type = other DNA
cccagtacgactttgtcttc

SEQ ID NO: 27004 - DNA, 20 bp, synthetic construct
  misc_feature 1..20: note = CRISPR gRNA sequence
  source 1..20: mol_type = other DNA
tgtcttctctgtcccctgcc

SEQ ID NO: 27005 - DNA, 20 bp, synthetic construct
  misc_feature 1..20: note = CRISPR gRNA sequence
  source 1..20: mol_type = other DNA
gtcttctctgtcccctgcca

SEQ ID NO: 27006 - DNA, 20 bp, synthetic construct
  misc_feature 1..20: note = CRISPR gRNA sequence
  source 1..20: mol_type = other DNA
tcttctctgtcccctgccat

SEQ ID NO: 27007 - DNA, 20 bp, synthetic construct
  misc_feature 1..20: note = CRISPR gRNA sequence
  source 1..20: mol_type = other DNA
ctctgtcccctgccattgct

SEQ ID NO: 27008 - DNA, 20 bp, synthetic construct
  misc_feature 1..20: note = CRISPR gRNA sequence
  source 1..20: mol_type = other DNA
tctgtcccctgccattgctt

SEQ ID NO: 27009 - DNA, 20 bp, synthetic construct
  misc_feature 1..20: note = CRISPR gRNA sequence
  source 1..20: mol_type = other DNA
tgtcccctgccattgcttga

SEQ ID NO: 27010 - DNA, 20 bp, synthetic construct
  misc_feature 1..20: note = CRISPR gRNA sequence
  source 1..20: mol_type = other DNA
tcccctgccattgcttgaac

SEQ ID NO: 27011 - DNA, 20 bp, synthetic construct
  misc_feature 1..20: note = CRISPR gRNA sequence
  source 1..20: mol_type = other DNA
ccattgcttgaaccgtccgg

SEQ ID NO: 27012 - DNA, 20 bp, synthetic construct
  misc_feature 1..20: note = CRISPR gRNA sequence
  source 1..20: mol_type = other DNA
cttgaaccgtccgggggatg

SEQ ID NO: 27013 - DNA, 20 bp, synthetic construct
  misc_feature 1..20: note = CRISPR gRNA sequence
  source 1..20: mol_type = other DNA
gaaccgtccgggggatgcct

SEQ ID NO: 27014 - DNA, 20 bp, synthetic construct
  misc_feature 1..20: note = CRISPR gRNA sequence
  source 1..20: mol_type = other DNA
aaccgtccgggggatgccta

SEQ ID NO: 27015 - DNA, 20 bp, synthetic construct
  misc_feature 1..20: note = CRISPR gRNA sequence
  source 1..20: mol_type = other DNA
tggcctgcaggatctgctct

SEQ ID NO: 27016 - DNA, 20 bp, synthetic construct
  misc_feature 1..20: note = CRISPR gRNA sequence
  source 1..20: mol_type = other DNA
caggatctgctcttctccct

SEQ ID NO: 27017 - DNA, 20 bp, synthetic construct
  misc_feature 1..20: note = CRISPR gRNA sequence
  source 1..20: mol_type = other DNA
ctcttctccctgggcccaca

SEQ ID NO: 27018 - DNA, 20 bp, synthetic construct
  misc_feature 1..20: note = CRISPR gRNA sequence
  source 1..20: mol_type = other DNA
ttctccctgggcccacagcc

SEQ ID NO: 27019 - DNA, 20 bp, synthetic construct
  misc_feature 1..20: note = CRISPR gRNA sequence
  source 1..20: mol_type = other DNA
ctccctgggcccacagccac

SEQ ID NO: 27020 - DNA, 20 bp, synthetic construct
  misc_feature 1..20: note = CRISPR gRNA sequence
  source 1..20: mol_type = other DNA
tccctgggcccacagccact

SEQ ID NO: 27021 - DNA, 20 bp, synthetic construct
  misc_feature 1..20: note = CRISPR gRNA sequence
  source 1..20: mol_type = other DNA
cctgggcccacagccactcg

SEQ ID NO: 27022 - DNA, 20 bp, synthetic construct
  misc_feature 1..20: note = CRISPR gRNA sequence
  source 1..20: mol_type = other DNA
ggcccacagccactcgtggc

SEQ ID NO: 27023 - DNA, 20 bp, synthetic construct
  misc_feature 1..20: note = CRISPR gRNA sequence
  source 1..20: mol_type = other DNA
gtggcggccgatgaggtttt

SEQ ID NO: 27024 - DNA, 20 bp, synthetic construct
  misc_feature 1..20: note = CRISPR gRNA sequence
  source 1..20: mol_type = other DNA
tcagccacatcttgaagaga

SEQ ID NO: 27025 - DNA, 20 bp, synthetic construct
  misc_feature 1..20: note = CRISPR gRNA sequence
  source 1..20: mol_type = other DNA
cagccacatcttgaagagac

SEQ ID NO: 27026 - DNA, 20 bp, synthetic construct
  misc_feature 1..20: note = CRISPR gRNA sequence
  source 1..20: mol_type = other DNA
agccacatcttgaagagacc

SEQ ID NO: 27027 - DNA, 20 bp, synthetic construct
  misc_feature 1..20: note = CRISPR gRNA sequence
  source 1..20: mol_type = other DNA
gaagagacctgaccgcgttc

SEQ ID NO: 27028 - DNA, 20 bp, synthetic construct
  misc_feature 1..20: note = CRISPR gRNA sequence
  source 1..20: mol_type = other DNA
aagagacctgaccgcgttct

SEQ ID NO: 27029 - DNA, 20 bp, synthetic construct
  misc_feature 1..20: note = CRISPR gRNA sequence
  source 1..20: mol_type = other DNA
accgcgttctgctcatccta

SEQ ID NO: 27030 - DNA, 20 bp, synthetic construct
  misc_feature 1..20: note = CRISPR gRNA sequence
  source 1..20: mol_type = other DNA
tgctcatcctagacggcttc

SEQ ID NO: 27031 - DNA, 20 bp, synthetic construct
  misc_feature 1..20: note = CRISPR gRNA sequence
  source 1..20: mol_type = other DNA
ctcatcctagacggcttcga

SEQ ID NO: 27032 - DNA, 20 bp, synthetic construct
  misc_feature 1..20: note = CRISPR gRNA sequence
  source 1..20: mol_type = other DNA
atcctagacggcttcgagga

SEQ ID NO: 27033 - DNA, 20 bp, synthetic construct
  misc_feature 1..20: note = CRISPR gRNA sequence
  source 1..20: mol_type = other DNA
gacggcttcgaggagctgga

SEQ ID NO: 27034 - DNA, 20 bp, synthetic construct
  misc_feature 1..20: note = CRISPR gRNA sequence
  source 1..20: mol_type = other DNA
cgaggagctggaagcgcaag

SEQ ID NO: 27035 - DNA, 20 bp, synthetic construct
  misc_feature 1..20: note = CRISPR gRNA sequence
  source 1..20: mol_type = other DNA
gaggagctggaagcgcaaga

SEQ ID NO: 27036 - DNA, 20 bp, synthetic construct
  misc_feature 1..20: note = CRISPR gRNA sequence
  source 1..20: mol_type = other DNA
gaagcgcaagatggcttcct

SEQ ID NO: 27037 - DNA, 20 bp, synthetic construct
  misc_feature 1..20: note = CRISPR gRNA sequence
  source 1..20: mol_type = other DNA
cctgcacagcacgtgcggac

SEQ ID NO: 27038 - DNA, 20 bp, synthetic construct
  misc_feature 1..20: note = CRISPR gRNA sequence
  source 1..20: mol_type = other DNA
ctgcacagcacgtgcggacc

SEQ ID NO: 27039 - DNA, 20 bp, synthetic construct
  misc_feature 1..20: note = CRISPR gRNA sequence
  source 1..20: mol_type = other DNA
cacagcacgtgcggaccggc

SEQ ID NO: 27040 - DNA, 20 bp, synthetic construct
  misc_feature 1..20: note = CRISPR gRNA sequence
  source 1..20: mol_type = other DNA
ctccctccgggggctgctgg

SEQ ID NO: 27041 - DNA, 20 bp, synthetic construct
  misc_feature 1..20: note = CRISPR gRNA sequence
  source 1..20: mol_type = other DNA
cctccgggggctgctggccg

SEQ ID NO: 27042 - DNA, 20 bp, synthetic construct
  misc_feature 1..20: note = CRISPR gRNA sequence
  source 1..20: mol_type = other DNA
cgggggctgctggccggcct

SEQ ID NO: 27043 - DNA, 20 bp, synthetic construct
  misc_feature 1..20: note = CRISPR gRNA sequence
  source 1..20: mol_type = other DNA
ctggccggccttttccagaa

SEQ ID NO: 27044 - DNA, 20 bp, synthetic construct
  misc_feature 1..20: note = CRISPR gRNA sequence
  source 1..20: mol_type = other DNA
gccggccttttccagaagaa

SEQ ID NO: 27045 - DNA, 20 bp, synthetic construct
  misc_feature 1..20: note = CRISPR gRNA sequence
  source 1..20: mol_type = other DNA
ttccagaagaagctgctccg

SEQ ID NO: 27046 - DNA, 20 bp, synthetic construct
  misc_feature 1..20: note = CRISPR gRNA sequence
  source 1..20: mol_type = other DNA
tccagaagaagctgctccga

SEQ ID NO: 27047 - DNA, 20 bp, synthetic construct
  misc_feature 1..20: note = CRISPR gRNA sequence
  source 1..20: mol_type = other DNA
ccagaagaagctgctccgag

SEQ ID NO: 27048 - DNA, 20 bp, synthetic construct
  misc_feature 1..20: note = CRISPR gRNA sequence
  source 1..20: mol_type = other DNA
cagaagaagctgctccgagg

SEQ ID NO: 27049 - DNA, 20 bp, synthetic construct
  misc_feature 1..20: note = CRISPR gRNA sequence
  source 1..20: mol_type = other DNA
ctccgaggttgcaccctcct

SEQ ID NO: 27050 - DNA, 20 bp, synthetic construct
  misc_feature 1..20: note = CRISPR gRNA sequence
  source 1..20: mol_type = other DNA
cgaggttgcaccctcctcct

SEQ ID NO: 27051 - DNA, 20 bp, synthetic construct
  misc_feature 1..20: note = CRISPR gRNA sequence
  source 1..20: mol_type = other DNA
caccctcctcctcacagccc

SEQ ID NO: 27052 - DNA, 20 bp, synthetic construct
  misc_feature 1..20: note = CRISPR gRNA sequence
  source 1..20: mol_type = other DNA
ctcctcacagcccggccccg

SEQ ID NO: 27053 - DNA, 20 bp, synthetic construct
  misc_feature 1..20: note = CRISPR gRNA sequence
  source 1..20: mol_type = other DNA
ctcacagcccggccccgggg

SEQ ID NO: 27054 - DNA, 20 bp, synthetic construct
  misc_feature 1..20: note = CRISPR gRNA sequence
  source 1..20: mol_type = other DNA
acagcccggccccggggccg

SEQ ID NO: 27055 - DNA, 20 bp, synthetic construct
  misc_feature 1..20: note = CRISPR gRNA sequence
  source 1..20: mol_type = other DNA
gtccagagcctgagcaaggc

SEQ ID NO: 27056 - DNA, 20 bp, synthetic construct
  misc_feature 1..20: note = CRISPR gRNA sequence
  source 1..20: mol_type = other DNA
agcaaggccgacgccctatt

SEQ ID NO: 27057 - DNA, 20 bp, synthetic construct
  misc_feature 1..20: note = CRISPR gRNA sequence
  source 1..20: mol_type = other DNA
tttgagctgtccggcttctc

SEQ ID NO: 27058 - DNA, 20 bp, synthetic construct
  misc_feature 1..20: note = CRISPR gRNA sequence
  source 1..20: mol_type = other DNA
gagctgtccggcttctccat

SEQ ID NO: 27059 - DNA, 20 bp, synthetic construct
  misc_feature 1..20: note = CRISPR gRNA sequence
  source 1..20: mol_type = other DNA
agctgtccggcttctccatg

SEQ ID NO: 27060 - DNA, 20 bp, synthetic construct
  misc_feature 1..20: note = CRISPR gRNA sequence
  source 1..20: mol_type = other DNA
tccggcttctccatggagca

SEQ ID NO: 27061 - DNA, 20 bp, synthetic construct
  misc_feature 1..20: note = CRISPR gRNA sequence
  source 1..20: mol_type = other DNA
ctccatggagcaggcccagg

SEQ ID NO: 27062 - DNA, 20 bp, synthetic construct
  misc_feature 1..20: note = CRISPR gRNA sequence
  source 1..20: mol_type = other DNA
tccatggagcaggcccaggc

SEQ ID NO: 27063 - DNA, 20 bp, synthetic construct
  misc_feature 1..20: note = CRISPR gRNA sequence
  source 1..20: mol_type = other DNA
catggagcaggcccaggcat

SEQ ID NO: 27064 - DNA, 20 bp, synthetic construct
  misc_feature 1..20: note = CRISPR gRNA sequence
  source 1..20: mol_type = other DNA
ctttgagagctcagggatga

SEQ ID NO: 27065 - DNA, 20 bp, synthetic construct
  misc_feature 1..20: note = CRISPR gRNA sequence
  source 1..20: mol_type = other DNA
tgagagctcagggatgacag

SEQ ID NO: 27066 - DNA, 20 bp, synthetic construct
  misc_feature 1..20: note = CRISPR gRNA sequence
  source 1..20: mol_type = other DNA
gagagctcagggatgacaga

SEQ ID NO: 27067 - DNA, 20 bp, synthetic construct
  misc_feature 1..20: note = CRISPR gRNA sequence
  source 1..20: mol_type = other DNA
agagctcagggatgacagag

SEQ ID NO: 27068 - DNA, 20 bp, synthetic construct
  misc_feature 1..20: note = CRISPR gRNA sequence
  source 1..20: mol_type = other DNA
agggatgacagagcaccaag

SEQ ID NO: 27069 - DNA, 20 bp, synthetic construct
  misc_feature 1..20: note = CRISPR gRNA sequence
  source 1..20: mol_type = other DNA
acgctcctccgggaccggcc

SEQ ID NO: 27070 - DNA, 20 bp, synthetic construct
  misc_feature 1..20: note = CRISPR gRNA sequence
  source 1..20: mol_type = other DNA
ctccgggaccggccacttct

SEQ ID NO: 27071 - DNA, 20 bp, synthetic construct
  misc_feature 1..20: note = CRISPR gRNA sequence
  source 1..20: mol_type = other DNA
cgggaccggccacttcttct

SEQ ID NO: 27072 - DNA, 20 bp, synthetic construct
  misc_feature 1..20: note = CRISPR gRNA sequence
  source 1..20: mol_type = other DNA
cttctcagtcacagccacag

SEQ ID NO: 27073 - DNA, 20 bp, synthetic construct
  misc_feature 1..20: note = CRISPR gRNA sequence
  source 1..20: mol_type = other DNA
ttctcagtcacagccacagc

SEQ ID NO: 27074 - DNA, 20 bp, synthetic construct
  misc_feature 1..20: note = CRISPR gRNA sequence
  source 1..20: mol_type = other DNA
ctcagtcacagccacagccc

SEQ ID NO: 27075 - DNA, 20 bp, synthetic construct
  misc_feature 1..20: note = CRISPR gRNA sequence
  source 1..20: mol_type = other DNA
tcagtcacagccacagccct

SEQ ID NO: 27076 - DNA, 20 bp, synthetic construct
  misc_feature 1..20: note = CRISPR gRNA sequence
  source 1..20: mol_type = other DNA
agtcacagccacagccctac

SEQ ID NO: 27077 - DNA, 20 bp, synthetic construct
  misc_feature 1..20: note = CRISPR gRNA sequence
  source 1..20: mol_type = other DNA
ctttgtgccgggcagtgtgc

SEQ ID NO: 27078 - DNA, 20 bp, synthetic construct
  misc_feature 1..20: note = CRISPR gRNA sequence
  source 1..20: mol_type = other DNA
tgtgccgggcagtgtgccag

SEQ ID NO: 27079 - DNA, 20 bp, synthetic construct
  misc_feature 1..20: note = CRISPR gRNA sequence
  source 1..20: mol_type = other DNA
gtgccgggcagtgtgccagc

SEQ ID NO: 27080 - DNA, 20 bp, synthetic construct
  misc_feature 1..20: note = CRISPR gRNA sequence
  source 1..20: mol_type = other DNA
tgccgggcagtgtgccagct

SEQ ID NO: 27081 - DNA, 20 bp, synthetic construct
  misc_feature 1..20: note = CRISPR gRNA sequence
  source 1..20: mol_type = other DNA
tcagaggccctgctggagct

SEQ ID NO: 27082 - DNA, 20 bp, synthetic construct
  misc_feature 1..20: note = CRISPR gRNA sequence
  source 1..20: mol_type = other DNA
agaggccctgctggagcttg

SEQ ID NO: 27083 - DNA, 20 bp, synthetic construct
  misc_feature 1..20: note = CRISPR gRNA sequence
  source 1..20: mol_type = other DNA
ctggagcttggggaggacgc

SEQ ID NO: 27084 - DNA, 20 bp, synthetic construct
  misc_feature 1..20: note = CRISPR gRNA sequence
  source 1..20: mol_type = other DNA
gagcttggggaggacgccaa

SEQ ID NO: 27085 - DNA, 20 bp, synthetic construct
  misc_feature 1..20: note = CRISPR gRNA sequence
  source 1..20: mol_type = other DNA
ggggaggacgccaagctgcc

SEQ ID NO: 27086 - DNA, 20 bp, synthetic construct
  misc_feature 1..20: note = CRISPR gRNA sequence
  source 1..20: mol_type = other DNA
gggaggacgccaagctgccc

SEQ ID NO: 27087 - DNA, 20 bp, synthetic construct
  misc_feature 1..20: note = CRISPR gRNA sequence
  source 1..20: mol_type = other DNA
ccctccacgctcacgggact

SEQ ID NO: 27088 - DNA, 20 bp, synthetic construct
  misc_feature 1..20: note = CRISPR gRNA sequence
  source 1..20: mol_type = other DNA
cacgctcacgggactctatg

SEQ ID NO: 27089 - DNA, 20 bp, synthetic construct
  misc_feature 1..20: note = CRISPR gRNA sequence
  source 1..20: mol_type = other DNA
acgggactctatgtcggcct

SEQ ID NO: 27090 - DNA, 20 bp, synthetic construct
  misc_feature 1..20: note = CRISPR gRNA sequence
  source 1..20: mol_type = other DNA
tatgtcggcctgctgggccg

SEQ ID NO: 27091 - DNA, 20 bp, synthetic construct
  misc_feature 1..20: note = CRISPR gRNA sequence
  source 1..20: mol_type = other DNA
tgtcggcctgctgggccgtg

SEQ ID NO: 27092 - DNA, 20 bp, synthetic construct
  misc_feature 1..20: note = CRISPR gRNA sequence
  source 1..20: mol_type = other DNA
ctgggccgtgcagccctcga

SEQ ID NO: 27093 - DNA, 20 bp, synthetic construct
  misc_feature 1..20: note = CRISPR gRNA sequence
  source 1..20: mol_type = other DNA
ggccgtgcagccctcgacag

SEQ ID NO: 27094 - DNA, 20 bp, synthetic construct
  misc_feature 1..20: note = CRISPR gRNA sequence
  source 1..20: mol_type = other DNA
gacagcccccccggggccct

SEQ ID NO: 27095 - DNA, 20 bp, synthetic construct
  misc_feature 1..20: note = CRISPR gRNA sequence
  source 1..20: mol_type = other DNA
gcagagctggccaagctggc

SEQ ID NO: 27096 - DNA, 20 bp, synthetic construct
  misc_feature 1..20: note = CRISPR gRNA sequence
  source 1..20: mol_type = other DNA
gccaagctggcctgggagct

SEQ ID NO: 27097 - DNA, 20 bp, synthetic construct
  misc_feature 1..20: note = CRISPR gRNA sequence
  source 1..20: mol_type = other DNA
gcctgggagctgggccgcag

SEQ ID NO: 27098 - DNA, 20 bp, synthetic construct
  misc_feature 1..20: note = CRISPR gRNA sequence
  source 1..20: mol_type = other DNA
ggagctgggccgcagacatc

SEQ ID NO: 27099 - DNA, 20 bp, synthetic construct
  misc_feature 1..20: note = CRISPR gRNA sequence
  source 1..20: mol_type = other DNA
ggccgcagacatcaaagtac

SEQ ID NO: 27100 - DNA, 20 bp, synthetic construct
  misc_feature 1..20: note = CRISPR gRNA sequence
  source 1..20: mol_type = other DNA
caggaggaccagttcccatc

SEQ ID NO: 27101 - DNA, 20 bp, synthetic construct
  misc_feature 1..20: note = CRISPR gRNA sequence
  source 1..20: mol_type = other DNA
ccatccgcagacgtgaggac

SEQ ID NO: 27102 - DNA, 20 bp, synthetic construct
  misc_feature 1..20: note = CRISPR gRNA sequence
  source 1..20: mol_type = other DNA
ggcgatggccaaaggcttag

SEQ ID NO: 27103 - DNA, 20 bp, synthetic construct
  misc_feature 1..20: note = CRISPR gRNA sequence
  source 1..20: mol_type = other DNA
agtccaacacccaccgcggg

SEQ ID NO: 27104 - DNA, 20 bp, synthetic construct
  misc_feature 1..20: note = CRISPR gRNA sequence
  source 1..20: mol_type = other DNA
gtccaacacccaccgcgggc

SEQ ID NO: 27105 - DNA, 20 bp, synthetic construct
  misc_feature 1..20: note = CRISPR gRNA sequence
  source 1..20: mol_type = other DNA
gccttccccagcttcctcct

SEQ ID NO: 27106 - DNA, 20 bp, synthetic construct
  misc_feature 1..20: note = CRISPR gRNA sequence
  source 1..20: mol_type = other DNA
ccccagcttcctcctgcaat

SEQ ID NO: 27107 - DNA, 20 bp, synthetic construct
  misc_feature 1..20: note = CRISPR gRNA sequence
  source 1..20: mol_type = other DNA
cccagcttcctcctgcaatg

SEQ ID NO: 27108 - DNA, 20 bp, synthetic construct
  misc_feature 1..20: note = CRISPR gRNA sequence
  source 1..20: mol_type = other DNA
cctcctgcaatgcttcctgg

SEQ ID NO: 27109 - DNA, 20 bp, synthetic construct
  misc_feature 1..20: note = CRISPR gRNA sequence
  source 1..20: mol_type = other DNA
ctcctgcaatgcttcctggg

SEQ ID NO: 27110 - DNA, 20 bp, synthetic construct
  misc_feature 1..20: note = CRISPR gRNA sequence
  source 1..20: mol_type = other DNA
ctgcaatgcttcctgggggc

SEQ ID NO: 27111 - DNA, 20 bp, synthetic construct
  misc_feature 1..20: note = CRISPR gRNA sequence
  source 1..20: mol_type = other DNA
caatgcttcctgggggccct

SEQ ID NO: 27112 - DNA, 20 bp, synthetic construct
  misc_feature 1..20: note = CRISPR gRNA sequence
  source 1..20: mol_type = other DNA
cctgggggccctgtggctgg

SEQ ID NO: 27113 - DNA, 20 bp, synthetic construct
  misc_feature 1..20: note = CRISPR gRNA sequence
  source 1..20: mol_type = other DNA
ctgggggccctgtggctggc

SEQ ID NO: 27114 - DNA, 20 bp, synthetic construct
  misc_feature 1..20: note = CRISPR gRNA sequence
  source 1..20: mol_type = other DNA
ggggccctgtggctggctct

SEQ ID NO: 27115 - DNA, 20 bp, synthetic construct
  misc_feature 1..20: note = CRISPR gRNA sequence
  source 1..20: mol_type = other DNA
tggctggctctgagtggcga

SEQ ID NO: 27116 - DNA, 20 bp, synthetic construct
  misc_feature 1..20: note = CRISPR gRNA sequence
  source 1..20: mol_type = other DNA
gctctgagtggcgaaatcaa

SEQ ID NO: 27117 - DNA, 20 bp, synthetic construct
  misc_feature 1..20: note = CRISPR gRNA sequence
  source 1..20: mol_type = other DNA
tgagtggcgaaatcaaggac

SEQ ID NO: 27118 - DNA, 20 bp, synthetic construct
  misc_feature 1..20: note = CRISPR gRNA sequence
  source 1..20: mol_type = other DNA
agtggcgaaatcaaggacaa

SEQ ID NO: 27119 - DNA, 20 bp, synthetic construct
  misc_feature 1..20: note = CRISPR gRNA sequence
  source 1..20: mol_type = other DNA
ccgcagtacctagcattgac

SEQ ID NO: 27120 - DNA, 20 bp, synthetic construct
  misc_feature 1..20: note = CRISPR gRNA sequence
  source 1..20: mol_type = other DNA
gcattgaccccaaggaagaa

SEQ ID NO: 27121 - DNA, 20 bp, synthetic construct
  misc_feature 1..20: note = CRISPR gRNA sequence
  source 1..20: mol_type = other DNA
accccaaggaagaagaggcc

SEQ ID NO: 27122 - DNA, 20 bp, synthetic construct
  misc_feature 1..20: note = CRISPR gRNA sequence
  source 1..20: mol_type = other DNA
tgacaactggctggagggcg

SEQ ID NO: 27123 - DNA, 20 bp, synthetic construct
  misc_feature 1..20: note = CRISPR gRNA sequence
  source 1..20: mol_type = other DNA
gctggagggcgtgccacgct

SEQ ID NO: 27124 - DNA, 20 bp, synthetic construct
  misc_feature 1..20: note = CRISPR gRNA sequence
  source 1..20: mol_type = other DNA
gagggcgtgccacgctttct

SEQ ID NO: 27125 - DNA, 20 bp, synthetic construct
  misc_feature 1..20: note = CRISPR gRNA sequence
  source 1..20: mol_type = other DNA
tctggctgggctgatcttcc

SEQ ID NO: 27126 - DNA, 20 bp, synthetic construct
  misc_feature 1..20: note = CRISPR gRNA sequence
  source 1..20: mol_type = other DNA
ctggctgggctgatcttcca

SEQ ID NO: 27127 - DNA, 20 bp, synthetic construct
  misc_feature 1..20: note = CRISPR gRNA sequence
  source 1..20: mol_type = other DNA
tggctgggctgatcttccag

SEQ ID NO: 27128 - DNA, 20 bp, synthetic construct
  misc_feature 1..20: note = CRISPR gRNA sequence
  source 1..20: mol_type = other DNA
gctgggctgatcttccagcc

SEQ ID NO: 27129 - DNA, 20 bp, synthetic construct
  misc_feature 1..20: note = CRISPR gRNA sequence
  source 1..20: mol_type = other DNA
ggctgatcttccagcctccc

SEQ ID NO: 27130 - DNA, 20 bp, synthetic construct
  misc_feature 1..20: note = CRISPR gRNA sequence
  source 1..20: mol_type = other DNA
atcttccagcctcccgcccg

SEQ ID NO: 27131 - DNA, 20 bp, synthetic construct
  misc_feature 1..20: note = CRISPR gRNA sequence
  source 1..20: mol_type = other DNA
ccagcctcccgcccgctgcc

SEQ ID NO: 27132 - DNA, 20 bp, synthetic construct
  misc_feature 1..20: note = CRISPR gRNA sequence
  source 1..20: mol_type = other DNA
cagcctcccgcccgctgcct

SEQ ID NO: 27133 - DNA, 20 bp, synthetic construct
  misc_feature 1..20: note = CRISPR gRNA sequence
  source 1..20: mol_type = other DNA
ccgcccgctgcctgggagcc

SEQ ID NO: 27134 - DNA, 20 bp, synthetic construct
  misc_feature 1..20: note = CRISPR gRNA sequence
  source 1..20: mol_type = other DNA
cctgggagccctactcgggc

SEQ ID NO: 27135 - DNA, 20 bp, synthetic construct
  misc_feature 1..20: note = CRISPR gRNA sequence
  source 1..20: mol_type = other DNA
ggagccctactcgggccatc

SEQ ID NO: 27136 - DNA, 20 bp, synthetic construct
  misc_feature 1..20: note = CRISPR gRNA sequence
  source 1..20: mol_type = other DNA
ctcgggccatcggcggctgc

SEQ ID NO: 27137 - DNA, 20 bp, synthetic construct
  misc_feature 1..20: note = CRISPR gRNA sequence
  source 1..20: mol_type = other DNA
gggccatcggcggctgcctc

SEQ ID NO: 27138 - DNA, 20 bp, synthetic construct
  misc_feature 1..20: note = CRISPR gRNA sequence
  source 1..20: mol_type = other DNA
cctcggtggacaggaagcag

SEQ ID NO: 27139 - DNA, 20 bp, synthetic construct
  misc_feature 1..20: note = CRISPR gRNA sequence
  source 1..20: mol_type = other DNA
ggtggacaggaagcagaagg

SEQ ID NO: 27140 - DNA, 20 bp, synthetic construct
  misc_feature 1..20: note = CRISPR gRNA sequence
  source 1..20: mol_type = other DNA
gcgaggtacctgaagcggct

SEQ ID NO: 27141 - DNA, 20 bp, synthetic construct
  misc_feature 1..20: note = CRISPR gRNA sequence
  source 1..20: mol_type = other DNA
cgaggtacctgaagcggctg

SEQ ID NO: 27142 - DNA, 20 bp, synthetic construct
  misc_feature 1..20: note = CRISPR gRNA sequence
  source 1..20: mol_type = other DNA
aagcggctgcagccggggac

SEQ ID NO: 27143 - DNA, 20 bp, synthetic construct
  misc_feature 1..20: note = CRISPR gRNA sequence
  source 1..20: mol_type = other DNA
cagccggggacactgcgggc

SEQ ID NO: 27144 - DNA, 20 bp, synthetic construct
  misc_feature 1..20: note = CRISPR gRNA sequence
  source 1..20: mol_type = other DNA
cgggcgcggcagctgctgga

SEQ ID NO: 27145 - DNA, 20 bp, synthetic construct
  misc_feature 1..20: note = CRISPR gRNA sequence
  source 1..20: mol_type = other DNA
ctggagctgctgcactgcgc

SEQ ID NO: 27146 - DNA, 20 bp, synthetic construct
  misc_feature 1..20: note = CRISPR gRNA sequence
  source 1..20: mol_type = other DNA
gagctgctgcactgcgccca

SEQ ID NO: 27147 - DNA, 20 bp, synthetic construct
  misc_feature 1..20: note = CRISPR gRNA sequence
  source 1..20: mol_type = other DNA
ctgcactgcgcccacgaggc

SEQ ID NO: 27148 - DNA, 20 bp, synthetic construct
  misc_feature 1..20: note = CRISPR gRNA sequence
  source 1..20: mol_type = other DNA
cactgcgcccacgaggccga

SEQ ID NO: 27149 - DNA, 20 bp, synthetic construct
  misc_feature 1..20: note = CRISPR gRNA sequence
  source 1..20: mol_type = other DNA
cgcccacgaggccgaggagg

SEQ ID NO: 27150 - DNA, 20 bp, synthetic construct
  misc_feature 1..20: note = CRISPR gRNA sequence
  source 1..20: mol_type = other DNA
gaatttggcagcacgtggta

SEQ ID NO: 27151 - DNA, 20 bp, synthetic construct
  misc_feature 1..20: note = CRISPR gRNA sequence
  source 1..20: mol_type = other DNA
ggcagcacgtggtacaggag

SEQ ID NO: 27152 - DNA, 20 bp, synthetic construct
  misc_feature 1..20: note = CRISPR gRNA sequence
  source 1..20: mol_type = other DNA
gcagcacgtggtacaggagc

SEQ ID NO: 27153 - DNA, 20 bp, synthetic construct
  misc_feature 1..20: note = CRISPR gRNA sequence
  source 1..20: mol_type = other DNA
cccggccgcctctcttttct

SEQ ID NO: 27154 - DNA, 20 bp, synthetic construct
  misc_feature 1..20: note = CRISPR gRNA sequence
  source 1..20: mol_type = other DNA
tcttttctgggcacccgcct

SEQ ID NO: 27155 - DNA, 20 bp, synthetic construct
  misc_feature 1..20: note = CRISPR gRNA sequence
  source 1..20: mol_type = other DNA
ttttctgggcacccgcctca

SEQ ID NO: 27156 - DNA, 20 bp, synthetic construct
  misc_feature 1..20: note = CRISPR gRNA sequence
  source 1..20: mol_type = other DNA
ttctgggcacccgcctcacg

SEQ ID NO: 27157 - DNA, 20 bp, synthetic construct
  misc_feature 1..20: note = CRISPR gRNA sequence
  source 1..20: mol_type = other DNA
tctgggcacccgcctcacgc

SEQ ID NO: 27158 - DNA, 20 bp, synthetic construct
  misc_feature 1..20: note = CRISPR gRNA sequence
  source 1..20: mol_type = other DNA
ctgggcacccgcctcacgcc

SEQ ID NO: 27159 - DNA, 20 bp, synthetic construct
  misc_feature 1..20: note = CRISPR gRNA sequence
  source 1..20: mol_type = other DNA
tgggcacccgcctcacgcct

SEQ ID NO: 27160 - DNA, 20 bp, synthetic construct
  misc_feature 1..20: note = CRISPR gRNA sequence
  source 1..20: mol_type = other DNA
ggcacccgcctcacgcctcc

SEQ ID NO: 27161 - DNA, 20 bp, synthetic construct
  misc_feature 1..20: note = CRISPR gRNA sequence
  source 1..20: mol_type = other DNA
acgcctcctgatgcacatgt

SEQ ID NO: 27162 - DNA, 20 bp, synthetic construct
  misc_feature 1..20: note = CRISPR gRNA sequence
  source 1..20: mol_type = other DNA
ctgatgcacatgtactgggc

SEQ ID NO: 27163 - DNA, 20 bp, synthetic construct
  misc_feature 1..20: note = CRISPR gRNA sequence
  source 1..20: mol_type = other DNA
atgcacatgtactgggcaag

SEQ ID NO: 27164 - DNA, 20 bp, synthetic construct
  misc_feature 1..20: note = CRISPR gRNA sequence
  source 1..20: mol_type = other DNA
ggcaaggccttggaggcggc

SEQ ID NO: 27165 - DNA, 20 bp, synthetic construct
  misc_feature 1..20: note = CRISPR gRNA sequence
  source 1..20: mol_type = other DNA
ggaggcggcgggccaagact

SEQ ID NO: 27166 - DNA, 20 bp, synthetic construct
  misc_feature 1..20: note = CRISPR gRNA sequence
  source 1..20: mol_type = other DNA
gaggcggcgggccaagactt

SEQ ID NO: 27167 - DNA, 20 bp, synthetic construct
  misc_feature 1..20: note = CRISPR gRNA sequence
  source 1..20: mol_type = other DNA
ctccctggacctccgcagca

SEQ ID NO: 27168 - DNA, 20 bp, synthetic construct
  misc_feature 1..20: note = CRISPR gRNA sequence
  source 1..20: mol_type = other DNA
tccctggacctccgcagcac

SEQ ID NO: 27169 - DNA, 20 bp, synthetic construct
  misc_feature 1..20: note = CRISPR gRNA sequence
  source 1..20: mol_type = other DNA
cctggacctccgcagcactg

SEQ ID NO: 27170 - DNA, 20 bp, synthetic construct
  misc_feature 1..20: note = CRISPR gRNA sequence
  source 1..20: mol_type = other DNA
gacctccgcagcactggcat

SEQ ID NO: 27171 - DNA, 20 bp, synthetic construct
  misc_feature 1..20: note = CRISPR gRNA sequence
  source 1..20: mol_type = other DNA
cgcagcactggcatttgccc

SEQ ID NO: 27172 - DNA, 20 bp, synthetic construct
  misc_feature 1..20: note = CRISPR gRNA sequence
  source 1..20: mol_type = other DNA
gcatttgcccctctggattg

SEQ ID NO: 27173 - DNA, 20 bp, synthetic construct
  misc_feature 1..20: note = CRISPR gRNA sequence
  source 1..20: mol_type = other DNA
gcccctctggattggggagc

SEQ ID NO: 27174 - DNA, 20 bp, synthetic construct
  misc_feature 1..20: note = CRISPR gRNA sequence
  source 1..20: mol_type = other DNA
cccctctggattggggagcc

SEQ ID NO: 27175 - DNA, 20 bp, synthetic construct
  misc_feature 1..20: note = CRISPR gRNA sequence
  source 1..20: mol_type = other DNA
tggattggggagcctcgtgg

SEQ ID NO: 27176 - DNA, 20 bp, synthetic construct
  misc_feature 1..20: note = CRISPR gRNA sequence
  source 1..20: mol_type = other DNA
gattggggagcctcgtggga

SEQ ID NO: 27177 - DNA, 20 bp, synthetic construct
  misc_feature 1..20: note = CRISPR gRNA sequence
  source 1..20: mol_type = other DNA
gggagcctcgtgggactcag

SEQ ID NO: 27178 - DNA, 20 bp, synthetic construct
  misc_feature 1..20: note = CRISPR gRNA sequence
  source 1..20: mol_type = other DNA
gtgggactcagctgtgtcac

SEQ ID NO: 27179 - DNA, 20 bp, synthetic construct
  misc_feature 1..20: note = CRISPR gRNA sequence
  source 1..20: mol_type = other DNA
agctgtgtcacccgtttcag

SEQ ID NO: 27180 - DNA, 20 bp, synthetic construct
  misc_feature 1..20: note = CRISPR gRNA sequence
  source 1..20: mol_type = other DNA
tgtcacccgtttcaggtggg

SEQ ID NO: 27181 - DNA, 20 bp, synthetic construct
  misc_feature 1..20: note = CRISPR gRNA sequence
  source 1..20: mol_type = other DNA
caggtggggtgaggggcttg

SEQ ID NO: 27182 - DNA, 20 bp, synthetic construct
  misc_feature 1..20: note = CRISPR gRNA sequence
  source 1..20: mol_type = other DNA
aggtggggtgaggggcttgg

SEQ ID NO: 27183 - DNA, 20 bp, synthetic construct
  misc_feature 1..20: note = CRISPR gRNA sequence
  source 1..20: mol_type = other DNA
ggggaagagacatccttgtg

SEQ ID NO: 27184 - DNA, 20 bp, synthetic construct
  misc_feature 1..20: note = CRISPR gRNA sequence
  source 1..20: mol_type = other DNA
gggaagagacatccttgtgt

SEQ ID NO: 27185 - DNA, 20 bp, synthetic construct
  misc_feature 1..20: note = CRISPR gRNA sequence
  source 1..20: mol_type = other DNA
gtgttgggcattaactgcgg

SEQ ID NO: 27186 - DNA, 20 bp, synthetic construct
  misc_feature 1..20: note = CRISPR gRNA sequence
  source 1..20: mol_type = other DNA
tgttgggcattaactgcggt

SEQ ID NO: 27187 - DNA, 20 bp, synthetic construct
  misc_feature 1..20: note = CRISPR gRNA sequence
  source 1..20: mol_type = other DNA
ggcattaactgcggtcttgg

SEQ ID NO: 27188 - DNA, 20 bp, synthetic construct
  misc_feature 1..20: note = CRISPR gRNA sequence
  source 1..20: mol_type = other DNA
actgcggtcttggtgccaag

SEQ ID NO: 27189 - DNA, 20 bp, synthetic construct
  misc_feature 1..20: note = CRISPR gRNA sequence
  source 1..20: mol_type = other DNA
cggtcttggtgccaagccca

SEQ ID NO: 27190 - DNA, 20 bp, synthetic construct
  misc_feature 1..20: note = CRISPR gRNA sequence
  source 1..20: mol_type = other DNA
ggtgccaagcccagtgctct

SEQ ID NO: 27191 - DNA, 20 bp, synthetic construct
  misc_feature 1..20: note = CRISPR gRNA sequence
  source 1..20: mol_type = other DNA
gtgccaagcccagtgctctg

SEQ ID NO: 27192 - DNA, 20 bp, synthetic construct
  misc_feature 1..20: note = CRISPR gRNA sequence
  source 1..20: mol_type = other DNA
tgtggggtctcttttagtat

SEQ ID NO: 27193 - DNA, 20 bp, synthetic construct
  misc_feature 1..20: note = CRISPR gRNA sequence
  source 1..20: mol_type = other DNA
tggggtctcttttagtatgc

SEQ ID NO: 27194 - DNA, 20 bp, synthetic construct
  misc_feature 1..20: note = CRISPR gRNA sequence
  source 1..20: mol_type = other DNA
ttttagtatgcagagcagcc

SEQ ID NO: 27195 - DNA, 20 bp, synthetic construct
  misc_feature 1..20: note = CRISPR gRNA sequence
  source 1..20: mol_type = other DNA
ttagtatgcagagcagccgg

SEQ ID NO: 27196 - DNA, 20 bp, synthetic construct
  misc_feature 1..20: note = CRISPR gRNA sequence
  source 1..20: mol_type = other DNA
tagtatgcagagcagccggg

SEQ ID NO: 27197 - DNA, 20 bp, synthetic construct
  misc_feature 1..20: note = CRISPR gRNA sequence
  source 1..20: mol_type = other DNA
agtatgcagagcagccgggt

SEQ ID NO: 27198 - DNA, 20 bp, synthetic construct
  misc_feature 1..20: note = CRISPR gRNA sequence
  source 1..20: mol_type = other DNA
gtatgcagagcagccgggtg

SEQ ID NO: 27199 - DNA, 20 bp, synthetic construct
  misc_feature 1..20: note = CRISPR gRNA sequence
  source 1..20: mol_type = other DNA
tctccatttttaagatgagg

SEQ ID NO: 27200 - DNA, 20 bp, synthetic construct
  misc_feature 1..20: note = CRISPR gRNA sequence
  source 1..20: mol_type = other DNA
tccatttttaagatgaggat

SEQ ID NO: 27201 - DNA, 20 bp, synthetic construct
  misc_feature 1..20: note = CRISPR gRNA sequence
  source 1..20: mol_type = other DNA
catttttaagatgaggatgt

SEQ ID NO: 27202 - DNA, 20 bp, synthetic construct
  misc_feature 1..20: note = CRISPR gRNA sequence
  source 1..20: mol_type = other DNA
ttaagatgaggatgttgagg

SEQ ID NO: 27203 - DNA, 20 bp, synthetic construct
  misc_feature 1..20: note = CRISPR gRNA sequence
  source 1..20: mol_type = other DNA
taagatgaggatgttgaggc

SEQ ID NO: 27204 - DNA, 20 bp, synthetic construct
  misc_feature 1..20: note = CRISPR gRNA sequence
  source 1..20: mol_type = other DNA
aagatgaggatgttgaggct

SEQ ID NO: 27205 - DNA, 20 bp, synthetic construct
  misc_feature 1..20: note = CRISPR gRNA sequence
  source 1..20: mol_type = other DNA
agatgaggatgttgaggctc

SEQ ID NO: 27206 - DNA, 20 bp, synthetic construct
  misc_feature 1..20: note = CRISPR gRNA sequence
  source 1..20: mol_type = other DNA
aggctcagagaggggcagcc

SEQ ID NO: 27207 - DNA, 20 bp, synthetic construct
  misc_feature 1..20: note = CRISPR gRNA sequence
  source 1..20: mol_type = other DNA
agagaggggcagccacttgc

SEQ ID NO: 27208 - DNA, 20 bp, synthetic construct
  misc_feature 1..20: note = CRISPR gRNA sequence
  source 1..20: mol_type = other DNA
gccacacagcaagtgagagg

SEQ ID NO: 27209 - DNA, 20 bp, synthetic construct
  misc_feature 1..20: note = CRISPR gRNA sequence
  source 1..20: mol_type = other DNA
ccacacagcaagtgagaggc

SEQ ID NO: 27210 - DNA, 20 bp, synthetic construct
  misc_feature 1..20: note = CRISPR gRNA sequence
  source 1..20: mol_type = other DNA
tcccagtcaatatttgaagg

SEQ ID NO: 27211 - DNA, 20 bp, synthetic construct
  misc_feature 1..20: note = CRISPR gRNA sequence
  source 1..20: mol_type = other DNA
ccagtcaatatttgaaggcc

SEQ ID NO: 27212 - DNA, 20 bp, synthetic construct
  misc_feature 1..20: note = CRISPR gRNA sequence
  source 1..20: mol_type = other DNA
gaaggcccgccatgtgccag

SEQ ID NO: 27213 - DNA, 20 bp, synthetic construct
  misc_feature 1..20: note = CRISPR gRNA sequence
  source 1..20: mol_type = other DNA
aaggcccgccatgtgccagt

SEQ ID NO: 27214 - DNA, 20 bp, synthetic construct
  misc_feature 1..20: note = CRISPR gRNA sequence
  source 1..20: mol_type = other DNA
gggtatgtctagaatctgag

SEQ ID NO: 27215 - DNA, 20 bp, synthetic construct
  misc_feature 1..20: note = CRISPR gRNA sequence
  source 1..20: mol_type = other DNA
gaatctgagactgacctggg

SEQ ID NO: 27216 - DNA, 20 bp, synthetic construct
  misc_feature 1..20: note = CRISPR gRNA sequence
  source 1..20: mol_type = other DNA
agactgacctgggctcaaat

SEQ ID NO: 27217 - DNA, 20 bp, synthetic construct
  misc_feature 1..20: note = CRISPR gRNA sequence
  source 1..20: mol_type = other DNA
acctgggctcaaatttgttt

SEQ ID NO: 27218 - DNA, 20 bp, synthetic construct
  misc_feature 1..20: note = CRISPR gRNA sequence
  source 1..20: mol_type = other DNA
ggctcaaatttgttttattc

SEQ ID NO: 27219 - DNA, 20 bp, synthetic construct
  misc_feature 1..20: note = CRISPR gRNA sequence
  source 1..20: mol_type = other DNA
aaatttgttttattctttcc

SEQ ID NO: 27220 - DNA, 20 bp, synthetic construct
  misc_feature 1..20: note = CRISPR gRNA sequence
  source 1..20: mol_type = other DNA
gttttattctttccaccccc

SEQ ID NO: 27221 - DNA, 20 bp, synthetic construct
  misc_feature 1..20: note = CRISPR gRNA sequence
  source 1..20: mol_type = other DNA
ttttattctttccaccccct

SEQ ID NO: 27222 - DNA, 20 bp, synthetic construct
  misc_feature 1..20: note = CRISPR gRNA sequence
  source 1..20: mol_type = other DNA
tattctttccaccccctgag

SEQ ID NO: 27223 - DNA, 20 bp, synthetic construct
  misc_feature 1..20: note = CRISPR gRNA sequence
  source 1..20: mol_type = other DNA
attctttccaccccctgagc

SEQ ID NO: 27224 - DNA, 20 bp, synthetic construct
  misc_feature 1..20: note = CRISPR gRNA sequence
  source 1..20: mol_type = other DNA
ttctttccaccccctgagca

SEQ ID NO: 27225 - DNA, 20 bp, synthetic construct
  misc_feature 1..20: note = CRISPR gRNA sequence
  source 1..20: mol_type = other DNA
tttccaccccctgagcacgc

SEQ ID NO: 27226 - DNA, 20 bp, synthetic construct
  misc_feature 1..20: note = CRISPR gRNA sequence
  source 1..20: mol_type = other DNA
tccaccccctgagcacgcca

SEQ ID NO: 27227 - DNA, 20 bp, synthetic construct
  misc_feature 1..20: note = CRISPR gRNA sequence
  source 1..20: mol_type = other DNA
ccaccccctgagcacgccac

SEQ ID NO: 27228 - DNA, 20 bp, synthetic construct
  misc_feature 1..20: note = CRISPR gRNA sequence
  source 1..20: mol_type = other DNA
caccccctgagcacgccacc

SEQ ID NO: 27229 - DNA, 20 bp, synthetic construct
  misc_feature 1..20: note = CRISPR gRNA sequence
  source 1..20: mol_type = other DNA
agcacgccaccgttttctta

SEQ ID NO: 27230 - DNA, 20 bp, synthetic construct
  misc_feature 1..20: note = CRISPR gRNA sequence
  source 1..20: mol_type = other DNA
tcttatgctaagagtaaagc

SEQ ID NO: 27231 - DNA, 20 bp, synthetic construct
  misc_feature 1..20: note = CRISPR gRNA sequence
  source 1..20: mol_type = other DNA
cttatgctaagagtaaagcc

SEQ ID NO: 27232 - DNA, 20 bp, synthetic construct
  misc_feature 1..20: note = CRISPR gRNA sequence
  source 1..20: mol_type = other DNA
ttatgctaagagtaaagcca

SEQ ID NO: 27233 - DNA, 20 bp, synthetic construct
  misc_feature 1..20: note = CRISPR gRNA sequence
  source 1..20: mol_type = other DNA
atgctaagagtaaagccatg

SEQ ID NO: 27234 - DNA, 20 bp, synthetic construct
  misc_feature 1..20: note = CRISPR gRNA sequence
  source 1..20: mol_type = other DNA
tgctaagagtaaagccatgg

SEQ ID NO: 27235 - DNA, 20 bp, synthetic construct
  misc_feature 1..20: note = CRISPR gRNA sequence
  source 1..20: mol_type = other DNA
agagtaaagccatggcctcc

SEQ ID NO: 27236 - DNA, 20 bp, synthetic construct
  misc_feature 1..20: note = CRISPR gRNA sequence
  source 1..20: mol_type = other DNA
cccttggactctctgcctcc

SEQ ID NO: 27237 - DNA, 20 bp, synthetic construct
  misc_feature 1..20: note = CRISPR gRNA sequence
  source 1..20: mol_type = other DNA
ggactctctgcctccattct

SEQ ID NO: 27238 - DNA, 20 bp, synthetic construct
  misc_feature 1..20: note = CRISPR gRNA sequence
  source 1..20: mol_type = other DNA
gactctctgcctccattctc

SEQ ID NO: 27239 - DNA, 20 bp, synthetic construct
  misc_feature 1..20: note = CRISPR gRNA sequence
  source 1..20: mol_type = other DNA
tctgcctccattctctcctc

SEQ ID NO: 27240 - DNA, 20 bp, synthetic construct
  misc_feature 1..20: note = CRISPR gRNA sequence
  source 1..20: mol_type = other DNA
tgcctccattctctcctctt

SEQ ID NO: 27241 - DNA, 20 bp, synthetic construct
  misc_feature 1..20: note = CRISPR gRNA sequence
  source 1..20: mol_type = other DNA
cctccattctctcctcttcc

SEQ ID NO: 27242 - DNA, 20 bp, synthetic construct
  misc_feature 1..20: note = CRISPR gRNA sequence
  source 1..20: mol_type = other DNA
cattctctcctcttccactc

SEQ ID NO: 27243 - DNA, 20 bp, synthetic construct
  misc_feature 1..20: note = CRISPR gRNA sequence
  source 1..20: mol_type = other DNA
tctcctcttccactccattt

SEQ ID NO: 27244 - DNA, 20 bp, synthetic construct
  misc_feature 1..20: note = CRISPR gRNA sequence
  source 1..20: mol_type = other DNA
tcctcttccactccattttg

SEQ ID NO: 27245 - DNA, 20 bp, synthetic construct
  misc_feature 1..20: note = CRISPR gRNA sequence
  source 1..20: mol_type = other DNA
ctcttccactccattttgta

SEQ ID NO: 27246 - DNA, 20 bp, synthetic construct
  misc_feature 1..20: note = CRISPR gRNA sequence
  source 1..20: mol_type = other DNA
ttccactccattttgtattc

SEQ ID NO: 27247 - DNA, 20 bp, synthetic construct
  misc_feature 1..20: note = CRISPR gRNA sequence
  source 1..20: mol_type = other DNA
ccactccattttgtattcag

SEQ ID NO: 27248 - DNA, 20 bp, synthetic construct
  misc_feature 1..20: note = CRISPR gRNA sequence
  source 1..20: mol_type = other DNA
cactccattttgtattcagc

SEQ ID NO: 27249 - DNA, 20 bp, synthetic construct
  misc_feature 1..20: note = CRISPR gRNA sequence
  source 1..20: mol_type = other DNA
cattttgtattcagcaacca

SEQ ID NO: 27250 - DNA, 20 bp, synthetic construct
  misc_feature 1..20: note = CRISPR gRNA sequence
  source 1..20: mol_type = other DNA
tgtattcagcaaccagacca

SEQ ID NO: 27251 - DNA, 20 bp, synthetic construct
  misc_feature 1..20: note = CRISPR gRNA sequence
  source 1..20: mol_type = other DNA
gtattcagcaaccagaccaa

SEQ ID NO: 27252 - DNA, 20 bp, synthetic construct
  misc_feature 1..20: note = CRISPR gRNA sequence
  source 1..20: mol_type = other DNA
tattcagcaaccagaccaat

SEQ ID NO: 27253 - DNA, 20 bp, synthetic construct
  misc_feature 1..20: note = CRISPR gRNA sequence
  source 1..20: mol_type = other DNA
agcaaccagaccaatcttct

SEQ ID NO: 27254 - DNA, 20 bp, synthetic construct
  misc_feature 1..20: note = CRISPR gRNA sequence
  source 1..20: mol_type = other DNA
ctcagaacttgaatctgatt

SEQ ID NO: 27255 - DNA, 20 bp, synthetic construct
  misc_feature 1..20: note = CRISPR gRNA sequence
  source 1..20: mol_type = other DNA
tcagaacttgaatctgattg

SEQ ID NO: 27256 - DNA, 20 bp, synthetic construct
  misc_feature 1..20: note = CRISPR gRNA sequence
  source 1..20: mol_type = other DNA
agaacttgaatctgattgta

SEQ ID NO: 27257 - DNA, 20 bp, synthetic construct
  misc_feature 1..20: note = CRISPR gRNA sequence
  source 1..20: mol_type = other DNA
gaatctgattgtatcccatc

SEQ ID NO: 27258 - DNA, 20 bp, synthetic construct
  misc_feature 1..20: note = CRISPR gRNA sequence
  source 1..20: mol_type = other DNA
aatctgattgtatcccatcc

SEQ ID NO: 27259 - DNA, 20 bp, synthetic construct
  misc_feature 1..20: note = CRISPR gRNA sequence
  source 1..20: mol_type = other DNA
attgtatcccatccctgctt

SEQ ID NO: 27260 - DNA, 20 bp, synthetic construct
  misc_feature 1..20: note = CRISPR gRNA sequence
  source 1..20: mol_type = other DNA
tatcccatccctgcttacaa

SEQ ID NO: 27261 - DNA, 20 bp, synthetic construct
  misc_feature 1..20: note = CRISPR gRNA sequence
  source 1..20: mol_type = other DNA
cttacaatccttcagggaca

SEQ ID NO: 27262 - DNA, 20 bp, synthetic construct
  misc_feature 1..20: note = CRISPR gRNA sequence
  source 1..20: mol_type = other DNA
acaatccttcagggacactc

SEQ ID NO: 27263 - DNA, 20 bp, synthetic construct
  misc_feature 1..20: note = CRISPR gRNA sequence
  source 1..20: mol_type = other DNA
caatccttcagggacactcc

SEQ ID NO: 27264 - DNA, 20 bp, synthetic construct
  misc_feature 1..20: note = CRISPR gRNA sequence
  source 1..20: mol_type = other DNA
cagggacactccaccactgt

SEQ ID NO: 27265 - DNA, 20 bp, synthetic construct
  misc_feature 1..20: note = CRISPR gRNA sequence
  source 1..20: mol_type = other DNA
agggacactccaccactgtc

SEQ ID NO: 27266 - DNA, 20 bp, synthetic construct
  misc_feature 1..20: note = CRISPR gRNA sequence
  source 1..20: mol_type = other DNA
caccactgtcaggatgaagg

SEQ ID NO: 27267 - DNA, 20 bp, synthetic construct
  misc_feature 1..20: note = CRISPR gRNA sequence
  source 1..20: mol_type = other DNA
tcaggatgaaggctaaattc

SEQ ID NO: 27268 - DNA, 20 bp, synthetic construct
  misc_feature 1..20: note = CRISPR gRNA sequence
  source 1..20: mol_type = other DNA
aattccttaatttggtttca

SEQ ID NO: 27269 - DNA, 20 bp, synthetic construct
  misc_feature 1..20: note = CRISPR gRNA sequence
  source 1..20: mol_type = other DNA
cttaatttggtttcattaag

SEQ ID NO: 27270 - DNA, 20 bp, synthetic construct
  misc_feature 1..20: note = CRISPR gRNA sequence
  source 1..20: mol_type = other DNA
aatttggtttcattaagtcg

SEQ ID NO: 27271 - DNA, 20 bp, synthetic construct
  misc_feature 1..20: note = CRISPR gRNA sequence
  source 1..20: mol_type = other DNA
atttggtttcattaagtcgg

SEQ ID NO: 27272 - DNA, 20 bp, synthetic construct
  misc_feature 1..20: note = CRISPR gRNA sequence
  source 1..20: mol_type = other DNA
ggtttcattaagtcggtctg

SEQ ID NO: 27273 - DNA, 20 bp, synthetic construct
  misc_feature 1..20: note = CRISPR gRNA sequence
  source 1..20: mol_type = other DNA
gtttcattaagtcggtctgc

SEQ ID NO: 27274 - DNA, 20 bp, synthetic construct
  misc_feature 1..20: note = CRISPR gRNA sequence
  source 1..20: mol_type = other DNA
cattaagtcggtctgcaatc

SEQ ID NO: 27275 - DNA, 20 bp, synthetic construct
  misc_feature 1..20: note = CRISPR gRNA sequence
  source 1..20: mol_type = other DNA
attaagtcggtctgcaatct

SEQ ID NO: 27276 - DNA, 20 bp, synthetic construct
  misc_feature 1..20: note = CRISPR gRNA sequence
  source 1..20: mol_type = other DNA
agtcggtctgcaatctgctt

SEQ ID NO: 27277 - DNA, 20 bp, synthetic construct
  misc_feature 1..20: note = CRISPR gRNA sequence
  source 1..20: mol_type = other DNA
caatctgcttgagcatttca

SEQ ID NO: 27278 - DNA, 20 bp, synthetic construct
  misc_feature 1..20: note = CRISPR gRNA sequence
  source 1..20: mol_type = other DNA
cttgagcatttcagcttaat

SEQ ID NO: 27279 - DNA, 20 bp, synthetic construct
  misc_feature 1..20: note = CRISPR gRNA sequence
  source 1..20: mol_type = other DNA
gagcatttcagcttaatcgc

SEQ ID NO: 27280 - DNA, 20 bp, synthetic construct
  misc_feature 1..20: note = CRISPR gRNA sequence
  source 1..20: mol_type = other DNA
agcatttcagcttaatcgcc

SEQ ID NO: 27281 - DNA, 20 bp, synthetic construct
  misc_feature 1..20: note = CRISPR gRNA sequence
  source 1..20: mol_type = other DNA
cagcttaatcgccagaggat

SEQ ID NO: 27282 - DNA, 20 bp, synthetic construct
  misc_feature 1..20: note = CRISPR gRNA sequence
  source 1..20: mol_type = other DNA
agcttaatcgccagaggatt

SEQ ID NO: 27283 - DNA, 20 bp, synthetic construct
  misc_feature 1..20: note = CRISPR gRNA sequence
  source 1..20: mol_type = other DNA
aatcgccagaggattgcttc

SEQ ID NO: 27284 - DNA, 20 bp, synthetic construct
  misc_feature 1..20: note = CRISPR gRNA sequence
  source 1..20: mol_type = other DNA
atcgccagaggattgcttcc

SEQ ID NO: 27285 - DNA, 20 bp, synthetic construct
  misc_feature 1..20: note = CRISPR gRNA sequence
  source 1..20: mol_type = other DNA
cttccatatttccccctaaa

SEQ ID NO: 27286 - DNA, 20 bp, synthetic construct
  misc_feature 1..20: note = CRISPR gRNA sequence
  source 1..20: mol_type = other DNA
ccatatttccccctaaacat

SEQ ID NO: 27287 - DNA, 20 bp, synthetic construct
  misc_feature 1..20: note = CRISPR gRNA sequence
  source 1..20: mol_type = other DNA
catatttccccctaaacata

SEQ ID NO: 27288 - DNA, 20 bp, synthetic construct
  misc_feature 1..20: note = CRISPR gRNA sequence
  source 1..20: mol_type = other DNA
ccccctaaacatactttacc

SEQ ID NO: 27289 - DNA, 20 bp, synthetic construct
  misc_feature 1..20: note = CRISPR gRNA sequence
  source 1..20: mol_type = other DNA
cccctaaacatactttaccc

SEQ ID NO: 27290 - DNA, 20 bp, synthetic construct
  misc_feature 1..20: note = CRISPR gRNA sequence
  source 1..20: mol_type = other DNA
aacatactttacccaagctg

SEQ ID NO: 27291 - DNA, 20 bp, synthetic construct
  misc_feature 1..20: note = CRISPR gRNA sequence
  source 1..20: mol_type = other DNA
tacccaagctgtaaggtcct

SEQ ID NO: 27292 - DNA, 20 bp, synthetic construct
  misc_feature 1..20: note = CRISPR gRNA sequence
  source 1..20: mol_type = other DNA
acccaagctgtaaggtccta

SEQ ID NO: 27293 - DNA, 20 bp, synthetic construct
  misc_feature 1..20: note = CRISPR gRNA sequence
  source 1..20: mol_type = other DNA
cccaagctgtaaggtcctac

SEQ ID NO: 27294 - DNA, 20 bp, synthetic construct
  misc_feature 1..20: note = CRISPR gRNA sequence
  source 1..20: mol_type = other DNA
taaggtcctacataattgtg

SEQ ID NO: 27295 - DNA, 20 bp, synthetic construct
  misc_feature 1..20: note = CRISPR gRNA sequence
  source 1..20: mol_type = other DNA
cataattgtgccaataattt

SEQ ID NO: 27296 - DNA, 20 bp, synthetic construct
  misc_feature 1..20: note = CRISPR gRNA sequence
  source 1..20: mol_type = other DNA
tgccaataatttagcagtga

SEQ ID NO: 27297 - DNA, 20 bp, synthetic construct
  misc_feature 1..20: note = CRISPR gRNA sequence
  source 1..20: mol_type = other DNA
agcagtgagcttcctggtag

SEQ ID NO: 27298 - DNA, 20 bp, synthetic construct
  misc_feature 1..20: note = CRISPR gRNA sequence
  source 1..20: mol_type = other DNA
gcagtgagcttcctggtagc

SEQ ID NO: 27299 - DNA, 20 bp, synthetic construct
  misc_feature 1..20: note = CRISPR gRNA sequence
  source 1..20: mol_type = other DNA
cctggtagccgaagcaaaaa

SEQ ID NO: 27300 - DNA, 20 bp, synthetic construct
  misc_feature 1..20: note = CRISPR gRNA sequence
  source 1..20: mol_type = other DNA
ctggtagccgaagcaaaaag

SEQ ID NO: 27301 - DNA, 20 bp, synthetic construct
  misc_feature 1..20: note = CRISPR gRNA sequence
  source 1..20: mol_type = other DNA
gtagccgaagcaaaaaggga

SEQ ID NO: 27302 - DNA, 20 bp, synthetic construct
  misc_feature 1..20: note = CRISPR gRNA sequence
  source 1..20: mol_type = other DNA
tgtgagttgtgagaaagtag

SEQ ID NO: 27303 - DNA, 20 bp, synthetic construct
  misc_feature 1..20: note = CRISPR gRNA sequence
  source 1..20: mol_type = other DNA
tgagaaagtaggaatcaata

SEQ ID NO: 27304 - DNA, 20 bp, synthetic construct
  misc_feature 1..20: note = CRISPR gRNA sequence
  source 1..20: mol_type = other DNA
gagtggtcatggaaggcttt

SEQ ID NO: 27305 - DNA, 20 bp, synthetic construct
  misc_feature 1..20: note = CRISPR gRNA sequence
  source 1..20: mol_type = other DNA
tctgggaaaggtagaggttg

SEQ ID NO: 27306 - DNA, 20 bp, synthetic construct
  misc_feature 1..20: note = CRISPR gRNA sequence
  source 1..20: mol_type = other DNA
ctgggaaaggtagaggttga

SEQ ID NO: 27307 - DNA, 20 bp, synthetic construct
  misc_feature 1..20: note = CRISPR gRNA sequence
  source 1..20: mol_type = other DNA
tgggaaaggtagaggttgag

SEQ ID NO: 27308 - DNA, 20 bp, synthetic construct
  misc_feature 1..20: note = CRISPR gRNA sequence
  source 1..20: mol_type = other DNA
ggaaaggtagaggttgagct

SEQ ID NO: 27309 - DNA, 20 bp, synthetic construct
  misc_feature 1..20: note = CRISPR gRNA sequence
  source 1..20: mol_type = other DNA
agctaaggaaagaaagtatt

SEQ ID NO: 27310 - DNA, 20 bp, synthetic construct
  misc_feature 1..20: note = CRISPR gRNA sequence
  source 1..20: mol_type = other DNA
aggaaagaaagtattttaat

SEQ ID NO: 27311 - DNA, 20 bp, synthetic construct
  misc_feature 1..20: note = CRISPR gRNA sequence
  source 1..20: mol_type = other DNA
taataggtaggaggaccctt

SEQ ID NO: 27312 - DNA, 20 bp, synthetic construct
  misc_feature 1..20: note = CRISPR gRNA sequence
  source 1..20: mol_type = other DNA
aataggtaggaggacccttc

SEQ ID NO: 27313 - DNA, 20 bp, synthetic construct
  misc_feature 1..20: note = CRISPR gRNA sequence
  source 1..20: mol_type = other DNA
ataggtaggaggacccttca

SEQ ID NO: 27314 - DNA, 20 bp, synthetic construct
  misc_feature 1..20: note = CRISPR gRNA sequence
  source 1..20: mol_type = other DNA
catggagctgcccttccatt

SEQ ID NO: 27315 - DNA, 20 bp, synthetic construct
  misc_feature 1..20: note = CRISPR gRNA sequence
  source 1..20: mol_type = other DNA
atggagctgcccttccatta

SEQ ID NO: 27316 - DNA, 20 bp, synthetic construct
  misc_feature 1..20: note = CRISPR gRNA sequence
  source 1..20: mol_type = other DNA
cccttccattaaggtctagc

SEQ ID NO: 27317 - DNA, 20 bp, synthetic construct
  misc_feature 1..20: note = CRISPR gRNA sequence
  source 1..20: mol_type = other DNA
ccattaaggtctagcctggt

SEQ ID NO: 27318 - DNA, 20 bp, synthetic construct
  misc_feature 1..20: note = CRISPR gRNA sequence
  source 1..20: mol_type = other DNA
cattaaggtctagcctggtc

SEQ ID NO: 27319 - DNA, 20 bp, synthetic construct
  misc_feature 1..20: note = CRISPR gRNA sequence
  source 1..20: mol_type = other DNA
aggtctagcctggtcaccgt

SEQ ID NO: 27320 - DNA, 20 bp, synthetic construct
  misc_feature 1..20: note = CRISPR gRNA sequence
  source 1..20: mol_type = other DNA
gcctggtcaccgtgcctggg

SEQ ID NO: 27321 - DNA, 20 bp, synthetic construct
  misc_feature 1..20: note = CRISPR gRNA sequence
  source 1..20: mol_type = other DNA
gtcaccgtgcctgggtctga

SEQ ID NO: 27322 - DNA, 20 bp, synthetic construct
  misc_feature 1..20: note = CRISPR gRNA sequence
  source 1..20: mol_type = other DNA
ggtctgaggccctccctcca

SEQ ID NO: 27323 - DNA, 20 bp, synthetic construct
  misc_feature 1..20: note = CRISPR gRNA sequence
  source 1..20: mol_type = other DNA
aggccctccctccacagggc

SEQ ID NO: 27324 - DNA, 20 bp, synthetic construct
  misc_feature 1..20: note = CRISPR gRNA sequence
  source 1..20: mol_type = other DNA
cctccacagggctgccttga

SEQ ID NO: 27325 - DNA, 20 bp, synthetic construct
  misc_feature 1..20: note = CRISPR gRNA sequence
  source 1..20: mol_type = other DNA
cacagggctgccttgagcga

SEQ ID NO: 27326 - DNA, 20 bp, synthetic construct
  misc_feature 1..20: note = CRISPR gRNA sequence
  source 1..20: mol_type = other DNA
ccttgagcgacacggtggcg

SEQ ID NO: 27327 - DNA, 20 bp, synthetic construct
  misc_feature 1..20: note = CRISPR gRNA sequence
  source 1..20: mol_type = other DNA
gagcgacacggtggcgctgt

SEQ ID NO: 27328 - DNA, 20 bp, synthetic construct
  misc_feature 1..20: note = CRISPR gRNA sequence
  source 1..20: mol_type = other DNA
agcgacacggtggcgctgtg

SEQ ID NO: 27329 - DNA, 20 bp, synthetic construct
  misc_feature 1..20: note = CRISPR gRNA sequence
  source 1..20: mol_type = other DNA
tgggagtccctgcagcagca

SEQ ID NO: 27330 - DNA, 20 bp, synthetic construct
  misc_feature 1..20: note = CRISPR gRNA sequence
  source 1..20: mol_type = other DNA
cagcagcatggggagaccaa

SEQ ID NO: 27331 - DNA, 20 bp, synthetic construct
  misc_feature 1..20: note = CRISPR gRNA sequence
  source 1..20: mol_type = other DNA
cttcaggcagcagaggagaa

SEQ ID NO: 27332 - DNA, 20 bp, synthetic construct
  misc_feature 1..20: note = CRISPR gRNA sequence
  source 1..20: mol_type = other DNA
caggcagcagaggagaagtt

SEQ ID NO: 27333 - DNA, 20 bp, synthetic construct
  misc_feature 1..20: note = CRISPR gRNA sequence
  source 1..20: mol_type = other DNA
aggcagcagaggagaagttc

SEQ ID NO: 27334 - DNA, 20 bp, synthetic construct
  misc_feature 1..20: note = CRISPR gRNA sequence
  source 1..20: mol_type = other DNA
accatcgagcctttcaaagc

SEQ ID NO: 27335 - DNA, 20 bp, synthetic construct
  misc_feature 1..20: note = CRISPR gRNA sequence
  source 1..20: mol_type = other DNA
tcaaagccaagtccctgaag

SEQ ID NO: 27336 - DNA, 20 bp, synthetic construct
  misc_feature 1..20: note = CRISPR gRNA sequence
  source 1..20: mol_type = other DNA
caaagccaagtccctgaagg

SEQ ID NO: 27337 - DNA, 20 bp, synthetic construct
  misc_feature 1..20: note = CRISPR gRNA sequence
  source 1..20: mol_type = other DNA
aaagccaagtccctgaagga

SEQ ID NO: 27338 - DNA, 20 bp, synthetic construct
  misc_feature 1..20: note = CRISPR gRNA sequence
  source 1..20: mol_type = other DNA
aaggatgtggaagacctggg

SEQ ID NO: 27339 - DNA, 20 bp, synthetic construct
  misc_feature 1..20: note = CRISPR gRNA sequence
  source 1..20: mol_type = other DNA
ggaaagcttgtgcagactca

SEQ ID NO: 27340 - DNA, 20 bp, synthetic construct
  misc_feature 1..20: note = CRISPR gRNA sequence
  source 1..20: mol_type = other DNA
gtgcagactcagaggtgaga

SEQ ID NO: 27341 - DNA, 20 bp, synthetic construct
  misc_feature 1..20: note = CRISPR gRNA sequence
  source 1..20: mol_type = other DNA
tgcagactcagaggtgagag

SEQ ID NO: 27342 - DNA, 20 bp, synthetic construct
  misc_feature 1..20: note = CRISPR gRNA sequence
  source 1..20: mol_type = other DNA
agaggtgagaggagaggcgg

SEQ ID NO: 27343 - DNA, 20 bp, synthetic construct
  misc_feature 1..20: note = CRISPR gRNA sequence
  source 1..20: mol_type = other DNA
acgccatgcaggttgaggac

SEQ ID NO: 27344 - DNA, 20 bp, synthetic construct
  misc_feature 1..20: note = CRISPR gRNA sequence
  source 1..20: mol_type = other DNA
aggacatgtaggacccattc

SEQ ID NO: 27345 - DNA, 20 bp, synthetic construct
  misc_feature 1..20: note = CRISPR gRNA sequence
  source 1..20: mol_type = other DNA
tcaagtttgtcatgggcatt

SEQ ID NO: 27346 - DNA, 20 bp, synthetic construct
  misc_feature 1..20: note = CRISPR gRNA sequence
  source 1..20: mol_type = other DNA
aagtttgtcatgggcatttc

SEQ ID NO: 27347 - DNA, 20 bp, synthetic construct
  misc_feature 1..20: note = CRISPR gRNA sequence
  source 1..20: mol_type = other DNA
gtcatgggcatttccagtgc

SEQ ID NO: 27348 - DNA, 20 bp, synthetic construct
  misc_feature 1..20: note = CRISPR gRNA sequence
  source 1..20: mol_type = other DNA
tcatgggcatttccagtgcc

SEQ ID NO: 27349 - DNA, 20 bp, synthetic construct
  misc_feature 1..20: note = CRISPR gRNA sequence
  source 1..20: mol_type = other DNA
ccagtgccccctgtcctctg

SEQ ID NO: 27350 - DNA, 20 bp, synthetic construct
  misc_feature 1..20: note = CRISPR gRNA sequence
  source 1..20: mol_type = other DNA
cagtgccccctgtcctctgg

SEQ ID NO: 27351 - DNA, 20 bp, synthetic construct
  misc_feature 1..20: note = CRISPR gRNA sequence
  source 1..20: mol_type = other DNA
tcctctgggacaccccatgc

SEQ ID NO: 27352 - DNA, 20 bp, synthetic construct
  misc_feature 1..20: note = CRISPR gRNA sequence
  source 1..20: mol_type = other DNA
tgggacaccccatgccctct

SEQ ID NO: 27353 - DNA, 20 bp, synthetic construct
  misc_feature 1..20: note = CRISPR gRNA sequence
  source 1..20: mol_type = other DNA
ggacaccccatgccctcttt

SEQ ID NO: 27354 - DNA, 20 bp, synthetic construct
  misc_feature 1..20: note = CRISPR gRNA sequence
  source 1..20: mol_type = other DNA
tttctgggcaatggctaacc

SEQ ID NO: 27355 - DNA, 20 bp, synthetic construct
  misc_feature 1..20: note = CRISPR gRNA sequence
  source 1..20: mol_type = other DNA
tctgggcaatggctaaccag

SEQ ID NO: 27356 - DNA, 20 bp, synthetic construct
  misc_feature 1..20: note = CRISPR gRNA sequence
  source 1..20: mol_type = other DNA
ctgggcaatggctaaccaga

SEQ ID NO: 27357 - DNA, 20 bp, synthetic construct
  misc_feature 1..20: note = CRISPR gRNA sequence
  source 1..20: mol_type = other DNA
tgggcaatggctaaccagag

SEQ ID NO: 27358 - DNA, 20 bp, synthetic construct
  misc_feature 1..20: note = CRISPR gRNA sequence
  source 1..20: mol_type = other DNA
ggcaatggctaaccagagtc

SEQ ID NO: 27359 - DNA, 20 bp, synthetic construct
  misc_feature 1..20: note = CRISPR gRNA sequence
  source 1..20: mol_type = other DNA
accagagtctctcactgcac

SEQ ID NO: 27360 - DNA, 20 bp, synthetic construct
  misc_feature 1..20: note = CRISPR gRNA sequence
  source 1..20: mol_type = other DNA
tcactgcactcgctgcccag

SEQ ID NO: 27361 - DNA, 20 bp, synthetic construct
  misc_feature 1..20: note = CRISPR gRNA sequence
  source 1..20: mol_type = other DNA
actgcactcgctgcccaggc

SEQ ID NO: 27362 - DNA, 20 bp, synthetic construct
  misc_feature 1..20: note = CRISPR gRNA sequence
  source 1..20: mol_type = other DNA
cactcgctgcccaggcggag

SEQ ID NO: 27363 - DNA, 20 bp, synthetic construct
  misc_feature 1..20: note = CRISPR gRNA sequence
  source 1..20: mol_type = other DNA
gctgcccaggcggagcctct

SEQ ID NO: 27364 - DNA, 20 bp, synthetic construct
  misc_feature 1..20: note = CRISPR gRNA sequence
  source 1..20: mol_type = other DNA
cccaggcggagcctctagaa

SEQ ID NO: 27365 - DNA, 20 bp, synthetic construct
  misc_feature 1..20: note = CRISPR gRNA sequence
  source 1..20: mol_type = other DNA
tagaattgaaaactttgctg

SEQ ID NO: 27366 - DNA, 20 bp, synthetic construct
  misc_feature 1..20: note = CRISPR gRNA sequence
  source 1..20: mol_type = other DNA
gaattgaaaactttgctgca

SEQ ID NO: 27367 - DNA, 20 bp, synthetic construct
  misc_feature 1..20: note = CRISPR gRNA sequence
  source 1..20: mol_type = other DNA
aaaactttgctgcattcaaa

SEQ ID NO: 27368 - DNA, 20 bp, synthetic construct
  misc_feature 1..20: note = CRISPR gRNA sequence
  source 1..20: mol_type = other DNA
tgctgcattcaaaacctgcc

SEQ ID NO: 27369 - DNA, 20 bp, synthetic construct
  misc_feature 1..20: note = CRISPR gRNA sequence
  source 1..20: mol_type = other DNA
gctgcattcaaaacctgcca

SEQ ID NO: 27370 - DNA, 20 bp, synthetic construct
  misc_feature 1..20: note = CRISPR gRNA sequence
  source 1..20: mol_type = other DNA
ctgcattcaaaacctgccat

SEQ ID NO: 27371 - DNA, 20 bp, synthetic construct
  misc_feature 1..20: note = CRISPR gRNA sequence
  source 1..20: mol_type = other DNA
cattcaaaacctgccatcat

SEQ ID NO: 27372 - DNA, 20 bp, synthetic construct
  misc_feature 1..20: note = CRISPR gRNA sequence
  source 1..20: mol_type = other DNA
aaaacctgccatcatgtgcc

SEQ ID NO: 27373 - DNA, 20 bp, synthetic construct
  misc_feature 1..20: note = CRISPR gRNA sequence
  source 1..20: mol_type = other DNA
ccatcatgtgcccaagtctt

SEQ ID NO: 27374 - DNA, 20 bp, synthetic construct
  misc_feature 1..20: note = CRISPR gRNA sequence
  source 1..20: mol_type = other DNA
agctaaagccatggagaacc

SEQ ID NO: 27375 - DNA, 20 bp, synthetic construct
  misc_feature 1..20: note = CRISPR gRNA sequence
  source 1..20: mol_type = other DNA
gctaaagccatggagaacct

SEQ ID NO: 27376 - DNA, 20 bp, synthetic construct
  misc_feature 1..20: note = CRISPR gRNA sequence
  source 1..20: mol_type = other DNA
aagccatggagaacctctcc

SEQ ID NO: 27377 - DNA, 20 bp, synthetic construct
  misc_feature 1..20: note = CRISPR gRNA sequence
  source 1..20: mol_type = other DNA
tccccttctaggagttaaca

SEQ ID NO: 27378 - DNA, 20 bp, synthetic construct
  misc_feature 1..20: note = CRISPR gRNA sequence
  source 1..20: mol_type = other DNA
cccttctaggagttaacaag

SEQ ID NO: 27379 - DNA, 20 bp, synthetic construct
  misc_feature 1..20: note = CRISPR gRNA sequence
  source 1..20: mol_type = other DNA
ctaggagttaacaaggatgc

SEQ ID NO: 27380 - DNA, 20 bp, synthetic construct
  misc_feature 1..20: note = CRISPR gRNA sequence
  source 1..20: mol_type = other DNA
taggagttaacaaggatgcc

SEQ ID NO: 27381 - DNA, 20 bp, synthetic construct
  misc_feature 1..20: note = CRISPR gRNA sequence
  source 1..20: mol_type = other DNA
ggagttaacaaggatgcctt

SEQ ID NO: 27382 - DNA, 20 bp, synthetic construct
  misc_feature 1..20: note = CRISPR gRNA sequence
  source 1..20: mol_type = other DNA
acaaggatgccttgtgcacc

SEQ ID NO: 27383 - DNA, 20 bp, synthetic construct
  misc_feature 1..20: note = CRISPR gRNA sequence
  source 1..20: mol_type = other DNA
gtgcacctagtaacagaagt

SEQ ID NO: 27384 - DNA, 20 bp, synthetic construct
  misc_feature 1..20: note = CRISPR gRNA sequence
  source 1..20: mol_type = other DNA
tgcacctagtaacagaagtg

SEQ ID NO: 27385 - DNA, 20 bp, synthetic construct
  misc_feature 1..20: note = CRISPR gRNA sequence
  source 1..20: mol_type = other DNA
gtaacagaagtgacacctac

SEQ ID NO: 27386 - DNA, 20 bp, synthetic construct
  misc_feature 1..20: note = CRISPR gRNA sequence
  source 1..20: mol_type = other DNA
ctgccaccctttgaggcatt

SEQ ID NO: 27387 - DNA, 20 bp, synthetic construct
  misc_feature 1..20: note = CRISPR gRNA sequence
  source 1..20: mol_type = other DNA
ccaccctttgaggcatttag

SEQ ID NO: 27388 - DNA, 20 bp, synthetic construct
  misc_feature 1..20: note = CRISPR gRNA sequence
  source 1..20: mol_type = other DNA
tgaggcatttaggacaactg

SEQ ID NO: 27389 - DNA, 20 bp, synthetic construct
  misc_feature 1..20: note = CRISPR gRNA sequence
  source 1..20: mol_type = other DNA
gaggcatttaggacaactgt

SEQ ID NO: 27390 - DNA, 20 bp, synthetic construct
  misc_feature 1..20: note = CRISPR gRNA sequence
  source 1..20: mol_type = other DNA
aggcatttaggacaactgtt

SEQ ID NO: 27391 - DNA, 20 bp, synthetic construct
  misc_feature 1..20: note = CRISPR gRNA sequence
  source 1..20: mol_type = other DNA
aggacaactgttgtcccaaa

SEQ ID NO: 27392 - DNA, 20 bp, synthetic construct
  misc_feature 1..20: note = CRISPR gRNA sequence
  source 1..20: mol_type = other DNA
ggacaactgttgtcccaaat

SEQ ID NO: 27393 - DNA, 20 bp, synthetic construct
  misc_feature 1..20: note = CRISPR gRNA sequence
  source 1..20: mol_type = other DNA
ttgtcccaaatttatagacg

SEQ ID NO: 27394 - DNA, 20 bp, synthetic construct
  misc_feature 1..20: note = CRISPR gRNA sequence
  source 1..20: mol_type = other DNA
tcccaaatttatagacggca

SEQ ID NO: 27395 - DNA, 20 bp, synthetic construct
  misc_feature 1..20: note = CRISPR gRNA sequence
  source 1..20: mol_type = other DNA
atagacggcagagctaaggt

SEQ ID NO: 27396 - DNA, 20 bp, synthetic construct
  misc_feature 1..20: note = CRISPR gRNA sequence
  source 1..20: mol_type = other DNA
tagacggcagagctaaggtc

SEQ ID NO: 27397 - DNA, 20 bp, synthetic construct
  misc_feature 1..20: note = CRISPR gRNA sequence
  source 1..20: mol_type = other DNA
aggtccagaaggcagacaaa

SEQ ID NO: 27398 - DNA, 20 bp, synthetic construct
  misc_feature 1..20: note = CRISPR gRNA sequence
  source 1..20: mol_type = other DNA
gattacagaacaagttaact

SEQ ID NO: 27399 - DNA, 20 bp, synthetic construct
  misc_feature 1..20: note = CRISPR gRNA sequence
  source 1..20: mol_type = other DNA
attacagaacaagttaactg

SEQ ID NO: 27400 - DNA, 20 bp, synthetic construct
  misc_feature 1..20: note = CRISPR gRNA sequence
  source 1..20: mol_type = other DNA
cagaacaagttaactgtctt

SEQ ID NO: 27401 - DNA, 20 bp, synthetic construct
  misc_feature 1..20: note = CRISPR gRNA sequence
  source 1..20: mol_type = other DNA
actgtctttcattcattcct

SEQ ID NO: 27402 - DNA, 20 bp, synthetic construct
  misc_feature 1..20: note = CRISPR gRNA sequence
  source 1..20: mol_type = other DNA
tctttcattcattccttcat

SEQ ID NO: 27403 - DNA, 20 bp, synthetic construct
  misc_feature 1..20: note = CRISPR gRNA sequence
  source 1..20: mol_type = other DNA
tcattcattccttcatcaca

SEQ ID NO: 27404 - DNA, 20 bp, synthetic construct
  misc_feature 1..20: note = CRISPR gRNA sequence
  source 1..20: mol_type = other DNA
cattcattccttcatcacac

SEQ ID NO: 27405 - DNA, 20 bp, synthetic construct
  misc_feature 1..20: note = CRISPR gRNA sequence
  source 1..20: mol_type = other DNA
attcattccttcatcacaca

SEQ ID NO: 27406 - DNA, 20 bp, synthetic construct
  misc_feature 1..20: note = CRISPR gRNA sequence
  source 1..20: mol_type = other DNA
attccttcatcacacattgt

SEQ ID NO: 27407 - DNA, 20 bp, synthetic construct
  misc_feature 1..20: note = CRISPR gRNA sequence
  source 1..20: mol_type = other DNA
cttcatcacacattgtttga

SEQ ID NO: 27408 - DNA, 20 bp, synthetic construct
  misc_feature 1..20: note = CRISPR gRNA sequence
  source 1..20: mol_type = other DNA
catcacacattgtttgagcg

SEQ ID NO: 27409 - DNA, 20 bp, synthetic construct
  misc_feature 1..20: note = CRISPR gRNA sequence
  source 1..20: mol_type = other DNA
atcacacattgtttgagcgc

SEQ ID NO: 27410 - DNA, 20 bp, synthetic construct
  misc_feature 1..20: note = CRISPR gRNA sequence
  source 1..20: mol_type = other DNA
tttgagcgcctcttaagtgc

SEQ ID NO: 27411 - DNA, 20 bp, synthetic construct
  misc_feature 1..20: note = CRISPR gRNA sequence
  source 1..20: mol_type = other DNA
gagcgcctcttaagtgctgt

SEQ ID NO: 27412 - DNA, 20 bp, synthetic construct
  misc_feature 1..20: note = CRISPR gRNA sequence
  source 1..20: mol_type = other DNA
agcgcctcttaagtgctgtc

SEQ ID NO: 27413 - DNA, 20 bp, synthetic construct
  misc_feature 1..20: note = CRISPR gRNA sequence
  source 1..20: mol_type = other DNA
ttaagtgctgtctgggatag

SEQ ID NO: 27414 - DNA, 20 bp, synthetic construct
  misc_feature 1..20: note = CRISPR gRNA sequence
  source 1..20: mol_type = other DNA
aagtgctgtctgggataggt

SEQ ID NO: 27415 - DNA, 20 bp, synthetic construct
  misc_feature 1..20: note = CRISPR gRNA sequence
  source 1..20: mol_type = other DNA
agtgctgtctgggataggta

SEQ ID NO: 27416 - DNA, 20 bp, synthetic construct
  misc_feature 1..20: note = CRISPR gRNA sequence
  source 1..20: mol_type = other DNA
tctgggataggtactggtaa

SEQ ID NO: 27417 - DNA, 20 bp, synthetic construct
  misc_feature 1..20: note = CRISPR gRNA sequence
  source 1..20: mol_type = other DNA
ggataggtactggtaagtgc

SEQ ID NO: 27418 - DNA, 20 bp, synthetic construct
  misc_feature 1..20: note = CRISPR gRNA sequence
  source 1..20: mol_type = other DNA
gtaagtgcctaatctgaggc

SEQ ID NO: 27419 - DNA, 20 bp, synthetic construct
  misc_feature 1..20: note = CRISPR gRNA sequence
  source 1..20: mol_type = other DNA
atctgaggctcatttccatg

SEQ ID NO: 27420 - DNA, 20 bp, synthetic construct
  misc_feature 1..20: note = CRISPR gRNA sequence
  source 1..20: mol_type = other DNA
aggctcatttccatgaaaga

SEQ ID NO: 27421 - DNA, 20 bp, synthetic construct
  misc_feature 1..20: note = CRISPR gRNA sequence
  source 1..20: mol_type = other DNA
atttccatgaaagatacagt

SEQ ID NO: 27422 - DNA, 20 bp, synthetic construct
  misc_feature 1..20: note = CRISPR gRNA sequence
  source 1..20: mol_type = other DNA
ccatgaaagatacagtcctg

SEQ ID NO: 27423 - DNA, 20 bp, synthetic construct
  misc_feature 1..20: note = CRISPR gRNA sequence
  source 1..20: mol_type = other DNA
catgaaagatacagtcctga

SEQ ID NO: 27424 - DNA, 20 bp, synthetic construct
  misc_feature 1..20: note = CRISPR gRNA sequence
  source 1..20: mol_type = other DNA
agatcttttatttttatttt

SEQ ID NO: 27425 - DNA, 20 bp, synthetic construct
  misc_feature 1..20: note = CRISPR gRNA sequence
  source 1..20: mol_type = other DNA
ttatttttatttttattatt

SEQ ID NO: 27426 - DNA, 20 bp, synthetic construct
  misc_feature 1..20: note = CRISPR gRNA sequence
  source 1..20: mol_type = other DNA
tatttttatttttattattt

SEQ ID NO: 27427 - DNA, 20 bp, synthetic construct
  misc_feature 1..20: note = CRISPR gRNA sequence
  source 1..20: mol_type = other DNA
atttttatttttattatttc

SEQ ID NO: 27428 - DNA, 20 bp, synthetic construct
  misc_feature 1..20: note = CRISPR gRNA sequence
  source 1..20: mol_type = other DNA
tttttatttttattatttct

SEQ ID NO: 27429 - DNA, 20 bp, synthetic construct
  misc_feature 1..20: note = CRISPR gRNA sequence
  source 1..20: mol_type = other DNA
ttatttttattatttcttaa

SEQ ID NO: 27430 - DNA, 20 bp, synthetic construct
  misc_feature 1..20: note = CRISPR gRNA sequence
  source 1..20: mol_type = other DNA
tatttttattatttcttaaa

SEQ ID NO: 27431 - DNA, 20 bp, synthetic construct
  misc_feature 1..20: note = CRISPR gRNA sequence
  source 1..20: mol_type = other DNA
atttttattatttcttaaag

SEQ ID NO: 27432 - DNA, 20 bp, synthetic construct
  misc_feature 1..20: note = CRISPR gRNA sequence
  source 1..20: mol_type = other DNA
tttttattatttcttaaaga

SEQ ID NO: 27433 - DNA, 20 bp, synthetic construct
  misc_feature 1..20: note = CRISPR gRNA sequence
  source 1..20: mol_type = other DNA
ttattatttcttaaagacag

SEQ ID NO: 27434 - DNA, 20 bp, synthetic construct
  misc_feature 1..20: note = CRISPR gRNA sequence
  source 1..20: mol_type = other DNA
tattatttcttaaagacagg

SEQ ID NO: 27435 - DNA, 20 bp, synthetic construct
  misc_feature 1..20: note = CRISPR gRNA sequence
  source 1..20: mol_type = other DNA
attatttcttaaagacaggg

SEQ ID NO: 27436 - DNA, 20 bp, synthetic construct
  misc_feature 1..20: note = CRISPR gRNA sequence
  source 1..20: mol_type = other DNA
ttatttcttaaagacagggt

SEQ ID NO: 27437 - DNA, 20 bp, synthetic construct
  misc_feature 1..20: note = CRISPR gRNA sequence
  source 1..20: mol_type = other DNA
tttcttaaagacagggtctc

SEQ ID NO: 27438 - DNA, 20 bp, synthetic construct
  misc_feature 1..20: note = CRISPR gRNA sequence
  source 1..20: mol_type = other DNA
cttaaagacagggtctcgct

SEQ ID NO: 27439 - DNA, 20 bp, synthetic construct
  misc_feature 1..20: note = CRISPR gRNA sequence
  source 1..20: mol_type = other DNA
ttaaagacagggtctcgctg

SEQ ID NO: 27440 - DNA, 20 bp, synthetic construct
  misc_feature 1..20: note = CRISPR gRNA sequence
  source 1..20: mol_type = other DNA
aaagacagggtctcgctgtg

SEQ ID NO: 27441 - DNA, 20 bp, synthetic construct
  misc_feature 1..20: note = CRISPR gRNA sequence
  source 1..20: mol_type = other DNA
aagacagggtctcgctgtgt

SEQ ID NO: 27442 - DNA, 20 bp, synthetic construct
  misc_feature 1..20: note = CRISPR gRNA sequence
  source 1..20: mol_type = other DNA
gctgtgtctaccaggctaga

SEQ ID NO: 27443 - DNA, 20 bp, synthetic construct
  misc_feature 1..20: note = CRISPR gRNA sequence
  source 1..20: mol_type = other DNA
tgtctaccaggctagaatac

SEQ ID NO: 27444 - DNA, 20 bp, synthetic construct
  misc_feature 1..20: note = CRISPR gRNA sequence
  source 1..20: mol_type = other DNA
ccaggctagaatacagtagt

SEQ ID NO: 27445 - DNA, 20 bp, synthetic construct
  misc_feature 1..20: note = CRISPR gRNA sequence
  source 1..20: mol_type = other DNA
gaatacagtagtgcgatcat

SEQ ID NO: 27446 - DNA, 20 bp, synthetic construct
  misc_feature 1..20: note = CRISPR gRNA sequence
  source 1..20: mol_type = other DNA
actgtagcttcggaactcct

SEQ ID NO: 27447 - DNA, 20 bp, synthetic construct
  misc_feature 1..20: note = CRISPR gRNA sequence
  source 1..20: mol_type = other DNA
ctgtagcttcggaactcctg

SEQ ID NO: 27448 - DNA, 20 bp, synthetic construct
  misc_feature 1..20: note = CRISPR gRNA sequence
  source 1..20: mol_type = other DNA
tagcttcggaactcctgagc

SEQ ID NO: 27449 - DNA, 20 bp, synthetic construct
  misc_feature 1..20: note = CRISPR gRNA sequence
  source 1..20: mol_type = other DNA
cggaactcctgagctcaagc

SEQ ID NO: 27450 - DNA, 20 bp, synthetic construct
  misc_feature 1..20: note = CRISPR gRNA sequence
  source 1..20: mol_type = other DNA
ggaactcctgagctcaagcg

SEQ ID NO: 27451 - DNA, 20 bp, synthetic construct
  misc_feature 1..20: note = CRISPR gRNA sequence
  source 1..20: mol_type = other DNA
ctgagctcaagcgatcctcc

SEQ ID NO: 27452 - DNA, 20 bp, synthetic construct
  misc_feature 1..20: note = CRISPR gRNA sequence
  source 1..20: mol_type = other DNA
agctcaagcgatcctcctgc

SEQ ID NO: 27453 - DNA, 20 bp, synthetic construct
  misc_feature 1..20: note = CRISPR gRNA sequence
  source 1..20: mol_type = other DNA
aagcgatcctcctgcctcag

SEQ ID NO: 27454 - DNA, 20 bp, synthetic construct
  misc_feature 1..20: note = CRISPR gRNA sequence
  source 1..20: mol_type = other DNA
ctgcctcagcctcccaagta

SEQ ID NO: 27455 - DNA, 20 bp, synthetic construct
  misc_feature 1..20: note = CRISPR gRNA sequence
  source 1..20: mol_type = other DNA
cctcagcctcccaagtagct

SEQ ID NO: 27456 - DNA, 20 bp, synthetic construct
  misc_feature 1..20: note = CRISPR gRNA sequence
  source 1..20: mol_type = other DNA
agcctcccaagtagctggga

SEQ ID NO: 27457 - DNA, 20 bp, synthetic construct
  misc_feature 1..20: note = CRISPR gRNA sequence
  source 1..20: mol_type = other DNA
ccaagtagctgggattatag

SEQ ID NO: 27458 - DNA, 20 bp, synthetic construct
  misc_feature 1..20: note = CRISPR gRNA sequence
  source 1..20: mol_type = other DNA
ggattataggtgcacgtcat

SEQ ID NO: 27459 - DNA, 20 bp, synthetic construct
  misc_feature 1..20: note = CRISPR gRNA sequence
  source 1..20: mol_type = other DNA
taggtgcacgtcatcacacc

SEQ ID NO: 27460 - DNA, 20 bp, synthetic construct
  misc_feature 1..20: note = CRISPR gRNA sequence
  source 1..20: mol_type = other DNA
tttaagtttttgtagacaca

SEQ ID NO: 27461 - DNA, 20 bp, synthetic construct
  misc_feature 1..20: note = CRISPR gRNA sequence
  source 1..20: mol_type = other DNA
ttaagtttttgtagacacag

SEQ ID NO: 27462 - DNA, 20 bp, synthetic construct
  misc_feature 1..20: note = CRISPR gRNA sequence
  source 1..20: mol_type = other DNA
taagtttttgtagacacagg

SEQ ID NO: 27463 - DNA, 20 bp, synthetic construct
  misc_feature 1..20: note = CRISPR gRNA sequence
  source 1..20: mol_type = other DNA
aagtttttgtagacacaggg

SEQ ID NO: 27464 - DNA, 20 bp, synthetic construct
  misc_feature 1..20: note = CRISPR gRNA sequence
  source 1..20: mol_type = other DNA
agtttttgtagacacaggga

SEQ ID NO: 27465 - DNA, 20 bp, synthetic construct
  misc_feature 1..20: note = CRISPR gRNA sequence
  source 1..20: mol_type = other DNA
ttgtagacacagggatcttg

SEQ ID NO: 27466 - DNA, 20 bp, synthetic construct
  misc_feature 1..20: note = CRISPR gRNA sequence
  source 1..20: mol_type = other DNA
tgtagacacagggatcttgc

SEQ ID NO: 27467 - DNA, 20 bp, synthetic construct
  misc_feature 1..20: note = CRISPR gRNA sequence
  source 1..20: mol_type = other DNA
gtagacacagggatcttgct

SEQ ID NO: 27468 - DNA, 20 bp, synthetic construct
  misc_feature 1..20: note = CRISPR gRNA sequence
  source 1..20: mol_type = other DNA
tagacacagggatcttgcta

SEQ ID NO: 27469 - DNA, 20 bp, synthetic construct
  misc_feature 1..20: note = CRISPR gRNA sequence
  source 1..20: mol_type = other DNA
gctatgttgcccaggctggt

SEQ ID NO: 27470 - DNA, 20 bp, synthetic construct
  misc_feature 1..20: note = CRISPR gRNA sequence
  source 1..20: mol_type = other DNA
ctatgttgcccaggctggtc

SEQ ID NO: 27471 - DNA, 20 bp, synthetic construct
  misc_feature 1..20: note = CRISPR gRNA sequence
  source 1..20: mol_type = other DNA
tgttgcccaggctggtcttg

SEQ ID NO: 27472 - DNA, 20 bp, synthetic construct
  misc_feature 1..20: note = CRISPR gRNA sequence
  source 1..20: mol_type = other DNA
cccaggctggtcttgaactc

SEQ ID NO: 27473 - DNA, 20 bp, synthetic construct
  misc_feature 1..20: note = CRISPR gRNA sequence
  source 1..20: mol_type = other DNA
gtcttgaactcctggcctca

SEQ ID NO: 27474 - DNA, 20 bp, synthetic construct
  misc_feature 1..20: note = CRISPR gRNA sequence
  source 1..20: mol_type = other DNA
gaactcctggcctcaagcaa

SEQ ID NO: 27475 - DNA, 20 bp, synthetic construct
  misc_feature 1..20: note = CRISPR gRNA sequence
  source 1..20: mol_type = other DNA
aactcctggcctcaagcaat

SEQ ID NO: 27476 - DNA, 20 bp, synthetic construct
  misc_feature 1..20: note = CRISPR gRNA sequence
  source 1..20: mol_type = other DNA
ctggcctcaagcaatcctcc

SEQ ID NO: 27477 - DNA, 20 bp, synthetic construct
  misc_feature 1..20: note = CRISPR gRNA sequence
  source 1..20: mol_type = other DNA
gcctcaagcaatcctcctgc

SEQ ID NO: 27478 - DNA, 20 bp, synthetic construct
  misc_feature 1..20: note = CRISPR gRNA sequence
  source 1..20: mol_type = other DNA
aagcaatcctcctgcctcag

SEQ ID NO: 27479 - DNA, 20 bp, synthetic construct
  misc_feature 1..20: note = CRISPR gRNA sequence
  source 1..20: mol_type = other DNA
ctgcctcagcctcccaaagt

SEQ ID NO: 27480 - DNA, 20 bp, synthetic construct
  misc_feature 1..20: note = CRISPR gRNA sequence
  source 1..20: mol_type = other DNA
cctcagcctcccaaagtgct

SEQ ID NO: 27481 - DNA, 20 bp, synthetic construct
  misc_feature 1..20: note = CRISPR gRNA sequence
  source 1..20: mol_type = other DNA
agcctcccaaagtgctggga

SEQ ID NO: 27482 - DNA, 20 bp, synthetic construct
  misc_feature 1..20: note = CRISPR gRNA sequence
  source 1..20: mol_type = other DNA
ccaaagtgctgggactacag

SEQ ID NO: 27483 - DNA, 20 bp, synthetic construct
  misc_feature 1..20: note = CRISPR gRNA sequence
  source 1..20: mol_type = other DNA
ggactacagtcacgaggcac

SEQ ID NO: 27484 - DNA, 20 bp, synthetic construct
  misc_feature 1..20: note = CRISPR gRNA sequence
  source 1..20: mol_type = other DNA
cagtcacgaggcaccgcacc

SEQ ID NO: 27485 - DNA, 20 bp, synthetic construct
  misc_feature 1..20: note = CRISPR gRNA sequence
  source 1..20: mol_type = other DNA
tttttttaagagggggacaa

SEQ ID NO: 27486 - DNA, 20 bp, synthetic construct
  misc_feature 1..20: note = CRISPR gRNA sequence
  source 1..20: mol_type = other DNA
ttttttaagagggggacaac

SEQ ID NO: 27487 - DNA, 20 bp, synthetic construct
  misc_feature 1..20: note = CRISPR gRNA sequence
  source 1..20: mol_type = other DNA
tttttaagagggggacaaca

SEQ ID NO: 27488 - DNA, 20 bp, synthetic construct
  misc_feature 1..20: note = CRISPR gRNA sequence
  source 1..20: mol_type = other DNA
ttttaagagggggacaacag

SEQ ID NO: 27489 - DNA, 20 bp, synthetic construct
  misc_feature 1..20: note = CRISPR gRNA sequence
  source 1..20: mol_type = other DNA
tttaagagggggacaacagt

SEQ ID NO: 27490 - DNA, 20 bp, synthetic construct
  misc_feature 1..20: note = CRISPR gRNA sequence
  source 1..20: mol_type = other DNA
ttaagagggggacaacagtt

SEQ ID NO: 27491 - DNA, 20 bp, synthetic construct
  misc_feature 1..20: note = CRISPR gRNA sequence
  source 1..20: mol_type = other DNA
taagagggggacaacagttg

SEQ ID NO: 27492 - DNA, 20 bp, synthetic construct
  misc_feature 1..20: note = CRISPR gRNA sequence
  source 1..20: mol_type = other DNA
aagagggggacaacagttgc

SEQ ID NO: 27493 - DNA, 20 bp, synthetic construct
  misc_feature 1..20: note = CRISPR gRNA sequence
  source 1..20: mol_type = other DNA
agagggggacaacagttgcc

SEQ ID NO: 27494 - DNA, 20 bp, synthetic construct
  misc_feature 1..20: note = CRISPR gRNA sequence
  source 1..20: mol_type = other DNA
ccccaaggaaagcaatcccc

SEQ ID NO: 27495 - DNA, 20 bp, synthetic construct
  misc_feature 1..20: note = CRISPR gRNA sequence
  source 1..20: mol_type = other DNA
gggaatttggggcactgggg

SEQ ID NO: 27496 - DNA, 20 bp, synthetic construct
  misc_feature 1..20: note = CRISPR gRNA sequence
  source 1..20: mol_type = other DNA
ggggcactggggcagccatc

SEQ ID NO: 27497 - DNA, 20 bp, synthetic construct
  misc_feature 1..20: note = CRISPR gRNA sequence
  source 1..20: mol_type = other DNA
gggcactggggcagccatca

SEQ ID NO: 27498 - DNA, 20 bp, synthetic construct
  misc_feature 1..20: note = CRISPR gRNA sequence
  source 1..20: mol_type = other DNA
gggcagccatcatgggaccc

SEQ ID NO: 27499 - DNA, 20 bp, synthetic construct
  misc_feature 1..20: note = CRISPR gRNA sequence
  source 1..20: mol_type = other DNA
agtgacagcagtgcctgctc

SEQ ID NO: 27500 - DNA, 20 bp, synthetic construct
  misc_feature 1..20: note = CRISPR gRNA sequence
  source 1..20: mol_type = other DNA
ctccccctaacattgcctgt

SEQ ID NO: 27501 - DNA, 20 bp, synthetic construct
  misc_feature 1..20: note = CRISPR gRNA sequence
  source 1..20: mol_type = other DNA
cccctaacattgcctgttct

SEQ ID NO: 27502 - DNA, 20 bp, synthetic construct
  misc_feature 1..20: note = CRISPR gRNA sequence
  source 1..20: mol_type = other DNA
acattgcctgttctctccag

SEQ ID NO: 27503 - DNA, 20 bp, synthetic construct
  misc_feature 1..20: note = CRISPR gRNA sequence
  source 1..20: mol_type = other DNA
cctgttctctccaggacgag

SEQ ID NO: 27504 - DNA, 20 bp, synthetic construct
  misc_feature 1..20: note = CRISPR gRNA sequence
  source 1..20: mol_type = other DNA
ttctctccaggacgagaagt

SEQ ID NO: 27505 - DNA, 20 bp, synthetic construct
  misc_feature 1..20: note = CRISPR gRNA sequence
  source 1..20: mol_type = other DNA
tctccaggacgagaagttcc

SEQ ID NO: 27506 - DNA, 20 bp, synthetic construct
  misc_feature 1..20: note = CRISPR gRNA sequence
  source 1..20: mol_type = other DNA
tccaggacgagaagttcctc

SEQ ID NO: 27507 - DNA, 20 bp, synthetic construct
  misc_feature 1..20: note = CRISPR gRNA sequence
  source 1..20: mol_type = other DNA
caggacgagaagttcctcgg

SEQ ID NO: 27508 - DNA, 20 bp, synthetic construct
  misc_feature 1..20: note = CRISPR gRNA sequence
  source 1..20: mol_type = other DNA
ctcggaagacacagctgggg

SEQ ID NO: 27509 - DNA, 20 bp, synthetic construct
  misc_feature 1..20: note = CRISPR gRNA sequence
  source 1..20: mol_type = other DNA
ggaagacacagctggggagc

SEQ ID NO: 27510 - DNA, 20 bp, synthetic construct
  misc_feature 1..20: note = CRISPR gRNA sequence
  source 1..20: mol_type = other DNA
gggagctccctgctgttcgg

SEQ ID NO: 27511 - DNA, 20 bp, synthetic construct
  misc_feature 1..20: note = CRISPR gRNA sequence
  source 1..20: mol_type = other DNA
cctgctgttcgggacctaaa

SEQ ID NO: 27512 - DNA, 20 bp, synthetic construct
  misc_feature 1..20: note = CRISPR gRNA sequence
  source 1..20: mol_type = other DNA
ctgttcgggacctaaagaaa

SEQ ID NO: 27513 - DNA, 20 bp, synthetic construct
  misc_feature 1..20: note = CRISPR gRNA sequence
  source 1..20: mol_type = other DNA
ttcgggacctaaagaaactg

SEQ ID NO: 27514 - DNA, 20 bp, synthetic construct
  misc_feature 1..20: note = CRISPR gRNA sequence
  source 1..20: mol_type = other DNA
gggacctaaagaaactggag

SEQ ID NO: 27515 - DNA, 20 bp, synthetic construct
  misc_feature 1..20: note = CRISPR gRNA sequence
  source 1..20: mol_type = other DNA
aagaaactggagtttgcgta

SEQ ID NO: 27516 - DNA, 20 bp, synthetic construct
  misc_feature 1..20: note = CRISPR gRNA sequence
  source 1..20: mol_type = other DNA
gagtttgcgtaagcaaaggg

SEQ ID NO: 27517 - DNA, 20 bp, synthetic construct
  misc_feature 1..20: note = CRISPR gRNA sequence
  source 1..20: mol_type = other DNA
gcgtaagcaaaggggtggat

SEQ ID NO: 27518 - DNA, 20 bp, synthetic construct
  misc_feature 1..20: note = CRISPR gRNA sequence
  source 1..20: mol_type = other DNA
cgtaagcaaaggggtggatt

SEQ ID NO: 27519 - DNA, 20 bp, synthetic construct
  misc_feature 1..20: note = CRISPR gRNA sequence
  source 1..20: mol_type = other DNA
tcttgtgggtctgcgcaagg

SEQ ID NO: 27520 - DNA, 20 bp, synthetic construct
  misc_feature 1..20: note = CRISPR gRNA sequence
  source 1..20: mol_type = other DNA
gtgggtctgcgcaaggtttc

SEQ ID NO: 27521 - DNA, 20 bp, synthetic construct
  misc_feature 1..20: note = CRISPR gRNA sequence
  source 1..20: mol_type = other DNA
tgggtctgcgcaaggtttcc

SEQ ID NO: 27522 - DNA, 20 bp, synthetic construct
  misc_feature 1..20: note = CRISPR gRNA sequence
  source 1..20: mol_type = other DNA
cgcaaggtttcccctgcagc

SEQ ID NO: 27523 - DNA, 20 bp, synthetic construct
  misc_feature 1..20: note = CRISPR gRNA sequence
  source 1..20: mol_type = other DNA
cccctgcagcattagctggg

SEQ ID NO: 27524 - DNA, 20 bp, synthetic construct
  misc_feature 1..20: note = CRISPR gRNA sequence
  source 1..20: mol_type = other DNA
ccctgcagcattagctgggc

SEQ ID NO: 27525 - DNA, 20 bp, synthetic construct
  misc_feature 1..20: note = CRISPR gRNA sequence
  source 1..20: mol_type = other DNA
cagcattagctgggcttgta

SEQ ID NO: 27526 - DNA, 20 bp, synthetic construct
  misc_feature 1..20: note = CRISPR gRNA sequence
  source 1..20: mol_type = other DNA
gctgggcttgtaccacctga

SEQ ID NO: 27527 - DNA, 20 bp, synthetic construct
  misc_feature 1..20: note = CRISPR gRNA sequence
  source 1..20: mol_type = other DNA
ggcttgtaccacctgaatgg

SEQ ID NO: 27528 - DNA, 20 bp, synthetic construct
  misc_feature 1..20: note = CRISPR gRNA sequence
  source 1..20: mol_type = other DNA
gtaccacctgaatggagata

SEQ ID NO: 27529 - DNA, 20 bp, synthetic construct
  misc_feature 1..20: note = CRISPR gRNA sequence
  source 1..20: mol_type = other DNA
taccacctgaatggagatag

SEQ ID NO: 27530 - DNA, 20 bp, synthetic construct
  misc_feature 1..20: note = CRISPR gRNA sequence
  source 1..20: mol_type = other DNA
aatggagatagatctccaga

SEQ ID NO: 27531 - DNA, 20 bp, synthetic construct
  misc_feature 1..20: note = CRISPR gRNA sequence
  source 1..20: mol_type = other DNA
cagaatcattcttaccctct

SEQ ID NO: 27532 - DNA, 20 bp, synthetic construct
  misc_feature 1..20: note = CRISPR gRNA sequence
  source 1..20: mol_type = other DNA
ttaccctcttgcccaccact

SEQ ID NO: 27533 - DNA, 20 bp, synthetic construct
  misc_feature 1..20: note = CRISPR gRNA sequence
  source 1..20: mol_type = other DNA
accctcttgcccaccacttt

SEQ ID NO: 27534 - DNA, 20 bp, synthetic construct
  misc_feature 1..20: note = CRISPR gRNA sequence
  source 1..20: mol_type = other DNA
ccctcttgcccaccactttg

SEQ ID NO: 27535 - DNA, 20 bp, synthetic construct
  misc_feature 1..20: note = CRISPR gRNA sequence
  source 1..20: mol_type = other DNA
ttgcccaccactttggaaat

SEQ ID NO: 27536 - DNA, 20 bp, synthetic construct
  misc_feature 1..20: note = CRISPR gRNA sequence
  source 1..20: mol_type = other DNA
gcccaccactttggaaatag

SEQ ID NO: 27537 - DNA, 20 bp, synthetic construct
  misc_feature 1..20: note = CRISPR gRNA sequence
  source 1..20: mol_type = other DNA
cccaccactttggaaatagc

SEQ ID NO: 27538 - DNA, 20 bp, synthetic construct
  misc_feature 1..20: note = CRISPR gRNA sequence
  source 1..20: mol_type = other DNA
tggaaatagcttccagcagc

SEQ ID NO: 27539 - DNA, 20 bp, synthetic construct
  misc_feature 1..20: note = CRISPR gRNA sequence
  source 1..20: mol_type = other DNA
ggaaatagcttccagcagct

SEQ ID NO: 27540 - DNA, 20 bp, synthetic construct
  misc_feature 1..20: note = CRISPR gRNA sequence
  source 1..20: mol_type = other DNA
gaaatagcttccagcagctg

SEQ ID NO: 27541 - DNA, 20 bp, synthetic construct
  misc_feature 1..20: note = CRISPR gRNA sequence
  source 1..20: mol_type = other DNA
ccagcagctggaaagtgacc

SEQ ID NO: 27542 - DNA, 20 bp, synthetic construct
  misc_feature 1..20: note = CRISPR gRNA sequence
  source 1..20: mol_type = other DNA
cagcagctggaaagtgacca

SEQ ID NO: 27543 - DNA, 20 bp, synthetic construct
  misc_feature 1..20: note = CRISPR gRNA sequence
  source 1..20: mol_type = other DNA
gaaagtgaccagtgtgggca

SEQ ID NO: 27544 - DNA, 20 bp, synthetic construct
  misc_feature 1..20: note = CRISPR gRNA sequence
  source 1..20: mol_type = other DNA
gaggttctcagatttgaagc

SEQ ID NO: 27545 - DNA, 20 bp, synthetic construct
  misc_feature 1..20: note = CRISPR gRNA sequence
  source 1..20: mol_type = other DNA
tcagatttgaagctaatgga

SEQ ID NO: 27546 - DNA, 20 bp, synthetic construct
  misc_feature 1..20: note = CRISPR gRNA sequence
  source 1..20: mol_type = other DNA
agatttgaagctaatggacc

SEQ ID NO: 27547 - DNA, 20 bp, synthetic construct
  misc_feature 1..20: note = CRISPR gRNA sequence
  source 1..20: mol_type = other DNA
gaagctaatggacccgtttg

SEQ ID NO: 27548 - DNA, 20 bp, synthetic construct
  misc_feature 1..20: note = CRISPR gRNA sequence
  source 1..20: mol_type = other DNA
aagctaatggacccgtttgc

SEQ ID NO: 27549 - DNA, 20 bp, synthetic construct
  misc_feature 1..20: note = CRISPR gRNA sequence
  source 1..20: mol_type = other DNA
atggacccgtttgctggtta

SEQ ID NO: 27550 - DNA, 20 bp, synthetic construct
  misc_feature 1..20: note = CRISPR gRNA sequence
  source 1..20: mol_type = other DNA
gctggttaacatggtcattc

SEQ ID NO: 27551 - DNA, 20 bp, synthetic construct
  misc_feature 1..20: note = CRISPR gRNA sequence
  source 1..20: mol_type = other DNA
ctggttaacatggtcattcc

SEQ ID NO: 27552 - DNA, 20 bp, synthetic construct
  misc_feature 1..20: note = CRISPR gRNA sequence
  source 1..20: mol_type = other DNA
gttaacatggtcattcccat

SEQ ID NO: 27553 - DNA, 20 bp, synthetic construct
  misc_feature 1..20: note = CRISPR gRNA sequence
  source 1..20: mol_type = other DNA
acatggtcattcccatcact

SEQ ID NO: 27554 - DNA, 20 bp, synthetic construct
  misc_feature 1..20: note = CRISPR gRNA sequence
  source 1..20: mol_type = other DNA
ccatcactcattcaacagag

SEQ ID NO: 27555 - DNA, 20 bp, synthetic construct
  misc_feature 1..20: note = CRISPR gRNA sequence
  source 1..20: mol_type = other DNA
attcaacagaggtattgagc

SEQ ID NO: 27556 - DNA, 20 bp, synthetic construct
  misc_feature 1..20: note = CRISPR gRNA sequence
  source 1..20: mol_type = other DNA
aacagaggtattgagcactt

SEQ ID NO: 27557 - DNA, 20 bp, synthetic construct
  misc_feature 1..20: note = CRISPR gRNA sequence
  source 1..20: mol_type = other DNA
agcacttgaatgactgaggc

SEQ ID NO: 27558 - DNA, 20 bp, synthetic construct
  misc_feature 1..20: note = CRISPR gRNA sequence
  source 1..20: mol_type = other DNA
gaatgactgaggctgctgtc

SEQ ID NO: 27559 - DNA, 20 bp, synthetic construct
  misc_feature 1..20: note = CRISPR gRNA sequence
  source 1..20: mol_type = other DNA
aatgactgaggctgctgtcc

SEQ ID NO: 27560 - DNA, 20 bp, synthetic construct
  misc_feature 1..20: note = CRISPR gRNA sequence
  source 1..20: mol_type = other DNA
aggctgctgtcctcatgagc

SEQ ID NO: 27561 - DNA, 20 bp, synthetic construct
  misc_feature 1..20: note = CRISPR gRNA sequence
  source 1..20: mol_type = other DNA
ctgtcctcatgagctgacag

SEQ ID NO: 27562 - DNA, 20 bp, synthetic construct
  misc_feature 1..20: note = CRISPR gRNA sequence
  source 1..20: mol_type = other DNA
tcctcatgagctgacagtct

SEQ ID NO: 27563 - DNA, 20 bp, synthetic construct
  misc_feature 1..20: note = CRISPR gRNA sequence
  source 1..20: mol_type = other DNA
atgagctgacagtctaatca

SEQ ID NO: 27564 - DNA, 20 bp, synthetic construct
  misc_feature 1..20: note = CRISPR gRNA sequence
  source 1..20: mol_type = other DNA
acagtctaatcaactcccct

SEQ ID NO: 27565 - DNA, 20 bp, synthetic construct
  misc_feature 1..20: note = CRISPR gRNA sequence
  source 1..20: mol_type = other DNA
atcaactcccctctggagga

SEQ ID NO: 27566 - DNA, 20 bp, synthetic construct
  misc_feature 1..20: note = CRISPR gRNA sequence
  source 1..20: mol_type = other DNA
ccctctggaggaggtcaggg

SEQ ID NO: 27567 - DNA, 20 bp, synthetic construct
  misc_feature 1..20: note = CRISPR gRNA sequence
  source 1..20: mol_type = other DNA
tggaggaggtcagggggact

SEQ ID NO: 27568 - DNA, 20 bp, synthetic construct
  misc_feature 1..20: note = CRISPR gRNA sequence
  source 1..20: mol_type = other DNA
gaggaggtcagggggacttc

SEQ ID NO: 27569 - DNA, 20 bp, synthetic construct
  misc_feature 1..20: note = CRISPR gRNA sequence
  source 1..20: mol_type = other DNA
cctggaggaggtgatatctg

SEQ ID NO: 27570 - DNA, 20 bp, synthetic construct
  misc_feature 1..20: note = CRISPR gRNA sequence
  source 1..20: mol_type = other DNA
ctggaggaggtgatatctgc

SEQ ID NO: 27571 - DNA, 20 bp, synthetic construct
  misc_feature 1..20: note = CRISPR gRNA sequence
  source 1..20: mol_type = other DNA
gaggaggtgatatctgcact

SEQ ID NO: 27572 - DNA, 20 bp, synthetic construct
  misc_feature 1..20: note = CRISPR gRNA sequence
  source 1..20: mol_type = other DNA
cactgaagcttcagtgagga

SEQ ID NO: 27573 - DNA, 20 bp, synthetic construct
  misc_feature 1..20: note = CRISPR gRNA sequence
  source 1..20: mol_type = other DNA
aagcttcagtgaggataagg

SEQ ID NO: 27574 - DNA, 20 bp, synthetic construct
  misc_feature 1..20: note = CRISPR gRNA sequence
  source 1..20: mol_type = other DNA
cagtgaggataaggaatgag

SEQ ID NO: 27575 - DNA, 20 bp, synthetic construct
  misc_feature 1..20: note = CRISPR gRNA sequence
  source 1..20: mol_type = other DNA
agtgaggataaggaatgagc

SEQ ID NO: 27576 - DNA, 20 bp, synthetic construct
  misc_feature 1..20: note = CRISPR gRNA sequence
  source 1..20: mol_type = other DNA
agtggggagaggggagtaag

SEQ ID NO: 27577 - DNA, 20 bp, synthetic construct
  misc_feature 1..20: note = CRISPR gRNA sequence
  source 1..20: mol_type = other DNA
tccaggaattgtaatttcgc

SEQ ID NO: 27578 - DNA, 20 bp, synthetic construct
  misc_feature 1..20: note = CRISPR gRNA sequence
  source 1..20: mol_type = other DNA
ccaggaattgtaatttcgcc

SEQ ID NO: 27579 - DNA, 20 bp, synthetic construct
  misc_feature 1..20: note = CRISPR gRNA sequence
  source 1..20: mol_type = other DNA
caggaattgtaatttcgcca

SEQ ID NO: 27580 - DNA, 20 bp, synthetic construct
  misc_feature 1..20: note = CRISPR gRNA sequence
  source 1..20: mol_type = other DNA
taatttcgccagggatcaga

SEQ ID NO: 27581 - DNA, 20 bp, synthetic construct
  misc_feature 1..20: note = CRISPR gRNA sequence
  source 1..20: mol_type = other DNA
cgccagggatcagaaaaggc

SEQ ID NO: 27582 - DNA, 20 bp, synthetic construct
  misc_feature 1..20: note = CRISPR gRNA sequence
  source 1..20: mol_type = other DNA
gccagggatcagaaaaggcc

SEQ ID NO: 27583 - DNA, 20 bp, synthetic construct
  misc_feature 1..20: note = CRISPR gRNA sequence
  source 1..20: mol_type = other DNA
ccataggaggatgccactat

SEQ ID NO: 27584 - DNA, 20 bp, synthetic construct
  misc_feature 1..20: note = CRISPR gRNA sequence
  source 1..20: mol_type = other DNA
cataggaggatgccactatg

SEQ ID NO: 27585 - DNA, 20 bp, synthetic construct
  misc_feature 1..20: note = CRISPR gRNA sequence
  source 1..20: mol_type = other DNA
tgactatggagtccttttcc

SEQ ID NO: 27586 - DNA, 20 bp, synthetic construct
  misc_feature 1..20: note = CRISPR gRNA sequence
  source 1..20: mol_type = other DNA
tggagtccttttccctcctg

SEQ ID NO: 27587 - DNA, 20 bp, synthetic construct
  misc_feature 1..20: note = CRISPR gRNA sequence
  source 1..20: mol_type = other DNA
ttccctcctgtggccaggaa

SEQ ID NO: 27588 - DNA, 20 bp, synthetic construct
  misc_feature 1..20: note = CRISPR gRNA sequence
  source 1..20: mol_type = other DNA
tccctcctgtggccaggaac

SEQ ID NO: 27589 - DNA, 20 bp, synthetic construct
  misc_feature 1..20: note = CRISPR gRNA sequence
  source 1..20: mol_type = other DNA
ccctcctgtggccaggaact

SEQ ID NO: 27590 - DNA, 20 bp, synthetic construct
  misc_feature 1..20: note = CRISPR gRNA sequence
  source 1..20: mol_type = other DNA
cctcctgtggccaggaactg

SEQ ID NO: 27591 - DNA, 20 bp, synthetic construct
  misc_feature 1..20: note = CRISPR gRNA sequence
  source 1..20: mol_type = other DNA
ctgtggccaggaactgcaca

SEQ ID NO: 27592 - DNA, 20 bp, synthetic construct
  misc_feature 1..20: note = CRISPR gRNA sequence
  source 1..20: mol_type = other DNA
tggccaggaactgcacaacg

SEQ ID NO: 27593 - DNA, 20 bp, synthetic construct
  misc_feature 1..20: note = CRISPR gRNA sequence
  source 1..20: mol_type = other DNA
cacaacgtcccttgtgcctg

SEQ ID NO: 27594 - DNA, 20 bp, synthetic construct
  misc_feature 1..20: note = CRISPR gRNA sequence
  source 1..20: mol_type = other DNA
gtgcctgagcttgtttactt

SEQ ID NO: 27595 - DNA, 20 bp, synthetic construct
  misc_feature 1..20: note = CRISPR gRNA sequence
  source 1..20: mol_type = other DNA
tgcctgagcttgtttacttc

SEQ ID NO: 27596 - DNA, 20 bp, synthetic construct
  misc_feature 1..20: note = CRISPR gRNA sequence
  source 1..20: mol_type = other DNA
agcttgtttacttccacagc

SEQ ID NO: 27597 - DNA, 20 bp, synthetic construct
  misc_feature 1..20: note = CRISPR gRNA sequence
  source 1..20: mol_type = other DNA
gtttacttccacagccaagg

SEQ ID NO: 27598 - DNA, 20 bp, synthetic construct
  misc_feature 1..20: note = CRISPR gRNA sequence
  source 1..20: mol_type = other DNA
tttacttccacagccaaggg

SEQ ID NO: 27599 - DNA, 20 bp, synthetic construct
  misc_feature 1..20: note = CRISPR gRNA sequence
  source 1..20: mol_type = other DNA
acttccacagccaagggatg

SEQ ID NO: 27600 - DNA, 20 bp, synthetic construct
  misc_feature 1..20: note = CRISPR gRNA sequence
  source 1..20: mol_type = other DNA
cttccacagccaagggatgg

SEQ ID NO: 27601 - DNA, 20 bp, synthetic construct
  misc_feature 1..20: note = CRISPR gRNA sequence
  source 1..20: mol_type = other DNA
ccacagccaagggatggcct

SEQ ID NO: 27602 - DNA, 20 bp, synthetic construct
  misc_feature 1..20: note = CRISPR gRNA sequence
  source 1..20: mol_type = other DNA
cacagccaagggatggcctc

SEQ ID NO: 27603 - DNA, 20 bp, synthetic construct
  misc_feature 1..20: note = CRISPR gRNA sequence
  source 1..20: mol_type = other DNA
cccagggagaatctttcccc

SEQ ID NO: 27604 - DNA, 20 bp, synthetic construct
  misc_feature 1..20: note = CRISPR gRNA sequence
  source 1..20: mol_type = other DNA
tcccccattttgaaattccc

SEQ ID NO: 27605 - DNA, 20 bp, synthetic construct
  misc_feature 1..20: note = CRISPR gRNA sequence
  source 1..20: mol_type = other DNA
cccccattttgaaattccca

SEQ ID NO: 27606 - DNA, 20 bp, synthetic construct
  misc_feature 1..20: note = CRISPR gRNA sequence
  source 1..20: mol_type = other DNA
ccccattttgaaattcccag

SEQ ID NO: 27607 - DNA, 20 bp, synthetic construct
  misc_feature 1..20: note = CRISPR gRNA sequence
  source 1..20: mol_type = other DNA
tgaaattcccaggagctttt

SEQ ID NO: 27608 - DNA, 20 bp, synthetic construct
  misc_feature 1..20: note = CRISPR gRNA sequence
  source 1..20: mol_type = other DNA
gaaattcccaggagcttttg

SEQ ID NO: 27609 - DNA, 20 bp, synthetic construct
  misc_feature 1..20: note = CRISPR gRNA sequence
  source 1..20: mol_type = other DNA
aaattcccaggagcttttga

SEQ ID NO: 27610 - DNA, 20 bp, synthetic construct
  misc_feature 1..20: note = CRISPR gRNA sequence
  source 1..20: mol_type = other DNA
ccaggagcttttgatgtgca

SEQ ID NO: 27611 - DNA, 20 bp, synthetic construct
  misc_feature 1..20: note = CRISPR gRNA sequence
  source 1..20: mol_type = other DNA
ttgatgtgcagctaggatga

SEQ ID NO: 27612 - DNA, 20 bp, synthetic construct
  misc_feature 1..20: note = CRISPR gRNA sequence
  source 1..20: mol_type = other DNA
tgatgtgcagctaggatgaa

SEQ ID NO: 27613 - DNA, 20 bp, synthetic construct
  misc_feature 1..20: note = CRISPR gRNA sequence
  source 1..20: mol_type = other DNA
gatgtgcagctaggatgaaa

SEQ ID NO: 27614 - DNA, 20 bp, synthetic construct
  misc_feature 1..20: note = CRISPR gRNA sequence
  source 1..20: mol_type = other DNA
atgtgcagctaggatgaaaa

SEQ ID NO: 27615 - DNA, 20 bp, synthetic construct
  misc_feature 1..20: note = CRISPR gRNA sequence
  source 1..20: mol_type = other DNA
ggatgaaaaagcaaccctac

SEQ ID NO: 27616 - DNA, 20 bp, synthetic construct
  misc_feature 1..20: note = CRISPR gRNA sequence
  source 1..20: mol_type = other DNA
cttgcctgggactatcctgg

SEQ ID NO: 27617 - DNA, 20 bp, synthetic construct
  misc_feature 1..20: note = CRISPR gRNA sequence
  source 1..20: mol_type = other DNA
gcctgggactatcctggttt

SEQ ID NO: 27618 - DNA, 20 bp, synthetic construct
  misc_feature 1..20: note = CRISPR gRNA sequence
  source 1..20: mol_type = other DNA
cctgggactatcctggtttg

SEQ ID NO: 27619 - DNA, 20 bp, synthetic construct
  misc_feature 1..20: note = CRISPR gRNA sequence
  source 1..20: mol_type = other DNA
ggactatcctggtttgaaaa

SEQ ID NO: 27620 - DNA, 20 bp, synthetic construct
  misc_feature 1..20: note = CRISPR gRNA sequence
  source 1..20: mol_type = other DNA
tcctggtttgaaaactgaaa

SEQ ID NO: 27621 - DNA, 20 bp, synthetic construct
  misc_feature 1..20: note = CRISPR gRNA sequence
  source 1..20: mol_type = other DNA
gtttgaaaactgaaagtctt

SEQ ID NO: 27622 - DNA, 20 bp, synthetic construct
  misc_feature 1..20: note = CRISPR gRNA sequence
  source 1..20: mol_type = other DNA
gaaaactgaaagtcttgcat

SEQ ID NO: 27623 - DNA, 20 bp, synthetic construct
  misc_feature 1..20: note = CRISPR gRNA sequence
  source 1..20: mol_type = other DNA
aaaactgaaagtcttgcatc

SEQ ID NO: 27624 - DNA, 20 bp, synthetic construct
  misc_feature 1..20: note = CRISPR gRNA sequence
  source 1..20: mol_type = other DNA
aaagtcttgcatcccaagaa

SEQ ID NO: 27625 - DNA, 20 bp, synthetic construct
  misc_feature 1..20: note = CRISPR gRNA sequence
  source 1..20: mol_type = other DNA
gcatcccaagaagcccctta

SEQ ID NO: 27626 - DNA, 20 bp, synthetic construct
  misc_feature 1..20: note = CRISPR gRNA sequence
  source 1..20: mol_type = other DNA
catcccaagaagccccttag

SEQ ID NO: 27627 - DNA, 20 bp, synthetic construct
  misc_feature 1..20: note = CRISPR gRNA sequence
  source 1..20: mol_type = other DNA
agtcccaggcaaactgggac

SEQ ID NO: 27628 - DNA, 20 bp, synthetic construct
  misc_feature 1..20: note = CRISPR gRNA sequence
  source 1..20: mol_type = other DNA
gtcccaggcaaactgggaca

SEQ ID NO: 27629 - DNA, 20 bp, synthetic construct
  misc_feature 1..20: note = CRISPR gRNA sequence
  source 1..20: mol_type = other DNA
ggacagttggttgctctatg

SEQ ID NO: 27630 - DNA, 20 bp, synthetic construct
  misc_feature 1..20: note = CRISPR gRNA sequence
  source 1..20: mol_type = other DNA
gttgctctatgtgtggccag

SEQ ID NO: 27631 - DNA, 20 bp, synthetic construct
  misc_feature 1..20: note = CRISPR gRNA sequence
  source 1..20: mol_type = other DNA
ctctatgtgtggccagggct

SEQ ID NO: 27632 - DNA, 20 bp, synthetic construct
  misc_feature 1..20: note = CRISPR gRNA sequence
  source 1..20: mol_type = other DNA
tatgtgtggccagggctggg

SEQ ID NO: 27633 - DNA, 20 bp, synthetic construct
  misc_feature 1..20: note = CRISPR gRNA sequence
  source 1..20: mol_type = other DNA
tgtgtggccagggctggggg

SEQ ID NO: 27634 - DNA, 20 bp, synthetic construct
  misc_feature 1..20: note = CRISPR gRNA sequence
  source 1..20: mol_type = other DNA
ggggccacaccctaggcagt

SEQ ID NO: 27635 - DNA, 20 bp, synthetic construct
  misc_feature 1..20: note = CRISPR gRNA sequence
  source 1..20: mol_type = other DNA
ggcagtgttgctggggtgac

SEQ ID NO: 27636 - DNA, 20 bp, synthetic construct
  misc_feature 1..20: note = CRISPR gRNA sequence
  source 1..20: mol_type = other DNA
ctggggtgacagaaatggag

SEQ ID NO: 27637 - DNA, 20 bp, synthetic construct
  misc_feature 1..20: note = CRISPR gRNA sequence
  source 1..20: mol_type = other DNA
gggtgacagaaatggagacc

SEQ ID NO: 27638 - DNA, 20 bp, synthetic construct
  misc_feature 1..20: note = CRISPR gRNA sequence
  source 1..20: mol_type = other DNA
ggcaaggctctagggagtcc

SEQ ID NO: 27639 - DNA, 20 bp, synthetic construct
  misc_feature 1..20: note = CRISPR gRNA sequence
  source 1..20: mol_type = other DNA
tagggagtccagttgtgtct

SEQ ID NO: 27640 - DNA, 20 bp, synthetic construct
  misc_feature 1..20: note = CRISPR gRNA sequence
  source 1..20: mol_type = other DNA
gggagtccagttgtgtctgg

SEQ ID NO: 27641 - DNA, 20 bp, synthetic construct
  misc_feature 1..20: note = CRISPR gRNA sequence
  source 1..20: mol_type = other DNA
tgtctgggtcactgaggagg

SEQ ID NO: 27642 - DNA, 20 bp, synthetic construct
  misc_feature 1..20: note = CRISPR gRNA sequence
  source 1..20: mol_type = other DNA
ggtcactgaggaggggcagc

SEQ ID NO: 27643 - DNA, 20 bp, synthetic construct
  misc_feature 1..20: note = CRISPR gRNA sequence
  source 1..20: mol_type = other DNA
aggaggggcagcccaccata

SEQ ID NO: 27644 - DNA, 20 bp, synthetic construct
  misc_feature 1..20: note = CRISPR gRNA sequence
  source 1..20: mol_type = other DNA
ttatatttagatctgtcaga

SEQ ID NO: 27645 - DNA, 20 bp, synthetic construct
  misc_feature 1..20: note = CRISPR gRNA sequence
  source 1..20: mol_type = other DNA
tatttagatctgtcagaata

SEQ ID NO: 27646 - DNA, 20 bp, synthetic construct
  misc_feature 1..20: note = CRISPR gRNA sequence
  source 1..20: mol_type = other DNA
agatctgtcagaatatagct

SEQ ID NO: 27647 - DNA, 20 bp, synthetic construct
  misc_feature 1..20: note = CRISPR gRNA sequence
  source 1..20: mol_type = other DNA
gatctgtcagaatatagctt

SEQ ID NO: 27648 - DNA, 20 bp, synthetic construct
  misc_feature 1..20: note = CRISPR gRNA sequence
  source 1..20: mol_type = other DNA
tcagaatatagcttttcttt

SEQ ID NO: 27649 - DNA, 20 bp, synthetic construct
  misc_feature 1..20: note = CRISPR gRNA sequence
  source 1..20: mol_type = other DNA
ttctttctttctttcctttc

SEQ ID NO: 27650 - DNA, 20 bp, synthetic construct
  misc_feature 1..20: note = CRISPR gRNA sequence
  source 1..20: mol_type = other DNA
tctttctttctttcctttct

SEQ ID NO: 27651 - DNA, 20 bp, synthetic construct
  misc_feature 1..20: note = CRISPR gRNA sequence
  source 1..20: mol_type = other DNA
ctttctttctttcctttctt

SEQ ID NO: 27652 - DNA, 20 bp, synthetic construct
  misc_feature 1..20: note = CRISPR gRNA sequence
  source 1..20: mol_type = other DNA
tttctttctttcctttcttc

SEQ ID NO: 27653 - DNA, 20 bp, synthetic construct
  misc_feature 1..20: note = CRISPR gRNA sequence
  source 1..20: mol_type = other DNA
tctttctttcctttcttctc

SEQ ID NO: 27654 - DNA, 20 bp, synthetic construct
  misc_feature 1..20: note = CRISPR gRNA sequence
  source 1..20: mol_type = other DNA
ctttctttcctttcttctct

SEQ ID NO: 27655 - DNA, 20 bp, synthetic construct
  misc_feature 1..20: note = CRISPR gRNA sequence
  source 1..20: mol_type = other DNA
tttctttcctttcttctctc

SEQ ID NO: 27656 - DNA, 20 bp, synthetic construct
  misc_feature 1..20: note = CRISPR gRNA sequence
  source 1..20: mol_type = other DNA
tctttcctttcttctctctt

SEQ ID NO: 27657 - DNA, 20 bp, synthetic construct
  misc_feature 1..20: note = CRISPR gRNA sequence
  source 1..20: mol_type = other DNA
ctttcctttcttctctcttt

SEQ ID NO: 27658 - DNA, 20 bp, synthetic construct
  misc_feature 1..20: note = CRISPR gRNA sequence
  source 1..20: mol_type = other DNA
tttcctttcttctctctttc

SEQ ID NO: 27659 - DNA, 20 bp, synthetic construct
  misc_feature 1..20: note = CRISPR gRNA sequence
  source 1..20: mol_type = other DNA
tcctttcttctctctttctt

SEQ ID NO: 27660 - DNA, 20 bp, synthetic construct
  misc_feature 1..20: note = CRISPR gRNA sequence
  source 1..20: mol_type = other DNA
cctttcttctctctttcttt

SEQ ID NO: 27661 - DNA, 20 bp, synthetic construct
  misc_feature 1..20: note = CRISPR gRNA sequence
  source 1..20: mol_type = other DNA
ctttcttctctctttctttt

SEQ ID NO: 27662 - DNA, 20 bp, synthetic construct
  misc_feature 1..20: note = CRISPR gRNA sequence
  source 1..20: mol_type = other DNA
tcttctctctttctttttct

SEQ ID NO: 27663 - DNA, 20 bp, synthetic construct
  misc_feature 1..20: note = CRISPR gRNA sequence
  source 1..20: mol_type = other DNA
cttctctctttctttttctt

SEQ ID NO: 27664 - DNA, 20 bp, synthetic construct
  misc_feature 1..20: note = CRISPR gRNA sequence
  source 1..20: mol_type = other DNA
ttctctctttctttttcttt

SEQ ID NO: 27665 - DNA, 20 bp, synthetic construct
  misc_feature 1..20: note = CRISPR gRNA sequence
  source 1..20: mol_type = other DNA
ctctctttctttttctttct

SEQ ID NO: 27666 - DNA, 20 bp, synthetic construct
  misc_feature 1..20: note = CRISPR gRNA sequence
  source 1..20: mol_type = other DNA
tctctttctttttctttctt

SEQ ID NO: 27667 - DNA, 20 bp, synthetic construct
  misc_feature 1..20: note = CRISPR gRNA sequence
  source 1..20: mol_type = other DNA
tctttctttttctttctttc

SEQ ID NO: 27668 - DNA, 20 bp, synthetic construct
  misc_feature 1..20: note = CRISPR gRNA sequence
  source 1..20: mol_type = other DNA
tttctttttctttctttctt

SEQ ID NO: 27669 - DNA, 20 bp, synthetic construct
  misc_feature 1..20: note = CRISPR gRNA sequence
  source 1..20: mol_type = other DNA
tctttttctttctttcttct

SEQ ID NO: 27670 - DNA, 20 bp, synthetic construct
  misc_feature 1..20: note = CRISPR gRNA sequence
  source 1..20: mol_type = other DNA
ctttttctttctttcttctt

SEQ ID NO: 27671 - DNA, 20 bp, synthetic construct
  misc_feature 1..20: note = CRISPR gRNA sequence
  source 1..20: mol_type = other DNA
tttttctttctttcttcttt

SEQ ID NO: 27672 - DNA, 20 bp, synthetic construct
  misc_feature 1..20: note = CRISPR gRNA sequence
  source 1..20: mol_type = other DNA
tttctttctttcttctttct

SEQ ID NO: 27673 - DNA, 20 bp, synthetic construct
  misc_feature 1..20: note = CRISPR gRNA sequence
  source 1..20: mol_type = other DNA
ttctttctttcttctttctt

SEQ ID NO: 27674 - DNA, 20 bp, synthetic construct
  misc_feature 1..20: note = CRISPR gRNA sequence
  source 1..20: mol_type = other DNA
tctttctttcttctttcttt

SEQ ID NO: 27675 - DNA, 20 bp, synthetic construct
  misc_feature 1..20: note = CRISPR gRNA sequence
  source 1..20: mol_type = other DNA
ctttctttcttctttctttc

SEQ ID NO: 27676 - DNA, 20 bp, synthetic construct
  misc_feature 1..20: note = CRISPR gRNA sequence
  source 1..20: mol_type = other DNA
tttctttcttctttctttct

SEQ ID NO: 27677 - DNA, 20 bp, synthetic construct
  misc_feature 1..20: note = CRISPR gRNA sequence
  source 1..20: mol_type = other DNA
tctttcttctttctttcttt

SEQ ID NO: 27678 - DNA, 20 bp, synthetic construct
  misc_feature 1..20: note = CRISPR gRNA sequence
  source 1..20: mol_type = other DNA
ctttcttctttctttctttc

SEQ ID NO: 27679 - DNA, 20 bp, synthetic construct
  misc_feature 1..20: note = CRISPR gRNA sequence
  source 1..20: mol_type = other DNA
tttcttctttctttctttct

SEQ ID NO: 27680 - DNA, 20 bp, synthetic construct
  misc_feature 1..20: note = CRISPR gRNA sequence
  source 1..20: mol_type = other DNA
tcttctttctttctttctct

SEQ ID NO: 27681 - DNA, 20 bp, synthetic construct
  misc_feature 1..20: note = CRISPR gRNA sequence
  source 1..20: mol_type = other DNA
cttctttctttctttctctc

SEQ ID NO: 27682 - DNA, 20 bp, synthetic construct
  misc_feature 1..20: note = CRISPR gRNA sequence
  source 1..20: mol_type = other DNA
ttctttctttctttctctct

SEQ ID NO: 27683 - DNA, 20 bp, synthetic construct
  misc_feature 1..20: note = CRISPR gRNA sequence
  source 1..20: mol_type = other DNA
ctttctttctttctctcttt

SEQ ID NO: 27684 - DNA, 20 bp, synthetic construct
  misc_feature 1..20: note = CRISPR gRNA sequence
  source 1..20: mol_type = other DNA
tttctttctttctctctttc

SEQ ID NO: 27685 - DNA, 20 bp, synthetic construct
  misc_feature 1..20: note = CRISPR gRNA sequence
  source 1..20: mol_type = other DNA
tctttctttctctctttctt

SEQ ID NO: 27686 - DNA, 20 bp, synthetic construct
  misc_feature 1..20: note = CRISPR gRNA sequence
  source 1..20: mol_type = other DNA
ctttctttctctctttcttt

SEQ ID NO: 27687 - DNA, 20 bp, synthetic construct
  misc_feature 1..20: note = CRISPR gRNA sequence
  source 1..20: mol_type = other DNA
tttctttctctctttctttc

SEQ ID NO: 27688 - DNA, 20 bp, synthetic construct
  misc_feature 1..20: note = CRISPR gRNA sequence
  source 1..20: mol_type = other DNA
tctttctctctttctttcct

SEQ ID NO: 27689 - DNA, 20 bp, synthetic construct
  misc_feature 1..20: note = CRISPR gRNA sequence
  source 1..20: mol_type = other DNA
ctttctctctttctttcctc

SEQ ID NO: 27690 - DNA, 20 bp, synthetic construct
  misc_feature 1..20: note = CRISPR gRNA sequence
  source 1..20: mol_type = other DNA
tttctctctttctttcctct

SEQ ID NO: 27691 - DNA, 20 bp, synthetic construct
  misc_feature 1..20: note = CRISPR gRNA sequence
  source 1..20: mol_type = other DNA
tctctctttctttcctcttt

SEQ ID NO: 27692 - DNA, 20 bp, synthetic construct
  misc_feature 1..20: note = CRISPR gRNA sequence
  source 1..20: mol_type = other DNA
ctctctttctttcctctttc

SEQ ID NO: 27693 - DNA, 20 bp, synthetic construct
  misc_feature 1..20: note = CRISPR gRNA sequence
  source 1..20: mol_type = other DNA
tctctttctttcctctttct

SEQ ID NO: 27694 - DNA, 20 bp, synthetic construct
  misc_feature 1..20: note = CRISPR gRNA sequence
  source 1..20: mol_type = other DNA
tctttctttcctctttcttt

SEQ ID NO: 27695 - DNA, 20 bp, synthetic construct
  misc_feature 1..20: note = CRISPR gRNA sequence
  source 1..20: mol_type = other DNA
tttctttcctctttctttcc

SEQ ID NO: 27696 - DNA, 20 bp, synthetic construct
  misc_feature 1..20: note = CRISPR gRNA sequence
  source 1..20: mol_type = other DNA
tctttcctctttctttcctt

SEQ ID NO: 27697 - DNA, 20 bp, synthetic construct
  misc_feature 1..20: note = CRISPR gRNA sequence
  source 1..20: mol_type = other DNA
ctttcctctttctttccttt

SEQ ID NO: 27698 - DNA, 20 bp, synthetic construct
  misc_feature 1..20: note = CRISPR gRNA sequence
  source 1..20: mol_type = other DNA
tttcctctttctttcctttc

SEQ ID NO: 27699 - DNA, 20 bp, synthetic construct
  misc_feature 1..20: note = CRISPR gRNA sequence
  source 1..20: mol_type = other DNA
tcctctttctttcctttccc

SEQ ID NO: 27700 - DNA, 20 bp, synthetic construct
  misc_feature 1..20: note = CRISPR gRNA sequence
  source 1..20: mol_type = other DNA
cctctttctttcctttccct

SEQ ID NO: 27701 - DNA, 20 bp, synthetic construct
  misc_feature 1..20: note = CRISPR gRNA sequence
  source 1..20: mol_type = other DNA
ctctttctttcctttccctt

SEQ ID NO: 27702 - DNA, 20 bp, synthetic construct
  misc_feature 1..20: note = CRISPR gRNA sequence
  source 1..20: mol_type = other DNA
tttctttcctttcccttcct

SEQ ID NO: 27703 - DNA, 20 bp, synthetic construct
  misc_feature 1..20: note = CRISPR gRNA sequence
  source 1..20: mol_type = other DNA
tctttcctttcccttccttt

SEQ ID NO: 27704 - DNA, 20 bp, synthetic construct
  misc_feature 1..20: note = CRISPR gRNA sequence
  source 1..20: mol_type = other DNA
ctttcctttcccttcctttt

SEQ ID NO: 27705 - DNA, 20 bp, synthetic construct
  misc_feature 1..20: note = CRISPR gRNA sequence
  source 1..20: mol_type = other DNA
tttcctttcccttccttttc

SEQ ID NO: 27706 - DNA, 20 bp, synthetic construct
  misc_feature 1..20: note = CRISPR gRNA sequence
  source 1..20: mol_type = other DNA
tcctttcccttccttttctt

SEQ ID NO: 27707 - DNA, 20 bp, synthetic construct
  misc_feature 1..20: note = CRISPR gRNA sequence
  source 1..20: mol_type = other DNA
cctttcccttccttttcttt

SEQ ID NO: 27708 - DNA, 20 bp, synthetic construct
  misc_feature 1..20: note = CRISPR gRNA sequence
  source 1..20: mol_type = other DNA
ctttcccttccttttctttc

SEQ ID NO: 27709 - DNA, 20 bp, synthetic construct
  misc_feature 1..20: note = CRISPR gRNA sequence
  source 1..20: mol_type = other DNA
tcccttccttttctttcctt

SEQ ID NO: 27710 - DNA, 20 bp, synthetic construct
  misc_feature 1..20: note = CRISPR gRNA sequence
  source 1..20: mol_type = other DNA
cccttccttttctttccttc

SEQ ID NO: 27711 - DNA, 20 bp, synthetic construct
  misc_feature 1..20: note = CRISPR gRNA sequence
  source 1..20: mol_type = other DNA
ccttccttttctttccttcc

SEQ ID NO: 27712 - DNA, 20 bp, synthetic construct
  misc_feature 1..20: note = CRISPR gRNA sequence
  source 1..20: mol_type = other DNA
ccttttctttccttccctcc

SEQ ID NO: 27713 - DNA, 20 bp, synthetic construct
  misc_feature 1..20: note = CRISPR gRNA sequence
  source 1..20: mol_type = other DNA
cttttctttccttccctccc

SEQ ID NO: 27714 - DNA, 20 bp, synthetic construct
  misc_feature 1..20: note = CRISPR gRNA sequence
  source 1..20: mol_type = other DNA
ttctttccttccctccctcc

SEQ ID NO: 27715 - DNA, 20 bp, synthetic construct
  misc_feature 1..20: note = CRISPR gRNA sequence
  source 1..20: mol_type = other DNA
tctttccttccctccctccc

SEQ ID NO: 27716 - DNA, 20 bp, synthetic construct
  misc_feature 1..20: note = CRISPR gRNA sequence
  source 1..20: mol_type = other DNA
ctttccttccctccctccct

SEQ ID NO: 27717 - DNA, 20 bp, synthetic construct
  misc_feature 1..20: note = CRISPR gRNA sequence
  source 1..20: mol_type = other DNA
tttccttccctccctccctc

SEQ ID NO: 27718 - DNA, 20 bp, synthetic construct
  misc_feature 1..20: note = CRISPR gRNA sequence
  source 1..20: mol_type = other DNA
tccttccctccctccctcct

SEQ ID NO: 27719 - DNA, 20 bp, synthetic construct
  misc_feature 1..20: note = CRISPR gRNA sequence
  source 1..20: mol_type = other DNA
ccttccctccctccctcctt

SEQ ID NO: 27720 - DNA, 20 bp, synthetic construct
  misc_feature 1..20: note = CRISPR gRNA sequence
  source 1..20: mol_type = other DNA
cttccctccctccctccttc

SEQ ID NO: 27721 - DNA, 20 bp, synthetic construct
  misc_feature 1..20: note = CRISPR gRNA sequence
  source 1..20: mol_type = other DNA
ccctccctccctccttcctt

SEQ ID NO: 27722 - DNA, 20 bp, synthetic construct
  misc_feature 1..20: note = CRISPR gRNA sequence
  source 1..20: mol_type = other DNA
cctccctccctccttccttc

SEQ ID NO: 27723 - DNA, 20 bp, synthetic construct
  misc_feature 1..20: note = CRISPR gRNA sequence
  source 1..20: mol_type = other DNA
cctccctccttccttccttc

SEQ ID NO: 27724 - DNA, 20 bp, synthetic construct
  misc_feature 1..20: note = CRISPR gRNA sequence
  source 1..20: mol_type = other DNA
cctccttccttccttccctc

SEQ ID NO: 27725 - DNA, 20 bp, synthetic construct
  misc_feature 1..20: note = CRISPR gRNA sequence
  source 1..20: mol_type = other DNA
cttccttccttccctccctc

SEQ ID NO: 27726 - DNA, 20 bp, synthetic construct
  misc_feature 1..20: note = CRISPR gRNA sequence
  source 1..20: mol_type = other DNA
ccttccttccctccctccct

SEQ ID NO: 27727 - DNA, 20 bp, synthetic construct
  misc_feature 1..20: note = CRISPR gRNA sequence
  source 1..20: mol_type = other DNA
cttccttccctccctccctt

SEQ ID NO: 27728 - DNA, 20 bp, synthetic construct
  misc_feature 1..20: note = CRISPR gRNA sequence
  source 1..20: mol_type = other DNA
ccttccctccctcccttctt

SEQ ID NO: 27729 - DNA, 20 bp, synthetic construct
  misc_feature 1..20: note = CRISPR gRNA sequence
  source 1..20: mol_type = other DNA
cttccctccctcccttcttc

SEQ ID NO: 27730 - DNA, 20 bp, synthetic construct
  misc_feature 1..20: note = CRISPR gRNA sequence
  source 1..20: mol_type = other DNA
ccctccctcccttcttcccc

SEQ ID NO: 27731 - DNA, 20 bp, synthetic construct
  misc_feature 1..20: note = CRISPR gRNA sequence
  source 1..20: mol_type = other DNA
cctccctcccttcttccccc

SEQ ID NO: 27732 - DNA, 20 bp, synthetic construct
  misc_feature 1..20: note = CRISPR gRNA sequence
  source 1..20: mol_type = other DNA
cctcccttcttccccctttt

SEQ ID NO: 27733 - DNA, 20 bp, synthetic construct
  misc_feature 1..20: note = CRISPR gRNA sequence
  source 1..20: mol_type = other DNA
ccttcttcccccttttcttc

SEQ ID NO: 27734 - DNA, 20 bp, synthetic construct
  misc_feature 1..20: note = CRISPR gRNA sequence
  source 1..20: mol_type = other DNA
cttcccccttttcttctttt

SEQ ID NO: 27735 - DNA, 20 bp, synthetic construct
  misc_feature 1..20: note = CRISPR gRNA sequence
  source 1..20: mol_type = other DNA
ttcccccttttcttcttttt

SEQ ID NO: 27736 - DNA, 20 bp, synthetic construct
  misc_feature 1..20: note = CRISPR gRNA sequence
  source 1..20: mol_type = other DNA
cccccttttcttctttttct

SEQ ID NO: 27737 - DNA, 20 bp, synthetic construct
  misc_feature 1..20: note = CRISPR gRNA sequence
  source 1..20: mol_type = other DNA
ccccttttcttctttttctt

SEQ ID NO: 27738 - DNA, 20 bp, synthetic construct
  misc_feature 1..20: note = CRISPR gRNA sequence
  source 1..20: mol_type = other DNA
ttcttctttttctttctctc

SEQ ID NO: 27739 - DNA, 20 bp, synthetic construct
  misc_feature 1..20: note = CRISPR gRNA sequence
  source 1..20: mol_type = other DNA
tcttctttttctttctctct

SEQ ID NO: 27740 - DNA, 20 bp, synthetic construct
  misc_feature 1..20: note = CRISPR gRNA sequence
  source 1..20: mol_type = other DNA
cttctttttctttctctctg

SEQ ID NO: 27741 - DNA, 20 bp, synthetic construct
  misc_feature 1..20: note = CRISPR gRNA sequence
  source 1..20: mol_type = other DNA
ttctttttctttctctctgt

SEQ ID NO: 27742 - DNA, 20 bp, synthetic construct
  misc_feature 1..20: note = CRISPR gRNA sequence
  source 1..20: mol_type = other DNA
ctttttctttctctctgttt

SEQ ID NO: 27743 - DNA, 20 bp, synthetic construct
  misc_feature 1..20: note = CRISPR gRNA sequence
  source 1..20: mol_type = other DNA
tttttctttctctctgtttc

SEQ ID NO: 27744 - DNA, 20 bp, synthetic construct
  misc_feature 1..20: note = CRISPR gRNA sequence
  source 1..20: mol_type = other DNA
tttctttctctctgtttctt

SEQ ID NO: 27745 - DNA, 20 bp, synthetic construct
  misc_feature 1..20: note = CRISPR gRNA sequence
  source 1..20: mol_type = other DNA
ttctttctctctgtttcttt

SEQ ID NO: 27746 - DNA, 20 bp, synthetic construct
  misc_feature 1..20: note = CRISPR gRNA sequence
  source 1..20: mol_type = other DNA
tctttctctctgtttctttc

SEQ ID NO: 27747 - DNA, 20 bp, synthetic construct
  misc_feature 1..20: note = CRISPR gRNA sequence
  source 1..20: mol_type = other DNA
ctttctctctgtttctttct

SEQ ID NO: 27748 - DNA, 20 bp, synthetic construct
  misc_feature 1..20: note = CRISPR gRNA sequence
  source 1..20: mol_type = other DNA
tttctctctgtttctttctt

SEQ ID NO: 27749 - DNA, 20 bp, synthetic construct
  misc_feature 1..20: note = CRISPR gRNA sequence
  source 1..20: mol_type = other DNA
tctctctgtttctttctttc

SEQ ID NO: 27750 - DNA, 20 bp, synthetic construct
  misc_feature 1..20: note = CRISPR gRNA sequence
  source 1..20: mol_type = other DNA
ctctctgtttctttctttct

SEQ ID NO: 27751 - DNA, 20 bp, synthetic construct
  misc_feature 1..20: note = CRISPR gRNA sequence
  source 1..20: mol_type = other DNA
tctctgtttctttctttctt

SEQ ID NO: 27752 - DNA, 20 bp, synthetic construct
  misc_feature 1..20: note = CRISPR gRNA sequence
  source 1..20: mol_type = other DNA
tctgtttctttctttctttc

SEQ ID NO: 27753 - DNA, 20 bp, synthetic construct
  misc_feature 1..20: note = CRISPR gRNA sequence
  source 1..20: mol_type = other DNA
tgtttctttctttctttctc

SEQ ID NO: 27754 - DNA, 20 bp, synthetic construct
  misc_feature 1..20: note = CRISPR gRNA sequence
  source 1..20: mol_type = other DNA
tttctttctttctttctctc

SEQ ID NO: 27755 - DNA, 20 bp, synthetic construct
  misc_feature 1..20: note = CRISPR gRNA sequence
  source 1..20: mol_type = other DNA
ctttctttctttctctctct

SEQ ID NO: 27756 - DNA, 20 bp, synthetic construct
  misc_feature 1..20: note = CRISPR gRNA sequence
  source 1..20: mol_type = other DNA
tttctttctttctctctctc

SEQ ID NO: 27757 - DNA, 20 bp, synthetic construct
  misc_feature 1..20: note = CRISPR gRNA sequence
  source 1..20: mol_type = other DNA
tctttctttctctctctctc

SEQ ID NO: 27758 - DNA, 20 bp, synthetic construct
  misc_feature 1..20: note = CRISPR gRNA sequence
  source 1..20: mol_type = other DNA
ctttctttctctctctctct

SEQ ID NO: 27759 - DNA, 20 bp, synthetic construct
  misc_feature 1..20: note = CRISPR gRNA sequence
  source 1..20: mol_type = other DNA
tttctttctctctctctctc

SEQ ID NO: 27760 - DNA, 20 bp, synthetic construct
  misc_feature 1..20: note = CRISPR gRNA sequence
  source 1..20: mol_type = other DNA
tctttctctctctctctccc

SEQ ID NO: 27761 - DNA, 20 bp, synthetic construct
  misc_feature 1..20: note = CRISPR gRNA sequence
  source 1..20: mol_type = other DNA
ctttctctctctctctccct

SEQ ID NO: 27762 - DNA, 20 bp, synthetic construct
  misc_feature 1..20: note = CRISPR gRNA sequence
  source 1..20: mol_type = other DNA
tttctctctctctctccctt

SEQ ID NO: 27763 - DNA, 20 bp, synthetic construct
  misc_feature 1..20: note = CRISPR gRNA sequence
  source 1..20: mol_type = other DNA
tctctctctctctcccttcc

SEQ ID NO: 27764 - DNA, 20 bp, synthetic construct
  misc_feature 1..20: note = CRISPR gRNA sequence
  source 1..20: mol_type = other DNA
ctctctctctctcccttcct

SEQ ID NO: 27765 - DNA, 20 bp, synthetic construct
  misc_feature 1..20: note = CRISPR gRNA sequence
  source 1..20: mol_type = other DNA
tctctctctctcccttcctt

SEQ ID NO: 27766 - DNA, 20 bp, synthetic construct
  misc_feature 1..20: note = CRISPR gRNA sequence
  source 1..20: mol_type = other DNA
tctctctctcccttccttcc

SEQ ID NO: 27767 - DNA, 20 bp, synthetic construct
  misc_feature 1..20: note = CRISPR gRNA sequence
  source 1..20: mol_type = other DNA
tctctctcccttccttcctc

SEQ ID NO: 27768 - DNA, 20 bp, synthetic construct
  misc_feature 1..20: note = CRISPR gRNA sequence
  source 1..20: mol_type = other DNA
tctctcccttccttcctccc

SEQ ID NO: 27769 - DNA, 20 bp, synthetic construct
  misc_feature 1..20: note = CRISPR gRNA sequence
  source 1..20: mol_type = other DNA
tctcccttccttcctccctc

SEQ ID NO: 27770 - DNA, 20 bp, synthetic construct
  misc_feature 1..20: note = CRISPR gRNA sequence
  source 1..20: mol_type = other DNA
tcccttccttcctccctccc

SEQ ID NO: 27771 - DNA, 20 bp, synthetic construct
  misc_feature 1..20: note = CRISPR gRNA sequence
  source 1..20: mol_type = other DNA
ccttccttcctccctcccta

SEQ ID NO: 27772 - DNA, 20 bp, synthetic construct
  misc_feature 1..20: note = CRISPR gRNA sequence
  source 1..20: mol_type = other DNA
ccttcctccctccctatctc

SEQ ID NO: 27773 - DNA, 20 bp, synthetic construct
  misc_feature 1..20: note = CRISPR gRNA sequence
  source 1..20: mol_type = other DNA
cttcctccctccctatctct

SEQ ID NO: 27774 - DNA, 20 bp, synthetic construct
  misc_feature 1..20: note = CRISPR gRNA sequence
  source 1..20: mol_type = other DNA
cctccctccctatctctctc

SEQ ID NO: 27775 - DNA, 20 bp, synthetic construct
  misc_feature 1..20: note = CRISPR gRNA sequence
  source 1..20: mol_type = other DNA
ctccctccctatctctctct

SEQ ID NO: 27776 - DNA, 20 bp, synthetic construct
  misc_feature 1..20: note = CRISPR gRNA sequence
  source 1..20: mol_type = other DNA
cctccctatctctctctttc

SEQ ID NO: 27777 - DNA, 20 bp, synthetic construct
  misc_feature 1..20: note = CRISPR gRNA sequence
  source 1..20: mol_type = other DNA
cctatctctctctttctttc

SEQ ID NO: 27778 - DNA, 20 bp, synthetic construct
  misc_feature 1..20: note = CRISPR gRNA sequence
  source 1..20: mol_type = other DNA
tctctctctttctttctttc

SEQ ID NO: 27779 - DNA, 20 bp, synthetic construct
  misc_feature 1..20: note = CRISPR gRNA sequence
  source 1..20: mol_type = other DNA
tctctttctttctttctttc

SEQ ID NO: 27780 - DNA, 20 bp, synthetic construct
  misc_feature 1..20: note = CRISPR gRNA sequence
  source 1..20: mol_type = other DNA
tctttctttctttctttcct

SEQ ID NO: 27781 - DNA, 20 bp, synthetic construct
  misc_feature 1..20: note = CRISPR gRNA sequence
  source 1..20: mol_type = other DNA
tttctttctttctttccttc

SEQ ID NO: 27782 - DNA, 20 bp, synthetic construct
  misc_feature 1..20: note = CRISPR gRNA sequence
  source 1..20: mol_type = other DNA
tctttctttctttccttctt

SEQ ID NO: 27783 - DNA, 20 bp, synthetic construct
  misc_feature 1..20: note = CRISPR gRNA sequence
  source 1..20: mol_type = other DNA
ctttctttctttccttcttt

SEQ ID NO: 27784 - DNA, 20 bp, synthetic construct
  misc_feature 1..20: note = CRISPR gRNA sequence
  source 1..20: mol_type = other DNA
tttctttctttccttctttt

SEQ ID NO: 27785 - DNA, 20 bp, synthetic construct
  misc_feature 1..20: note = CRISPR gRNA sequence
  source 1..20: mol_type = other DNA
tctttctttccttcttttct

SEQ ID NO: 27786 - DNA, 20 bp, synthetic construct
  misc_feature 1..20: note = CRISPR gRNA sequence
  source 1..20: mol_type = other DNA
ctttctttccttcttttctt

SEQ ID NO: 27787 - DNA, 20 bp, synthetic construct
  misc_feature 1..20: note = CRISPR gRNA sequence
  source 1..20: mol_type = other DNA
tttctttccttcttttcttt

SEQ ID NO: 27788 - DNA, 20 bp, synthetic construct
  misc_feature 1..20: note = CRISPR gRNA sequence
  source 1..20: mol_type = other DNA
tctttccttcttttctttct

SEQ ID NO: 27789 - DNA, 20 bp, synthetic construct
  misc_feature 1..20: note = CRISPR gRNA sequence
  source 1..20: mol_type = other DNA
ctttccttcttttctttctt

SEQ ID NO: 27790 - DNA, 20 bp, synthetic construct
  misc_feature 1..20: note = CRISPR gRNA sequence
  source 1..20: mol_type = other DNA
tttccttcttttctttcttt

SEQ ID NO: 27791 - DNA, 20 bp, synthetic construct
  misc_feature 1..20: note = CRISPR gRNA sequence
  source 1..20: mol_type = other DNA
tccttcttttctttctttcc

SEQ ID NO: 27792 - DNA, 20 bp, synthetic construct
  misc_feature 1..20: note = CRISPR gRNA sequence
  source 1..20: mol_type = other DNA
ccttcttttctttctttcct

SEQ ID NO: 27793 - DNA, 20 bp, synthetic construct
  misc_feature 1..20: note = CRISPR gRNA sequence
  source 1..20: mol_type = other DNA
cttcttttctttctttcctt

SEQ ID NO: 27794 - DNA, 20 bp, synthetic construct
  misc_feature 1..20: note = CRISPR gRNA sequence
  source 1..20: mol_type = other DNA
cttttctttctttcctttct

SEQ ID NO: 27795 - DNA, 20 bp, synthetic construct
  misc_feature 1..20: note = CRISPR gRNA sequence
  source 1..20: mol_type = other DNA
ttttctttctttcctttctc

SEQ ID NO: 27796 - DNA, 20 bp, synthetic construct
  misc_feature 1..20: note = CRISPR gRNA sequence
  source 1..20: mol_type = other DNA
ttctttctttcctttctctc

SEQ ID NO: 27797 - DNA, 20 bp, synthetic construct
  misc_feature 1..20: note = CRISPR gRNA sequence
  source 1..20: mol_type = other DNA
tctttctttcctttctctcc

SEQ ID NO: 27798 - DNA, 20 bp, synthetic construct
  misc_feature 1..20: note = CRISPR gRNA sequence
  source 1..20: mol_type = other DNA
ctttctttcctttctctcct

SEQ ID NO: 27799 - DNA, 20 bp, synthetic construct
  misc_feature 1..20: note = CRISPR gRNA sequence
  source 1..20: mol_type = other DNA
tttctttcctttctctcctt

SEQ ID NO: 27800 - DNA, 20 bp, synthetic construct
  misc_feature 1..20: note = CRISPR gRNA sequence
  source 1..20: mol_type = other DNA
tctttcctttctctcctttc

SEQ ID NO: 27801 - DNA, 20 bp, synthetic construct
  misc_feature 1..20: note = CRISPR gRNA sequence
  source 1..20: mol_type = other DNA
ctttcctttctctcctttct

SEQ ID NO: 27802 - DNA, 20 bp, synthetic construct
  misc_feature 1..20: note = CRISPR gRNA sequence
  source 1..20: mol_type = other DNA
tttcctttctctcctttctc

SEQ ID NO: 27803 - DNA, 20 bp, synthetic construct
  misc_feature 1..20: note = CRISPR gRNA sequence
  source 1..20: mol_type = other DNA
tcctttctctcctttctctt

SEQ ID NO: 27804 - DNA, 20 bp, synthetic construct
  misc_feature 1..20: note = CRISPR gRNA sequence
  source 1..20: mol_type = other DNA
cctttctctcctttctcttt

SEQ ID NO: 27805 - DNA, 20 bp, synthetic construct
  misc_feature 1..20: note = CRISPR gRNA sequence
  source 1..20: mol_type = other DNA
ctttctctcctttctctttc

SEQ ID NO: 27806 - DNA, 20 bp, synthetic construct
  misc_feature 1..20: note = CRISPR gRNA sequence
  source 1..20: mol_type = other DNA
tctctcctttctctttcttt

SEQ ID NO: 27807 - DNA, 20 bp, synthetic construct
  misc_feature 1..20: note = CRISPR gRNA sequence
  source 1..20: mol_type = other DNA
ctctcctttctctttctttc

SEQ ID NO: 27808 - DNA, 20 bp, synthetic construct
  misc_feature 1..20: note = CRISPR gRNA sequence
  source 1..20: mol_type = other DNA
tctcctttctctttctttct

SEQ ID NO: 27809 - DNA, 20 bp, synthetic construct
  misc_feature 1..20: note = CRISPR gRNA sequence
  source 1..20: mol_type = other DNA
tcctttctctttctttcttt

SEQ ID NO: 27810 - DNA, 20 bp, synthetic construct
  misc_feature 1..20: note = CRISPR gRNA sequence
  source 1..20: mol_type = other DNA
ctttctctttctttctttcc

SEQ ID NO: 27811 - DNA, 20 bp, synthetic construct
  misc_feature 1..20: note = CRISPR gRNA sequence
  source 1..20: mol_type = other DNA
tctctttctttctttccatt

SEQ ID NO: 27812 - DNA, 20 bp, synthetic construct
  misc_feature 1..20: note = CRISPR gRNA sequence
  source 1..20: mol_type = other DNA
ctctttctttctttccattc

SEQ ID NO: 27813 - DNA, 20 bp, synthetic construct
  misc_feature 1..20: note = CRISPR gRNA sequence
  source 1..20: mol_type = other DNA
tctttctttctttccattct

SEQ ID NO: 27814 - DNA, 20 bp, synthetic construct
  misc_feature 1..20: note = CRISPR gRNA sequence
  source 1..20: mol_type = other DNA
tttctttctttccattctct

SEQ ID NO: 27815 - DNA, 20 bp, synthetic construct
  misc_feature 1..20: note = CRISPR gRNA sequence
  source 1..20: mol_type = other DNA
tctttctttccattctcttt

SEQ ID NO: 27816 - DNA, 20 bp, synthetic construct
  misc_feature 1..20: note = CRISPR gRNA sequence
  source 1..20: mol_type = other DNA
ctttctttccattctctttc

SEQ ID NO: 27817 - DNA, 20 bp, synthetic construct
  misc_feature 1..20: note = CRISPR gRNA sequence
  source 1..20: mol_type = other DNA
tttctttccattctctttct

SEQ ID NO: 27818 - DNA, 20 bp, synthetic construct
  misc_feature 1..20: note = CRISPR gRNA sequence
  source 1..20: mol_type = other DNA
tctttccattctctttcttt

SEQ ID NO: 27819 - DNA, 20 bp, synthetic construct
  misc_feature 1..20: note = CRISPR gRNA sequence
  source 1..20: mol_type = other DNA
ctttccattctctttctttc

SEQ ID NO: 27820 - DNA, 20 bp, synthetic construct
  misc_feature 1..20: note = CRISPR gRNA sequence
  source 1..20: mol_type = other DNA
tttccattctctttctttct

SEQ ID NO: 27821 - DNA, 20 bp, synthetic construct
  misc_feature 1..20: note = CRISPR gRNA sequence
  source 1..20: mol_type = other DNA
tccattctctttctttctct

SEQ ID NO: 27822 - DNA, 20 bp, synthetic construct
  misc_feature 1..20: note = CRISPR gRNA sequence
  source 1..20: mol_type = other DNA
ccattctctttctttctctt

SEQ ID NO: 27823 - DNA, 20 bp, synthetic construct
  misc_feature 1..20: note = CRISPR gRNA sequence
  source 1..20: mol_type = other DNA
cattctctttctttctcttt

SEQ ID NO: 27824 - DNA, 20 bp, synthetic construct
  misc_feature 1..20: note = CRISPR gRNA sequence
  source 1..20: mol_type = other DNA
tctttctttctctttccttc

SEQ ID NO: 27825 - DNA, 20 bp, synthetic construct
  misc_feature 1..20: note = CRISPR gRNA sequence
  source 1..20: mol_type = other DNA
tttctttctctttccttccc

SEQ ID NO: 27826 - DNA, 20 bp, synthetic construct
  misc_feature 1..20: note = CRISPR gRNA sequence
  source 1..20: mol_type = other DNA
tctttctctttccttccctc

SEQ ID NO: 27827 - DNA, 20 bp, synthetic construct
  misc_feature 1..20: note = CRISPR gRNA sequence
  source 1..20: mol_type = other DNA
ctttctctttccttccctcc

SEQ ID NO: 27828 - DNA, 20 bp, synthetic construct
  misc_feature 1..20: note = CRISPR gRNA sequence
  source 1..20: mol_type = other DNA
tttctctttccttccctccc

SEQ ID NO: 27829 - DNA, 20 bp, synthetic construct
  misc_feature 1..20: note = CRISPR gRNA sequence
  source 1..20: mol_type = other DNA
tctctttccttccctccctt

SEQ ID NO: 27830 - DNA, 20 bp, synthetic construct
  misc_feature 1..20: note = CRISPR gRNA sequence
  source 1..20: mol_type = other DNA
ctctttccttccctcccttc

SEQ ID NO: 27831 - DNA, 20 bp, synthetic construct
  misc_feature 1..20: note = CRISPR gRNA sequence
  source 1..20: mol_type = other DNA
tctttccttccctcccttcc

SEQ ID NO: 27832 - DNA, 20 bp, synthetic construct
  misc_feature 1..20: note = CRISPR gRNA sequence
  source 1..20: mol_type = other DNA
tttccttccctcccttcctt

SEQ ID NO: 27833 - DNA, 20 bp, synthetic construct
  misc_feature 1..20: note = CRISPR gRNA sequence
  source 1..20: mol_type = other DNA
tccttccctcccttccttct

SEQ ID NO: 27834 - DNA, 20 bp, synthetic construct
  misc_feature 1..20: note = CRISPR gRNA sequence
  source 1..20: mol_type = other DNA
ccttccctcccttccttctc

SEQ ID NO: 27835 - DNA, 20 bp, synthetic construct
  misc_feature 1..20: note = CRISPR gRNA sequence
  source 1..20: mol_type = other DNA
cttccctcccttccttctct

SEQ ID NO: 27836 - DNA, 20 bp, synthetic construct
  misc_feature 1..20: note = CRISPR gRNA sequence
  source 1..20: mol_type = other DNA
ccctcccttccttctcttcc

SEQ ID NO: 27837 - DNA, 20 bp, synthetic construct
  misc_feature 1..20: note = CRISPR gRNA sequence
  source 1..20: mol_type = other DNA
cctcccttccttctcttcct

SEQ ID NO: 27838 - DNA, 20 bp, synthetic construct
  misc_feature 1..20: note = CRISPR gRNA sequence
  source 1..20: mol_type = other DNA
ccttccttctcttccttcct

SEQ ID NO: 27839 - DNA, 20 bp, synthetic construct
  misc_feature 1..20: note = CRISPR gRNA sequence
  source 1..20: mol_type = other DNA
ccttctcttccttccttctt

SEQ ID NO: 27840 - DNA, 20 bp, synthetic construct
  misc_feature 1..20: note = CRISPR gRNA sequence
  source 1..20: mol_type = other DNA
cttctcttccttccttcttt

SEQ ID NO: 27841 - DNA, 20 bp, synthetic construct
  misc_feature 1..20: note = CRISPR gRNA sequence
  source 1..20: mol_type = other DNA
ctcttccttccttctttttc

SEQ ID NO: 27842 - DNA, 20 bp, synthetic construct
  misc_feature 1..20: note = CRISPR gRNA sequence
  source 1..20: mol_type = other DNA
tcttccttccttctttttcc

SEQ ID NO: 27843 - DNA, 20 bp, synthetic construct
  misc_feature 1..20: note = CRISPR gRNA sequence
  source 1..20: mol_type = other DNA
ttccttccttctttttcctt

SEQ ID NO: 27844 - DNA, 20 bp, synthetic construct
  misc_feature 1..20: note = CRISPR gRNA sequence
  source 1..20: mol_type = other DNA
ccttccttctttttcctttc

SEQ ID NO: 27845 - DNA, 20 bp, synthetic construct
  misc_feature 1..20: note = CRISPR gRNA sequence
  source 1..20: mol_type = other DNA
cttccttctttttcctttcc

SEQ ID NO: 27846 - DNA, 20 bp, synthetic construct
  misc_feature 1..20: note = CRISPR gRNA sequence
  source 1..20: mol_type = other DNA
ccttctttttcctttccttt

SEQ ID NO: 27847 - DNA, 20 bp, synthetic construct
  misc_feature 1..20: note = CRISPR gRNA sequence
  source 1..20: mol_type = other DNA
cttctttttcctttcctttt

SEQ ID NO: 27848 - DNA, 20 bp, synthetic construct
  misc_feature 1..20: note = CRISPR gRNA sequence
  source 1..20: mol_type = other DNA
ctttttcctttccttttctt

SEQ ID NO: 27849 - DNA, 20 bp, synthetic construct
  misc_feature 1..20: note = CRISPR gRNA sequence
  source 1..20: mol_type = other DNA
tttttcctttccttttcttt

SEQ ID NO: 27850 - DNA, 20 bp, synthetic construct
  misc_feature 1..20: note = CRISPR gRNA sequence
  source 1..20: mol_type = other DNA
tttcctttccttttctttcc

SEQ ID NO: 27851 - DNA, 20 bp, synthetic construct
  misc_feature 1..20: note = CRISPR gRNA sequence
  source 1..20: mol_type = other DNA
ttcctttccttttctttcct

SEQ ID NO: 27852 - DNA, 20 bp, synthetic construct
  misc_feature 1..20: note = CRISPR gRNA sequence
  source 1..20: mol_type = other DNA
tcctttccttttctttcctt

SEQ ID NO: 27853 - DNA, 20 bp, synthetic construct
  misc_feature 1..20: note = CRISPR gRNA sequence
  source 1..20: mol_type = other DNA
cctttccttttctttccttt

SEQ ID NO: 27854 - DNA, 20 bp, synthetic construct
  misc_feature 1..20: note = CRISPR gRNA sequence
  source 1..20: mol_type = other DNA
ctttccttttctttcctttt

SEQ ID NO: 27855 - DNA, 20 bp, synthetic construct
  misc_feature 1..20: note = CRISPR gRNA sequence
  source 1..20: mol_type = other DNA
tccttttctttccttttctt

SEQ ID NO: 27856 - DNA, 20 bp, synthetic construct
  misc_feature 1..20: note = CRISPR gRNA sequence
  source 1..20: mol_type = other DNA
ccttttctttccttttcttt

SEQ ID NO: 27857 - DNA, 20 bp, synthetic construct
  misc_feature 1..20: note = CRISPR gRNA sequence
  source 1..20: mol_type = other DNA
cttttctttccttttctttt

SEQ ID NO: 27858 - DNA, 20 bp, synthetic construct
  misc_feature 1..20: note = CRISPR gRNA sequence
  source 1..20: mol_type = other DNA
ttctttccttttcttttctt

SEQ ID NO: 27859 - DNA, 20 bp, synthetic construct
  misc_feature 1..20: note = CRISPR gRNA sequence
  source 1..20: mol_type = other DNA
tctttccttttcttttcttt

SEQ ID NO: 27860 - DNA, 20 bp, synthetic construct
  misc_feature 1..20: note = CRISPR gRNA sequence
  source 1..20: mol_type = other DNA
ctttccttttcttttctttc

SEQ ID NO: 27861 - DNA, 20 bp, synthetic construct
  misc_feature 1..20: note = CRISPR gRNA sequence
  source 1..20: mol_type = other DNA
tttccttttcttttctttct

SEQ ID NO: 27862 - DNA, 20 bp, synthetic construct
  misc_feature 1..20: note = CRISPR gRNA sequence
  source 1..20: mol_type = other DNA
tccttttcttttctttcttg

SEQ ID NO: 27863 - DNA, 20 bp, synthetic construct
  misc_feature 1..20: note = CRISPR gRNA sequence
  source 1..20: mol_type = other DNA
ccttttcttttctttcttga

SEQ ID NO: 27864 - DNA, 20 bp, synthetic construct
  misc_feature 1..20: note = CRISPR gRNA sequence
  source 1..20: mol_type = other DNA
cttttcttttctttcttgag

SEQ ID NO: 27865 - DNA, 20 bp, synthetic construct
  misc_feature 1..20: note = CRISPR gRNA sequence
  source 1..20: mol_type = other DNA
ttcttttctttcttgaggca

SEQ ID NO: 27866 - DNA, 20 bp, synthetic construct
  misc_feature 1..20: note = CRISPR gRNA sequence
  source 1..20: mol_type = other DNA
tcttttctttcttgaggcag

SEQ ID NO: 27867 - DNA, 20 bp, synthetic construct
  misc_feature 1..20: note = CRISPR gRNA sequence
  source 1..20: mol_type = other DNA
cttttctttcttgaggcaga

SEQ ID NO: 27868 - DNA, 20 bp, synthetic construct
  misc_feature 1..20: note = CRISPR gRNA sequence
  source 1..20: mol_type = other DNA
ttttctttcttgaggcagag

SEQ ID NO: 27869 - DNA, 20 bp, synthetic construct
  misc_feature 1..20: note = CRISPR gRNA sequence
  source 1..20: mol_type = other DNA
ttctttcttgaggcagagtc

SEQ ID NO: 27870 - DNA, 20 bp, synthetic construct
  misc_feature 1..20: note = CRISPR gRNA sequence
  source 1..20: mol_type = other DNA
tctttcttgaggcagagtct

SEQ ID NO: 27871 - DNA, 20 bp, synthetic construct
  misc_feature 1..20: note = CRISPR gRNA sequence
  source 1..20: mol_type = other DNA
ctttcttgaggcagagtctt

SEQ ID NO: 27872 - DNA, 20 bp, synthetic construct
  misc_feature 1..20: note = CRISPR gRNA sequence
  source 1..20: mol_type = other DNA
tttcttgaggcagagtctta

SEQ ID NO: 27873 - DNA, 20 bp, synthetic construct
  misc_feature 1..20: note = CRISPR gRNA sequence
  source 1..20: mol_type = other DNA
tcttgaggcagagtcttact

SEQ ID NO: 27874 - DNA, 20 bp, synthetic construct
  misc_feature 1..20: note = CRISPR gRNA sequence
  source 1..20: mol_type = other DNA
cttgaggcagagtcttactc

SEQ ID NO: 27875 - DNA, 20 bp, synthetic construct
  misc_feature 1..20: note = CRISPR gRNA sequence
  source 1..20: mol_type = other DNA
ttgaggcagagtcttactct

SEQ ID NO: 27876 - DNA, 20 bp, synthetic construct
  misc_feature 1..20: note = CRISPR gRNA sequence
  source 1..20: mol_type = other DNA
gaggcagagtcttactctgt

SEQ ID NO: 27877 - DNA, 20 bp, synthetic construct
  misc_feature 1..20: note = CRISPR gRNA sequence
  source 1..20: mol_type = other DNA
aggcagagtcttactctgtc

SEQ ID NO: 27878 - DNA, 20 bp, synthetic construct
  misc_feature 1..20: note = CRISPR gRNA sequence
  source 1..20: mol_type = other DNA
actctgtccctcaggctgga

SEQ ID NO: 27879 - DNA, 20 bp, synthetic construct
  misc_feature 1..20: note = CRISPR gRNA sequence
  source 1..20: mol_type = other DNA
ctctgtccctcaggctggag

SEQ ID NO: 27880 - DNA, 20 bp, synthetic construct
  misc_feature 1..20: note = CRISPR gRNA sequence
  source 1..20: mol_type = other DNA
tgtccctcaggctggagttc

SEQ ID NO: 27881 - DNA, 20 bp, synthetic construct
  misc_feature 1..20: note = CRISPR gRNA sequence
  source 1..20: mol_type = other DNA
tccctcaggctggagttcag

SEQ ID NO: 27882 - DNA, 20 bp, synthetic construct
  misc_feature 1..20: note = CRISPR gRNA sequence
  source 1..20: mol_type = other DNA
aggctggagttcagtggcac

SEQ ID NO: 27883 - DNA, 20 bp, synthetic construct
  misc_feature 1..20: note = CRISPR gRNA sequence
  source 1..20: mol_type = other DNA
gagttcagtggcacaatcac

SEQ ID NO: 27884 - DNA, 20 bp, synthetic construct
  misc_feature 1..20: note = CRISPR gRNA sequence
  source 1..20: mol_type = other DNA
agtggcacaatcacagctca

SEQ ID NO: 27885 - DNA, 20 bp, synthetic construct
  misc_feature 1..20: note = CRISPR gRNA sequence
  source 1..20: mol_type = other DNA
accacagcctcaacctccct

SEQ ID NO: 27886 - DNA, 20 bp, synthetic construct
  misc_feature 1..20: note = CRISPR gRNA sequence
  source 1..20: mol_type = other DNA
aacctccctaggctcaagtg

SEQ ID NO: 27887 - DNA, 20 bp, synthetic construct
  misc_feature 1..20: note = CRISPR gRNA sequence
  source 1..20: mol_type = other DNA
cctaggctcaagtgatcctc

SEQ ID NO: 27888 - DNA, 20 bp, synthetic construct
  misc_feature 1..20: note = CRISPR gRNA sequence
  source 1..20: mol_type = other DNA
ggctcaagtgatcctcccac

SEQ ID NO: 27889 - DNA, 20 bp, synthetic construct
  misc_feature 1..20: note = CRISPR gRNA sequence
  source 1..20: mol_type = other DNA
aagtgatcctcccacctcag

SEQ ID NO: 27890 - DNA, 20 bp, synthetic construct
  misc_feature 1..20: note = CRISPR gRNA sequence
  source 1..20: mol_type = other DNA
ccacctcagcctccctagta

SEQ ID NO: 27891 - DNA, 20 bp, synthetic construct
  misc_feature 1..20: note = CRISPR gRNA sequence
  source 1..20: mol_type = other DNA
agcctccctagtagctggga

SEQ ID NO: 27892 - DNA, 20 bp, synthetic construct
  misc_feature 1..20: note = CRISPR gRNA sequence
  source 1..20: mol_type = other DNA
cctagtagctgggactacag

SEQ ID NO: 27893 - DNA, 20 bp, synthetic construct
  misc_feature 1..20: note = CRISPR gRNA sequence
  source 1..20: mol_type = other DNA
gtagctgggactacaggcat

SEQ ID NO: 27894 - DNA, 20 bp, synthetic construct
  misc_feature 1..20: note = CRISPR gRNA sequence
  source 1..20: mol_type = other DNA
ggactacaggcatgccccac

SEQ ID NO: 27895 - DNA, 20 bp, synthetic construct
  misc_feature 1..20: note = CRISPR gRNA sequence
  source 1..20: mol_type = other DNA
caggcatgccccacctgact

SEQ ID NO: 27896 - DNA, 20 bp, synthetic construct
  misc_feature 1..20: note = CRISPR gRNA sequence
  source 1..20: mol_type = other DNA
actaatttttgtattttttg

SEQ ID NO: 27897 - DNA, 20 bp, synthetic construct
  misc_feature 1..20: note = CRISPR gRNA sequence
  source 1..20: mol_type = other DNA
atttttgtattttttgtaga

SEQ ID NO: 27898 - DNA, 20 bp, synthetic construct
  misc_feature 1..20: note = CRISPR gRNA sequence
  source 1..20: mol_type = other DNA
ttgtattttttgtagagaca

SEQ ID NO: 27899 - DNA, 20 bp, synthetic construct
  misc_feature 1..20: note = CRISPR gRNA sequence
  source 1..20: mol_type = other DNA
tgtattttttgtagagacag

SEQ ID NO: 27900 - DNA, 20 bp, synthetic construct
  misc_feature 1..20: note = CRISPR gRNA sequence
  source 1..20: mol_type = other DNA
gtattttttgtagagacagg

SEQ ID NO: 27901 - DNA, 20 bp, synthetic construct
  misc_feature 1..20: note = CRISPR gRNA sequence
  source 1..20: mol_type = other DNA
tattttttgtagagacagga

SEQ ID NO: 27902 - DNA, 20 bp, synthetic construct
  misc_feature 1..20: note = CRISPR gRNA sequence
  source 1..20: mol_type = other DNA
tttgtagagacaggatttca

SEQ ID NO: 27903 - DNA, 20 bp, synthetic construct
  misc_feature 1..20: note = CRISPR gRNA sequence
  source 1..20: mol_type = other DNA
ttgtagagacaggatttcac

SEQ ID NO: 27904 - DNA, 20 bp, synthetic construct
  misc_feature 1..20: note = CRISPR gRNA sequence
  source 1..20: mol_type = other DNA
tgtagagacaggatttcacc

SEQ ID NO: 27905 - DNA, 20 bp, synthetic construct
  misc_feature 1..20: note = CRISPR gRNA sequence
  source 1..20: mol_type = other DNA
gtagagacaggatttcacca

SEQ ID NO: 27906 - DNA, 20 bp, synthetic construct
  misc_feature 1..20: note = CRISPR gRNA sequence
  source 1..20: mol_type = other DNA
tagagacaggatttcaccat

SEQ ID NO: 27907 - DNA, 20 bp, synthetic construct
  misc_feature 1..20: note = CRISPR gRNA sequence
  source 1..20: mol_type = other DNA
caccatgttgcccagtctgg

SEQ ID NO: 27908 - DNA, 20 bp, synthetic construct
  misc_feature 1..20: note = CRISPR gRNA sequence
  source 1..20: mol_type = other DNA
accatgttgcccagtctggt

SEQ ID NO: 27909 - DNA, 20 bp, synthetic construct
  misc_feature 1..20: note = CRISPR gRNA sequence
  source 1..20: mol_type = other DNA
cccagtctggtctcgagctc

SEQ ID NO: 27910 - DNA, 20 bp, synthetic construct
  misc_feature 1..20: note = CRISPR gRNA sequence
  source 1..20: mol_type = other DNA
gtctcgagctcctgggctca

SEQ ID NO: 27911 - DNA, 20 bp, synthetic construct
  misc_feature 1..20: note = CRISPR gRNA sequence
  source 1..20: mol_type = other DNA
gagctcctgggctcaagcaa

SEQ ID NO: 27912 - DNA, 20 bp, synthetic construct
  misc_feature 1..20: note = CRISPR gRNA sequence
  source 1..20: mol_type = other DNA
ctgggctcaagcaatcctcc

SEQ ID NO: 27913 - DNA, 20 bp, synthetic construct
  misc_feature 1..20: note = CRISPR gRNA sequence
  source 1..20: mol_type = other DNA
ggctcaagcaatcctcccac

SEQ ID NO: 27914 - DNA, 20 bp, synthetic construct
  misc_feature 1..20: note = CRISPR gRNA sequence
  source 1..20: mol_type = other DNA
aagcaatcctcccacctcag

SEQ ID NO: 27915 - DNA, 20 bp, synthetic construct
  misc_feature 1..20: note = CRISPR gRNA sequence
  source 1..20: mol_type = other DNA
ccacctcagcctcccaaagt

SEQ ID NO: 27916 - DNA, 20 bp, synthetic construct
  misc_feature 1..20: note = CRISPR gRNA sequence
  source 1..20: mol_type = other DNA
agcctcccaaagtgctagga

SEQ ID NO: 27917 - DNA, 20 bp, synthetic construct
  misc_feature 1..20: note = CRISPR gRNA sequence
  source 1..20: mol_type = other DNA
ccaaagtgctaggattacag

SEQ ID NO: 27918 - DNA, 20 bp, synthetic construct
  misc_feature 1..20: note = CRISPR gRNA sequence
  source 1..20: mol_type = other DNA
ggattacaggtgcgagctcc

SEQ ID NO: 27919 - DNA, 20 bp, synthetic construct
  misc_feature 1..20: note = CRISPR gRNA sequence
  source 1..20: mol_type = other DNA
caggtgcgagctcccgcacc

SEQ ID NO: 27920 - DNA, 20 bp, synthetic construct
  misc_feature 1..20: note = CRISPR gRNA sequence
  source 1..20: mol_type = other DNA
ccgcacctggccagaacagg

SEQ ID NO: 27921 - DNA, 20 bp, synthetic construct
  misc_feature 1..20: note = CRISPR gRNA sequence
  source 1..20: mol_type = other DNA
gccagaacaggcttttaaat

SEQ ID NO: 27922 - DNA, 20 bp, synthetic construct
  misc_feature 1..20: note = CRISPR gRNA sequence
  source 1..20: mol_type = other DNA
ttaaatttgcagctcacctt

SEQ ID NO: 27923 - DNA, 20 bp, synthetic construct
  misc_feature 1..20: note = CRISPR gRNA sequence
  source 1..20: mol_type = other DNA
taaatttgcagctcaccttc

SEQ ID NO: 27924 - DNA, 20 bp, synthetic construct
  misc_feature 1..20: note = CRISPR gRNA sequence
  source 1..20: mol_type = other DNA
aaatttgcagctcaccttcc

SEQ ID NO: 27925 - DNA, 20 bp, synthetic construct
  misc_feature 1..20: note = CRISPR gRNA sequence
  source 1..20: mol_type = other DNA
aatttgcagctcaccttcca

SEQ ID NO: 27926 - DNA, 20 bp, synthetic construct
  misc_feature 1..20: note = CRISPR gRNA sequence
  source 1..20: mol_type = other DNA
gcagctcaccttccatctca

SEQ ID NO: 27927 - DNA, 20 bp, synthetic construct
  misc_feature 1..20: note = CRISPR gRNA sequence
  source 1..20: mol_type = other DNA
cagctcaccttccatctcaa

SEQ ID NO: 27928 - DNA, 20 bp, synthetic construct
  misc_feature 1..20: note = CRISPR gRNA sequence
  source 1..20: mol_type = other DNA
accttccatctcaattatct

SEQ ID NO: 27929 - DNA, 20 bp, synthetic construct
  misc_feature 1..20: note = CRISPR gRNA sequence
  source 1..20: mol_type = other DNA
ccatctcaattatctcaggc

SEQ ID NO: 27930 - DNA, 20 bp, synthetic construct
  misc_feature 1..20: note = CRISPR gRNA sequence
  source 1..20: mol_type = other DNA
catctcaattatctcaggcc

SEQ ID NO: 27931 - DNA, 20 bp, synthetic construct
  misc_feature 1..20: note = CRISPR gRNA sequence
  source 1..20: mol_type = other DNA
aattatctcaggccaccctc

SEQ ID NO: 27932 - DNA, 20 bp, synthetic construct
  misc_feature 1..20: note = CRISPR gRNA sequence
  source 1..20: mol_type = other DNA
tctcaggccaccctcctcta

SEQ ID NO: 27933 - DNA, 20 bp, synthetic construct
  misc_feature 1..20: note = CRISPR gRNA sequence
  source 1..20: mol_type = other DNA
aggccaccctcctctacagg

SEQ ID NO: 27934 - DNA, 20 bp, synthetic construct
  misc_feature 1..20: note = CRISPR gRNA sequence
  source 1..20: mol_type = other DNA
ctctacaggcattgtcatca

SEQ ID NO: 27935 - DNA, 20 bp, synthetic construct
  misc_feature 1..20: note = CRISPR gRNA sequence
  source 1..20: mol_type = other DNA
tacaggcattgtcatcatct

SEQ ID NO: 27936 - DNA, 20 bp, synthetic construct
  misc_feature 1..20: note = CRISPR gRNA sequence
  source 1..20: mol_type = other DNA
caggcattgtcatcatctcc

SEQ ID NO: 27937 - DNA, 20 bp, synthetic construct
  misc_feature 1..20: note = CRISPR gRNA sequence
  source 1..20: mol_type = other DNA
tcatcatctccccattgtac

SEQ ID NO: 27938 - DNA, 20 bp, synthetic construct
  misc_feature 1..20: note = CRISPR gRNA sequence
  source 1..20: mol_type = other DNA
cccattgtacaaatggcaat

SEQ ID NO: 27939 - DNA, 20 bp, synthetic construct
  misc_feature 1..20: note = CRISPR gRNA sequence
  source 1..20: mol_type = other DNA
tacaaatggcaatgctgaga

SEQ ID NO: 27940 - DNA, 20 bp, synthetic construct
  misc_feature 1..20: note = CRISPR gRNA sequence
  source 1..20: mol_type = other DNA
agaacaagagactttaaatt

SEQ ID NO: 27941 - DNA, 20 bp, synthetic construct
  misc_feature 1..20: note = CRISPR gRNA sequence
  source 1..20: mol_type = other DNA
taaattgtttatccaaagtc

SEQ ID NO: 27942 - DNA, 20 bp, synthetic construct
  misc_feature 1..20: note = CRISPR gRNA sequence
  source 1..20: mol_type = other DNA
aaattgtttatccaaagtca

SEQ ID NO: 27943 - DNA, 20 bp, synthetic construct
  misc_feature 1..20: note = CRISPR gRNA sequence
  source 1..20: mol_type = other DNA
aattgtttatccaaagtcat

SEQ ID NO: 27944 - DNA, 20 bp, synthetic construct
  misc_feature 1..20: note = CRISPR gRNA sequence
  source 1..20: mol_type = other DNA
tttatccaaagtcataaagg

SEQ ID NO: 27945 - DNA, 20 bp, synthetic construct
  misc_feature 1..20: note = CRISPR gRNA sequence
  source 1..20: mol_type = other DNA
atccaaagtcataaaggtca

SEQ ID NO: 27946 - DNA, 20 bp, synthetic construct
  misc_feature 1..20: note = CRISPR gRNA sequence
  source 1..20: mol_type = other DNA
tccaaagtcataaaggtcag

SEQ ID NO: 27947 - DNA, 20 bp, synthetic construct
  misc_feature 1..20: note = CRISPR gRNA sequence
  source 1..20: mol_type = other DNA
gccctaagctccttccacag

SEQ ID NO: 27948 - DNA, 20 bp, synthetic construct
  misc_feature 1..20: note = CRISPR gRNA sequence
  source 1..20: mol_type = other DNA
agctccttccacagaaaaag

SEQ ID NO: 27949 - DNA, 20 bp, synthetic construct
  misc_feature 1..20: note = CRISPR gRNA sequence
  source 1..20: mol_type = other DNA
cttccacagaaaaagctaaa

SEQ ID NO: 27950 - DNA, 20 bp, synthetic construct
  misc_feature 1..20: note = CRISPR gRNA sequence
  source 1..20: mol_type = other DNA
ccacagaaaaagctaaatga

SEQ ID NO: 27951 - DNA, 20 bp, synthetic construct
  misc_feature 1..20: note = CRISPR gRNA sequence
  source 1..20: mol_type = other DNA
cacagaaaaagctaaatgaa

SEQ ID NO: 27952 - DNA, 20 bp, synthetic construct
  misc_feature 1..20: note = CRISPR gRNA sequence
  source 1..20: mol_type = other DNA
aatgaatgtttgttccttgg

SEQ ID NO: 27953 - DNA, 20 bp, synthetic construct
  misc_feature 1..20: note = CRISPR gRNA sequence
  source 1..20: mol_type = other DNA
gttccttggtaggggtctag

SEQ ID NO: 27954 - DNA, 20 bp, synthetic construct
  misc_feature 1..20: note = CRISPR gRNA sequence
  source 1..20: mol_type = other DNA
ttccttggtaggggtctaga

SEQ ID NO: 27955 - DNA, 20 bp, synthetic construct
  misc_feature 1..20: note = CRISPR gRNA sequence
  source 1..20: mol_type = other DNA
cttggtaggggtctagatca

SEQ ID NO: 27956 - DNA, 20 bp, synthetic construct
  misc_feature 1..20: note = CRISPR gRNA sequence
  source 1..20: mol_type = other DNA
ggtaggggtctagatcatct

SEQ ID NO: 27957 - DNA, 20 bp, synthetic construct
  misc_feature 1..20: note = CRISPR gRNA sequence
  source 1..20: mol_type = other DNA
gtaggggtctagatcatcta

SEQ ID NO: 27958 - DNA, 20 bp, synthetic construct
  misc_feature 1..20: note = CRISPR gRNA sequence
  source 1..20: mol_type = other DNA
gatcatctaatgattaggaa

SEQ ID NO: 27959 - DNA, 20 bp, synthetic construct
  misc_feature 1..20: note = CRISPR gRNA sequence
  source 1..20: mol_type = other DNA
atgattaggaaggagttgtt

SEQ ID NO: 27960 - DNA, 20 bp, synthetic construct
  misc_feature 1..20: note = CRISPR gRNA sequence
  source 1..20: mol_type = other DNA
ggaaggagttgttatgcctg

SEQ ID NO: 27961 - DNA, 20 bp, synthetic construct
  misc_feature 1..20: note = CRISPR gRNA sequence
  source 1..20: mol_type = other DNA
ttatgcctgtggtatattcg

SEQ ID NO: 27962 - DNA, 20 bp, synthetic construct
  misc_feature 1..20: note = CRISPR gRNA sequence
  source 1..20: mol_type = other DNA
tgcctgtggtatattcggtg

SEQ ID NO: 27963 - DNA, 20 bp, synthetic construct
  misc_feature 1..20: note = CRISPR gRNA sequence
  source 1..20: mol_type = other DNA
tggtatattcggtgctgttt

SEQ ID NO: 27964 - DNA, 20 bp, synthetic construct
  misc_feature 1..20: note = CRISPR gRNA sequence
  source 1..20: mol_type = other DNA
ggtgctgtttttttttggag

SEQ ID NO: 27965 - DNA, 20 bp, synthetic construct
  misc_feature 1..20: note = CRISPR gRNA sequence
  source 1..20: mol_type = other DNA
tttttttttggagatggggt

SEQ ID NO: 27966 - DNA, 20 bp, synthetic construct
  misc_feature 1..20: note = CRISPR gRNA sequence
  source 1..20: mol_type = other DNA
ttttttggagatggggtctt

SEQ ID NO: 27967 - DNA, 20 bp, synthetic construct
  misc_feature 1..20: note = CRISPR gRNA sequence
  source 1..20: mol_type = other DNA
tttttggagatggggtcttg

SEQ ID NO: 27968 - DNA, 20 bp, synthetic construct
  misc_feature 1..20: note = CRISPR gRNA sequence
  source 1..20: mol_type = other DNA
ttttggagatggggtcttgc

SEQ ID NO: 27969 - DNA, 20 bp, synthetic construct
  misc_feature 1..20: note = CRISPR gRNA sequence
  source 1..20: mol_type = other DNA
tttggagatggggtcttgct

SEQ ID NO: 27970 - DNA, 20 bp, synthetic construct
  misc_feature 1..20: note = CRISPR gRNA sequence
  source 1..20: mol_type = other DNA
ttggagatggggtcttgctc

SEQ ID NO: 27971 - DNA, 20 bp, synthetic construct
  misc_feature 1..20: note = CRISPR gRNA sequence
  source 1..20: mol_type = other DNA
tggagatggggtcttgctct

SEQ ID NO: 27972 - DNA, 20 bp, synthetic construct
  misc_feature 1..20: note = CRISPR gRNA sequence
  source 1..20: mol_type = other DNA
ggagatggggtcttgctctg

SEQ ID NO: 27973 - DNA, 20 bp, synthetic construct
  misc_feature 1..20: note = CRISPR gRNA sequence
  source 1..20: mol_type = other DNA
gagatggggtcttgctctgt

SEQ ID NO: 27974 - DNA, 20 bp, synthetic construct
  misc_feature 1..20: note = CRISPR gRNA sequence
  source 1..20: mol_type = other DNA
gctctgtcacccaggctaga

SEQ ID NO: 27975 - DNA, 20 bp, synthetic construct
  misc_feature 1..20: note = CRISPR gRNA sequence
  source 1..20: mol_type = other DNA
ctctgtcacccaggctagaa

SEQ ID NO: 27976 - DNA, 20 bp, synthetic construct
  misc_feature 1..20: note = CRISPR gRNA sequence
  source 1..20: mol_type = other DNA
tgtcacccaggctagaatgc

SEQ ID NO: 27977 - DNA, 20 bp, synthetic construct
  misc_feature 1..20: note = CRISPR gRNA sequence
  source 1..20: mol_type = other DNA
tcacccaggctagaatgcag

SEQ ID NO: 27978 - DNA, 20 bp, synthetic construct
  misc_feature 1..20: note = CRISPR gRNA sequence
  source 1..20: mol_type = other DNA
gaatgcagtggtatgatctt

SEQ ID NO: 27979 - DNA, 20 bp, synthetic construct
  misc_feature 1..20: note = CRISPR gRNA sequence
  source 1..20: mol_type = other DNA
ggctcactgcaatctccacc

SEQ ID NO: 27980 - DNA, 20 bp, synthetic construct
  misc_feature 1..20: note = CRISPR gRNA sequence
  source 1..20: mol_type = other DNA
gctcactgcaatctccacct

SEQ ID NO: 27981 - DNA, 20 bp, synthetic construct
  misc_feature 1..20: note = CRISPR gRNA sequence
  source 1..20: mol_type = other DNA
actgcaatctccacctctcg

SEQ ID NO: 27982 - DNA, 20 bp, synthetic construct
  misc_feature 1..20: note = CRISPR gRNA sequence
  source 1..20: mol_type = other DNA
caatctccacctctcggttc

SEQ ID NO: 27983 - DNA, 20 bp, synthetic construct
  misc_feature 1..20: note = CRISPR gRNA sequence
  source 1..20: mol_type = other DNA
cacctctcggttcaagcaat

SEQ ID NO: 27984 - DNA, 20 bp, synthetic construct
  misc_feature 1..20: note = CRISPR gRNA sequence
  source 1..20: mol_type = other DNA
tcggttcaagcaattttcct

SEQ ID NO: 27985 - DNA, 20 bp, synthetic construct
  misc_feature 1..20: note = CRISPR gRNA sequence
  source 1..20: mol_type = other DNA
ggttcaagcaattttcctgc

SEQ ID NO: 27986 - DNA, 20 bp, synthetic construct
  misc_feature 1..20: note = CRISPR gRNA sequence
  source 1..20: mol_type = other DNA
aagcaattttcctgcctcag

SEQ ID NO: 27987 - DNA, 20 bp, synthetic construct
  misc_feature 1..20: note = CRISPR gRNA sequence
  source 1..20: mol_type = other DNA
tcctgcctcagcctcccgag

SEQ ID NO: 27988 - DNA, 20 bp, synthetic construct
  misc_feature 1..20: note = CRISPR gRNA sequence
  source 1..20: mol_type = other DNA
cctgcctcagcctcccgagt

SEQ ID NO: 27989 - DNA, 20 bp, synthetic construct
  misc_feature 1..20: note = CRISPR gRNA sequence
  source 1..20: mol_type = other DNA
ctgcctcagcctcccgagta

SEQ ID NO: 27990 - DNA, 20 bp, synthetic construct
  misc_feature 1..20: note = CRISPR gRNA sequence
  source 1..20: mol_type = other DNA
cctcagcctcccgagtagct

SEQ ID NO: 27991 - DNA, 20 bp, synthetic construct
  misc_feature 1..20: note = CRISPR gRNA sequence
  source 1..20: mol_type = other DNA
agcctcccgagtagctggga

SEQ ID NO: 27992 - DNA, 20 bp, synthetic construct
  misc_feature 1..20: note = CRISPR gRNA sequence
  source 1..20: mol_type = other DNA
ccgagtagctgggattacag

SEQ ID NO: 27993 - DNA, 20 bp, synthetic construct
  misc_feature 1..20: note = CRISPR gRNA sequence
  source 1..20: mol_type = other DNA
ggattacaggtgtacaccac

SEQ ID NO: 27994 - DNA, 20 bp, synthetic construct
  misc_feature 1..20: note = CRISPR gRNA sequence
  source 1..20: mol_type = other DNA
caggtgtacaccactacacc

SEQ ID NO: 27995 - DNA, 20 bp, synthetic construct
  misc_feature 1..20: note = CRISPR gRNA sequence
  source 1..20: mol_type = other DNA
cacctggctaatttttgtat

SEQ ID NO: 27996 - DNA, 20 bp, synthetic construct
  misc_feature 1..20: note = CRISPR gRNA sequence
  source 1..20: mol_type = other DNA
gctaatttttgtatttttag

SEQ ID NO: 27997 - DNA, 20 bp, synthetic construct
  misc_feature 1..20: note = CRISPR gRNA sequence
  source 1..20: mol_type = other DNA
atttttgtatttttagtaga

SEQ ID NO: 27998 - DNA, 20 bp, synthetic construct
  misc_feature 1..20: note = CRISPR gRNA sequence
  source 1..20: mol_type = other DNA
ttgtatttttagtagagacg

SEQ ID NO: 27999 - DNA, 20 bp, synthetic construct
  misc_feature 1..20: note = CRISPR gRNA sequence
  source 1..20: mol_type = other DNA
tgtatttttagtagagacgg

SEQ ID NO: 28000 - DNA, 20 bp, synthetic construct
  misc_feature 1..20: note = CRISPR gRNA sequence
  source 1..20: mol_type = other DNA
gtatttttagtagagacggg

SEQ ID NO: 28001 - DNA, 20 bp, synthetic construct
  misc_feature 1..20: note = CRISPR gRNA sequence
  source 1..20: mol_type = other DNA
tatttttagtagagacgggc

SEQ ID NO: 28002 - DNA, 20 bp, synthetic construct
  misc_feature 1..20: note = CRISPR gRNA sequence
  source 1..20: mol_type = other DNA
ttagtagagacgggctttaa

SEQ ID NO: 28003 - DNA, 20 bp, synthetic construct
  misc_feature 1..20: note = CRISPR gRNA sequence
  source 1..20: mol_type = other DNA
tagtagagacgggctttaac

SEQ ID NO: 28004 - DNA, 20 bp, synthetic construct
  misc_feature 1..20: note = CRISPR gRNA sequence
  source 1..20: mol_type = other DNA
agtagagacgggctttaacc

SEQ ID NO: 28005 - DNA, 20 bp, synthetic construct
  misc_feature 1..20: note = CRISPR gRNA sequence
  source 1..20: mol_type = other DNA
gtagagacgggctttaacca

SEQ ID NO: 28006 - DNA, 20 bp, synthetic construct
  misc_feature 1..20: note = CRISPR gRNA sequence
  source 1..20: mol_type = other DNA
taaccatgttggccaggctg

SEQ ID NO: 28007 - DNA, 20 bp, synthetic construct
  misc_feature 1..20: note = CRISPR gRNA sequence
  source 1..20: mol_type = other DNA
aaccatgttggccaggctgg

SEQ ID NO: 28008 - DNA, 20 bp, synthetic construct
  misc_feature 1..20: note = CRISPR gRNA sequence
  source 1..20: mol_type = other DNA
accatgttggccaggctggt

SEQ ID NO: 28009 - DNA, 20 bp, synthetic construct
  misc_feature 1..20: note = CRISPR gRNA sequence
  source 1..20: mol_type = other DNA
gccaggctggtcttgaactc

SEQ ID NO: 28010 - DNA, 20 bp, synthetic construct
  misc_feature 1..20: note = CRISPR gRNA sequence
  source 1..20: mol_type = other DNA
gtcttgaactcctggcctca

SEQ ID NO: 28011 - DNA, 20 bp, synthetic construct
  misc_feature 1..20: note = CRISPR gRNA sequence
  source 1..20: mol_type = other DNA
gaactcctggcctcagatgt

SEQ ID NO: 28012 - DNA, 20 bp, synthetic construct
  misc_feature 1..20: note = CRISPR gRNA sequence
  source 1..20: mol_type = other DNA
aactcctggcctcagatgtt

SEQ ID NO: 28013 - DNA, 20 bp, synthetic construct
  misc_feature 1..20: note = CRISPR gRNA sequence
  source 1..20: mol_type = other DNA
ctggcctcagatgttcctcc

SEQ ID NO: 28014 - DNA, 20 bp, synthetic construct
  misc_feature 1..20: note = CRISPR gRNA sequence
  source 1..20: mol_type = other DNA
gcctcagatgttcctcccac

SEQ ID NO: 28015 - DNA, 20 bp, synthetic construct
  misc_feature 1..20: note = CRISPR gRNA sequence
  source 1..20: mol_type = other DNA
agatgttcctcccacctcag

SEQ ID NO: 28016 - DNA, 20 bp, synthetic construct
  misc_feature 1..20: note = CRISPR gRNA sequence
  source 1..20: mol_type = other DNA
ctcccacctcagcctcccaa

SEQ ID NO: 28017 - DNA, 20 bp, synthetic construct
  misc_feature 1..20: note = CRISPR gRNA sequence
  source 1..20: mol_type = other DNA
ccacctcagcctcccaaagt

SEQ ID NO: 28018 - DNA, 20 bp, synthetic construct
  misc_feature 1..20: note = CRISPR gRNA sequence
  source 1..20: mol_type = other DNA
agcctcccaaagtgctggga

SEQ ID NO: 28019 - DNA, 20 bp, synthetic construct
  misc_feature 1..20: note = CRISPR gRNA sequence
  source 1..20: mol_type = other DNA
ccaaagtgctgggattacag

SEQ ID NO: 28020 - DNA, 20 bp, synthetic construct
  misc_feature 1..20: note = CRISPR gRNA sequence
  source 1..20: mol_type = other DNA
ggattacaggtgtaagccac

SEQ ID NO: 28021 - DNA, 20 bp, synthetic construct
  misc_feature 1..20: note = CRISPR gRNA sequence
  source 1..20: mol_type = other DNA
caggtgtaagccaccatgcc

SEQ ID NO: 28022 - DNA, 20 bp, synthetic construct
  misc_feature 1..20: note = CRISPR gRNA sequence
  source 1..20: mol_type = other DNA
ataattcagtgcattttata

SEQ ID NO: 28023 - DNA, 20 bp, synthetic construct
  misc_feature 1..20: note = CRISPR gRNA sequence
  source 1..20: mol_type = other DNA
taattcagtgcattttatat

SEQ ID NO: 28024 - DNA, 20 bp, synthetic construct
  misc_feature 1..20: note = CRISPR gRNA sequence
  source 1..20: mol_type = other DNA
agtgcattttatatataatc

SEQ ID NO: 28025 - DNA, 20 bp, synthetic construct
  misc_feature 1..20: note = CRISPR gRNA sequence
  source 1..20: mol_type = other DNA
tatatataatctcattaatc

SEQ ID NO: 28026 - DNA, 20 bp, synthetic construct
  misc_feature 1..20: note = CRISPR gRNA sequence
  source 1..20: mol_type = other DNA
atatataatctcattaatct

SEQ ID NO: 28027 - DNA, 20 bp, synthetic construct
  misc_feature 1..20: note = CRISPR gRNA sequence
  source 1..20: mol_type = other DNA
tatataatctcattaatctc

SEQ ID NO: 28028 - DNA, 20 bp, synthetic construct
  misc_feature 1..20: note = CRISPR gRNA sequence
  source 1..20: mol_type = other DNA
attaatctcaagagctactg

SEQ ID NO: 28029 - DNA, 20 bp, synthetic construct
  misc_feature 1..20: note = CRISPR gRNA sequence
  source 1..20: mol_type = other DNA
atctcaagagctactgtgga

SEQ ID NO: 28030 - DNA, 20 bp, synthetic construct
  misc_feature 1..20: note = CRISPR gRNA sequence
  source 1..20: mol_type = other DNA
aagagctactgtggaagaca

SEQ ID NO: 28031 - DNA, 20 bp, synthetic construct
  misc_feature 1..20: note = CRISPR gRNA sequence
  source 1..20: mol_type = other DNA
ctgtggaagacagacagtca

SEQ ID NO: 28032 - DNA, 20 bp, synthetic construct
  misc_feature 1..20: note = CRISPR gRNA sequence
  source 1..20: mol_type = other DNA
tggaagacagacagtcatca

SEQ ID NO: 28033 - DNA, 20 bp, synthetic construct
  misc_feature 1..20: note = CRISPR gRNA sequence
  source 1..20: mol_type = other DNA
ccccattttacagatgagga

SEQ ID NO: 28034 - DNA, 20 bp, synthetic construct
  misc_feature 1..20: note = CRISPR gRNA sequence
  source 1..20: mol_type = other DNA
cccattttacagatgaggag

SEQ ID NO: 28035 - DNA, 20 bp, synthetic construct
  misc_feature 1..20: note = CRISPR gRNA sequence
  source 1..20: mol_type = other DNA
tacagatgaggagacggagg

SEQ ID NO: 28036 - DNA, 20 bp, synthetic construct
  misc_feature 1..20: note = CRISPR gRNA sequence
  source 1..20: mol_type = other DNA
acagatgaggagacggaggc

SEQ ID NO: 28037 - DNA, 20 bp, synthetic construct
  misc_feature 1..20: note = CRISPR gRNA sequence
  source 1..20: mol_type = other DNA
cagatgaggagacggaggcc

SEQ ID NO: 28038 - DNA, 20 bp, synthetic construct
  misc_feature 1..20: note = CRISPR gRNA sequence
  source 1..20: mol_type = other DNA
gtgaggttaagtgacttgcc

SEQ ID NO: 28039 - DNA, 20 bp, synthetic construct
  misc_feature 1..20: note = CRISPR gRNA sequence
  source 1..20: mol_type = other DNA
agtgacttgcccgtggtccc

SEQ ID NO: 28040 - DNA, 20 bp, synthetic construct
  misc_feature 1..20: note = CRISPR gRNA sequence
  source 1..20: mol_type = other DNA
gcccgtggtcccccagctgg

SEQ ID NO: 28041 - DNA, 20 bp, synthetic construct
  misc_feature 1..20: note = CRISPR gRNA sequence
  source 1..20: mol_type = other DNA
cccgtggtcccccagctggt

SEQ ID NO: 28042 - DNA, 20 bp, synthetic construct
  misc_feature 1..20: note = CRISPR gRNA sequence
  source 1..20: mol_type = other DNA
gtcacccacaagctatcagc

SEQ ID NO: 28043 - DNA, 20 bp, synthetic construct
  misc_feature 1..20: note = CRISPR gRNA sequence
  source 1..20: mol_type = other DNA
tcagctctccctgatcactg

SEQ ID NO: 28044 - DNA, 20 bp, synthetic construct
  misc_feature 1..20: note = CRISPR gRNA sequence
  source 1..20: mol_type = other DNA
tccctgatcactgctcccct

SEQ ID NO: 28045 - DNA, 20 bp, synthetic construct
  misc_feature 1..20: note = CRISPR gRNA sequence
  source 1..20: mol_type = other DNA
cctgatcactgctcccctgt

SEQ ID NO: 28046 - DNA, 20 bp, synthetic construct
  misc_feature 1..20: note = CRISPR gRNA sequence
  source 1..20: mol_type = other DNA
atcactgctcccctgtgccc

SEQ ID NO: 28047 - DNA, 20 bp, synthetic construct
  misc_feature 1..20: note = CRISPR gRNA sequence
  source 1..20: mol_type = other DNA
ctcccctgtgccccagaaaa

SEQ ID NO: 28048 - DNA, 20 bp, synthetic construct
  misc_feature 1..20: note = CRISPR gRNA sequence
  source 1..20: mol_type = other DNA
ccctgtgccccagaaaaaag

SEQ ID NO: 28049 - DNA, 20 bp, synthetic construct
  misc_feature 1..20: note = CRISPR gRNA sequence
  source 1..20: mol_type = other DNA
tgccccagaaaaaagccagt

SEQ ID NO: 28050 - DNA, 20 bp, synthetic construct
  misc_feature 1..20: note = CRISPR gRNA sequence
  source 1..20: mol_type = other DNA
ttgttttgaacagagacaag

SEQ ID NO: 28051 - DNA, 20 bp, synthetic construct
  misc_feature 1..20: note = CRISPR gRNA sequence
  source 1..20: mol_type = other DNA
gttttgaacagagacaaggt

SEQ ID NO: 28052 - DNA, 20 bp, synthetic construct
  misc_feature 1..20: note = CRISPR gRNA sequence
  source 1..20: mol_type = other DNA
ttttgaacagagacaaggtg

SEQ ID NO: 28053 - DNA, 20 bp, synthetic construct
  misc_feature 1..20: note = CRISPR gRNA sequence
  source 1..20: mol_type = other DNA
tgaacagagacaaggtgcta

SEQ ID NO: 28054 - DNA, 20 bp, synthetic construct
  misc_feature 1..20: note = CRISPR gRNA sequence
  source 1..20: mol_type = other DNA
gaacagagacaaggtgctaa

SEQ ID NO: 28055 - DNA, 20 bp, synthetic construct
  misc_feature 1..20: note = CRISPR gRNA sequence
  source 1..20: mol_type = other DNA
aacagagacaaggtgctaaa

SEQ ID NO: 28056 - DNA, 20 bp, synthetic construct
  misc_feature 1..20: note = CRISPR gRNA sequence
  source 1..20: mol_type = other DNA
aatttgtccagaggtaaaaa

SEQ ID NO: 28057 - DNA, 20 bp, synthetic construct
  misc_feature 1..20: note = CRISPR gRNA sequence
  source 1..20: mol_type = other DNA
gtccagaggtaaaaatgatg

SEQ ID NO: 28058 - DNA, 20 bp, synthetic construct
  misc_feature 1..20: note = CRISPR gRNA sequence
  source 1..20: mol_type = other DNA
tccagaggtaaaaatgatgc

SEQ ID NO: 28059 - DNA, 20 bp, synthetic construct
  misc_feature 1..20: note = CRISPR gRNA sequence
  source 1..20: mol_type = other DNA
aaaaggggaaatgtctgaaa

SEQ ID NO: 28060 - DNA, 20 bp, synthetic construct
  misc_feature 1..20: note = CRISPR gRNA sequence
  source 1..20: mol_type = other DNA
aaaacaataactgagggccc

SEQ ID NO: 28061 - DNA, 20 bp, synthetic construct
  misc_feature 1..20: note = CRISPR gRNA sequence
  source 1..20: mol_type = other DNA
agggccctttctggccttaa

SEQ ID NO: 28062 - DNA, 20 bp, synthetic construct
  misc_feature 1..20: note = CRISPR gRNA sequence
  source 1..20: mol_type = other DNA
tctggccttaaattattttc

SEQ ID NO: 28063 - DNA, 20 bp, synthetic construct
  misc_feature 1..20: note = CRISPR gRNA sequence
  source 1..20: mol_type = other DNA
ctggccttaaattattttca

SEQ ID NO: 28064 - DNA, 20 bp, synthetic construct
  misc_feature 1..20: note = CRISPR gRNA sequence
  source 1..20: mol_type = other DNA
tggccttaaattattttcag

SEQ ID NO: 28065 - DNA, 20 bp, synthetic construct
  misc_feature 1..20: note = CRISPR gRNA sequence
  source 1..20: mol_type = other DNA
gccttaaattattttcagct

SEQ ID NO: 28066 - DNA, 20 bp, synthetic construct
  misc_feature 1..20: note = CRISPR gRNA sequence
  source 1..20: mol_type = other DNA
aaattattttcagctgaaaa

SEQ ID NO: 28067 - DNA, 20 bp, synthetic construct
  misc_feature 1..20: note = CRISPR gRNA sequence
  source 1..20: mol_type = other DNA
aattattttcagctgaaaaa

SEQ ID NO: 28068 - DNA, 20 bp, synthetic construct
  misc_feature 1..20: note = CRISPR gRNA sequence
  source 1..20: mol_type = other DNA
ttttcagctgaaaaagcccc

SEQ ID NO: 28069 - DNA, 20 bp, synthetic construct
  misc_feature 1..20: note = CRISPR gRNA sequence
  source 1..20: mol_type = other DNA
tcagctgaaaaagcccctag

SEQ ID NO: 28070 - DNA, 20 bp, synthetic construct
  misc_feature 1..20: note = CRISPR gRNA sequence
  source 1..20: mol_type = other DNA
cagctgaaaaagcccctagt

SEQ ID NO: 28071 - DNA, 20 bp, synthetic construct
  misc_feature 1..20: note = CRISPR gRNA sequence
  source 1..20: mol_type = other DNA
agctgaaaaagcccctagtt

SEQ ID NO: 28072 - DNA, 20 bp, synthetic construct
  misc_feature 1..20: note = CRISPR gRNA sequence
  source 1..20: mol_type = other DNA
aaaaagcccctagttcaaga

SEQ ID NO: 28073 - DNA, 20 bp, synthetic construct
  misc_feature 1..20: note = CRISPR gRNA sequence
  source 1..20: mol_type = other DNA
gttcaagatcggaactgcgc

SEQ ID NO: 28074 - DNA, 20 bp, synthetic construct
  misc_feature 1..20: note = CRISPR gRNA sequence
  source 1..20: mol_type = other DNA
aagatcggaactgcgctctg

SEQ ID NO: 28075 - DNA, 20 bp, synthetic construct
  misc_feature 1..20: note = CRISPR gRNA sequence
  source 1..20: mol_type = other DNA
cgctctggggaacagcggcc

SEQ ID NO: 28076 - DNA, 20 bp, synthetic construct
  misc_feature 1..20: note = CRISPR gRNA sequence
  source 1..20: mol_type = other DNA
tggggaacagcggccatggg

SEQ ID NO: 28077 - DNA, 20 bp, synthetic construct
  misc_feature 1..20: note = CRISPR gRNA sequence
  source 1..20: mol_type = other DNA
gggaacagcggccatggggt

SEQ ID NO: 28078 - DNA, 20 bp, synthetic construct
  misc_feature 1..20: note = CRISPR gRNA sequence
  source 1..20: mol_type = other DNA
gagccgggtgatcagccacc

SEQ ID NO: 28079 - DNA, 20 bp, synthetic construct
  misc_feature 1..20: note = CRISPR gRNA sequence
  source 1..20: mol_type = other DNA
gagaccggaagcccccgagg

SEQ ID NO: 28080 - DNA, 20 bp, synthetic construct
  misc_feature 1..20: note = CRISPR gRNA sequence
  source 1..20: mol_type = other DNA
tgaggaaggaaggaaggaag

SEQ ID NO: 28081 - DNA, 20 bp, synthetic construct
  misc_feature 1..20: note = CRISPR gRNA sequence
  source 1..20: mol_type = other DNA
aggaaggaaggaaggaagga

SEQ ID NO: 28082 - DNA, 20 bp, synthetic construct
  misc_feature 1..20: note = CRISPR gRNA sequence
  source 1..20: mol_type = other DNA
tttctggcattttctcaggc

SEQ ID NO: 28083 - DNA, 20 bp, synthetic construct
  misc_feature 1..20: note = CRISPR gRNA sequence
  source 1..20: mol_type = other DNA
ctggcattttctcaggcttc

SEQ ID NO: 28084 - DNA, 20 bp, synthetic construct
  misc_feature 1..20: note = CRISPR gRNA sequence
  source 1..20: mol_type = other DNA
tggcattttctcaggcttct

SEQ ID NO: 28085 - DNA, 20 bp, synthetic construct
  misc_feature 1..20: note = CRISPR gRNA sequence
  source 1..20: mol_type = other DNA
gcattttctcaggcttctac

SEQ ID NO: 28086 - DNA, 20 bp, synthetic construct
  misc_feature 1..20: note = CRISPR gRNA sequence
  source 1..20: mol_type = other DNA
tctcaggcttctactgtgcc

SEQ ID NO: 28087 - DNA, 20 bp, synthetic construct
  misc_feature 1..20: note = CRISPR gRNA sequence
  source 1..20: mol_type = other DNA
ctcaggcttctactgtgccc

SEQ ID NO: 28088 - DNA, 20 bp, synthetic construct
  misc_feature 1..20: note = CRISPR gRNA sequence
  source 1..20: mol_type = other DNA
tcaggcttctactgtgccca

SEQ ID NO: 28089 - DNA, 20 bp, synthetic construct
  misc_feature 1..20: note = CRISPR gRNA sequence
  source 1..20: mol_type = other DNA
aggcttctactgtgcccagg

SEQ ID NO: 28090 - DNA, 20 bp, synthetic construct
  misc_feature 1..20: note = CRISPR gRNA sequence
  source 1..20: mol_type = other DNA
ctactgtgcccaggcaccct

SEQ ID NO: 28091 - DNA, 20 bp, synthetic construct
  misc_feature 1..20: note = CRISPR gRNA sequence
  source 1..20: mol_type = other DNA
tactgtgcccaggcaccctg

SEQ ID NO: 28092 - DNA, 20 bp, synthetic construct
  misc_feature 1..20: note = CRISPR gRNA sequence
  source 1..20: mol_type = other DNA
ctgtgcccaggcaccctgta

SEQ ID NO: 28093 - DNA, 20 bp, synthetic construct
  misc_feature 1..20: note = CRISPR gRNA sequence
  source 1..20: mol_type = other DNA
tgcccaggcaccctgtagac

SEQ ID NO: 28094 - DNA, 20 bp, synthetic construct
  misc_feature 1..20: note = CRISPR gRNA sequence
  source 1..20: mol_type = other DNA
tagacctcatctgtctgtca

SEQ ID NO: 28095 - DNA, 20 bp, synthetic construct
  misc_feature 1..20: note = CRISPR gRNA sequence
  source 1..20: mol_type = other DNA
atctgtctgtcaaatcaggg

SEQ ID NO: 28096 - DNA, 20 bp, synthetic construct
  misc_feature 1..20: note = CRISPR gRNA sequence
  source 1..20: mol_type = other DNA
tctgtcaaatcagggttctt

SEQ ID NO: 28097 - DNA, 20 bp, synthetic construct
  misc_feature 1..20: note = CRISPR gRNA sequence
  source 1..20: mol_type = other DNA
tcaaatcagggttcttagcc

SEQ ID NO: 28098 - DNA, 20 bp, synthetic construct
  misc_feature 1..20: note = CRISPR gRNA sequence
  source 1..20: mol_type = other DNA
ttagccactcacaaccctac

SEQ ID NO: 28099 - DNA, 20 bp, synthetic construct
  misc_feature 1..20: note = CRISPR gRNA sequence
  source 1..20: mol_type = other DNA
agccactcacaaccctacag

SEQ ID NO: 28100 - DNA, 20 bp, synthetic construct
  misc_feature 1..20: note = CRISPR gRNA sequence
  source 1..20: mol_type = other DNA
gccactcacaaccctacagg

SEQ ID NO: 28101 - DNA, 20 bp, synthetic construct
  misc_feature 1..20: note = CRISPR gRNA sequence
  source 1..20: mol_type = other DNA
acaaccctacagggacttcg

SEQ ID NO: 28102 - DNA, 20 bp, synthetic construct
  misc_feature 1..20: note = CRISPR gRNA sequence
  source 1..20: mol_type = other DNA
cagggacttcgtttgtacac

SEQ ID NO: 28103 - DNA, 20 bp, synthetic construct
  misc_feature 1..20: note = CRISPR gRNA sequence
  source 1..20: mol_type = other DNA
cgtttgtacacagagtcctt

SEQ ID NO: 28104 - DNA, 20 bp, synthetic construct
  misc_feature 1..20: note = CRISPR gRNA sequence
  source 1..20: mol_type = other DNA
gtttgtacacagagtccttc

SEQ ID NO: 28105 - DNA, 20 bp, synthetic construct
  misc_feature 1..20: note = CRISPR gRNA sequence
  source 1..20: mol_type = other DNA
gtacacagagtccttcccca

SEQ ID NO: 28106 - DNA, 20 bp, synthetic construct
  misc_feature 1..20: note = CRISPR gRNA sequence
  source 1..20: mol_type = other DNA
tacacagagtccttccccag

SEQ ID NO: 28107 - DNA, 20 bp, synthetic construct
  misc_feature 1..20: note = CRISPR gRNA sequence
  source 1..20: mol_type = other DNA
ccccagttcagtccccactc

SEQ ID NO: 28108 - DNA, 20 bp, synthetic construct
  misc_feature 1..20: note = CRISPR gRNA sequence
  source 1..20: mol_type = other DNA
cccagttcagtccccactca

SEQ ID NO: 28109 - DNA, 20 bp, synthetic construct
  misc_feature 1..20: note = CRISPR gRNA sequence
  source 1..20: mol_type = other DNA
agtccccactcacctgttca

SEQ ID NO: 28110 - DNA, 20 bp, synthetic construct
  misc_feature 1..20: note = CRISPR gRNA sequence
  source 1..20: mol_type = other DNA
acctgttcacccttatctcc

SEQ ID NO: 28111 - DNA, 20 bp, synthetic construct
  misc_feature 1..20: note = CRISPR gRNA sequence
  source 1..20: mol_type = other DNA
ttcacccttatctcctacac

SEQ ID NO: 28112 - DNA, 20 bp, synthetic construct
  misc_feature 1..20: note = CRISPR gRNA sequence
  source 1..20: mol_type = other DNA
acccttatctcctacactcg

SEQ ID NO: 28113 - DNA, 20 bp, synthetic construct
  misc_feature 1..20: note = CRISPR gRNA sequence
  source 1..20: mol_type = other DNA
atctcctacactcgctgggt

SEQ ID NO: 28114 - DNA, 20 bp, synthetic construct
  misc_feature 1..20: note = CRISPR gRNA sequence
  source 1..20: mol_type = other DNA
tctcctacactcgctgggtg

SEQ ID NO: 28115 - DNA, 20 bp, synthetic construct
  misc_feature 1..20: note = CRISPR gRNA sequence
  source 1..20: mol_type = other DNA
ctacactcgctgggtgctct

SEQ ID NO: 28116 - DNA, 20 bp, synthetic construct
  misc_feature 1..20: note = CRISPR gRNA sequence
  source 1..20: mol_type = other DNA
cactcgctgggtgctctctc

SEQ ID NO: 28117 - DNA, 20 bp, synthetic construct
  misc_feature 1..20: note = CRISPR gRNA sequence
  source 1..20: mol_type = other DNA
gctgggtgctctctccattc

SEQ ID NO: 28118 - DNA, 20 bp, synthetic construct
  misc_feature 1..20: note = CRISPR gRNA sequence
  source 1..20: mol_type = other DNA
ggtgctctctccattccagc

SEQ ID NO: 28119 - DNA, 20 bp, synthetic construct
  misc_feature 1..20: note = CRISPR gRNA sequence
  source 1..20: mol_type = other DNA
tctccattccagccacaggg

SEQ ID NO: 28120 - DNA, 20 bp, synthetic construct
  misc_feature 1..20: note = CRISPR gRNA sequence
  source 1..20: mol_type = other DNA
tccattccagccacagggcc

SEQ ID NO: 28121 - DNA, 20 bp, synthetic construct
  misc_feature 1..20: note = CRISPR gRNA sequence
  source 1..20: mol_type = other DNA
cattccagccacagggcctc

SEQ ID NO: 28122 - DNA, 20 bp, synthetic construct
  misc_feature 1..20: note = CRISPR gRNA sequence
  source 1..20: mol_type = other DNA
cagccacagggcctccttgc

SEQ ID NO: 28123 - DNA, 20 bp, synthetic construct
  misc_feature 1..20: note = CRISPR gRNA sequence
  source 1..20: mol_type = other DNA
cttgctggctttcaacctcc

SEQ ID NO: 28124 - DNA, 20 bp, synthetic construct
  misc_feature 1..20: note = CRISPR gRNA sequence
  source 1..20: mol_type = other DNA
gctggctttcaacctcctag

SEQ ID NO: 28125 - DNA, 20 bp, synthetic construct
  misc_feature 1..20: note = CRISPR gRNA sequence
  source 1..20: mol_type = other DNA
ctggctttcaacctcctagg

SEQ ID NO: 28126 - DNA, 20 bp, synthetic construct
  misc_feature 1..20: note = CRISPR gRNA sequence
  source 1..20: mol_type = other DNA
gctttcaacctcctaggcat

SEQ ID NO: 28127 - DNA, 20 bp, synthetic construct
  misc_feature 1..20: note = CRISPR gRNA sequence
  source 1..20: mol_type = other DNA
tcaacctcctaggcatgctt

SEQ ID NO: 28128 - DNA, 20 bp, synthetic construct
  misc_feature 1..20: note = CRISPR gRNA sequence
  source 1..20: mol_type = other DNA
caacctcctaggcatgcttc

SEQ ID NO: 28129 - DNA, 20 bp, synthetic construct
  misc_feature 1..20: note = CRISPR gRNA sequence
  source 1..20: mol_type = other DNA
aacctcctaggcatgcttct

SEQ ID NO: 28130 - DNA, 20 bp, synthetic construct
  misc_feature 1..20: note = CRISPR gRNA sequence
  source 1..20: mol_type = other DNA
ctaggcatgcttctgcctcc

SEQ ID NO: 28131 - DNA, 20 bp, synthetic construct
  misc_feature 1..20: note = CRISPR gRNA sequence
  source 1..20: mol_type = other DNA
ggcatgcttctgcctccagg

SEQ ID NO: 28132 - DNA, 20 bp, synthetic construct
  misc_feature 1..20: note = CRISPR gRNA sequence
  source 1..20: mol_type = other DNA
ctgcctccaggcctttgcac

SEQ ID NO: 28133 - DNA, 20 bp, synthetic construct
  misc_feature 1..20: note = CRISPR gRNA sequence
  source 1..20: mol_type = other DNA
tgcctccaggcctttgcacc

SEQ ID NO: 28134 - DNA, 20 bp, synthetic construct
  misc_feature 1..20: note = CRISPR gRNA sequence
  source 1..20: mol_type = other DNA
cctccaggcctttgcaccgg

SEQ ID NO: 28135 - DNA, 20 bp, synthetic construct
  misc_feature 1..20: note = CRISPR gRNA sequence
  source 1..20: mol_type = other DNA
caggcctttgcaccggctgt

SEQ ID NO: 28136 - DNA, 20 bp, synthetic construct
  misc_feature 1..20: note = CRISPR gRNA sequence
  source 1..20: mol_type = other DNA
tgcaccggctgtgccctctg

SEQ ID NO: 28137 - DNA, 20 bp, synthetic construct
  misc_feature 1..20: note = CRISPR gRNA sequence
  source 1..20: mol_type = other DNA
gcaccggctgtgccctctgc

SEQ ID NO: 28138 - DNA, 20 bp, synthetic construct
  misc_feature 1..20: note = CRISPR gRNA sequence
  source 1..20: mol_type = other DNA
caccggctgtgccctctgcc

SEQ ID NO: 28139 - DNA, 20 bp, synthetic construct
  misc_feature 1..20: note = CRISPR gRNA sequence
  source 1..20: mol_type = other DNA
tgccctctgcctggaatact

SEQ ID NO: 28140 - DNA, 20 bp, synthetic construct
  misc_feature 1..20: note = CRISPR gRNA sequence
  source 1..20: mol_type = other DNA
tgcctggaatacttctcccc

SEQ ID NO: 28141 - DNA, 20 bp, synthetic construct
  misc_feature 1..20: note = CRISPR gRNA sequence
  source 1..20: mol_type = other DNA
cctggaatacttctccccag

SEQ ID NO: 28142 - DNA, 20 bp, synthetic construct
  misc_feature 1..20: note = CRISPR gRNA sequence
  source 1..20: mol_type = other DNA
gaatacttctccccagatat

SEQ ID NO: 28143 - DNA, 20 bp, synthetic construct
  misc_feature 1..20: note = CRISPR gRNA sequence
  source 1..20: mol_type = other DNA
ctccccagatatctgcatgg

SEQ ID NO: 28144 - DNA, 20 bp, synthetic construct
  misc_feature 1..20: note = CRISPR gRNA sequence
  source 1..20: mol_type = other DNA
tccccagatatctgcatggc

SEQ ID NO: 28145 - DNA, 20 bp, synthetic construct
  misc_feature 1..20: note = CRISPR gRNA sequence
  source 1..20: mol_type = other DNA
cccagatatctgcatggctc

SEQ ID NO: 28146 - DNA, 20 bp, synthetic construct
  misc_feature 1..20: note = CRISPR gRNA sequence
  source 1..20: mol_type = other DNA
catggctcatgccttcacct

SEQ ID NO: 28147 - DNA, 20 bp, synthetic construct
  misc_feature 1..20: note = CRISPR gRNA sequence
  source 1..20: mol_type = other DNA
atgccttcacctcctctggt

SEQ ID NO: 28148 - DNA, 20 bp, synthetic construct
  misc_feature 1..20: note = CRISPR gRNA sequence
  source 1..20: mol_type = other DNA
cacctcctctggtctttact

SEQ ID NO: 28149 - DNA, 20 bp, synthetic construct
  misc_feature 1..20: note = CRISPR gRNA sequence
  source 1..20: mol_type = other DNA
acctcctctggtctttactc

SEQ ID NO: 28150 - DNA, 20 bp, synthetic construct
  misc_feature 1..20: note = CRISPR gRNA sequence
  source 1..20: mol_type = other DNA
ctctggtctttactcagtga

SEQ ID NO: 28151 - DNA, 20 bp, synthetic construct
  misc_feature 1..20: note = CRISPR gRNA sequence
  source 1..20: mol_type = other DNA
tggtctttactcagtgaggc

SEQ ID NO: 28152 - DNA, 20 bp, synthetic construct
  misc_feature 1..20: note = CRISPR gRNA sequence
  source 1..20: mol_type = other DNA
gtctttactcagtgaggcct

SEQ ID NO: 28153 - DNA, 20 bp, synthetic construct
  misc_feature 1..20: note = CRISPR gRNA sequence
  source 1..20: mol_type = other DNA
tactcagtgaggccttttct

SEQ ID NO: 28154 - DNA, 20 bp, synthetic construct
  misc_feature 1..20: note = CRISPR gRNA sequence
  source 1..20: mol_type = other DNA
actcagtgaggccttttctt

SEQ ID NO: 28155 - DNA, 20 bp, synthetic construct
  misc_feature 1..20: note = CRISPR gRNA sequence
  source 1..20: mol_type = other DNA
ctcagtgaggccttttcttt

SEQ ID NO: 28156 - DNA, 20 bp, synthetic construct
  misc_feature 1..20: note = CRISPR gRNA sequence
  source 1..20: mol_type = other DNA
agtgaggccttttcttttct

SEQ ID NO: 28157 - DNA, 20 bp, synthetic construct
  misc_feature 1..20: note = CRISPR gRNA sequence
  source 1..20: mol_type = other DNA
ttcttttctttctttccctg

SEQ ID NO: 28158 - DNA, 20 bp, synthetic construct
  misc_feature 1..20: note = CRISPR gRNA sequence
  source 1..20: mol_type = other DNA
tcttttctttctttccctgt

SEQ ID NO: 28159 - DNA, 20 bp, synthetic construct
  misc_feature 1..20: note = CRISPR gRNA sequence
  source 1..20: mol_type = other DNA
cttttctttctttccctgtt

SEQ ID NO: 28160 - DNA, 20 bp, synthetic construct
  misc_feature 1..20: note = CRISPR gRNA sequence
  source 1..20: mol_type = other DNA
ttttctttctttccctgttt

SEQ ID NO: 28161 - DNA, 20 bp, synthetic construct
  misc_feature 1..20: note = CRISPR gRNA sequence
  source 1..20: mol_type = other DNA
ttctttctttccctgtttct

SEQ ID NO: 28162 - DNA, 20 bp, synthetic construct
  misc_feature 1..20: note = CRISPR gRNA sequence
  source 1..20: mol_type = other DNA
tctttctttccctgtttctt

SEQ ID NO: 28163 - DNA, 20 bp, synthetic construct
  misc_feature 1..20: note = CRISPR gRNA sequence
  source 1..20: mol_type = other DNA
ctttctttccctgtttcttt

SEQ ID NO: 28164 - DNA, 20 bp, synthetic construct
  misc_feature 1..20: note = CRISPR gRNA sequence
  source 1..20: mol_type = other DNA
tttctttccctgtttctttc

SEQ ID NO: 28165 - DNA, 20 bp, synthetic construct
  misc_feature 1..20: note = CRISPR gRNA sequence
  source 1..20: mol_type = other DNA
tctttccctgtttctttctt

SEQ ID NO: 28166 - DNA, 20 bp, synthetic construct
  misc_feature 1..20: note = CRISPR gRNA sequence
  source 1..20: mol_type = other DNA
ctttccctgtttctttcttt

SEQ ID NO: 28167 - DNA, 20 bp, synthetic construct
  misc_feature 1..20: note = CRISPR gRNA sequence
  source 1..20: mol_type = other DNA
tttccctgtttctttctttc

SEQ ID NO: 28168 - DNA, 20 bp, synthetic construct
  misc_feature 1..20: note = CRISPR gRNA sequence
  source 1..20: mol_type = other DNA
tccctgtttctttctttctt

SEQ ID NO: 28169 - DNA, 20 bp, synthetic construct
  misc_feature 1..20: note = CRISPR gRNA sequence
  source 1..20: mol_type = other DNA
ccctgtttctttctttcttt

SEQ ID NO: 28170 - DNA, 20 bp, synthetic construct
  misc_feature 1..20: note = CRISPR gRNA sequence
  source 1..20: mol_type = other DNA
cctgtttctttctttctttc

SEQ ID NO: 28171 - DNA, 20 bp, synthetic construct
  misc_feature 1..20: note = CRISPR gRNA sequence
  source 1..20: mol_type = other DNA
tttctttctttctttctttc

SEQ ID NO: 28172 - DNA, 20 bp, synthetic construct
  misc_feature 1..20: note = CRISPR gRNA sequence
  source 1..20: mol_type = other DNA
ctttctttctttctttccct

SEQ ID NO: 28173 - DNA, 20 bp, synthetic construct
  misc_feature 1..20: note = CRISPR gRNA sequence
  source 1..20: mol_type = other DNA
tttctttctttctttccctc

SEQ ID NO: 28174 - DNA, 20 bp, synthetic construct
  misc_feature 1..20: note = CRISPR gRNA sequence
  source 1..20: mol_type = other DNA
tctttctttctttccctcct

SEQ ID NO: 28175 - DNA, 20 bp, synthetic construct
  misc_feature 1..20: note = CRISPR gRNA sequence
  source 1..20: mol_type = other DNA
ctttctttctttccctcctt

SEQ ID NO: 28176 - DNA, 20 bp, synthetic construct
  misc_feature 1..20: note = CRISPR gRNA sequence
  source 1..20: mol_type = other DNA
tttctttctttccctccttt

SEQ ID NO: 28177 - DNA, 20 bp, synthetic construct
  misc_feature 1..20: note = CRISPR gRNA sequence
  source 1..20: mol_type = other DNA
tctttctttccctcctttct

SEQ ID NO: 28178 - DNA, 20 bp, synthetic construct
  misc_feature 1..20: note = CRISPR gRNA sequence
  source 1..20: mol_type = other DNA
ctttctttccctcctttctt

SEQ ID NO: 28179 - DNA, 20 bp, synthetic construct
  misc_feature 1..20: note = CRISPR gRNA sequence
  source 1..20: mol_type = other DNA
tttctttccctcctttcttt

SEQ ID NO: 28180 - DNA, 20 bp, synthetic construct
  misc_feature 1..20: note = CRISPR gRNA sequence
  source 1..20: mol_type = other DNA
tctttccctcctttctttct

SEQ ID NO: 28181 - DNA, 20 bp, synthetic construct
  misc_feature 1..20: note = CRISPR gRNA sequence
  source 1..20: mol_type = other DNA
ctttccctcctttctttctt

SEQ ID NO: 28182 - DNA, 20 bp, synthetic construct
  misc_feature 1..20: note = CRISPR gRNA sequence
  source 1..20: mol_type = other DNA
tttccctcctttctttcttt

SEQ ID NO: 28183 - DNA, 20 bp, synthetic construct
  misc_feature 1..20: note = CRISPR gRNA sequence
  source 1..20: mol_type = other DNA
tccctcctttctttctttct

SEQ ID NO: 28184 - DNA, 20 bp, synthetic construct
  misc_feature 1..20: note = CRISPR gRNA sequence
  source 1..20: mol_type = other DNA
ccctcctttctttctttctt

SEQ ID NO: 28185 - DNA, 20 bp, synthetic construct
  misc_feature 1..20: note = CRISPR gRNA sequence
  source 1..20: mol_type = other DNA
cctcctttctttctttcttt

SEQ ID NO: 28186 - DNA, 20 bp, synthetic construct
  misc_feature 1..20: note = CRISPR gRNA sequence
  source 1..20: mol_type = other DNA
ctttctttctttctttccct

SEQ ID NO: 28187 - DNA, 20 bp, synthetic construct
  misc_feature 1..20: note = CRISPR gRNA sequence
  source 1..20: mol_type = other DNA
tctttctttctttccctttc

SEQ ID NO: 28188 - DNA, 20 bp, synthetic construct
  misc_feature 1..20: note = CRISPR gRNA sequence
  source 1..20: mol_type = other DNA
ctttctttctttccctttct

SEQ ID NO: 28189 - DNA, 20 bp, synthetic construct
  misc_feature 1..20: note = CRISPR gRNA sequence
  source 1..20: mol_type = other DNA
tttctttctttccctttctt

SEQ ID NO: 28190 - DNA, 20 bp, synthetic construct
  misc_feature 1..20: note = CRISPR gRNA sequence
  source 1..20: mol_type = other DNA
tctttctttccctttctttc

SEQ ID NO: 28191 - DNA, 20 bp, synthetic construct
  misc_feature 1..20: note = CRISPR gRNA sequence
  source 1..20: mol_type = other DNA
ctttctttccctttctttct

SEQ ID NO: 28192 - DNA, 20 bp, synthetic construct
  misc_feature 1..20: note = CRISPR gRNA sequence
  source 1..20: mol_type = other DNA
tttctttccctttctttctt

SEQ ID NO: 28193 - DNA, 20 bp, synthetic construct
  misc_feature 1..20: note = CRISPR gRNA sequence
  source 1..20: mol_type = other DNA
tctttccctttctttctttc

SEQ ID NO: 28194 - DNA, 20 bp, synthetic construct
  misc_feature 1..20: note = CRISPR gRNA sequence
  source 1..20: mol_type = other DNA
ctttccctttctttctttct

SEQ ID NO: 28195 - DNA, 20 bp, synthetic construct
  misc_feature 1..20: note = CRISPR gRNA sequence
  source 1..20: mol_type = other DNA
tttccctttctttctttctt

SEQ ID NO: 28196 - DNA, 20 bp, synthetic construct
  misc_feature 1..20: note = CRISPR gRNA sequence
  source 1..20: mol_type = other DNA
tccctttctttctttctttt

SEQ ID NO: 28197 - DNA, 20 bp, synthetic construct
  misc_feature 1..20: note = CRISPR gRNA sequence
  source 1..20: mol_type = other DNA
ccctttctttctttcttttt

SEQ ID NO: 28198 - DNA, 20 bp, synthetic construct
  misc_feature 1..20: note = CRISPR gRNA sequence
  source 1..20: mol_type = other DNA
cctttctttctttctttttc

SEQ ID NO: 28199 - DNA, 20 bp, synthetic construct
  misc_feature 1..20: note = CRISPR gRNA sequence
  source 1..20: mol_type = other DNA
tctttctttctttttccttt

SEQ ID NO: 28200 - DNA, 20 bp, synthetic construct
  misc_feature 1..20: note = CRISPR gRNA sequence
  source 1..20: mol_type = other DNA
ctttctttctttttcctttt

SEQ ID NO: 28201 - DNA, 20 bp, synthetic construct
  misc_feature 1..20: note = CRISPR gRNA sequence
  source 1..20: mol_type = other DNA
tttctttctttttccttttt

SEQ ID NO: 28202 - DNA, 20 bp, synthetic construct
  misc_feature 1..20: note = CRISPR gRNA sequence
  source 1..20: mol_type = other DNA
tctttctttttccttttttc

SEQ ID NO: 28203 - DNA, 20 bp, synthetic construct
  misc_feature 1..20: note = CRISPR gRNA sequence
  source 1..20: mol_type = other DNA
ctttctttttccttttttct

SEQ ID NO: 28204 - DNA, 20 bp, synthetic construct
  misc_feature 1..20: note = CRISPR gRNA sequence
  source 1..20: mol_type = other DNA
tttctttttccttttttctt

SEQ ID NO: 28205 - DNA, 20 bp, synthetic construct
  misc_feature 1..20: note = CRISPR gRNA sequence
  source 1..20: mol_type = other DNA
tctttttccttttttctttt

SEQ ID NO: 28206 - DNA, 20 bp, synthetic construct
  misc_feature 1..20: note = CRISPR gRNA sequence
  source 1..20: mol_type = other DNA
ctttttccttttttcttttt

SEQ ID NO: 28207 - DNA, 20 bp, synthetic construct
  misc_feature 1..20: note = CRISPR gRNA sequence
  source 1..20: mol_type = other DNA
tttttccttttttctttttc

SEQ ID NO: 28208 - DNA, 20 bp, synthetic construct
  misc_feature 1..20: note = CRISPR gRNA sequence
  source 1..20: mol_type = other DNA
tttccttttttctttttctt

SEQ ID NO: 28209 - DNA, 20 bp, synthetic construct
  misc_feature 1..20: note = CRISPR gRNA sequence
  source 1..20: mol_type = other DNA
ttccttttttctttttcttt

SEQ ID NO: 28210 - DNA, 20 bp, synthetic construct
  misc_feature 1..20: note = CRISPR gRNA sequence
  source 1..20: mol_type = other DNA
tccttttttctttttctttt

SEQ ID NO: 28211 - DNA, 20 bp, synthetic construct
  misc_feature 1..20: note = CRISPR gRNA sequence
  source 1..20: mol_type = other DNA
ccttttttctttttcttttt

SEQ ID NO: 28212 - DNA, 20 bp, synthetic construct
  misc_feature 1..20: note = CRISPR gRNA sequence
  source 1..20: mol_type = other DNA
cttttttctttttctttttt

SEQ ID NO: 28213 - DNA, 20 bp, synthetic construct
  misc_feature 1..20: note = CRISPR gRNA sequence
  source 1..20: mol_type = other DNA
ttttctttttctttttttga

SEQ ID NO: 28214 - DNA, 20 bp, synthetic construct
  misc_feature 1..20: note = CRISPR gRNA sequence
  source 1..20: mol_type = other DNA
tttctttttctttttttgag

SEQ ID NO: 28215 - DNA, 20 bp, synthetic construct
  misc_feature 1..20: note = CRISPR gRNA sequence
  source 1..20: mol_type = other DNA
ttctttttctttttttgagg

SEQ ID NO: 28216 - DNA, 20 bp, synthetic construct
  misc_feature 1..20: note = CRISPR gRNA sequence
  source 1..20: mol_type = other DNA
tctttttctttttttgaggt

SEQ ID NO: 28217 - DNA, 20 bp, synthetic construct
  misc_feature 1..20: note = CRISPR gRNA sequence
  source 1..20: mol_type = other DNA
ctttttctttttttgaggtg

SEQ ID NO: 28218 - DNA, 20 bp, synthetic construct
  misc_feature 1..20: note = CRISPR gRNA sequence
  source 1..20: mol_type = other DNA
tttttctttttttgaggtgg

SEQ ID NO: 28219 - DNA, 20 bp, synthetic construct
  misc_feature 1..20: note = CRISPR gRNA sequence
  source 1..20: mol_type = other DNA
tttctttttttgaggtggag

SEQ ID NO: 28220 - DNA, 20 bp, synthetic construct
  misc_feature 1..20: note = CRISPR gRNA sequence
  source 1..20: mol_type = other DNA
ttctttttttgaggtggagt

SEQ ID NO: 28221 - DNA, 20 bp, synthetic construct
  misc_feature 1..20: note = CRISPR gRNA sequence
  source 1..20: mol_type = other DNA
tctttttttgaggtggagtc

SEQ ID NO: 28222 - DNA, 20 bp, synthetic construct
  misc_feature 1..20: note = CRISPR gRNA sequence
  source 1..20: mol_type = other DNA
ctttttttgaggtggagtct

SEQ ID NO: 28223 - DNA, 20 bp, synthetic construct
  misc_feature 1..20: note = CRISPR gRNA sequence
  source 1..20: mol_type = other DNA
tttttttgaggtggagtctc

SEQ ID NO: 28224 - DNA, 20 bp, synthetic construct
  misc_feature 1..20: note = CRISPR gRNA sequence
  source 1..20: mol_type = other DNA
tttttgaggtggagtctcgc

SEQ ID NO: 28225 - DNA, 20 bp, synthetic construct
  misc_feature 1..20: note = CRISPR gRNA sequence
  source 1..20: mol_type = other DNA
ttttgaggtggagtctcgct

SEQ ID NO: 28226 - DNA, 20 bp, synthetic construct
  misc_feature 1..20: note = CRISPR gRNA sequence
  source 1..20: mol_type = other DNA
tttgaggtggagtctcgctc

SEQ ID NO: 28227 - DNA, 20 bp, synthetic construct
  misc_feature 1..20: note = CRISPR gRNA sequence
  source 1..20: mol_type = other DNA
ttgaggtggagtctcgctct

SEQ ID NO: 28228 - DNA, 20 bp, synthetic construct
  misc_feature 1..20: note = CRISPR gRNA sequence
  source 1..20: mol_type = other DNA
tgaggtggagtctcgctctg

SEQ ID NO: 28229 - DNA, 20 bp, synthetic construct
  misc_feature 1..20: note = CRISPR gRNA sequence
  source 1..20: mol_type = other DNA
gaggtggagtctcgctctgt

SEQ ID NO: 28230 - DNA, 20 bp, synthetic construct
  misc_feature 1..20: note = CRISPR gRNA sequence
  source 1..20: mol_type = other DNA
aggtggagtctcgctctgtc

SEQ ID NO: 28231 - DNA, 20 bp, synthetic construct
  misc_feature 1..20: note = CRISPR gRNA sequence
  source 1..20: mol_type = other DNA
gctctgtcacccaggctgga

SEQ ID NO: 28232 - DNA, 20 bp, synthetic construct
  misc_feature 1..20: note = CRISPR gRNA sequence
  source 1..20: mol_type = other DNA
tgtcacccaggctggagtgc

SEQ ID NO: 28233 - DNA, 20 bp, synthetic construct
  misc_feature 1..20: note = CRISPR gRNA sequence
  source 1..20: mol_type = other DNA
tcacccaggctggagtgcag

SEQ ID NO: 28234 - DNA, 20 bp, synthetic construct
  misc_feature 1..20: note = CRISPR gRNA sequence
  source 1..20: mol_type = other DNA
gagtgcagtggcacaatctc

SEQ ID NO: 28235 - DNA, 20 bp, synthetic construct
  misc_feature 1..20: note = CRISPR gRNA sequence
  source 1..20: mol_type = other DNA
gactcactgcaacctcctcc

SEQ ID NO: 28236 - DNA, 20 bp, synthetic construct
  misc_feature 1..20: note = CRISPR gRNA sequence
  source 1..20: mol_type = other DNA
actgcaacctcctcctccca

SEQ ID NO: 28237 - DNA, 20 bp, synthetic construct
  misc_feature 1..20: note = CRISPR gRNA sequence
  source 1..20: mol_type = other DNA
caacctcctcctcccaagtc

SEQ ID NO: 28238 - DNA, 20 bp, synthetic construct
  misc_feature 1..20: note = CRISPR gRNA sequence
  source 1..20: mol_type = other DNA
ctcctcccaagtccaagtga

SEQ ID NO: 28239 - DNA, 20 bp, synthetic construct
  misc_feature 1..20: note = CRISPR gRNA sequence
  source 1..20: mol_type = other DNA
ctcccaagtccaagtgattc

SEQ ID NO: 28240 - DNA, 20 bp, synthetic construct
  misc_feature 1..20: note = CRISPR gRNA sequence
  source 1..20: mol_type = other DNA
ccaagtccaagtgattctct

SEQ ID NO: 28241 - DNA, 20 bp, synthetic construct
  misc_feature 1..20: note = CRISPR gRNA sequence
  source 1..20: mol_type = other DNA
tcttgcctcagcctcccgag

SEQ ID NO: 28242 - DNA, 20 bp, synthetic construct
  misc_feature 1..20: note = CRISPR gRNA sequence
  source 1..20: mol_type = other DNA
ttgcctcagcctcccgagta

SEQ ID NO: 28243 - DNA, 20 bp, synthetic construct
  misc_feature 1..20: note = CRISPR gRNA sequence
  source 1..20: mol_type = other DNA
gcctcagcctcccgagtagc

SEQ ID NO: 28244 - DNA, 20 bp, synthetic construct
  misc_feature 1..20: note = CRISPR gRNA sequence
  source 1..20: mol_type = other DNA
cctcagcctcccgagtagct

SEQ ID NO: 28245 - DNA, 20 bp, synthetic construct
  misc_feature 1..20: note = CRISPR gRNA sequence
  source 1..20: mol_type = other DNA
agcctcccgagtagctggga

SEQ ID NO: 28246 - DNA, 20 bp, synthetic construct
  misc_feature 1..20: note = CRISPR gRNA sequence
  source 1..20: mol_type = other DNA
ccgagtagctgggactacag

SEQ ID NO: 28247 - DNA, 20 bp, synthetic construct
  misc_feature 1..20: note = CRISPR gRNA sequence
  source 1..20: mol_type = other DNA
ggactacaggcacatgtcac

SEQ ID NO: 28248 - DNA, 20 bp, synthetic construct
  misc_feature 1..20: note = CRISPR gRNA sequence
  source 1..20: mol_type = other DNA
caggcacatgtcaccacatc

SEQ ID NO: 28249 - DNA, 20 bp, synthetic construct
  misc_feature 1..20: note = CRISPR gRNA sequence
  source 1..20: mol_type = other DNA
gctaattttttgtattttta

SEQ ID NO: 28250 - DNA, 20 bp, synthetic construct
  misc_feature 1..20: note = CRISPR gRNA sequence
  source 1..20: mol_type = other DNA
attttttgtatttttagtag

SEQ ID NO: 28251 - DNA, 20 bp, synthetic construct
  misc_feature 1..20: note = CRISPR gRNA sequence
  source 1..20: mol_type = other DNA
tttgtatttttagtagagac

SEQ ID NO: 28252 - DNA, 20 bp, synthetic construct
  misc_feature 1..20: note = CRISPR gRNA sequence
  source 1..20: mol_type = other DNA
ttgtatttttagtagagacg

SEQ ID NO: 28253 - DNA, 20 bp, synthetic construct
  misc_feature 1..20: note = CRISPR gRNA sequence
  source 1..20: mol_type = other DNA
tgtatttttagtagagacgg

SEQ ID NO: 28254 - DNA, 20 bp, synthetic construct
  misc_feature 1..20: note = CRISPR gRNA sequence
  source 1..20: mol_type = other DNA
gtatttttagtagagacggg

SEQ ID NO: 28255 - DNA, 20 bp, synthetic construct
  misc_feature 1..20: note = CRISPR gRNA sequence
  source 1..20: mol_type = other DNA
tatttttagtagagacgggg

SEQ ID NO: 28256 - DNA, 20 bp, synthetic construct
  misc_feature 1..20: note = CRISPR gRNA sequence
  source 1..20: mol_type = other DNA
ttagtagagacggggtttca

SEQ ID NO: 28257 - DNA, 20 bp, synthetic construct
  misc_feature 1..20: note = CRISPR gRNA sequence
  source 1..20: mol_type = other DNA
tagtagagacggggtttcac

SEQ ID NO: 28258 - DNA, 20 bp, synthetic construct
  misc_feature 1..20: note = CRISPR gRNA sequence
  source 1..20: mol_type = other DNA
agtagagacggggtttcacc

SEQ ID NO: 28259 - DNA, 20 bp, synthetic construct
  misc_feature 1..20: note = CRISPR gRNA sequence
  source 1..20: mol_type = other DNA
gtagagacggggtttcaccg

SEQ ID NO: 28260 - DNA, 20 bp, synthetic construct
  misc_feature 1..20: note = CRISPR gRNA sequence
  source 1..20: mol_type = other DNA
caccgtgttagccaggatgg

SEQ ID NO: 28261 - DNA, 20 bp, synthetic construct
  misc_feature 1..20: note = CRISPR gRNA sequence
  source 1..20: mol_type = other DNA
accgtgttagccaggatggt

SEQ ID NO: 28262 - DNA, 20 bp, synthetic construct
  misc_feature 1..20: note = CRISPR gRNA sequence
  source 1..20: mol_type = other DNA
gccaggatggtctcaatctt

SEQ ID NO: 28263 - DNA, 20 bp, synthetic construct
  misc_feature 1..20: note = CRISPR gRNA sequence
  source 1..20: mol_type = other DNA
aatcttctgacctcgtgatc

SEQ ID NO: 28264 - DNA, 20 bp, synthetic construct
  misc_feature 1..20: note = CRISPR gRNA sequence
  source 1..20: mol_type = other DNA
ctgacctcgtgatcccccca

SEQ ID NO: 28265 - DNA, 20 bp, synthetic construct
  misc_feature 1..20: note = CRISPR gRNA sequence
  source 1..20: mol_type = other DNA
tgacctcgtgatccccccac

SEQ ID NO: 28266 - DNA, 20 bp, synthetic construct
  misc_feature 1..20: note = CRISPR gRNA sequence
  source 1..20: mol_type = other DNA
acctcgtgatccccccacct

SEQ ID NO: 28267 - DNA, 20 bp, synthetic construct
  misc_feature 1..20: note = CRISPR gRNA sequence
  source 1..20: mol_type = other DNA
gtgatccccccacctcggcc

SEQ ID NO: 28268 - DNA, 20 bp, synthetic construct
  misc_feature 1..20: note = CRISPR gRNA sequence
  source 1..20: mol_type = other DNA
ggcctcccaaagtgctggga

SEQ ID NO: 28269 - DNA, 20 bp, synthetic construct
  misc_feature 1..20: note = CRISPR gRNA sequence
  source 1..20: mol_type = other DNA
ccaaagtgctgggattacag

SEQ ID NO: 28270 - DNA, 20 bp, synthetic construct
  misc_feature 1..20: note = CRISPR gRNA sequence
  source 1..20: mol_type = other DNA
ggattacaggcgtgagccac

SEQ ID NO: 28271 - DNA, 20 bp, synthetic construct
  misc_feature 1..20: note = CRISPR gRNA sequence
  source 1..20: mol_type = other DNA
caggcgtgagccaccacacc

SEQ ID NO: 28272 - DNA, 20 bp, synthetic construct
  misc_feature 1..20: note = CRISPR gRNA sequence
  source 1..20: mol_type = other DNA
agtgaggtcttttctgaccc

SEQ ID NO: 28273 - DNA, 20 bp, synthetic construct
  misc_feature 1..20: note = CRISPR gRNA sequence
  source 1..20: mol_type = other DNA
ttctgaccctcacagttaaa

SEQ ID NO: 28274 - DNA, 20 bp, synthetic construct
  misc_feature 1..20: note = CRISPR gRNA sequence
  source 1..20: mol_type = other DNA
tctgaccctcacagttaaaa

SEQ ID NO: 28275 - DNA, 20 bp, synthetic construct
  misc_feature 1..20: note = CRISPR gRNA sequence
  source 1..20: mol_type = other DNA
ctgaccctcacagttaaaaa

SEQ ID NO: 28276 - DNA, 20 bp, synthetic construct
  misc_feature 1..20: note = CRISPR gRNA sequence
  source 1..20: mol_type = other DNA
tgaccctcacagttaaaaat

SEQ ID NO: 28277 - DNA, 20 bp, synthetic construct
  misc_feature 1..20: note = CRISPR gRNA sequence
  source 1..20: mol_type = other DNA
accctcacagttaaaaataa

SEQ ID NO: 28278 - DNA, 20 bp, synthetic construct
  misc_feature 1..20: note = CRISPR gRNA sequence
  source 1..20: mol_type = other DNA
acagttaaaaataaaactct

SEQ ID NO: 28279 - DNA, 20 bp, synthetic construct
  misc_feature 1..20: note = CRISPR gRNA sequence
  source 1..20: mol_type = other DNA
aaaataaaactctggccagg

SEQ ID NO: 28280 - DNA, 20 bp, synthetic construct
  misc_feature 1..20: note = CRISPR gRNA sequence
  source 1..20: mol_type = other DNA
tggccaggcgcagtggctta

SEQ ID NO: 28281 - DNA, 20 bp, synthetic construct
  misc_feature 1..20: note = CRISPR gRNA sequence
  source 1..20: mol_type = other DNA
gccaggcgcagtggcttatg

SEQ ID NO: 28282 - DNA, 20 bp, synthetic construct
  misc_feature 1..20: note = CRISPR gRNA sequence
  source 1..20: mol_type = other DNA
atgcctgtaatcccagcact

SEQ ID NO: 28283 - DNA, 20 bp, synthetic construct
  misc_feature 1..20: note = CRISPR gRNA sequence
  source 1..20: mol_type = other DNA
tgcctgtaatcccagcactt

SEQ ID NO: 28284 - DNA, 20 bp, synthetic construct
  misc_feature 1..20: note = CRISPR gRNA sequence
  source 1..20: mol_type = other DNA
taatcccagcactttgggag

SEQ ID NO: 28285 - DNA, 20 bp, synthetic construct
  misc_feature 1..20: note = CRISPR gRNA sequence
  source 1..20: mol_type = other DNA
tgggaggccgaggcaggtgg

SEQ ID NO: 28286 - DNA, 20 bp, synthetic construct
  misc_feature 1..20: note = CRISPR gRNA sequence
  source 1..20: mol_type = other DNA
gggaggccgaggcaggtgga

SEQ ID NO: 28287 - DNA, 20 bp, synthetic construct
  misc_feature 1..20: note = CRISPR gRNA sequence
  source 1..20: mol_type = other DNA
ggaggccgaggcaggtggat

SEQ ID NO: 28288 - DNA, 20 bp, synthetic construct
  misc_feature 1..20: note = CRISPR gRNA sequence
  source 1..20: mol_type = other DNA
gagaccagcctggccaacat

SEQ ID NO: 28289 - DNA, 20 bp, synthetic construct
  misc_feature 1..20: note = CRISPR gRNA sequence
  source 1..20: mol_type = other DNA
agaccagcctggccaacata

SEQ ID NO: 28290 - DNA, 20 bp, synthetic construct
  misc_feature 1..20: note = CRISPR gRNA sequence
  source 1..20: mol_type = other DNA
gccaacatagtgaaacccca

SEQ ID NO: 28291 - DNA, 20 bp, synthetic construct
  misc_feature 1..20: note = CRISPR gRNA sequence
  source 1..20: mol_type = other DNA
tactaaatatacaaaacaaa

SEQ ID NO: 28292 - DNA, 20 bp, synthetic construct
  misc_feature 1..20: note = CRISPR gRNA sequence
  source 1..20: mol_type = other DNA
ctaaatatacaaaacaaatt

SEQ ID NO: 28293 - DNA, 20 bp, synthetic construct
  misc_feature 1..20: note = CRISPR gRNA sequence
  source 1..20: mol_type = other DNA
aatatacaaaacaaattagc

SEQ ID NO: 28294 - DNA, 20 bp, synthetic construct
  misc_feature 1..20: note = CRISPR gRNA sequence
  source 1..20: mol_type = other DNA
gctgggcatggtggcaggtg

SEQ ID NO: 28295 - DNA, 20 bp, synthetic construct
  misc_feature 1..20: note = CRISPR gRNA sequence
  source 1..20: mol_type = other DNA
ggcatggtggcaggtgcctg

SEQ ID NO: 28296 - DNA, 20 bp, synthetic construct
  misc_feature 1..20: note = CRISPR gRNA sequence
  source 1..20: mol_type = other DNA
tagtcacagctacttgggag

SEQ ID NO: 28297 - DNA, 20 bp, synthetic construct
  misc_feature 1..20: note = CRISPR gRNA sequence
  source 1..20: mol_type = other DNA
cttgggaggctgaggcagga

SEQ ID NO: 28298 - DNA, 20 bp, synthetic construct
  misc_feature 1..20: note = CRISPR gRNA sequence
  source 1..20: mol_type = other DNA
gggaggctgaggcaggagaa

SEQ ID NO: 28299 - DNA, 20 bp, synthetic construct
  misc_feature 1..20: note = CRISPR gRNA sequence
  source 1..20: mol_type = other DNA
ggaggctgaggcaggagaat

SEQ ID NO: 28300 - DNA, 20 bp, synthetic construct
  misc_feature 1..20: note = CRISPR gRNA sequence
  source 1..20: mol_type = other DNA
aggcaggagaatcatttgaa

SEQ ID NO: 28301 - DNA, 20 bp, synthetic construct
  misc_feature 1..20: note = CRISPR gRNA sequence
  source 1..20: mol_type = other DNA
gaaaccgggaggcggaggtt

SEQ ID NO: 28302 - DNA, 20 bp, synthetic construct
  misc_feature 1..20: note = CRISPR gRNA sequence
  source 1..20: mol_type = other DNA
aaaccgggaggcggaggttg

SEQ ID NO: 28303 - DNA, 20 bp, synthetic construct
  misc_feature 1..20: note = CRISPR gRNA sequence
  source 1..20: mol_type = other DNA
cggtgagctgagatcacgcc

SEQ ID NO: 28304 - DNA, 20 bp, synthetic construct
  misc_feature 1..20: note = CRISPR gRNA sequence
  source 1..20: mol_type = other DNA
agatcacgccactgcagtcc

SEQ ID NO: 28305 - DNA, 20 bp, synthetic construct
  misc_feature 1..20: note = CRISPR gRNA sequence
  source 1..20: mol_type = other DNA
cagtccagcttggatgacag

SEQ ID NO: 28306 - DNA, 20 bp, synthetic construct
  misc_feature 1..20: note = CRISPR gRNA sequence
  source 1..20: mol_type = other DNA
ggatgacagagtgagacccc

SEQ ID NO: 28307 - DNA, 20 bp, synthetic construct
  misc_feature 1..20: note = CRISPR gRNA sequence
  source 1..20: mol_type = other DNA
gatgacagagtgagacccca

SEQ ID NO: 28308 - DNA, 20 bp, synthetic construct
  misc_feature 1..20: note = CRISPR gRNA sequence
  source 1..20: mol_type = other DNA
aaaaataaataaataaataa

SEQ ID NO: 28309 - DNA, 20 bp, synthetic construct
  misc_feature 1..20: note = CRISPR gRNA sequence
  source 1..20: mol_type = other DNA
cattcccctcatggttaaaa

SEQ ID NO: 28310 - DNA, 20 bp, synthetic construct
  misc_feature 1..20: note = CRISPR gRNA sequence
  source 1..20: mol_type = other DNA
ccctcatggttaaaaaaaaa

SEQ ID NO: 28311 - DNA, 20 bp, synthetic construct
  misc_feature 1..20: note = CRISPR gRNA sequence
  source 1..20: mol_type = other DNA
atggttaaaaaaaaaactcc

SEQ ID NO: 28312 - DNA, 20 bp, synthetic construct
  misc_feature 1..20: note = CRISPR gRNA sequence
  source 1..20: mol_type = other DNA
aaaaaaaaactccatccccc

SEQ ID NO: 28313 - DNA, 20 bp, synthetic construct
  misc_feature 1..20: note = CRISPR gRNA sequence
  source 1..20: mol_type = other DNA
catccccctcaccactgtat

SEQ ID NO: 28314 - DNA, 20 bp, synthetic construct
  misc_feature 1..20: note = CRISPR gRNA sequence
  source 1..20: mol_type = other DNA
accactgtatatttccatat

SEQ ID NO: 28315 - DNA, 20 bp, synthetic construct
  misc_feature 1..20: note = CRISPR gRNA sequence
  source 1..20: mol_type = other DNA
tatatttccatatgattcat

SEQ ID NO: 28316 - DNA, 20 bp, synthetic construct
  misc_feature 1..20: note = CRISPR gRNA sequence
  source 1..20: mol_type = other DNA
ccatatgattcattgtctca

SEQ ID NO: 28317 - DNA, 20 bp, synthetic construct
  misc_feature 1..20: note = CRISPR gRNA sequence
  source 1..20: mol_type = other DNA
catatgattcattgtctcag

SEQ ID NO: 28318 - DNA, 20 bp, synthetic construct
  misc_feature 1..20: note = CRISPR gRNA sequence
  source 1..20: mol_type = other DNA
attgtctcagacatcagctt

SEQ ID NO: 28319 - DNA, 20 bp, synthetic construct
  misc_feature 1..20: note = CRISPR gRNA sequence
  source 1..20: mol_type = other DNA
tctcagacatcagcttgctt

SEQ ID NO: 28320 - DNA, 20 bp, synthetic construct
  misc_feature 1..20: note = CRISPR gRNA sequence
  source 1..20: mol_type = other DNA
agacatcagcttgctttccg

SEQ ID NO: 28321 - DNA, 20 bp, synthetic construct
  misc_feature 1..20: note = CRISPR gRNA sequence
  source 1..20: mol_type = other DNA
gctttccgatttctttgatt

SEQ ID NO: 28322 - DNA, 20 bp, synthetic construct
  misc_feature 1..20: note = CRISPR gRNA sequence
  source 1..20: mol_type = other DNA
ctttccgatttctttgatta

SEQ ID NO: 28323 - DNA, 20 bp, synthetic construct
  misc_feature 1..20: note = CRISPR gRNA sequence
  source 1..20: mol_type = other DNA
tccgatttctttgattatct

SEQ ID NO: 28324 - DNA, 20 bp, synthetic construct
  misc_feature 1..20: note = CRISPR gRNA sequence
  source 1..20: mol_type = other DNA
ccgatttctttgattatctg

SEQ ID NO: 28325 - DNA, 20 bp, synthetic construct
  misc_feature 1..20: note = CRISPR gRNA sequence
  source 1..20: mol_type = other DNA
cgatttctttgattatctgt

SEQ ID NO: 28326 - DNA, 20 bp, synthetic construct
  misc_feature 1..20: note = CRISPR gRNA sequence
  source 1..20: mol_type = other DNA
ctttgattatctgtctatct

SEQ ID NO: 28327 - DNA, 20 bp, synthetic construct
  misc_feature 1..20: note = CRISPR gRNA sequence
  source 1..20: mol_type = other DNA
tttgattatctgtctatctt

SEQ ID NO: 28328 - DNA, 20 bp, synthetic construct
  misc_feature 1..20: note = CRISPR gRNA sequence
  source 1..20: mol_type = other DNA
tgattatctgtctatcttcc

SEQ ID NO: 28329 - DNA, 20 bp, synthetic construct
  misc_feature 1..20: note = CRISPR gRNA sequence
  source 1..20: mol_type = other DNA
gattatctgtctatcttccc

SEQ ID NO: 28330 - DNA, 20 bp, synthetic construct
  misc_feature 1..20: note = CRISPR gRNA sequence
  source 1..20: mol_type = other DNA
attatctgtctatcttcccc

SEQ ID NO: 28331 - DNA, 20 bp, synthetic construct
  misc_feature 1..20: note = CRISPR gRNA sequence
  source 1..20: mol_type = other DNA
tctgtctatcttcccccctg

SEQ ID NO: 28332 - DNA, 20 bp, synthetic construct
  misc_feature 1..20: note = CRISPR gRNA sequence
  source 1..20: mol_type = other DNA
tctatcttcccccctggaat

SEQ ID NO: 28333 - DNA, 20 bp, synthetic construct
  misc_feature 1..20: note = CRISPR gRNA sequence
  source 1..20: mol_type = other DNA
tcttcccccctggaatgtca

SEQ ID NO: 28334 - DNA, 20 bp, synthetic construct
  misc_feature 1..20: note = CRISPR gRNA sequence
  source 1..20: mol_type = other DNA
cccccctggaatgtcagcac

SEQ ID NO: 28335 - DNA, 20 bp, synthetic construct
  misc_feature 1..20: note = CRISPR gRNA sequence
  source 1..20: mol_type = other DNA
ccccctggaatgtcagcacc

SEQ ID NO: 28336 - DNA, 20 bp, synthetic construct
  misc_feature 1..20: note = CRISPR gRNA sequence
  source 1..20: mol_type = other DNA
gaatgtcagcacccagaagg

SEQ ID NO: 28337 - DNA, 20 bp, synthetic construct
  misc_feature 1..20: note = CRISPR gRNA sequence
  source 1..20: mol_type = other DNA
tcgtctgtttggcccacaac

SEQ ID NO: 28338 - DNA, 20 bp, synthetic construct
  misc_feature 1..20: note = CRISPR gRNA sequence
  source 1..20: mol_type = other DNA
cgtctgtttggcccacaact

SEQ ID NO: 28339 - DNA, 20 bp, synthetic construct
  misc_feature 1..20: note = CRISPR gRNA sequence
  source 1..20: mol_type = other DNA
gtctgtttggcccacaactt

SEQ ID NO: 28340 - DNA, 20 bp, synthetic construct
  misc_feature 1..20: note = CRISPR gRNA sequence
  source 1..20: mol_type = other DNA
tttggcccacaactttcctc

SEQ ID NO: 28341 - DNA, 20 bp, synthetic construct
  misc_feature 1..20: note = CRISPR gRNA sequence
  source 1..20: mol_type = other DNA
ggcccacaactttcctccct

SEQ ID NO: 28342 - DNA, 20 bp, synthetic construct
  misc_feature 1..20: note = CRISPR gRNA sequence
  source 1..20: mol_type = other DNA
gcccacaactttcctccctg

SEQ ID NO: 28343 - DNA, 20 bp, synthetic construct
  misc_feature 1..20: note = CRISPR gRNA sequence
  source 1..20: mol_type = other DNA
tcctccctgggcctggcaca

SEQ ID NO: 28344 - DNA, 20 bp, synthetic construct
  misc_feature 1..20: note = CRISPR gRNA sequence
  source 1..20: mol_type = other DNA
cctccctgggcctggcacat

SEQ ID NO: 28345 - DNA, 20 bp, synthetic construct
  misc_feature 1..20: note = CRISPR gRNA sequence
  source 1..20: mol_type = other DNA
ctccctgggcctggcacata

SEQ ID NO: 28346 - DNA, 20 bp, synthetic construct
  misc_feature 1..20: note = CRISPR gRNA sequence
  source 1..20: mol_type = other DNA
cctgggcctggcacatagta

SEQ ID NO: 28347 - DNA, 20 bp, synthetic construct
  misc_feature 1..20: note = CRISPR gRNA sequence
  source 1..20: mol_type = other DNA
ggcctggcacatagtaggca

SEQ ID NO: 28348 - DNA, 20 bp, synthetic construct
  misc_feature 1..20: note = CRISPR gRNA sequence
  source 1..20: mol_type = other DNA
gcacatagtaggcaagcggt

SEQ ID NO: 28349 - DNA, 20 bp, synthetic construct
  misc_feature 1..20: note = CRISPR gRNA sequence
  source 1..20: mol_type = other DNA
aacaacgaatgccttaatcc

SEQ ID NO: 28350 - DNA, 20 bp, synthetic construct
  misc_feature 1..20: note = CRISPR gRNA sequence
  source 1..20: mol_type = other DNA
acaacgaatgccttaatcca

SEQ ID NO: 28351 - DNA, 20 bp, synthetic construct
  misc_feature 1..20: note = CRISPR gRNA sequence
  source 1..20: mol_type = other DNA
aatccaagaacccccataag

SEQ ID NO: 28352 - DNA, 20 bp, synthetic construct
  misc_feature 1..20: note = CRISPR gRNA sequence
  source 1..20: mol_type = other DNA
atccaagaacccccataaga

SEQ ID NO: 28353 - DNA, 20 bp, synthetic construct
  misc_feature 1..20: note = CRISPR gRNA sequence
  source 1..20: mol_type = other DNA
gggtgaaatatttgaggaga

SEQ ID NO: 28354 - DNA, 20 bp, synthetic construct
  misc_feature 1..20: note = CRISPR gRNA sequence
  source 1..20: mol_type = other DNA
gaggagatcaagacttaagg

SEQ ID NO: 28355 - DNA, 20 bp, synthetic construct
  misc_feature 1..20: note = CRISPR gRNA sequence
  source 1..20: mol_type = other DNA
aggagatcaagacttaaggg

SEQ ID NO: 28356 - DNA, 20 bp, synthetic construct
  misc_feature 1..20: note = CRISPR gRNA sequence
  source 1..20: mol_type = other DNA
aagggtgaagggatttgcca

SEQ ID NO: 28357 - DNA, 20 bp, synthetic construct
  misc_feature 1..20: note = CRISPR gRNA sequence
  source 1..20: mol_type = other DNA
agggtgaagggatttgccaa

SEQ ID NO: 28358 - DNA, 20 bp, synthetic construct
  misc_feature 1..20: note = CRISPR gRNA sequence
  source 1..20: mol_type = other DNA
gccaaggcctttagcaggga

SEQ ID NO: 28359 - DNA, 20 bp, synthetic construct
  misc_feature 1..20: note = CRISPR gRNA sequence
  source 1..20: mol_type = other DNA
ccaaggcctttagcagggag

SEQ ID NO: 28360 - DNA, 20 bp, synthetic construct
  misc_feature 1..20: note = CRISPR gRNA sequence
  source 1..20: mol_type = other DNA
tagcagggagccaaatgcca

SEQ ID NO: 28361 - DNA, 20 bp, synthetic construct
  misc_feature 1..20: note = CRISPR gRNA sequence
  source 1..20: mol_type = other DNA
agcagggagccaaatgccag

SEQ ID NO: 28362 - DNA, 20 bp, synthetic construct
  misc_feature 1..20: note = CRISPR gRNA sequence
  source 1..20: mol_type = other DNA
gcagggagccaaatgccaga

SEQ ID NO: 28363 - DNA, 20 bp, synthetic construct
  misc_feature 1..20: note = CRISPR gRNA sequence
  source 1..20: mol_type = other DNA
gagtcaaactctgatcctgt

SEQ ID NO: 28364 - DNA, 20 bp, synthetic construct
  misc_feature 1..20: note = CRISPR gRNA sequence
  source 1..20: mol_type = other DNA
tgatcctgtggccttttgct

SEQ ID NO: 28365 - DNA, 20 bp, synthetic construct
  misc_feature 1..20: note = CRISPR gRNA sequence
  source 1..20: mol_type = other DNA
atcctgtggccttttgctga

SEQ ID NO: 28366 - DNA, 20 bp, synthetic construct
  misc_feature 1..20: note = CRISPR gRNA sequence
  source 1..20: mol_type = other DNA
tggccttttgctgaggccag

SEQ ID NO: 28367 - DNA, 20 bp, synthetic construct
  misc_feature 1..20: note = CRISPR gRNA sequence
  source 1..20: mol_type = other DNA
ttgctgaggccagtgttctc

SEQ ID NO: 28368 - DNA, 20 bp, synthetic construct
  misc_feature 1..20: note = CRISPR gRNA sequence
  source 1..20: mol_type = other DNA
tgctgaggccagtgttctca

SEQ ID NO: 28369 - DNA, 20 bp, synthetic construct
  misc_feature 1..20: note = CRISPR gRNA sequence
  source 1..20: mol_type = other DNA
gctgaggccagtgttctcag

SEQ ID NO: 28370 - DNA, 20 bp, synthetic construct
  misc_feature 1..20: note = CRISPR gRNA sequence
  source 1..20: mol_type = other DNA
ctgaggccagtgttctcaga

SEQ ID NO: 28371 - DNA, 20 bp, synthetic construct
  misc_feature 1..20: note = CRISPR gRNA sequence
  source 1..20: mol_type = other DNA
aggccagtgttctcagactt

SEQ ID NO: 28372 - DNA, 20 bp, synthetic construct
  misc_feature 1..20: note = CRISPR gRNA sequence
  source 1..20: mol_type = other DNA
tcagacttcaggatttcaga

SEQ ID NO: 28373 - DNA, 20 bp, synthetic construct
  misc_feature 1..20: note = CRISPR gRNA sequence
  source 1..20: mol_type = other DNA
agacttcaggatttcagagg

SEQ ID NO: 28374 - DNA, 20 bp, synthetic construct
  misc_feature 1..20: note = CRISPR gRNA sequence
  source 1..20: mol_type = other DNA
caggatttcagaggccgaga

SEQ ID NO: 28375 - DNA, 20 bp, synthetic construct
  misc_feature 1..20: note = CRISPR gRNA sequence
  source 1..20: mol_type = other DNA
aggatttcagaggccgagaa

SEQ ID NO: 28376 - DNA, 20 bp, synthetic construct
  misc_feature 1..20: note = CRISPR gRNA sequence
  source 1..20: mol_type = other DNA
cagaggccgagaacatttcg

SEQ ID NO: 28377 - DNA, 20 bp, synthetic construct
  misc_feature 1..20: note = CRISPR gRNA sequence
  source 1..20: mol_type = other DNA
agaggccgagaacatttcgg

SEQ ID NO: 28378 - DNA, 20 bp, synthetic construct
  misc_feature 1..20: note = CRISPR gRNA sequence
  source 1..20: mol_type = other DNA
cggaatgaattcgagtgacc

SEQ ID NO: 28379 - DNA, 20 bp, synthetic construct
  misc_feature 1..20: note = CRISPR gRNA sequence
  source 1..20: mol_type = other DNA
ggaatgaattcgagtgaccg

SEQ ID NO: 28380 - DNA, 20 bp, synthetic construct
  misc_feature 1..20: note = CRISPR gRNA sequence
  source 1..20: mol_type = other DNA
gagtgaccgtgcgcggttac

SEQ ID NO: 28381 - DNA, 20 bp, synthetic construct
  misc_feature 1..20: note = CRISPR gRNA sequence
  source 1..20: mol_type = other DNA
ctgttttttaatgtttatca

SEQ ID NO: 28382 - DNA, 20 bp, synthetic construct
  misc_feature 1..20: note = CRISPR gRNA sequence
  source 1..20: mol_type = other DNA
ttttttaatgtttatcaagg

SEQ ID NO: 28383 - DNA, 20 bp, synthetic construct
  misc_feature 1..20: note = CRISPR gRNA sequence
  source 1..20: mol_type = other DNA
tttaatgtttatcaaggatg

SEQ ID NO: 28384 - DNA, 20 bp, synthetic construct
  misc_feature 1..20: note = CRISPR gRNA sequence
  source 1..20: mol_type = other DNA
ttaatgtttatcaaggatgc

SEQ ID NO: 28385 - DNA, 20 bp, synthetic construct
  misc_feature 1..20: note = CRISPR gRNA sequence
  source 1..20: mol_type = other DNA
taatgtttatcaaggatgct

SEQ ID NO: 28386 - DNA, 20 bp, synthetic construct
  misc_feature 1..20: note = CRISPR gRNA sequence
  source 1..20: mol_type = other DNA
aatgtttatcaaggatgctc

SEQ ID NO: 28387 - DNA, 20 bp, synthetic construct
  misc_feature 1..20: note = CRISPR gRNA sequence
  source 1..20: mol_type = other DNA
atgtttatcaaggatgctca

SEQ ID NO: 28388 - DNA, 20 bp, synthetic construct
  misc_feature 1..20: note = CRISPR gRNA sequence
  source 1..20: mol_type = other DNA
atcaaggatgctcattcaaa

SEQ ID NO: 28389 - DNA, 20 bp, synthetic construct
  misc_feature 1..20: note = CRISPR gRNA sequence
  source 1..20: mol_type = other DNA
tcaaggatgctcattcaaac

SEQ ID NO: 28390 - DNA, 20 bp, synthetic construct
  misc_feature 1..20: note = CRISPR gRNA sequence
  source 1..20: mol_type = other DNA
attcaaacaaacaaataaca

SEQ ID NO: 28391 - DNA, 20 bp, synthetic construct
  misc_feature 1..20: note = CRISPR gRNA sequence
  source 1..20: mol_type = other DNA
aaacaaacaaataacaacaa

SEQ ID NO: 28392 - DNA, 20 bp, synthetic construct
  misc_feature 1..20: note = CRISPR gRNA sequence
  source 1..20: mol_type = other DNA
ctggcaccataattttacca

SEQ ID NO: 28393 - DNA, 20 bp, synthetic construct
  misc_feature 1..20: note = CRISPR gRNA sequence
  source 1..20: mol_type = other DNA
gcaccataattttaccaaag

SEQ ID NO: 28394 - DNA, 20 bp, synthetic construct
  misc_feature 1..20: note = CRISPR gRNA sequence
  source 1..20: mol_type = other DNA
taccaaagaatgatcattct

SEQ ID NO: 28395 - DNA, 20 bp, synthetic construct
  misc_feature 1..20: note = CRISPR gRNA sequence
  source 1..20: mol_type = other DNA
accaaagaatgatcattcta

SEQ ID NO: 28396 - DNA, 20 bp, synthetic construct
  misc_feature 1..20: note = CRISPR gRNA sequence
  source 1..20: mol_type = other DNA
ccaaagaatgatcattctaa

SEQ ID NO: 28397 - DNA, 20 bp, synthetic construct
  misc_feature 1..20: note = CRISPR gRNA sequence
  source 1..20: mol_type = other DNA
taatattgaaaaagttcaaa

SEQ ID NO: 28398 - DNA, 20 bp, synthetic construct
  misc_feature 1..20: note = CRISPR gRNA sequence
  source 1..20: mol_type = other DNA
atattgaaaaagttcaaagg

SEQ ID NO: 28399 - DNA, 20 bp, synthetic construct
  misc_feature 1..20: note = CRISPR gRNA sequence
  source 1..20: mol_type = other DNA
aaaaagttcaaaggacataa

SEQ ID NO: 28400 - DNA, 20 bp, synthetic construct
  misc_feature 1..20: note = CRISPR gRNA sequence
  source 1..20: mol_type = other DNA
aaaggacataattgcagaat

SEQ ID NO: 28401 - DNA, 20 bp, synthetic construct
  misc_feature 1..20: note = CRISPR gRNA sequence
  source 1..20: mol_type = other DNA
cagaataaaagacagctctt

SEQ ID NO: 28402 - DNA, 20 bp, synthetic construct
  misc_feature 1..20: note = CRISPR gRNA sequence
  source 1..20: mol_type = other DNA
tttatatggaatgcatttaa

SEQ ID NO: 28403 - DNA, 20 bp, synthetic construct
  misc_feature 1..20: note = CRISPR gRNA sequence
  source 1..20: mol_type = other DNA
tatatggaatgcatttaacc

SEQ ID NO: 28404 - DNA, 20 bp, synthetic construct
  misc_feature 1..20: note = CRISPR gRNA sequence
  source 1..20: mol_type = other DNA
atatggaatgcatttaacca

SEQ ID NO: 28405 - DNA, 20 bp, synthetic construct
  misc_feature 1..20: note = CRISPR gRNA sequence
  source 1..20: mol_type = other DNA
tatggaatgcatttaaccat

SEQ ID NO: 28406 - DNA, 20 bp, synthetic construct
  misc_feature 1..20: note = CRISPR gRNA sequence
  source 1..20: mol_type = other DNA
aaccatatttttaaactaaa

SEQ ID NO: 28407 - DNA, 20 bp, synthetic construct
  misc_feature 1..20: note = CRISPR gRNA sequence
  source 1..20: mol_type = other DNA
accatatttttaaactaaac

SEQ ID NO: 28408 - DNA, 20 bp, synthetic construct
  misc_feature 1..20: note = CRISPR gRNA sequence
  source 1..20: mol_type = other DNA
ttaaactaaacggcccttcg

SEQ ID NO: 28409 - DNA, 20 bp, synthetic construct
  misc_feature 1..20: note = CRISPR gRNA sequence
  source 1..20: mol_type = other DNA
taaactaaacggcccttcgt

SEQ ID NO: 28410 - DNA, 20 bp, synthetic construct
  misc_feature 1..20: note = CRISPR gRNA sequence
  source 1..20: mol_type = other DNA
aaactaaacggcccttcgtt

SEQ ID NO: 28411 - DNA, 20 bp, synthetic construct
  misc_feature 1..20: note = CRISPR gRNA sequence
  source 1..20: mol_type = other DNA
aactaaacggcccttcgttg

SEQ ID NO: 28412 - DNA, 20 bp, synthetic construct
  misc_feature 1..20: note = CRISPR gRNA sequence
  source 1..20: mol_type = other DNA
aacggcccttcgttgtcctt

SEQ ID NO: 28413 - DNA, 20 bp, synthetic construct
  misc_feature 1..20: note = CRISPR gRNA sequence
  source 1..20: mol_type = other DNA
cgttgtccttatttttctca

SEQ ID NO: 28414 - DNA, 20 bp, synthetic construct
  misc_feature 1..20: note = CRISPR gRNA sequence
  source 1..20: mol_type = other DNA
gttgtccttatttttctcat

SEQ ID NO: 28415 - DNA, 20 bp, synthetic construct
  misc_feature 1..20: note = CRISPR gRNA sequence
  source 1..20: mol_type = other DNA
tccttatttttctcatcccc

SEQ ID NO: 28416 - DNA, 20 bp, synthetic construct
  misc_feature 1..20: note = CRISPR gRNA sequence
  source 1..20: mol_type = other DNA
atttttctcatccccttgaa

SEQ ID NO: 28417 - DNA, 20 bp, synthetic construct
  misc_feature 1..20: note = CRISPR gRNA sequence
  source 1..20: mol_type = other DNA
tttttctcatccccttgaag

SEQ ID NO: 28418 - DNA, 20 bp, synthetic construct
  misc_feature 1..20: note = CRISPR gRNA sequence
  source 1..20: mol_type = other DNA
ttctcatccccttgaagtct

SEQ ID NO: 28419 - DNA, 20 bp, synthetic construct
  misc_feature 1..20: note = CRISPR gRNA sequence
  source 1..20: mol_type = other DNA
tctcatccccttgaagtctg

SEQ ID NO: 28420 - DNA, 20 bp, synthetic construct
  misc_feature 1..20: note = CRISPR gRNA sequence
  source 1..20: mol_type = other DNA
ctcatccccttgaagtctgc

SEQ ID NO: 28421 - DNA, 20 bp, synthetic construct
  misc_feature 1..20: note = CRISPR gRNA sequence
  source 1..20: mol_type = other DNA
tcatccccttgaagtctgct

SEQ ID NO: 28422 - DNA, 20 bp, synthetic construct
  misc_feature 1..20: note = CRISPR gRNA sequence
  source 1..20: mol_type = other DNA
atccccttgaagtctgctct

SEQ ID NO: 28423 - DNA, 20 bp, synthetic construct
  misc_feature 1..20: note = CRISPR gRNA sequence
  source 1..20: mol_type = other DNA
gaagtctgctctaaatgttg

SEQ ID NO: 28424 - DNA, 20 bp, synthetic construct
  misc_feature 1..20: note = CRISPR gRNA sequence
  source 1..20: mol_type = other DNA
aagtctgctctaaatgttga

SEQ ID NO: 28425 - DNA, 20 bp, synthetic construct
  misc_feature 1..20: note = CRISPR gRNA sequence
  source 1..20: mol_type = other DNA
ctctaaatgttgatccaggc

SEQ ID NO: 28426 - DNA, 20 bp, synthetic construct
  misc_feature 1..20: note = CRISPR gRNA sequence
  source 1..20: mol_type = other DNA
taaatgttgatccaggctgt

SEQ ID NO: 28427 - DNA, 20 bp, synthetic construct
  misc_feature 1..20: note = CRISPR gRNA sequence
  source 1..20: mol_type = other DNA
aatgttgatccaggctgtgt

SEQ ID NO: 28428 - DNA, 20 bp, synthetic construct
  misc_feature 1..20: note = CRISPR gRNA sequence
  source 1..20: mol_type = other DNA
atccaggctgtgtgaccctg

SEQ ID NO: 28429 - DNA, 20 bp, synthetic construct
  misc_feature 1..20: note = CRISPR gRNA sequence
  source 1..20: mol_type = other DNA
tgtgaccctgtgtgagctat

SEQ ID NO: 28430 - DNA, 20 bp, synthetic construct
  misc_feature 1..20: note = CRISPR gRNA sequence
  source 1..20: mol_type = other DNA
tgtgagctatttgatcgcct

SEQ ID NO: 28431 - DNA, 20 bp, synthetic construct
  misc_feature 1..20: note = CRISPR gRNA sequence
  source 1..20: mol_type = other DNA
tttgatcgcctagtgcctca

SEQ ID NO: 28432 - DNA, 20 bp, synthetic construct
  misc_feature 1..20: note = CRISPR gRNA sequence
  source 1..20: mol_type = other DNA
gatcgcctagtgcctcagtt

SEQ ID NO: 28433 - DNA, 20 bp, synthetic construct
  misc_feature 1..20: note = CRISPR gRNA sequence
  source 1..20: mol_type = other DNA
atcgcctagtgcctcagttt

SEQ ID NO: 28434 - DNA, 20 bp, synthetic construct
  misc_feature 1..20: note = CRISPR gRNA sequence
  source 1..20: mol_type = other DNA
gtgcctcagtttccctatat

SEQ ID NO: 28435 - DNA, 20 bp, synthetic construct
  misc_feature 1..20: note = CRISPR gRNA sequence
  source 1..20: mol_type = other DNA
agtttccctatatgtaaaat

SEQ ID NO: 28436 - DNA, 20 bp, synthetic construct
  misc_feature 1..20: note = CRISPR gRNA sequence
  source 1..20: mol_type = other DNA
ccctatatgtaaaatggaga

SEQ ID NO: 28437 - DNA, 20 bp, synthetic construct
  misc_feature 1..20: note = CRISPR gRNA sequence
  source 1..20: mol_type = other DNA
cctatatgtaaaatggagat

SEQ ID NO: 28438 - DNA, 20 bp, synthetic construct
  misc_feature 1..20: note = CRISPR gRNA sequence
  source 1..20: mol_type = other DNA
tatgtaaaatggagataaga

SEQ ID NO: 28439 - DNA, 20 bp, synthetic construct
  misc_feature 1..20: note = CRISPR gRNA sequence
  source 1..20: mol_type = other DNA
agagtcttgaggagtaaatg

SEQ ID NO: 28440 - DNA, 20 bp, synthetic construct
  misc_feature 1..20: note = CRISPR gRNA sequence
  source 1..20: mol_type = other DNA
gaggagtaaatgagatctag

SEQ ID NO: 28441 - DNA, 20 bp, synthetic construct
  misc_feature 1..20: note = CRISPR gRNA sequence
  source 1..20: mol_type = other DNA
aggagtaaatgagatctagg

SEQ ID NO: 28442 - DNA, 20 bp, synthetic construct
  misc_feature 1..20: note = CRISPR gRNA sequence
  source 1..20: mol_type = other DNA
ggccgagggaagggcctagc

SEQ ID NO: 28443 - DNA, 20 bp, synthetic construct
  misc_feature 1..20: note = CRISPR gRNA sequence
  source 1..20: mol_type = other DNA
gcatgcccctggcttataat

SEQ ID NO: 28444 - DNA, 20 bp, synthetic construct
  misc_feature 1..20: note = CRISPR gRNA sequence
  source 1..20: mol_type = other DNA
gcttataataaatgctcaac

SEQ ID NO: 28445 - DNA, 20 bp, synthetic construct
  misc_feature 1..20: note = CRISPR gRNA sequence
  source 1..20: mol_type = other DNA
ataataaatgctcaacaaat

SEQ ID NO: 28446 - DNA, 20 bp, synthetic construct
  misc_feature 1..20: note = CRISPR gRNA sequence
  source 1..20: mol_type = other DNA
taataaatgctcaacaaatg

SEQ ID NO: 28447 - DNA, 20 bp, synthetic construct
  misc_feature 1..20: note = CRISPR gRNA sequence
  source 1..20: mol_type = other DNA
aacaaatggttccttttgtt

SEQ ID NO: 28448 - DNA, 20 bp, synthetic construct
  misc_feature 1..20: note = CRISPR gRNA sequence
  source 1..20: mol_type = other DNA
cttttgttattaaaatgcaa

SEQ ID NO: 28449 - DNA, 20 bp, synthetic construct
  misc_feature 1..20: note = CRISPR gRNA sequence
  source 1..20: mol_type = other DNA
ttgttattaaaatgcaaagg

SEQ ID NO: 28450 - DNA, 20 bp, synthetic construct
  misc_feature 1..20: note = CRISPR gRNA sequence
  source 1..20: mol_type = other DNA
tgttattaaaatgcaaaggc

SEQ ID NO: 28451 - DNA, 20 bp, synthetic construct
  misc_feature 1..20: note = CRISPR gRNA sequence
  source 1..20: mol_type = other DNA
gttattaaaatgcaaaggca

SEQ ID NO: 28452 - DNA, 20 bp, synthetic construct
  misc_feature 1..20: note = CRISPR gRNA sequence
  source 1..20: mol_type = other DNA
ttattaaaatgcaaaggcat

SEQ ID NO: 28453 - DNA, 20 bp, synthetic construct
  misc_feature 1..20: note = CRISPR gRNA sequence
  source 1..20: mol_type = other DNA
ttaaaatgcaaaggcatatt

SEQ ID NO: 28454 - DNA, 20 bp, synthetic construct
  misc_feature 1..20: note = CRISPR gRNA sequence
  source 1..20: mol_type = other DNA
aaatgcaaaggcatattagt

SEQ ID NO: 28455 - DNA, 20 bp, synthetic construct
  misc_feature 1..20: note = CRISPR gRNA sequence
  source 1..20: mol_type = other DNA
gtcaaccacctggtttacca

SEQ ID NO: 28456 - DNA, 20 bp, synthetic construct
  misc_feature 1..20: note = CRISPR gRNA sequence
  source 1..20: mol_type = other DNA
gtttaccactggcagtggtc

SEQ ID NO: 28457 - DNA, 20 bp, synthetic construct
  misc_feature 1..20: note = CRISPR gRNA sequence
  source 1..20: mol_type = other DNA
accactggcagtggtcgtca

SEQ ID NO: 28458 - DNA, 20 bp, synthetic construct
  misc_feature 1..20: note = CRISPR gRNA sequence
  source 1..20: mol_type = other DNA
ccactggcagtggtcgtcag

SEQ ID NO: 28459 - DNA, 20 bp, synthetic construct
  misc_feature 1..20: note = CRISPR gRNA sequence
  source 1..20: mol_type = other DNA
gcagtggtcgtcagctggca

SEQ ID NO: 28460 - DNA, 20 bp, synthetic construct
  misc_feature 1..20: note = CRISPR gRNA sequence
  source 1..20: mol_type = other DNA
gcatttcaggaccccttccc

SEQ ID NO: 28461 - DNA, 20 bp, synthetic construct
  misc_feature 1..20: note = CRISPR gRNA sequence
  source 1..20: mol_type = other DNA
caggaccccttccccaggct

SEQ ID NO: 28462 - DNA, 20 bp, synthetic construct
  misc_feature 1..20: note = CRISPR gRNA sequence
  source 1..20: mol_type = other DNA
aggaccccttccccaggctg

SEQ ID NO: 28463 - DNA, 20 bp, synthetic construct
  misc_feature 1..20: note = CRISPR gRNA sequence
  source 1..20: mol_type = other DNA
ccccaggctgcggcgggaga

SEQ ID NO: 28464 - DNA, 20 bp, synthetic construct
  misc_feature 1..20: note = CRISPR gRNA sequence
  source 1..20: mol_type = other DNA
cccaggctgcggcgggagaa

SEQ ID NO: 28465 - DNA, 20 bp, synthetic construct
  misc_feature 1..20: note = CRISPR gRNA sequence
  source 1..20: mol_type = other DNA
cggcgggagaagggtatctg

SEQ ID NO: 28466 - DNA, 20 bp, synthetic construct
  misc_feature 1..20: note = CRISPR gRNA sequence
  source 1..20: mol_type = other DNA
tggatgttgggaagagtaag

SEQ ID NO: 28467 - DNA, 20 bp, synthetic construct
  misc_feature 1..20: note = CRISPR gRNA sequence
  source 1..20: mol_type = other DNA
ggaagagtaagaactggctc

SEQ ID NO: 28468 - DNA, 20 bp, synthetic construct
  misc_feature 1..20: note = CRISPR gRNA sequence
  source 1..20: mol_type = other DNA
gctccctacttagagacaaa

SEQ ID NO: 28469 - DNA, 20 bp, synthetic construct
  misc_feature 1..20: note = CRISPR gRNA sequence
  source 1..20: mol_type = other DNA
cctacttagagacaaaagct

SEQ ID NO: 28470 - DNA, 20 bp, synthetic construct
  misc_feature 1..20: note = CRISPR gRNA sequence
  source 1..20: mol_type = other DNA
cttagagacaaaagctgggg

SEQ ID NO: 28471 - DNA, 20 bp, synthetic construct
  misc_feature 1..20: note = CRISPR gRNA sequence
  source 1..20: mol_type = other DNA
agagacaaaagctggggagc

SEQ ID NO: 28472 - DNA, 20 bp, synthetic construct
  misc_feature 1..20: note = CRISPR gRNA sequence
  source 1..20: mol_type = other DNA
gagacaaaagctggggagcc

SEQ ID NO: 28473 - DNA, 20 bp, synthetic construct
  misc_feature 1..20: note = CRISPR gRNA sequence
  source 1..20: mol_type = other DNA
gggagccccaagatgggagc

SEQ ID NO: 28474 - DNA, 20 bp, synthetic construct
  misc_feature 1..20: note = CRISPR gRNA sequence
  source 1..20: mol_type = other DNA
acctctttttcttttctttt

SEQ ID NO: 28475 - DNA, 20 bp, synthetic construct
  misc_feature 1..20: note = CRISPR gRNA sequence
  source 1..20: mol_type = other DNA
cctctttttcttttcttttt

SEQ ID NO: 28476 - DNA, 20 bp, synthetic construct
  misc_feature 1..20: note = CRISPR gRNA sequence
  source 1..20: mol_type = other DNA
tttttcttttctttttttgt

SEQ ID NO: 28477 - DNA, 20 bp, synthetic construct
  misc_feature 1..20: note = CRISPR gRNA sequence
  source 1..20: mol_type = other DNA
tttcttttctttttttgttt

SEQ ID NO: 28478 - DNA, 20 bp, synthetic construct
  misc_feature 1..20: note = CRISPR gRNA sequence
  source 1..20: mol_type = other DNA
ttcttttctttttttgtttt

SEQ ID NO: 28479 - DNA, 20 bp, synthetic construct
  misc_feature 1..20: note = CRISPR gRNA sequence
  source 1..20: mol_type = other DNA
tcttttctttttttgttttt

SEQ ID NO: 28480 - DNA, 20 bp, synthetic construct
  misc_feature 1..20: note = CRISPR gRNA sequence
  source 1..20: mol_type = other DNA
cttttctttttttgtttttt

SEQ ID NO: 28481 - DNA, 20 bp, synthetic construct
  misc_feature 1..20: note = CRISPR gRNA sequence
  source 1..20: mol_type = other DNA
ttttctttttttgttttttt

SEQ ID NO: 28482 - DNA, 20 bp, synthetic construct
  misc_feature 1..20: note = CRISPR gRNA sequence
  source 1..20: mol_type = other DNA
ttctttttttgttttttttc

SEQ ID NO: 28483 - DNA, 20 bp, synthetic construct
  misc_feature 1..20: note = CRISPR gRNA sequence
  source 1..20: mol_type = other DNA
tctttttttgttttttttct

SEQ ID NO: 28484 - DNA, 20 bp, synthetic construct
  misc_feature 1..20: note = CRISPR gRNA sequence
  source 1..20: mol_type = other DNA
ctttttttgttttttttctt

SEQ ID NO: 28485 - DNA, 20 bp, synthetic construct
  misc_feature 1..20: note = CRISPR gRNA sequence
  source 1..20: mol_type = other DNA
tttttttgttttttttcttt

SEQ ID NO: 28486 - DNA, 20 bp, synthetic construct
  misc_feature 1..20: note = CRISPR gRNA sequence
  source 1..20: mol_type = other DNA
tttttgttttttttcttttt

SEQ ID NO: 28487 - DNA, 20 bp, synthetic construct
  misc_feature 1..20: note = CRISPR gRNA sequence
  source 1..20: mol_type = other DNA
ttttgttttttttctttttt

SEQ ID NO: 28488 - DNA, 20 bp, synthetic construct
  misc_feature 1..20: note = CRISPR gRNA sequence
  source 1..20: mol_type = other DNA
tttgttttttttcttttttg

SEQ ID NO: 28489 - DNA, 20 bp, synthetic construct
  misc_feature 1..20: note = CRISPR gRNA sequence
  source 1..20: mol_type = other DNA
ttgttttttttcttttttga

SEQ ID NO: 28490 - DNA, 20 bp, synthetic construct
  misc_feature 1..20: note = CRISPR gRNA sequence
  source 1..20: mol_type = other DNA
tgttttttttcttttttgag

SEQ ID NO: 28491 - DNA, 20 bp, synthetic construct
  misc_feature 1..20: note = CRISPR gRNA sequence
  source 1..20: mol_type = other DNA
gttttttttcttttttgaga

SEQ ID NO: 28492 - DNA, 20 bp, synthetic construct
  misc_feature 1..20: note = CRISPR gRNA sequence
  source 1..20: mol_type = other DNA
ttttttttcttttttgagac

SEQ ID NO: 28493 - DNA, 20 bp, synthetic construct
  misc_feature 1..20: note = CRISPR gRNA sequence
  source 1..20: mol_type = other DNA
tttttcttttttgagacagg

SEQ ID NO: 28494 - DNA, 20 bp, synthetic construct
  misc_feature 1..20: note = CRISPR gRNA sequence
  source 1..20: mol_type = other DNA
ttttcttttttgagacaggg

SEQ ID NO: 28495 - DNA, 20 bp, synthetic construct
  misc_feature 1..20: note = CRISPR gRNA sequence
  source 1..20: mol_type = other DNA
tttcttttttgagacagggt

SEQ ID NO: 28496 - DNA, 20 bp, synthetic construct
  misc_feature 1..20: note = CRISPR gRNA sequence
  source 1..20: mol_type = other DNA
ttcttttttgagacagggtc

SEQ ID NO: 28497 - DNA, 20 bp, synthetic construct
  misc_feature 1..20: note = CRISPR gRNA sequence
  source 1..20: mol_type = other DNA
tcttttttgagacagggtct

SEQ ID NO: 28498 - DNA, 20 bp, synthetic construct
  misc_feature 1..20: note = CRISPR gRNA sequence
  source 1..20: mol_type = other DNA
cttttttgagacagggtctc

SEQ ID NO: 28499 - DNA, 20 bp, synthetic construct
  misc_feature 1..20: note = CRISPR gRNA sequence
  source 1..20: mol_type = other DNA
ttttttgagacagggtctcg

SEQ ID NO: 28500 - DNA, 20 bp, synthetic construct
  misc_feature 1..20: note = CRISPR gRNA sequence
  source 1..20: mol_type = other DNA
ttttgagacagggtctcgct

SEQ ID NO: 28501 - DNA, 20 bp, synthetic construct
  misc_feature 1..20: note = CRISPR gRNA sequence
  source 1..20: mol_type = other DNA
tttgagacagggtctcgctc

SEQ ID NO: 28502 - DNA, 20 bp, synthetic construct
  misc_feature 1..20: note = CRISPR gRNA sequence
  source 1..20: mol_type = other DNA
ttgagacagggtctcgctct

SEQ ID NO: 28503 - DNA, 20 bp, synthetic construct
  misc_feature 1..20: note = CRISPR gRNA sequence
  source 1..20: mol_type = other DNA
tgagacagggtctcgctctt

SEQ ID NO: 28504 - DNA, 20 bp, synthetic construct
  misc_feature 1..20: note = CRISPR gRNA sequence
  source 1..20: mol_type = other DNA
gagacagggtctcgctctta

SEQ ID NO: 28505 - DNA, 20 bp, synthetic construct
  misc_feature 1..20: note = CRISPR gRNA sequence
  source 1..20: mol_type = other DNA
agacagggtctcgctcttac

SEQ ID NO: 28506 - DNA, 20 bp, synthetic construct
  misc_feature 1..20: note = CRISPR gRNA sequence
  source 1..20: mol_type = other DNA
gctcttacccaggctggagt

SEQ ID NO: 28507 - DNA, 20 bp, synthetic construct
  misc_feature 1..20: note = CRISPR gRNA sequence
  source 1..20: mol_type = other DNA
ttacccaggctggagtgcag

SEQ ID NO: 28508 - DNA, 20 bp, synthetic construct
  misc_feature 1..20: note = CRISPR gRNA sequence
  source 1..20: mol_type = other DNA
acccaggctggagtgcagtg

SEQ ID NO: 28509 - DNA, 20 bp, synthetic construct
  misc_feature 1..20: note = CRISPR gRNA sequence
  source 1..20: mol_type = other DNA
cccaggctggagtgcagtgg

SEQ ID NO: 28510 - DNA, 20 bp, synthetic construct
  misc_feature 1..20: note = CRISPR gRNA sequence
  source 1..20: mol_type = other DNA
gagtgcagtggtgtgatcat

SEQ ID NO: 28511 - DNA, 20 bp, synthetic construct
  misc_feature 1..20: note = CRISPR gRNA sequence
  source 1..20: mol_type = other DNA
actgcatcctccacctcctg

SEQ ID NO: 28512 - DNA, 20 bp, synthetic construct
  misc_feature 1..20: note = CRISPR gRNA sequence
  source 1..20: mol_type = other DNA
catcctccacctcctgggct

SEQ ID NO: 28513 - DNA, 20 bp, synthetic construct
  misc_feature 1..20: note = CRISPR gRNA sequence
  source 1..20: mol_type = other DNA
cacctcctgggctcaagcga

SEQ ID NO: 28514 - DNA, 20 bp, synthetic construct
  misc_feature 1..20: note = CRISPR gRNA sequence
  source 1..20: mol_type = other DNA
ctgggctcaagcgatgcttc

SEQ ID NO: 28515 - DNA, 20 bp, synthetic construct
  misc_feature 1..20: note = CRISPR gRNA sequence
  source 1..20: mol_type = other DNA
ggctcaagcgatgcttccac

SEQ ID NO: 28516 - DNA, 20 bp, synthetic construct
  misc_feature 1..20: note = CRISPR gRNA sequence
  source 1..20: mol_type = other DNA
aagcgatgcttccacctcag

SEQ ID NO: 28517 - DNA, 20 bp, synthetic construct
  misc_feature 1..20: note = CRISPR gRNA sequence
  source 1..20: mol_type = other DNA
ccacctcagcctcctaagaa

SEQ ID NO: 28518 - DNA, 20 bp, synthetic construct
  misc_feature 1..20: note = CRISPR gRNA sequence
  source 1..20: mol_type = other DNA
cacctcagcctcctaagaag

SEQ ID NO: 28519 - DNA, 20 bp, synthetic construct
  misc_feature 1..20: note = CRISPR gRNA sequence
  source 1..20: mol_type = other DNA
agcctcctaagaagctgaga

SEQ ID NO: 28520 - DNA, 20 bp, synthetic construct
  misc_feature 1..20: note = CRISPR gRNA sequence
  source 1..20: mol_type = other DNA
ctaagaagctgagaccacag

SEQ ID NO: 28521 - DNA, 20 bp, synthetic construct
  misc_feature 1..20: note = CRISPR gRNA sequence
  source 1..20: mol_type = other DNA
agaagctgagaccacaggac

SEQ ID NO: 28522 - DNA, 20 bp, synthetic construct
  misc_feature 1..20: note = CRISPR gRNA sequence
  source 1..20: mol_type = other DNA
agaccacaggacacaccacc

SEQ ID NO: 28523 - DNA, 20 bp, synthetic construct
  misc_feature 1..20: note = CRISPR gRNA sequence
  source 1..20: mol_type = other DNA
ggctaattattgtgtttttt

SEQ ID NO: 28524 - DNA, 20 bp, synthetic construct
  misc_feature 1..20: note = CRISPR gRNA sequence
  source 1..20: mol_type = other DNA
gctaattattgtgttttttg

SEQ ID NO: 28525 - DNA, 20 bp, synthetic construct
  misc_feature 1..20: note = CRISPR gRNA sequence
  source 1..20: mol_type = other DNA
attattgtgttttttgtaga

SEQ ID NO: 28526 - DNA, 20 bp, synthetic construct
  misc_feature 1..20: note = CRISPR gRNA sequence
  source 1..20: mol_type = other DNA
ttgtgttttttgtagagact

SEQ ID NO: 28527 - DNA, 20 bp, synthetic construct
  misc_feature 1..20: note = CRISPR gRNA sequence
  source 1..20: mol_type = other DNA
tgttttttgtagagactgag

SEQ ID NO: 28528 - DNA, 20 bp, synthetic construct
  misc_feature 1..20: note = CRISPR gRNA sequence
  source 1..20: mol_type = other DNA
tttgtagagactgagtctca

SEQ ID NO: 28529 - DNA, 20 bp, synthetic construct
  misc_feature 1..20: note = CRISPR gRNA sequence
  source 1..20: mol_type = other DNA
ttgtagagactgagtctcac

SEQ ID NO: 28530 - DNA, 20 bp, synthetic construct
  misc_feature 1..20: note = CRISPR gRNA sequence
  source 1..20: mol_type = other DNA
tgtagagactgagtctcact

SEQ ID NO: 28531 - DNA, 20 bp, synthetic construct
  misc_feature 1..20: note = CRISPR gRNA sequence
  source 1..20: mol_type = other DNA
gtagagactgagtctcacta

SEQ ID NO: 28532 - DNA, 20 bp, synthetic construct
  misc_feature 1..20: note = CRISPR gRNA sequence
  source 1..20: mol_type = other DNA
tagagactgagtctcactat

SEQ ID NO: 28533 - DNA, 20 bp, synthetic construct
  misc_feature 1..20: note = CRISPR gRNA sequence
  source 1..20: mol_type = other DNA
agtctcactatgttgcccaa

SEQ ID NO: 28534 - DNA, 20 bp, synthetic construct
  misc_feature 1..20: note = CRISPR gRNA sequence
  source 1..20: mol_type = other DNA
actatgttgcccaagctggt

SEQ ID NO: 28535 - DNA, 20 bp, synthetic construct
  misc_feature 1..20: note = CRISPR gRNA sequence
  source 1..20: mol_type = other DNA
tgttgcccaagctggtcttg

SEQ ID NO: 28536 - DNA, 20 bp, synthetic construct
  misc_feature 1..20: note = CRISPR gRNA sequence
  source 1..20: mol_type = other DNA
cccaagctggtcttgaactc

SEQ ID NO: 28537 - DNA, 20 bp, synthetic construct
  misc_feature 1..20: note = CRISPR gRNA sequence
  source 1..20: mol_type = other DNA
gtcttgaactcctgggctca

SEQ ID NO: 28538 - DNA, 20 bp, synthetic construct
  misc_feature 1..20: note = CRISPR gRNA sequence
  source 1..20: mol_type = other DNA
gaactcctgggctcaagcag

SEQ ID NO: 28539 - DNA, 20 bp, synthetic construct
  misc_feature 1..20: note = CRISPR gRNA sequence
  source 1..20: mol_type = other DNA
aactcctgggctcaagcagt

SEQ ID NO: 28540 - DNA, 20 bp, synthetic construct
  misc_feature 1..20: note = CRISPR gRNA sequence
  source 1..20: mol_type = other DNA
ctgggctcaagcagtcctct

SEQ ID NO: 28541 - DNA, 20 bp, synthetic construct
  misc_feature 1..20: note = CRISPR gRNA sequence
  source 1..20: mol_type = other DNA
ggctcaagcagtcctcttac

SEQ ID NO: 28542 - DNA, 20 bp, synthetic construct
  misc_feature 1..20: note = CRISPR gRNA sequence
  source 1..20: mol_type = other DNA
aagcagtcctcttaccttgg

SEQ ID NO: 28543 - DNA, 20 bp, synthetic construct
  misc_feature 1..20: note = CRISPR gRNA sequence
  source 1..20: mol_type = other DNA
ttaccttggcctcccaaaat

SEQ ID NO: 28544 - DNA, 20 bp, synthetic construct
  misc_feature 1..20: note = CRISPR gRNA sequence
  source 1..20: mol_type = other DNA
accttggcctcccaaaatgc

SEQ ID NO: 28545 - DNA, 20 bp, synthetic construct
  misc_feature 1..20: note = CRISPR gRNA sequence
  source 1..20: mol_type = other DNA
ccttggcctcccaaaatgct

SEQ ID NO: 28546 - DNA, 20 bp, synthetic construct
  misc_feature 1..20: note = CRISPR gRNA sequence
  source 1..20: mol_type = other DNA
ggcctcccaaaatgctggaa

SEQ ID NO: 28547 - DNA, 20 bp, synthetic construct
  misc_feature 1..20: note = CRISPR gRNA sequence
  source 1..20: mol_type = other DNA
gcctcccaaaatgctggaat

SEQ ID NO: 28548 - DNA, 20 bp, synthetic construct
  misc_feature 1..20: note = CRISPR gRNA sequence
  source 1..20: mol_type = other DNA
ccaaaatgctggaattacag

SEQ ID NO: 28549 - DNA, 20 bp, synthetic construct
  misc_feature 1..20: note = CRISPR gRNA sequence
  source 1..20: mol_type = other DNA
gaattacagacatgagccac

SEQ ID NO: 28550 - DNA, 20 bp, synthetic construct
  misc_feature 1..20: note = CRISPR gRNA sequence
  source 1..20: mol_type = other DNA
cagacatgagccactgttcc

SEQ ID NO: 28551 - DNA, 20 bp, synthetic construct
  misc_feature 1..20: note = CRISPR gRNA sequence
  source 1..20: mol_type = other DNA
ttcccagcctcaactggcct

SEQ ID NO: 28552 - DNA, 20 bp, synthetic construct
  misc_feature 1..20: note = CRISPR gRNA sequence
  source 1..20: mol_type = other DNA
ccagcctcaactggcctctt

SEQ ID NO: 28553 - DNA, 20 bp, synthetic construct
  misc_feature 1..20: note = CRISPR gRNA sequence
  source 1..20: mol_type = other DNA
aactggcctcttatgggggg

SEQ ID NO: 28554 - DNA, 20 bp, synthetic construct
  misc_feature 1..20: note = CRISPR gRNA sequence
  source 1..20: mol_type = other DNA
gcctcttatggggggctatg

SEQ ID NO: 28555 - DNA, 20 bp, synthetic construct
  misc_feature 1..20: note = CRISPR gRNA sequence
  source 1..20: mol_type = other DNA
ttatggggggctatgaaatc

SEQ ID NO: 28556 - DNA, 20 bp, synthetic construct
  misc_feature 1..20: note = CRISPR gRNA sequence
  source 1..20: mol_type = other DNA
atggggggctatgaaatcta

SEQ ID NO: 28557 - DNA, 20 bp, synthetic construct
  misc_feature 1..20: note = CRISPR gRNA sequence
  source 1..20: mol_type = other DNA
tggggggctatgaaatctac

SEQ ID NO: 28558 - DNA, 20 bp, synthetic construct
  misc_feature 1..20: note = CRISPR gRNA sequence
  source 1..20: mol_type = other DNA
tgaaatctaccccaagcaga

SEQ ID NO: 28559 - DNA, 20 bp, synthetic construct
  misc_feature 1..20: note = CRISPR gRNA sequence
  source 1..20: mol_type = other DNA
ccccaagcagaaaagattgg

SEQ ID NO: 28560 - DNA, 20 bp, synthetic construct
  misc_feature 1..20: note = CRISPR gRNA sequence
  source 1..20: mol_type = other DNA
gggtcctacgtggaagggtt

SEQ ID NO: 28561 - DNA, 20 bp, synthetic construct
  misc_feature 1..20: note = CRISPR gRNA sequence
  source 1..20: mol_type = other DNA
cgtggaagggttgcagggac

SEQ ID NO: 28562 - DNA, 20 bp, synthetic construct
  misc_feature 1..20: note = CRISPR gRNA sequence
  source 1..20: mol_type = other DNA
cagggacctaagaggctggg

SEQ ID NO: 28563 - DNA, 20 bp, synthetic construct
  misc_feature 1..20: note = CRISPR gRNA sequence
  source 1..20: mol_type = other DNA
agaggctggggtggaaggga

SEQ ID NO: 28564 - DNA, 20 bp, synthetic construct
  misc_feature 1..20: note = CRISPR gRNA sequence
  source 1..20: mol_type = other DNA
gggtggaagggaagaggagg

SEQ ID NO: 28565 - DNA, 20 bp, synthetic construct
  misc_feature 1..20: note = CRISPR gRNA sequence
  source 1..20: mol_type = other DNA
agacaggacctgacttctgt

SEQ ID NO: 28566 - DNA, 20 bp, synthetic construct
  misc_feature 1..20: note = CRISPR gRNA sequence
  source 1..20: mol_type = other DNA
acttctgtgccttgtctctg

SEQ ID NO: 28567 - DNA, 20 bp, synthetic construct
  misc_feature 1..20: note = CRISPR gRNA sequence
  source 1..20: mol_type = other DNA
ctgtgccttgtctctgcccc

SEQ ID NO: 28568 - DNA, 20 bp, synthetic construct
  misc_feature 1..20: note = CRISPR gRNA sequence
  source 1..20: mol_type = other DNA
tgtgccttgtctctgcccca

SEQ ID NO: 28569 - DNA, 20 bp, synthetic construct
  misc_feature 1..20: note = CRISPR gRNA sequence
  source 1..20: mol_type = other DNA
tgccttgtctctgccccacc

SEQ ID NO: 28570 - DNA, 20 bp, synthetic construct
  misc_feature 1..20: note = CRISPR gRNA sequence
  source 1..20: mol_type = other DNA
gtctctgccccaccctgggg

SEQ ID NO: 28571 - DNA, 20 bp, synthetic construct
  misc_feature 1..20: note = CRISPR gRNA sequence
  source 1..20: mol_type = other DNA
tctctgccccaccctggggc

SEQ ID NO: 28572 - DNA, 20 bp, synthetic construct
  misc_feature 1..20: note = CRISPR gRNA sequence
  source 1..20: mol_type = other DNA
tgccccaccctggggctgaa

SEQ ID NO: 28573 - DNA, 20 bp, synthetic construct
  misc_feature 1..20: note = CRISPR gRNA sequence
  source 1..20: mol_type = other DNA
ccccaccctggggctgaatg

SEQ ID NO: 28574 - DNA, 20 bp, synthetic construct
  misc_feature 1..20: note = CRISPR gRNA sequence
  source 1..20: mol_type = other DNA
gggctgaatgaggggctgtg

SEQ ID NO: 28575 - DNA, 20 bp, synthetic construct
  misc_feature 1..20: note = CRISPR gRNA sequence
  source 1..20: mol_type = other DNA
aatgaggggctgtgactgtg

SEQ ID NO: 28576 - DNA, 20 bp, synthetic construct
  misc_feature 1..20: note = CRISPR gRNA sequence
  source 1..20: mol_type = other DNA
tgactgtgactggaggtctt

SEQ ID NO: 28577 - DNA, 20 bp, synthetic construct
  misc_feature 1..20: note = CRISPR gRNA sequence
  source 1..20: mol_type = other DNA
tgactggaggtcttaccctt

SEQ ID NO: 28578 - DNA, 20 bp, synthetic construct
  misc_feature 1..20: note = CRISPR gRNA sequence
  source 1..20: mol_type = other DNA
gaggtcttacccttgctctt

SEQ ID NO: 28579 - DNA, 20 bp, synthetic construct
  misc_feature 1..20: note = CRISPR gRNA sequence
  source 1..20: mol_type = other DNA
acccttgctctttgcctcct

SEQ ID NO: 28580 - DNA, 20 bp, synthetic construct
  misc_feature 1..20: note = CRISPR gRNA sequence
  source 1..20: mol_type = other DNA
cccttgctctttgcctccta

SEQ ID NO: 28581 - DNA, 20 bp, synthetic construct
  misc_feature 1..20: note = CRISPR gRNA sequence
  source 1..20: mol_type = other DNA
gctctttgcctcctaggctg

SEQ ID NO: 28582 - DNA, 20 bp, synthetic construct
  misc_feature 1..20: note = CRISPR gRNA sequence
  source 1..20: mol_type = other DNA
ctctttgcctcctaggctgg

SEQ ID NO: 28583 - DNA, 20 bp, synthetic construct
  misc_feature 1..20: note = CRISPR gRNA sequence
  source 1..20: mol_type = other DNA
tttgcctcctaggctgggcc

SEQ ID NO: 28584 - DNA, 20 bp, synthetic construct
  misc_feature 1..20: note = CRISPR gRNA sequence
  source 1..20: mol_type = other DNA
tgcctcctaggctgggccct

SEQ ID NO: 28585 - DNA, 20 bp, synthetic construct
  misc_feature 1..20: note = CRISPR gRNA sequence
  source 1..20: mol_type = other DNA
gcctcctaggctgggccctg

SEQ ID NO: 28586 - DNA, 20 bp, synthetic construct
  misc_feature 1..20: note = CRISPR gRNA sequence
  source 1..20: mol_type = other DNA
cctcctaggctgggccctgt

SEQ ID NO: 28587 - DNA, 20 bp, synthetic construct
  misc_feature 1..20: note = CRISPR gRNA sequence
  source 1..20: mol_type = other DNA
ctaggctgggccctgtctca

SEQ ID NO: 28588 - DNA, 20 bp, synthetic construct
  misc_feature 1..20: note = CRISPR gRNA sequence
  source 1..20: mol_type = other DNA
ggctgggccctgtctcaggc

SEQ ID NO: 28589 - DNA, 20 bp, synthetic construct
  misc_feature 1..20: note = CRISPR gRNA sequence
  source 1..20: mol_type = other DNA
ggccctgtctcaggccccca

SEQ ID NO: 28590 - DNA, 20 bp, synthetic construct
  misc_feature 1..20: note = CRISPR gRNA sequence
  source 1..20: mol_type = other DNA
tctcaggcccccaggctttc

SEQ ID NO: 28591 - DNA, 20 bp, synthetic construct
  misc_feature 1..20: note = CRISPR gRNA sequence
  source 1..20: mol_type = other DNA
aggcccccaggctttcccca

SEQ ID NO: 28592 - DNA, 20 bp, synthetic construct
  misc_feature 1..20: note = CRISPR gRNA sequence
  source 1..20: mol_type = other DNA
tccccaaactggtgcggatc

SEQ ID NO: 28593 - DNA, 20 bp, synthetic construct
  misc_feature 1..20: note = CRISPR gRNA sequence
  source 1..20: mol_type = other DNA
ccccaaactggtgcggatcc

SEQ ID NO: 28594 - DNA, 20 bp, synthetic construct
  misc_feature 1..20: note = CRISPR gRNA sequence
  source 1..20: mol_type = other DNA
cccaaactggtgcggatcct

SEQ ID NO: 28595 - DNA, 20 bp, synthetic construct
  misc_feature 1..20: note = CRISPR gRNA sequence
  source 1..20: mol_type = other DNA
gtgcggatcctcacggcctt

SEQ ID NO: 28596 - DNA, 20 bp, synthetic construct
  misc_feature 1..20: note = CRISPR gRNA sequence
  source 1..20: mol_type = other DNA
acggccttttcctccctgca

SEQ ID NO: 28597 - DNA, 20 bp, synthetic construct
  misc_feature 1..20: note = CRISPR gRNA sequence
  source 1..20: mol_type = other DNA
ttcctccctgcagcatctgg

SEQ ID NO: 28598 - DNA, 20 bp, synthetic construct
  misc_feature 1..20: note = CRISPR gRNA sequence
  source 1..20: mol_type = other DNA
tcctccctgcagcatctgga

SEQ ID NO: 28599 - DNA, 20 bp, synthetic construct
  misc_feature 1..20: note = CRISPR gRNA sequence
  source 1..20: mol_type = other DNA
cctccctgcagcatctggag

SEQ ID NO: 28600 - DNA, 20 bp, synthetic construct
  misc_feature 1..20: note = CRISPR gRNA sequence
  source 1..20: mol_type = other DNA
ctccctgcagcatctggagt

SEQ ID NO: 28601 - DNA, 20 bp, synthetic construct
  misc_feature 1..20: note = CRISPR gRNA sequence
  source 1..20: mol_type = other DNA
cctgcagcatctggagtgag

SEQ ID NO: 28602 - DNA, 20 bp, synthetic construct
  misc_feature 1..20: note = CRISPR gRNA sequence
  source 1..20: mol_type = other DNA
cagcatctggagtgagtata

SEQ ID NO: 28603 - DNA, 20 bp, synthetic construct
  misc_feature 1..20: note = CRISPR gRNA sequence
  source 1..20: mol_type = other DNA
gagtgagtatagactctggg

SEQ ID NO: 28604 - DNA, 20 bp, synthetic construct
  misc_feature 1..20: note = CRISPR gRNA sequence
  source 1..20: mol_type = other DNA
tgggaccccttcctctcaac

SEQ ID NO: 28605 - DNA, 20 bp, synthetic construct
  misc_feature 1..20: note = CRISPR gRNA sequence
  source 1..20: mol_type = other DNA
ggaccccttcctctcaacat

SEQ ID NO: 28606 - DNA, 20 bp, synthetic construct
  misc_feature 1..20: note = CRISPR gRNA sequence
  source 1..20: mol_type = other DNA
cctctcaacatctgggtgca

SEQ ID NO: 28607 - DNA, 20 bp, synthetic construct
  misc_feature 1..20: note = CRISPR gRNA sequence
  source 1..20: mol_type = other DNA
ctctcaacatctgggtgcag

SEQ ID NO: 28608 - DNA, 20 bp, synthetic construct
  misc_feature 1..20: note = CRISPR gRNA sequence
  source 1..20: mol_type = other DNA
tcaacatctgggtgcagtgc

SEQ ID NO: 28609 - DNA, 20 bp, synthetic construct
  misc_feature 1..20: note = CRISPR gRNA sequence
  source 1..20: mol_type = other DNA
aacatctgggtgcagtgctg

SEQ ID NO: 28610 - DNA, 20 bp, synthetic construct
  misc_feature 1..20: note = CRISPR gRNA sequence
  source 1..20: mol_type = other DNA
ggtgcagtgctgtgatcata

SEQ ID NO: 28611 - DNA, 20 bp, synthetic construct
  misc_feature 1..20: note = CRISPR gRNA sequence
  source 1..20: mol_type = other DNA
tgatcatagctcactgcagc

SEQ ID NO: 28612 - DNA, 20 bp, synthetic construct
  misc_feature 1..20: note = CRISPR gRNA sequence
  source 1..20: mol_type = other DNA
actgcagcctcgaattcctg

SEQ ID NO: 28613 - DNA, 20 bp, synthetic construct
  misc_feature 1..20: note = CRISPR gRNA sequence
  source 1..20: mol_type = other DNA
cagcctcgaattcctggcct

SEQ ID NO: 28614 - DNA, 20 bp, synthetic construct
  misc_feature 1..20: note = CRISPR gRNA sequence
  source 1..20: mol_type = other DNA
gaattcctggcctcaagtag

SEQ ID NO: 28615 - DNA, 20 bp, synthetic construct
  misc_feature 1..20: note = CRISPR gRNA sequence
  source 1..20: mol_type = other DNA
ctggcctcaagtagtcctcc

SEQ ID NO: 28616 - DNA, 20 bp, synthetic construct
  misc_feature 1..20: note = CRISPR gRNA sequence
  source 1..20: mol_type = other DNA
gcctcaagtagtcctcctgc

SEQ ID NO: 28617 - DNA, 20 bp, synthetic construct
  misc_feature 1..20: note = CRISPR gRNA sequence
  source 1..20: mol_type = other DNA
aagtagtcctcctgcctcag

SEQ ID NO: 28618 - DNA, 20 bp, synthetic construct
  misc_feature 1..20: note = CRISPR gRNA sequence
  source 1..20: mol_type = other DNA
ctgcctcagcctcctgagta

SEQ ID NO: 28619 - DNA, 20 bp, synthetic construct
  misc_feature 1..20: note = CRISPR gRNA sequence
  source 1..20: mol_type = other DNA
cctcagcctcctgagtagct

SEQ ID NO: 28620 - DNA, 20 bp, synthetic construct
  misc_feature 1..20: note = CRISPR gRNA sequence
  source 1..20: mol_type = other DNA
agcctcctgagtagctggga

SEQ ID NO: 28621 - DNA, 20 bp, synthetic construct
  misc_feature 1..20: note = CRISPR gRNA sequence
  source 1..20: mol_type = other DNA
ctgagtagctgggaccacag

SEQ ID NO: 28622 - DNA, 20 bp, synthetic construct
  misc_feature 1..20: note = CRISPR gRNA sequence
  source 1..20: mol_type = other DNA
agtagctgggaccacaggtg

SEQ ID NO: 28623 - DNA, 20 bp, synthetic construct
  misc_feature 1..20: note = CRISPR gRNA sequence
  source 1..20: mol_type = other DNA
ggaccacaggtgcatgctac

SEQ ID NO: 28624 - DNA, 20 bp, synthetic construct
  misc_feature 1..20: note = CRISPR gRNA sequence
  source 1..20: mol_type = other DNA
cagtgcccagcaacctctgg

SEQ ID NO: 28625 - DNA, 20 bp, synthetic construct
  misc_feature 1..20: note = CRISPR gRNA sequence
  source 1..20: mol_type = other DNA
tgggttttgacaaccccaaa

SEQ ID NO: 28626 - DNA, 20 bp, synthetic construct
  misc_feature 1..20: note = CRISPR gRNA sequence
  source 1..20: mol_type = other DNA
ggttttgacaaccccaaatc

SEQ ID NO: 28627 - DNA, 20 bp, synthetic construct
  misc_feature 1..20: note = CRISPR gRNA sequence
  source 1..20: mol_type = other DNA
tgacaaccccaaatcctgcc

SEQ ID NO: 28628 - DNA, 20 bp, synthetic construct
  misc_feature 1..20: note = CRISPR gRNA sequence
  source 1..20: mol_type = other DNA
gacaaccccaaatcctgccc

SEQ ID NO: 28629 - DNA, 20 bp, synthetic construct
  misc_feature 1..20: note = CRISPR gRNA sequence
  source 1..20: mol_type = other DNA
acaaccccaaatcctgcccc

SEQ ID NO: 28630 - DNA, 20 bp, synthetic construct
  misc_feature 1..20: note = CRISPR gRNA sequence
  source 1..20: mol_type = other DNA
cccccaaggcacctgcagaa

SEQ ID NO: 28631 - DNA, 20 bp, synthetic construct
  misc_feature 1..20: note = CRISPR gRNA sequence
  source 1..20: mol_type = other DNA
cagaaagaaaagccctcact

SEQ ID NO: 28632 - DNA, 20 bp, synthetic construct
  misc_feature 1..20: note = CRISPR gRNA sequence
  source 1..20: mol_type = other DNA
actttgtccctttttttctc

SEQ ID NO: 28633 - DNA, 20 bp, synthetic construct
  misc_feature 1..20: note = CRISPR gRNA sequence
  source 1..20: mol_type = other DNA
tgtccctttttttctctctt

SEQ ID NO: 28634 - DNA, 20 bp, synthetic construct
  misc_feature 1..20: note = CRISPR gRNA sequence
  source 1..20: mol_type = other DNA
gtccctttttttctctcttc

SEQ ID NO: 28635 - DNA, 20 bp, synthetic construct
  misc_feature 1..20: note = CRISPR gRNA sequence
  source 1..20: mol_type = other DNA
tccctttttttctctcttcc

SEQ ID NO: 28636 - DNA, 20 bp, synthetic construct
  misc_feature 1..20: note = CRISPR gRNA sequence
  source 1..20: mol_type = other DNA
tttttctctcttccgcctac

SEQ ID NO: 28637 - DNA, 20 bp, synthetic construct
  misc_feature 1..20: note = CRISPR gRNA sequence
  source 1..20: mol_type = other DNA
ttttctctcttccgcctact

SEQ ID NO: 28638 - DNA, 20 bp, synthetic construct
  misc_feature 1..20: note = CRISPR gRNA sequence
  source 1..20: mol_type = other DNA
tttctctcttccgcctactg

SEQ ID NO: 28639 - DNA, 20 bp, synthetic construct
  misc_feature 1..20: note = CRISPR gRNA sequence
  source 1..20: mol_type = other DNA
ttctctcttccgcctactgc

SEQ ID NO: 28640 - DNA, 20 bp, synthetic construct
  misc_feature 1..20: note = CRISPR gRNA sequence
  source 1..20: mol_type = other DNA
tctctcttccgcctactgca

SEQ ID NO: 28641 - DNA, 20 bp, synthetic construct
  misc_feature 1..20: note = CRISPR gRNA sequence
  source 1..20: mol_type = other DNA
ctctcttccgcctactgcat

SEQ ID NO: 28642 - DNA, 20 bp, synthetic construct
  misc_feature 1..20: note = CRISPR gRNA sequence
  source 1..20: mol_type = other DNA
tctcttccgcctactgcatc

SEQ ID NO: 28643 - DNA, 20 bp, synthetic construct
  misc_feature 1..20: note = CRISPR gRNA sequence
  source 1..20: mol_type = other DNA
tcttccgcctactgcatcct

SEQ ID NO: 28644 - DNA, 20 bp, synthetic construct
  misc_feature 1..20: note = CRISPR gRNA sequence
  source 1..20: mol_type = other DNA
ttccgcctactgcatcctca

SEQ ID NO: 28645 - DNA, 20 bp, synthetic construct
  misc_feature 1..20: note = CRISPR gRNA sequence
  source 1..20: mol_type = other DNA
ccgcctactgcatcctcaat

SEQ ID NO: 28646 - DNA, 20 bp, synthetic construct
  misc_feature 1..20: note = CRISPR gRNA sequence
  source 1..20: mol_type = other DNA
cgcctactgcatcctcaatg

SEQ ID NO: 28647 - DNA, 20 bp, synthetic construct
  misc_feature 1..20: note = CRISPR gRNA sequence
  source 1..20: mol_type = other DNA
ctgcatcctcaatgtggctg

SEQ ID NO: 28648 - DNA, 20 bp, synthetic construct
  misc_feature 1..20: note = CRISPR gRNA sequence
  source 1..20: mol_type = other DNA
catcctcaatgtggctggca

SEQ ID NO: 28649 - DNA, 20 bp, synthetic construct
  misc_feature 1..20: note = CRISPR gRNA sequence
  source 1..20: mol_type = other DNA
aatgtggctggcacatgagt

SEQ ID NO: 28650 - DNA, 20 bp, synthetic construct
  misc_feature 1..20: note = CRISPR gRNA sequence
  source 1..20: mol_type = other DNA
gcacatgagtgatgagatga

SEQ ID NO: 28651 - DNA, 20 bp, synthetic construct
  misc_feature 1..20: note = CRISPR gRNA sequence
  source 1..20: mol_type = other DNA
tagatcctttcgtgaccttt

SEQ ID NO: 28652 - DNA, 20 bp, synthetic construct
  misc_feature 1..20: note = CRISPR gRNA sequence
  source 1..20: mol_type = other DNA
tcgtgacctttgaaactcct

SEQ ID NO: 28653 - DNA, 20 bp, synthetic construct
  misc_feature 1..20: note = CRISPR gRNA sequence
  source 1..20: mol_type = other DNA
cgtgacctttgaaactcctt

SEQ ID NO: 28654 - DNA, 20 bp, synthetic construct
  misc_feature 1..20: note = CRISPR gRNA sequence
  source 1..20: mol_type = other DNA
gtgacctttgaaactccttt

SEQ ID NO: 28655 - DNA, 20 bp, synthetic construct
  misc_feature 1..20: note = CRISPR gRNA sequence
  source 1..20: mol_type = other DNA
tgaaactcctttcctcacaa

SEQ ID NO: 28656 - DNA, 20 bp, synthetic construct
  misc_feature 1..20: note = CRISPR gRNA sequence
  source 1..20: mol_type = other DNA
gaaactcctttcctcacaac

SEQ ID NO: 28657 - DNA, 20 bp, synthetic construct
  misc_feature 1..20: note = CRISPR gRNA sequence
  source 1..20: mol_type = other DNA
aaactcctttcctcacaacc

SEQ ID NO: 28658 - DNA, 20 bp, synthetic construct
  misc_feature 1..20: note = CRISPR gRNA sequence
  source 1..20: mol_type = other DNA
ctttcctcacaacctcattt

SEQ ID NO: 28659 - DNA, 20 bp, synthetic construct
  misc_feature 1..20: note = CRISPR gRNA sequence
  source 1..20: mol_type = other DNA
tcctcacaacctcatttgct

SEQ ID NO: 28660 - DNA, 20 bp, synthetic construct
  misc_feature 1..20: note = CRISPR gRNA sequence
  source 1..20: mol_type = other DNA
cctcacaacctcatttgctg

SEQ ID NO: 28661 - DNA, 20 bp, synthetic construct
  misc_feature 1..20: note = CRISPR gRNA sequence
  source 1..20: mol_type = other DNA
ctcacaacctcatttgctgc

SEQ ID NO: 28662 - DNA, 20 bp, synthetic construct
  misc_feature 1..20: note = CRISPR gRNA sequence
  source 1..20: mol_type = other DNA
acaacctcatttgctgctct

SEQ ID NO: 28663 - DNA, 20 bp, synthetic construct
  misc_feature 1..20: note = CRISPR gRNA sequence
  source 1..20: mol_type = other DNA
atttgctgctctcagcaatt

SEQ ID NO: 28664 - DNA, 20 bp, synthetic construct
  misc_feature 1..20: note = CRISPR gRNA sequence
  source 1..20: mol_type = other DNA
gctgctctcagcaattcagc

SEQ ID NO: 28665 - DNA, 20 bp, synthetic construct
  misc_feature 1..20: note = CRISPR gRNA sequence
  source 1..20: mol_type = other DNA
ctgctctcagcaattcagct

SEQ ID NO: 28666 - DNA, 20 bp, synthetic construct
  misc_feature 1..20: note = CRISPR gRNA sequence
  source 1..20: mol_type = other DNA
ctctcagcaattcagctggg

SEQ ID NO: 28667 - DNA, 20 bp, synthetic construct
  misc_feature 1..20: note = CRISPR gRNA sequence
  source 1..20: mol_type = other DNA
tcagcaattcagctggggag

SEQ ID NO: 28668 - DNA, 20 bp, synthetic construct
  misc_feature 1..20: note = CRISPR gRNA sequence
  source 1..20: mol_type = other DNA
agcaattcagctggggaggg

SEQ ID NO: 28669 - DNA, 20 bp, synthetic construct
  misc_feature 1..20: note = CRISPR gRNA sequence
  source 1..20: mol_type = other DNA
agctggggagggattgggga

SEQ ID NO: 28670 - DNA, 20 bp, synthetic construct
  misc_feature 1..20: note = CRISPR gRNA sequence
  source 1..20: mol_type = other DNA
gggagggattggggagcata

SEQ ID NO: 28671 - DNA, 20 bp, synthetic construct
  misc_feature 1..20: note = CRISPR gRNA sequence
  source 1..20: mol_type = other DNA
gggagcatagtcctacttta

SEQ ID NO: 28672 - DNA, 20 bp, synthetic construct
  misc_feature 1..20: note = CRISPR gRNA sequence
  source 1..20: mol_type = other DNA
ctttacagtggaggttaagg

SEQ ID NO: 28673 - DNA, 20 bp, synthetic construct
  misc_feature 1..20: note = CRISPR gRNA sequence
  source 1..20: mol_type = other DNA
tacagtggaggttaaggaag

SEQ ID NO: 28674 - DNA, 20 bp, synthetic construct
  misc_feature 1..20: note = CRISPR gRNA sequence
  source 1..20: mol_type = other DNA
acagtggaggttaaggaagt

SEQ ID NO: 28675 - DNA, 20 bp, synthetic construct
  misc_feature 1..20: note = CRISPR gRNA sequence
  source 1..20: mol_type = other DNA
cagtggaggttaaggaagtt

SEQ ID NO: 28676 - DNA, 20 bp, synthetic construct
  misc_feature 1..20: note = CRISPR gRNA sequence
  source 1..20: mol_type = other DNA
aggaagttgccaagcctcag

SEQ ID NO: 28677 - DNA, 20 bp, synthetic construct
  misc_feature 1..20: note = CRISPR gRNA sequence
  source 1..20: mol_type = other DNA
ccaagcctcaggggcttagt

SEQ ID NO: 28678 - DNA, 20 bp, synthetic construct
  misc_feature 1..20: note = CRISPR gRNA sequence
  source 1..20: mol_type = other DNA
aggggcttagttcctaagaa

SEQ ID NO: 28679 - DNA, 20 bp, synthetic construct
  misc_feature 1..20: note = CRISPR gRNA sequence
  source 1..20: mol_type = other DNA
agttcctaagaagctaaaca

SEQ ID NO: 28680 - DNA, 20 bp, synthetic construct
  misc_feature 1..20: note = CRISPR gRNA sequence
  source 1..20: mol_type = other DNA
gttcctaagaagctaaacag

SEQ ID NO: 28681 - DNA, 20 bp, synthetic construct
  misc_feature 1..20: note = CRISPR gRNA sequence
  source 1..20: mol_type = other DNA
ctaagaagctaaacagggat

SEQ ID NO: 28682 - DNA, 20 bp, synthetic construct
  misc_feature 1..20: note = CRISPR gRNA sequence
  source 1..20: mol_type = other DNA
agaagctaaacagggattca

SEQ ID NO: 28683 - DNA, 20 bp, synthetic construct
  misc_feature 1..20: note = CRISPR gRNA sequence
  source 1..20: mol_type = other DNA
aacagggattcaagtccatc

SEQ ID NO: 28684 - DNA, 20 bp, synthetic construct
  misc_feature 1..20: note = CRISPR gRNA sequence
  source 1..20: mol_type = other DNA
aagtccatcatgagttagac

SEQ ID NO: 28685 - DNA, 20 bp, synthetic construct
  misc_feature 1..20: note = CRISPR gRNA sequence
  source 1..20: mol_type = other DNA
gactttgccctctggctgcc

SEQ ID NO: 28686 - DNA, 20 bp, synthetic construct
  misc_feature 1..20: note = CRISPR gRNA sequence
  source 1..20: mol_type = other DNA
tgccctctggctgcctggtt

SEQ ID NO: 28687 - DNA, 20 bp, synthetic construct
  misc_feature 1..20: note = CRISPR gRNA sequence
  source 1..20: mol_type = other DNA
gccctctggctgcctggttg

SEQ ID NO: 28688 - DNA, 20 bp, synthetic construct
  misc_feature 1..20: note = CRISPR gRNA sequence
  source 1..20: mol_type = other DNA
ccctctggctgcctggttgg

SEQ ID NO: 28689 - DNA, 20 bp, synthetic construct
  misc_feature 1..20: note = CRISPR gRNA sequence
  source 1..20: mol_type = other DNA
tggctgcctggttggagccc

SEQ ID NO: 28690 - DNA, 20 bp, synthetic construct
  misc_feature 1..20: note = CRISPR gRNA sequence
  source 1..20: mol_type = other DNA
gctgcctggttggagccccc

SEQ ID NO: 28691 - DNA, 20 bp, synthetic construct
  misc_feature 1..20: note = CRISPR gRNA sequence
  source 1..20: mol_type = other DNA
cctggttggagcccccaggt

SEQ ID NO: 28692 - DNA, 20 bp, synthetic construct
  misc_feature 1..20: note = CRISPR gRNA sequence
  source 1..20: mol_type = other DNA
gttggagcccccaggtgatg

SEQ ID NO: 28693 - DNA, 20 bp, synthetic construct
  misc_feature 1..20: note = CRISPR gRNA sequence
  source 1..20: mol_type = other DNA
gagcccccaggtgatgaagt

SEQ ID NO: 28694 - DNA, 20 bp, synthetic construct
  misc_feature 1..20: note = CRISPR gRNA sequence
  source 1..20: mol_type = other DNA
gtctgaaaagctcaggaatg

SEQ ID NO: 28695 - DNA, 20 bp, synthetic construct
  misc_feature 1..20: note = CRISPR gRNA sequence
  source 1..20: mol_type = other DNA
aaaagctcaggaatgtgccg

SEQ ID NO: 28696 - DNA, 20 bp, synthetic construct
  misc_feature 1..20: note = CRISPR gRNA sequence
  source 1..20: mol_type = other DNA
aggaatgtgccggctgccta

SEQ ID NO: 28697 - DNA, 20 bp, synthetic construct
  misc_feature 1..20: note = CRISPR gRNA sequence
  source 1..20: mol_type = other DNA
cctatggtgtattagagctg

SEQ ID NO: 28698 - DNA, 20 bp, synthetic construct
  misc_feature 1..20: note = CRISPR gRNA sequence
  source 1..20: mol_type = other DNA
tggtgtattagagctggggg

SEQ ID NO: 28699 - DNA, 20 bp, synthetic construct
  misc_feature 1..20: note = CRISPR gRNA sequence
  source 1..20: mol_type = other DNA
gagctggggggtgggaaggg

SEQ ID NO: 28700 - DNA, 20 bp, synthetic construct
  misc_feature 1..20: note = CRISPR gRNA sequence
  source 1..20: mol_type = other DNA
gggggtgggaagggcaggtg

SEQ ID NO: 28701 - DNA, 20 bp, synthetic construct
  misc_feature 1..20: note = CRISPR gRNA sequence
  source 1..20: mol_type = other DNA
aggaggccctcactgggatg

SEQ ID NO: 28702 - DNA, 20 bp, synthetic construct
  misc_feature 1..20: note = CRISPR gRNA sequence
  source 1..20: mol_type = other DNA
actgggatgggaagggtcag

SEQ ID NO: 28703 - DNA, 20 bp, synthetic construct
  misc_feature 1..20: note = CRISPR gRNA sequence
  source 1..20: mol_type = other DNA
ggatgggaagggtcagatgg

SEQ ID NO: 28704 - DNA, 20 bp, synthetic construct
  misc_feature 1..20: note = CRISPR gRNA sequence
  source 1..20: mol_type = other DNA
gctgatggcccccatctgat

SEQ ID NO: 28705 - DNA, 20 bp, synthetic construct
  misc_feature 1..20: note = CRISPR gRNA sequence
  source 1..20: mol_type = other DNA
atggcccccatctgattcca

SEQ ID NO: 28706 - DNA, 20 bp, synthetic construct
  misc_feature 1..20: note = CRISPR gRNA sequence
  source 1..20: mol_type = other DNA
attccacctgcagcctggat

SEQ ID NO: 28707 - DNA, 20 bp, synthetic construct
  misc_feature 1..20: note = CRISPR gRNA sequence
  source 1..20: mol_type = other DNA
cacctgcagcctggatgcgc

SEQ ID NO: 28708 - DNA, 20 bp, synthetic construct
  misc_feature 1..20: note = CRISPR gRNA sequence
  source 1..20: mol_type = other DNA
cagcctggatgcgctgagtg

SEQ ID NO: 28709 - DNA, 20 bp, synthetic construct
  misc_feature 1..20: note = CRISPR gRNA sequence
  source 1..20: mol_type = other DNA
gatgcgctgagtgagaacaa

SEQ ID NO: 28710 - DNA, 20 bp, synthetic construct
  misc_feature 1..20: note = CRISPR gRNA sequence
  source 1..20: mol_type = other DNA
agtgagaacaagatcgggga

SEQ ID NO: 28711 - DNA, 20 bp, synthetic construct
  misc_feature 1..20: note = CRISPR gRNA sequence
  source 1..20: mol_type = other DNA
gcagctctcagccaccttcc

SEQ ID NO: 28712 - DNA, 20 bp, synthetic construct
  misc_feature 1..20: note = CRISPR gRNA sequence
  source 1..20: mol_type = other DNA
tcagccaccttcccccagct

SEQ ID NO: 28713 - DNA, 20 bp, synthetic construct
  misc_feature 1..20: note = CRISPR gRNA sequence
  source 1..20: mol_type = other DNA
agccaccttcccccagctga

SEQ ID NO: 28714 - DNA, 20 bp, synthetic construct
  misc_feature 1..20: note = CRISPR gRNA sequence
  source 1..20: mol_type = other DNA
cccccagctgaagtccttgg

SEQ ID NO: 28715 - DNA, 20 bp, synthetic construct
  misc_feature 1..20: note = CRISPR gRNA sequence
  source 1..20: mol_type = other DNA
ccccagctgaagtccttgga

SEQ ID NO: 28716 - DNA, 20 bp, synthetic construct
  misc_feature 1..20: note = CRISPR gRNA sequence
  source 1..20: mol_type = other DNA
aagtccttggaaaccctcaa

SEQ ID NO: 28717 - DNA, 20 bp, synthetic construct
  misc_feature 1..20: note = CRISPR gRNA sequence
  source 1..20: mol_type = other DNA
ggaaaccctcaagtgagtga

SEQ ID NO: 28718 - DNA, 20 bp, synthetic construct
  misc_feature 1..20: note = CRISPR gRNA sequence
  source 1..20: mol_type = other DNA
gaaaccctcaagtgagtgag

SEQ ID NO: 28719 - DNA, 20 bp, synthetic construct
  misc_feature 1..20: note = CRISPR gRNA sequence
  source 1..20: mol_type = other DNA
aagtgagtgagctgggcctg

SEQ ID NO: 28720 - DNA, 20 bp, synthetic construct
  misc_feature 1..20: note = CRISPR gRNA sequence
  source 1..20: mol_type = other DNA
ggcctgcccttcctgctgaa

SEQ ID NO: 28721 - DNA, 20 bp, synthetic construct
  misc_feature 1..20: note = CRISPR gRNA sequence
  source 1..20: mol_type = other DNA
cccttcctgctgaatcgggc

SEQ ID NO: 28722 - DNA, 20 bp, synthetic construct
  misc_feature 1..20: note = CRISPR gRNA sequence
  source 1..20: mol_type = other DNA
cctgctgaatcgggccccca

SEQ ID NO: 28723 - DNA, 20 bp, synthetic construct
  misc_feature 1..20: note = CRISPR gRNA sequence
  source 1..20: mol_type = other DNA
ctgctgaatcgggcccccaa

SEQ ID NO: 28724 - DNA, 20 bp, synthetic construct
  misc_feature 1..20: note = CRISPR gRNA sequence
  source 1..20: mol_type = other DNA
ctgaatcgggcccccaaagt

SEQ ID NO: 28725 - DNA, 20 bp, synthetic construct
  misc_feature 1..20: note = CRISPR gRNA sequence
  source 1..20: mol_type = other DNA
aatcgggcccccaaagtccg

SEQ ID NO: 28726 - DNA, 20 bp, synthetic construct
  misc_feature 1..20: note = CRISPR gRNA sequence
  source 1..20: mol_type = other DNA
actttttcaaaattaattta

SEQ ID NO: 28727 - DNA, 20 bp, synthetic construct
  misc_feature 1..20: note = CRISPR gRNA sequence
  source 1..20: mol_type = other DNA
tttcaaaattaatttaaatt

SEQ ID NO: 28728 - DNA, 20 bp, synthetic construct
  misc_feature 1..20: note = CRISPR gRNA sequence
  source 1..20: mol_type = other DNA
ttcaaaattaatttaaattt

SEQ ID NO: 28729 - DNA, 20 bp, synthetic construct
  misc_feature 1..20: note = CRISPR gRNA sequence
  source 1..20: mol_type = other DNA
tcaaaattaatttaaatttg

SEQ ID NO: 28730 - DNA, 20 bp, synthetic construct
  misc_feature 1..20: note = CRISPR gRNA sequence
  source 1..20: mol_type = other DNA
caaaattaatttaaatttgt

SEQ ID NO: 28731 - DNA, 20 bp, synthetic construct
  misc_feature 1..20: note = CRISPR gRNA sequence
  source 1..20: mol_type = other DNA
aaaattaatttaaatttgtt

SEQ ID NO: 28732 - DNA, 20 bp, synthetic construct
  misc_feature 1..20: note = CRISPR gRNA sequence
  source 1..20: mol_type = other DNA
atttaaatttgtttttttag

SEQ ID NO: 28733 - DNA, 20 bp, synthetic construct
  misc_feature 1..20: note = CRISPR gRNA sequence
  source 1..20: mol_type = other DNA
aaatttgtttttttagacaa

SEQ ID NO: 28734 - DNA, 20 bp, synthetic construct
  misc_feature 1..20: note = CRISPR gRNA sequence
  source 1..20: mol_type = other DNA
aatttgtttttttagacaag

SEQ ID NO: 28735 - DNA, 20 bp, synthetic construct
  misc_feature 1..20: note = CRISPR gRNA sequence
  source 1..20: mol_type = other DNA
gtttttttagacaagggctc

SEQ ID NO: 28736 - DNA, 20 bp, synthetic construct
  misc_feature 1..20: note = CRISPR gRNA sequence
  source 1..20: mol_type = other DNA
tttttttagacaagggctcg

SEQ ID NO: 28737 - DNA, 20 bp, synthetic construct
  misc_feature 1..20: note = CRISPR gRNA sequence
  source 1..20: mol_type = other DNA
ttttagacaagggctcgctg

SEQ ID NO: 28738 - DNA, 20 bp, synthetic construct
  misc_feature 1..20: note = CRISPR gRNA sequence
  source 1..20: mol_type = other DNA
tttagacaagggctcgctgt

SEQ ID NO: 28739 - DNA, 20 bp, synthetic construct
  misc_feature 1..20: note = CRISPR gRNA sequence
  source 1..20: mol_type = other DNA
ttagacaagggctcgctgtg

SEQ ID NO: 28740 - DNA, 20 bp, synthetic construct
  misc_feature 1..20: note = CRISPR gRNA sequence
  source 1..20: mol_type = other DNA
tagacaagggctcgctgtgt

SEQ ID NO: 28741 - DNA, 20 bp, synthetic construct
  misc_feature 1..20: note = CRISPR gRNA sequence
  source 1..20: mol_type = other DNA
agacaagggctcgctgtgtc

SEQ ID NO: 28742 - DNA, 20 bp, synthetic construct
  misc_feature 1..20: note = CRISPR gRNA sequence
  source 1..20: mol_type = other DNA
gacaagggctcgctgtgtca

SEQ ID NO: 28743 - DNA, 20 bp, synthetic construct
  misc_feature 1..20: note = CRISPR gRNA sequence
  source 1..20: mol_type = other DNA
gctgtgtcacccaggctaga

SEQ ID NO: 28744 - DNA, 20 bp, synthetic construct
  misc_feature 1..20: note = CRISPR gRNA sequence
  source 1..20: mol_type = other DNA
tgtcacccaggctagaatat

SEQ ID NO: 28745 - DNA, 20 bp, synthetic construct
  misc_feature 1..20: note = CRISPR gRNA sequence
  source 1..20: mol_type = other DNA
gaatatagtgctatgatcat

SEQ ID NO: 28746 - DNA, 20 bp, synthetic construct
  misc_feature 1..20: note = CRISPR gRNA sequence
  source 1..20: mol_type = other DNA
tgatcatacctctgcagcct

SEQ ID NO: 28747 - DNA, 20 bp, synthetic construct
  misc_feature 1..20: note = CRISPR gRNA sequence
  source 1..20: mol_type = other DNA
tgcagccttgaactcctggc

SEQ ID NO: 28748 - DNA, 20 bp, synthetic construct
  misc_feature 1..20: note = CRISPR gRNA sequence
  source 1..20: mol_type = other DNA
cagccttgaactcctggcct

SEQ ID NO: 28749 - DNA, 20 bp, synthetic construct
  misc_feature 1..20: note = CRISPR gRNA sequence
  source 1..20: mol_type = other DNA
gaactcctggcctcaaggaa

SEQ ID NO: 28750 - DNA, 20 bp, synthetic construct
  misc_feature 1..20: note = CRISPR gRNA sequence
  source 1..20: mol_type = other DNA
aactcctggcctcaaggaat

SEQ ID NO: 28751 - DNA, 20 bp, synthetic construct
  misc_feature 1..20: note = CRISPR gRNA sequence
  source 1..20: mol_type = other DNA
ctggcctcaaggaatctcct

SEQ ID NO: 28752 - DNA, 20 bp, synthetic construct
  misc_feature 1..20: note = CRISPR gRNA sequence
  source 1..20: mol_type = other DNA
gcctcaaggaatctcctcac

SEQ ID NO: 28753 - DNA, 20 bp, synthetic construct
  misc_feature 1..20: note = CRISPR gRNA sequence
  source 1..20: mol_type = other DNA
aaggaatctcctcacctccg

SEQ ID NO: 28754 - DNA, 20 bp, synthetic construct
  misc_feature 1..20: note = CRISPR gRNA sequence
  source 1..20: mol_type = other DNA
ctcacctccgcttcccaaag

SEQ ID NO: 28755 - DNA, 20 bp, synthetic construct
  misc_feature 1..20: note = CRISPR gRNA sequence
  source 1..20: mol_type = other DNA
acctccgcttcccaaagtgc

SEQ ID NO: 28756 - DNA, 20 bp, synthetic construct
  misc_feature 1..20: note = CRISPR gRNA sequence
  source 1..20: mol_type = other DNA
cgcttcccaaagtgctggga

SEQ ID NO: 28757 - DNA, 20 bp, synthetic construct
  misc_feature 1..20: note = CRISPR gRNA sequence
  source 1..20: mol_type = other DNA
cccaaagtgctgggattata

SEQ ID NO: 28758 - DNA, 20 bp, synthetic construct
  misc_feature 1..20: note = CRISPR gRNA sequence
  source 1..20: mol_type = other DNA
ccaaagtgctgggattatag

SEQ ID NO: 28759 - DNA, 20 bp, synthetic construct
  misc_feature 1..20: note = CRISPR gRNA sequence
  source 1..20: mol_type = other DNA
ggattataggtgtgacttac

SEQ ID NO: 28760 - DNA, 20 bp, synthetic construct
  misc_feature 1..20: note = CRISPR gRNA sequence
  source 1..20: mol_type = other DNA
taggtgtgacttaccatgcc

SEQ ID NO: 28761 - DNA, 20 bp, synthetic construct
  misc_feature 1..20: note = CRISPR gRNA sequence
  source 1..20: mol_type = other DNA
accatgcccagccccagtgg

SEQ ID NO: 28762 - DNA, 20 bp, synthetic construct
  misc_feature 1..20: note = CRISPR gRNA sequence
  source 1..20: mol_type = other DNA
ccatgcccagccccagtgga

SEQ ID NO: 28763 - DNA, 20 bp, synthetic construct
  misc_feature 1..20: note = CRISPR gRNA sequence
  source 1..20: mol_type = other DNA
atccattcactcattcacct

SEQ ID NO: 28764 - DNA, 20 bp, synthetic construct
  misc_feature 1..20: note = CRISPR gRNA sequence
  source 1..20: mol_type = other DNA
actcattcacctattcaatc

SEQ ID NO: 28765 - DNA, 20 bp, synthetic construct
  misc_feature 1..20: note = CRISPR gRNA sequence
  source 1..20: mol_type = other DNA
attcacctattcaatcagcc

SEQ ID NO: 28766 - DNA, 20 bp, synthetic construct
  misc_feature 1..20: note = CRISPR gRNA sequence
  source 1..20: mol_type = other DNA
acctattcaatcagccattc

SEQ ID NO: 28767 - DNA, 20 bp, synthetic construct
  misc_feature 1..20: note = CRISPR gRNA sequence
  source 1..20: mol_type = other DNA
ttcaatcagccattcatcct

SEQ ID NO: 28768 - DNA, 20 bp, synthetic construct
  misc_feature 1..20: note = CRISPR gRNA sequence
  source 1..20: mol_type = other DNA
aatcagccattcatccttcc

SEQ ID NO: 28769 - DNA, 20 bp, synthetic construct
  misc_feature 1..20: note = CRISPR gRNA sequence
  source 1..20: mol_type = other DNA
atccttccattcaatgattc

SEQ ID NO: 28770 - DNA, 20 bp, synthetic construct
  misc_feature 1..20: note = CRISPR gRNA sequence
  source 1..20: mol_type = other DNA
ccattcaatgattcatccat

SEQ ID NO: 28771 - DNA, 20 bp, synthetic construct
  misc_feature 1..20: note = CRISPR gRNA sequence
  source 1..20: mol_type = other DNA
cattcaatgattcatccatt

SEQ ID NO: 28772 - DNA, 20 bp, synthetic construct
  misc_feature 1..20: note = CRISPR gRNA sequence
  source 1..20: mol_type = other DNA
aatgattcatccattcactt

SEQ ID NO: 28773 - DNA, 20 bp, synthetic construct
  misc_feature 1..20: note = CRISPR gRNA sequence
  source 1..20: mol_type = other DNA
atccattcacttatgcagtc

SEQ ID NO: 28774 - DNA, 20 bp, synthetic construct
  misc_feature 1..20: note = CRISPR gRNA sequence
  source 1..20: mol_type = other DNA
acttatgcagtcatttcttt

SEQ ID NO: 28775 - DNA, 20 bp, synthetic construct
  misc_feature 1..20: note = CRISPR gRNA sequence
  source 1..20: mol_type = other DNA
atgcagtcatttctttactc

SEQ ID NO: 28776 - DNA, 20 bp, synthetic construct
  misc_feature 1..20: note = CRISPR gRNA sequence
  source 1..20: mol_type = other DNA
tgcagtcatttctttactcc

SEQ ID NO: 28777 - DNA, 20 bp, synthetic construct
  misc_feature 1..20: note = CRISPR gRNA sequence
  source 1..20: mol_type = other DNA
ctttactccctcatccaacc

SEQ ID NO: 28778 - DNA, 20 bp, synthetic construct
  misc_feature 1..20: note = CRISPR gRNA sequence
  source 1..20: mol_type = other DNA
tttactccctcatccaaccg

SEQ ID NO: 28779 - DNA, 20 bp, synthetic construct
  misc_feature 1..20: note = CRISPR gRNA sequence
  source 1..20: mol_type = other DNA
tactccctcatccaaccgct

SEQ ID NO: 28780 - DNA, 20 bp, synthetic construct
  misc_feature 1..20: note = CRISPR gRNA sequence
  source 1..20: mol_type = other DNA
actccctcatccaaccgctc

SEQ ID NO: 28781 - DNA, 20 bp, synthetic construct
  misc_feature 1..20: note = CRISPR gRNA sequence
  source 1..20: mol_type = other DNA
ctccctcatccaaccgctca

SEQ ID NO: 28782 - DNA, 20 bp, synthetic construct
  misc_feature 1..20: note = CRISPR gRNA sequence
  source 1..20: mol_type = other DNA
cctcatccaaccgctcactc

SEQ ID NO: 28783 - DNA, 20 bp, synthetic construct
  misc_feature 1..20: note = CRISPR gRNA sequence
  source 1..20: mol_type = other DNA
atccaaccgctcactcaatc

SEQ ID NO: 28784 - DNA, 20 bp, synthetic construct
  misc_feature 1..20: note = CRISPR gRNA sequence
  source 1..20: mol_type = other DNA
actcaatcatttctttactt

SEQ ID NO: 28785 - DNA, 20 bp, synthetic construct
  misc_feature 1..20: note = CRISPR gRNA sequence
  source 1..20: mol_type = other DNA
aatcatttctttacttaccc

SEQ ID NO: 28786 - DNA, 20 bp, synthetic construct
  misc_feature 1..20: note = CRISPR gRNA sequence
  source 1..20: mol_type = other DNA
ctttacttacccaaccattt

SEQ ID NO: 28787 - DNA, 20 bp, synthetic construct
  misc_feature 1..20: note = CRISPR gRNA sequence
  source 1..20: mol_type = other DNA
tttacttacccaaccattta

SEQ ID NO: 28788 - DNA, 20 bp, synthetic construct
  misc_feature 1..20: note = CRISPR gRNA sequence
  source 1..20: mol_type = other DNA
tacttacccaaccatttatt

SEQ ID NO: 28789 - DNA, 20 bp, synthetic construct
  misc_feature 1..20: note = CRISPR gRNA sequence
  source 1..20: mol_type = other DNA
acttacccaaccatttatta

SEQ ID NO: 28790 - DNA, 20 bp, synthetic construct
  misc_feature 1..20: note = CRISPR gRNA sequence
  source 1..20: mol_type = other DNA
cttacccaaccatttattaa

SEQ ID NO: 28791 - DNA, 20 bp, synthetic construct
  misc_feature 1..20: note = CRISPR gRNA sequence
  source 1..20: mol_type = other DNA
acccaaccatttattaattt

SEQ ID NO: 28792 - DNA, 20 bp, synthetic construct
  misc_feature 1..20: note = CRISPR gRNA sequence
  source 1..20: mol_type = other DNA
cccaaccatttattaattta

SEQ ID NO: 28793 - DNA, 20 bp, synthetic construct
  misc_feature 1..20: note = CRISPR gRNA sequence
  source 1..20: mol_type = other DNA
attaatttaatcaacaaata

SEQ ID NO: 28794 - DNA, 20 bp, synthetic construct
  misc_feature 1..20: note = CRISPR gRNA sequence
  source 1..20: mol_type = other DNA
ttaatttaatcaacaaatat

SEQ ID NO: 28795 - DNA, 20 bp, synthetic construct
  misc_feature 1..20: note = CRISPR gRNA sequence
  source 1..20: mol_type = other DNA
atttaatcaacaaatattta

SEQ ID NO: 28796 - DNA, 20 bp, synthetic construct
  misc_feature 1..20: note = CRISPR gRNA sequence
  source 1..20: mol_type = other DNA
aatcaacaaatatttaagga

SEQ ID NO: 28797 - DNA, 20 bp, synthetic construct
  misc_feature 1..20: note = CRISPR gRNA sequence
  source 1..20: mol_type = other DNA
atcaacaaatatttaaggag

SEQ ID NO: 28798 - DNA, 20 bp, synthetic construct
  misc_feature 1..20: note = CRISPR gRNA sequence
  source 1..20: mol_type = other DNA
aaggaggacctactatgtgc

SEQ ID NO: 28799 - DNA, 20 bp, synthetic construct
  misc_feature 1..20: note = CRISPR gRNA sequence
  source 1..20: mol_type = other DNA
aggaggacctactatgtgca

SEQ ID NO: 28800 - DNA, 20 bp, synthetic construct
  misc_feature 1..20: note = CRISPR gRNA sequence
  source 1..20: mol_type = other DNA
ctatgtgcaggcacctttct

SEQ ID NO: 28801 - DNA, 20 bp, synthetic construct
  misc_feature 1..20: note = CRISPR gRNA sequence
  source 1..20: mol_type = other DNA
tgtgcaggcacctttctagg

SEQ ID NO: 28802 - DNA, 20 bp, synthetic construct
  misc_feature 1..20: note = CRISPR gRNA sequence
  source 1..20: mol_type = other DNA
tctaggccctggagacccag

SEQ ID NO: 28803 - DNA, 20 bp, synthetic construct
  misc_feature 1..20: note = CRISPR gRNA sequence
  source 1..20: mol_type = other DNA
ctaggccctggagacccagc

SEQ ID NO: 28804 - DNA, 20 bp, synthetic construct
  misc_feature 1..20: note = CRISPR gRNA sequence
  source 1..20: mol_type = other DNA
taggccctggagacccagct

SEQ ID NO: 28805 - DNA, 20 bp, synthetic construct
  misc_feature 1..20: note = CRISPR gRNA sequence
  source 1..20: mol_type = other DNA
ggccctggagacccagcttt

SEQ ID NO: 28806 - DNA, 20 bp, synthetic construct
  misc_feature 1..20: note = CRISPR gRNA sequence
  source 1..20: mol_type = other DNA
gagacccagctttaaacaaa

SEQ ID NO: 28807 - DNA, 20 bp, synthetic construct
  misc_feature 1..20: note = CRISPR gRNA sequence
  source 1..20: mol_type = other DNA
taaacaaaacaaataaatcc

SEQ ID NO: 28808 - DNA, 20 bp, synthetic construct
  misc_feature 1..20: note = CRISPR gRNA sequence
  source 1..20: mol_type = other DNA
aaacaaaacaaataaatccc

SEQ ID NO: 28809 - DNA, 20 bp, synthetic construct
  misc_feature 1..20: note = CRISPR gRNA sequence
  source 1..20: mol_type = other DNA
aacaaaacaaataaatcccc

SEQ ID NO: 28810 - DNA, 20 bp, synthetic construct
  misc_feature 1..20: note = CRISPR gRNA sequence
  source 1..20: mol_type = other DNA
acctcaggaatcttaaattc

SEQ ID NO: 28811 - DNA, 20 bp, synthetic construct
  misc_feature 1..20: note = CRISPR gRNA sequence
  source 1..20: mol_type = other DNA
aggaatcttaaattctagtg

SEQ ID NO: 28812 - DNA, 20 bp, synthetic construct
  misc_feature 1..20: note = CRISPR gRNA sequence
  source 1..20: mol_type = other DNA
aaattctagtgaggagacac

SEQ ID NO: 28813 - DNA, 20 bp, synthetic construct
  misc_feature 1..20: note = CRISPR gRNA sequence
  source 1..20: mol_type = other DNA
aattctagtgaggagacaca

SEQ ID NO: 28814 - DNA, 20 bp, synthetic construct
  misc_feature 1..20: note = CRISPR gRNA sequence
  source 1..20: mol_type = other DNA
tagtgaggagacacaatgaa

SEQ ID NO: 28815 - DNA, 20 bp, synthetic construct
  misc_feature 1..20: note = CRISPR gRNA sequence
  source 1..20: mol_type = other DNA
gtgaggagacacaatgaaca

SEQ ID NO: 28816 - DNA, 20 bp, synthetic construct
  misc_feature 1..20: note = CRISPR gRNA sequence
  source 1..20: mol_type = other DNA
taaagtatacagtaatgaaa

SEQ ID NO: 28817 - DNA, 20 bp, synthetic construct
  misc_feature 1..20: note = CRISPR gRNA sequence
  source 1..20: mol_type = other DNA
ggtgacagaaaattatactg

SEQ ID NO: 28818 - DNA, 20 bp, synthetic construct
  misc_feature 1..20: note = CRISPR gRNA sequence
  source 1..20: mol_type = other DNA
gtgacagaaaattatactgg

SEQ ID NO: 28819 - DNA, 20 bp, synthetic construct
  misc_feature 1..20: note = CRISPR gRNA sequence
  source 1..20: mol_type = other DNA
tactggggggtgaaatagga

SEQ ID NO: 28820 - DNA, 20 bp, synthetic construct
  misc_feature 1..20: note = CRISPR gRNA sequence
  source 1..20: mol_type = other DNA
gggggtgaaataggagagat

SEQ ID NO: 28821 - DNA, 20 bp, synthetic construct
  misc_feature 1..20: note = CRISPR gRNA sequence
  source 1..20: mol_type = other DNA
ggatttatcaataaagcatt

SEQ ID NO: 28822 - DNA, 20 bp, synthetic construct
  misc_feature 1..20: note = CRISPR gRNA sequence
  source 1..20: mol_type = other DNA
atcaataaagcattattatc

SEQ ID NO: 28823 - DNA, 20 bp, synthetic construct
  misc_feature 1..20: note = CRISPR gRNA sequence
  source 1..20: mol_type = other DNA
tcaataaagcattattatca

SEQ ID NO: 28824 - DNA, 20 bp, synthetic construct
  misc_feature 1..20: note = CRISPR gRNA sequence
  source 1..20: mol_type = other DNA
ttatcaaaacagtaaaactt

SEQ ID NO: 28825 - DNA, 20 bp, synthetic construct
  misc_feature 1..20: note = CRISPR gRNA sequence
  source 1..20: mol_type = other DNA
tcaaaacagtaaaacttttt

SEQ ID NO: 28826 - DNA, 20 bp, synthetic construct
  misc_feature 1..20: note = CRISPR gRNA sequence
  source 1..20: mol_type = other DNA
tttaaaaactgttctgggct

SEQ ID NO: 28827 - DNA, 20 bp, synthetic construct
  misc_feature 1..20: note = CRISPR gRNA sequence
  source 1..20: mol_type = other DNA
ttaaaaactgttctgggctc

SEQ ID NO: 28828 - DNA, 20 bp, synthetic construct
  misc_feature 1..20: note = CRISPR gRNA sequence
  source 1..20: mol_type = other DNA
taaaaactgttctgggctct

SEQ ID NO: 28829 - DNA, 20 bp, synthetic construct
  misc_feature 1..20: note = CRISPR gRNA sequence
  source 1..20: mol_type = other DNA
aaaaactgttctgggctctg

SEQ ID NO: 28830 - DNA, 20 bp, synthetic construct
  misc_feature 1..20: note = CRISPR gRNA sequence
  source 1..20: mol_type = other DNA
aaaactgttctgggctctgg

SEQ ID NO: 28831 - DNA, 20 bp, synthetic construct
  misc_feature 1..20: note = CRISPR gRNA sequence
  source 1..20: mol_type = other DNA
ttctgggctctgggaagttg

SEQ ID NO: 28832 - DNA, 20 bp, synthetic construct
  misc_feature 1..20: note = CRISPR gRNA sequence
  source 1..20: mol_type = other DNA
tgggctctgggaagttggag

SEQ ID NO: 28833 - DNA, 20 bp, synthetic construct
  misc_feature 1..20: note = CRISPR gRNA sequence
  source 1..20: mol_type = other DNA
ggctctgggaagttggagat

SEQ ID NO: 28834 - DNA, 20 bp, synthetic construct
  misc_feature 1..20: note = CRISPR gRNA sequence
  source 1..20: mol_type = other DNA
tgggaagttggagatggata

SEQ ID NO: 28835 - DNA, 20 bp, synthetic construct
  misc_feature 1..20: note = CRISPR gRNA sequence
  source 1..20: mol_type = other DNA
ggaagttggagatggataag

SEQ ID NO: 28836 - DNA, 20 bp, synthetic construct
  misc_feature 1..20: note = CRISPR gRNA sequence
  source 1..20: mol_type = other DNA
gagatggataagatacagga

SEQ ID NO: 28837 - DNA, 20 bp, synthetic construct
  misc_feature 1..20: note = CRISPR gRNA sequence
  source 1..20: mol_type = other DNA
tttttctttttttcagacaa

SEQ ID NO: 28838 - DNA, 20 bp, synthetic construct
  misc_feature 1..20: note = CRISPR gRNA sequence
  source 1..20: mol_type = other DNA
ttttctttttttcagacaag

SEQ ID NO: 28839 - DNA, 20 bp, synthetic construct
  misc_feature 1..20: note = CRISPR gRNA sequence
  source 1..20: mol_type = other DNA
tttctttttttcagacaagg

SEQ ID NO: 28840 - DNA, 20 bp, synthetic construct
  misc_feature 1..20: note = CRISPR gRNA sequence
  source 1..20: mol_type = other DNA
ttctttttttcagacaaggt

SEQ ID NO: 28841 - DNA, 20 bp, synthetic construct
  misc_feature 1..20: note = CRISPR gRNA sequence
  source 1..20: mol_type = other DNA
tctttttttcagacaaggtc

SEQ ID NO: 28842 - DNA, 20 bp, synthetic construct
  misc_feature 1..20: note = CRISPR gRNA sequence
  source 1..20: mol_type = other DNA
ctttttttcagacaaggtct

SEQ ID NO: 28843 - DNA, 20 bp, synthetic construct
  misc_feature 1..20: note = CRISPR gRNA sequence
  source 1..20: mol_type = other DNA
tttttttcagacaaggtctc

SEQ ID NO: 28844 - DNA, 20 bp, synthetic construct
  misc_feature 1..20: note = CRISPR gRNA sequence
  source 1..20: mol_type = other DNA
tttttcagacaaggtctcgc

SEQ ID NO: 28845 - DNA, 20 bp, synthetic construct
  misc_feature 1..20: note = CRISPR gRNA sequence
  source 1..20: mol_type = other DNA
ttttcagacaaggtctcgct

SEQ ID NO: 28846 - DNA, 20 bp, synthetic construct
  misc_feature 1..20: note = CRISPR gRNA sequence
  source 1..20: mol_type = other DNA
tttcagacaaggtctcgctc

SEQ ID NO: 28847 - DNA, 20 bp, synthetic construct
  misc_feature 1..20: note = CRISPR gRNA sequence
  source 1..20: mol_type = other DNA
ttcagacaaggtctcgctct

SEQ ID NO: 28848 - DNA, 20 bp, synthetic construct
  misc_feature 1..20: note = CRISPR gRNA sequence
  source 1..20: mol_type = other DNA
tcagacaaggtctcgctctg

SEQ ID NO: 28849 - DNA, 20 bp, synthetic construct
  misc_feature 1..20: note = CRISPR gRNA sequence
  source 1..20: mol_type = other DNA
cagacaaggtctcgctctgt

SEQ ID NO: 28850 - DNA, 20 bp, synthetic construct
  misc_feature 1..20: note = CRISPR gRNA sequence
  source 1..20: mol_type = other DNA
agacaaggtctcgctctgtc

SEQ ID NO: 28851 - DNA, 20 bp, synthetic construct
  misc_feature 1..20: note = CRISPR gRNA sequence
  source 1..20: mol_type = other DNA
gctctgtcacccagggtgga

SEQ ID NO: 28852 - DNA, 20 bp, synthetic construct
  misc_feature 1..20: note = CRISPR gRNA sequence
  source 1..20: mol_type = other DNA
tgtcacccagggtggagtgc

SEQ ID NO: 28853 - DNA, 20 bp, synthetic construct
  misc_feature 1..20: note = CRISPR gRNA sequence
  source 1..20: mol_type = other DNA
tcacccagggtggagtgcag

SEQ ID NO: 28854 - DNA, 20 bp, synthetic construct
  misc_feature 1..20: note = CRISPR gRNA sequence
  source 1..20: mol_type = other DNA
actgcagcctcaatctccta

SEQ ID NO: 28855 - DNA, 20 bp, synthetic construct
  misc_feature 1..20: note = CRISPR gRNA sequence
  source 1..20: mol_type = other DNA
cagcctcaatctcctaggct

SEQ ID NO: 28856 - DNA, 20 bp, synthetic construct
  misc_feature 1..20: note = CRISPR gRNA sequence
  source 1..20: mol_type = other DNA
aatctcctaggctcaagcaa

SEQ ID NO: 28857 - DNA, 20 bp, synthetic construct
  misc_feature 1..20: note = CRISPR gRNA sequence
  source 1..20: mol_type = other DNA
ctaggctcaagcaatcctcc

SEQ ID NO: 28858 - DNA, 20 bp, synthetic construct
  misc_feature 1..20: note = CRISPR gRNA sequence
  source 1..20: mol_type = other DNA
ggctcaagcaatcctcccat

SEQ ID NO: 28859 - DNA, 20 bp, synthetic construct
  misc_feature 1..20: note = CRISPR gRNA sequence
  source 1..20: mol_type = other DNA
aagcaatcctcccatctcaa

SEQ ID NO: 28860 - DNA, 20 bp, synthetic construct
  misc_feature 1..20: note = CRISPR gRNA sequence
  source 1..20: mol_type = other DNA
ccatctcaaccttctgagta

SEQ ID NO: 28861 - DNA, 20 bp, synthetic construct
  misc_feature 1..20: note = CRISPR gRNA sequence
  source 1..20: mol_type = other DNA
aaccttctgagtagctggga

SEQ ID NO: 28862 - DNA, 20 bp, synthetic construct
  misc_feature 1..20: note = CRISPR gRNA sequence
  source 1..20: mol_type = other DNA
ctgagtagctgggacaggtg

SEQ ID NO: 28863 - DNA, 20 bp, synthetic construct
  misc_feature 1..20: note = CRISPR gRNA sequence
  source 1..20: mol_type = other DNA
tgagtagctgggacaggtgc

SEQ ID NO: 28864 - DNA, 20 bp, synthetic construct
  misc_feature 1..20: note = CRISPR gRNA sequence
  source 1..20: mol_type = other DNA
agtagctgggacaggtgcat

SEQ ID NO: 28865 - DNA, 20 bp, synthetic construct
  misc_feature 1..20: note = CRISPR gRNA sequence
  source 1..20: mol_type = other DNA
ggacaggtgcatgccaccac

SEQ ID NO: 28866 - DNA, 20 bp, synthetic construct
  misc_feature 1..20: note = CRISPR gRNA sequence
  source 1..20: mol_type = other DNA
atttttgtatttttttgtag

SEQ ID NO: 28867 - DNA, 20 bp, synthetic construct
  misc_feature 1..20: note = CRISPR gRNA sequence
  source 1..20: mol_type = other DNA
ttgtatttttttgtagagac

SEQ ID NO: 28868 - DNA, 20 bp, synthetic construct
  misc_feature 1..20: note = CRISPR gRNA sequence
  source 1..20: mol_type = other DNA
tgtatttttttgtagagacg

SEQ ID NO: 28869 - DNA, 20 bp, synthetic construct
  misc_feature 1..20: note = CRISPR gRNA sequence
  source 1..20: mol_type = other DNA
gtatttttttgtagagacgt

SEQ ID NO: 28870 - DNA, 20 bp, synthetic construct
  misc_feature 1..20: note = CRISPR gRNA sequence
  source 1..20: mol_type = other DNA
tatttttttgtagagacgtg

SEQ ID NO: 28871 - DNA, 20 bp, synthetic construct
  misc_feature 1..20: note = CRISPR gRNA sequence
  source 1..20: mol_type = other DNA
ttttgtagagacgtggtttc

SEQ ID NO: 28872 - DNA, 20 bp, synthetic construct
  misc_feature 1..20: note = CRISPR gRNA sequence
  source 1..20: mol_type = other DNA
tttgtagagacgtggtttca

SEQ ID NO: 28873 - DNA, 20 bp, synthetic construct
  misc_feature 1..20: note = CRISPR gRNA sequence
  source 1..20: mol_type = other DNA
ttgtagagacgtggtttcac

SEQ ID NO: 28874 - DNA, 20 bp, synthetic construct
  misc_feature 1..20: note = CRISPR gRNA sequence
  source 1..20: mol_type = other DNA
tgtagagacgtggtttcacc

SEQ ID NO: 28875 - DNA, 20 bp, synthetic construct
  misc_feature 1..20: note = CRISPR gRNA sequence
  source 1..20: mol_type = other DNA
gtagagacgtggtttcacca

SEQ ID NO: 28876 - DNA, 20 bp, synthetic construct
  misc_feature 1..20: note = CRISPR gRNA sequence
  source 1..20: mol_type = other DNA
tagagacgtggtttcaccac

SEQ ID NO: 28877 - DNA, 20 bp, synthetic construct
  misc_feature 1..20: note = CRISPR gRNA sequence
  source 1..20: mol_type = other DNA
caccacgttgcccaggctgg

SEQ ID NO: 28878 - DNA, 20 bp, synthetic construct
  misc_feature 1..20: note = CRISPR gRNA sequence
  source 1..20: mol_type = other DNA
accacgttgcccaggctggt

SEQ ID NO: 28879 - DNA, 20 bp, synthetic construct
  misc_feature 1..20: note = CRISPR gRNA sequence
  source 1..20: mol_type = other DNA
cccaggctggtcttgaactt

SEQ ID NO: 28880 - DNA, 20 bp, synthetic construct
  misc_feature 1..20: note = CRISPR gRNA sequence
  source 1..20: mol_type = other DNA
gtcttgaacttctgagctca

SEQ ID NO: 28881 - DNA, 20 bp, synthetic construct
  misc_feature 1..20: note = CRISPR gRNA sequence
  source 1..20: mol_type = other DNA
gaacttctgagctcaagcca

SEQ ID NO: 28882 - DNA, 20 bp, synthetic construct
  misc_feature 1..20: note = CRISPR gRNA sequence
  source 1..20: mol_type = other DNA
aacttctgagctcaagccat

SEQ ID NO: 28883 - DNA, 20 bp, synthetic construct
  misc_feature 1..20: note = CRISPR gRNA sequence
  source 1..20: mol_type = other DNA
ctgagctcaagccatcctcc

SEQ ID NO: 28884 - DNA, 20 bp, synthetic construct
  misc_feature 1..20: note = CRISPR gRNA sequence
  source 1..20: mol_type = other DNA
tgagctcaagccatcctcct

SEQ ID NO: 28885 - DNA, 20 bp, synthetic construct
  misc_feature 1..20: note = CRISPR gRNA sequence
  source 1..20: mol_type = other DNA
agctcaagccatcctcctgc

SEQ ID NO: 28886 - DNA, 20 bp, synthetic construct
  misc_feature 1..20: note = CRISPR gRNA sequence
  source 1..20: mol_type = other DNA
aagccatcctcctgcctctg

SEQ ID NO: 28887 - DNA, 20 bp, synthetic construct
  misc_feature 1..20: note = CRISPR gRNA sequence
  source 1..20: mol_type = other DNA
ctgcctctgcctcccaaagt

SEQ ID NO: 28888 - DNA, 20 bp, synthetic construct
  misc_feature 1..20: note = CRISPR gRNA sequence
  source 1..20: mol_type = other DNA
cctctgcctcccaaagtact

SEQ ID NO: 28889 - DNA, 20 bp, synthetic construct
  misc_feature 1..20: note = CRISPR gRNA sequence
  source 1..20: mol_type = other DNA
tgcctcccaaagtactggga

SEQ ID NO: 28890 - DNA, 20 bp, synthetic construct
  misc_feature 1..20: note = CRISPR gRNA sequence
  source 1..20: mol_type = other DNA
cctcccaaagtactgggatt

SEQ ID NO: 28891 - DNA, 20 bp, synthetic construct
  misc_feature 1..20: note = CRISPR gRNA sequence
  source 1..20: mol_type = other DNA
ccaaagtactgggattacag

SEQ ID NO: 28892 - DNA, 20 bp, synthetic construct
  misc_feature 1..20: note = CRISPR gRNA sequence
  source 1..20: mol_type = other DNA
ggattacaggcatgagtcac

SEQ ID NO: 28893 - DNA, 20 bp, synthetic construct
  misc_feature 1..20: note = CRISPR gRNA sequence
  source 1..20: mol_type = other DNA
caggcatgagtcactgtgcc

SEQ ID NO: 28894 - DNA, 20 bp, synthetic construct
  misc_feature 1..20: note = CRISPR gRNA sequence
  source 1..20: mol_type = other DNA
tgcctggttcaatgggattt

SEQ ID NO: 28895 - DNA, 20 bp, synthetic construct
  misc_feature 1..20: note = CRISPR gRNA sequence
  source 1..20: mol_type = other DNA
gttcaatgggattttttttt

SEQ ID NO: 28896 - DNA, 20 bp, synthetic construct
  misc_feature 1..20: note = CRISPR gRNA sequence
  source 1..20: mol_type = other DNA
aatgggattttttttttttt

SEQ ID NO: 28897 - DNA, 20 bp, synthetic construct
  misc_feature 1..20: note = CRISPR gRNA sequence
  source 1..20: mol_type = other DNA
tttttttttttttttgacac

SEQ ID NO: 28898 - DNA, 20 bp, synthetic construct
  misc_feature 1..20: note = CRISPR gRNA sequence
  source 1..20: mol_type = other DNA
ttttttttttttttgacacg

SEQ ID NO: 28899 - DNA, 20 bp, synthetic construct
  misc_feature 1..20: note = CRISPR gRNA sequence
  source 1..20: mol_type = other DNA
tttttttttttttgacacgg

SEQ ID NO: 28900 - DNA, 20 bp, synthetic construct
  misc_feature 1..20: note = CRISPR gRNA sequence
  source 1..20: mol_type = other DNA
ttttttttttttgacacgga

SEQ ID NO: 28901 - DNA, 20 bp, synthetic construct
  misc_feature 1..20: note = CRISPR gRNA sequence
  source 1..20: mol_type = other DNA
tttttttttttgacacggag

SEQ ID NO: 28902 - DNA, 20 bp, synthetic construct
  misc_feature 1..20: note = CRISPR gRNA sequence
  source 1..20: mol_type = other DNA
ttttttttttgacacggagt

SEQ ID NO: 28903 - DNA, 20 bp, synthetic construct
  misc_feature 1..20: note = CRISPR gRNA sequence
  source 1..20: mol_type = other DNA
tttttttttgacacggagtc

SEQ ID NO: 28904 - DNA, 20 bp, synthetic construct
  misc_feature 1..20: note = CRISPR gRNA sequence
  source 1..20: mol_type = other DNA
ttttttttgacacggagtct

SEQ ID NO: 28905 - DNA, 20 bp, synthetic construct
  misc_feature 1..20: note = CRISPR gRNA sequence
  source 1..20: mol_type = other DNA
tttttttgacacggagtctc

SEQ ID NO: 28906 - DNA, 20 bp, synthetic construct
  misc_feature 1..20: note = CRISPR gRNA sequence
  source 1..20: mol_type = other DNA
ttttttgacacggagtctcg

SEQ ID NO: 28907 - DNA, 20 bp, synthetic construct
  misc_feature 1..20: note = CRISPR gRNA sequence
  source 1..20: mol_type = other DNA
tttttgacacggagtctcgc

SEQ ID NO: 28908 - DNA, 20 bp, synthetic construct
  misc_feature 1..20: note = CRISPR gRNA sequence
  source 1..20: mol_type = other DNA
ttttgacacggagtctcgct

SEQ ID NO: 28909 - DNA, 20 bp, synthetic construct
  misc_feature 1..20: note = CRISPR gRNA sequence
  source 1..20: mol_type = other DNA
tttgacacggagtctcgctc

SEQ ID NO: 28910 - DNA, 20 bp, synthetic construct
  misc_feature 1..20: note = CRISPR gRNA sequence
  source 1..20: mol_type = other DNA
ttgacacggagtctcgctct

SEQ ID NO: 28911 - DNA, 20 bp, synthetic construct
  misc_feature 1..20: note = CRISPR gRNA sequence
  source 1..20: mol_type = other DNA
tgacacggagtctcgctctg

SEQ ID NO: 28912 - DNA, 20 bp, synthetic construct
  misc_feature 1..20: note = CRISPR gRNA sequence
  source 1..20: mol_type = other DNA
gacacggagtctcgctctgt

SEQ ID NO: 28913 - DNA, 20 bp, synthetic construct
  misc_feature 1..20: note = CRISPR gRNA sequence
  source 1..20: mol_type = other DNA
acacggagtctcgctctgta

SEQ ID NO: 28914 - DNA, 20 bp, synthetic construct
  misc_feature 1..20: note = CRISPR gRNA sequence
  source 1..20: mol_type = other DNA
gctctgtagcccaggctgga

SEQ ID NO: 28915 - DNA, 20 bp, synthetic construct
  misc_feature 1..20: note = CRISPR gRNA sequence
  source 1..20: mol_type = other DNA
tgtagcccaggctggagtgc

SEQ ID NO: 28916 - DNA, 20 bp, synthetic construct
  misc_feature 1..20: note = CRISPR gRNA sequence
  source 1..20: mol_type = other DNA
tagcccaggctggagtgcag

SEQ ID NO: 28917 - DNA, 20 bp, synthetic construct
  misc_feature 1..20: note = CRISPR gRNA sequence
  source 1..20: mol_type = other DNA
gagtgcagtggtacgatcta

SEQ ID NO: 28918 - DNA, 20 bp, synthetic construct
  misc_feature 1..20: note = CRISPR gRNA sequence
  source 1..20: mol_type = other DNA
tttattgcaaacttcacctc

SEQ ID NO: 28919 - DNA, 20 bp, synthetic construct
  misc_feature 1..20: note = CRISPR gRNA sequence
  source 1..20: mol_type = other DNA
attgcaaacttcacctcctg

SEQ ID NO: 28920 - DNA, 20 bp, synthetic construct
  misc_feature 1..20: note = CRISPR gRNA sequence
  source 1..20: mol_type = other DNA
ttgcaaacttcacctcctgg

SEQ ID NO: 28921 - DNA, 20 bp, synthetic construct
  misc_feature 1..20: note = CRISPR gRNA sequence
  source 1..20: mol_type = other DNA
caaacttcacctcctgggtt

SEQ ID NO: 28922 - DNA, 20 bp, synthetic construct
  misc_feature 1..20: note = CRISPR gRNA sequence
  source 1..20: mol_type = other DNA
cacctcctgggttcaagcaa

SEQ ID NO: 28923 - DNA, 20 bp, synthetic construct
  misc_feature 1..20: note = CRISPR gRNA sequence
  source 1..20: mol_type = other DNA
acctcctgggttcaagcaat

SEQ ID NO: 28924 - DNA, 20 bp, synthetic construct
  misc_feature 1..20: note = CRISPR gRNA sequence
  source 1..20: mol_type = other DNA
ctgggttcaagcaattctca

SEQ ID NO: 28925 - DNA, 20 bp, synthetic construct
  misc_feature 1..20: note = CRISPR gRNA sequence
  source 1..20: mol_type = other DNA
ggttcaagcaattctcacac

SEQ ID NO: 28926 - DNA, 20 bp, synthetic construct
  misc_feature 1..20: note = CRISPR gRNA sequence
  source 1..20: mol_type = other DNA
aagcaattctcacacctcag

SEQ ID NO: 28927 - DNA, 20 bp, synthetic construct
  misc_feature 1..20: note = CRISPR gRNA sequence
  source 1..20: mol_type = other DNA
tcacacctcagcctcccaag

SEQ ID NO: 28928 - DNA, 20 bp, synthetic construct
  misc_feature 1..20: note = CRISPR gRNA sequence
  source 1..20: mol_type = other DNA
acacctcagcctcccaagta

SEQ ID NO: 28929 - DNA, 20 bp, synthetic construct
  misc_feature 1..20: note = CRISPR gRNA sequence
  source 1..20: mol_type = other DNA
agcctcccaagtagctggaa

SEQ ID NO: 28930 - DNA, 20 bp, synthetic construct
  misc_feature 1..20: note = CRISPR gRNA sequence
  source 1..20: mol_type = other DNA
ccaagtagctggaattacag

SEQ ID NO: 28931 - DNA, 20 bp, synthetic construct
  misc_feature 1..20: note = CRISPR gRNA sequence
  source 1..20: mol_type = other DNA
gaattacaggcatgcaccac

SEQ ID NO: 28932 - DNA, 20 bp, synthetic construct
  misc_feature 1..20: note = CRISPR gRNA sequence
  source 1..20: mol_type = other DNA
caggcatgcaccactacacc

SEQ ID NO: 28933 - DNA, 20 bp, synthetic construct
  misc_feature 1..20: note = CRISPR gRNA sequence
  source 1..20: mol_type = other DNA
cacccaactaatttttgtat

SEQ ID NO: 28934 - DNA, 20 bp, synthetic construct
  misc_feature 1..20: note = CRISPR gRNA sequence
  source 1..20: mol_type = other DNA
atttttgtatttttagtaga

SEQ ID NO: 28935 - DNA, 20 bp, synthetic construct
  misc_feature 1..20: note = CRISPR gRNA sequence
  source 1..20: mol_type = other DNA
ttgtatttttagtagagacg

SEQ ID NO: 28936 - DNA, 20 bp, synthetic construct
  misc_feature 1..20: note = CRISPR gRNA sequence
  source 1..20: mol_type = other DNA
tgtatttttagtagagacgg

SEQ ID NO: 28937 - DNA, 20 bp, synthetic construct
  misc_feature 1..20: note = CRISPR gRNA sequence
  source 1..20: mol_type = other DNA
gtatttttagtagagacggg

SEQ ID NO: 28938 - DNA, 20 bp, synthetic construct
  misc_feature 1..20: note = CRISPR gRNA sequence
  source 1..20: mol_type = other DNA
tatttttagtagagacgggg

SEQ ID NO: 28939 - DNA, 20 bp, synthetic construct
  misc_feature 1..20: note = CRISPR gRNA sequence
  source 1..20: mol_type = other DNA
ttagtagagacggggtttca

SEQ ID NO: 28940 - DNA, 20 bp, synthetic construct
  misc_feature 1..20: note = CRISPR gRNA sequence
  source 1..20: mol_type = other DNA
tagtagagacggggtttcac

SEQ ID NO: 28941 - DNA, 20 bp, synthetic construct
  misc_feature 1..20: note = CRISPR gRNA sequence
  source 1..20: mol_type = other DNA
agtagagacggggtttcacc

SEQ ID NO: 28942 - DNA, 20 bp, synthetic construct
  misc_feature 1..20: note = CRISPR gRNA sequence
  source 1..20: mol_type = other DNA
gtagagacggggtttcacca

SEQ ID NO: 28943 - DNA, 20 bp, synthetic construct
  misc_feature 1..20: note = CRISPR gRNA sequence
  source 1..20: mol_type = other DNA
caccaggttggccaggctgg

SEQ ID NO: 28944 - DNA, 20 bp, synthetic construct
  misc_feature 1..20: note = CRISPR gRNA sequence
  source 1..20: mol_type = other DNA
accaggttggccaggctggt

SEQ ID NO: 28945 - DNA, 20 bp, synthetic construct
  misc_feature 1..20: note = CRISPR gRNA sequence
  source 1..20: mol_type = other DNA
gccaggctggtcttgaactc

SEQ ID NO: 28946 - DNA, 20 bp, synthetic construct
  misc_feature 1..20: note = CRISPR gRNA sequence
  source 1..20: mol_type = other DNA
gtcttgaactcctgacctca

SEQ ID NO: 28947 - DNA, 20 bp, synthetic construct
  misc_feature 1..20: note = CRISPR gRNA sequence
  source 1..20: mol_type = other DNA
gaactcctgacctcaagtga

SEQ ID NO: 28948 - DNA, 20 bp, synthetic construct
  misc_feature 1..20: note = CRISPR gRNA sequence
  source 1..20: mol_type = other DNA
aactcctgacctcaagtgat

SEQ ID NO: 28949 - DNA, 20 bp, synthetic construct
  misc_feature 1..20: note = CRISPR gRNA sequence
  source 1..20: mol_type = other DNA
ctgacctcaagtgatccgcc

SEQ ID NO: 28950 - DNA, 20 bp, synthetic construct
  misc_feature 1..20: note = CRISPR gRNA sequence
  source 1..20: mol_type = other DNA
acctcaagtgatccgcccac

SEQ ID NO: 28951 - DNA, 20 bp, synthetic construct
  misc_feature 1..20: note = CRISPR gRNA sequence
  source 1..20: mol_type = other DNA
aagtgatccgcccacctcag

SEQ ID NO: 28952 - DNA, 20 bp, synthetic construct
  misc_feature 1..20: note = CRISPR gRNA sequence
  source 1..20: mol_type = other DNA
agcctcccaaagtgctggga

SEQ ID NO: 28953 - DNA, 20 bp, synthetic construct
  misc_feature 1..20: note = CRISPR gRNA sequence
  source 1..20: mol_type = other DNA
ccaaagtgctgggattaccg

SEQ ID NO: 28954 - DNA, 20 bp, synthetic construct
  misc_feature 1..20: note = CRISPR gRNA sequence
  source 1..20: mol_type = other DNA
ggattaccggcatgagccac

SEQ ID NO: 28955 - DNA, 20 bp, synthetic construct
  misc_feature 1..20: note = CRISPR gRNA sequence
  source 1..20: mol_type = other DNA
ccggcatgagccaccacgcc

SEQ ID NO: 28956 - DNA, 20 bp, synthetic construct
  misc_feature 1..20: note = CRISPR gRNA sequence
  source 1..20: mol_type = other DNA
aacatgattttttactgaac

SEQ ID NO: 28957 - DNA, 20 bp, synthetic construct
  misc_feature 1..20: note = CRISPR gRNA sequence
  source 1..20: mol_type = other DNA
tttactgaacctagaggata

SEQ ID NO: 28958 - DNA, 20 bp, synthetic construct
  misc_feature 1..20: note = CRISPR gRNA sequence
  source 1..20: mol_type = other DNA
ttactgaacctagaggatat

SEQ ID NO: 28959 - DNA, 20 bp, synthetic construct
  misc_feature 1..20: note = CRISPR gRNA sequence
  source 1..20: mol_type = other DNA
tactgaacctagaggatatc

SEQ ID NO: 28960 - DNA, 20 bp, synthetic construct
  misc_feature 1..20: note = CRISPR gRNA sequence
  source 1..20: mol_type = other DNA
actgaacctagaggatatca

SEQ ID NO: 28961 - DNA, 20 bp, synthetic construct
  misc_feature 1..20: note = CRISPR gRNA sequence
  source 1..20: mol_type = other DNA
ctgaacctagaggatatcaa

SEQ ID NO: 28962 - DNA, 20 bp, synthetic construct
  misc_feature 1..20: note = CRISPR gRNA sequence
  source 1..20: mol_type = other DNA
aacctagaggatatcaaaat

SEQ ID NO: 28963 - DNA, 20 bp, synthetic construct
  misc_feature 1..20: note = CRISPR gRNA sequence
  source 1..20: mol_type = other DNA
gaggatatcaaaatcttccc

SEQ ID NO: 28964 - DNA, 20 bp, synthetic construct
  misc_feature 1..20: note = CRISPR gRNA sequence
  source 1..20: mol_type = other DNA
cccacactccccctcacaac

SEQ ID NO: 28965 - DNA, 20 bp, synthetic construct
  misc_feature 1..20: note = CRISPR gRNA sequence
  source 1..20: mol_type = other DNA
ccacactccccctcacaacc

SEQ ID NO: 28966 - DNA, 20 bp, synthetic construct
  misc_feature 1..20: note = CRISPR gRNA sequence
  source 1..20: mol_type = other DNA
cccctcacaaccaaggtctt

SEQ ID NO: 28967 - DNA, 20 bp, synthetic construct
  misc_feature 1..20: note = CRISPR gRNA sequence
  source 1..20: mol_type = other DNA
acaaccaaggtcttaggatg

SEQ ID NO: 28968 - DNA, 20 bp, synthetic construct
  misc_feature 1..20: note = CRISPR gRNA sequence
  source 1..20: mol_type = other DNA
aggatggccaaataatttac

SEQ ID NO: 28969 - DNA, 20 bp, synthetic construct
  misc_feature 1..20: note = CRISPR gRNA sequence
  source 1..20: mol_type = other DNA
ggatggccaaataatttacc

SEQ ID NO: 28970 - DNA, 20 bp, synthetic construct
  misc_feature 1..20: note = CRISPR gRNA sequence
  source 1..20: mol_type = other DNA
accggaatttacttagcaat

SEQ ID NO: 28971 - DNA, 20 bp, synthetic construct
  misc_feature 1..20: note = CRISPR gRNA sequence
  source 1..20: mol_type = other DNA
ccggaatttacttagcaatt

SEQ ID NO: 28972 - DNA, 20 bp, synthetic construct
  misc_feature 1..20: note = CRISPR gRNA sequence
  source 1..20: mol_type = other DNA
acttagcaatttccttaatt

SEQ ID NO: 28973 - DNA, 20 bp, synthetic construct
  misc_feature 1..20: note = CRISPR gRNA sequence
  source 1..20: mol_type = other DNA
cttagcaatttccttaattg

SEQ ID NO: 28974 - DNA, 20 bp, synthetic construct
  misc_feature 1..20: note = CRISPR gRNA sequence
  source 1..20: mol_type = other DNA
agcaatttccttaattgtag

SEQ ID NO: 28975 - DNA, 20 bp, synthetic construct
  misc_feature 1..20: note = CRISPR gRNA sequence
  source 1..20: mol_type = other DNA
gcaatttccttaattgtagg

SEQ ID NO: 28976 - DNA, 20 bp, synthetic construct
  misc_feature 1..20: note = CRISPR gRNA sequence
  source 1..20: mol_type = other DNA
ccttaattgtaggactgtgg

SEQ ID NO: 28977 - DNA, 20 bp, synthetic construct
  misc_feature 1..20: note = CRISPR gRNA sequence
  source 1..20: mol_type = other DNA
cttaattgtaggactgtggg

SEQ ID NO: 28978 - DNA, 20 bp, synthetic construct
  misc_feature 1..20: note = CRISPR gRNA sequence
  source 1..20: mol_type = other DNA
aattgtaggactgtgggact

SEQ ID NO: 28979 - DNA, 20 bp, synthetic construct
  misc_feature 1..20: note = CRISPR gRNA sequence
  source 1..20: mol_type = other DNA
attgtaggactgtgggactt

SEQ ID NO: 28980 - DNA, 20 bp, synthetic construct
  misc_feature 1..20: note = CRISPR gRNA sequence
  source 1..20: mol_type = other DNA
taggactgtgggacttctcc

SEQ ID NO: 28981 - DNA, 20 bp, synthetic construct
  misc_feature 1..20: note = CRISPR gRNA sequence
  source 1..20: mol_type = other DNA
tgggacttctccagtaattt

SEQ ID NO: 28982 - DNA, 20 bp, synthetic construct
  misc_feature 1..20: note = CRISPR gRNA sequence
  source 1..20: mol_type = other DNA
ctccagtaatttctagtgtc

SEQ ID NO: 28983 - DNA, 20 bp, synthetic construct
  misc_feature 1..20: note = CRISPR gRNA sequence
  source 1..20: mol_type = other DNA
tccagtaatttctagtgtcc

SEQ ID NO: 28984 - DNA, 20 bp, synthetic construct
  misc_feature 1..20: note = CRISPR gRNA sequence
  source 1..20: mol_type = other DNA
cagtaatttctagtgtccta

SEQ ID NO: 28985 - DNA, 20 bp, synthetic construct
  misc_feature 1..20: note = CRISPR gRNA sequence
  source 1..20: mol_type = other DNA
ctagtgtcctaggtaacact

SEQ ID NO: 28986 - DNA, 20 bp, synthetic construct
  misc_feature 1..20: note = CRISPR gRNA sequence
  source 1..20: mol_type = other DNA
tagtgtcctaggtaacactg

SEQ ID NO: 28987 - DNA, 20 bp, synthetic construct
  misc_feature 1..20: note = CRISPR gRNA sequence
  source 1..20: mol_type = other DNA
gtgtcctaggtaacactgta

SEQ ID NO: 28988 - DNA, 20 bp, synthetic construct
  misc_feature 1..20: note = CRISPR gRNA sequence
  source 1..20: mol_type = other DNA
ggtaacactgtaagctagat

SEQ ID NO: 28989 - DNA, 20 bp, synthetic construct
  misc_feature 1..20: note = CRISPR gRNA sequence
  source 1..20: mol_type = other DNA
taagctagatttcttctcct

SEQ ID NO: 28990 - DNA, 20 bp, synthetic construct
  misc_feature 1..20: note = CRISPR gRNA sequence
  source 1..20: mol_type = other DNA
gatttcttctccttagtcct

SEQ ID NO: 28991 - DNA, 20 bp, synthetic construct
  misc_feature 1..20: note = CRISPR gRNA sequence
  source 1..20: mol_type = other DNA
cttctccttagtccttccgt

SEQ ID NO: 28992 - DNA, 20 bp, synthetic construct
  misc_feature 1..20: note = CRISPR gRNA sequence
  source 1..20: mol_type = other DNA
ttctccttagtccttccgtc

SEQ ID NO: 28993 - DNA, 20 bp, synthetic construct
  misc_feature 1..20: note = CRISPR gRNA sequence
  source 1..20: mol_type = other DNA
ctccttagtccttccgtccc

SEQ ID NO: 28994 - DNA, 20 bp, synthetic construct
  misc_feature 1..20: note = CRISPR gRNA sequence
  source 1..20: mol_type = other DNA
tccttagtccttccgtcccc

SEQ ID NO: 28995 - DNA, 20 bp, synthetic construct
  misc_feature 1..20: note = CRISPR gRNA sequence
  source 1..20: mol_type = other DNA
cttagtccttccgtccccct

SEQ ID NO: 28996 - DNA, 20 bp, synthetic construct
  misc_feature 1..20: note = CRISPR gRNA sequence
  source 1..20: mol_type = other DNA
agtccttccgtccccctctt

SEQ ID NO: 28997 - DNA, 20 bp, synthetic construct
  misc_feature 1..20: note = CRISPR gRNA sequence
  source 1..20: mol_type = other DNA
gtccttccgtccccctcttt

SEQ ID NO: 28998 - DNA, 20 bp, synthetic construct
  misc_feature 1..20: note = CRISPR gRNA sequence
  source 1..20: mol_type = other DNA
ccgtccccctctttcttacc

SEQ ID NO: 28999 - DNA, 20 bp, synthetic construct
  misc_feature 1..20: note = CRISPR gRNA sequence
  source 1..20: mol_type = other DNA
cgtccccctctttcttaccc

SEQ ID NO: 29000 - DNA, 20 bp, synthetic construct
  misc_feature 1..20: note = CRISPR gRNA sequence
  source 1..20: mol_type = other DNA
tttcttacccgccaccccac

SEQ ID NO: 29001 - DNA, 20 bp, synthetic construct
  misc_feature 1..20: note = CRISPR gRNA sequence
  source 1..20: mol_type = other DNA
tcttacccgccaccccactt

SEQ ID NO: 29002 - DNA, 20 bp, synthetic construct
  misc_feature 1..20: note = CRISPR gRNA sequence
  source 1..20: mol_type = other DNA
cttacccgccaccccactta

SEQ ID NO: 29003 - DNA, 20 bp, synthetic construct
  misc_feature 1..20: note = CRISPR gRNA sequence
  source 1..20: mol_type = other DNA
ttacccgccaccccacttaa

SEQ ID NO: 29004 - DNA, 20 bp, synthetic construct
  misc_feature 1..20: note = CRISPR gRNA sequence
  source 1..20: mol_type = other DNA
acccgccaccccacttaagt

SEQ ID NO: 29005 - DNA, 20 bp, synthetic construct
  misc_feature 1..20: note = CRISPR gRNA sequence
  source 1..20: mol_type = other DNA
cccgccaccccacttaagta

SEQ ID NO: 29006 - DNA, 20 bp, synthetic construct
  misc_feature 1..20: note = CRISPR gRNA sequence
  source 1..20: mol_type = other DNA
aagtatttattgagcaccta

SEQ ID NO: 29007 - DNA, 20 bp, synthetic construct
  misc_feature 1..20: note = CRISPR gRNA sequence
  source 1..20: mol_type = other DNA
agtatttattgagcacctac

SEQ ID NO: 29008 - DNA, 20 bp, synthetic construct
  misc_feature 1..20: note = CRISPR gRNA sequence
  source 1..20: mol_type = other DNA
attgagcacctactatgtgc

SEQ ID NO: 29009 - DNA, 20 bp, synthetic construct
  misc_feature 1..20: note = CRISPR gRNA sequence
  source 1..20: mol_type = other DNA
ttgagcacctactatgtgcc

SEQ ID NO: 29010 - DNA, 20 bp, synthetic construct
  misc_feature 1..20: note = CRISPR gRNA sequence
  source 1..20: mol_type = other DNA
agcacctactatgtgcctgg

SEQ ID NO: 29011 - DNA, 20 bp, synthetic construct
  misc_feature 1..20: note = CRISPR gRNA sequence
  source 1..20: mol_type = other DNA
ctatgtgcctggcagtgctc

SEQ ID NO: 29012 - DNA, 20 bp, synthetic construct
  misc_feature 1..20: note = CRISPR gRNA sequence
  source 1..20: mol_type = other DNA
tgtgcctggcagtgctctag

SEQ ID NO: 29013 - DNA, 20 bp, synthetic construct
  misc_feature 1..20: note = CRISPR gRNA sequence
  source 1..20: mol_type = other DNA
gcagtgctctaggcacaggg

SEQ ID NO: 29014 - DNA, 20 bp, synthetic construct
  misc_feature 1..20: note = CRISPR gRNA sequence
  source 1..20: mol_type = other DNA
taggcacagggatacagtaa

SEQ ID NO: 29015 - DNA, 20 bp, synthetic construct
  misc_feature 1..20: note = CRISPR gRNA sequence
  source 1..20: mol_type = other DNA
ggcacagggatacagtaatg

SEQ ID NO: 29016 - DNA, 20 bp, synthetic construct
  misc_feature 1..20: note = CRISPR gRNA sequence
  source 1..20: mol_type = other DNA
ctccatgtgaagcccacaac

SEQ ID NO: 29017 - DNA, 20 bp, synthetic construct
  misc_feature 1..20: note = CRISPR gRNA sequence
  source 1..20: mol_type = other DNA
catgtgaagcccacaacccg

SEQ ID NO: 29018 - DNA, 20 bp, synthetic construct
  misc_feature 1..20: note = CRISPR gRNA sequence
  source 1..20: mol_type = other DNA
cacagccattaaacaaataa

SEQ ID NO: 29019 - DNA, 20 bp, synthetic construct
  misc_feature 1..20: note = CRISPR gRNA sequence
  source 1..20: mol_type = other DNA
aacaaataatgccaacactt

SEQ ID NO: 29020 - DNA, 20 bp, synthetic construct
  misc_feature 1..20: note = CRISPR gRNA sequence
  source 1..20: mol_type = other DNA
atttcattatagtgctgaaa

SEQ ID NO: 29021 - DNA, 20 bp, synthetic construct
  misc_feature 1..20: note = CRISPR gRNA sequence
  source 1..20: mol_type = other DNA
tttcattatagtgctgaaaa

SEQ ID NO: 29022 - DNA, 20 bp, synthetic construct
  misc_feature 1..20: note = CRISPR gRNA sequence
  source 1..20: mol_type = other DNA
cattatagtgctgaaaagtg

SEQ ID NO: 29023 - DNA, 20 bp, synthetic construct
  misc_feature 1..20: note = CRISPR gRNA sequence
  source 1..20: mol_type = other DNA
attatagtgctgaaaagtgg

SEQ ID NO: 29024 - DNA, 20 bp, synthetic construct
  misc_feature 1..20: note = CRISPR gRNA sequence
  source 1..20: mol_type = other DNA
tagtgctgaaaagtggcgca

SEQ ID NO: 29025 - DNA, 20 bp, synthetic construct
  misc_feature 1..20: note = CRISPR gRNA sequence
  source 1..20: mol_type = other DNA
aaaagtggcgcagagggaaa

SEQ ID NO: 29026 - DNA, 20 bp, synthetic construct
  misc_feature 1..20: note = CRISPR gRNA sequence
  source 1..20: mol_type = other DNA
taaagtcatgggacaggtgg

SEQ ID NO: 29027 - DNA, 20 bp, synthetic construct
  misc_feature 1..20: note = CRISPR gRNA sequence
  source 1..20: mol_type = other DNA
tccctcccatccacctcctc

SEQ ID NO: 29028 - DNA, 20 bp, synthetic construct
  misc_feature 1..20: note = CRISPR gRNA sequence
  source 1..20: mol_type = other DNA
cctcccatccacctcctcat

SEQ ID NO: 29029 - DNA, 20 bp, synthetic construct
  misc_feature 1..20: note = CRISPR gRNA sequence
  source 1..20: mol_type = other DNA
ccatccacctcctcatccct

SEQ ID NO: 29030 - DNA, 20 bp, synthetic construct
  misc_feature 1..20: note = CRISPR gRNA sequence
  source 1..20: mol_type = other DNA
ctcatccctgccctcccact

SEQ ID NO: 29031 - DNA, 20 bp, synthetic construct
  misc_feature 1..20: note = CRISPR gRNA sequence
  source 1..20: mol_type = other DNA
atccctgccctcccacttgg

SEQ ID NO: 29032 - DNA, 20 bp, synthetic construct
  misc_feature 1..20: note = CRISPR gRNA sequence
  source 1..20: mol_type = other DNA
ccctcccacttggccacagg

SEQ ID NO: 29033 - DNA, 20 bp, synthetic construct
  misc_feature 1..20: note = CRISPR gRNA sequence
  source 1..20: mol_type = other DNA
ccacttggccacaggaccta

SEQ ID NO: 29034 - DNA, 20 bp, synthetic construct
  misc_feature 1..20: note = CRISPR gRNA sequence
  source 1..20: mol_type = other DNA
ggccacaggacctaacagta

SEQ ID NO: 29035 - DNA, 20 bp, synthetic construct
  misc_feature 1..20: note = CRISPR gRNA sequence
  source 1..20: mol_type = other DNA
gccacaggacctaacagtat

SEQ ID NO: 29036 - DNA, 20 bp, synthetic construct
  misc_feature 1..20: note = CRISPR gRNA sequence
  source 1..20: mol_type = other DNA
acagtatcctcctatttacc

SEQ ID NO: 29037 - DNA, 20 bp, synthetic construct
  misc_feature 1..20: note = CRISPR gRNA sequence
  source 1..20: mol_type = other DNA
ctatttaccgagaggtagct

SEQ ID NO: 29038 - DNA, 20 bp, synthetic construct
  misc_feature 1..20: note = CRISPR gRNA sequence
  source 1..20: mol_type = other DNA
tttaccgagaggtagcttaa

SEQ ID NO: 29039 - DNA, 20 bp, synthetic construct
  misc_feature 1..20: note = CRISPR gRNA sequence
  source 1..20: mol_type = other DNA
accgagaggtagcttaagtc

SEQ ID NO: 29040 - DNA, 20 bp, synthetic construct
  misc_feature 1..20: note = CRISPR gRNA sequence
  source 1..20: mol_type = other DNA
ccgagaggtagcttaagtct

SEQ ID NO: 29041 - DNA, 20 bp, synthetic construct
  misc_feature 1..20: note = CRISPR gRNA sequence
  source 1..20: mol_type = other DNA
aagtctgtcgacagcgccat

SEQ ID NO: 29042 - DNA, 20 bp, synthetic construct
  misc_feature 1..20: note = CRISPR gRNA sequence
  source 1..20: mol_type = other DNA
agtctgtcgacagcgccatt

SEQ ID NO: 29043 - DNA, 20 bp, synthetic construct
  misc_feature 1..20: note = CRISPR gRNA sequence
  source 1..20: mol_type = other DNA
tcgacagcgccattcacagc

SEQ ID NO: 29044 - DNA, 20 bp, synthetic construct
  misc_feature 1..20: note = CRISPR gRNA sequence
  source 1..20: mol_type = other DNA
acagcctatgacccagaact

SEQ ID NO: 29045 - DNA, 20 bp, synthetic construct
  misc_feature 1..20: note = CRISPR gRNA sequence
  source 1..20: mol_type = other DNA
tgacccagaactctccttga

SEQ ID NO: 29046 - DNA, 20 bp, synthetic construct
  misc_feature 1..20: note = CRISPR gRNA sequence
  source 1..20: mol_type = other DNA
tccttgaggtcaaagtgagg

SEQ ID NO: 29047 - DNA, 20 bp, synthetic construct
  misc_feature 1..20: note = CRISPR gRNA sequence
  source 1..20: mol_type = other DNA
cttgaggtcaaagtgaggca

SEQ ID NO: 29048 - DNA, 20 bp, synthetic construct
  misc_feature 1..20: note = CRISPR gRNA sequence
  source 1..20: mol_type = other DNA
gaggtcaaagtgaggcatgc

SEQ ID NO: 29049 - DNA, 20 bp, synthetic construct
  misc_feature 1..20: note = CRISPR gRNA sequence
  source 1..20: mol_type = other DNA
aggtcaaagtgaggcatgca

SEQ ID NO: 29050 - DNA, 20 bp, synthetic construct
  misc_feature 1..20: note = CRISPR gRNA sequence
  source 1..20: mol_type = other DNA
ggtcctgagccctccccctc

SEQ ID NO: 29051 - DNA, 20 bp, synthetic construct
  misc_feature 1..20: note = CRISPR gRNA sequence
  source 1..20: mol_type = other DNA
gtcctgagccctccccctca

SEQ ID NO: 29052 - DNA, 20 bp, synthetic construct
  misc_feature 1..20: note = CRISPR gRNA sequence
  source 1..20: mol_type = other DNA
agccctccccctcactgtgt

SEQ ID NO: 29053 - DNA, 20 bp, synthetic construct
  misc_feature 1..20: note = CRISPR gRNA sequence
  source 1..20: mol_type = other DNA
cccctcactgtgtccccgca

SEQ ID NO: 29054 - DNA, 20 bp, synthetic construct
  misc_feature 1..20: note = CRISPR gRNA sequence
  source 1..20: mol_type = other DNA
actgtgtccccgcagtctgt

SEQ ID NO: 29055 - DNA, 20 bp, synthetic construct
  misc_feature 1..20: note = CRISPR gRNA sequence
  source 1..20: mol_type = other DNA
tgtccccgcagtctgtccca

SEQ ID NO: 29056 - DNA, 20 bp, synthetic construct
  misc_feature 1..20: note = CRISPR gRNA sequence
  source 1..20: mol_type = other DNA
tcccagaacaacatcactga

SEQ ID NO: 29057 - DNA, 20 bp, synthetic construct
  misc_feature 1..20: note = CRISPR gRNA sequence
  source 1..20: mol_type = other DNA
acctgggtgcctacaaactc

SEQ ID NO: 29058 - DNA, 20 bp, synthetic construct
  misc_feature 1..20: note = CRISPR gRNA sequence
  source 1..20: mol_type = other DNA
ggtgcctacaaactcgccga

SEQ ID NO: 29059 - DNA, 20 bp, synthetic construct
  misc_feature 1..20: note = CRISPR gRNA sequence
  source 1..20: mol_type = other DNA
caaactcgccgaggccctgc

SEQ ID NO: 29060 - DNA, 20 bp, synthetic construct
  misc_feature 1..20: note = CRISPR gRNA sequence
  source 1..20: mol_type = other DNA
gccgaggccctgccttcgct

SEQ ID NO: 29061 - DNA, 20 bp, synthetic construct
  misc_feature 1..20: note = CRISPR gRNA sequence
  source 1..20: mol_type = other DNA
ccttcgctcgctgcatccct

SEQ ID NO: 29062 - DNA, 20 bp, synthetic construct
  misc_feature 1..20: note = CRISPR gRNA sequence
  source 1..20: mol_type = other DNA
cgctcgctgcatccctgctc

SEQ ID NO: 29063 - DNA, 20 bp, synthetic construct
  misc_feature 1..20: note = CRISPR gRNA sequence
  source 1..20: mol_type = other DNA
gctcgctgcatccctgctca

SEQ ID NO: 29064 - DNA, 20 bp, synthetic construct
  misc_feature 1..20: note = CRISPR gRNA sequence
  source 1..20: mol_type = other DNA
gctgcatccctgctcaggct

SEQ ID NO: 29065 - DNA, 20 bp, synthetic construct
  misc_feature 1..20: note = CRISPR gRNA sequence
  source 1..20: mol_type = other DNA
catccctgctcaggctaagg

SEQ ID NO: 29066 - DNA, 20 bp, synthetic construct
  misc_feature 1..20: note = CRISPR gRNA sequence
  source 1..20: mol_type = other DNA
ctcaggctaaggtgagtggg

SEQ ID NO: 29067 - DNA, 20 bp, synthetic construct
  misc_feature 1..20: note = CRISPR gRNA sequence
  source 1..20: mol_type = other DNA
aggctaaggtgagtggggcc

SEQ ID NO: 29068 - DNA, 20 bp, synthetic construct
  misc_feature 1..20: note = CRISPR gRNA sequence
  source 1..20: mol_type = other DNA
aggtgagtggggccccggat

SEQ ID NO: 29069 - DNA, 20 bp, synthetic construct
  misc_feature 1..20: note = CRISPR gRNA sequence
  source 1..20: mol_type = other DNA
agctggggggctgcagagcg

SEQ ID NO: 29070 - DNA, 20 bp, synthetic construct
  misc_feature 1..20: note = CRISPR gRNA sequence
  source 1..20: mol_type = other DNA
gggggctgcagagcgcaggg

SEQ ID NO: 29071 - DNA, 20 bp, synthetic construct
  misc_feature 1..20: note = CRISPR gRNA sequence
  source 1..20: mol_type = other DNA
cagagcgcagggaacccaca

SEQ ID NO: 29072 - DNA, 20 bp, synthetic construct
  misc_feature 1..20: note = CRISPR gRNA sequence
  source 1..20: mol_type = other DNA
gctgcaggggacactgagac

SEQ ID NO: 29073 - DNA, 20 bp, synthetic construct
  misc_feature 1..20: note = CRISPR gRNA sequence
  source 1..20: mol_type = other DNA
caggggacactgagacccta

SEQ ID NO: 29074 - DNA, 20 bp, synthetic construct
  misc_feature 1..20: note = CRISPR gRNA sequence
  source 1..20: mol_type = other DNA
agaccctagaagcaatcacc

SEQ ID NO: 29075 - DNA, 20 bp, synthetic construct
  misc_feature 1..20: note = CRISPR gRNA sequence
  source 1..20: mol_type = other DNA
gaagcaatcaccacagccct

SEQ ID NO: 29076 - DNA, 20 bp, synthetic construct
  misc_feature 1..20: note = CRISPR gRNA sequence
  source 1..20: mol_type = other DNA
aacaaaaggattagcgggac

SEQ ID NO: 29077 - DNA, 20 bp, synthetic construct
  misc_feature 1..20: note = CRISPR gRNA sequence
  source 1..20: mol_type = other DNA
gcgggacgtggtgaaagaaa

SEQ ID NO: 29078 - DNA, 20 bp, synthetic construct
  misc_feature 1..20: note = CRISPR gRNA sequence
  source 1..20: mol_type = other DNA
tgagcaagtcagttattcat

SEQ ID NO: 29079 - DNA, 20 bp, synthetic construct
  misc_feature 1..20: note = CRISPR gRNA sequence
  source 1..20: mol_type = other DNA
agcaagtcagttattcattc

SEQ ID NO: 29080 - DNA, 20 bp, synthetic construct
  misc_feature 1..20: note = CRISPR gRNA sequence
  source 1..20: mol_type = other DNA
ttcattcctagccgctgttt

SEQ ID NO: 29081 - DNA, 20 bp, synthetic construct
  misc_feature 1..20: note = CRISPR gRNA sequence
  source 1..20: mol_type = other DNA
attcctagccgctgttttct

SEQ ID NO: 29082 - DNA, 20 bp, synthetic construct
  misc_feature 1..20: note = CRISPR gRNA sequence
  source 1..20: mol_type = other DNA
ctagccgctgttttcttacc

SEQ ID NO: 29083 - DNA, 20 bp, synthetic construct
  misc_feature 1..20: note = CRISPR gRNA sequence
  source 1..20: mol_type = other DNA
gccgctgttttcttacctgg

SEQ ID NO: 29084 - DNA, 20 bp, synthetic construct
  misc_feature 1..20: note = CRISPR gRNA sequence
  source 1..20: mol_type = other DNA
ttttcttacctggaaaatgg

SEQ ID NO: 29085 - DNA, 20 bp, synthetic construct
  misc_feature 1..20: note = CRISPR gRNA sequence
  source 1..20: mol_type = other DNA
tcttacctggaaaatgggaa

SEQ ID NO: 29086 - DNA, 20 bp, synthetic construct
  misc_feature 1..20: note = CRISPR gRNA sequence
  source 1..20: mol_type = other DNA
cttacctggaaaatgggaac

SEQ ID NO: 29087 - DNA, 20 bp, synthetic construct
  misc_feature 1..20: note = CRISPR gRNA sequence
  source 1..20: mol_type = other DNA
ttacctggaaaatgggaacc

SEQ ID NO: 29088 - DNA, 20 bp, synthetic construct
  misc_feature 1..20: note = CRISPR gRNA sequence
  source 1..20: mol_type = other DNA
acctggaaaatgggaaccat

SEQ ID NO: 29089 - DNA, 20 bp, synthetic construct
  misc_feature 1..20: note = CRISPR gRNA sequence
  source 1..20: mol_type = other DNA
cctggaaaatgggaaccatc

SEQ ID NO: 29090 - DNA, 20 bp, synthetic construct
  misc_feature 1..20: note = CRISPR gRNA sequence
  source 1..20: mol_type = other DNA
gaaaatgggaaccatcctaa

SEQ ID NO: 29091 - DNA, 20 bp, synthetic construct
  misc_feature 1..20: note = CRISPR gRNA sequence
  source 1..20: mol_type = other DNA
atggtctatgtaagcacttg

SEQ ID NO: 29092 - DNA, 20 bp, synthetic construct
  misc_feature 1..20: note = CRISPR gRNA sequence
  source 1..20: mol_type = other DNA
tgtaagcacttgtcacaatg

SEQ ID NO: 29093 - DNA, 20 bp, synthetic construct
  misc_feature 1..20: note = CRISPR gRNA sequence
  source 1..20: mol_type = other DNA
gtcacaatgccaggttctgt

SEQ ID NO: 29094 - DNA, 20 bp, synthetic construct
  misc_feature 1..20: note = CRISPR gRNA sequence
  source 1..20: mol_type = other DNA
tcacaatgccaggttctgtt

SEQ ID NO: 29095 - DNA, 20 bp, synthetic construct
  misc_feature 1..20: note = CRISPR gRNA sequence
  source 1..20: mol_type = other DNA
tgttatgcaataaatattgc

SEQ ID NO: 29096 - DNA, 20 bp, synthetic construct
  misc_feature 1..20: note = CRISPR gRNA sequence
  source 1..20: mol_type = other DNA
ttatgcaataaatattgctc

SEQ ID NO: 29097 - DNA, 20 bp, synthetic construct
  misc_feature 1..20: note = CRISPR gRNA sequence
  source 1..20: mol_type = other DNA
tgcaataaatattgctcctt

SEQ ID NO: 29098 - DNA, 20 bp, synthetic construct
  misc_feature 1..20: note = CRISPR gRNA sequence
  source 1..20: mol_type = other DNA
ctccttttcccccagggatg

SEQ ID NO: 29099 - DNA, 20 bp, synthetic construct
  misc_feature 1..20: note = CRISPR gRNA sequence
  source 1..20: mol_type = other DNA
cttttcccccagggatggcg

SEQ ID NO: 29100 - DNA, 20 bp, synthetic construct
  misc_feature 1..20: note = CRISPR gRNA sequence
  source 1..20: mol_type = other DNA
ttcccccagggatggcggga

SEQ ID NO: 29101 - DNA, 20 bp, synthetic construct
  misc_feature 1..20: note = CRISPR gRNA sequence
  source 1..20: mol_type = other DNA
tcccccagggatggcgggac

SEQ ID NO: 29102 - DNA, 20 bp, synthetic construct
  misc_feature 1..20: note = CRISPR gRNA sequence
  source 1..20: mol_type = other DNA
cccccagggatggcgggacc

SEQ ID NO: 29103 - DNA, 20 bp, synthetic construct
  misc_feature 1..20: note = CRISPR gRNA sequence
  source 1..20: mol_type = other DNA
ccccagggatggcgggacca

SEQ ID NO: 29104 - DNA, 20 bp, synthetic construct
  misc_feature 1..20: note = CRISPR gRNA sequence
  source 1..20: mol_type = other DNA
tttccggaacctaggggtgg

SEQ ID NO: 29105 - DNA, 20 bp, synthetic construct
  misc_feature 1..20: note = CRISPR gRNA sequence
  source 1..20: mol_type = other DNA
ttccggaacctaggggtggt

SEQ ID NO: 29106 - DNA, 20 bp, synthetic construct
  misc_feature 1..20: note = CRISPR gRNA sequence
  source 1..20: mol_type = other DNA
tccggaacctaggggtggtg

SEQ ID NO: 29107 - DNA, 20 bp, synthetic construct
  misc_feature 1..20: note = CRISPR gRNA sequence
  source 1..20: mol_type = other DNA
ccggaacctaggggtggtgg

SEQ ID NO: 29108 - DNA, 20 bp, synthetic construct
  misc_feature 1..20: note = CRISPR gRNA sequence
  source 1..20: mol_type = other DNA
cggaacctaggggtggtggc

SEQ ID NO: 29109 - DNA, 20 bp, synthetic construct
  misc_feature 1..20: note = CRISPR gRNA sequence
  source 1..20: mol_type = other DNA
ggggtggtggcttctggaag

SEQ ID NO: 29110 - DNA, 20 bp, synthetic construct
  misc_feature 1..20: note = CRISPR gRNA sequence
  source 1..20: mol_type = other DNA
ctggaaggctaaccacgtac

SEQ ID NO: 29111 - DNA, 20 bp, synthetic construct
  misc_feature 1..20: note = CRISPR gRNA sequence
  source 1..20: mol_type = other DNA
tggaaggctaaccacgtacg

SEQ ID NO: 29112 - DNA, 20 bp, synthetic construct
  misc_feature 1..20: note = CRISPR gRNA sequence
  source 1..20: mol_type = other DNA
gaaggctaaccacgtacgtc

SEQ ID NO: 29113 - DNA, 20 bp, synthetic construct
  misc_feature 1..20: note = CRISPR gRNA sequence
  source 1..20: mol_type = other DNA
accacgtacgtcagcttttg

SEQ ID NO: 29114 - DNA, 20 bp, synthetic construct
  misc_feature 1..20: note = CRISPR gRNA sequence
  source 1..20: mol_type = other DNA
ttgccggccttgtcacttac

SEQ ID NO: 29115 - DNA, 20 bp, synthetic construct
  misc_feature 1..20: note = CRISPR gRNA sequence
  source 1..20: mol_type = other DNA
tgccggccttgtcacttaca

SEQ ID NO: 29116 - DNA, 20 bp, synthetic construct
  misc_feature 1..20: note = CRISPR gRNA sequence
  source 1..20: mol_type = other DNA
gccggccttgtcacttacat

SEQ ID NO: 29117 - DNA, 20 bp, synthetic construct
  misc_feature 1..20: note = CRISPR gRNA sequence
  source 1..20: mol_type = other DNA
ccggccttgtcacttacatg

SEQ ID NO: 29118 - DNA, 20 bp, synthetic construct
  misc_feature 1..20: note = CRISPR gRNA sequence
  source 1..20: mol_type = other DNA
gtcacttacatgccggtcag

SEQ ID NO: 29119 - DNA, 20 bp, synthetic construct
  misc_feature 1..20: note = CRISPR gRNA sequence
  source 1..20: mol_type = other DNA
tcacttacatgccggtcagt

SEQ ID NO: 29120 - DNA, 20 bp, synthetic construct
  misc_feature 1..20: note = CRISPR gRNA sequence
  source 1..20: mol_type = other DNA
acatgccggtcagtgtttca

SEQ ID NO: 29121 - DNA, 20 bp, synthetic construct
  misc_feature 1..20: note = CRISPR gRNA sequence
  source 1..20: mol_type = other DNA
catgccggtcagtgtttcac

SEQ ID NO: 29122 - DNA, 20 bp, synthetic construct
  misc_feature 1..20: note = CRISPR gRNA sequence
  source 1..20: mol_type = other DNA
cactgccaccttctggtagg

SEQ ID NO: 29123 - DNA, 20 bp, synthetic construct
  misc_feature 1..20: note = CRISPR gRNA sequence
  source 1..20: mol_type = other DNA
actgccaccttctggtaggc

SEQ ID NO: 29124 - DNA, 20 bp, synthetic construct
  misc_feature 1..20: note = CRISPR gRNA sequence
  source 1..20: mol_type = other DNA
ccaccttctggtaggccttg

SEQ ID NO: 29125 - DNA, 20 bp, synthetic construct
  misc_feature 1..20: note = CRISPR gRNA sequence
  source 1..20: mol_type = other DNA
ctggtaggccttggcatagc

SEQ ID NO: 29126 - DNA, 20 bp, synthetic construct
  misc_feature 1..20: note = CRISPR gRNA sequence
  source 1..20: mol_type = other DNA
tggtaggccttggcatagca

SEQ ID NO: 29127 - DNA, 20 bp, synthetic construct
  misc_feature 1..20: note = CRISPR gRNA sequence
  source 1..20: mol_type = other DNA
gtaggccttggcatagcacc

SEQ ID NO: 29128 - DNA, 20 bp, synthetic construct
  misc_feature 1..20: note = CRISPR gRNA sequence
  source 1..20: mol_type = other DNA
ggcatagcacctcttgcttt

SEQ ID NO: 29129 - DNA, 20 bp, synthetic construct
  misc_feature 1..20: note = CRISPR gRNA sequence
  source 1..20: mol_type = other DNA
gcatagcacctcttgctttt

SEQ ID NO: 29130 - DNA, 20 bp, synthetic construct
  misc_feature 1..20: note = CRISPR gRNA sequence
  source 1..20: mol_type = other DNA
ttgcttttgagtgacttcca

SEQ ID NO: 29131 - DNA, 20 bp, synthetic construct
  misc_feature 1..20: note = CRISPR gRNA sequence
  source 1..20: mol_type = other DNA
gcttttgagtgacttccatc

SEQ ID NO: 29132 - DNA, 20 bp, synthetic construct
  misc_feature 1..20: note = CRISPR gRNA sequence
  source 1..20: mol_type = other DNA
cttttgagtgacttccatcc

SEQ ID NO: 29133 - DNA, 20 bp, synthetic construct
  misc_feature 1..20: note = CRISPR gRNA sequence
  source 1..20: mol_type = other DNA
ttgagtgacttccatccagg

SEQ ID NO: 29134 - DNA, 20 bp, synthetic construct
  misc_feature 1..20: note = CRISPR gRNA sequence
  source 1..20: mol_type = other DNA
tgagtgacttccatccaggc

SEQ ID NO: 29135 - DNA, 20 bp, synthetic construct
  misc_feature 1..20: note = CRISPR gRNA sequence
  source 1..20: mol_type = other DNA
gagtgacttccatccaggcc

SEQ ID NO: 29136 - DNA, 20 bp, synthetic construct
  misc_feature 1..20: note = CRISPR gRNA sequence
  source 1..20: mol_type = other DNA
agtgacttccatccaggccc

SEQ ID NO: 29137 - DNA, 20 bp, synthetic construct
  misc_feature 1..20: note = CRISPR gRNA sequence
  source 1..20: mol_type = other DNA
ccatccaggccctggtgtgg

SEQ ID NO: 29138 - DNA, 20 bp, synthetic construct
  misc_feature 1..20: note = CRISPR gRNA sequence
  source 1..20: mol_type = other DNA
catccaggccctggtgtggt

SEQ ID NO: 29139 - DNA, 20 bp, synthetic construct
  misc_feature 1..20: note = CRISPR gRNA sequence
  source 1..20: mol_type = other DNA
gtgtggtcccagaggtaatg

SEQ ID NO: 29140 - DNA, 20 bp, synthetic construct
  misc_feature 1..20: note = CRISPR gRNA sequence
  source 1..20: mol_type = other DNA
agcttggaccagagccccag

SEQ ID NO: 29141 - DNA, 20 bp, synthetic construct
  misc_feature 1..20: note = CRISPR gRNA sequence
  source 1..20: mol_type = other DNA
ggaccagagccccagtcatc

SEQ ID NO: 29142 - DNA, 20 bp, synthetic construct
  misc_feature 1..20: note = CRISPR gRNA sequence
  source 1..20: mol_type = other DNA
gaccagagccccagtcatcc

SEQ ID NO: 29143 - DNA, 20 bp, synthetic construct
  misc_feature 1..20: note = CRISPR gRNA sequence
  source 1..20: mol_type = other DNA
agcattaccagctcttctta

SEQ ID NO: 29144 - DNA, 20 bp, synthetic construct
  misc_feature 1..20: note = CRISPR gRNA sequence
  source 1..20: mol_type = other DNA
ccagctcttcttactcgcca

SEQ ID NO: 29145 - DNA, 20 bp, synthetic construct
  misc_feature 1..20: note = CRISPR gRNA sequence
  source 1..20: mol_type = other DNA
ttcttactcgccagactgag

SEQ ID NO: 29146 - DNA, 20 bp, synthetic construct
  misc_feature 1..20: note = CRISPR gRNA sequence
  source 1..20: mol_type = other DNA
cttactcgccagactgagag

SEQ ID NO: 29147 - DNA, 20 bp, synthetic construct
  misc_feature 1..20: note = CRISPR gRNA sequence
  source 1..20: mol_type = other DNA
ttactcgccagactgagaga

SEQ ID NO: 29148 - DNA, 20 bp, synthetic construct
  misc_feature 1..20: note = CRISPR gRNA sequence
  source 1..20: mol_type = other DNA
actcgccagactgagagaaa

SEQ ID NO: 29149 - DNA, 20 bp, synthetic construct
  misc_feature 1..20: note = CRISPR gRNA sequence
  source 1..20: mol_type = other DNA
ctcgccagactgagagaaac

SEQ ID NO: 29150 - DNA, 20 bp, synthetic construct
  misc_feature 1..20: note = CRISPR gRNA sequence
  source 1..20: mol_type = other DNA
gccagactgagagaaactgc

SEQ ID NO: 29151 - DNA, 20 bp, synthetic construct
  misc_feature 1..20: note = CRISPR gRNA sequence
  source 1..20: mol_type = other DNA
agagaaactgctctcctctt

SEQ ID NO: 29152 - DNA, 20 bp, synthetic construct
  misc_feature 1..20: note = CRISPR gRNA sequence
  source 1..20: mol_type = other DNA
ctctcctcttcgccagagct

SEQ ID NO: 29153 - DNA, 20 bp, synthetic construct
  misc_feature 1..20: note = CRISPR gRNA sequence
  source 1..20: mol_type = other DNA
tcctcttcgccagagctctt

SEQ ID NO: 29154 - DNA, 20 bp, synthetic construct
  misc_feature 1..20: note = CRISPR gRNA sequence
  source 1..20: mol_type = other DNA
ctcttcgccagagctcttca

SEQ ID NO: 29155 - DNA, 20 bp, synthetic construct
  misc_feature 1..20: note = CRISPR gRNA sequence
  source 1..20: mol_type = other DNA
ttcgccagagctcttcactt

SEQ ID NO: 29156 - DNA, 20 bp, synthetic construct
  misc_feature 1..20: note = CRISPR gRNA sequence
  source 1..20: mol_type = other DNA
cgccagagctcttcacttac

SEQ ID NO: 29157 - DNA, 20 bp, synthetic construct
  misc_feature 1..20: note = CRISPR gRNA sequence
  source 1..20: mol_type = other DNA
gccagagctcttcacttact

SEQ ID NO: 29158 - DNA, 20 bp, synthetic construct
  misc_feature 1..20: note = CRISPR gRNA sequence
  source 1..20: mol_type = other DNA
ttcacttactgaggacaacc

SEQ ID NO: 29159 - DNA, 20 bp, synthetic construct
  misc_feature 1..20: note = CRISPR gRNA sequence
  source 1..20: mol_type = other DNA
cacttactgaggacaaccag

SEQ ID NO: 29160 - DNA, 20 bp, synthetic construct
  misc_feature 1..20: note = CRISPR gRNA sequence
  source 1..20: mol_type = other DNA
acttactgaggacaaccaga

SEQ ID NO: 29161 - DNA, 20 bp, synthetic construct
  misc_feature 1..20: note = CRISPR gRNA sequence
  source 1..20: mol_type = other DNA
actgaggacaaccagagtca

SEQ ID NO: 29162 - DNA, 20 bp, synthetic construct
  misc_feature 1..20: note = CRISPR gRNA sequence
  source 1..20: mol_type = other DNA
ctgaggacaaccagagtcag

SEQ ID NO: 29163 - DNA, 20 bp, synthetic construct
  misc_feature 1..20: note = CRISPR gRNA sequence
  source 1..20: mol_type = other DNA
aggacaaccagagtcagatt

SEQ ID NO: 29164 - DNA, 20 bp, synthetic construct
  misc_feature 1..20: note = CRISPR gRNA sequence
  source 1..20: mol_type = other DNA
ccaggaaagatggcatttgg

SEQ ID NO: 29165 - DNA, 20 bp, synthetic construct
  misc_feature 1..20: note = CRISPR gRNA sequence
  source 1..20: mol_type = other DNA
ggtcccttattatttattta

SEQ ID NO: 29166 - DNA, 20 bp, synthetic construct
  misc_feature 1..20: note = CRISPR gRNA sequence
  source 1..20: mol_type = other DNA
gtcccttattatttatttat

SEQ ID NO: 29167 - DNA, 20 bp, synthetic construct
  misc_feature 1..20: note = CRISPR gRNA sequence
  source 1..20: mol_type = other DNA
attatttatttatttttaat

SEQ ID NO: 29168 - DNA, 20 bp, synthetic construct
  misc_feature 1..20: note = CRISPR gRNA sequence
  source 1..20: mol_type = other DNA
ttatttatttatttttaatt

SEQ ID NO: 29169 - DNA, 20 bp, synthetic construct
  misc_feature 1..20: note = CRISPR gRNA sequence
  source 1..20: mol_type = other DNA
tttatttatttttaattttt

SEQ ID NO: 29170 - DNA, 20 bp, synthetic construct
  misc_feature 1..20: note = CRISPR gRNA sequence
  source 1..20: mol_type = other DNA
atttatttttaattttttta

SEQ ID NO: 29171 - DNA, 20 bp, synthetic construct
  misc_feature 1..20: note = CRISPR gRNA sequence
  source 1..20: mol_type = other DNA
tttatttttaatttttttaa

SEQ ID NO: 29172 - DNA, 20 bp, synthetic construct
  misc_feature 1..20: note = CRISPR gRNA sequence
  source 1..20: mol_type = other DNA
atttttaatttttttaattt

SEQ ID NO: 29173 - DNA, 20 bp, synthetic construct
  misc_feature 1..20: note = CRISPR gRNA sequence
  source 1..20: mol_type = other DNA
tttttaatttttttaatttc

SEQ ID NO: 29174 - DNA, 20 bp, synthetic construct
  misc_feature 1..20: note = CRISPR gRNA sequence
  source 1..20: mol_type = other DNA
ttaatttttttaatttctgt

SEQ ID NO: 29175 - DNA, 20 bp, synthetic construct
  misc_feature 1..20: note = CRISPR gRNA sequence
  source 1..20: mol_type = other DNA
taatttttttaatttctgtt

SEQ ID NO: 29176 - DNA, 20 bp, synthetic construct
  misc_feature 1..20: note = CRISPR gRNA sequence
  source 1..20: mol_type = other DNA
aatttttttaatttctgttt

SEQ ID NO: 29177 - DNA, 20 bp, synthetic construct
  misc_feature 1..20: note = CRISPR gRNA sequence
  source 1..20: mol_type = other DNA
atttttttaatttctgtttt

SEQ ID NO: 29178 - DNA, 20 bp, synthetic construct
  misc_feature 1..20: note = CRISPR gRNA sequence
  source 1..20: mol_type = other DNA
ttttaatttctgtttttgag

SEQ ID NO: 29179 - DNA, 20 bp, synthetic construct
  misc_feature 1..20: note = CRISPR gRNA sequence
  source 1..20: mol_type = other DNA
tttaatttctgtttttgaga

SEQ ID NO: 29180 - DNA, 20 bp, synthetic construct
  misc_feature 1..20: note = CRISPR gRNA sequence
  source 1..20: mol_type = other DNA
ttaatttctgtttttgagat

SEQ ID NO: 29181 - DNA, 20 bp, synthetic construct
  misc_feature 1..20: note = CRISPR gRNA sequence
  source 1..20: mol_type = other DNA
taatttctgtttttgagatg

SEQ ID NO: 29182 - DNA, 20 bp, synthetic construct
  misc_feature 1..20: note = CRISPR gRNA sequence
  source 1..20: mol_type = other DNA
aatttctgtttttgagatgg

SEQ ID NO: 29183 - DNA, 20 bp, synthetic construct
  misc_feature 1..20: note = CRISPR gRNA sequence
  source 1..20: mol_type = other DNA
atttctgtttttgagatgga

SEQ ID NO: 29184 - DNA, 20 bp, synthetic construct
  misc_feature 1..20: note = CRISPR gRNA sequence
  source 1..20: mol_type = other DNA
ctgtttttgagatggagtct

SEQ ID NO: 29185 - DNA, 20 bp, synthetic construct
  misc_feature 1..20: note = CRISPR gRNA sequence
  source 1..20: mol_type = other DNA
tgtttttgagatggagtctc

SEQ ID NO: 29186 - DNA, 20 bp, synthetic construct
  misc_feature 1..20: note = CRISPR gRNA sequence
  source 1..20: mol_type = other DNA
tttttgagatggagtctcgc

SEQ ID NO: 29187 - DNA, 20 bp, synthetic construct
  misc_feature 1..20: note = CRISPR gRNA sequence
  source 1..20: mol_type = other DNA
ttgagatggagtctcgctct

SEQ ID NO: 29188 - DNA, 20 bp, synthetic construct
  misc_feature 1..20: note = CRISPR gRNA sequence
  source 1..20: mol_type = other DNA
tgagatggagtctcgctctg

SEQ ID NO: 29189 - DNA, 20 bp, synthetic construct
  misc_feature 1..20: note = CRISPR gRNA sequence
  source 1..20: mol_type = other DNA
gagatggagtctcgctctgt

SEQ ID NO: 29190 - DNA, 20 bp, synthetic construct
  misc_feature 1..20: note = CRISPR gRNA sequence
  source 1..20: mol_type = other DNA
agatggagtctcgctctgtc

SEQ ID NO: 29191 - DNA, 20 bp, synthetic construct
  misc_feature 1..20: note = CRISPR gRNA sequence
  source 1..20: mol_type = other DNA
gctctgtcacccaggctgga

SEQ ID NO: 29192 - DNA, 20 bp, synthetic construct
  misc_feature 1..20: note = CRISPR gRNA sequence
  source 1..20: mol_type = other DNA
tgtcacccaggctggagtga

SEQ ID NO: 29193 - DNA, 20 bp, synthetic construct
  misc_feature 1..20: note = CRISPR gRNA sequence
  source 1..20: mol_type = other DNA
tcacccaggctggagtgaag

SEQ ID NO: 29194 - DNA, 20 bp, synthetic construct
  misc_feature 1..20: note = CRISPR gRNA sequence
  source 1..20: mol_type = other DNA
gagtgaagtggtgtgatctc

SEQ ID NO: 29195 - DNA, 20 bp, synthetic construct
  misc_feature 1..20: note = CRISPR gRNA sequence
  source 1..20: mol_type = other DNA
agctcactgcaacttctgcc

SEQ ID NO: 29196 - DNA, 20 bp, synthetic construct
  misc_feature 1..20: note = CRISPR gRNA sequence
  source 1..20: mol_type = other DNA
actgcaacttctgccccccc

SEQ ID NO: 29197 - DNA, 20 bp, synthetic construct
  misc_feature 1..20: note = CRISPR gRNA sequence
  source 1..20: mol_type = other DNA
caacttctgcccccccccag

SEQ ID NO: 29198 - DNA, 20 bp, synthetic construct
  misc_feature 1..20: note = CRISPR gRNA sequence
  source 1..20: mol_type = other DNA
ctgcccccccccaggttcaa

SEQ ID NO: 29199 - DNA, 20 bp, synthetic construct
  misc_feature 1..20: note = CRISPR gRNA sequence
  source 1..20: mol_type = other DNA
tgcccccccccaggttcaag

SEQ ID NO: 29200 - DNA, 20 bp, synthetic construct
  misc_feature 1..20: note = CRISPR gRNA sequence
  source 1..20: mol_type = other DNA
cccccccccaggttcaagct

SEQ ID NO: 29201 - DNA, 20 bp, synthetic construct
  misc_feature 1..20: note = CRISPR gRNA sequence
  source 1..20: mol_type = other DNA
aagctattcgcctgcctcag

SEQ ID NO: 29202 - DNA, 20 bp, synthetic construct
  misc_feature 1..20: note = CRISPR gRNA sequence
  source 1..20: mol_type = other DNA
ttcgcctgcctcagtgctcc

SEQ ID NO: 29203 - DNA, 20 bp, synthetic construct
  misc_feature 1..20: note = CRISPR gRNA sequence
  source 1..20: mol_type = other DNA
gcctgcctcagtgctccgag

SEQ ID NO: 29204 - DNA, 20 bp, synthetic construct
  misc_feature 1..20: note = CRISPR gRNA sequence
  source 1..20: mol_type = other DNA
cctcagtgctccgagtagct

SEQ ID NO: 29205 - DNA, 20 bp, synthetic construct
  misc_feature 1..20: note = CRISPR gRNA sequence
  source 1..20: mol_type = other DNA
agtgctccgagtagctggga

SEQ ID NO: 29206 - DNA, 20 bp, synthetic construct
  misc_feature 1..20: note = CRISPR gRNA sequence
  source 1..20: mol_type = other DNA
cgagtagctgggattatagg

SEQ ID NO: 29207 - DNA, 20 bp, synthetic construct
  misc_feature 1..20: note = CRISPR gRNA sequence
  source 1..20: mol_type = other DNA
ggattataggcgcccaccac

SEQ ID NO: 29208 - DNA, 20 bp, synthetic construct
  misc_feature 1..20: note = CRISPR gRNA sequence
  source 1..20: mol_type = other DNA
taggcgcccaccaccacgtc

SEQ ID NO: 29209 - DNA, 20 bp, synthetic construct
  misc_feature 1..20: note = CRISPR gRNA sequence
  source 1..20: mol_type = other DNA
gtttttatatttttagtaga

SEQ ID NO: 29210 - DNA, 20 bp, synthetic construct
  misc_feature 1..20: note = CRISPR gRNA sequence
  source 1..20: mol_type = other DNA
ttatatttttagtagagaca

SEQ ID NO: 29211 - DNA, 20 bp, synthetic construct
  misc_feature 1..20: note = CRISPR gRNA sequence
  source 1..20: mol_type = other DNA
tatatttttagtagagacag

SEQ ID NO: 29212 - DNA, 20 bp, synthetic construct
  misc_feature 1..20: note = CRISPR gRNA sequence
  source 1..20: mol_type = other DNA
atatttttagtagagacagg

SEQ ID NO: 29213 - DNA, 20 bp, synthetic construct
  misc_feature 1..20: note = CRISPR gRNA sequence
  source 1..20: mol_type = other DNA
tatttttagtagagacaggg

SEQ ID NO: 29214 - DNA, 20 bp, synthetic construct
  misc_feature 1..20: note = CRISPR gRNA sequence
  source 1..20: mol_type = other DNA
ttagtagagacagggtttcg

SEQ ID NO: 29215 - DNA, 20 bp, synthetic construct
  misc_feature 1..20: note = CRISPR gRNA sequence
  source 1..20: mol_type = other DNA
tagtagagacagggtttcgc

SEQ ID NO: 29216 - DNA, 20 bp, synthetic construct
  misc_feature 1..20: note = CRISPR gRNA sequence
  source 1..20: mol_type = other DNA
agtagagacagggtttcgcc

SEQ ID NO: 29217 - DNA, 20 bp, synthetic construct
  misc_feature 1..20: note = CRISPR gRNA sequence
  source 1..20: mol_type = other DNA
gtagagacagggtttcgcca

SEQ ID NO: 29218 - DNA, 20 bp, synthetic construct
  misc_feature 1..20: note = CRISPR gRNA sequence
  source 1..20: mol_type = other DNA
cgccatgttggccaggctgg

SEQ ID NO: 29219 - DNA, 20 bp, synthetic construct
  misc_feature 1..20: note = CRISPR gRNA sequence
  source 1..20: mol_type = other DNA
gccatgttggccaggctggt

SEQ ID NO: 29220 - DNA, 20 bp, synthetic construct
  misc_feature 1..20: note = CRISPR gRNA sequence
  source 1..20: mol_type = other DNA
gccaggctggtctcaaactc

SEQ ID NO: 29221 - DNA, 20 bp, synthetic construct
  misc_feature 1..20: note = CRISPR gRNA sequence
  source 1..20: mol_type = other DNA
gtctcaaactcctgatctca

SEQ ID NO: 29222 - DNA, 20 bp, synthetic construct
  misc_feature 1..20: note = CRISPR gRNA sequence
  source 1..20: mol_type = other DNA
aaactcctgatctcaggtga

SEQ ID NO: 29223 - DNA, 20 bp, synthetic construct
  misc_feature 1..20: note = CRISPR gRNA sequence
  source 1..20: mol_type = other DNA
ctgatctcaggtgatccacc

SEQ ID NO: 29224 - DNA, 20 bp, synthetic construct
  misc_feature 1..20: note = CRISPR gRNA sequence
  source 1..20: mol_type = other DNA
atctcaggtgatccacctgc

SEQ ID NO: 29225 - DNA, 20 bp, synthetic construct
  misc_feature 1..20: note = CRISPR gRNA sequence
  source 1..20: mol_type = other DNA
aggtgatccacctgcctcgg

SEQ ID NO: 29226 - DNA, 20 bp, synthetic construct
  misc_feature 1..20: note = CRISPR gRNA sequence
  source 1..20: mol_type = other DNA
cctcggcctcccaaagtgag

SEQ ID NO: 29227 - DNA, 20 bp, synthetic construct
  misc_feature 1..20: note = CRISPR gRNA sequence
  source 1..20: mol_type = other DNA
ggcctcccaaagtgagtact

SEQ ID NO: 29228 - DNA, 20 bp, synthetic construct
  misc_feature 1..20: note = CRISPR gRNA sequence
  source 1..20: mol_type = other DNA
ccaaagtgagtactaggatt

SEQ ID NO: 29229 - DNA, 20 bp, synthetic construct
  misc_feature 1..20: note = CRISPR gRNA sequence
  source 1..20: mol_type = other DNA
ggattacaggcgtgagccac

SEQ ID NO: 29230 - DNA, 20 bp, synthetic construct
  misc_feature 1..20: note = CRISPR gRNA sequence
  source 1..20: mol_type = other DNA
caggcgtgagccaccatgcc

SEQ ID NO: 29231 - DNA, 20 bp, synthetic construct
  misc_feature 1..20: note = CRISPR gRNA sequence
  source 1..20: mol_type = other DNA
atttatttatttatttattt

SEQ ID NO: 29232 - DNA, 20 bp, synthetic construct
  misc_feature 1..20: note = CRISPR gRNA sequence
  source 1..20: mol_type = other DNA
tttatttatttatttattta

SEQ ID NO: 29233 - DNA, 20 bp, synthetic construct
  misc_feature 1..20: note = CRISPR gRNA sequence
  source 1..20: mol_type = other DNA
atttatttatttatttattt

SEQ ID NO: 29234 - DNA, 20 bp, synthetic construct
  misc_feature 1..20: note = CRISPR gRNA sequence
  source 1..20: mol_type = other DNA
tttatttatttatttattta

SEQ ID NO: 29235 - DNA, 20 bp, synthetic construct
  misc_feature 1..20: note = CRISPR gRNA sequence
  source 1..20: mol_type = other DNA
atttatttatttatttattt

SEQ ID NO: 29236 - DNA, 20 bp, synthetic construct
  misc_feature 1..20: note = CRISPR gRNA sequence
  source 1..20: mol_type = other DNA
tttatttatttatttatttg

SEQ ID NO: 29237 - DNA, 20 bp, synthetic construct
  misc_feature 1..20: note = CRISPR gRNA sequence
  source 1..20: mol_type = other DNA
atttatttatttatttggag

SEQ ID NO: 29238 - DNA, 20 bp, synthetic construct
  misc_feature 1..20: note = CRISPR gRNA sequence
  source 1..20: mol_type = other DNA
tttatttatttatttggaga

SEQ ID NO: 29239 - DNA, 20 bp, synthetic construct
  misc_feature 1..20: note = CRISPR gRNA sequence
  source 1..20: mol_type = other DNA
atttatttatttggagatgg

SEQ ID NO: 29240 - DNA, 20 bp, synthetic construct
  misc_feature 1..20: note = CRISPR gRNA sequence
  source 1..20: mol_type = other DNA
tttatttatttggagatggg

SEQ ID NO: 29241 - DNA, 20 bp, synthetic construct
  misc_feature 1..20: note = CRISPR gRNA sequence
  source 1..20: mol_type = other DNA
atttatttggagatggggtc

SEQ ID NO: 29242 - DNA, 20 bp, synthetic construct
  misc_feature 1..20: note = CRISPR gRNA sequence
  source 1..20: mol_type = other DNA
tttatttggagatggggtct

SEQ ID NO: 29243 - DNA, 20 bp, synthetic construct
  misc_feature 1..20: note = CRISPR gRNA sequence
  source 1..20: mol_type = other DNA
atttggagatggggtctcac

SEQ ID NO: 29244 - DNA, 20 bp, synthetic construct
  misc_feature 1..20: note = CRISPR gRNA sequence
  source 1..20: mol_type = other DNA
tttggagatggggtctcacc

SEQ ID NO: 29245 - DNA, 20 bp, synthetic construct
  misc_feature 1..20: note = CRISPR gRNA sequence
  source 1..20: mol_type = other DNA
ggagatggggtctcacccag

SEQ ID NO: 29246 - DNA, 20 bp, synthetic construct
  misc_feature 1..20: note = CRISPR gRNA sequence
  source 1..20: mol_type = other DNA
gagatggggtctcacccagg

SEQ ID NO: 29247 - DNA, 20 bp, synthetic construct
  misc_feature 1..20: note = CRISPR gRNA sequence
  source 1..20: mol_type = other DNA
acccaggttgtagtgcaggg

SEQ ID NO: 29248 - DNA, 20 bp, synthetic construct
  misc_feature 1..20: note = CRISPR gRNA sequence
  source 1..20: mol_type = other DNA
tagtgcaggggtgcaatgat

SEQ ID NO: 29249 - DNA, 20 bp, synthetic construct
  misc_feature 1..20: note = CRISPR gRNA sequence
  source 1..20: mol_type = other DNA
actacagcctcgactacctg

SEQ ID NO: 29250 - DNA, 20 bp, synthetic construct
  misc_feature 1..20: note = CRISPR gRNA sequence
  source 1..20: mol_type = other DNA
cagcctcgactacctggact

SEQ ID NO: 29251 - DNA, 20 bp, synthetic construct
  misc_feature 1..20: note = CRISPR gRNA sequence
  source 1..20: mol_type = other DNA
gactacctggactgaagcga

SEQ ID NO: 29252 - DNA, 20 bp, synthetic construct
  misc_feature 1..20: note = CRISPR gRNA sequence
  source 1..20: mol_type = other DNA
cctggactgaagcgaacctc

SEQ ID NO: 29253 - DNA, 20 bp, synthetic construct
  misc_feature 1..20: note = CRISPR gRNA sequence
  source 1..20: mol_type = other DNA
gactgaagcgaacctcccac

SEQ ID NO: 29254 - DNA, 20 bp, synthetic construct
  misc_feature 1..20: note = CRISPR gRNA sequence
  source 1..20: mol_type = other DNA
aagcgaacctcccacctcag

SEQ ID NO: 29255 - DNA, 20 bp, synthetic construct
  misc_feature 1..20: note = CRISPR gRNA sequence
  source 1..20: mol_type = other DNA
ccacctcagccttccaagta

SEQ ID NO: 29256 - DNA, 20 bp, synthetic construct
  misc_feature 1..20: note = CRISPR gRNA sequence
  source 1..20: mol_type = other DNA
agccttccaagtagctgggt

SEQ ID NO: 29257 - DNA, 20 bp, synthetic construct
  misc_feature 1..20: note = CRISPR gRNA sequence
  source 1..20: mol_type = other DNA
ccaagtagctgggtcctata

SEQ ID NO: 29258 - DNA, 20 bp, synthetic construct
  misc_feature 1..20: note = CRISPR gRNA sequence
  source 1..20: mol_type = other DNA
caagtagctgggtcctatac

SEQ ID NO: 29259 - DNA, 20 bp, synthetic construct
  misc_feature 1..20: note = CRISPR gRNA sequence
  source 1..20: mol_type = other DNA
ggtcctataccctcctgagc

SEQ ID NO: 29260 - DNA, 20 bp, synthetic construct
  misc_feature 1..20: note = CRISPR gRNA sequence
  source 1..20: mol_type = other DNA
taccctcctgagccttgtta

SEQ ID NO: 29261 - DNA, 20 bp, synthetic construct
  misc_feature 1..20: note = CRISPR gRNA sequence
  source 1..20: mol_type = other DNA
ctgagccttgttaatttctt

SEQ ID NO: 29262 - DNA, 20 bp, synthetic construct
  misc_feature 1..20: note = CRISPR gRNA sequence
  source 1..20: mol_type = other DNA
agccttgttaatttcttccc

SEQ ID NO: 29263 - DNA, 20 bp, synthetic construct
  misc_feature 1..20: note = CRISPR gRNA sequence
  source 1..20: mol_type = other DNA
gttaatttcttcccagcatg

SEQ ID NO: 29264 - DNA, 20 bp, synthetic construct
  misc_feature 1..20: note = CRISPR gRNA sequence
  source 1..20: mol_type = other DNA
ttaatttcttcccagcatga

SEQ ID NO: 29265 - DNA, 20 bp, synthetic construct
  misc_feature 1..20: note = CRISPR gRNA sequence
  source 1..20: mol_type = other DNA
atttcttcccagcatgatca

SEQ ID NO: 29266 - DNA, 20 bp, synthetic construct
  misc_feature 1..20: note = CRISPR gRNA sequence
  source 1..20: mol_type = other DNA
cttcccagcatgatcactgt

SEQ ID NO: 29267 - DNA, 20 bp, synthetic construct
  misc_feature 1..20: note = CRISPR gRNA sequence
  source 1..20: mol_type = other DNA
ttcccagcatgatcactgtt

SEQ ID NO: 29268 - DNA, 20 bp, synthetic construct
  misc_feature 1..20: note = CRISPR gRNA sequence
  source 1..20: mol_type = other DNA
cccagcatgatcactgtttt

SEQ ID NO: 29269 - DNA, 20 bp, synthetic construct
  misc_feature 1..20: note = CRISPR gRNA sequence
  source 1..20: mol_type = other DNA
ccagcatgatcactgtttta

SEQ ID NO: 29270 - DNA, 20 bp, synthetic construct
  misc_feature 1..20: note = CRISPR gRNA sequence
  source 1..20: mol_type = other DNA
ttttacaatattttatttat

SEQ ID NO: 29271 - DNA, 20 bp, synthetic construct
  misc_feature 1..20: note = CRISPR gRNA sequence
  source 1..20: mol_type = other DNA
tacaatattttatttatgta

SEQ ID NO: 29272 - DNA, 20 bp, synthetic construct
  misc_feature 1..20: note = CRISPR gRNA sequence
  source 1..20: mol_type = other DNA
acaatattttatttatgtag

SEQ ID NO: 29273 - DNA, 20 bp, synthetic construct
  misc_feature 1..20: note = CRISPR gRNA sequence
  source 1..20: mol_type = other DNA
caatattttatttatgtagg

SEQ ID NO: 29274 - DNA, 20 bp, synthetic construct
  misc_feature 1..20: note = CRISPR gRNA sequence
  source 1..20: mol_type = other DNA
tatttatgtaggtgcttact

SEQ ID NO: 29275 - DNA, 20 bp, synthetic construct
  misc_feature 1..20: note = CRISPR gRNA sequence
  source 1..20: mol_type = other DNA
atttatgtaggtgcttactt

SEQ ID NO: 29276 - DNA, 20 bp, synthetic construct
  misc_feature 1..20: note = CRISPR gRNA sequence
  source 1..20: mol_type = other DNA
tttatgtaggtgcttacttc

SEQ ID NO: 29277 - DNA, 20 bp, synthetic construct
  misc_feature 1..20: note = CRISPR gRNA sequence
  source 1..20: mol_type = other DNA
atgtaggtgcttacttcttg

SEQ ID NO: 29278 - DNA, 20 bp, synthetic construct
  misc_feature 1..20: note = CRISPR gRNA sequence
  source 1..20: mol_type = other DNA
tgtaggtgcttacttcttgc

SEQ ID NO: 29279 - DNA, 20 bp, synthetic construct
  misc_feature 1..20: note = CRISPR gRNA sequence
  source 1..20: mol_type = other DNA
acttcttgctatgcaaagaa

SEQ ID NO: 29280 - DNA, 20 bp, synthetic construct
  misc_feature 1..20: note = CRISPR gRNA sequence
  source 1..20: mol_type = other DNA
cttcttgctatgcaaagaaa

SEQ ID NO: 29281 - DNA, 20 bp, synthetic construct
  misc_feature 1..20: note = CRISPR gRNA sequence
  source 1..20: mol_type = other DNA
cttgctatgcaaagaaactc

SEQ ID NO: 29282 - DNA, 20 bp, synthetic construct
  misc_feature 1..20: note = CRISPR gRNA sequence
  source 1..20: mol_type = other DNA
ttgctatgcaaagaaactca

SEQ ID NO: 29283 - DNA, 20 bp, synthetic construct
  misc_feature 1..20: note = CRISPR gRNA sequence
  source 1..20: mol_type = other DNA
gctatgcaaagaaactcaga

SEQ ID NO: 29284 - DNA, 20 bp, synthetic construct
  misc_feature 1..20: note = CRISPR gRNA sequence
  source 1..20: mol_type = other DNA
ctatgcaaagaaactcagaa

SEQ ID NO: 29285 - DNA, 20 bp, synthetic construct
  misc_feature 1..20: note = CRISPR gRNA sequence
  source 1..20: mol_type = other DNA
tgcaaagaaactcagaagca

SEQ ID NO: 29286 - DNA, 20 bp, synthetic construct
  misc_feature 1..20: note = CRISPR gRNA sequence
  source 1..20: mol_type = other DNA
agaagcaaaaatagaatctg

SEQ ID NO: 29287 - DNA, 20 bp, synthetic construct
  misc_feature 1..20: note = CRISPR gRNA sequence
  source 1..20: mol_type = other DNA
tctggttcataattgtgcta

SEQ ID NO: 29288 - DNA, 20 bp, synthetic construct
  misc_feature 1..20: note = CRISPR gRNA sequence
  source 1..20: mol_type = other DNA
gttcataattgtgctaaaaa

SEQ ID NO: 29289 - DNA, 20 bp, synthetic construct
  misc_feature 1..20: note = CRISPR gRNA sequence
  source 1..20: mol_type = other DNA
ataattgtgctaaaaactag

SEQ ID NO: 29290 - DNA, 20 bp, synthetic construct
  misc_feature 1..20: note = CRISPR gRNA sequence
  source 1..20: mol_type = other DNA
tgctaaaaactagagataca

SEQ ID NO: 29291 - DNA, 20 bp, synthetic construct
  misc_feature 1..20: note = CRISPR gRNA sequence
  source 1..20: mol_type = other DNA
aaaactagagatacaagtat

SEQ ID NO: 29292 - DNA, 20 bp, synthetic construct
  misc_feature 1..20: note = CRISPR gRNA sequence
  source 1..20: mol_type = other DNA
gagatacaagtatgaactag

SEQ ID NO: 29293 - DNA, 20 bp, synthetic construct
  misc_feature 1..20: note = CRISPR gRNA sequence
  source 1..20: mol_type = other DNA
gacagatgtcgttcttgctt

SEQ ID NO: 29294 - DNA, 20 bp, synthetic construct
  misc_feature 1..20: note = CRISPR gRNA sequence
  source 1..20: mol_type = other DNA
ttgcttttgagtttctttgc

SEQ ID NO: 29295 - DNA, 20 bp, synthetic construct
  misc_feature 1..20: note = CRISPR gRNA sequence
  source 1..20: mol_type = other DNA
gcttttgagtttctttgcgt

SEQ ID NO: 29296 - DNA, 20 bp, synthetic construct
  misc_feature 1..20: note = CRISPR gRNA sequence
  source 1..20: mol_type = other DNA
cttttgagtttctttgcgta

SEQ ID NO: 29297 - DNA, 20 bp, synthetic construct
  misc_feature 1..20: note = CRISPR gRNA sequence
  source 1..20: mol_type = other DNA
ttgagtttctttgcgtagta

SEQ ID NO: 29298 - DNA, 20 bp, synthetic construct
  misc_feature 1..20: note = CRISPR gRNA sequence
  source 1..20: mol_type = other DNA
tgagtttctttgcgtagtag

SEQ ID NO: 29299 - DNA, 20 bp, synthetic construct
  misc_feature 1..20: note = CRISPR gRNA sequence
  source 1..20: mol_type = other DNA
gagtttctttgcgtagtagg

SEQ ID NO: 29300 - DNA, 20 bp, synthetic construct
  misc_feature 1..20: note = CRISPR gRNA sequence
  source 1..20: mol_type = other DNA
agtttctttgcgtagtagga

SEQ ID NO: 29301 - DNA, 20 bp, synthetic construct
  misc_feature 1..20: note = CRISPR gRNA sequence
  source 1..20: mol_type = other DNA
ctttgcgtagtaggaattag

SEQ ID NO: 29302 - DNA, 20 bp, synthetic construct
  misc_feature 1..20: note = CRISPR gRNA sequence
  source 1..20: mol_type = other DNA
tttgcgtagtaggaattagg

SEQ ID NO: 29303 - DNA, 20 bp, synthetic construct
  misc_feature 1..20: note = CRISPR gRNA sequence
  source 1..20: mol_type = other DNA
tgcgtagtaggaattaggca

SEQ ID NO: 29304 - DNA, 20 bp, synthetic construct
  misc_feature 1..20: note = CRISPR gRNA sequence
  source 1..20: mol_type = other DNA
gcgtagtaggaattaggcac

SEQ ID NO: 29305 - DNA, 20 bp, synthetic construct
  misc_feature 1..20: note = CRISPR gRNA sequence
  source 1..20: mol_type = other DNA
cgtagtaggaattaggcaca

SEQ ID NO: 29306 - DNA, 20 bp, synthetic construct
  misc_feature 1..20: note = CRISPR gRNA sequence
  source 1..20: mol_type = other DNA
ggcacatacataaataaaat

SEQ ID NO: 29307 - DNA, 20 bp, synthetic construct
  misc_feature 1..20: note = CRISPR gRNA sequence
  source 1..20: mol_type = other DNA
taaaacagtgattcatgctg

SEQ ID NO: 29308 - DNA, 20 bp, synthetic construct
  misc_feature 1..20: note = CRISPR gRNA sequence
  source 1..20: mol_type = other DNA
atgctgggaaggaaactaac

SEQ ID NO: 29309 - DNA, 20 bp, synthetic construct
  misc_feature 1..20: note = CRISPR gRNA sequence
  source 1..20: mol_type = other DNA
ggaaggaaactaacaagccc

SEQ ID NO: 29310 - DNA, 20 bp, synthetic construct
  misc_feature 1..20: note = CRISPR gRNA sequence
  source 1..20: mol_type = other DNA
acaagccccaggagggtaca

SEQ ID NO: 29311 - DNA, 20 bp, synthetic construct
  misc_feature 1..20: note = CRISPR gRNA sequence
  source 1..20: mol_type = other DNA
ctggggagatgattcttccg

SEQ ID NO: 29312 - DNA, 20 bp, synthetic construct
  misc_feature 1..20: note = CRISPR gRNA sequence
  source 1..20: mol_type = other DNA
tggggagatgattcttccgt

SEQ ID NO: 29313 - DNA, 20 bp, synthetic construct
  misc_feature 1..20: note = CRISPR gRNA sequence
  source 1..20: mol_type = other DNA
gggagatgattcttccgtgg

SEQ ID NO: 29314 - DNA, 20 bp, synthetic construct
  misc_feature 1..20: note = CRISPR gRNA sequence
  source 1..20: mol_type = other DNA
ttccgtgggaagctctaggg

SEQ ID NO: 29315 - DNA, 20 bp, synthetic construct
  misc_feature 1..20: note = CRISPR gRNA sequence
  source 1..20: mol_type = other DNA
ccgtgggaagctctagggga

SEQ ID NO: 29316 - DNA, 20 bp, synthetic construct
  misc_feature 1..20: note = CRISPR gRNA sequence
  source 1..20: mol_type = other DNA
cgtgggaagctctaggggaa

SEQ ID NO: 29317 - DNA, 20 bp, synthetic construct
  misc_feature 1..20: note = CRISPR gRNA sequence
  source 1..20: mol_type = other DNA
taggggaaaaggactctagg

SEQ ID NO: 29318 - DNA, 20 bp, synthetic construct
  misc_feature 1..20: note = CRISPR gRNA sequence
  source 1..20: mol_type = other DNA
ggggaaaaggactctaggaa

SEQ ID NO: 29319 - DNA, 20 bp, synthetic construct
  misc_feature 1..20: note = CRISPR gRNA sequence
  source 1..20: mol_type = other DNA
taggaagaaagaacagcagg

SEQ ID NO: 29320 - DNA, 20 bp, synthetic construct
  misc_feature 1..20: note = CRISPR gRNA sequence
  source 1..20: mol_type = other DNA
ggaagaaagaacagcaggtg

SEQ ID NO: 29321 - DNA, 20 bp, synthetic construct
  misc_feature 1..20: note = CRISPR gRNA sequence
  source 1..20: mol_type = other DNA
agtgggaaaaggggctgtgt

SEQ ID NO: 29322 - DNA, 20 bp, synthetic construct
  misc_feature 1..20: note = CRISPR gRNA sequence
  source 1..20: mol_type = other DNA
tgttttaagggtcagaaggg

SEQ ID NO: 29323 - DNA, 20 bp, synthetic construct
  misc_feature 1..20: note = CRISPR gRNA sequence
  source 1..20: mol_type = other DNA
taagggtcagaagggccact

SEQ ID NO: 29324 - DNA, 20 bp, synthetic construct
  misc_feature 1..20: note = CRISPR gRNA sequence
  source 1..20: mol_type = other DNA
aagggtcagaagggccactg

SEQ ID NO: 29325 - DNA, 20 bp, synthetic construct
  misc_feature 1..20: note = CRISPR gRNA sequence
  source 1..20: mol_type = other DNA
agggtcagaagggccactgt

SEQ ID NO: 29326 - DNA, 20 bp, synthetic construct
  misc_feature 1..20: note = CRISPR gRNA sequence
  source 1..20: mol_type = other DNA
tggctgtgtgtagtgaatga

SEQ ID NO: 29327 - DNA, 20 bp, synthetic construct
  misc_feature 1..20: note = CRISPR gRNA sequence
  source 1..20: mol_type = other DNA
tgtgtagtgaatgagggaca

SEQ ID NO: 29328 - DNA, 20 bp, synthetic construct
  misc_feature 1..20: note = CRISPR gRNA sequence
  source 1..20: mol_type = other DNA
ggcaatggtggaagtagggg

SEQ ID NO: 29329 - DNA, 20 bp, synthetic construct
  misc_feature 1..20: note = CRISPR gRNA sequence
  source 1..20: mol_type = other DNA
gtgggtcacaagaggtattt

SEQ ID NO: 29330 - DNA, 20 bp, synthetic construct
  misc_feature 1..20: note = CRISPR gRNA sequence
  source 1..20: mol_type = other DNA
tgggtcacaagaggtatttg

SEQ ID NO: 29331 - DNA, 20 bp, synthetic construct
  misc_feature 1..20: note = CRISPR gRNA sequence
  source 1..20: mol_type = other DNA
gcagtttttcagtgtgaatg

SEQ ID NO: 29332 - DNA, 20 bp, synthetic construct
  misc_feature 1..20: note = CRISPR gRNA sequence
  source 1..20: mol_type = other DNA
cagtttttcagtgtgaatgg

SEQ ID NO: 29333 - DNA, 20 bp, synthetic construct
  misc_feature 1..20: note = CRISPR gRNA sequence
  source 1..20: mol_type = other DNA
ttcagtgtgaatggaaaagt

SEQ ID NO: 29334 - DNA, 20 bp, synthetic construct
  misc_feature 1..20: note = CRISPR gRNA sequence
  source 1..20: mol_type = other DNA
tcagtgtgaatggaaaagta

SEQ ID NO: 29335 - DNA, 20 bp, synthetic construct
  misc_feature 1..20: note = CRISPR gRNA sequence
  source 1..20: mol_type = other DNA
cagtgtgaatggaaaagtag

SEQ ID NO: 29336 - DNA, 20 bp, synthetic construct
  misc_feature 1..20: note = CRISPR gRNA sequence
  source 1..20: mol_type = other DNA
agtgtgaatggaaaagtagg

SEQ ID NO: 29337 - DNA, 20 bp, synthetic construct
  misc_feature 1..20: note = CRISPR gRNA sequence
  source 1..20: mol_type = other DNA
ggaaggcgacacttgatctg

SEQ ID NO: 29338 - DNA, 20 bp, synthetic construct
  misc_feature 1..20: note = CRISPR gRNA sequence
  source 1..20: mol_type = other DNA
gatctgatttacacttttct

SEQ ID NO: 29339 - DNA, 20 bp, synthetic construct
  misc_feature 1..20: note = CRISPR gRNA sequence
  source 1..20: mol_type = other DNA
atctgatttacacttttctt

SEQ ID NO: 29340 - DNA, 20 bp, synthetic construct
  misc_feature 1..20: note = CRISPR gRNA sequence
  source 1..20: mol_type = other DNA
atttacacttttcttttttc

SEQ ID NO: 29341 - DNA, 20 bp, synthetic construct
  misc_feature 1..20: note = CRISPR gRNA sequence
  source 1..20: mol_type = other DNA
acacttttcttttttctttt

SEQ ID NO: 29342 - DNA, 20 bp, synthetic construct
  misc_feature 1..20: note = CRISPR gRNA sequence
  source 1..20: mol_type = other DNA
cacttttcttttttcttttc

SEQ ID NO: 29343 - DNA, 20 bp, synthetic construct
  misc_feature 1..20: note = CRISPR gRNA sequence
  source 1..20: mol_type = other DNA
ttcttttttcttttcttttc

SEQ ID NO: 29344 - DNA, 20 bp, synthetic construct
  misc_feature 1..20: note = CRISPR gRNA sequence
  source 1..20: mol_type = other DNA
tcttttttcttttcttttct

SEQ ID NO: 29345 - DNA, 20 bp, synthetic construct
  misc_feature 1..20: note = CRISPR gRNA sequence
  source 1..20: mol_type = other DNA
cttttttcttttcttttctt

SEQ ID NO: 29346 - DNA, 20 bp, synthetic construct
  misc_feature 1..20: note = CRISPR gRNA sequence
  source 1..20: mol_type = other DNA
ttttttcttttcttttcttt

SEQ ID NO: 29347 - DNA, 20 bp, synthetic construct
  misc_feature 1..20: note = CRISPR gRNA sequence
  source 1..20: mol_type = other DNA
ttttcttttcttttcttttt

SEQ ID NO: 29348 - DNA, 20 bp, synthetic construct
  misc_feature 1..20: note = CRISPR gRNA sequence
  source 1..20: mol_type = other DNA
tttcttttcttttctttttg

SEQ ID NO: 29349 - DNA, 20 bp, synthetic construct
  misc_feature 1..20: note = CRISPR gRNA sequence
  source 1..20: mol_type = other DNA
ttcttttcttttctttttga

SEQ ID NO: 29350 - DNA, 20 bp, synthetic construct
  misc_feature 1..20: note = CRISPR gRNA sequence
  source 1..20: mol_type = other DNA
tcttttcttttctttttgag

SEQ ID NO: 29351 - DNA, 20 bp, synthetic construct
  misc_feature 1..20: note = CRISPR gRNA sequence
  source 1..20: mol_type = other DNA
cttttcttttctttttgaga

SEQ ID NO: 29352 - DNA, 20 bp, synthetic construct
  misc_feature 1..20: note = CRISPR gRNA sequence
  source 1..20: mol_type = other DNA
ttttcttttctttttgagac

SEQ ID NO: 29353 - DNA, 20 bp, synthetic construct
  misc_feature 1..20: note = CRISPR gRNA sequence
  source 1..20: mol_type = other DNA
ttcttttctttttgagacca

SEQ ID NO: 29354 - DNA, 20 bp, synthetic construct
  misc_feature 1..20: note = CRISPR gRNA sequence
  source 1..20: mol_type = other DNA
tcttttctttttgagaccaa

SEQ ID NO: 29355 - DNA, 20 bp, synthetic construct
  misc_feature 1..20: note = CRISPR gRNA sequence
  source 1..20: mol_type = other DNA
cttttctttttgagaccaag

SEQ ID NO: 29356 - DNA, 20 bp, synthetic construct
  misc_feature 1..20: note = CRISPR gRNA sequence
  source 1..20: mol_type = other DNA
ttttctttttgagaccaagt

SEQ ID NO: 29357 - DNA, 20 bp, synthetic construct
  misc_feature 1..20: note = CRISPR gRNA sequence
  source 1..20: mol_type = other DNA
ttctttttgagaccaagtct

SEQ ID NO: 29358 - DNA, 20 bp, synthetic construct
  misc_feature 1..20: note = CRISPR gRNA sequence
  source 1..20: mol_type = other DNA
tctttttgagaccaagtctc

SEQ ID NO: 29359 - DNA, 20 bp, synthetic construct
  misc_feature 1..20: note = CRISPR gRNA sequence
  source 1..20: mol_type = other DNA
ctttttgagaccaagtctca

SEQ ID NO: 29360 - DNA, 20 bp, synthetic construct
  misc_feature 1..20: note = CRISPR gRNA sequence
  source 1..20: mol_type = other DNA
tttttgagaccaagtctcac

SEQ ID NO: 29361 - DNA, 20 bp, synthetic construct
  misc_feature 1..20: note = CRISPR gRNA sequence
  source 1..20: mol_type = other DNA
tttgagaccaagtctcactt

SEQ ID NO: 29362 - DNA, 20 bp, synthetic construct
  misc_feature 1..20: note = CRISPR gRNA sequence
  source 1..20: mol_type = other DNA
ttgagaccaagtctcacttt

SEQ ID NO: 29363 - DNA, 20 bp, synthetic construct
  misc_feature 1..20: note = CRISPR gRNA sequence
  source 1..20: mol_type = other DNA
tgagaccaagtctcacttta

SEQ ID NO: 29364 - DNA, 20 bp, synthetic construct
  misc_feature 1..20: note = CRISPR gRNA sequence
  source 1..20: mol_type = other DNA
gagaccaagtctcactttat

SEQ ID NO: 29365 - DNA, 20 bp, synthetic construct
  misc_feature 1..20: note = CRISPR gRNA sequence
  source 1..20: mol_type = other DNA
agaccaagtctcactttatt

SEQ ID NO: 29366 - DNA, 20 bp, synthetic construct
  misc_feature 1..20: note = CRISPR gRNA sequence
  source 1..20: mol_type = other DNA
actttattgcccaggctaag

SEQ ID NO: 29367 - DNA, 20 bp, synthetic construct
  misc_feature 1..20: note = CRISPR gRNA sequence
  source 1..20: mol_type = other DNA
tattgcccaggctaaggtgc

SEQ ID NO: 29368 - DNA, 20 bp, synthetic construct
  misc_feature 1..20: note = CRISPR gRNA sequence
  source 1..20: mol_type = other DNA
attgcccaggctaaggtgca

SEQ ID NO: 29369 - DNA, 20 bp, synthetic construct
  misc_feature 1..20: note = CRISPR gRNA sequence
  source 1..20: mol_type = other DNA
ttgcccaggctaaggtgcag

SEQ ID NO: 29370 - DNA, 20 bp, synthetic construct
  misc_feature 1..20: note = CRISPR gRNA sequence
  source 1..20: mol_type = other DNA
cccaggctaaggtgcagtgg

SEQ ID NO: 29371 - DNA, 20 bp, synthetic construct
  misc_feature 1..20: note = CRISPR gRNA sequence
  source 1..20: mol_type = other DNA
aggtgcagtggcatgatctc

SEQ ID NO: 29372 - DNA, 20 bp, synthetic construct
  misc_feature 1..20: note = CRISPR gRNA sequence
  source 1..20: mol_type = other DNA
agctcactgcaagcactgcc

SEQ ID NO: 29373 - DNA, 20 bp, synthetic construct
  misc_feature 1..20: note = CRISPR gRNA sequence
  source 1..20: mol_type = other DNA
actgcaagcactgcctcctg

SEQ ID NO: 29374 - DNA, 20 bp, synthetic construct
  misc_feature 1..20: note = CRISPR gRNA sequence
  source 1..20: mol_type = other DNA
caagcactgcctcctgggtt

SEQ ID NO: 29375 - DNA, 20 bp, synthetic construct
  misc_feature 1..20: note = CRISPR gRNA sequence
  source 1..20: mol_type = other DNA
cctcctgggttcaagtgatt

SEQ ID NO: 29376 - DNA, 20 bp, synthetic construct
  misc_feature 1..20: note = CRISPR gRNA sequence
  source 1..20: mol_type = other DNA
ctgggttcaagtgattctca

SEQ ID NO: 29377 - DNA, 20 bp, synthetic construct
  misc_feature 1..20: note = CRISPR gRNA sequence
  source 1..20: mol_type = other DNA
ggttcaagtgattctcatgc

SEQ ID NO: 29378 - DNA, 20 bp, synthetic construct
  misc_feature 1..20: note = CRISPR gRNA sequence
  source 1..20: mol_type = other DNA
aagtgattctcatgcctcag

SEQ ID NO: 29379 - DNA, 20 bp, synthetic construct
  misc_feature 1..20: note = CRISPR gRNA sequence
  source 1..20: mol_type = other DNA
tcatgcctcagcctcccaag

SEQ ID NO: 29380 - DNA, 20 bp, synthetic construct
  misc_feature 1..20: note = CRISPR gRNA sequence
  source 1..20: mol_type = other DNA
atgcctcagcctcccaagta

SEQ ID NO: 29381 - DNA, 20 bp, synthetic construct
  misc_feature 1..20: note = CRISPR gRNA sequence
  source 1..20: mol_type = other DNA
agcctcccaagtagctggga

SEQ ID NO: 29382 - DNA, 20 bp, synthetic construct
  misc_feature 1..20: note = CRISPR gRNA sequence
  source 1..20: mol_type = other DNA
ccaagtagctgggattacag

SEQ ID NO: 29383 - DNA, 20 bp, synthetic construct
  misc_feature 1..20: note = CRISPR gRNA sequence
  source 1..20: mol_type = other DNA
ggattacagatgcccgccac

SEQ ID NO: 29384 - DNA, 20 bp, synthetic construct
  misc_feature 1..20: note = CRISPR gRNA sequence
  source 1..20: mol_type = other DNA
cagatgcccgccaccacacc

SEQ ID NO: 29385 - DNA, 20 bp, synthetic construct
  misc_feature 1..20: note = CRISPR gRNA sequence
  source 1..20: mol_type = other DNA
tttttgtgttttcagtagag

SEQ ID NO: 29386 - DNA, 20 bp, synthetic construct
  misc_feature 1..20: note = CRISPR gRNA sequence
  source 1..20: mol_type = other DNA
ttgtgttttcagtagagaca

SEQ ID NO: 29387 - DNA, 20 bp, synthetic construct
  misc_feature 1..20: note = CRISPR gRNA sequence
  source 1..20: mol_type = other DNA
tgtgttttcagtagagacag

SEQ ID NO: 29388 - DNA, 20 bp, synthetic construct
  misc_feature 1..20: note = CRISPR gRNA sequence
  source 1..20: mol_type = other DNA
gtgttttcagtagagacagg

SEQ ID NO: 29389 - DNA, 20 bp, synthetic construct
  misc_feature 1..20: note = CRISPR gRNA sequence
  source 1..20: mol_type = other DNA
tgttttcagtagagacaggg

SEQ ID NO: 29390 - DNA, 20 bp, synthetic construct
  misc_feature 1..20: note = CRISPR gRNA sequence
  source 1..20: mol_type = other DNA
tcagtagagacagggcttcg

SEQ ID NO: 29391 - DNA, 20 bp, synthetic construct
  misc_feature 1..20: note = CRISPR gRNA sequence
  source 1..20: mol_type = other DNA
cagtagagacagggcttcgc

SEQ ID NO: 29392 - DNA, 20 bp, synthetic construct
  misc_feature 1..20: note = CRISPR gRNA sequence
  source 1..20: mol_type = other DNA
agtagagacagggcttcgcc

SEQ ID NO: 29393 - DNA, 20 bp, synthetic construct
  misc_feature 1..20: note = CRISPR gRNA sequence
  source 1..20: mol_type = other DNA
cgccatgtggcccagactgg

SEQ ID NO: 29394 - DNA, 20 bp, synthetic construct
  misc_feature 1..20: note = CRISPR gRNA sequence
  source 1..20: mol_type = other DNA
gccatgtggcccagactggt

SEQ ID NO: 29395 - DNA, 20 bp, synthetic construct
  misc_feature 1..20: note = CRISPR gRNA sequence
  source 1..20: mol_type = other DNA
gtcttgaaatcctgggccca

SEQ ID NO: 29396 - DNA, 20 bp, synthetic construct
  misc_feature 1..20: note = CRISPR gRNA sequence
  source 1..20: mol_type = other DNA
gaaatcctgggcccaagcga

SEQ ID NO: 29397 - DNA, 20 bp, synthetic construct
  misc_feature 1..20: note = CRISPR gRNA sequence
  source 1..20: mol_type = other DNA
aaatcctgggcccaagcgat

SEQ ID NO: 29398 - DNA, 20 bp, synthetic construct
  misc_feature 1..20: note = CRISPR gRNA sequence
  source 1..20: mol_type = other DNA
ggcccaagcgatccacccac

SEQ ID NO: 29399 - DNA, 20 bp, synthetic construct
  misc_feature 1..20: note = CRISPR gRNA sequence
  source 1..20: mol_type = other DNA
agccttccaaagtgctggga

SEQ ID NO: 29400 - DNA, 20 bp, synthetic construct
  misc_feature 1..20: note = CRISPR gRNA sequence
  source 1..20: mol_type = other DNA
ccaaagtgctgggattacgg

SEQ ID NO: 29401 - DNA, 20 bp, synthetic construct
  misc_feature 1..20: note = CRISPR gRNA sequence
  source 1..20: mol_type = other DNA
caaagtgctgggattacggg

SEQ ID NO: 29402 - DNA, 20 bp, synthetic construct
  misc_feature 1..20: note = CRISPR gRNA sequence
  source 1..20: mol_type = other DNA
ggattacgggtgtgagccac

SEQ ID NO: 29403 - DNA, 20 bp, synthetic construct
  misc_feature 1..20: note = CRISPR gRNA sequence
  source 1..20: mol_type = other DNA
cgggtgtgagccaccatgcc

SEQ ID NO: 29404 - DNA, 20 bp, synthetic construct
  misc_feature 1..20: note = CRISPR gRNA sequence
  source 1..20: mol_type = other DNA
atttaccctttaagaaacat

SEQ ID NO: 29405 - DNA, 20 bp, synthetic construct
  misc_feature 1..20: note = CRISPR gRNA sequence
  source 1..20: mol_type = other DNA
accctttaagaaacatcata

SEQ ID NO: 29406 - DNA, 20 bp, synthetic construct
  misc_feature 1..20: note = CRISPR gRNA sequence
  source 1..20: mol_type = other DNA
ccctttaagaaacatcatat

SEQ ID NO: 29407 - DNA, 20 bp, synthetic construct
  misc_feature 1..20: note = CRISPR gRNA sequence
  source 1..20: mol_type = other DNA
taagaaacatcatatttcat

SEQ ID NO: 29408 - DNA, 20 bp, synthetic construct
  misc_feature 1..20: note = CRISPR gRNA sequence
  source 1..20: mol_type = other DNA
aagaaacatcatatttcatg

SEQ ID NO: 29409 - DNA, 20 bp, synthetic construct
  misc_feature 1..20: note = CRISPR gRNA sequence
  source 1..20: mol_type = other DNA
agaaacatcatatttcatgg

SEQ ID NO: 29410 - DNA, 20 bp, synthetic construct
  misc_feature 1..20: note = CRISPR gRNA sequence
  source 1..20: mol_type = other DNA
catggaatctaagatgccat

SEQ ID NO: 29411 - DNA, 20 bp, synthetic construct
  misc_feature 1..20: note = CRISPR gRNA sequence
  source 1..20: mol_type = other DNA
atggaatctaagatgccatc

SEQ ID NO: 29412 - DNA, 20 bp, synthetic construct
  misc_feature 1..20: note = CRISPR gRNA sequence
  source 1..20: mol_type = other DNA
agatgccatccattgtaaga

SEQ ID NO: 29413 - DNA, 20 bp, synthetic construct
  misc_feature 1..20: note = CRISPR gRNA sequence
  source 1..20: mol_type = other DNA
taagaccccaatatgaggcc

SEQ ID NO: 29414 - DNA, 20 bp, synthetic construct
  misc_feature 1..20: note = CRISPR gRNA sequence
  source 1..20: mol_type = other DNA
tgacacgctattggttataa

SEQ ID NO: 29415 - DNA, 20 bp, synthetic construct
  misc_feature 1..20: note = CRISPR gRNA sequence
  source 1..20: mol_type = other DNA
ttggttataagacacatcct

SEQ ID NO: 29416 - DNA, 20 bp, synthetic construct
  misc_feature 1..20: note = CRISPR gRNA sequence
  source 1..20: mol_type = other DNA
gttataagacacatcctgat

SEQ ID NO: 29417 - DNA, 20 bp, synthetic construct
  misc_feature 1..20: note = CRISPR gRNA sequence
  source 1..20: mol_type = other DNA
taagacacatcctgatctca

SEQ ID NO: 29418 - DNA, 20 bp, synthetic construct
  misc_feature 1..20: note = CRISPR gRNA sequence
  source 1..20: mol_type = other DNA
atctcaatgatattcaaatg

SEQ ID NO: 29419 - DNA, 20 bp, synthetic construct
  misc_feature 1..20: note = CRISPR gRNA sequence
  source 1..20: mol_type = other DNA
aatgatattcaaatggtgac

SEQ ID NO: 29420 - DNA, 20 bp, synthetic construct
  misc_feature 1..20: note = CRISPR gRNA sequence
  source 1..20: mol_type = other DNA
aaatggtgacatatatgtct

SEQ ID NO: 29421 - DNA, 20 bp, synthetic construct
  misc_feature 1..20: note = CRISPR gRNA sequence
  source 1..20: mol_type = other DNA
ggcatcgatgaaatatggtc

SEQ ID NO: 29422 - DNA, 20 bp, synthetic construct
  misc_feature 1..20: note = CRISPR gRNA sequence
  source 1..20: mol_type = other DNA
gcatcgatgaaatatggtca

SEQ ID NO: 29423 - DNA, 20 bp, synthetic construct
  misc_feature 1..20: note = CRISPR gRNA sequence
  source 1..20: mol_type = other DNA
ctctccctgtggggtggagg

SEQ ID NO: 29424 - DNA, 20 bp, synthetic construct
  misc_feature 1..20: note = CRISPR gRNA sequence
  source 1..20: mol_type = other DNA
tccctgtggggtggaggaag

SEQ ID NO: 29425 - DNA, 20 bp, synthetic construct
  misc_feature 1..20: note = CRISPR gRNA sequence
  source 1..20: mol_type = other DNA
cctgtggggtggaggaaggg

SEQ ID NO: 29426 - DNA, 20 bp, synthetic construct
  misc_feature 1..20: note = CRISPR gRNA sequence
  source 1..20: mol_type = other DNA
tggggtggaggaagggtctc

SEQ ID NO: 29427 - DNA, 20 bp, synthetic construct
  misc_feature 1..20: note = CRISPR gRNA sequence
  source 1..20: mol_type = other DNA
cagggttcagagattgcaaa

SEQ ID NO: 29428 - DNA, 20 bp, synthetic construct
  misc_feature 1..20: note = CRISPR gRNA sequence
  source 1..20: mol_type = other DNA
agagattgcaaaacccccat

SEQ ID NO: 29429 - DNA, 20 bp, synthetic construct
  misc_feature 1..20: note = CRISPR gRNA sequence
  source 1..20: mol_type = other DNA
caaaacccccatctagtttc

SEQ ID NO: 29430 - DNA, 20 bp, synthetic construct
  misc_feature 1..20: note = CRISPR gRNA sequence
  source 1..20: mol_type = other DNA
gtttctgcactggtaccggc

SEQ ID NO: 29431 - DNA, 20 bp, synthetic construct
  misc_feature 1..20: note = CRISPR gRNA sequence
  source 1..20: mol_type = other DNA
ctgcactggtaccggccgac

SEQ ID NO: 29432 - DNA, 20 bp, synthetic construct
  misc_feature 1..20: note = CRISPR gRNA sequence
  source 1..20: mol_type = other DNA
tgcactggtaccggccgacc

SEQ ID NO: 29433 - DNA, 20 bp, synthetic construct
  misc_feature 1..20: note = CRISPR gRNA sequence
  source 1..20: mol_type = other DNA
cactggtaccggccgacccg

SEQ ID NO: 29434 - DNA, 20 bp, synthetic construct
  misc_feature 1..20: note = CRISPR gRNA sequence
  source 1..20: mol_type = other DNA
gtaccggccgacccgtgatg

SEQ ID NO: 29435 - DNA, 20 bp, synthetic construct
  misc_feature 1..20: note = CRISPR gRNA sequence
  source 1..20: mol_type = other DNA
atttagcctgaatccacttg

SEQ ID NO: 29436 - DNA, 20 bp, synthetic construct
  misc_feature 1..20: note = CRISPR gRNA sequence
  source 1..20: mol_type = other DNA
agcctgaatccacttggcag

SEQ ID NO: 29437 - DNA, 20 bp, synthetic construct
  misc_feature 1..20: note = CRISPR gRNA sequence
  source 1..20: mol_type = other DNA
gcctgaatccacttggcagc

SEQ ID NO: 29438 - DNA, 20 bp, synthetic construct
  misc_feature 1..20: note = CRISPR gRNA sequence
  source 1..20: mol_type = other DNA
aatccacttggcagcagtgt

SEQ ID NO: 29439 - DNA, 20 bp, synthetic construct
  misc_feature 1..20: note = CRISPR gRNA sequence
  source 1..20: mol_type = other DNA
ggcagcagtgtaaacctgct

SEQ ID NO: 29440 - DNA, 20 bp, synthetic construct
  misc_feature 1..20: note = CRISPR gRNA sequence
  source 1..20: mol_type = other DNA
gcagcagtgtaaacctgctg

SEQ ID NO: 29441 - DNA, 20 bp, synthetic construct
  misc_feature 1..20: note = CRISPR gRNA sequence
  source 1..20: mol_type = other DNA
ctgcatttatttattttttt

SEQ ID NO: 29442 - DNA, 20 bp, synthetic construct
  misc_feature 1..20: note = CRISPR gRNA sequence
  source 1..20: mol_type = other DNA
catttatttatttttttctt

SEQ ID NO: 29443 - DNA, 20 bp, synthetic construct
  misc_feature 1..20: note = CRISPR gRNA sequence
  source 1..20: mol_type = other DNA
atttatttttttcttttttt

SEQ ID NO: 29444 - DNA, 20 bp, synthetic construct
  misc_feature 1..20: note = CRISPR gRNA sequence
  source 1..20: mol_type = other DNA
tttatttttttctttttttt

SEQ ID NO: 29445 - DNA, 20 bp, synthetic construct
  misc_feature 1..20: note = CRISPR gRNA sequence
  source 1..20: mol_type = other DNA
atttttttctttttttttcg

SEQ ID NO: 29446 - DNA, 20 bp, synthetic construct
  misc_feature 1..20: note = CRISPR gRNA sequence
  source 1..20: mol_type = other DNA
tttttttctttttttttcga

SEQ ID NO: 29447 - DNA, 20 bp, synthetic construct
  misc_feature 1..20: note = CRISPR gRNA sequence
  source 1..20: mol_type = other DNA
ttttctttttttttcgagac

SEQ ID NO: 29448 - DNA, 20 bp, synthetic construct
  misc_feature 1..20: note = CRISPR gRNA sequence
  source 1..20: mol_type = other DNA
tttctttttttttcgagaca

SEQ ID NO: 29449 - DNA, 20 bp, synthetic construct
  misc_feature 1..20: note = CRISPR gRNA sequence
  source 1..20: mol_type = other DNA
ttctttttttttcgagacag

SEQ ID NO: 29450 - DNA, 20 bp, synthetic construct
  misc_feature 1..20: note = CRISPR gRNA sequence
  source 1..20: mol_type = other DNA
tctttttttttcgagacaga

SEQ ID NO: 29451 - DNA, 20 bp, synthetic construct
  misc_feature 1..20: note = CRISPR gRNA sequence
  source 1..20: mol_type = other DNA
ctttttttttcgagacagag

SEQ ID NO: 29452 - DNA, 20 bp, synthetic construct
  misc_feature 1..20: note = CRISPR gRNA sequence
  source 1..20: mol_type = other DNA
tttttttttcgagacagagt

SEQ ID NO: 29453 - DNA, 20 bp, synthetic construct
  misc_feature 1..20: note = CRISPR gRNA sequence
  source 1..20: mol_type = other DNA
tttttttcgagacagagttt

SEQ ID NO: 29454 - DNA, 20 bp, synthetic construct
  misc_feature 1..20: note = CRISPR gRNA sequence
  source 1..20: mol_type = other DNA
ttttttcgagacagagtttc

SEQ ID NO: 29455 - DNA, 20 bp, synthetic construct
  misc_feature 1..20: note = CRISPR gRNA sequence
  source 1..20: mol_type = other DNA
tttttcgagacagagtttcg

SEQ ID NO: 29456 - DNA, 20 bp, synthetic construct
  misc_feature 1..20: note = CRISPR gRNA sequence
  source 1..20: mol_type = other DNA
ttttcgagacagagtttcgc

SEQ ID NO: 29457 - DNA, 20 bp, synthetic construct
  misc_feature 1..20: note = CRISPR gRNA sequence
  source 1..20: mol_type = other DNA
tttcgagacagagtttcgct

SEQ ID NO: 29458 - DNA, 20 bp, synthetic construct
  misc_feature 1..20: note = CRISPR gRNA sequence
  source 1..20: mol_type = other DNA
ttcgagacagagtttcgctc

SEQ ID NO: 29459 - DNA, 20 bp, synthetic construct
  misc_feature 1..20: note = CRISPR gRNA sequence
  source 1..20: mol_type = other DNA
tcgagacagagtttcgctct

SEQ ID NO: 29460 - DNA, 20 bp, synthetic construct
  misc_feature 1..20: note = CRISPR gRNA sequence
  source 1..20: mol_type = other DNA
cgagacagagtttcgctctt

SEQ ID NO: 29461 - DNA, 20 bp, synthetic construct
  misc_feature 1..20: note = CRISPR gRNA sequence
  source 1..20: mol_type = other DNA
gagacagagtttcgctcttg

SEQ ID NO: 29462 - DNA, 20 bp, synthetic construct
  misc_feature 1..20: note = CRISPR gRNA sequence
  source 1..20: mol_type = other DNA
cgctcttgttgccaaggctg

SEQ ID NO: 29463 - DNA, 20 bp, synthetic construct
  misc_feature 1..20: note = CRISPR gRNA sequence
  source 1..20: mol_type = other DNA
gctcttgttgccaaggctgg

SEQ ID NO: 29464 - DNA, 20 bp, synthetic construct
  misc_feature 1..20: note = CRISPR gRNA sequence
  source 1..20: mol_type = other DNA
ttgttgccaaggctggagtg

SEQ ID NO: 29465 - DNA, 20 bp, synthetic construct
  misc_feature 1..20: note = CRISPR gRNA sequence
  source 1..20: mol_type = other DNA
gttgccaaggctggagtgca

SEQ ID NO: 29466 - DNA, 20 bp, synthetic construct
  misc_feature 1..20: note = CRISPR gRNA sequence
  source 1..20: mol_type = other DNA
ttgccaaggctggagtgcag

SEQ ID NO: 29467 - DNA, 20 bp, synthetic construct
  misc_feature 1..20: note = CRISPR gRNA sequence
  source 1..20: mol_type = other DNA
ccaaggctggagtgcagtct

SEQ ID NO: 29468 - DNA, 20 bp, synthetic construct
  misc_feature 1..20: note = CRISPR gRNA sequence
  source 1..20: mol_type = other DNA
gagtgcagtctcagttcact

SEQ ID NO: 29469 - DNA, 20 bp, synthetic construct
  misc_feature 1..20: note = CRISPR gRNA sequence
  source 1..20: mol_type = other DNA
agttcactgcaactccgcct

SEQ ID NO: 29470 - DNA, 20 bp, synthetic construct
  misc_feature 1..20: note = CRISPR gRNA sequence
  source 1..20: mol_type = other DNA
actgcaactccgcctcccga

SEQ ID NO: 29471 - DNA, 20 bp, synthetic construct
  misc_feature 1..20: note = CRISPR gRNA sequence
  source 1..20: mol_type = other DNA
caactccgcctcccgagttc

SEQ ID NO: 29472 - DNA, 20 bp, synthetic construct
  misc_feature 1..20: note = CRISPR gRNA sequence
  source 1..20: mol_type = other DNA
cgcctcccgagttcaagcaa

SEQ ID NO: 29473 - DNA, 20 bp, synthetic construct
  misc_feature 1..20: note = CRISPR gRNA sequence
  source 1..20: mol_type = other DNA
ccgagttcaagcaattctcc

SEQ ID NO: 29474 - DNA, 20 bp, synthetic construct
  misc_feature 1..20: note = CRISPR gRNA sequence
  source 1..20: mol_type = other DNA
aagcaattctcctgcctcag

SEQ ID NO: 29475 - DNA, 20 bp, synthetic construct
  misc_feature 1..20: note = CRISPR gRNA sequence
  source 1..20: mol_type = other DNA
tcctgcctcagcctctcaag

SEQ ID NO: 29476 - DNA, 20 bp, synthetic construct
  misc_feature 1..20: note = CRISPR gRNA sequence
  source 1..20: mol_type = other DNA
ctgcctcagcctctcaagta

SEQ ID NO: 29477 - DNA, 20 bp, synthetic construct
  misc_feature 1..20: note = CRISPR gRNA sequence
  source 1..20: mol_type = other DNA
cctcagcctctcaagtagct

SEQ ID NO: 29478 - DNA, 20 bp, synthetic construct
  misc_feature 1..20: note = CRISPR gRNA sequence
  source 1..20: mol_type = other DNA
agcctctcaagtagctggga

SEQ ID NO: 29479 - DNA, 20 bp, synthetic construct
  misc_feature 1..20: note = CRISPR gRNA sequence
  source 1..20: mol_type = other DNA
tcaagtagctgggagtatag

SEQ ID NO: 29480 - DNA, 20 bp, synthetic construct
  misc_feature 1..20: note = CRISPR gRNA sequence
  source 1..20: mol_type = other DNA
aagtagctgggagtataggc

SEQ ID NO: 29481 - DNA, 20 bp, synthetic construct
  misc_feature 1..20: note = CRISPR gRNA sequence
  source 1..20: mol_type = other DNA
ggagtataggcatgtgccat

SEQ ID NO: 29482 - DNA, 20 bp, synthetic construct
  misc_feature 1..20: note = CRISPR gRNA sequence
  source 1..20: mol_type = other DNA
attttgtatttttagtagag

SEQ ID NO: 29483 - DNA, 20 bp, synthetic construct
  misc_feature 1..20: note = CRISPR gRNA sequence
  source 1..20: mol_type = other DNA
tgtatttttagtagagacgg

SEQ ID NO: 29484 - DNA, 20 bp, synthetic construct
  misc_feature 1..20: note = CRISPR gRNA sequence
  source 1..20: mol_type = other DNA
gtatttttagtagagacggg

SEQ ID NO: 29485 - DNA, 20 bp, synthetic construct
  misc_feature 1..20: note = CRISPR gRNA sequence
  source 1..20: mol_type = other DNA
tatttttagtagagacgggg

SEQ ID NO: 29486 - DNA, 20 bp, synthetic construct
  misc_feature 1..20: note = CRISPR gRNA sequence
  source 1..20: mol_type = other DNA
ttagtagagacggggtttct

SEQ ID NO: 29487 - DNA, 20 bp, synthetic construct
  misc_feature 1..20: note = CRISPR gRNA sequence
  source 1..20: mol_type = other DNA
tagtagagacggggtttctc

SEQ ID NO: 29488 - DNA, 20 bp, synthetic construct
  misc_feature 1..20: note = CRISPR gRNA sequence
  source 1..20: mol_type = other DNA
agtagagacggggtttctcc

SEQ ID NO: 29489 - DNA, 20 bp, synthetic construct
  misc_feature 1..20: note = CRISPR gRNA sequence
  source 1..20: mol_type = other DNA
gtagagacggggtttctcca

SEQ ID NO: 29490 - DNA, 20 bp, synthetic construct
  misc_feature 1..20: note = CRISPR gRNA sequence
  source 1..20: mol_type = other DNA
ctccatgttggtcaggctgg

SEQ ID NO: 29491 - DNA, 20 bp, synthetic construct
  misc_feature 1..20: note = CRISPR gRNA sequence
  source 1..20: mol_type = other DNA
tccatgttggtcaggctggt

SEQ ID NO: 29492 - DNA, 20 bp, synthetic construct
  misc_feature 1..20: note = CRISPR gRNA sequence
  source 1..20: mol_type = other DNA
catgttggtcaggctggtct

SEQ ID NO: 29493 - DNA, 20 bp, synthetic construct
  misc_feature 1..20: note = CRISPR gRNA sequence
  source 1..20: mol_type = other DNA
gtcaggctggtctcaaactc

SEQ ID NO: 29494 - DNA, 20 bp, synthetic construct
  misc_feature 1..20: note = CRISPR gRNA sequence
  source 1..20: mol_type = other DNA
gtctcaaactcccgacctta

SEQ ID NO: 29495 - DNA, 20 bp, synthetic construct
  misc_feature 1..20: note = CRISPR gRNA sequence
  source 1..20: mol_type = other DNA
aaactcccgaccttaggtga

SEQ ID NO: 29496 - DNA, 20 bp, synthetic construct
  misc_feature 1..20: note = CRISPR gRNA sequence
  source 1..20: mol_type = other DNA
ccgaccttaggtgatccacc

SEQ ID NO: 29497 - DNA, 20 bp, synthetic construct
  misc_feature 1..20: note = CRISPR gRNA sequence
  source 1..20: mol_type = other DNA
aggtgatccacccgcctcgg

SEQ ID NO: 29498 - DNA, 20 bp, synthetic construct
  misc_feature 1..20: note = CRISPR gRNA sequence
  source 1..20: mol_type = other DNA
ggtgatccacccgcctcggc

SEQ ID NO: 29499 - DNA, 20 bp, synthetic construct
  misc_feature 1..20: note = CRISPR gRNA sequence
  source 1..20: mol_type = other DNA
ggcctccaaagtgttaggat

SEQ ID NO: 29500 - DNA, 20 bp, synthetic construct
  misc_feature 1..20: note = CRISPR gRNA sequence
  source 1..20: mol_type = other DNA
caaagtgttaggattacagg

SEQ ID NO: 29501 - DNA, 20 bp, synthetic construct
  misc_feature 1..20: note = CRISPR gRNA sequence
  source 1..20: mol_type = other DNA
ggattacaggcgtgagccac

SEQ ID NO: 29502 - DNA, 20 bp, synthetic construct
  misc_feature 1..20: note = CRISPR gRNA sequence
  source 1..20: mol_type = other DNA
caggcgtgagccactgcacc

SEQ ID NO: 29503 - DNA, 20 bp, synthetic construct
  misc_feature 1..20: note = CRISPR gRNA sequence
  source 1..20: mol_type = other DNA
cacctgctgcttttatatgc

SEQ ID NO: 29504 - DNA, 20 bp, synthetic construct
  misc_feature 1..20: note = CRISPR gRNA sequence
  source 1..20: mol_type = other DNA
ctgcttttatatgcagccct

SEQ ID NO: 29505 - DNA, 20 bp, synthetic construct
  misc_feature 1..20: note = CRISPR gRNA sequence
  source 1..20: mol_type = other DNA
cttttatatgcagccctgca

SEQ ID NO: 29506 - DNA, 20 bp, synthetic construct
  misc_feature 1..20: note = CRISPR gRNA sequence
  source 1..20: mol_type = other DNA
ttatatgcagccctgcaagg

SEQ ID NO: 29507 - DNA, 20 bp, synthetic construct
  misc_feature 1..20: note = CRISPR gRNA sequence
  source 1..20: mol_type = other DNA
tatatgcagccctgcaaggg

SEQ ID NO: 29508 - DNA, 20 bp, synthetic construct
  misc_feature 1..20: note = CRISPR gRNA sequence
  source 1..20: mol_type = other DNA
atatgcagccctgcaaggga

SEQ ID NO: 29509 - DNA, 20 bp, synthetic construct
  misc_feature 1..20: note = CRISPR gRNA sequence
  source 1..20: mol_type = other DNA
tatgcagccctgcaagggag

SEQ ID NO: 29510 - DNA, 20 bp, synthetic construct
  misc_feature 1..20: note = CRISPR gRNA sequence
  source 1..20: mol_type = other DNA
caagggagttctgaggctga

SEQ ID NO: 29511 - DNA, 20 bp, synthetic construct
  misc_feature 1..20: note = CRISPR gRNA sequence
  source 1..20: mol_type = other DNA
tgaggctgaatcatggcaaa

SEQ ID NO: 29512 - DNA, 20 bp, synthetic construct
  misc_feature 1..20: note = CRISPR gRNA sequence
  source 1..20: mol_type = other DNA
aggctgaatcatggcaaagt

SEQ ID NO: 29513 - DNA, 20 bp, synthetic construct
  misc_feature 1..20: note = CRISPR gRNA sequence
  source 1..20: mol_type = other DNA
aatcatggcaaagtcatggc

SEQ ID NO: 29514 - DNA, 20 bp, synthetic construct
  misc_feature 1..20: note = CRISPR gRNA sequence
  source 1..20: mol_type = other DNA
aaatcatacccgcagcagca

SEQ ID NO: 29515 - DNA, 20 bp, synthetic construct
  misc_feature 1..20: note = CRISPR gRNA sequence
  source 1..20: mol_type = other DNA
acctgttaaaaggctgcttg

SEQ ID NO: 29516 - DNA, 20 bp, synthetic construct
  misc_feature 1..20: note = CRISPR gRNA sequence
  source 1..20: mol_type = other DNA
ttaaaaggctgcttggtgtc

SEQ ID NO: 29517 - DNA, 20 bp, synthetic construct
  misc_feature 1..20: note = CRISPR gRNA sequence
  source 1..20: mol_type = other DNA
aaaggctgcttggtgtcgag

SEQ ID NO: 29518 - DNA, 20 bp, synthetic construct
  misc_feature 1..20: note = CRISPR gRNA sequence
  source 1..20: mol_type = other DNA
cttggtgtcgagtaaacagc

SEQ ID NO: 29519 - DNA, 20 bp, synthetic construct
  misc_feature 1..20: note = CRISPR gRNA sequence
  source 1..20: mol_type = other DNA
ggtgtcgagtaaacagctga

SEQ ID NO: 29520 - DNA, 20 bp, synthetic construct
  misc_feature 1..20: note = CRISPR gRNA sequence
  source 1..20: mol_type = other DNA
gtgtcgagtaaacagctgaa

SEQ ID NO: 29521 - DNA, 20 bp, synthetic construct
  misc_feature 1..20: note = CRISPR gRNA sequence
  source 1..20: mol_type = other DNA
aagttggcatcagtgacact

SEQ ID NO: 29522 - DNA, 20 bp, synthetic construct
  misc_feature 1..20: note = CRISPR gRNA sequence
  source 1..20: mol_type = other DNA
gcatcagtgacactcatcat

SEQ ID NO: 29523 - DNA, 20 bp, synthetic construct
  misc_feature 1..20: note = CRISPR gRNA sequence
  source 1..20: mol_type = other DNA
atcatgctattttcactgct

SEQ ID NO: 29524 - DNA, 20 bp, synthetic construct
  misc_feature 1..20: note = CRISPR gRNA sequence
  source 1..20: mol_type = other DNA
ttttcactgctactaatgct

SEQ ID NO: 29525 - DNA, 20 bp, synthetic construct
  misc_feature 1..20: note = CRISPR gRNA sequence
  source 1..20: mol_type = other DNA
tcactgctactaatgctggt

SEQ ID NO: 29526 - DNA, 20 bp, synthetic construct
  misc_feature 1..20: note = CRISPR gRNA sequence
  source 1..20: mol_type = other DNA
cactgctactaatgctggtt

SEQ ID NO: 29527 - DNA, 20 bp, synthetic construct
  misc_feature 1..20: note = CRISPR gRNA sequence
  source 1..20: mol_type = other DNA
actgctactaatgctggttg

SEQ ID NO: 29528 - DNA, 20 bp, synthetic construct
  misc_feature 1..20: note = CRISPR gRNA sequence
  source 1..20: mol_type = other DNA
ctactaatgctggttgtgaa

SEQ ID NO: 29529 - DNA, 20 bp, synthetic construct
  misc_feature 1..20: note = CRISPR gRNA sequence
  source 1..20: mol_type = other DNA
ctaatgctggttgtgaatat

SEQ ID NO: 29530 - DNA, 20 bp, synthetic construct
  misc_feature 1..20: note = CRISPR gRNA sequence
  source 1..20: mol_type = other DNA
atgctggttgtgaatatgct

SEQ ID NO: 29531 - DNA, 20 bp, synthetic construct
  misc_feature 1..20: note = CRISPR gRNA sequence
  source 1..20: mol_type = other DNA
gttgtgaatatgctgcagaa

SEQ ID NO: 29532 - DNA, 20 bp, synthetic construct
  misc_feature 1..20: note = CRISPR gRNA sequence
  source 1..20: mol_type = other DNA
tgaatatgctgcagaaactg

SEQ ID NO: 29533 - DNA, 20 bp, synthetic construct
  misc_feature 1..20: note = CRISPR gRNA sequence
  source 1..20: mol_type = other DNA
cagaaactggagctggtcca

SEQ ID NO: 29534 - DNA, 20 bp, synthetic construct
  misc_feature 1..20: note = CRISPR gRNA sequence
  source 1..20: mol_type = other DNA
gagctggtccagtgactggc

SEQ ID NO: 29535 - DNA, 20 bp, synthetic construct
  misc_feature 1..20: note = CRISPR gRNA sequence
  source 1..20: mol_type = other DNA
gtccagtgactggctttttc

SEQ ID NO: 29536 - DNA, 20 bp, synthetic construct
  misc_feature 1..20: note = CRISPR gRNA sequence
  source 1..20: mol_type = other DNA
gctttttctcttcctgcccc

SEQ ID NO: 29537 - DNA, 20 bp, synthetic construct
  misc_feature 1..20: note = CRISPR gRNA sequence
  source 1..20: mol_type = other DNA
tttctcttcctgcccccagt

SEQ ID NO: 29538 - DNA, 20 bp, synthetic construct
  misc_feature 1..20: note = CRISPR gRNA sequence
  source 1..20: mol_type = other DNA
ttctcttcctgcccccagtg

SEQ ID NO: 29539 - DNA, 20 bp, synthetic construct
  misc_feature 1..20: note = CRISPR gRNA sequence
  source 1..20: mol_type = other DNA
tctcttcctgcccccagtgc

SEQ ID NO: 29540 - DNA, 20 bp, synthetic construct
  misc_feature 1..20: note = CRISPR gRNA sequence
  source 1..20: mol_type = other DNA
ctcttcctgcccccagtgct

SEQ ID NO: 29541 - DNA, 20 bp, synthetic construct
  misc_feature 1..20: note = CRISPR gRNA sequence
  source 1..20: mol_type = other DNA
tcttcctgcccccagtgctg

SEQ ID NO: 29542 - DNA, 20 bp, synthetic construct
  misc_feature 1..20: note = CRISPR gRNA sequence
  source 1..20: mol_type = other DNA
ttcctgcccccagtgctggt

SEQ ID NO: 29543 - DNA, 20 bp, synthetic construct
  misc_feature 1..20: note = CRISPR gRNA sequence
  source 1..20: mol_type = other DNA
cctgcccccagtgctggtca

SEQ ID NO: 29544 - DNA, 20 bp, synthetic construct
  misc_feature 1..20: note = CRISPR gRNA sequence
  source 1..20: mol_type = other DNA
ctgcccccagtgctggtcac

SEQ ID NO: 29545 - DNA, 20 bp, synthetic construct
  misc_feature 1..20: note = CRISPR gRNA sequence
  source 1..20: mol_type = other DNA
cccccagtgctggtcacacc

SEQ ID NO: 29546 - DNA, 20 bp, synthetic construct
  misc_feature 1..20: note = CRISPR gRNA sequence
  source 1..20: mol_type = other DNA
gtcacaccctctatgttaac

SEQ ID NO: 29547 - DNA, 20 bp, synthetic construct
  misc_feature 1..20: note = CRISPR gRNA sequence
  source 1..20: mol_type = other DNA
tatgttaactcatgcgaccc

SEQ ID NO: 29548 - DNA, 20 bp, synthetic construct
  misc_feature 1..20: note = CRISPR gRNA sequence
  source 1..20: mol_type = other DNA
tgttaactcatgcgaccctc

SEQ ID NO: 29549 - DNA, 20 bp, synthetic construct
  misc_feature 1..20: note = CRISPR gRNA sequence
  source 1..20: mol_type = other DNA
actcatgcgaccctcaccaa

SEQ ID NO: 29550 - DNA, 20 bp, synthetic construct
  misc_feature 1..20: note = CRISPR gRNA sequence
  source 1..20: mol_type = other DNA
atgcgaccctcaccaatgtt

SEQ ID NO: 29551 - DNA, 20 bp, synthetic construct
  misc_feature 1..20: note = CRISPR gRNA sequence
  source 1..20: mol_type = other DNA
accaatgttcctgtgatgta

SEQ ID NO: 29552 - DNA, 20 bp, synthetic construct
  misc_feature 1..20: note = CRISPR gRNA sequence
  source 1..20: mol_type = other DNA
ctgtgatgtagtcagaacca

SEQ ID NO: 29553 - DNA, 20 bp, synthetic construct
  misc_feature 1..20: note = CRISPR gRNA sequence
  source 1..20: mol_type = other DNA
tgatgtagtcagaaccatag

SEQ ID NO: 29554 - DNA, 20 bp, synthetic construct
  misc_feature 1..20: note = CRISPR gRNA sequence
  source 1..20: mol_type = other DNA
acatttagttcattctaggc

SEQ ID NO: 29555 - DNA, 20 bp, synthetic construct
  misc_feature 1..20: note = CRISPR gRNA sequence
  source 1..20: mol_type = other DNA
agttcattctaggcaccaag

SEQ ID NO: 29556 - DNA, 20 bp, synthetic construct
  misc_feature 1..20: note = CRISPR gRNA sequence
  source 1..20: mol_type = other DNA
gttcattctaggcaccaagg

SEQ ID NO: 29557 - DNA, 20 bp, synthetic construct
  misc_feature 1..20: note = CRISPR gRNA sequence
  source 1..20: mol_type = other DNA
attctaggcaccaaggcatg

SEQ ID NO: 29558 - DNA, 20 bp, synthetic construct
  misc_feature 1..20: note = CRISPR gRNA sequence
  source 1..20: mol_type = other DNA
taggcaccaaggcatgttct

SEQ ID NO: 29559 - DNA, 20 bp, synthetic construct
  misc_feature 1..20: note = CRISPR gRNA sequence
  source 1..20: mol_type = other DNA
ggcaccaaggcatgttctaa

SEQ ID NO: 29560 - DNA, 20 bp, synthetic construct
  misc_feature 1..20: note = CRISPR gRNA sequence
  source 1..20: mol_type = other DNA
taaatgttatatcagcattg

SEQ ID NO: 29561 - DNA, 20 bp, synthetic construct
  misc_feature 1..20: note = CRISPR gRNA sequence
  source 1..20: mol_type = other DNA
aatgttatatcagcattgat

SEQ ID NO: 29562 - DNA, 20 bp, synthetic construct
  misc_feature 1..20: note = CRISPR gRNA sequence
  source 1..20: mol_type = other DNA
tatcagcattgattcattta

SEQ ID NO: 29563 - DNA, 20 bp, synthetic construct
  misc_feature 1..20: note = CRISPR gRNA sequence
  source 1..20: mol_type = other DNA
attcatttactcctccccac

SEQ ID NO: 29564 - DNA, 20 bp, synthetic construct
  misc_feature 1..20: note = CRISPR gRNA sequence
  source 1..20: mol_type = other DNA
atttactcctccccacaatg

SEQ ID NO: 29565 - DNA, 20 bp, synthetic construct
  misc_feature 1..20: note = CRISPR gRNA sequence
  source 1..20: mol_type = other DNA
actcctccccacaatgactc

SEQ ID NO: 29566 - DNA, 20 bp, synthetic construct
  misc_feature 1..20: note = CRISPR gRNA sequence
  source 1..20: mol_type = other DNA
ctcctccccacaatgactct

SEQ ID NO: 29567 - DNA, 20 bp, synthetic construct
  misc_feature 1..20: note = CRISPR gRNA sequence
  source 1..20: mol_type = other DNA
ctccccacaatgactctatc

SEQ ID NO: 29568 - DNA, 20 bp, synthetic construct
  misc_feature 1..20: note = CRISPR gRNA sequence
  source 1..20: mol_type = other DNA
cccacaatgactctatcatg

SEQ ID NO: 29569 - DNA, 20 bp, synthetic construct
  misc_feature 1..20: note = CRISPR gRNA sequence
  source 1..20: mol_type = other DNA
tatcatgcccattttacaga

SEQ ID NO: 29570 - DNA, 20 bp, synthetic construct
  misc_feature 1..20: note = CRISPR gRNA sequence
  source 1..20: mol_type = other DNA
tcatgcccattttacagatg

SEQ ID NO: 29571 - DNA, 20 bp, synthetic construct
  misc_feature 1..20: note = CRISPR gRNA sequence
  source 1..20: mol_type = other DNA
tacagatgggcaaactgagt

SEQ ID NO: 29572 - DNA, 20 bp, synthetic construct
  misc_feature 1..20: note = CRISPR gRNA sequence
  source 1..20: mol_type = other DNA
acagatgggcaaactgagtc

SEQ ID NO: 29573 - DNA, 20 bp, synthetic construct
  misc_feature 1..20: note = CRISPR gRNA sequence
  source 1..20: mol_type = other DNA
cagatgggcaaactgagtct

SEQ ID NO: 29574 - DNA, 20 bp, synthetic construct
  misc_feature 1..20: note = CRISPR gRNA sequence
  source 1..20: mol_type = other DNA
agtctcagaagagttgagta

SEQ ID NO: 29575 - DNA, 20 bp, synthetic construct
  misc_feature 1..20: note = CRISPR gRNA sequence
  source 1..20: mol_type = other DNA
agaagagttgagtagcttgc

SEQ ID NO: 29576 - DNA, 20 bp, synthetic construct
  misc_feature 1..20: note = CRISPR gRNA sequence
  source 1..20: mol_type = other DNA
agtagcttgcccaaggtcac

SEQ ID NO: 29577 - DNA, 20 bp, synthetic construct
  misc_feature 1..20: note = CRISPR gRNA sequence
  source 1..20: mol_type = other DNA
gcccaaggtcacataggcag

SEQ ID NO: 29578 - DNA, 20 bp, synthetic construct
  misc_feature 1..20: note = CRISPR gRNA sequence
  source 1..20: mol_type = other DNA
cccaaggtcacataggcagt

SEQ ID NO: 29579 - DNA, 20 bp, synthetic construct
  misc_feature 1..20: note = CRISPR gRNA sequence
  source 1..20: mol_type = other DNA
ggatttgaacttgggaagtt

SEQ ID NO: 29580 - DNA, 20 bp, synthetic construct
  misc_feature 1..20: note = CRISPR gRNA sequence
  source 1..20: mol_type = other DNA
gaacttgggaagttgttctg

SEQ ID NO: 29581 - DNA, 20 bp, synthetic construct
  misc_feature 1..20: note = CRISPR gRNA sequence
  source 1..20: mol_type = other DNA
aacttgggaagttgttctga

SEQ ID NO: 29582 - DNA, 20 bp, synthetic construct
  misc_feature 1..20: note = CRISPR gRNA sequence
  source 1..20: mol_type = other DNA
gggaagttgttctgacagtt

SEQ ID NO: 29583 - DNA, 20 bp, synthetic construct
  misc_feature 1..20: note = CRISPR gRNA sequence
  source 1..20: mol_type = other DNA
ggaagttgttctgacagttt

SEQ ID NO: 29584 - DNA, 20 bp, synthetic construct
  misc_feature 1..20: note = CRISPR gRNA sequence
  source 1..20: mol_type = other DNA
ttctgacagtttccacacag

SEQ ID NO: 29585 - DNA, 20 bp, synthetic construct
  misc_feature 1..20: note = CRISPR gRNA sequence
  source 1..20: mol_type = other DNA
tgacagtttccacacagtaa

SEQ ID NO: 29586 - DNA, 20 bp, synthetic construct
  misc_feature 1..20: note = CRISPR gRNA sequence
  source 1..20: mol_type = other DNA
acagtttccacacagtaagg

SEQ ID NO: 29587 - DNA, 20 bp, synthetic construct
  misc_feature 1..20: note = CRISPR gRNA sequence
  source 1..20: mol_type = other DNA
ccacacagtaaggcaagaaa

SEQ ID NO: 29588 - DNA, 20 bp, synthetic construct
  misc_feature 1..20: note = CRISPR gRNA sequence
  source 1..20: mol_type = other DNA
cacacagtaaggcaagaaat

SEQ ID NO: 29589 - DNA, 20 bp, synthetic construct
  misc_feature 1..20: note = CRISPR gRNA sequence
  source 1..20: mol_type = other DNA
ccttttagtcctgctgtttt

SEQ ID NO: 29590 - DNA, 20 bp, synthetic construct
  misc_feature 1..20: note = CRISPR gRNA sequence
  source 1..20: mol_type = other DNA
cttttagtcctgctgttttc

SEQ ID NO: 29591 - DNA, 20 bp, synthetic construct
  misc_feature 1..20: note = CRISPR gRNA sequence
  source 1..20: mol_type = other DNA
ttagtcctgctgttttcctg

SEQ ID NO: 29592 - DNA, 20 bp, synthetic construct
  misc_feature 1..20: note = CRISPR gRNA sequence
  source 1..20: mol_type = other DNA
tagtcctgctgttttcctgg

SEQ ID NO: 29593 - DNA, 20 bp, synthetic construct
  misc_feature 1..20: note = CRISPR gRNA sequence
  source 1..20: mol_type = other DNA
agtcctgctgttttcctggg

SEQ ID NO: 29594 - DNA, 20 bp, synthetic construct
  misc_feature 1..20: note = CRISPR gRNA sequence
  source 1..20: mol_type = other DNA
gtcctgctgttttcctgggc

SEQ ID NO: 29595 - DNA, 20 bp, synthetic construct
  misc_feature 1..20: note = CRISPR gRNA sequence
  source 1..20: mol_type = other DNA
ctgttttcctgggctcactg

SEQ ID NO: 29596 - DNA, 20 bp, synthetic construct
  misc_feature 1..20: note = CRISPR gRNA sequence
  source 1..20: mol_type = other DNA
ttttcctgggctcactgttt

SEQ ID NO: 29597 - DNA, 20 bp, synthetic construct
  misc_feature 1..20: note = CRISPR gRNA sequence
  source 1..20: mol_type = other DNA
tcctgggctcactgtttgac

SEQ ID NO: 29598 - DNA, 20 bp, synthetic construct
  misc_feature 1..20: note = CRISPR gRNA sequence
  source 1..20: mol_type = other DNA
cctgggctcactgtttgacc

SEQ ID NO: 29599 - DNA, 20 bp, synthetic construct
  misc_feature 1..20: note = CRISPR gRNA sequence
  source 1..20: mol_type = other DNA
ctgggctcactgtttgacca

SEQ ID NO: 29600 - DNA, 20 bp, synthetic construct
  misc_feature 1..20: note = CRISPR gRNA sequence
  source 1..20: mol_type = other DNA
ggctcactgtttgaccacag

SEQ ID NO: 29601 - DNA, 20 bp, synthetic construct
  misc_feature 1..20: note = CRISPR gRNA sequence
  source 1..20: mol_type = other DNA
actgtttgaccacagagaag

SEQ ID NO: 29602 - DNA, 20 bp, synthetic construct
  misc_feature 1..20: note = CRISPR gRNA sequence
  source 1..20: mol_type = other DNA
tttgaccacagagaagtggt

SEQ ID NO: 29603 - DNA, 20 bp, synthetic construct
  misc_feature 1..20: note = CRISPR gRNA sequence
  source 1..20: mol_type = other DNA
gaccacagagaagtggtctc

SEQ ID NO: 29604 - DNA, 20 bp, synthetic construct
  misc_feature 1..20: note = CRISPR gRNA sequence
  source 1..20: mol_type = other DNA
accacagagaagtggtctca

SEQ ID NO: 29605 - DNA, 20 bp, synthetic construct
  misc_feature 1..20: note = CRISPR gRNA sequence
  source 1..20: mol_type = other DNA
aactctctgggtcttggttt

SEQ ID NO: 29606 - DNA, 20 bp, synthetic construct
  misc_feature 1..20: note = CRISPR gRNA sequence
  source 1..20: mol_type = other DNA
tctgggtcttggtttgcctg

SEQ ID NO: 29607 - DNA, 20 bp, synthetic construct
  misc_feature 1..20: note = CRISPR gRNA sequence
  source 1..20: mol_type = other DNA
tgggtcttggtttgcctgtc

SEQ ID NO: 29608 - DNA, 20 bp, synthetic construct
  misc_feature 1..20: note = CRISPR gRNA sequence
  source 1..20: mol_type = other DNA
ggtcttggtttgcctgtctt

SEQ ID NO: 29609 - DNA, 20 bp, synthetic construct
  misc_feature 1..20: note = CRISPR gRNA sequence
  source 1..20: mol_type = other DNA
ggtttgcctgtctttaaaat

SEQ ID NO: 29610 - DNA, 20 bp, synthetic construct
  misc_feature 1..20: note = CRISPR gRNA sequence
  source 1..20: mol_type = other DNA
gtttgcctgtctttaaaatg

SEQ ID NO: 29611 - DNA, 20 bp, synthetic construct
  misc_feature 1..20: note = CRISPR gRNA sequence
  source 1..20: mol_type = other DNA
gcctgtctttaaaatggggc

SEQ ID NO: 29612 - DNA, 20 bp, synthetic construct
  misc_feature 1..20: note = CRISPR gRNA sequence
  source 1..20: mol_type = other DNA
cctgtctttaaaatggggca

SEQ ID NO: 29613 - DNA, 20 bp, synthetic construct
  misc_feature 1..20: note = CRISPR gRNA sequence
  source 1..20: mol_type = other DNA
tctttaaaatggggcagtaa

SEQ ID NO: 29614 - DNA, 20 bp, synthetic construct
  misc_feature 1..20: note = CRISPR gRNA sequence
  source 1..20: mol_type = other DNA
taaaatggggcagtaatccc

SEQ ID NO: 29615 - DNA, 20 bp, synthetic construct
  misc_feature 1..20: note = CRISPR gRNA sequence
  source 1..20: mol_type = other DNA
aaaatggggcagtaatccca

SEQ ID NO: 29616 - DNA, 20 bp, synthetic construct
  misc_feature 1..20: note = CRISPR gRNA sequence
  source 1..20: mol_type = other DNA
aaatggggcagtaatcccag

SEQ ID NO: 29617 - DNA, 20 bp, synthetic construct
  misc_feature 1..20: note = CRISPR gRNA sequence
  source 1..20: mol_type = other DNA
ccacggggctgacctccagg

SEQ ID NO: 29618 - DNA, 20 bp, synthetic construct
  misc_feature 1..20: note = CRISPR gRNA sequence
  source 1..20: mol_type = other DNA
acctccaggctgcaggggac

SEQ ID NO: 29619 - DNA, 20 bp, synthetic construct
  misc_feature 1..20: note = CRISPR gRNA sequence
  source 1..20: mol_type = other DNA
caggctgcaggggacactga

SEQ ID NO: 29620 - DNA, 20 bp, synthetic construct
  misc_feature 1..20: note = CRISPR gRNA sequence
  source 1..20: mol_type = other DNA
caggggacactgagatccta

SEQ ID NO: 29621 - DNA, 20 bp, synthetic construct
  misc_feature 1..20: note = CRISPR gRNA sequence
  source 1..20: mol_type = other DNA
agatcctagaagcaatcacc

SEQ ID NO: 29622 - DNA, 20 bp, synthetic construct
  misc_feature 1..20: note = CRISPR gRNA sequence
  source 1..20: mol_type = other DNA
gaagcaatcaccacagccct

SEQ ID NO: 29623 - DNA, 20 bp, synthetic construct
  misc_feature 1..20: note = CRISPR gRNA sequence
  source 1..20: mol_type = other DNA
aacaagagaactagtgggac

SEQ ID NO: 29624 - DNA, 20 bp, synthetic construct
  misc_feature 1..20: note = CRISPR gRNA sequence
  source 1..20: mol_type = other DNA
gtgggacctggggacagaaa

SEQ ID NO: 29625 - DNA, 20 bp, synthetic construct
  misc_feature 1..20: note = CRISPR gRNA sequence
  source 1..20: mol_type = other DNA
gggacagaaactttgagcaa

SEQ ID NO: 29626 - DNA, 20 bp, synthetic construct
  misc_feature 1..20: note = CRISPR gRNA sequence
  source 1..20: mol_type = other DNA
tgagcaagtcacttattcat

SEQ ID NO: 29627 - DNA, 20 bp, synthetic construct
  misc_feature 1..20: note = CRISPR gRNA sequence
  source 1..20: mol_type = other DNA
gagcaagtcacttattcatt

SEQ ID NO: 29628 - DNA, 20 bp, synthetic construct
  misc_feature 1..20: note = CRISPR gRNA sequence
  source 1..20: mol_type = other DNA
agcaagtcacttattcattc

SEQ ID NO: 29629 - DNA, 20 bp, synthetic construct
  misc_feature 1..20: note = CRISPR gRNA sequence
  source 1..20: mol_type = other DNA
attcattcctagcctctatt

SEQ ID NO: 29630 - DNA, 20 bp, synthetic construct
  misc_feature 1..20: note = CRISPR gRNA sequence
  source 1..20: mol_type = other DNA
ttcattcctagcctctattt

SEQ ID NO: 29631 - DNA, 20 bp, synthetic construct
  misc_feature 1..20: note = CRISPR gRNA sequence
  source 1..20: mol_type = other DNA
attcctagcctctattttca

SEQ ID NO: 29632 - DNA, 20 bp, synthetic construct
  misc_feature 1..20: note = CRISPR gRNA sequence
  source 1..20: mol_type = other DNA
ctagcctctattttcatatc

SEQ ID NO: 29633 - DNA, 20 bp, synthetic construct
  misc_feature 1..20: note = CRISPR gRNA sequence
  source 1..20: mol_type = other DNA
gcctctattttcatatctag

SEQ ID NO: 29634 - DNA, 20 bp, synthetic construct
  misc_feature 1..20: note = CRISPR gRNA sequence
  source 1..20: mol_type = other DNA
tattttcatatctagaaaat

SEQ ID NO: 29635 - DNA, 20 bp, synthetic construct
  misc_feature 1..20: note = CRISPR gRNA sequence
  source 1..20: mol_type = other DNA
ttttcatatctagaaaatgg

SEQ ID NO: 29636 - DNA, 20 bp, synthetic construct
  misc_feature 1..20: note = CRISPR gRNA sequence
  source 1..20: mol_type = other DNA
tcatatctagaaaatgggaa

SEQ ID NO: 29637 - DNA, 20 bp, synthetic construct
  misc_feature 1..20: note = CRISPR gRNA sequence
  source 1..20: mol_type = other DNA
catatctagaaaatgggaac

SEQ ID NO: 29638 - DNA, 20 bp, synthetic construct
  misc_feature 1..20: note = CRISPR gRNA sequence
  source 1..20: mol_type = other DNA
atatctagaaaatgggaacc

SEQ ID NO: 29639 - DNA, 20 bp, synthetic construct
  misc_feature 1..20: note = CRISPR gRNA sequence
  source 1..20: mol_type = other DNA
gaaaatgggaaccatcccaa

SEQ ID NO: 29640 - DNA, 20 bp, synthetic construct
  misc_feature 1..20: note = CRISPR gRNA sequence
  source 1..20: mol_type = other DNA
tgtaagtacttggcacaatg

SEQ ID NO: 29641 - DNA, 20 bp, synthetic construct
  misc_feature 1..20: note = CRISPR gRNA sequence
  source 1..20: mol_type = other DNA
ggcacaatgccaggctctgt

SEQ ID NO: 29642 - DNA, 20 bp, synthetic construct
  misc_feature 1..20: note = CRISPR gRNA sequence
  source 1..20: mol_type = other DNA
gcacaatgccaggctctgtt

SEQ ID NO: 29643 - DNA, 20 bp, synthetic construct
  misc_feature 1..20: note = CRISPR gRNA sequence
  source 1..20: mol_type = other DNA
tgttgtgcaataaatattga

SEQ ID NO: 29644 - DNA, 20 bp, synthetic construct
  misc_feature 1..20: note = CRISPR gRNA sequence
  source 1..20: mol_type = other DNA
ttgtgcaataaatattgatt

SEQ ID NO: 29645 - DNA, 20 bp, synthetic construct
  misc_feature 1..20: note = CRISPR gRNA sequence
  source 1..20: mol_type = other DNA
tgcaataaatattgattcct

SEQ ID NO: 29646 - DNA, 20 bp, synthetic construct
  misc_feature 1..20: note = CRISPR gRNA sequence
  source 1..20: mol_type = other DNA
attccttcccccagggatag

SEQ ID NO: 29647 - DNA, 20 bp, synthetic construct
  misc_feature 1..20: note = CRISPR gRNA sequence
  source 1..20: mol_type = other DNA
cttcccccagggatagtggg

SEQ ID NO: 29648 - DNA, 20 bp, synthetic construct
  misc_feature 1..20: note = CRISPR gRNA sequence
  source 1..20: mol_type = other DNA
cccccagggatagtgggacc

SEQ ID NO: 29649 - DNA, 20 bp, synthetic construct
  misc_feature 1..20: note = CRISPR gRNA sequence
  source 1..20: mol_type = other DNA
ccccagggatagtgggacca

SEQ ID NO: 29650 - DNA, 20 bp, synthetic construct
  misc_feature 1..20: note = CRISPR gRNA sequence
  source 1..20: mol_type = other DNA
tttctggaatctagggatgg

SEQ ID NO: 29651 - DNA, 20 bp, synthetic construct
  misc_feature 1..20: note = CRISPR gRNA sequence
  source 1..20: mol_type = other DNA
ttctggaatctagggatggt

SEQ ID NO: 29652 - DNA, 20 bp, synthetic construct
  misc_feature 1..20: note = CRISPR gRNA sequence
  source 1..20: mol_type = other DNA
tctggaatctagggatggtg

SEQ ID NO: 29653 - DNA, 20 bp, synthetic construct
  misc_feature 1..20: note = CRISPR gRNA sequence
  source 1..20: mol_type = other DNA
ctggaatctagggatggtgg

SEQ ID NO: 29654 - DNA, 20 bp, synthetic construct
  misc_feature 1..20: note = CRISPR gRNA sequence
  source 1..20: mol_type = other DNA
tggaatctagggatggtggc

SEQ ID NO: 29655 - DNA, 20 bp, synthetic construct
  misc_feature 1..20: note = CRISPR gRNA sequence
  source 1..20: mol_type = other DNA
gaatctagggatggtggctt

SEQ ID NO: 29656 - DNA, 20 bp, synthetic construct
  misc_feature 1..20: note = CRISPR gRNA sequence
  source 1..20: mol_type = other DNA
gggatggtggcttctggaag

SEQ ID NO: 29657 - DNA, 20 bp, synthetic construct
  misc_feature 1..20: note = CRISPR gRNA sequence
  source 1..20: mol_type = other DNA
ctggaaggctgaccatgcac

SEQ ID NO: 29658 - DNA, 20 bp, synthetic construct
  misc_feature 1..20: note = CRISPR gRNA sequence
  source 1..20: mol_type = other DNA
tggaaggctgaccatgcaca

SEQ ID NO: 29659 - DNA, 20 bp, synthetic construct
  misc_feature 1..20: note = CRISPR gRNA sequence
  source 1..20: mol_type = other DNA
gaaggctgaccatgcacagg

SEQ ID NO: 29660 - DNA, 20 bp, synthetic construct
  misc_feature 1..20: note = CRISPR gRNA sequence
  source 1..20: mol_type = other DNA
accatgcacaggcctccaat

SEQ ID NO: 29661 - DNA, 20 bp, synthetic construct
  misc_feature 1..20: note = CRISPR gRNA sequence
  source 1..20: mol_type = other DNA
caatccctccccctggcctc

SEQ ID NO: 29662 - DNA, 20 bp, synthetic construct
  misc_feature 1..20: note = CRISPR gRNA sequence
  source 1..20: mol_type = other DNA
cccctggcctctgtttccga

SEQ ID NO: 29663 - DNA, 20 bp, synthetic construct
  misc_feature 1..20: note = CRISPR gRNA sequence
  source 1..20: mol_type = other DNA
gcctctgtttccgacagctt

SEQ ID NO: 29664 - DNA, 20 bp, synthetic construct
  misc_feature 1..20: note = CRISPR gRNA sequence
  source 1..20: mol_type = other DNA
tgtttccgacagcttgtaca

SEQ ID NO: 29665 - DNA, 20 bp, synthetic construct
  misc_feature 1..20: note = CRISPR gRNA sequence
  source 1..20: mol_type = other DNA
tttccgacagcttgtacaat

SEQ ID NO: 29666 - DNA, 20 bp, synthetic construct
  misc_feature 1..20: note = CRISPR gRNA sequence
  source 1..20: mol_type = other DNA
ccgacagcttgtacaataac

SEQ ID NO: 29667 - DNA, 20 bp, synthetic construct
  misc_feature 1..20: note = CRISPR gRNA sequence
  source 1..20: mol_type = other DNA
cgacagcttgtacaataact

SEQ ID NO: 29668 - DNA, 20 bp, synthetic construct
  misc_feature 1..20: note = CRISPR gRNA sequence
  source 1..20: mol_type = other DNA
gtacaataactgcatctgcg

SEQ ID NO: 29669 - DNA, 20 bp, synthetic construct
  misc_feature 1..20: note = CRISPR gRNA sequence
  source 1..20: mol_type = other DNA
tacaataactgcatctgcga

SEQ ID NO: 29670 - DNA, 20 bp, synthetic construct
  misc_feature 1..20: note = CRISPR gRNA sequence
  source 1..20: mol_type = other DNA
catctgcgacgtgggagccg

SEQ ID NO: 29671 - DNA, 20 bp, synthetic construct
  misc_feature 1..20: note = CRISPR gRNA sequence
  source 1..20: mol_type = other DNA
cgacgtgggagccgagagct

SEQ ID NO: 29672 - DNA, 20 bp, synthetic construct
  misc_feature 1..20: note = CRISPR gRNA sequence
  source 1..20: mol_type = other DNA
ggctcgtgtgcttccggaca

SEQ ID NO: 29673 - DNA, 20 bp, synthetic construct
  misc_feature 1..20: note = CRISPR gRNA sequence
  source 1..20: mol_type = other DNA
gctcgtgtgcttccggacat

SEQ ID NO: 29674 - DNA, 20 bp, synthetic construct
  misc_feature 1..20: note = CRISPR gRNA sequence
  source 1..20: mol_type = other DNA
gtgtgcttccggacatggtg

SEQ ID NO: 29675 - DNA, 20 bp, synthetic construct
  misc_feature 1..20: note = CRISPR gRNA sequence
  source 1..20: mol_type = other DNA
ccggacatggtgtccctccg

SEQ ID NO: 29676 - DNA, 20 bp, synthetic construct
  misc_feature 1..20: note = CRISPR gRNA sequence
  source 1..20: mol_type = other DNA
cggacatggtgtccctccgg

SEQ ID NO: 29677 - DNA, 20 bp, synthetic construct
  misc_feature 1..20: note = CRISPR gRNA sequence
  source 1..20: mol_type = other DNA
cgggtgatggagtgagtgtg

SEQ ID NO: 29678 - DNA, 20 bp, synthetic construct
  misc_feature 1..20: note = CRISPR gRNA sequence
  source 1..20: mol_type = other DNA
ggcggtgggtggctcagccc

SEQ ID NO: 29679 - DNA, 20 bp, synthetic construct
  misc_feature 1..20: note = CRISPR gRNA sequence
  source 1..20: mol_type = other DNA
agcccggggtgggagacact

SEQ ID NO: 29680 - DNA, 20 bp, synthetic construct
  misc_feature 1..20: note = CRISPR gRNA sequence
  source 1..20: mol_type = other DNA
aagtctctccctggtgtcct

SEQ ID NO: 29681 - DNA, 20 bp, synthetic construct
  misc_feature 1..20: note = CRISPR gRNA sequence
  source 1..20: mol_type = other DNA
tccctggtgtcctggaagag

SEQ ID NO: 29682 - DNA, 20 bp, synthetic construct
  misc_feature 1..20: note = CRISPR gRNA sequence
  source 1..20: mol_type = other DNA
cctggtgtcctggaagagct

SEQ ID NO: 29683 - DNA, 20 bp, synthetic construct
  misc_feature 1..20: note = CRISPR gRNA sequence
  source 1..20: mol_type = other DNA
gtgtcctggaagagctggat

SEQ ID NO: 29684 - DNA, 20 bp, synthetic construct
  misc_feature 1..20: note = CRISPR gRNA sequence
  source 1..20: mol_type = other DNA
gaagagctggatgtgggggt

SEQ ID NO: 29685 - DNA, 20 bp, synthetic construct
  misc_feature 1..20: note = CRISPR gRNA sequence
  source 1..20: mol_type = other DNA
gatgtgggggtggccttggt

SEQ ID NO: 29686 - DNA, 20 bp, synthetic construct
  misc_feature 1..20: note = CRISPR gRNA sequence
  source 1..20: mol_type = other DNA
ggtctggagctggggagtcc

SEQ ID NO: 29687 - DNA, 20 bp, synthetic construct
  misc_feature 1..20: note = CRISPR gRNA sequence
  source 1..20: mol_type = other DNA
gtctggagctggggagtccc

SEQ ID NO: 29688 - DNA, 20 bp, synthetic construct
  misc_feature 1..20: note = CRISPR gRNA sequence
  source 1..20: mol_type = other DNA
gagctggggagtcccaaggg

SEQ ID NO: 29689 - DNA, 20 bp, synthetic construct
  misc_feature 1..20: note = CRISPR gRNA sequence
  source 1..20: mol_type = other DNA
gggagtcccaagggccaggc

SEQ ID NO: 29690 - DNA, 20 bp, synthetic construct
  misc_feature 1..20: note = CRISPR gRNA sequence
  source 1..20: mol_type = other DNA
ctcttgccagcgtccagtac

SEQ ID NO: 29691 - DNA, 20 bp, synthetic construct
  misc_feature 1..20: note = CRISPR gRNA sequence
  source 1..20: mol_type = other DNA
tcttgccagcgtccagtaca

SEQ ID NO: 29692 - DNA, 20 bp, synthetic construct
  misc_feature 1..20: note = CRISPR gRNA sequence
  source 1..20: mol_type = other DNA
ttgccagcgtccagtacaac

SEQ ID NO: 29693 - DNA, 20 bp, synthetic construct
  misc_feature 1..20: note = CRISPR gRNA sequence
  source 1..20: mol_type = other DNA
gccagcgtccagtacaacaa

SEQ ID NO: 29694 - DNA, 20 bp, synthetic construct
  misc_feature 1..20: note = CRISPR gRNA sequence
  source 1..20: mol_type = other DNA
ccagcgtccagtacaacaag

SEQ ID NO: 29695 - DNA, 20 bp, synthetic construct
  misc_feature 1..20: note = CRISPR gRNA sequence
  source 1..20: mol_type = other DNA
acggctgccggggcccagca

SEQ ID NO: 29696 - DNA, 20 bp, synthetic construct
  misc_feature 1..20: note = CRISPR gRNA sequence
  source 1..20: mol_type = other DNA
ccggggcccagcagctcgct

SEQ ID NO: 29697 - DNA, 20 bp, synthetic construct
  misc_feature 1..20: note = CRISPR gRNA sequence
  source 1..20: mol_type = other DNA
gctgccagccttcggaggtg

SEQ ID NO: 29698 - DNA, 20 bp, synthetic construct
  misc_feature 1..20: note = CRISPR gRNA sequence
  source 1..20: mol_type = other DNA
ccagccttcggaggtgtcct

SEQ ID NO: 29699 - DNA, 20 bp, synthetic construct
  misc_feature 1..20: note = CRISPR gRNA sequence
  source 1..20: mol_type = other DNA
cggaggtgtcctcatgtgga

SEQ ID NO: 29700 - DNA, 20 bp, synthetic construct
  misc_feature 1..20: note = CRISPR gRNA sequence
  source 1..20: mol_type = other DNA
ggaggtgtcctcatgtggag

SEQ ID NO: 29701 - DNA, 20 bp, synthetic construct
  misc_feature 1..20: note = CRISPR gRNA sequence
  source 1..20: mol_type = other DNA
atgtggagacgctggcgtaa

SEQ ID NO: 29702 - DNA, 20 bp, synthetic construct
  misc_feature 1..20: note = CRISPR gRNA sequence
  source 1..20: mol_type = other DNA
gcgtaagtccaggcaaccct

SEQ ID NO: 29703 - DNA, 20 bp, synthetic construct
  misc_feature 1..20: note = CRISPR gRNA sequence
  source 1..20: mol_type = other DNA
gtgggtggagaacaactcac

SEQ ID NO: 29704 - DNA, 20 bp, synthetic construct
  misc_feature 1..20: note = CRISPR gRNA sequence
  source 1..20: mol_type = other DNA
actccccaggcgtgtggccc

SEQ ID NO: 29705 - DNA, 20 bp, synthetic construct
  misc_feature 1..20: note = CRISPR gRNA sequence
  source 1..20: mol_type = other DNA
cccaggcgtgtggcccagtg

SEQ ID NO: 29706 - DNA, 20 bp, synthetic construct
  misc_feature 1..20: note = CRISPR gRNA sequence
  source 1..20: mol_type = other DNA
aaatcatgctcttcccttca

SEQ ID NO: 29707 - DNA, 20 bp, synthetic construct
  misc_feature 1..20: note = CRISPR gRNA sequence
  source 1..20: mol_type = other DNA
ttcccttcaccaatctgcaa

SEQ ID NO: 29708 - DNA, 20 bp, synthetic construct
  misc_feature 1..20: note = CRISPR gRNA sequence
  source 1..20: mol_type = other DNA
cccttcaccaatctgcaacc

SEQ ID NO: 29709 - DNA, 20 bp, synthetic construct
  misc_feature 1..20: note = CRISPR gRNA sequence
  source 1..20: mol_type = other DNA
ccttcaccaatctgcaaccc

SEQ ID NO: 29710 - DNA, 20 bp, synthetic construct
  misc_feature 1..20: note = CRISPR gRNA sequence
  source 1..20: mol_type = other DNA
caccaatctgcaaccctggg

SEQ ID NO: 29711 - DNA, 20 bp, synthetic construct
  misc_feature 1..20: note = CRISPR gRNA sequence
  source 1..20: mol_type = other DNA
accaatctgcaaccctgggt

SEQ ID NO: 29712 - DNA, 20 bp, synthetic construct
  misc_feature 1..20: note = CRISPR gRNA sequence
  source 1..20: mol_type = other DNA
caaccctgggtgagcagaca

SEQ ID NO: 29713 - DNA, 20 bp, synthetic construct
  misc_feature 1..20: note = CRISPR gRNA sequence
  source 1..20: mol_type = other DNA
ggtgagcagacacttccccc

SEQ ID NO: 29714 - DNA, 20 bp, synthetic construct
  misc_feature 1..20: note = CRISPR gRNA sequence
  source 1..20: mol_type = other DNA
ccccctctggcttcagcttc

SEQ ID NO: 29715 - DNA, 20 bp, synthetic construct
  misc_feature 1..20: note = CRISPR gRNA sequence
  source 1..20: mol_type = other DNA
cccctctggcttcagcttct

SEQ ID NO: 29716 - DNA, 20 bp, synthetic construct
  misc_feature 1..20: note = CRISPR gRNA sequence
  source 1..20: mol_type = other DNA
tggcttcagcttcttcatct

SEQ ID NO: 29717 - DNA, 20 bp, synthetic construct
  misc_feature 1..20: note = CRISPR gRNA sequence
  source 1..20: mol_type = other DNA
gcttcagcttcttcatctgt

SEQ ID NO: 29718 - DNA, 20 bp, synthetic construct
  misc_feature 1..20: note = CRISPR gRNA sequence
  source 1..20: mol_type = other DNA
cagcttcttcatctgtaaag

SEQ ID NO: 29719 - DNA, 20 bp, synthetic construct
  misc_feature 1..20: note = CRISPR gRNA sequence
  source 1..20: mol_type = other DNA
agcttcttcatctgtaaagt

SEQ ID NO: 29720 - DNA, 20 bp, synthetic construct
  misc_feature 1..20: note = CRISPR gRNA sequence
  source 1..20: mol_type = other DNA
cttcatctgtaaagtgggga

SEQ ID NO: 29721 - DNA, 20 bp, synthetic construct
  misc_feature 1..20: note = CRISPR gRNA sequence
  source 1..20: mol_type = other DNA
ttcatctgtaaagtggggac

SEQ ID NO: 29722 - DNA, 20 bp, synthetic construct
  misc_feature 1..20: note = CRISPR gRNA sequence
  source 1..20: mol_type = other DNA
catctgtaaagtggggacag

SEQ ID NO: 29723 - DNA, 20 bp, synthetic construct
  misc_feature 1..20: note = CRISPR gRNA sequence
  source 1..20: mol_type = other DNA
atctgtaaagtggggacagt

SEQ ID NO: 29724 - DNA, 20 bp, synthetic construct
  misc_feature 1..20: note = CRISPR gRNA sequence
  source 1..20: mol_type = other DNA
taaagtggggacagtaataa

SEQ ID NO: 29725 - DNA, 20 bp, synthetic construct
  misc_feature 1..20: note = CRISPR gRNA sequence
  source 1..20: mol_type = other DNA
tgtgaggcttaaactaatca

SEQ ID NO: 29726 - DNA, 20 bp, synthetic construct
  misc_feature 1..20: note = CRISPR gRNA sequence
  source 1..20: mol_type = other DNA
gtgaggcttaaactaatcaa

SEQ ID NO: 29727 - DNA, 20 bp, synthetic construct
  misc_feature 1..20: note = CRISPR gRNA sequence
  source 1..20: mol_type = other DNA
tgaggcttaaactaatcaag

SEQ ID NO: 29728 - DNA, 20 bp, synthetic construct
  misc_feature 1..20: note = CRISPR gRNA sequence
  source 1..20: mol_type = other DNA
aaactaatcaagccctacaa

SEQ ID NO: 29729 - DNA, 20 bp, synthetic construct
  misc_feature 1..20: note = CRISPR gRNA sequence
  source 1..20: mol_type = other DNA
aactaatcaagccctacaaa

SEQ ID NO: 29730 - DNA, 20 bp, synthetic construct
  misc_feature 1..20: note = CRISPR gRNA sequence
  source 1..20: mol_type = other DNA
atcaagccctacaaagctct

SEQ ID NO: 29731 - DNA, 20 bp, synthetic construct
  misc_feature 1..20: note = CRISPR gRNA sequence
  source 1..20: mol_type = other DNA
caaagctcttataacaacag

SEQ ID NO: 29732 - DNA, 20 bp, synthetic construct
  misc_feature 1..20: note = CRISPR gRNA sequence
  source 1..20: mol_type = other DNA
ttataacaacagtagctggc

SEQ ID NO: 29733 - DNA, 20 bp, synthetic construct
  misc_feature 1..20: note = CRISPR gRNA sequence
  source 1..20: mol_type = other DNA
ataacaacagtagctggcac

SEQ ID NO: 29734 - DNA, 20 bp, synthetic construct
  misc_feature 1..20: note = CRISPR gRNA sequence
  source 1..20: mol_type = other DNA
taacaacagtagctggcaca

SEQ ID NO: 29735 - DNA, 20 bp, synthetic construct
  misc_feature 1..20: note = CRISPR gRNA sequence
  source 1..20: mol_type = other DNA
gcacacaaaaatgccaataa

SEQ ID NO: 29736 - DNA, 20 bp, synthetic construct
  misc_feature 1..20: note = CRISPR gRNA sequence
  source 1..20: mol_type = other DNA
tattaggctgaaccatatga

SEQ ID NO: 29737 - DNA, 20 bp, synthetic construct
  misc_feature 1..20: note = CRISPR gRNA sequence
  source 1..20: mol_type = other DNA
ggctgaaccatatgaaattg

SEQ ID NO: 29738 - DNA, 20 bp, synthetic construct
  misc_feature 1..20: note = CRISPR gRNA sequence
  source 1..20: mol_type = other DNA
aaccatatgaaattgctgac

SEQ ID NO: 29739 - DNA, 20 bp, synthetic construct
  misc_feature 1..20: note = CRISPR gRNA sequence
  source 1..20: mol_type = other DNA
ctgacatccacccatttttg

SEQ ID NO: 29740 - DNA, 20 bp, synthetic construct
  misc_feature 1..20: note = CRISPR gRNA sequence
  source 1..20: mol_type = other DNA
acatccacccatttttgacc

SEQ ID NO: 29741 - DNA, 20 bp, synthetic construct
  misc_feature 1..20: note = CRISPR gRNA sequence
  source 1..20: mol_type = other DNA
ttgacctgtaaaattggcaa

SEQ ID NO: 29742 - DNA, 20 bp, synthetic construct
  misc_feature 1..20: note = CRISPR gRNA sequence
  source 1..20: mol_type = other DNA
tgacctgtaaaattggcaat

SEQ ID NO: 29743 - DNA, 20 bp, synthetic construct
  misc_feature 1..20: note = CRISPR gRNA sequence
  source 1..20: mol_type = other DNA
gacctgtaaaattggcaatt

SEQ ID NO: 29744 - DNA, 20 bp, synthetic construct
  misc_feature 1..20: note = CRISPR gRNA sequence
  source 1..20: mol_type = other DNA
acctgtaaaattggcaattt

SEQ ID NO: 29745 - DNA, 20 bp, synthetic construct
  misc_feature 1..20: note = CRISPR gRNA sequence
  source 1..20: mol_type = other DNA
taaaattggcaatttcatat

SEQ ID NO: 29746 - DNA, 20 bp, synthetic construct
  misc_feature 1..20: note = CRISPR gRNA sequence
  source 1..20: mol_type = other DNA
gcaatttcatatggttcagg

SEQ ID NO: 29747 - DNA, 20 bp, synthetic construct
  misc_feature 1..20: note = CRISPR gRNA sequence
  source 1..20: mol_type = other DNA
catatggttcaggtttatct

SEQ ID NO: 29748 - DNA, 20 bp, synthetic construct
  misc_feature 1..20: note = CRISPR gRNA sequence
  source 1..20: mol_type = other DNA
atatggttcaggtttatctt

SEQ ID NO: 29749 - DNA, 20 bp, synthetic construct
  misc_feature 1..20: note = CRISPR gRNA sequence
  source 1..20: mol_type = other DNA
aggtttatcttttattaagt

SEQ ID NO: 29750 - DNA, 20 bp, synthetic construct
  misc_feature 1..20: note = CRISPR gRNA sequence
  source 1..20: mol_type = other DNA
atcttttattaagtcaccat

SEQ ID NO: 29751 - DNA, 20 bp, synthetic construct
  misc_feature 1..20: note = CRISPR gRNA sequence
  source 1..20: mol_type = other DNA
tcttttattaagtcaccatg

SEQ ID NO: 29752 - DNA, 20 bp, synthetic construct
  misc_feature 1..20: note = CRISPR gRNA sequence
  source 1..20: mol_type = other DNA
ttattaagtcaccatgatgt

SEQ ID NO: 29753 - DNA, 20 bp, synthetic construct
  misc_feature 1..20: note = CRISPR gRNA sequence
  source 1..20: mol_type = other DNA
tattaagtcaccatgatgtc

SEQ ID NO: 29754 - DNA, 20 bp, synthetic construct
  misc_feature 1..20: note = CRISPR gRNA sequence
  source 1..20: mol_type = other DNA
attaagtcaccatgatgtcc

SEQ ID NO: 29755 - DNA, 20 bp, synthetic construct
  misc_feature 1..20: note = CRISPR gRNA sequence
  source 1..20: mol_type = other DNA
ttaagtcaccatgatgtcca

SEQ ID NO: 29756 - DNA, 20 bp, synthetic construct
  misc_feature 1..20: note = CRISPR gRNA sequence
  source 1..20: mol_type = other DNA
agtcaccatgatgtccaata

SEQ ID NO: 29757 - DNA, 20 bp, synthetic construct
  misc_feature 1..20: note = CRISPR gRNA sequence
  source 1..20: mol_type = other DNA
gttactttatattctttcaa

SEQ ID NO: 29758 - DNA, 20 bp, synthetic construct
  misc_feature 1..20: note = CRISPR gRNA sequence
  source 1..20: mol_type = other DNA
ctttatattctttcaaagca

SEQ ID NO: 29759 - DNA, 20 bp, synthetic construct
  misc_feature 1..20: note = CRISPR gRNA sequence
  source 1..20: mol_type = other DNA
tatattctttcaaagcactt

SEQ ID NO: 29760 - DNA, 20 bp, synthetic construct
  misc_feature 1..20: note = CRISPR gRNA sequence
  source 1..20: mol_type = other DNA
atattctttcaaagcacttt

SEQ ID NO: 29761 - DNA, 20 bp, synthetic construct
  misc_feature 1..20: note = CRISPR gRNA sequence
  source 1..20: mol_type = other DNA
tattctttcaaagcactttt

SEQ ID NO: 29762 - DNA, 20 bp, synthetic construct
  misc_feature 1..20: note = CRISPR gRNA sequence
  source 1..20: mol_type = other DNA
tttcaaagcacttttatctc

SEQ ID NO: 29763 - DNA, 20 bp, synthetic construct
  misc_feature 1..20: note = CRISPR gRNA sequence
  source 1..20: mol_type = other DNA
tcaaagcacttttatctcca

SEQ ID NO: 29764 - DNA, 20 bp, synthetic construct
  misc_feature 1..20: note = CRISPR gRNA sequence
  source 1..20: mol_type = other DNA
caaagcacttttatctccac

SEQ ID NO: 29765 - DNA, 20 bp, synthetic construct
  misc_feature 1..20: note = CRISPR gRNA sequence
  source 1..20: mol_type = other DNA
aaagcacttttatctccaca

SEQ ID NO: 29766 - DNA, 20 bp, synthetic construct
  misc_feature 1..20: note = CRISPR gRNA sequence
  source 1..20: mol_type = other DNA
ttatctccacaatcactcac

SEQ ID NO: 29767 - DNA, 20 bp, synthetic construct
  misc_feature 1..20: note = CRISPR gRNA sequence
  source 1..20: mol_type = other DNA
tatctccacaatcactcacc

SEQ ID NO: 29768 - DNA, 20 bp, synthetic construct
  misc_feature 1..20: note = CRISPR gRNA sequence
  source 1..20: mol_type = other DNA
atctccacaatcactcacct

SEQ ID NO: 29769 - DNA, 20 bp, synthetic construct
  misc_feature 1..20: note = CRISPR gRNA sequence
  source 1..20: mol_type = other DNA
tctccacaatcactcacctc

SEQ ID NO: 29770 - DNA, 20 bp, synthetic construct
  misc_feature 1..20: note = CRISPR gRNA sequence
  source 1..20: mol_type = other DNA
cacaatcactcacctcttct

SEQ ID NO: 29771 - DNA, 20 bp, synthetic construct
  misc_feature 1..20: note = CRISPR gRNA sequence
  source 1..20: mol_type = other DNA
acctcttctaagacgcacag

SEQ ID NO: 29772 - DNA, 20 bp, synthetic construct
  misc_feature 1..20: note = CRISPR gRNA sequence
  source 1..20: mol_type = other DNA
ttctaagacgcacagggtgg

SEQ ID NO: 29773 - DNA, 20 bp, synthetic construct
  misc_feature 1..20: note = CRISPR gRNA sequence
  source 1..20: mol_type = other DNA
ctaagacgcacagggtgggt

SEQ ID NO: 29774 - DNA, 20 bp, synthetic construct
  misc_feature 1..20: note = CRISPR gRNA sequence
  source 1..20: mol_type = other DNA
taagacgcacagggtgggtc

SEQ ID NO: 29775 - DNA, 20 bp, synthetic construct
  misc_feature 1..20: note = CRISPR gRNA sequence
  source 1..20: mol_type = other DNA
agacgcacagggtgggtctt

SEQ ID NO: 29776 - DNA, 20 bp, synthetic construct
  misc_feature 1..20: note = CRISPR gRNA sequence
  source 1..20: mol_type = other DNA
acaagacccattttacagat

SEQ ID NO: 29777 - DNA, 20 bp, synthetic construct
  misc_feature 1..20: note = CRISPR gRNA sequence
  source 1..20: mol_type = other DNA
caagacccattttacagatg

SEQ ID NO: 29778 - DNA, 20 bp, synthetic construct
  misc_feature 1..20: note = CRISPR gRNA sequence
  source 1..20: mol_type = other DNA
tacagatgaggaaaataaag

SEQ ID NO: 29779 - DNA, 20 bp, synthetic construct
  misc_feature 1..20: note = CRISPR gRNA sequence
  source 1..20: mol_type = other DNA
acagatgaggaaaataaagc

SEQ ID NO: 29780 - DNA, 20 bp, synthetic construct
  misc_feature 1..20: note = CRISPR gRNA sequence
  source 1..20: mol_type = other DNA
cagatgaggaaaataaagca

SEQ ID NO: 29781 - DNA, 20 bp, synthetic construct
  misc_feature 1..20: note = CRISPR gRNA sequence
  source 1..20: mol_type = other DNA
actaacctttctggggtcac

SEQ ID NO: 29782 - DNA, 20 bp, synthetic construct
  misc_feature 1..20: note = CRISPR gRNA sequence
  source 1..20: mol_type = other DNA
acctttctggggtcacacag

SEQ ID NO: 29783 - DNA, 20 bp, synthetic construct
  misc_feature 1..20: note = CRISPR gRNA sequence
  source 1..20: mol_type = other DNA
tctggggtcacacagcaagt

SEQ ID NO: 29784 - DNA, 20 bp, synthetic construct
  misc_feature 1..20: note = CRISPR gRNA sequence
  source 1..20: mol_type = other DNA
ctggggtcacacagcaagtc

SEQ ID NO: 29785 - DNA, 20 bp, synthetic construct
  misc_feature 1..20: note = CRISPR gRNA sequence
  source 1..20: mol_type = other DNA
tggggtcacacagcaagtca

SEQ ID NO: 29786 - DNA, 20 bp, synthetic construct
  misc_feature 1..20: note = CRISPR gRNA sequence
  source 1..20: mol_type = other DNA
gggtcacacagcaagtcagc

SEQ ID NO: 29787 - DNA, 20 bp, synthetic construct
  misc_feature 1..20: note = CRISPR gRNA sequence
  source 1..20: mol_type = other DNA
cagaaccataaaggaatctc

SEQ ID NO: 29788 - DNA, 20 bp, synthetic construct
  misc_feature 1..20: note = CRISPR gRNA sequence
  source 1..20: mol_type = other DNA
gggcctcctaggcttctcct

SEQ ID NO: 29789 - DNA, 20 bp, synthetic construct
  misc_feature 1..20: note = CRISPR gRNA sequence
  source 1..20: mol_type = other DNA
ctaggcttctccttttcccc

SEQ ID NO: 29790 - DNA, 20 bp, synthetic construct
  misc_feature 1..20: note = CRISPR gRNA sequence
  source 1..20: mol_type = other DNA
ggcttctccttttccccatg

SEQ ID NO: 29791 - DNA, 20 bp, synthetic construct
  misc_feature 1..20: note = CRISPR gRNA sequence
  source 1..20: mol_type = other DNA
ctccttttccccatgaccca

SEQ ID NO: 29792 - DNA, 20 bp, synthetic construct
  misc_feature 1..20: note = CRISPR gRNA sequence
  source 1..20: mol_type = other DNA
tccttttccccatgacccac

SEQ ID NO: 29793 - DNA, 20 bp, synthetic construct
  misc_feature 1..20: note = CRISPR gRNA sequence
  source 1..20: mol_type = other DNA
cttttccccatgacccacac

SEQ ID NO: 29794 - DNA, 20 bp, synthetic construct
  misc_feature 1..20: note = CRISPR gRNA sequence
  source 1..20: mol_type = other DNA
ttccccatgacccacaccgg

SEQ ID NO: 29795 - DNA, 20 bp, synthetic construct
  misc_feature 1..20: note = CRISPR gRNA sequence
  source 1..20: mol_type = other DNA
tccccatgacccacaccggt

SEQ ID NO: 29796 - DNA, 20 bp, synthetic construct
  misc_feature 1..20: note = CRISPR gRNA sequence
  source 1..20: mol_type = other DNA
ccccatgacccacaccggtc

SEQ ID NO: 29797 - DNA, 20 bp, synthetic construct
  misc_feature 1..20: note = CRISPR gRNA sequence
  source 1..20: mol_type = other DNA
cccatgacccacaccggtcg

SEQ ID NO: 29798 - DNA, 20 bp, synthetic construct
  misc_feature 1..20: note = CRISPR gRNA sequence
  source 1..20: mol_type = other DNA
gccaggggaaaagtccccaa

SEQ ID NO: 29799 - DNA, 20 bp, synthetic construct
  misc_feature 1..20: note = CRISPR gRNA sequence
  source 1..20: mol_type = other DNA
ccaggggaaaagtccccaac

SEQ ID NO: 29800 - DNA, 20 bp, synthetic construct
  misc_feature 1..20: note = CRISPR gRNA sequence
  source 1..20: mol_type = other DNA
taggctgggtggaaggaggg

SEQ ID NO: 29801 - DNA, 20 bp, synthetic construct
  misc_feature 1..20: note = CRISPR gRNA sequence
  source 1..20: mol_type = other DNA
ggctgggtggaaggagggat

SEQ ID NO: 29802 - DNA, 20 bp, synthetic construct
  misc_feature 1..20: note = CRISPR gRNA sequence
  source 1..20: mol_type = other DNA
ggtggaaggagggatttggg

SEQ ID NO: 29803 - DNA, 20 bp, synthetic construct
  misc_feature 1..20: note = CRISPR gRNA sequence
  source 1..20: mol_type = other DNA
gggggcagctgtcactgggg

SEQ ID NO: 29804 - DNA, 20 bp, synthetic construct
  misc_feature 1..20: note = CRISPR gRNA sequence
  source 1..20: mol_type = other DNA
ggggcagctgtcactggggc

SEQ ID NO: 29805 - DNA, 20 bp, synthetic construct
  misc_feature 1..20: note = CRISPR gRNA sequence
  source 1..20: mol_type = other DNA
tcactggggccccaggccgc

SEQ ID NO: 29806 - DNA, 20 bp, synthetic construct
  misc_feature 1..20: note = CRISPR gRNA sequence
  source 1..20: mol_type = other DNA
gggccccaggccgccctctc

SEQ ID NO: 29807 - DNA, 20 bp, synthetic construct
  misc_feature 1..20: note = CRISPR gRNA sequence
  source 1..20: mol_type = other DNA
tctcctctaacctggctctg

SEQ ID NO: 29808 - DNA, 20 bp, synthetic construct
  misc_feature 1..20: note = CRISPR gRNA sequence
  source 1..20: mol_type = other DNA
tcctctaacctggctctgag

SEQ ID NO: 29809 - DNA, 20 bp, synthetic construct
  misc_feature 1..20: note = CRISPR gRNA sequence
  source 1..20: mol_type = other DNA
ctctaacctggctctgagtc

SEQ ID NO: 29810 - DNA, 20 bp, synthetic construct
  misc_feature 1..20: note = CRISPR gRNA sequence
  source 1..20: mol_type = other DNA
taacctggctctgagtccca

SEQ ID NO: 29811 - DNA, 20 bp, synthetic construct
  misc_feature 1..20: note = CRISPR gRNA sequence
  source 1..20: mol_type = other DNA
acctggctctgagtcccatc

SEQ ID NO: 29812 - DNA, 20 bp, synthetic construct
  misc_feature 1..20: note = CRISPR gRNA sequence
  source 1..20: mol_type = other DNA
gctctgagtcccatcccccc

SEQ ID NO: 29813 - DNA, 20 bp, synthetic construct
  misc_feature 1..20: note = CRISPR gRNA sequence
  source 1..20: mol_type = other DNA
tgagtcccatccccccttgc

SEQ ID NO: 29814 - DNA, 20 bp, synthetic construct
  misc_feature 1..20: note = CRISPR gRNA sequence
  source 1..20: mol_type = other DNA
agtcccatccccccttgcag

SEQ ID NO: 29815 - DNA, 20 bp, synthetic construct
  misc_feature 1..20: note = CRISPR gRNA sequence
  source 1..20: mol_type = other DNA
gcaggatgtggacgcccacc

SEQ ID NO: 29816 - DNA, 20 bp, synthetic construct
  misc_feature 1..20: note = CRISPR gRNA sequence
  source 1..20: mol_type = other DNA
caggatgtggacgcccacca

SEQ ID NO: 29817 - DNA, 20 bp, synthetic construct
  misc_feature 1..20: note = CRISPR gRNA sequence
  source 1..20: mol_type = other DNA
agtgtccaggaacacctgca

SEQ ID NO: 29818 - DNA, 20 bp, synthetic construct
  misc_feature 1..20: note = CRISPR gRNA sequence
  source 1..20: mol_type = other DNA
caacaacaggattcacggat

SEQ ID NO: 29819 - DNA, 20 bp, synthetic construct
  misc_feature 1..20: note = CRISPR gRNA sequence
  source 1..20: mol_type = other DNA
acggatcagcctgagatgat

SEQ ID NO: 29820 - DNA, 20 bp, synthetic construct
  misc_feature 1..20: note = CRISPR gRNA sequence
  source 1..20: mol_type = other DNA
agatgatcccagctgtgctc

SEQ ID NO: 29821 - DNA, 20 bp, synthetic construct
  misc_feature 1..20: note = CRISPR gRNA sequence
  source 1..20: mol_type = other DNA
tgctctggacagggtaacca

SEQ ID NO: 29822 - DNA, 20 bp, synthetic construct
  misc_feature 1..20: note = CRISPR gRNA sequence
  source 1..20: mol_type = other DNA
tggacagggtaaccagggtg

SEQ ID NO: 29823 - DNA, 20 bp, synthetic construct
  misc_feature 1..20: note = CRISPR gRNA sequence
  source 1..20: mol_type = other DNA
gacagggtaaccagggtggg

SEQ ID NO: 29824 - DNA, 20 bp, synthetic construct
  misc_feature 1..20: note = CRISPR gRNA sequence
  source 1..20: mol_type = other DNA
gggaggggagagccgcagtg

SEQ ID NO: 29825 - DNA, 20 bp, synthetic construct
  misc_feature 1..20: note = CRISPR gRNA sequence
  source 1..20: mol_type = other DNA
ggaggggagagccgcagtgg

SEQ ID NO: 29826 - DNA, 20 bp, synthetic construct
  misc_feature 1..20: note = CRISPR gRNA sequence
  source 1..20: mol_type = other DNA
ggggcagtgtccttgtgaag

SEQ ID NO: 29827 - DNA, 20 bp, synthetic construct
  misc_feature 1..20: note = CRISPR gRNA sequence
  source 1..20: mol_type = other DNA
gtgaaggtggcattcaaaaa

SEQ ID NO: 29828 - DNA, 20 bp, synthetic construct
  misc_feature 1..20: note = CRISPR gRNA sequence
  source 1..20: mol_type = other DNA
tgaaggtggcattcaaaaaa

SEQ ID NO: 29829 - DNA, 20 bp, synthetic construct
  misc_feature 1..20: note = CRISPR gRNA sequence
  source 1..20: mol_type = other DNA
tttgaatgccaccttcacaa

SEQ ID NO: 29830 - DNA, 20 bp, synthetic construct
  misc_feature 1..20: note = CRISPR gRNA sequence
  source 1..20: mol_type = other DNA
ttgaatgccaccttcacaag

SEQ ID NO: 29831 - DNA, 20 bp, synthetic construct
  misc_feature 1..20: note = CRISPR gRNA sequence
  source 1..20: mol_type = other DNA
tgaatgccaccttcacaagg

SEQ ID NO: 29832 - DNA, 20 bp, synthetic construct
  misc_feature 1..20: note = CRISPR gRNA sequence
  source 1..20: mol_type = other DNA
gaatgccaccttcacaagga

SEQ ID NO: 29833 - DNA, 20 bp, synthetic construct
  misc_feature 1..20: note = CRISPR gRNA sequence
  source 1..20: mol_type = other DNA
aatgccaccttcacaaggac

SEQ ID NO: 29834 - DNA, 20 bp, synthetic construct
  misc_feature 1..20: note = CRISPR gRNA sequence
  source 1..20: mol_type = other DNA
cacaaggacactgcccccaa

SEQ ID NO: 29835 - DNA, 20 bp, synthetic construct
  misc_feature 1..20: note = CRISPR gRNA sequence
  source 1..20: mol_type = other DNA
acaaggacactgcccccaac

SEQ ID NO: 29836 - DNA, 20 bp, synthetic construct
  misc_feature 1..20: note = CRISPR gRNA sequence
  source 1..20: mol_type = other DNA
cccccaacccactgcggctc

SEQ ID NO: 29837 - DNA, 20 bp, synthetic construct
  misc_feature 1..20: note = CRISPR gRNA sequence
  source 1..20: mol_type = other DNA
cggctctcccctcccaagcc

SEQ ID NO: 29838 - DNA, 20 bp, synthetic construct
  misc_feature 1..20: note = CRISPR gRNA sequence
  source 1..20: mol_type = other DNA
tcccctcccaagcccaccct

SEQ ID NO: 29839 - DNA, 20 bp, synthetic construct
  misc_feature 1..20: note = CRISPR gRNA sequence
  source 1..20: mol_type = other DNA
ccctcccaagcccaccctgg

SEQ ID NO: 29840 - DNA, 20 bp, synthetic construct
  misc_feature 1..20: note = CRISPR gRNA sequence
  source 1..20: mol_type = other DNA
ccaagcccaccctggttacc

SEQ ID NO: 29841 - DNA, 20 bp, synthetic construct
  misc_feature 1..20: note = CRISPR gRNA sequence
  source 1..20: mol_type = other DNA
gttaccctgtccagagcaca

SEQ ID NO: 29842 - DNA, 20 bp, synthetic construct
  misc_feature 1..20: note = CRISPR gRNA sequence
  source 1..20: mol_type = other DNA
ccctgtccagagcacagctg

SEQ ID NO: 29843 - DNA, 20 bp, synthetic construct
  misc_feature 1..20: note = CRISPR gRNA sequence
  source 1..20: mol_type = other DNA
tccagagcacagctgggatc

SEQ ID NO: 29844 - DNA, 20 bp, synthetic construct
  misc_feature 1..20: note = CRISPR gRNA sequence
  source 1..20: mol_type = other DNA
ggatcatctcaggctgatcc

SEQ ID NO: 29845 - DNA, 20 bp, synthetic construct
  misc_feature 1..20: note = CRISPR gRNA sequence
  source 1..20: mol_type = other DNA
aggctgatccgtgaatcctg

SEQ ID NO: 29846 - DNA, 20 bp, synthetic construct
  misc_feature 1..20: note = CRISPR gRNA sequence
  source 1..20: mol_type = other DNA
atccgtgaatcctgttgttg

SEQ ID NO: 29847 - DNA, 20 bp, synthetic construct
  misc_feature 1..20: note = CRISPR gRNA sequence
  source 1..20: mol_type = other DNA
ttgttgcaggtgttcctgga

SEQ ID NO: 29848 - DNA, 20 bp, synthetic construct
  misc_feature 1..20: note = CRISPR gRNA sequence
  source 1..20: mol_type = other DNA
ttgcaggtgttcctggacac

SEQ ID NO: 29849 - DNA, 20 bp, synthetic construct
  misc_feature 1..20: note = CRISPR gRNA sequence
  source 1..20: mol_type = other DNA
caggtgttcctggacactga

SEQ ID NO: 29850 - DNA, 20 bp, synthetic construct
  misc_feature 1..20: note = CRISPR gRNA sequence
  source 1..20: mol_type = other DNA
ctggacactgaatgggatgg

SEQ ID NO: 29851 - DNA, 20 bp, synthetic construct
  misc_feature 1..20: note = CRISPR gRNA sequence
  source 1..20: mol_type = other DNA
gacactgaatgggatggtgg

SEQ ID NO: 29852 - DNA, 20 bp, synthetic construct
  misc_feature 1..20: note = CRISPR gRNA sequence
  source 1..20: mol_type = other DNA
aatgggatggtgggcgtcca

SEQ ID NO: 29853 - DNA, 20 bp, synthetic construct
  misc_feature 1..20: note = CRISPR gRNA sequence
  source 1..20: mol_type = other DNA
caaggggggatgggactcag

SEQ ID NO: 29854 - DNA, 20 bp, synthetic construct
  misc_feature 1..20: note = CRISPR gRNA sequence
  source 1..20: mol_type = other DNA
agagccaggttagaggagag

SEQ ID NO: 29855 - DNA, 20 bp, synthetic construct
  misc_feature 1..20: note = CRISPR gRNA sequence
  source 1..20: mol_type = other DNA
gaggagagagggcggcctgg

SEQ ID NO: 29856 - DNA, 20 bp, synthetic construct
  misc_feature 1..20: note = CRISPR gRNA sequence
  source 1..20: mol_type = other DNA
gggccccagtgacagctgcc

SEQ ID NO: 29857 - DNA, 20 bp, synthetic construct
  misc_feature 1..20: note = CRISPR gRNA sequence
  source 1..20: mol_type = other DNA
cccccaaatccctccttcca

SEQ ID NO: 29858 - DNA, 20 bp, synthetic construct
  misc_feature 1..20: note = CRISPR gRNA sequence
  source 1..20: mol_type = other DNA
cttccacccagcctagaacg

SEQ ID NO: 29859 - DNA, 20 bp, synthetic construct
  misc_feature 1..20: note = CRISPR gRNA sequence
  source 1..20: mol_type = other DNA
ccacccagcctagaacgttg

SEQ ID NO: 29860 - DNA, 20 bp, synthetic construct
  misc_feature 1..20: note = CRISPR gRNA sequence
  source 1..20: mol_type = other DNA
cacccagcctagaacgttgg

SEQ ID NO: 29861 - DNA, 20 bp, synthetic construct
  misc_feature 1..20: note = CRISPR gRNA sequence
  source 1..20: mol_type = other DNA
gaacgttggggacttttccc

SEQ ID NO: 29862 - DNA, 20 bp, synthetic construct
  misc_feature 1..20: note = CRISPR gRNA sequence
  source 1..20: mol_type = other DNA
gggacttttcccctggcaag

SEQ ID NO: 29863 - DNA, 20 bp, synthetic construct
  misc_feature 1..20: note = CRISPR gRNA sequence
  source 1..20: mol_type = other DNA
ttcccctggcaagataccga

SEQ ID NO: 29864 - DNA, 20 bp, synthetic construct
  misc_feature 1..20: note = CRISPR gRNA sequence
  source 1..20: mol_type = other DNA
tcccctggcaagataccgac

SEQ ID NO: 29865 - DNA, 20 bp, synthetic construct
  misc_feature 1..20: note = CRISPR gRNA sequence
  source 1..20: mol_type = other DNA
cccctggcaagataccgacc

SEQ ID NO: 29866 - DNA, 20 bp, synthetic construct
  misc_feature 1..20: note = CRISPR gRNA sequence
  source 1..20: mol_type = other DNA
ccctggcaagataccgaccg

SEQ ID NO: 29867 - DNA, 20 bp, synthetic construct
  misc_feature 1..20: note = CRISPR gRNA sequence
  source 1..20: mol_type = other DNA
gcaagataccgaccggtgtg

SEQ ID NO: 29868 - DNA, 20 bp, synthetic construct
  misc_feature 1..20: note = CRISPR gRNA sequence
  source 1..20: mol_type = other DNA
ggaggcccgagattccttta

SEQ ID NO: 29869 - DNA, 20 bp, synthetic construct
  misc_feature 1..20: note = CRISPR gRNA sequence
  source 1..20: mol_type = other DNA
ctttatggttctgcagctga

SEQ ID NO: 29870 - DNA, 20 bp, synthetic construct
  misc_feature 1..20: note = CRISPR gRNA sequence
  source 1..20: mol_type = other DNA
tatggttctgcagctgactt

SEQ ID NO: 29871 - DNA, 20 bp, synthetic construct
  misc_feature 1..20: note = CRISPR gRNA sequence
  source 1..20: mol_type = other DNA
atggttctgcagctgacttg

SEQ ID NO: 29872 - DNA, 20 bp, synthetic construct
  misc_feature 1..20: note = CRISPR gRNA sequence
  source 1..20: mol_type = other DNA
tggttctgcagctgacttgc

SEQ ID NO: 29873 - DNA, 20 bp, synthetic construct
  misc_feature 1..20: note = CRISPR gRNA sequence
  source 1..20: mol_type = other DNA
tgcagctgacttgctgtgtg

SEQ ID NO: 29874 - DNA, 20 bp, synthetic construct
  misc_feature 1..20: note = CRISPR gRNA sequence
  source 1..20: mol_type = other DNA
cagctgacttgctgtgtgac

SEQ ID NO: 29875 - DNA, 20 bp, synthetic construct
  misc_feature 1..20: note = CRISPR gRNA sequence
  source 1..20: mol_type = other DNA
acttgctgtgtgaccccaga

SEQ ID NO: 29876 - DNA, 20 bp, synthetic construct
  misc_feature 1..20: note = CRISPR gRNA sequence
  source 1..20: mol_type = other DNA
gctgtgtgaccccagaaagg

SEQ ID NO: 29877 - DNA, 20 bp, synthetic construct
  misc_feature 1..20: note = CRISPR gRNA sequence
  source 1..20: mol_type = other DNA
ctgtgtgaccccagaaaggt

SEQ ID NO: 29878 - DNA, 20 bp, synthetic construct
  misc_feature 1..20: note = CRISPR gRNA sequence
  source 1..20: mol_type = other DNA
tgtgaccccagaaaggttag

SEQ ID NO: 29879 - DNA, 20 bp, synthetic construct
  misc_feature 1..20: note = CRISPR gRNA sequence
  source 1..20: mol_type = other DNA
gttaactgctctgtgcttta

SEQ ID NO: 29880 - DNA, 20 bp, synthetic construct
  misc_feature 1..20: note = CRISPR gRNA sequence
  source 1..20: mol_type = other DNA
actgctctgtgctttatttt

SEQ ID NO: 29881 - DNA, 20 bp, synthetic construct
  misc_feature 1..20: note = CRISPR gRNA sequence
  source 1..20: mol_type = other DNA
ctctgtgctttattttcctc

SEQ ID NO: 29882 - DNA, 20 bp, synthetic construct
  misc_feature 1..20: note = CRISPR gRNA sequence
  source 1..20: mol_type = other DNA
tgtgctttattttcctcatc

SEQ ID NO: 29883 - DNA, 20 bp, synthetic construct
  misc_feature 1..20: note = CRISPR gRNA sequence
  source 1..20: mol_type = other DNA
tgctttattttcctcatctg

SEQ ID NO: 29884 - DNA, 20 bp, synthetic construct
  misc_feature 1..20: note = CRISPR gRNA sequence
  source 1..20: mol_type = other DNA
tattttcctcatctgtaaaa

SEQ ID NO: 29885 - DNA, 20 bp, synthetic construct
  misc_feature 1..20: note = CRISPR gRNA sequence
  source 1..20: mol_type = other DNA
attttcctcatctgtaaaat

SEQ ID NO: 29886 - DNA, 20 bp, synthetic construct
  misc_feature 1..20: note = CRISPR gRNA sequence
  source 1..20: mol_type = other DNA
ttttcctcatctgtaaaatg

SEQ ID NO: 29887 - DNA, 20 bp, synthetic construct
  misc_feature 1..20: note = CRISPR gRNA sequence
  source 1..20: mol_type = other DNA
tcctcatctgtaaaatgggt

SEQ ID NO: 29888 - DNA, 20 bp, synthetic construct
  misc_feature 1..20: note = CRISPR gRNA sequence
  source 1..20: mol_type = other DNA
cctcatctgtaaaatgggtc

SEQ ID NO: 29889 - DNA, 20 bp, synthetic construct
  misc_feature 1..20: note = CRISPR gRNA sequence
  source 1..20: mol_type = other DNA
ctcatctgtaaaatgggtct

SEQ ID NO: 29890 - DNA, 20 bp, synthetic construct
  misc_feature 1..20: note = CRISPR gRNA sequence
  source 1..20: mol_type = other DNA
atctgtaaaatgggtcttgt

SEQ ID NO: 29891 - DNA, 20 bp, synthetic construct
  misc_feature 1..20: note = CRISPR gRNA sequence
  source 1..20: mol_type = other DNA
taaaatgggtcttgtaagac

SEQ ID NO: 29892 - DNA, 20 bp, synthetic construct
  misc_feature 1..20: note = CRISPR gRNA sequence
  source 1..20: mol_type = other DNA
gtaagacccaccctgtgcgt

SEQ ID NO: 29893 - DNA, 20 bp, synthetic construct
  misc_feature 1..20: note = CRISPR gRNA sequence
  source 1..20: mol_type = other DNA
taagacccaccctgtgcgtc

SEQ ID NO: 29894 - DNA, 20 bp, synthetic construct
  misc_feature 1..20: note = CRISPR gRNA sequence
  source 1..20: mol_type = other DNA
tgcgtcttagaagaggtgag

SEQ ID NO: 29895 - DNA, 20 bp, synthetic construct
  misc_feature 1..20: note = CRISPR gRNA sequence
  source 1..20: mol_type = other DNA
agaagaggtgagtgattgtg

SEQ ID NO: 29896 - DNA, 20 bp, synthetic construct
  misc_feature 1..20: note = CRISPR gRNA sequence
  source 1..20: mol_type = other DNA
gaagaggtgagtgattgtgg

SEQ ID NO: 29897 - DNA, 20 bp, synthetic construct
  misc_feature 1..20: note = CRISPR gRNA sequence
  source 1..20: mol_type = other DNA
tggagataaaagtgctttga

SEQ ID NO: 29898 - DNA, 20 bp, synthetic construct
  misc_feature 1..20: note = CRISPR gRNA sequence
  source 1..20: mol_type = other DNA
tgaaagaatataaagtaacc

SEQ ID NO: 29899 - DNA, 20 bp, synthetic construct
  misc_feature 1..20: note = CRISPR gRNA sequence
  source 1..20: mol_type = other DNA
gaaagaatataaagtaacca

SEQ ID NO: 29900 - DNA, 20 bp, synthetic construct
  misc_feature 1..20: note = CRISPR gRNA sequence
  source 1..20: mol_type = other DNA
aaagaatataaagtaaccag

SEQ ID NO: 29901 - DNA, 20 bp, synthetic construct
  misc_feature 1..20: note = CRISPR gRNA sequence
  source 1..20: mol_type = other DNA
gacatcatggtgacttaata

SEQ ID NO: 29902 - DNA, 20 bp, synthetic construct
  misc_feature 1..20: note = CRISPR gRNA sequence
  source 1..20: mol_type = other DNA
aataaaagataaacctgaac

SEQ ID NO: 29903 - DNA, 20 bp, synthetic construct
  misc_feature 1..20: note = CRISPR gRNA sequence
  source 1..20: mol_type = other DNA
ataaaagataaacctgaacc

SEQ ID NO: 29904 - DNA, 20 bp, synthetic construct
  misc_feature 1..20: note = CRISPR gRNA sequence
  source 1..20: mol_type = other DNA
aaccatatgaaattgccaat

SEQ ID NO: 29905 - DNA, 20 bp, synthetic construct
  misc_feature 1..20: note = CRISPR gRNA sequence
  source 1..20: mol_type = other DNA
ccaattttacaggtcaaaaa

SEQ ID NO: 29906 - DNA, 20 bp, synthetic construct
  misc_feature 1..20: note = CRISPR gRNA sequence
  source 1..20: mol_type = other DNA
tacaggtcaaaaatgggtgg

SEQ ID NO: 29907 - DNA, 20 bp, synthetic construct
  misc_feature 1..20: note = CRISPR gRNA sequence
  source 1..20: mol_type = other DNA
acaggtcaaaaatgggtgga

SEQ ID NO: 29908 - DNA, 20 bp, synthetic construct
  misc_feature 1..20: note = CRISPR gRNA sequence
  source 1..20: mol_type = other DNA
caggtcaaaaatgggtggat

SEQ ID NO: 29909 - DNA, 20 bp, synthetic construct
  misc_feature 1..20: note = CRISPR gRNA sequence
  source 1..20: mol_type = other DNA
catatggttcagcctaatat

SEQ ID NO: 29910 - DNA, 20 bp, synthetic construct
  misc_feature 1..20: note = CRISPR gRNA sequence
  source 1..20: mol_type = other DNA
atatggttcagcctaatata

SEQ ID NO: 29911 - DNA, 20 bp, synthetic construct
  misc_feature 1..20: note = CRISPR gRNA sequence
  source 1..20: mol_type = other DNA
agcctaatatagcatttatt

SEQ ID NO: 29912 - DNA, 20 bp, synthetic construct
  misc_feature 1..20: note = CRISPR gRNA sequence
  source 1..20: mol_type = other DNA
atatagcatttattggcatt

SEQ ID NO: 29913 - DNA, 20 bp, synthetic construct
  misc_feature 1..20: note = CRISPR gRNA sequence
  source 1..20: mol_type = other DNA
attggcatttttgtgtgcca

SEQ ID NO: 29914 - DNA, 20 bp, synthetic construct
  misc_feature 1..20: note = CRISPR gRNA sequence
  source 1..20: mol_type = other DNA
ttggcatttttgtgtgccag

SEQ ID NO: 29915 - DNA, 20 bp, synthetic construct
  misc_feature 1..20: note = CRISPR gRNA sequence
  source 1..20: mol_type = other DNA
gcatttttgtgtgccagcta

SEQ ID NO: 29916 - DNA, 20 bp, synthetic construct
  misc_feature 1..20: note = CRISPR gRNA sequence
  source 1..20: mol_type = other DNA
ttgtgtgccagctactgttg

SEQ ID NO: 29917 - DNA, 20 bp, synthetic construct
  misc_feature 1..20: note = CRISPR gRNA sequence
  source 1..20: mol_type = other DNA
tgtgtgccagctactgttgt

SEQ ID NO: 29918 - DNA, 20 bp, synthetic construct
  misc_feature 1..20: note = CRISPR gRNA sequence
  source 1..20: mol_type = other DNA
gtgtgccagctactgttgtt

SEQ ID NO: 29919 - DNA, 20 bp, synthetic construct
  misc_feature 1..20: note = CRISPR gRNA sequence
  source 1..20: mol_type = other DNA
tgtgccagctactgttgtta

SEQ ID NO: 29920 - DNA, 20 bp, synthetic construct
  misc_feature 1..20: note = CRISPR gRNA sequence
  source 1..20: mol_type = other DNA
ctgttgttataagagctttg

SEQ ID NO: 29921 - DNA, 20 bp, synthetic construct
  misc_feature 1..20: note = CRISPR gRNA sequence
  source 1..20: mol_type = other DNA
ttgttataagagctttgtag

SEQ ID NO: 29922 - DNA, 20 bp, synthetic construct
  misc_feature 1..20: note = CRISPR gRNA sequence
  source 1..20: mol_type = other DNA
ttataagagctttgtagggc

SEQ ID NO: 29923 - DNA, 20 bp, synthetic construct
  misc_feature 1..20: note = CRISPR gRNA sequence
  source 1..20: mol_type = other DNA
taagagctttgtagggcttg

SEQ ID NO: 29924 - DNA, 20 bp, synthetic construct
  misc_feature 1..20: note = CRISPR gRNA sequence
  source 1..20: mol_type = other DNA
tgtagggcttgattagttta

SEQ ID NO: 29925 - DNA, 20 bp, synthetic construct
  misc_feature 1..20: note = CRISPR gRNA sequence
  source 1..20: mol_type = other DNA
gtagggcttgattagtttaa

SEQ ID NO: 29926 - DNA, 20 bp, synthetic construct
  misc_feature 1..20: note = CRISPR gRNA sequence
  source 1..20: mol_type = other DNA
tagggcttgattagtttaag

SEQ ID NO: 29927 - DNA, 20 bp, synthetic construct
  misc_feature 1..20: note = CRISPR gRNA sequence
  source 1..20: mol_type = other DNA
gattagtttaagcctcacaa

SEQ ID NO: 29928 - DNA, 20 bp, synthetic construct
  misc_feature 1..20: note = CRISPR gRNA sequence
  source 1..20: mol_type = other DNA
attagtttaagcctcacaaa

SEQ ID NO: 29929 - DNA, 20 bp, synthetic construct
  misc_feature 1..20: note = CRISPR gRNA sequence
  source 1..20: mol_type = other DNA
gtttaagcctcacaaaacct

SEQ ID NO: 29930 - DNA, 20 bp, synthetic construct
  misc_feature 1..20: note = CRISPR gRNA sequence
  source 1..20: mol_type = other DNA
aagcctcacaaaacctcttg

SEQ ID NO: 29931 - DNA, 20 bp, synthetic construct
  misc_feature 1..20: note = CRISPR gRNA sequence
  source 1..20: mol_type = other DNA
agcctcacaaaacctcttgg

SEQ ID NO: 29932 - DNA, 20 bp, synthetic construct
  misc_feature 1..20: note = CRISPR gRNA sequence
  source 1..20: mol_type = other DNA
acaaaacctcttgggtggat

SEQ ID NO: 29933 - DNA, 20 bp, synthetic construct
  misc_feature 1..20: note = CRISPR gRNA sequence
  source 1..20: mol_type = other DNA
ttgggtggatattattactg

SEQ ID NO: 29934 - DNA, 20 bp, synthetic construct
  misc_feature 1..20: note = CRISPR gRNA sequence
  source 1..20: mol_type = other DNA
gggtggatattattactgtc

SEQ ID NO: 29935 - DNA, 20 bp, synthetic construct
  misc_feature 1..20: note = CRISPR gRNA sequence
  source 1..20: mol_type = other DNA
ggtggatattattactgtcc

SEQ ID NO: 29936 - DNA, 20 bp, synthetic construct
  misc_feature 1..20: note = CRISPR gRNA sequence
  source 1..20: mol_type = other DNA
ttactgtccccactttacag

SEQ ID NO: 29937 - DNA, 20 bp, synthetic construct
  misc_feature 1..20: note = CRISPR gRNA sequence
  source 1..20: mol_type = other DNA
ctgtccccactttacagatg

SEQ ID NO: 29938 - DNA, 20 bp, synthetic construct
  misc_feature 1..20: note = CRISPR gRNA sequence
  source 1..20: mol_type = other DNA
tccccactttacagatgaag

SEQ ID NO: 29939 - DNA, 20 bp, synthetic construct
  misc_feature 1..20: note = CRISPR gRNA sequence
  source 1..20: mol_type = other DNA
tacagatgaagaagctgaag

SEQ ID NO: 29940 - DNA, 20 bp, synthetic construct
  misc_feature 1..20: note = CRISPR gRNA sequence
  source 1..20: mol_type = other DNA
acagatgaagaagctgaagc

SEQ ID NO: 29941 - DNA, 20 bp, synthetic construct
  misc_feature 1..20: note = CRISPR gRNA sequence
  source 1..20: mol_type = other DNA
cagatgaagaagctgaagcc

SEQ ID NO: 29942 - DNA, 20 bp, synthetic construct
  misc_feature 1..20: note = CRISPR gRNA sequence
  source 1..20: mol_type = other DNA
aagccagagggggaagtgtc

SEQ ID NO: 29943 - DNA, 20 bp, synthetic construct
  misc_feature 1..20: note = CRISPR gRNA sequence
  source 1..20: mol_type = other DNA
ctcacccagggttgcagatt

SEQ ID NO: 29944 - DNA, 20 bp, synthetic construct
  misc_feature 1..20: note = CRISPR gRNA sequence
  source 1..20: mol_type = other DNA
acccagggttgcagattggt

SEQ ID NO: 29945 - DNA, 20 bp, synthetic construct
  misc_feature 1..20: note = CRISPR gRNA sequence
  source 1..20: mol_type = other DNA
cagattggtgaagggaagag

SEQ ID NO: 29946 - DNA, 20 bp, synthetic construct
  misc_feature 1..20: note = CRISPR gRNA sequence
  source 1..20: mol_type = other DNA
gtgaagggaagagcatgatt

SEQ ID NO: 29947 - DNA, 20 bp, synthetic construct
  misc_feature 1..20: note = CRISPR gRNA sequence
  source 1..20: mol_type = other DNA
gagctccggggtcacactgg

SEQ ID NO: 29948 - DNA, 20 bp, synthetic construct
  misc_feature 1..20: note = CRISPR gRNA sequence
  source 1..20: mol_type = other DNA
agctccggggtcacactggg

SEQ ID NO: 29949 - DNA, 20 bp, synthetic construct
  misc_feature 1..20: note = CRISPR gRNA sequence
  source 1..20: mol_type = other DNA
cggggtcacactgggccaca

SEQ ID NO: 29950 - DNA, 20 bp, synthetic construct
  misc_feature 1..20: note = CRISPR gRNA sequence
  source 1..20: mol_type = other DNA
ggccacacgcctggggagtg

SEQ ID NO: 29951 - DNA, 20 bp, synthetic construct
  misc_feature 1..20: note = CRISPR gRNA sequence
  source 1..20: mol_type = other DNA
gggagtgagttgttctccac

SEQ ID NO: 29952 - DNA, 20 bp, synthetic construct
  misc_feature 1..20: note = CRISPR gRNA sequence
  source 1..20: mol_type = other DNA
ttctccacccaccagggttg

SEQ ID NO: 29953 - DNA, 20 bp, synthetic construct
  misc_feature 1..20: note = CRISPR gRNA sequence
  source 1..20: mol_type = other DNA
tccacccaccagggttgcct

SEQ ID NO: 29954 - DNA, 20 bp, synthetic construct
  misc_feature 1..20: note = CRISPR gRNA sequence
  source 1..20: mol_type = other DNA
cacccaccagggttgcctgg

SEQ ID NO: 29955 - DNA, 20 bp, synthetic construct
  misc_feature 1..20: note = CRISPR gRNA sequence
  source 1..20: mol_type = other DNA
cctggacttacgccagcgtc

SEQ ID NO: 29956 - DNA, 20 bp, synthetic construct
  misc_feature 1..20: note = CRISPR gRNA sequence
  source 1..20: mol_type = other DNA
gacttacgccagcgtctcca

SEQ ID NO: 29957 - DNA, 20 bp, synthetic construct
  misc_feature 1..20: note = CRISPR gRNA sequence
  source 1..20: mol_type = other DNA
acgccagcgtctccacatga

SEQ ID NO: 29958 - DNA, 20 bp, synthetic construct
  misc_feature 1..20: note = CRISPR gRNA sequence
  source 1..20: mol_type = other DNA
cgccagcgtctccacatgag

SEQ ID NO: 29959 - DNA, 20 bp, synthetic construct
  misc_feature 1..20: note = CRISPR gRNA sequence
  source 1..20: mol_type = other DNA
cacatgaggacacctccgaa

SEQ ID NO: 29960 - DNA, 20 bp, synthetic construct
  misc_feature 1..20: note = CRISPR gRNA sequence
  source 1..20: mol_type = other DNA
cgaaggctggcagcgagctg

SEQ ID NO: 29961 - DNA, 20 bp, synthetic construct
  misc_feature 1..20: note = CRISPR gRNA sequence
  source 1..20: mol_type = other DNA
gcagcgagctgctgggcccc

SEQ ID NO: 29962 - DNA, 20 bp, synthetic construct
  misc_feature 1..20: note = CRISPR gRNA sequence
  source 1..20: mol_type = other DNA
ctgggccccggcagccgtga

SEQ ID NO: 29963 - DNA, 20 bp, synthetic construct
  misc_feature 1..20: note = CRISPR gRNA sequence
  source 1..20: mol_type = other DNA
ggccccggcagccgtgaact

SEQ ID NO: 29964 - DNA, 20 bp, synthetic construct
  misc_feature 1..20: note = CRISPR gRNA sequence
  source 1..20: mol_type = other DNA
gttgtactggacgctggcaa

SEQ ID NO: 29965 - DNA, 20 bp, synthetic construct
  misc_feature 1..20: note = CRISPR gRNA sequence
  source 1..20: mol_type = other DNA
ttgtactggacgctggcaag

SEQ ID NO: 29966 - DNA, 20 bp, synthetic construct
  misc_feature 1..20: note = CRISPR gRNA sequence
  source 1..20: mol_type = other DNA
tactggacgctggcaagaga

SEQ ID NO: 29967 - DNA, 20 bp, synthetic construct
  misc_feature 1..20: note = CRISPR gRNA sequence
  source 1..20: mol_type = other DNA
gacgctggcaagagaaactc

SEQ ID NO: 29968 - DNA, 20 bp, synthetic construct
  misc_feature 1..20: note = CRISPR gRNA sequence
  source 1..20: mol_type = other DNA
gcaagagaaactcaccttgg

SEQ ID NO: 29969 - DNA, 20 bp, synthetic construct
  misc_feature 1..20: note = CRISPR gRNA sequence
  source 1..20: mol_type = other DNA
accttggggcctggcccttg

SEQ ID NO: 29970 - DNA, 20 bp, synthetic construct
  misc_feature 1..20: note = CRISPR gRNA sequence
  source 1..20: mol_type = other DNA
ggggcctggcccttgggact

SEQ ID NO: 29971 - DNA, 20 bp, synthetic construct
  misc_feature 1..20: note = CRISPR gRNA sequence
  source 1..20: mol_type = other DNA
gggcctggcccttgggactc

SEQ ID NO: 29972 - DNA, 20 bp, synthetic construct
  misc_feature 1..20: note = CRISPR gRNA sequence
  source 1..20: mol_type = other DNA
gcccttgggactccccagct

SEQ ID NO: 29973 - DNA, 20 bp, synthetic construct
  misc_feature 1..20: note = CRISPR gRNA sequence
  source 1..20: mol_type = other DNA
gggactccccagctccagac

SEQ ID NO: 29974 - DNA, 20 bp, synthetic construct
  misc_feature 1..20: note = CRISPR gRNA sequence
  source 1..20: mol_type = other DNA
ggactccccagctccagacc

SEQ ID NO: 29975 - DNA, 20 bp, synthetic construct
  misc_feature 1..20: note = CRISPR gRNA sequence
  source 1..20: mol_type = other DNA
cccagctccagaccaaggcc

SEQ ID NO: 29976 - DNA, 20 bp, synthetic construct
  misc_feature 1..20: note = CRISPR gRNA sequence
  source 1..20: mol_type = other DNA
cagaccaaggccacccccac

SEQ ID NO: 29977 - DNA, 20 bp, synthetic construct
  misc_feature 1..20: note = CRISPR gRNA sequence
  source 1..20: mol_type = other DNA
ttccaggacaccagggagag

SEQ ID NO: 29978 - DNA, 20 bp, synthetic construct
  misc_feature 1..20: note = CRISPR gRNA sequence
  source 1..20: mol_type = other DNA
ccaggacaccagggagagac

SEQ ID NO: 29979 - DNA, 20 bp, synthetic construct
  misc_feature 1..20: note = CRISPR gRNA sequence
  source 1..20: mol_type = other DNA
caggacaccagggagagact

SEQ ID NO: 29980 - DNA, 20 bp, synthetic construct
  misc_feature 1..20: note = CRISPR gRNA sequence
  source 1..20: mol_type = other DNA
cagtgtctcccaccccgggc

SEQ ID NO: 29981 - DNA, 20 bp, synthetic construct
  misc_feature 1..20: note = CRISPR gRNA sequence
  source 1..20: mol_type = other DNA
agtgtctcccaccccgggct

SEQ ID NO: 29982 - DNA, 20 bp, synthetic construct
  misc_feature 1..20: note = CRISPR gRNA sequence
  source 1..20: mol_type = other DNA
ccaccccgggctgagccacc

SEQ ID NO: 29983 - DNA, 20 bp, synthetic construct
  misc_feature 1..20: note = CRISPR gRNA sequence
  source 1..20: mol_type = other DNA
agccacccaccgcccagact

SEQ ID NO: 29984 - DNA, 20 bp, synthetic construct
  misc_feature 1..20: note = CRISPR gRNA sequence
  source 1..20: mol_type = other DNA
ccacactcactccatcaccc

SEQ ID NO: 29985 - DNA, 20 bp, synthetic construct
  misc_feature 1..20: note = CRISPR gRNA sequence
  source 1..20: mol_type = other DNA
actccatcacccggagggac

SEQ ID NO: 29986 - DNA, 20 bp, synthetic construct
  misc_feature 1..20: note = CRISPR gRNA sequence
  source 1..20: mol_type = other DNA
catcacccggagggacacca

SEQ ID NO: 29987 - DNA, 20 bp, synthetic construct
  misc_feature 1..20: note = CRISPR gRNA sequence
  source 1..20: mol_type = other DNA
tcggctcccacgtcgcagat

SEQ ID NO: 29988 - DNA, 20 bp, synthetic construct
  misc_feature 1..20: note = CRISPR gRNA sequence
  source 1..20: mol_type = other DNA
ggctcccacgtcgcagatgc

SEQ ID NO: 29989 - DNA, 20 bp, synthetic construct
  misc_feature 1..20: note = CRISPR gRNA sequence
  source 1..20: mol_type = other DNA
ccacgtcgcagatgcagtta

SEQ ID NO: 29990 - DNA, 20 bp, synthetic construct
  misc_feature 1..20: note = CRISPR gRNA sequence
  source 1..20: mol_type = other DNA
ttgtacaagctgtcggaaac

SEQ ID NO: 29991 - DNA, 20 bp, synthetic construct
  misc_feature 1..20: note = CRISPR gRNA sequence
  source 1..20: mol_type = other DNA
tacaagctgtcggaaacaga

SEQ ID NO: 29992 - DNA, 20 bp, synthetic construct
  misc_feature 1..20: note = CRISPR gRNA sequence
  source 1..20: mol_type = other DNA
tcggaaacagaggccagggg

SEQ ID NO: 29993 - DNA, 20 bp, synthetic construct
  misc_feature 1..20: note = CRISPR gRNA sequence
  source 1..20: mol_type = other DNA
gaggcctgtgcatggtcagc

SEQ ID NO: 29994 - DNA, 20 bp, synthetic construct
  misc_feature 1..20: note = CRISPR gRNA sequence
  source 1..20: mol_type = other DNA
tgcatggtcagccttccaga

SEQ ID NO: 29995 - DNA, 20 bp, synthetic construct
  misc_feature 1..20: note = CRISPR gRNA sequence
  source 1..20: mol_type = other DNA
ccagaagccaccatccctag

SEQ ID NO: 29996 - DNA, 20 bp, synthetic construct
  misc_feature 1..20: note = CRISPR gRNA sequence
  source 1..20: mol_type = other DNA
cagaagccaccatccctaga

SEQ ID NO: 29997 - DNA, 20 bp, synthetic construct
  misc_feature 1..20: note = CRISPR gRNA sequence
  source 1..20: mol_type = other DNA
gattccagaaaaagcctggt

SEQ ID NO: 29998 - DNA, 20 bp, synthetic construct
  misc_feature 1..20: note = CRISPR gRNA sequence
  source 1..20: mol_type = other DNA
cagaaaaagcctggtcccac

SEQ ID NO: 29999 - DNA, 20 bp, synthetic construct
  misc_feature 1..20: note = CRISPR gRNA sequence
  source 1..20: mol_type = other DNA
gtcccactatccctggggga

SEQ ID NO: 30000 - DNA, 20 bp, synthetic construct
  misc_feature 1..20: note = CRISPR gRNA sequence
  source 1..20: mol_type = other DNA
tccctgggggaaggaatcaa

SEQ ID NO: 30001 - DNA, 20 bp, synthetic construct
  misc_feature 1..20: note = CRISPR gRNA sequence
  source 1..20: mol_type = other DNA
ggggaaggaatcaatattta

SEQ ID NO: 30002 - DNA, 20 bp, synthetic construct
  misc_feature 1..20: note = CRISPR gRNA sequence
  source 1..20: mol_type = other DNA
attgcacaacagagcctggc

SEQ ID NO: 30003 - DNA, 20 bp, synthetic construct
  misc_feature 1..20: note = CRISPR gRNA sequence
  source 1..20: mol_type = other DNA
ttgcacaacagagcctggca

SEQ ID NO: 30004 - DNA, 20 bp, synthetic construct
  misc_feature 1..20: note = CRISPR gRNA sequence
  source 1..20: mol_type = other DNA
cacaacagagcctggcattg

SEQ ID NO: 30005 - DNA, 20 bp, synthetic construct
  misc_feature 1..20: note = CRISPR gRNA sequence
  source 1..20: mol_type = other DNA
gcattgtgccaagtacttac

SEQ ID NO: 30006 - DNA, 20 bp, synthetic construct
  misc_feature 1..20: note = CRISPR gRNA sequence
  source 1..20: mol_type = other DNA
tgccaagtacttacataggc

SEQ ID NO: 30007 - DNA, 20 bp, synthetic construct
  misc_feature 1..20: note = CRISPR gRNA sequence
  source 1..20: mol_type = other DNA
acataggccattgggatggt

SEQ ID NO: 30008 - DNA, 20 bp, synthetic construct
  misc_feature 1..20: note = CRISPR gRNA sequence
  source 1..20: mol_type = other DNA
cataggccattgggatggtt

SEQ ID NO: 30009 - DNA, 20 bp, synthetic construct
  misc_feature 1..20: note = CRISPR gRNA sequence
  source 1..20: mol_type = other DNA
ggatggttcccattttctag

SEQ ID NO: 30010 - DNA, 20 bp, synthetic construct
  misc_feature 1..20: note = CRISPR gRNA sequence
  source 1..20: mol_type = other DNA
ccattttctagatatgaaaa

SEQ ID NO: 30011 - DNA, 20 bp, synthetic construct
  misc_feature 1..20: note = CRISPR gRNA sequence
  source 1..20: mol_type = other DNA
tctagatatgaaaatagagg

SEQ ID NO: 30012 - DNA, 20 bp, synthetic construct
  misc_feature 1..20: note = CRISPR gRNA sequence
  source 1..20: mol_type = other DNA
ctagatatgaaaatagaggc

SEQ ID NO: 30013 - DNA, 20 bp, synthetic construct
  misc_feature 1..20: note = CRISPR gRNA sequence
  source 1..20: mol_type = other DNA
tagatatgaaaatagaggct

SEQ ID NO: 30014 - DNA, 20 bp, synthetic construct
  misc_feature 1..20: note = CRISPR gRNA sequence
  source 1..20: mol_type = other DNA
gatatgaaaatagaggctag

SEQ ID NO: 30015 - DNA, 20 bp, synthetic construct
  misc_feature 1..20: note = CRISPR gRNA sequence
  source 1..20: mol_type = other DNA
ggaatgaataagtgacttgc

SEQ ID NO: 30016 - DNA, 20 bp, synthetic construct
  misc_feature 1..20: note = CRISPR gRNA sequence
  source 1..20: mol_type = other DNA
gctcaaagtttctgtcccca

SEQ ID NO: 30017 - DNA, 20 bp, synthetic construct
  misc_feature 1..20: note = CRISPR gRNA sequence
  source 1..20: mol_type = other DNA
ctcaaagtttctgtccccag

SEQ ID NO: 30018 - DNA, 20 bp, synthetic construct
  misc_feature 1..20: note = CRISPR gRNA sequence
  source 1..20: mol_type = other DNA
aaagtttctgtccccaggtc

SEQ ID NO: 30019 - DNA, 20 bp, synthetic construct
  misc_feature 1..20: note = CRISPR gRNA sequence
  source 1..20: mol_type = other DNA
ctgtccccaggtcccactag

SEQ ID NO: 30020 - DNA, 20 bp, synthetic construct
  misc_feature 1..20: note = CRISPR gRNA sequence
  source 1..20: mol_type = other DNA
tgtccccaggtcccactagt

SEQ ID NO: 30021 - DNA, 20 bp, synthetic construct
  misc_feature 1..20: note = CRISPR gRNA sequence
  source 1..20: mol_type = other DNA
tccccaggtcccactagttc

SEQ ID NO: 30022 - DNA, 20 bp, synthetic construct
  misc_feature 1..20: note = CRISPR gRNA sequence
  source 1..20: mol_type = other DNA
gttctcttgttcagggctgt

SEQ ID NO: 30023 - DNA, 20 bp, synthetic construct
  misc_feature 1..20: note = CRISPR gRNA sequence
  source 1..20: mol_type = other DNA
tcttgttcagggctgtggtg

SEQ ID NO: 30024 - DNA, 20 bp, synthetic construct
  misc_feature 1..20: note = CRISPR gRNA sequence
  source 1..20: mol_type = other DNA
ttgttcagggctgtggtgat

SEQ ID NO: 30025 - DNA, 20 bp, synthetic construct
  misc_feature 1..20: note = CRISPR gRNA sequence
  source 1..20: mol_type = other DNA
gttcagggctgtggtgattg

SEQ ID NO: 30026 - DNA, 20 bp, synthetic construct
  misc_feature 1..20: note = CRISPR gRNA sequence
  source 1..20: mol_type = other DNA
ttcagggctgtggtgattgc

SEQ ID NO: 30027 - DNA, 20 bp, synthetic construct
  misc_feature 1..20: note = CRISPR gRNA sequence
  source 1..20: mol_type = other DNA
agggctgtggtgattgcttc

SEQ ID NO: 30028 - DNA, 20 bp, synthetic construct
  misc_feature 1..20: note = CRISPR gRNA sequence
  source 1..20: mol_type = other DNA
tggtgattgcttctaggatc

SEQ ID NO: 30029 - DNA, 20 bp, synthetic construct
  misc_feature 1..20: note = CRISPR gRNA sequence
  source 1..20: mol_type = other DNA
cttctaggatctcagtgtcc

SEQ ID NO: 30030 - DNA, 20 bp, synthetic construct
  misc_feature 1..20: note = CRISPR gRNA sequence
  source 1..20: mol_type = other DNA
ctaggatctcagtgtcccct

SEQ ID NO: 30031 - DNA, 20 bp, synthetic construct
  misc_feature 1..20: note = CRISPR gRNA sequence
  source 1..20: mol_type = other DNA
taggatctcagtgtcccctg

SEQ ID NO: 30032 - DNA, 20 bp, synthetic construct
  misc_feature 1..20: note = CRISPR gRNA sequence
  source 1..20: mol_type = other DNA
ggatctcagtgtcccctgca

SEQ ID NO: 30033 - DNA, 20 bp, synthetic construct
  misc_feature 1..20: note = CRISPR gRNA sequence
  source 1..20: mol_type = other DNA
agtgtcccctgcagcctgga

SEQ ID NO: 30034 - DNA, 20 bp, synthetic construct
  misc_feature 1..20: note = CRISPR gRNA sequence
  source 1..20: mol_type = other DNA
cagcctggaggtcagccccg

SEQ ID NO: 30035 - DNA, 20 bp, synthetic construct
  misc_feature 1..20: note = CRISPR gRNA sequence
  source 1..20: mol_type = other DNA
gaggtcagccccgtgggagt

SEQ ID NO: 30036 - DNA, 20 bp, synthetic construct
  misc_feature 1..20: note = CRISPR gRNA sequence
  source 1..20: mol_type = other DNA
ctgggattactgccccattt

SEQ ID NO: 30037 - DNA, 20 bp, synthetic construct
  misc_feature 1..20: note = CRISPR gRNA sequence
  source 1..20: mol_type = other DNA
ggattactgccccattttaa

SEQ ID NO: 30038 - DNA, 20 bp, synthetic construct
  misc_feature 1..20: note = CRISPR gRNA sequence
  source 1..20: mol_type = other DNA
ctgccccattttaaagacag

SEQ ID NO: 30039 - DNA, 20 bp, synthetic construct
  misc_feature 1..20: note = CRISPR gRNA sequence
  source 1..20: mol_type = other DNA
ccccattttaaagacaggca

SEQ ID NO: 30040 - DNA, 20 bp, synthetic construct
  misc_feature 1..20: note = CRISPR gRNA sequence
  source 1..20: mol_type = other DNA
taaagacaggcaaaccaaga

SEQ ID NO: 30041 - DNA, 20 bp, synthetic construct
  misc_feature 1..20: note = CRISPR gRNA sequence
  source 1..20: mol_type = other DNA
aaagacaggcaaaccaagac

SEQ ID NO: 30042 - DNA, 20 bp, synthetic construct
  misc_feature 1..20: note = CRISPR gRNA sequence
  source 1..20: mol_type = other DNA
aagacaggcaaaccaagacc

SEQ ID NO: 30043 - DNA, 20 bp, synthetic construct
  misc_feature 1..20: note = CRISPR gRNA sequence
  source 1..20: mol_type = other DNA
agaccacttctctgtggtca

SEQ ID NO: 30044 - DNA, 20 bp, synthetic construct
  misc_feature 1..20: note = CRISPR gRNA sequence
  source 1..20: mol_type = other DNA
ctctgtggtcaaacagtgag

SEQ ID NO: 30045 - DNA, 20 bp, synthetic construct
  misc_feature 1..20: note = CRISPR gRNA sequence
  source 1..20: mol_type = other DNA
tctgtggtcaaacagtgagc

SEQ ID NO: 30046 - DNA, 20 bp, synthetic construct
  misc_feature 1..20: note = CRISPR gRNA sequence
  source 1..20: mol_type = other DNA
tgtggtcaaacagtgagccc

SEQ ID NO: 30047 - DNA, 20 bp, synthetic construct
  misc_feature 1..20: note = CRISPR gRNA sequence
  source 1..20: mol_type = other DNA
tggtcaaacagtgagcccag

SEQ ID NO: 30048 - DNA, 20 bp, synthetic construct
  misc_feature 1..20: note = CRISPR gRNA sequence
  source 1..20: mol_type = other DNA
aaaggaagtcatttcttgcc

SEQ ID NO: 30049 - DNA, 20 bp, synthetic construct
  misc_feature 1..20: note = CRISPR gRNA sequence
  source 1..20: mol_type = other DNA
cttgccttactgtgtggaaa

SEQ ID NO: 30050 - DNA, 20 bp, synthetic construct
  misc_feature 1..20: note = CRISPR gRNA sequence
  source 1..20: mol_type = other DNA
ttgccttactgtgtggaaac

SEQ ID NO: 30051 - DNA, 20 bp, synthetic construct
  misc_feature 1..20: note = CRISPR gRNA sequence
  source 1..20: mol_type = other DNA
gccttactgtgtggaaactg

SEQ ID NO: 30052 - DNA, 20 bp, synthetic construct
  misc_feature 1..20: note = CRISPR gRNA sequence
  source 1..20: mol_type = other DNA
ccttactgtgtggaaactgt

SEQ ID NO: 30053 - DNA, 20 bp, synthetic construct
  misc_feature 1..20: note = CRISPR gRNA sequence
  source 1..20: mol_type = other DNA
actgtgtggaaactgtcaga

SEQ ID NO: 30054 - DNA, 20 bp, synthetic construct
  misc_feature 1..20: note = CRISPR gRNA sequence
  source 1..20: mol_type = other DNA
ctgtgtggaaactgtcagaa

SEQ ID NO: 30055 - DNA, 20 bp, synthetic construct
  misc_feature 1..20: note = CRISPR gRNA sequence
  source 1..20: mol_type = other DNA
tgtggaaactgtcagaacaa

SEQ ID NO: 30056 - DNA, 20 bp, synthetic construct
  misc_feature 1..20: note = CRISPR gRNA sequence
  source 1..20: mol_type = other DNA
tcagaacaacttcccaagtt

SEQ ID NO: 30057 - DNA, 20 bp, synthetic construct
  misc_feature 1..20: note = CRISPR gRNA sequence
  source 1..20: mol_type = other DNA
cccaagttcaaatcccagct

SEQ ID NO: 30058 - DNA, 20 bp, synthetic construct
  misc_feature 1..20: note = CRISPR gRNA sequence
  source 1..20: mol_type = other DNA
ccaagttcaaatcccagcta

SEQ ID NO: 30059 - DNA, 20 bp, synthetic construct
  misc_feature 1..20: note = CRISPR gRNA sequence
  source 1..20: mol_type = other DNA
aaatcccagctatgcctctt

SEQ ID NO: 30060 - DNA, 20 bp, synthetic construct
  misc_feature 1..20: note = CRISPR gRNA sequence
  source 1..20: mol_type = other DNA
tgcctcttactgcctatgtg

SEQ ID NO: 30061 - DNA, 20 bp, synthetic construct
  misc_feature 1..20: note = CRISPR gRNA sequence
  source 1..20: mol_type = other DNA
ttactgcctatgtgaccttg

SEQ ID NO: 30062 - DNA, 20 bp, synthetic construct
  misc_feature 1..20: note = CRISPR gRNA sequence
  source 1..20: mol_type = other DNA
actgcctatgtgaccttggg

SEQ ID NO: 30063 - DNA, 20 bp, synthetic construct
  misc_feature 1..20: note = CRISPR gRNA sequence
  source 1..20: mol_type = other DNA
ctgcctatgtgaccttgggc

SEQ ID NO: 30064 - DNA, 20 bp, synthetic construct
  misc_feature 1..20: note = CRISPR gRNA sequence
  source 1..20: mol_type = other DNA
cctatgtgaccttgggcaag

SEQ ID NO: 30065 - DNA, 20 bp, synthetic construct
  misc_feature 1..20: note = CRISPR gRNA sequence
  source 1..20: mol_type = other DNA
tgtgaccttgggcaagctac

SEQ ID NO: 30066 - DNA, 20 bp, synthetic construct
  misc_feature 1..20: note = CRISPR gRNA sequence
  source 1..20: mol_type = other DNA
gggcaagctactcaactctt

SEQ ID NO: 30067 - DNA, 20 bp, synthetic construct
  misc_feature 1..20: note = CRISPR gRNA sequence
  source 1..20: mol_type = other DNA
ggcaagctactcaactcttc

SEQ ID NO: 30068 - DNA, 20 bp, synthetic construct
  misc_feature 1..20: note = CRISPR gRNA sequence
  source 1..20: mol_type = other DNA
ctcaactcttctgagactca

SEQ ID NO: 30069 - DNA, 20 bp, synthetic construct
  misc_feature 1..20: note = CRISPR gRNA sequence
  source 1..20: mol_type = other DNA
aactcttctgagactcagtt

SEQ ID NO: 30070 - DNA, 20 bp, synthetic construct
  misc_feature 1..20: note = CRISPR gRNA sequence
  source 1..20: mol_type = other DNA
ttctgagactcagtttgccc

SEQ ID NO: 30071 - DNA, 20 bp, synthetic construct
  misc_feature 1..20: note = CRISPR gRNA sequence
  source 1..20: mol_type = other DNA
ctgagactcagtttgcccat

SEQ ID NO: 30072 - DNA, 20 bp, synthetic construct
  misc_feature 1..20: note = CRISPR gRNA sequence
  source 1..20: mol_type = other DNA
tgagactcagtttgcccatc

SEQ ID NO: 30073 - DNA, 20 bp, synthetic construct
  misc_feature 1..20: note = CRISPR gRNA sequence
  source 1..20: mol_type = other DNA
agactcagtttgcccatctg

SEQ ID NO: 30074 - DNA, 20 bp, synthetic construct
  misc_feature 1..20: note = CRISPR gRNA sequence
  source 1..20: mol_type = other DNA
agtttgcccatctgtaaaat

SEQ ID NO: 30075 - DNA, 20 bp, synthetic construct
  misc_feature 1..20: note = CRISPR gRNA sequence
  source 1..20: mol_type = other DNA
gcccatctgtaaaatgggca

SEQ ID NO: 30076 - DNA, 20 bp, synthetic construct
  misc_feature 1..20: note = CRISPR gRNA sequence
  source 1..20: mol_type = other DNA
cccatctgtaaaatgggcat

SEQ ID NO: 30077 - DNA, 20 bp, synthetic construct
  misc_feature 1..20: note = CRISPR gRNA sequence
  source 1..20: mol_type = other DNA
taaaatgggcatgatagagt

SEQ ID NO: 30078 - DNA, 20 bp, synthetic construct
  misc_feature 1..20: note = CRISPR gRNA sequence
  source 1..20: mol_type = other DNA
tggggaggagtaaatgaatc

SEQ ID NO: 30079 - DNA, 20 bp, synthetic construct
  misc_feature 1..20: note = CRISPR gRNA sequence
  source 1..20: mol_type = other DNA
atataacatttagaacatgc

SEQ ID NO: 30080 - DNA, 20 bp, synthetic construct
  misc_feature 1..20: note = CRISPR gRNA sequence
  source 1..20: mol_type = other DNA
agaacatgccttggtgccta

SEQ ID NO: 30081 - DNA, 20 bp, synthetic construct
  misc_feature 1..20: note = CRISPR gRNA sequence
  source 1..20: mol_type = other DNA
gaacatgccttggtgcctag

SEQ ID NO: 30082 - DNA, 20 bp, synthetic construct
  misc_feature 1..20: note = CRISPR gRNA sequence
  source 1..20: mol_type = other DNA
ggtgcctagaatgaactaaa

SEQ ID NO: 30083 - DNA, 20 bp, synthetic construct
  misc_feature 1..20: note = CRISPR gRNA sequence
  source 1..20: mol_type = other DNA
gtgcctagaatgaactaaat

SEQ ID NO: 30084 - DNA, 20 bp, synthetic construct
  misc_feature 1..20: note = CRISPR gRNA sequence
  source 1..20: mol_type = other DNA
gaatgaactaaatgttagct

SEQ ID NO: 30085 - DNA, 20 bp, synthetic construct
  misc_feature 1..20: note = CRISPR gRNA sequence
  source 1..20: mol_type = other DNA
aatgttagctatggttctga

SEQ ID NO: 30086 - DNA, 20 bp, synthetic construct
  misc_feature 1..20: note = CRISPR gRNA sequence
  source 1..20: mol_type = other DNA
gctatggttctgactacatc

SEQ ID NO: 30087 - DNA, 20 bp, synthetic construct
  misc_feature 1..20: note = CRISPR gRNA sequence
  source 1..20: mol_type = other DNA
tggttctgactacatcacag

SEQ ID NO: 30088 - DNA, 20 bp, synthetic construct
  misc_feature 1..20: note = CRISPR gRNA sequence
  source 1..20: mol_type = other DNA
tgactacatcacaggaacat

SEQ ID NO: 30089 - DNA, 20 bp, synthetic construct
  misc_feature 1..20: note = CRISPR gRNA sequence
  source 1..20: mol_type = other DNA
actacatcacaggaacattg

SEQ ID NO: 30090 - DNA, 20 bp, synthetic construct
  misc_feature 1..20: note = CRISPR gRNA sequence
  source 1..20: mol_type = other DNA
catcacaggaacattggtga

SEQ ID NO: 30091 - DNA, 20 bp, synthetic construct
  misc_feature 1..20: note = CRISPR gRNA sequence
  source 1..20: mol_type = other DNA
gtgagggtcgcatgagttaa

SEQ ID NO: 30092 - DNA, 20 bp, synthetic construct
  misc_feature 1..20: note = CRISPR gRNA sequence
  source 1..20: mol_type = other DNA
acatagagggtgtgaccagc

SEQ ID NO: 30093 - DNA, 20 bp, synthetic construct
  misc_feature 1..20: note = CRISPR gRNA sequence
  source 1..20: mol_type = other DNA
ggggcaggaagagaaaaagc

SEQ ID NO: 30094 - DNA, 20 bp, synthetic construct
  misc_feature 1..20: note = CRISPR gRNA sequence
  source 1..20: mol_type = other DNA
gaccagctccagtttctgca

SEQ ID NO: 30095 - DNA, 20 bp, synthetic construct
  misc_feature 1..20: note = CRISPR gRNA sequence
  source 1..20: mol_type = other DNA
cagtttctgcagcatattca

SEQ ID NO: 30096 - DNA, 20 bp, synthetic construct
  misc_feature 1..20: note = CRISPR gRNA sequence
  source 1..20: mol_type = other DNA
ctgcagcatattcacaacca

SEQ ID NO: 30097 - DNA, 20 bp, synthetic construct
  misc_feature 1..20: note = CRISPR gRNA sequence
  source 1..20: mol_type = other DNA
tgcagcatattcacaaccag

SEQ ID NO: 30098 - DNA, 20 bp, synthetic construct
  misc_feature 1..20: note = CRISPR gRNA sequence
  source 1..20: mol_type = other DNA
cagcatattcacaaccagca

SEQ ID NO: 30099 - DNA, 20 bp, synthetic construct
  misc_feature 1..20: note = CRISPR gRNA sequence
  source 1..20: mol_type = other DNA
acaaccagcattagtagcag

SEQ ID NO: 30100 - DNA, 20 bp, synthetic construct
  misc_feature 1..20: note = CRISPR gRNA sequence
  source 1..20: mol_type = other DNA
gtagcagtgaaaatagcatg

SEQ ID NO: 30101 - DNA, 20 bp, synthetic construct
  misc_feature 1..20: note = CRISPR gRNA sequence
  source 1..20: mol_type = other DNA
atgccaacttcagctgttta

SEQ ID NO: 30102 - DNA, 20 bp, synthetic construct
  misc_feature 1..20: note = CRISPR gRNA sequence
  source 1..20: mol_type = other DNA
cagctgtttactcgacacca

SEQ ID NO: 30103 - DNA, 20 bp, synthetic construct
  misc_feature 1..20: note = CRISPR gRNA sequence
  source 1..20: mol_type = other DNA
agctgtttactcgacaccaa

SEQ ID NO: 30104 - DNA, 20 bp, synthetic construct
  misc_feature 1..20: note = CRISPR gRNA sequence
  source 1..20: mol_type = other DNA
tttactcgacaccaagcagc

SEQ ID NO: 30105 - DNA, 20 bp, synthetic construct
  misc_feature 1..20: note = CRISPR gRNA sequence
  source 1..20: mol_type = other DNA
actcgacaccaagcagcctt

SEQ ID NO: 30106 - DNA, 20 bp, synthetic construct
  misc_feature 1..20: note = CRISPR gRNA sequence
  source 1..20: mol_type = other DNA
ctcgacaccaagcagccttt

SEQ ID NO: 30107 - DNA, 20 bp, synthetic construct
  misc_feature 1..20: note = CRISPR gRNA sequence
  source 1..20: mol_type = other DNA
gacaccaagcagccttttaa

SEQ ID NO: 30108 - DNA, 20 bp, synthetic construct
  misc_feature 1..20: note = CRISPR gRNA sequence
  source 1..20: mol_type = other DNA
ttaacaggtcaggtgctgct

SEQ ID NO: 30109 - DNA, 20 bp, synthetic construct
  misc_feature 1..20: note = CRISPR gRNA sequence
  source 1..20: mol_type = other DNA
taacaggtcaggtgctgctg

SEQ ID NO: 30110 - DNA, 20 bp, synthetic construct
  misc_feature 1..20: note = CRISPR gRNA sequence
  source 1..20: mol_type = other DNA
aacaggtcaggtgctgctgc

SEQ ID NO: 30111 - DNA, 20 bp, synthetic construct
  misc_feature 1..20: note = CRISPR gRNA sequence
  source 1..20: mol_type = other DNA
acaggtcaggtgctgctgcg

SEQ ID NO: 30112 - DNA, 20 bp, synthetic construct
  misc_feature 1..20: note = CRISPR gRNA sequence
  source 1..20: mol_type = other DNA
ctgcgggtatgatttcaggg

SEQ ID NO: 30113 - DNA, 20 bp, synthetic construct
  misc_feature 1..20: note = CRISPR gRNA sequence
  source 1..20: mol_type = other DNA
cgggtatgatttcagggcca

SEQ ID NO: 30114 - DNA, 20 bp, synthetic construct
  misc_feature 1..20: note = CRISPR gRNA sequence
  source 1..20: mol_type = other DNA
cagggccatgactttgccat

SEQ ID NO: 30115 - DNA, 20 bp, synthetic construct
  misc_feature 1..20: note = CRISPR gRNA sequence
  source 1..20: mol_type = other DNA
agggccatgactttgccatg

SEQ ID NO: 30116 - DNA, 20 bp, synthetic construct
  misc_feature 1..20: note = CRISPR gRNA sequence
  source 1..20: mol_type = other DNA
tgccatgattcagcctcaga

SEQ ID NO: 30117 - DNA, 20 bp, synthetic construct
  misc_feature 1..20: note = CRISPR gRNA sequence
  source 1..20: mol_type = other DNA
gccatgattcagcctcagaa

SEQ ID NO: 30118 - DNA, 20 bp, synthetic construct
  misc_feature 1..20: note = CRISPR gRNA sequence
  source 1..20: mol_type = other DNA
ccatgattcagcctcagaac

SEQ ID NO: 30119 - DNA, 20 bp, synthetic construct
  misc_feature 1..20: note = CRISPR gRNA sequence
  source 1..20: mol_type = other DNA
agcctcagaactcccttgca

SEQ ID NO: 30120 - DNA, 20 bp, synthetic construct
  misc_feature 1..20: note = CRISPR gRNA sequence
  source 1..20: mol_type = other DNA
agaactcccttgcagggctg

SEQ ID NO: 30121 - DNA, 20 bp, synthetic construct
  misc_feature 1..20: note = CRISPR gRNA sequence
  source 1..20: mol_type = other DNA
ccttgcagggctgcatataa

SEQ ID NO: 30122 - DNA, 20 bp, synthetic construct
  misc_feature 1..20: note = CRISPR gRNA sequence
  source 1..20: mol_type = other DNA
gcagggctgcatataaaagc

SEQ ID NO: 30123 - DNA, 20 bp, synthetic construct
  misc_feature 1..20: note = CRISPR gRNA sequence
  source 1..20: mol_type = other DNA
cagggctgcatataaaagca

SEQ ID NO: 30124 - DNA, 20 bp, synthetic construct
  misc_feature 1..20: note = CRISPR gRNA sequence
  source 1..20: mol_type = other DNA
catataaaagcagcaggtgc

SEQ ID NO: 30125 - DNA, 20 bp, synthetic construct
  misc_feature 1..20: note = CRISPR gRNA sequence
  source 1..20: mol_type = other DNA
acgcctgtaatcctaacact

SEQ ID NO: 30126 - DNA, 20 bp, synthetic construct
  misc_feature 1..20: note = CRISPR gRNA sequence
  source 1..20: mol_type = other DNA
taatcctaacactttggagg

SEQ ID NO: 30127 - DNA, 20 bp, synthetic construct
  misc_feature 1..20: note = CRISPR gRNA sequence
  source 1..20: mol_type = other DNA
acactttggaggccgaggcg

SEQ ID NO: 30128 - DNA, 20 bp, synthetic construct
  misc_feature 1..20: note = CRISPR gRNA sequence
  source 1..20: mol_type = other DNA
tggaggccgaggcgggtgga

SEQ ID NO: 30129 - DNA, 20 bp, synthetic construct
  misc_feature 1..20: note = CRISPR gRNA sequence
  source 1..20: mol_type = other DNA
ggaggccgaggcgggtggat

SEQ ID NO: 30130 - DNA, 20 bp, synthetic construct
  misc_feature 1..20: note = CRISPR gRNA sequence
  source 1..20: mol_type = other DNA
gaggccgaggcgggtggatc

SEQ ID NO: 30131 - DNA, 20 bp, synthetic construct
  misc_feature 1..20: note = CRISPR gRNA sequence
  source 1..20: mol_type = other DNA
aggtcgggagtttgagacca

SEQ ID NO: 30132 - DNA, 20 bp, synthetic construct
  misc_feature 1..20: note = CRISPR gRNA sequence
  source 1..20: mol_type = other DNA
gagaccagcctgaccaacat

SEQ ID NO: 30133 - DNA, 20 bp, synthetic construct
  misc_feature 1..20: note = CRISPR gRNA sequence
  source 1..20: mol_type = other DNA
agaccagcctgaccaacatg

SEQ ID NO: 30134 - DNA, 20 bp, synthetic construct
  misc_feature 1..20: note = CRISPR gRNA sequence
  source 1..20: mol_type = other DNA
accaacatggagaaaccccg

SEQ ID NO: 30135 - DNA, 20 bp, synthetic construct
  misc_feature 1..20: note = CRISPR gRNA sequence
  source 1..20: mol_type = other DNA
tactaaaaatacaaaattag

SEQ ID NO: 30136 - DNA, 20 bp, synthetic construct
  misc_feature 1..20: note = CRISPR gRNA sequence
  source 1..20: mol_type = other DNA
ctaaaaatacaaaattagcc

SEQ ID NO: 30137 - DNA, 20 bp, synthetic construct
  misc_feature 1..20: note = CRISPR gRNA sequence
  source 1..20: mol_type = other DNA
aaaatacaaaattagccggg

SEQ ID NO: 30138 - DNA, 20 bp, synthetic construct
  misc_feature 1..20: note = CRISPR gRNA sequence
  source 1..20: mol_type = other DNA
gccgggtgtgatggcacatg

SEQ ID NO: 30139 - DNA, 20 bp, synthetic construct
  misc_feature 1..20: note = CRISPR gRNA sequence
  source 1..20: mol_type = other DNA
tactcccagctacttgagag

SEQ ID NO: 30140 - DNA, 20 bp, synthetic construct
  misc_feature 1..20: note = CRISPR gRNA sequence
  source 1..20: mol_type = other DNA
ccagctacttgagaggctga

SEQ ID NO: 30141 - DNA, 20 bp, synthetic construct
  misc_feature 1..20: note = CRISPR gRNA sequence
  source 1..20: mol_type = other DNA
cttgagaggctgaggcagga

SEQ ID NO: 30142 - DNA, 20 bp, synthetic construct
  misc_feature 1..20: note = CRISPR gRNA sequence
  source 1..20: mol_type = other DNA
gagaggctgaggcaggagaa

SEQ ID NO: 30143 - DNA, 20 bp, synthetic construct
  misc_feature 1..20: note = CRISPR gRNA sequence
  source 1..20: mol_type = other DNA
agaggctgaggcaggagaat

SEQ ID NO: 30144 - DNA, 20 bp, synthetic construct
  misc_feature 1..20: note = CRISPR gRNA sequence
  source 1..20: mol_type = other DNA
aggcaggagaattgcttgaa

SEQ ID NO: 30145 - DNA, 20 bp, synthetic construct
  misc_feature 1..20: note = CRISPR gRNA sequence
  source 1..20: mol_type = other DNA
cttgaactcgggaggcggag

SEQ ID NO: 30146 - DNA, 20 bp, synthetic construct
  misc_feature 1..20: note = CRISPR gRNA sequence
  source 1..20: mol_type = other DNA
gaactcgggaggcggagttg

SEQ ID NO: 30147 - DNA, 20 bp, synthetic construct
  misc_feature 1..20: note = CRISPR gRNA sequence
  source 1..20: mol_type = other DNA
aactcgggaggcggagttgc

SEQ ID NO: 30148 - DNA, 20 bp, synthetic construct
  misc_feature 1..20: note = CRISPR gRNA sequence
  source 1..20: mol_type = other DNA
gggaggcggagttgcagtga

SEQ ID NO: 30149 - DNA, 20 bp, synthetic construct
  misc_feature 1..20: note = CRISPR gRNA sequence
  source 1..20: mol_type = other DNA
cagtgaactgagactgcact

SEQ ID NO: 30150 - DNA, 20 bp, synthetic construct
  misc_feature 1..20: note = CRISPR gRNA sequence
  source 1..20: mol_type = other DNA
agactgcactccagccttgg

SEQ ID NO: 30151 - DNA, 20 bp, synthetic construct
  misc_feature 1..20: note = CRISPR gRNA sequence
  source 1..20: mol_type = other DNA
cactccagccttggcaacaa

SEQ ID NO: 30152 - DNA, 20 bp, synthetic construct
  misc_feature 1..20: note = CRISPR gRNA sequence
  source 1..20: mol_type = other DNA
cagccttggcaacaagagcg

SEQ ID NO: 30153 - DNA, 20 bp, synthetic construct
  misc_feature 1..20: note = CRISPR gRNA sequence
  source 1..20: mol_type = other DNA
ggcaacaagagcgaaactct

SEQ ID NO: 30154 - DNA, 20 bp, synthetic construct
  misc_feature 1..20: note = CRISPR gRNA sequence
  source 1..20: mol_type = other DNA
gcaacaagagcgaaactctg

SEQ ID NO: 30155 - DNA, 20 bp, synthetic construct
  misc_feature 1..20: note = CRISPR gRNA sequence
  source 1..20: mol_type = other DNA
tgtctcgaaaaaaaaagaaa

SEQ ID NO: 30156 - DNA, 20 bp, synthetic construct
  misc_feature 1..20: note = CRISPR gRNA sequence
  source 1..20: mol_type = other DNA
tctcgaaaaaaaaagaaaaa

SEQ ID NO: 30157 - DNA, 20 bp, synthetic construct
  misc_feature 1..20: note = CRISPR gRNA sequence
  source 1..20: mol_type = other DNA
gaaaaaaaaagaaaaaaata

SEQ ID NO: 30158 - DNA, 20 bp, synthetic construct
  misc_feature 1..20: note = CRISPR gRNA sequence
  source 1..20: mol_type = other DNA
acactgctgccaagtggatt

SEQ ID NO: 30159 - DNA, 20 bp, synthetic construct
  misc_feature 1..20: note = CRISPR gRNA sequence
  source 1..20: mol_type = other DNA
cactgctgccaagtggattc

SEQ ID NO: 30160 - DNA, 20 bp, synthetic construct
  misc_feature 1..20: note = CRISPR gRNA sequence
  source 1..20: mol_type = other DNA
ctgccaagtggattcaggct

SEQ ID NO: 30161 - DNA, 20 bp, synthetic construct
  misc_feature 1..20: note = CRISPR gRNA sequence
  source 1..20: mol_type = other DNA
ccaagtggattcaggctaaa

SEQ ID NO: 30162 - DNA, 20 bp, synthetic construct
  misc_feature 1..20: note = CRISPR gRNA sequence
  source 1..20: mol_type = other DNA
aggctaaatcaactcacatc

SEQ ID NO: 30163 - DNA, 20 bp, synthetic construct
  misc_feature 1..20: note = CRISPR gRNA sequence
  source 1..20: mol_type = other DNA
aatcaactcacatcacgggt

SEQ ID NO: 30164 - DNA, 20 bp, synthetic construct
  misc_feature 1..20: note = CRISPR gRNA sequence
  source 1..20: mol_type = other DNA
acatcacgggtcggccggta

SEQ ID NO: 30165 - DNA, 20 bp, synthetic construct
  misc_feature 1..20: note = CRISPR gRNA sequence
  source 1..20: mol_type = other DNA
gatgggggttttgcaatctc

SEQ ID NO: 30166 - DNA, 20 bp, synthetic construct
  misc_feature 1..20: note = CRISPR gRNA sequence
  source 1..20: mol_type = other DNA
tgcaatctctgaaccctgga

SEQ ID NO: 30167 - DNA, 20 bp, synthetic construct
  misc_feature 1..20: note = CRISPR gRNA sequence
  source 1..20: mol_type = other DNA
gcaatctctgaaccctggag

SEQ ID NO: 30168 - DNA, 20 bp, synthetic construct
  misc_feature 1..20: note = CRISPR gRNA sequence
  source 1..20: mol_type = other DNA
caatctctgaaccctggaga

SEQ ID NO: 30169 - DNA, 20 bp, synthetic construct
  misc_feature 1..20: note = CRISPR gRNA sequence
  source 1..20: mol_type = other DNA
tgaaccctggagacccttcc

SEQ ID NO: 30170 - DNA, 20 bp, synthetic construct
  misc_feature 1..20: note = CRISPR gRNA sequence
  source 1..20: mol_type = other DNA
aaccctggagacccttcctc

SEQ ID NO: 30171 - DNA, 20 bp, synthetic construct
  misc_feature 1..20: note = CRISPR gRNA sequence
  source 1..20: mol_type = other DNA
gagacccttcctccacccca

SEQ ID NO: 30172 - DNA, 20 bp, synthetic construct
  misc_feature 1..20: note = CRISPR gRNA sequence
  source 1..20: mol_type = other DNA
cctccaccccacagggagag

SEQ ID NO: 30173 - DNA, 20 bp, synthetic construct
  misc_feature 1..20: note = CRISPR gRNA sequence
  source 1..20: mol_type = other DNA
ctccaccccacagggagagt

SEQ ID NO: 30174 - DNA, 20 bp, synthetic construct
  misc_feature 1..20: note = CRISPR gRNA sequence
  source 1..20: mol_type = other DNA
caccccacagggagagtaat

SEQ ID NO: 30175 - DNA, 20 bp, synthetic construct
  misc_feature 1..20: note = CRISPR gRNA sequence
  source 1..20: mol_type = other DNA
accatatttcatcgatgcca

SEQ ID NO: 30176 - DNA, 20 bp, synthetic construct
  misc_feature 1..20: note = CRISPR gRNA sequence
  source 1..20: mol_type = other DNA
catcgatgccaagacatata

SEQ ID NO: 30177 - DNA, 20 bp, synthetic construct
  misc_feature 1..20: note = CRISPR gRNA sequence
  source 1..20: mol_type = other DNA
atcgatgccaagacatatat

SEQ ID NO: 30178 - DNA, 20 bp, synthetic construct
  misc_feature 1..20: note = CRISPR gRNA sequence
  source 1..20: mol_type = other DNA
gaatatcattgagatcagga

SEQ ID NO: 30179 - DNA, 20 bp, synthetic construct
  misc_feature 1..20: note = CRISPR gRNA sequence
  source 1..20: mol_type = other DNA
aatatcattgagatcaggat

SEQ ID NO: 30180 - DNA, 20 bp, synthetic construct
  misc_feature 1..20: note = CRISPR gRNA sequence
  source 1..20: mol_type = other DNA
agatcaggatgtgtcttata

SEQ ID NO: 30181 - DNA, 20 bp, synthetic construct
  misc_feature 1..20: note = CRISPR gRNA sequence
  source 1..20: mol_type = other DNA
ataaccaatagcgtgtcaca

SEQ ID NO: 30182 - DNA, 20 bp, synthetic construct
  misc_feature 1..20: note = CRISPR gRNA sequence
  source 1..20: mol_type = other DNA
taaccaatagcgtgtcacag

SEQ ID NO: 30183 - DNA, 20 bp, synthetic construct
  misc_feature 1..20: note = CRISPR gRNA sequence
  source 1..20: mol_type = other DNA
gcattttggcctcatattgg

SEQ ID NO: 30184 - DNA, 20 bp, synthetic construct
  misc_feature 1..20: note = CRISPR gRNA sequence
  source 1..20: mol_type = other DNA
cattttggcctcatattggg

SEQ ID NO: 30185 - DNA, 20 bp, synthetic construct
  misc_feature 1..20: note = CRISPR gRNA sequence
  source 1..20: mol_type = other DNA
tggcctcatattggggtctt

SEQ ID NO: 30186 - DNA, 20 bp, synthetic construct
  misc_feature 1..20: note = CRISPR gRNA sequence
  source 1..20: mol_type = other DNA
ggcctcatattggggtctta

SEQ ID NO: 30187 - DNA, 20 bp, synthetic construct
  misc_feature 1..20: note = CRISPR gRNA sequence
  source 1..20: mol_type = other DNA
gcctcatattggggtcttac

SEQ ID NO: 30188 - DNA, 20 bp, synthetic construct
  misc_feature 1..20: note = CRISPR gRNA sequence
  source 1..20: mol_type = other DNA
atattggggtcttacaatgg

SEQ ID NO: 30189 - DNA, 20 bp, synthetic construct
  misc_feature 1..20: note = CRISPR gRNA sequence
  source 1..20: mol_type = other DNA
gggtcttacaatggatggca

SEQ ID NO: 30190 - DNA, 20 bp, synthetic construct
  misc_feature 1..20: note = CRISPR gRNA sequence
  source 1..20: mol_type = other DNA
acaatggatggcatcttaga

SEQ ID NO: 30191 - DNA, 20 bp, synthetic construct
  misc_feature 1..20: note = CRISPR gRNA sequence
  source 1..20: mol_type = other DNA
caatggatggcatcttagat

SEQ ID NO: 30192 - DNA, 20 bp, synthetic construct
  misc_feature 1..20: note = CRISPR gRNA sequence
  source 1..20: mol_type = other DNA
agattccatgaaatatgatg

SEQ ID NO: 30193 - DNA, 20 bp, synthetic construct
  misc_feature 1..20: note = CRISPR gRNA sequence
  source 1..20: mol_type = other DNA
gattccatgaaatatgatgt

SEQ ID NO: 30194 - DNA, 20 bp, synthetic construct
  misc_feature 1..20: note = CRISPR gRNA sequence
  source 1..20: mol_type = other DNA
catgaaatatgatgtttctt

SEQ ID NO: 30195 - DNA, 20 bp, synthetic construct
  misc_feature 1..20: note = CRISPR gRNA sequence
  source 1..20: mol_type = other DNA
cttaaagggtaaatcaggct

SEQ ID NO: 30196 - DNA, 20 bp, synthetic construct
  misc_feature 1..20: note = CRISPR gRNA sequence
  source 1..20: mol_type = other DNA
ttaaagggtaaatcaggctg

SEQ ID NO: 30197 - DNA, 20 bp, synthetic construct
  misc_feature 1..20: note = CRISPR gRNA sequence
  source 1..20: mol_type = other DNA
aaagggtaaatcaggctggg

SEQ ID NO: 30198 - DNA, 20 bp, synthetic construct
  misc_feature 1..20: note = CRISPR gRNA sequence
  source 1..20: mol_type = other DNA
aagggtaaatcaggctgggc

SEQ ID NO: 30199 - DNA, 20 bp, synthetic construct
  misc_feature 1..20: note = CRISPR gRNA sequence
  source 1..20: mol_type = other DNA
ggcatggtggctcacacccg

SEQ ID NO: 30200 - DNA, 20 bp, synthetic construct
  misc_feature 1..20: note = CRISPR gRNA sequence
  source 1..20: mol_type = other DNA
acacccgtaatcccagcact

SEQ ID NO: 30201 - DNA, 20 bp, synthetic construct
  misc_feature 1..20: note = CRISPR gRNA sequence
  source 1..20: mol_type = other DNA
tggaaggctgaggtgggtgg

SEQ ID NO: 30202 - DNA, 20 bp, synthetic construct
  misc_feature 1..20: note = CRISPR gRNA sequence
  source 1..20: mol_type = other DNA
ggaaggctgaggtgggtgga

SEQ ID NO: 30203 - DNA, 20 bp, synthetic construct
  misc_feature 1..20: note = CRISPR gRNA sequence
  source 1..20: mol_type = other DNA
gaaggctgaggtgggtggat

SEQ ID NO: 30204 - DNA, 20 bp, synthetic construct
  misc_feature 1..20: note = CRISPR gRNA sequence
  source 1..20: mol_type = other DNA
aggtgggtggatcgcttggg

SEQ ID NO: 30205 - DNA, 20 bp, synthetic construct
  misc_feature 1..20: note = CRISPR gRNA sequence
  source 1..20: mol_type = other DNA
gggcccaggatttcaagacc

SEQ ID NO: 30206 - DNA, 20 bp, synthetic construct
  misc_feature 1..20: note = CRISPR gRNA sequence
  source 1..20: mol_type = other DNA
ggcccaggatttcaagacca

SEQ ID NO: 30207 - DNA, 20 bp, synthetic construct
  misc_feature 1..20: note = CRISPR gRNA sequence
  source 1..20: mol_type = other DNA
caagaccagtctgggccaca

SEQ ID NO: 30208 - DNA, 20 bp, synthetic construct
  misc_feature 1..20: note = CRISPR gRNA sequence
  source 1..20: mol_type = other DNA
aagaccagtctgggccacat

SEQ ID NO: 30209 - DNA, 20 bp, synthetic construct
  misc_feature 1..20: note = CRISPR gRNA sequence
  source 1..20: mol_type = other DNA
ggccacatggcgaagccctg

SEQ ID NO: 30210 - DNA, 20 bp, synthetic construct
  misc_feature 1..20: note = CRISPR gRNA sequence
  source 1..20: mol_type = other DNA
tctctactgaaaacacaaaa

SEQ ID NO: 30211 - DNA, 20 bp, synthetic construct
  misc_feature 1..20: note = CRISPR gRNA sequence
  source 1..20: mol_type = other DNA
tactgaaaacacaaaaatag

SEQ ID NO: 30212 - DNA, 20 bp, synthetic construct
  misc_feature 1..20: note = CRISPR gRNA sequence
  source 1..20: mol_type = other DNA
ctgaaaacacaaaaatagcc

SEQ ID NO: 30213 - DNA, 20 bp, synthetic construct
  misc_feature 1..20: note = CRISPR gRNA sequence
  source 1..20: mol_type = other DNA
aaaacacaaaaatagcctgg

SEQ ID NO: 30214 - DNA, 20 bp, synthetic construct
  misc_feature 1..20: note = CRISPR gRNA sequence
  source 1..20: mol_type = other DNA
gtgtggtggcgggcatctgt

SEQ ID NO: 30215 - DNA, 20 bp, synthetic construct
  misc_feature 1..20: note = CRISPR gRNA sequence
  source 1..20: mol_type = other DNA
taatcccagctacttgggag

SEQ ID NO: 30216 - DNA, 20 bp, synthetic construct
  misc_feature 1..20: note = CRISPR gRNA sequence
  source 1..20: mol_type = other DNA
cttgggaggctgaggcatga

SEQ ID NO: 30217 - DNA, 20 bp, synthetic construct
  misc_feature 1..20: note = CRISPR gRNA sequence
  source 1..20: mol_type = other DNA
gggaggctgaggcatgagaa

SEQ ID NO: 30218 - DNA, 20 bp, synthetic construct
  misc_feature 1..20: note = CRISPR gRNA sequence
  source 1..20: mol_type = other DNA
ggaggctgaggcatgagaat

SEQ ID NO: 30219 - DNA, 20 bp, synthetic construct
  misc_feature 1..20: note = CRISPR gRNA sequence
  source 1..20: mol_type = other DNA
aggcatgagaatcacttgaa

SEQ ID NO: 30220 - DNA, 20 bp, synthetic construct
  misc_feature 1..20: note = CRISPR gRNA sequence
  source 1..20: mol_type = other DNA
gaacccaggaggcagtgctt

SEQ ID NO: 30221 - DNA, 20 bp, synthetic construct
  misc_feature 1..20: note = CRISPR gRNA sequence
  source 1..20: mol_type = other DNA
aacccaggaggcagtgcttg

SEQ ID NO: 30222 - DNA, 20 bp, synthetic construct
  misc_feature 1..20: note = CRISPR gRNA sequence
  source 1..20: mol_type = other DNA
gcagtgagctgagatcatgc

SEQ ID NO: 30223 - DNA, 20 bp, synthetic construct
  misc_feature 1..20: note = CRISPR gRNA sequence
  source 1..20: mol_type = other DNA
cagtgagctgagatcatgcc

SEQ ID NO: 30224 - DNA, 20 bp, synthetic construct
  misc_feature 1..20: note = CRISPR gRNA sequence
  source 1..20: mol_type = other DNA
agatcatgccactgcacctt

SEQ ID NO: 30225 - DNA, 20 bp, synthetic construct
  misc_feature 1..20: note = CRISPR gRNA sequence
  source 1..20: mol_type = other DNA
caccttagcctgggcaataa

SEQ ID NO: 30226 - DNA, 20 bp, synthetic construct
  misc_feature 1..20: note = CRISPR gRNA sequence
  source 1..20: mol_type = other DNA
agcctgggcaataaagtgag

SEQ ID NO: 30227 - DNA, 20 bp, synthetic construct
  misc_feature 1..20: note = CRISPR gRNA sequence
  source 1..20: mol_type = other DNA
gcctgggcaataaagtgaga

SEQ ID NO: 30228 - DNA, 20 bp, synthetic construct
  misc_feature 1..20: note = CRISPR gRNA sequence
  source 1..20: mol_type = other DNA
ggcaataaagtgagacttgg

SEQ ID NO: 30229 - DNA, 20 bp, synthetic construct
  misc_feature 1..20: note = CRISPR gRNA sequence
  source 1..20: mol_type = other DNA
ggtctcaaaaagaaaagaaa

SEQ ID NO: 30230 - DNA, 20 bp, synthetic construct
  misc_feature 1..20: note = CRISPR gRNA sequence
  source 1..20: mol_type = other DNA
gtctcaaaaagaaaagaaaa

SEQ ID NO: 30231 - DNA, 20 bp, synthetic construct
  misc_feature 1..20: note = CRISPR gRNA sequence
  source 1..20: mol_type = other DNA
aaaaagaaaagaaaagaaaa

SEQ ID NO: 30232 - DNA, 20 bp, synthetic construct
  misc_feature 1..20: note = CRISPR gRNA sequence
  source 1..20: mol_type = other DNA
cccaggcccacctacttttc

SEQ ID NO: 30233 - DNA, 20 bp, synthetic construct
  misc_feature 1..20: note = CRISPR gRNA sequence
  source 1..20: mol_type = other DNA
ccaggcccacctacttttcc

SEQ ID NO: 30234 - DNA, 20 bp, synthetic construct
  misc_feature 1..20: note = CRISPR gRNA sequence
  source 1..20: mol_type = other DNA
cttttccattcacactgaaa

SEQ ID NO: 30235 - DNA, 20 bp, synthetic construct
  misc_feature 1..20: note = CRISPR gRNA sequence
  source 1..20: mol_type = other DNA
ttccattcacactgaaaaac

SEQ ID NO: 30236 - DNA, 20 bp, synthetic construct
  misc_feature 1..20: note = CRISPR gRNA sequence
  source 1..20: mol_type = other DNA
tccattcacactgaaaaact

SEQ ID NO: 30237 - DNA, 20 bp, synthetic construct
  misc_feature 1..20: note = CRISPR gRNA sequence
  source 1..20: mol_type = other DNA
ccattcacactgaaaaactg

SEQ ID NO: 30238 - DNA, 20 bp, synthetic construct
  misc_feature 1..20: note = CRISPR gRNA sequence
  source 1..20: mol_type = other DNA
cattcacactgaaaaactgc

SEQ ID NO: 30239 - DNA, 20 bp, synthetic construct
  misc_feature 1..20: note = CRISPR gRNA sequence
  source 1..20: mol_type = other DNA
acactgaaaaactgcaaata

SEQ ID NO: 30240 - DNA, 20 bp, synthetic construct
  misc_feature 1..20: note = CRISPR gRNA sequence
  source 1..20: mol_type = other DNA
aaaaactgcaaatacctctt

SEQ ID NO: 30241 - DNA, 20 bp, synthetic construct
  misc_feature 1..20: note = CRISPR gRNA sequence
  source 1..20: mol_type = other DNA
caaatacctcttgtgaccca

SEQ ID NO: 30242 - DNA, 20 bp, synthetic construct
  misc_feature 1..20: note = CRISPR gRNA sequence
  source 1..20: mol_type = other DNA
ttgtgacccacaagggcctc

SEQ ID NO: 30243 - DNA, 20 bp, synthetic construct
  misc_feature 1..20: note = CRISPR gRNA sequence
  source 1..20: mol_type = other DNA
gtgacccacaagggcctccc

SEQ ID NO: 30244 - DNA, 20 bp, synthetic construct
  misc_feature 1..20: note = CRISPR gRNA sequence
  source 1..20: mol_type = other DNA
tgacccacaagggcctccct

SEQ ID NO: 30245 - DNA, 20 bp, synthetic construct
  misc_feature 1..20: note = CRISPR gRNA sequence
  source 1..20: mol_type = other DNA
cctgtgtgatctggattccc

SEQ ID NO: 30246 - DNA, 20 bp, synthetic construct
  misc_feature 1..20: note = CRISPR gRNA sequence
  source 1..20: mol_type = other DNA
tgtgatctggattcccctga

SEQ ID NO: 30247 - DNA, 20 bp, synthetic construct
  misc_feature 1..20: note = CRISPR gRNA sequence
  source 1..20: mol_type = other DNA
gattcccctgacctccccta

SEQ ID NO: 30248 - DNA, 20 bp, synthetic construct
  misc_feature 1..20: note = CRISPR gRNA sequence
  source 1..20: mol_type = other DNA
ccctgacctcccctacttcc

SEQ ID NO: 30249 - DNA, 20 bp, synthetic construct
  misc_feature 1..20: note = CRISPR gRNA sequence
  source 1..20: mol_type = other DNA
acctcccctacttccaccat

SEQ ID NO: 30250 - DNA, 20 bp, synthetic construct
  misc_feature 1..20: note = CRISPR gRNA sequence
  source 1..20: mol_type = other DNA
ccctacttccaccattgccc

SEQ ID NO: 30251 - DNA, 20 bp, synthetic construct
  misc_feature 1..20: note = CRISPR gRNA sequence
  source 1..20: mol_type = other DNA
cttccaccattgcccagcct

SEQ ID NO: 30252 - DNA, 20 bp, synthetic construct
  misc_feature 1..20: note = CRISPR gRNA sequence
  source 1..20: mol_type = other DNA
ccaccattgcccagcctctg

SEQ ID NO: 30253 - DNA, 20 bp, synthetic construct
  misc_feature 1..20: note = CRISPR gRNA sequence
  source 1..20: mol_type = other DNA
caccattgcccagcctctgt

SEQ ID NO: 30254 - DNA, 20 bp, synthetic construct
  misc_feature 1..20: note = CRISPR gRNA sequence
  source 1..20: mol_type = other DNA
cccagcctctgtccctcatt

SEQ ID NO: 30255 - DNA, 20 bp, synthetic construct
  misc_feature 1..20: note = CRISPR gRNA sequence
  source 1..20: mol_type = other DNA
tgtccctcattcactacaca

SEQ ID NO: 30256 - DNA, 20 bp, synthetic construct
  misc_feature 1..20: note = CRISPR gRNA sequence
  source 1..20: mol_type = other DNA
tccctcattcactacacaca

SEQ ID NO: 30257 - DNA, 20 bp, synthetic construct
  misc_feature 1..20: note = CRISPR gRNA sequence
  source 1..20: mol_type = other DNA
attcactacacacagccaca

SEQ ID NO: 30258 - DNA, 20 bp, synthetic construct
  misc_feature 1..20: note = CRISPR gRNA sequence
  source 1..20: mol_type = other DNA
actacacacagccacagtgg

SEQ ID NO: 30259 - DNA, 20 bp, synthetic construct
  misc_feature 1..20: note = CRISPR gRNA sequence
  source 1..20: mol_type = other DNA
cacacagccacagtggccct

SEQ ID NO: 30260 - DNA, 20 bp, synthetic construct
  misc_feature 1..20: note = CRISPR gRNA sequence
  source 1..20: mol_type = other DNA
ctgacccttaaaacacagcc

SEQ ID NO: 30261 - DNA, 20 bp, synthetic construct
  misc_feature 1..20: note = CRISPR gRNA sequence
  source 1..20: mol_type = other DNA
tgacccttaaaacacagccc

SEQ ID NO: 30262 - DNA, 20 bp, synthetic construct
  misc_feature 1..20: note = CRISPR gRNA sequence
  source 1..20: mol_type = other DNA
acccttaaaacacagcccct

SEQ ID NO: 30263 - DNA, 20 bp, synthetic construct
  misc_feature 1..20: note = CRISPR gRNA sequence
  source 1..20: mol_type = other DNA
aaaacacagccccttttccc

SEQ ID NO: 30264 - DNA, 20 bp, synthetic construct
  misc_feature 1..20: note = CRISPR gRNA sequence
  source 1..20: mol_type = other DNA
aaacacagccccttttccca

SEQ ID NO: 30265 - DNA, 20 bp, synthetic construct
  misc_feature 1..20: note = CRISPR gRNA sequence
  source 1..20: mol_type = other DNA
ttcccacttagggcctttgc

SEQ ID NO: 30266 - DNA, 20 bp, synthetic construct
  misc_feature 1..20: note = CRISPR gRNA sequence
  source 1..20: mol_type = other DNA
tcccacttagggcctttgca

SEQ ID NO: 30267 - DNA, 20 bp, synthetic construct
  misc_feature 1..20: note = CRISPR gRNA sequence
  source 1..20: mol_type = other DNA
cccacttagggcctttgcac

SEQ ID NO: 30268 - DNA, 20 bp, synthetic construct
  misc_feature 1..20: note = CRISPR gRNA sequence
  source 1..20: mol_type = other DNA
ccacttagggcctttgcacc

SEQ ID NO: 30269 - DNA, 20 bp, synthetic construct
  misc_feature 1..20: note = CRISPR gRNA sequence
  source 1..20: mol_type = other DNA
agggcctttgcacctgctgt

SEQ ID NO: 30270 - DNA, 20 bp, synthetic construct
  misc_feature 1..20: note = CRISPR gRNA sequence
  source 1..20: mol_type = other DNA
gggcctttgcacctgctgtt

SEQ ID NO: 30271 - DNA, 20 bp, synthetic construct
  misc_feature 1..20: note = CRISPR gRNA sequence
  source 1..20: mol_type = other DNA
tgcacctgctgttctttctt

SEQ ID NO: 30272 - DNA, 20 bp, synthetic construct
  misc_feature 1..20: note = CRISPR gRNA sequence
  source 1..20: mol_type = other DNA
gcacctgctgttctttcttc

SEQ ID NO: 30273 - DNA, 20 bp, synthetic construct
  misc_feature 1..20: note = CRISPR gRNA sequence
  source 1..20: mol_type = other DNA
cacctgctgttctttcttcc

SEQ ID NO: 30274 - DNA, 20 bp, synthetic construct
  misc_feature 1..20: note = CRISPR gRNA sequence
  source 1..20: mol_type = other DNA
ctgttctttcttcctagagt

SEQ ID NO: 30275 - DNA, 20 bp, synthetic construct
  misc_feature 1..20: note = CRISPR gRNA sequence
  source 1..20: mol_type = other DNA
ttctttcttcctagagtcct

SEQ ID NO: 30276 - DNA, 20 bp, synthetic construct
  misc_feature 1..20: note = CRISPR gRNA sequence
  source 1..20: mol_type = other DNA
tttcttcctagagtcctttt

SEQ ID NO: 30277 - DNA, 20 bp, synthetic construct
  misc_feature 1..20: note = CRISPR gRNA sequence
  source 1..20: mol_type = other DNA
tcttcctagagtccttttcc

SEQ ID NO: 30278 - DNA, 20 bp, synthetic construct
  misc_feature 1..20: note = CRISPR gRNA sequence
  source 1..20: mol_type = other DNA
cttcctagagtccttttccc

SEQ ID NO: 30279 - DNA, 20 bp, synthetic construct
  misc_feature 1..20: note = CRISPR gRNA sequence
  source 1..20: mol_type = other DNA
ttcctagagtccttttcccc

SEQ ID NO: 30280 - DNA, 20 bp, synthetic construct
  misc_feature 1..20: note = CRISPR gRNA sequence
  source 1..20: mol_type = other DNA
cctagagtccttttccccta

SEQ ID NO: 30281 - DNA, 20 bp, synthetic construct
  misc_feature 1..20: note = CRISPR gRNA sequence
  source 1..20: mol_type = other DNA
ctagagtccttttcccctag

SEQ ID NO: 30282 - DNA, 20 bp, synthetic construct
  misc_feature 1..20: note = CRISPR gRNA sequence
  source 1..20: mol_type = other DNA
gagtccttttcccctagagc

SEQ ID NO: 30283 - DNA, 20 bp, synthetic construct
  misc_feature 1..20: note = CRISPR gRNA sequence
  source 1..20: mol_type = other DNA
ttcccctagagcttcccacg

SEQ ID NO: 30284 - DNA, 20 bp, synthetic construct
  misc_feature 1..20: note = CRISPR gRNA sequence
  source 1..20: mol_type = other DNA
tcccctagagcttcccacgg

SEQ ID NO: 30285 - DNA, 20 bp, synthetic construct
  misc_feature 1..20: note = CRISPR gRNA sequence
  source 1..20: mol_type = other DNA
cccctagagcttcccacgga

SEQ ID NO: 30286 - DNA, 20 bp, synthetic construct
  misc_feature 1..20: note = CRISPR gRNA sequence
  source 1..20: mol_type = other DNA
ccctagagcttcccacggaa

SEQ ID NO: 30287 - DNA, 20 bp, synthetic construct
  misc_feature 1..20: note = CRISPR gRNA sequence
  source 1..20: mol_type = other DNA
gagcttcccacggaagaatc

SEQ ID NO: 30288 - DNA, 20 bp, synthetic construct
  misc_feature 1..20: note = CRISPR gRNA sequence
  source 1..20: mol_type = other DNA
cccacggaagaatcatctcc

SEQ ID NO: 30289 - DNA, 20 bp, synthetic construct
  misc_feature 1..20: note = CRISPR gRNA sequence
  source 1..20: mol_type = other DNA
ccacggaagaatcatctccc

SEQ ID NO: 30290 - DNA, 20 bp, synthetic construct
  misc_feature 1..20: note = CRISPR gRNA sequence
  source 1..20: mol_type = other DNA
cccagaagtcctgtaccctc

SEQ ID NO: 30291 - DNA, 20 bp, synthetic construct
  misc_feature 1..20: note = CRISPR gRNA sequence
  source 1..20: mol_type = other DNA
taccctcctggggcttgtta

SEQ ID NO: 30292 - DNA, 20 bp, synthetic construct
  misc_feature 1..20: note = CRISPR gRNA sequence
  source 1..20: mol_type = other DNA
ctggggcttgttagtttcct

SEQ ID NO: 30293 - DNA, 20 bp, synthetic construct
  misc_feature 1..20: note = CRISPR gRNA sequence
  source 1..20: mol_type = other DNA
gggcttgttagtttccttcc

SEQ ID NO: 30294 - DNA, 20 bp, synthetic construct
  misc_feature 1..20: note = CRISPR gRNA sequence
  source 1..20: mol_type = other DNA
gttagtttccttcccagcat

SEQ ID NO: 30295 - DNA, 20 bp, synthetic construct
  misc_feature 1..20: note = CRISPR gRNA sequence
  source 1..20: mol_type = other DNA
ttagtttccttcccagcatg

SEQ ID NO: 30296 - DNA, 20 bp, synthetic construct
  misc_feature 1..20: note = CRISPR gRNA sequence
  source 1..20: mol_type = other DNA
gtttccttcccagcatgaat

SEQ ID NO: 30297 - DNA, 20 bp, synthetic construct
  misc_feature 1..20: note = CRISPR gRNA sequence
  source 1..20: mol_type = other DNA
ccttcccagcatgaatcact

SEQ ID NO: 30298 - DNA, 20 bp, synthetic construct
  misc_feature 1..20: note = CRISPR gRNA sequence
  source 1..20: mol_type = other DNA
cttcccagcatgaatcactg

SEQ ID NO: 30299 - DNA, 20 bp, synthetic construct
  misc_feature 1..20: note = CRISPR gRNA sequence
  source 1..20: mol_type = other DNA
cccagcatgaatcactgttt

SEQ ID NO: 30300 - DNA, 20 bp, synthetic construct
  misc_feature 1..20: note = CRISPR gRNA sequence
  source 1..20: mol_type = other DNA
ccagcatgaatcactgtttt

SEQ ID NO: 30301 - DNA, 20 bp, synthetic construct
  misc_feature 1..20: note = CRISPR gRNA sequence
  source 1..20: mol_type = other DNA
ttttacaatattttatttat

SEQ ID NO: 30302 - DNA, 20 bp, synthetic construct
  misc_feature 1..20: note = CRISPR gRNA sequence
  source 1..20: mol_type = other DNA
tacaatattttatttatgta

SEQ ID NO: 30303 - DNA, 20 bp, synthetic construct
  misc_feature 1..20: note = CRISPR gRNA sequence
  source 1..20: mol_type = other DNA
acaatattttatttatgtat

SEQ ID NO: 30304 - DNA, 20 bp, synthetic construct
  misc_feature 1..20: note = CRISPR gRNA sequence
  source 1..20: mol_type = other DNA
caatattttatttatgtatg

SEQ ID NO: 30305 - DNA, 20 bp, synthetic construct
  misc_feature 1..20: note = CRISPR gRNA sequence
  source 1..20: mol_type = other DNA
tatttatgtatgtgcctaat

SEQ ID NO: 30306 - DNA, 20 bp, synthetic construct
  misc_feature 1..20: note = CRISPR gRNA sequence
  source 1..20: mol_type = other DNA
atttatgtatgtgcctaatt

SEQ ID NO: 30307 - DNA, 20 bp, synthetic construct
  misc_feature 1..20: note = CRISPR gRNA sequence
  source 1..20: mol_type = other DNA
tttatgtatgtgcctaattc

SEQ ID NO: 30308 - DNA, 20 bp, synthetic construct
  misc_feature 1..20: note = CRISPR gRNA sequence
  source 1..20: mol_type = other DNA
atgtatgtgcctaattccta

SEQ ID NO: 30309 - DNA, 20 bp, synthetic construct
  misc_feature 1..20: note = CRISPR gRNA sequence
  source 1..20: mol_type = other DNA
tgtatgtgcctaattcctac

SEQ ID NO: 30310 - DNA, 20 bp, synthetic construct
  misc_feature 1..20: note = CRISPR gRNA sequence
  source 1..20: mol_type = other DNA
attcctactacgcaaagaaa

SEQ ID NO: 30311 - DNA, 20 bp, synthetic construct
  misc_feature 1..20: note = CRISPR gRNA sequence
  source 1..20: mol_type = other DNA
ctactacgcaaagaaactca

SEQ ID NO: 30312 - DNA, 20 bp, synthetic construct
  misc_feature 1..20: note = CRISPR gRNA sequence
  source 1..20: mol_type = other DNA
ctacgcaaagaaactcaaaa

SEQ ID NO: 30313 - DNA, 20 bp, synthetic construct
  misc_feature 1..20: note = CRISPR gRNA sequence
  source 1..20: mol_type = other DNA
cgcaaagaaactcaaaagca

SEQ ID NO: 30314 - DNA, 20 bp, synthetic construct
  misc_feature 1..20: note = CRISPR gRNA sequence
  source 1..20: mol_type = other DNA
aaaagcaagaacgacatctg

SEQ ID NO: 30315 - DNA, 20 bp, synthetic construct
  misc_feature 1..20: note = CRISPR gRNA sequence
  source 1..20: mol_type = other DNA
tctagttcatacttgtatct

SEQ ID NO: 30316 - DNA, 20 bp, synthetic construct
  misc_feature 1..20: note = CRISPR gRNA sequence
  source 1..20: mol_type = other DNA
gttcatacttgtatctctag

SEQ ID NO: 30317 - DNA, 20 bp, synthetic construct
  misc_feature 1..20: note = CRISPR gRNA sequence
  source 1..20: mol_type = other DNA
atacttgtatctctagtttt

SEQ ID NO: 30318 - DNA, 20 bp, synthetic construct
  misc_feature 1..20: note = CRISPR gRNA sequence
  source 1..20: mol_type = other DNA
gtatctctagtttttagcac

SEQ ID NO: 30319 - DNA, 20 bp, synthetic construct
  misc_feature 1..20: note = CRISPR gRNA sequence
  source 1..20: mol_type = other DNA
tatctctagtttttagcaca

SEQ ID NO: 30320 - DNA, 20 bp, synthetic construct
  misc_feature 1..20: note = CRISPR gRNA sequence
  source 1..20: mol_type = other DNA
tagtttttagcacaattatg

SEQ ID NO: 30321 - DNA, 20 bp, synthetic construct
  misc_feature 1..20: note = CRISPR gRNA sequence
  source 1..20: mol_type = other DNA
gtttttagcacaattatgaa

SEQ ID NO: 30322 - DNA, 20 bp, synthetic construct
  misc_feature 1..20: note = CRISPR gRNA sequence
  source 1..20: mol_type = other DNA
ttagcacaattatgaaccag

SEQ ID NO: 30323 - DNA, 20 bp, synthetic construct
  misc_feature 1..20: note = CRISPR gRNA sequence
  source 1..20: mol_type = other DNA
tagcacaattatgaaccaga

SEQ ID NO: 30324 - DNA, 20 bp, synthetic construct
  misc_feature 1..20: note = CRISPR gRNA sequence
  source 1..20: mol_type = other DNA
agcacaattatgaaccagac

SEQ ID NO: 30325 - DNA, 20 bp, synthetic construct
  misc_feature 1..20: note = CRISPR gRNA sequence
  source 1..20: mol_type = other DNA
gcacaattatgaaccagaca

SEQ ID NO: 30326 - DNA, 20 bp, synthetic construct
  misc_feature 1..20: note = CRISPR gRNA sequence
  source 1..20: mol_type = other DNA
tgaaccagacagattctatt

SEQ ID NO: 30327 - DNA, 20 bp, synthetic construct
  misc_feature 1..20: note = CRISPR gRNA sequence
  source 1..20: mol_type = other DNA
tatttttgcttctgagtttc

SEQ ID NO: 30328 - DNA, 20 bp, synthetic construct
  misc_feature 1..20: note = CRISPR gRNA sequence
  source 1..20: mol_type = other DNA
tttttgcttctgagtttctt

SEQ ID NO: 30329 - DNA, 20 bp, synthetic construct
  misc_feature 1..20: note = CRISPR gRNA sequence
  source 1..20: mol_type = other DNA
ttgcttctgagtttctttgc

SEQ ID NO: 30330 - DNA, 20 bp, synthetic construct
  misc_feature 1..20: note = CRISPR gRNA sequence
  source 1..20: mol_type = other DNA
tgcttctgagtttctttgca

SEQ ID NO: 30331 - DNA, 20 bp, synthetic construct
  misc_feature 1..20: note = CRISPR gRNA sequence
  source 1..20: mol_type = other DNA
gcttctgagtttctttgcat

SEQ ID NO: 30332 - DNA, 20 bp, synthetic construct
  misc_feature 1..20: note = CRISPR gRNA sequence
  source 1..20: mol_type = other DNA
cttctgagtttctttgcata

SEQ ID NO: 30333 - DNA, 20 bp, synthetic construct
  misc_feature 1..20: note = CRISPR gRNA sequence
  source 1..20: mol_type = other DNA
ctgagtttctttgcatagca

SEQ ID NO: 30334 - DNA, 20 bp, synthetic construct
  misc_feature 1..20: note = CRISPR gRNA sequence
  source 1..20: mol_type = other DNA
tgagtttctttgcatagcaa

SEQ ID NO: 30335 - DNA, 20 bp, synthetic construct
  misc_feature 1..20: note = CRISPR gRNA sequence
  source 1..20: mol_type = other DNA
agtttctttgcatagcaaga

SEQ ID NO: 30336 - DNA, 20 bp, synthetic construct
  misc_feature 1..20: note = CRISPR gRNA sequence
  source 1..20: mol_type = other DNA
ctttgcatagcaagaagtaa

SEQ ID NO: 30337 - DNA, 20 bp, synthetic construct
  misc_feature 1..20: note = CRISPR gRNA sequence
  source 1..20: mol_type = other DNA
tttgcatagcaagaagtaag

SEQ ID NO: 30338 - DNA, 20 bp, synthetic construct
  misc_feature 1..20: note = CRISPR gRNA sequence
  source 1..20: mol_type = other DNA
tgcatagcaagaagtaagca

SEQ ID NO: 30339 - DNA, 20 bp, synthetic construct
  misc_feature 1..20: note = CRISPR gRNA sequence
  source 1..20: mol_type = other DNA
gcatagcaagaagtaagcac

SEQ ID NO: 30340 - DNA, 20 bp, synthetic construct
  misc_feature 1..20: note = CRISPR gRNA sequence
  source 1..20: mol_type = other DNA
catagcaagaagtaagcacc

SEQ ID NO: 30341 - DNA, 20 bp, synthetic construct
  misc_feature 1..20: note = CRISPR gRNA sequence
  source 1..20: mol_type = other DNA
cataaataaaatattgtaaa

SEQ ID NO: 30342 - DNA, 20 bp, synthetic construct
  misc_feature 1..20: note = CRISPR gRNA sequence
  source 1..20: mol_type = other DNA
taaaacagtgatcatgctgg

SEQ ID NO: 30343 - DNA, 20 bp, synthetic construct
  misc_feature 1..20: note = CRISPR gRNA sequence
  source 1..20: mol_type = other DNA
ggaagaaattaacaaggctc

SEQ ID NO: 30344 - DNA, 20 bp, synthetic construct
  misc_feature 1..20: note = CRISPR gRNA sequence
  source 1..20: mol_type = other DNA
acaaggctcaggagggtata

SEQ ID NO: 30345 - DNA, 20 bp, synthetic construct
  misc_feature 1..20: note = CRISPR gRNA sequence
  source 1..20: mol_type = other DNA
aggagggtataggacccagc

SEQ ID NO: 30346 - DNA, 20 bp, synthetic construct
  misc_feature 1..20: note = CRISPR gRNA sequence
  source 1..20: mol_type = other DNA
cttggaaggctgaggtggga

SEQ ID NO: 30347 - DNA, 20 bp, synthetic construct
  misc_feature 1..20: note = CRISPR gRNA sequence
  source 1..20: mol_type = other DNA
ggaaggctgaggtgggaggt

SEQ ID NO: 30348 - DNA, 20 bp, synthetic construct
  misc_feature 1..20: note = CRISPR gRNA sequence
  source 1..20: mol_type = other DNA
gaaggctgaggtgggaggtt

SEQ ID NO: 30349 - DNA, 20 bp, synthetic construct
  misc_feature 1..20: note = CRISPR gRNA sequence
  source 1..20: mol_type = other DNA
aggtgggaggttcgcttcag

SEQ ID NO: 30350 - DNA, 20 bp, synthetic construct
  misc_feature 1..20: note = CRISPR gRNA sequence
  source 1..20: mol_type = other DNA
gcttcagtccaggtagtcga

SEQ ID NO: 30351 - DNA, 20 bp, synthetic construct
  misc_feature 1..20: note = CRISPR gRNA sequence
  source 1..20: mol_type = other DNA
cagtccaggtagtcgaggct

SEQ ID NO: 30352 - DNA, 20 bp, synthetic construct
  misc_feature 1..20: note = CRISPR gRNA sequence
  source 1..20: mol_type = other DNA
agtccaggtagtcgaggctg

SEQ ID NO: 30353 - DNA, 20 bp, synthetic construct
  misc_feature 1..20: note = CRISPR gRNA sequence
  source 1..20: mol_type = other DNA
tagtgagccatcattgcacc

SEQ ID NO: 30354 - DNA, 20 bp, synthetic construct
  misc_feature 1..20: note = CRISPR gRNA sequence
  source 1..20: mol_type = other DNA
cacccctgcactacaacctg

SEQ ID NO: 30355 - DNA, 20 bp, synthetic construct
  misc_feature 1..20: note = CRISPR gRNA sequence
  source 1..20: mol_type = other DNA
cactacaacctgggtgagac

SEQ ID NO: 30356 - DNA, 20 bp, synthetic construct
  misc_feature 1..20: note = CRISPR gRNA sequence
  source 1..20: mol_type = other DNA
caacctgggtgagaccccat

SEQ ID NO: 30357 - DNA, 20 bp, synthetic construct
  misc_feature 1..20: note = CRISPR gRNA sequence
  source 1..20: mol_type = other DNA
ggtgagaccccatctccaaa

SEQ ID NO: 30358 - DNA, 20 bp, synthetic construct
  misc_feature 1..20: note = CRISPR gRNA sequence
  source 1..20: mol_type = other DNA
caaataaataaataaataaa

SEQ ID NO: 30359 - DNA, 20 bp, synthetic construct
  misc_feature 1..20: note = CRISPR gRNA sequence
  source 1..20: mol_type = other DNA
gccgggcatggtggctcacg

SEQ ID NO: 30360 - DNA, 20 bp, synthetic construct
  misc_feature 1..20: note = CRISPR gRNA sequence
  source 1..20: mol_type = other DNA
acgcctgtaatcctagtact

SEQ ID NO: 30361 - DNA, 20 bp, synthetic construct
  misc_feature 1..20: note = CRISPR gRNA sequence
  source 1..20: mol_type = other DNA
taatcctagtactcactttg

SEQ ID NO: 30362 - DNA, 20 bp, synthetic construct
  misc_feature 1..20: note = CRISPR gRNA sequence
  source 1..20: mol_type = other DNA
gtactcactttgggaggccg

SEQ ID NO: 30363 - DNA, 20 bp, synthetic construct
  misc_feature 1..20: note = CRISPR gRNA sequence
  source 1..20: mol_type = other DNA
actttgggaggccgaggcag

SEQ ID NO: 30364 - DNA, 20 bp, synthetic construct
  misc_feature 1..20: note = CRISPR gRNA sequence
  source 1..20: mol_type = other DNA
tgggaggccgaggcaggtgg

SEQ ID NO: 30365 - DNA, 20 bp, synthetic construct
  misc_feature 1..20: note = CRISPR gRNA sequence
  source 1..20: mol_type = other DNA
gggaggccgaggcaggtgga

SEQ ID NO: 30366 - DNA, 20 bp, synthetic construct
  misc_feature 1..20: note = CRISPR gRNA sequence
  source 1..20: mol_type = other DNA
ggaggccgaggcaggtggat

SEQ ID NO: 30367 - DNA, 20 bp, synthetic construct
  misc_feature 1..20: note = CRISPR gRNA sequence
  source 1..20: mol_type = other DNA
agatcaggagtttgagacca

SEQ ID NO: 30368 - DNA, 20 bp, synthetic construct
  misc_feature 1..20: note = CRISPR gRNA sequence
  source 1..20: mol_type = other DNA
gagaccagcctggccaacat

SEQ ID NO: 30369 - DNA, 20 bp, synthetic construct
  misc_feature 1..20: note = CRISPR gRNA sequence
  source 1..20: mol_type = other DNA
agaccagcctggccaacatg

SEQ ID NO: 30370 - DNA, 20 bp, synthetic construct
  misc_feature 1..20: note = CRISPR gRNA sequence
  source 1..20: mol_type = other DNA
gccaacatggcgaaaccctg

SEQ ID NO: 30371 - DNA, 20 bp, synthetic construct
  misc_feature 1..20: note = CRISPR gRNA sequence
  source 1..20: mol_type = other DNA
tctctactaaaaatataaaa

SEQ ID NO: 30372 - DNA, 20 bp, synthetic construct
  misc_feature 1..20: note = CRISPR gRNA sequence
  source 1..20: mol_type = other DNA
tactaaaaatataaaaacta

SEQ ID NO: 30373 - DNA, 20 bp, synthetic construct
  misc_feature 1..20: note = CRISPR gRNA sequence
  source 1..20: mol_type = other DNA
ctaaaaatataaaaactagc

SEQ ID NO: 30374 - DNA, 20 bp, synthetic construct
  misc_feature 1..20: note = CRISPR gRNA sequence
  source 1..20: mol_type = other DNA
aaaatataaaaactagctgg

SEQ ID NO: 30375 - DNA, 20 bp, synthetic construct
  misc_feature 1..20: note = CRISPR gRNA sequence
  source 1..20: mol_type = other DNA
gctggacgtggtggtgggcg

SEQ ID NO: 30376 - DNA, 20 bp, synthetic construct
  misc_feature 1..20: note = CRISPR gRNA sequence
  source 1..20: mol_type = other DNA
gacgtggtggtgggcgccta

SEQ ID NO: 30377 - DNA, 20 bp, synthetic construct
  misc_feature 1..20: note = CRISPR gRNA sequence
  source 1..20: mol_type = other DNA
taatcccagctactcggagc

SEQ ID NO: 30378 - DNA, 20 bp, synthetic construct
  misc_feature 1..20: note = CRISPR gRNA sequence
  source 1..20: mol_type = other DNA
ctcggagcactgaggcaggc

SEQ ID NO: 30379 - DNA, 20 bp, synthetic construct
  misc_feature 1..20: note = CRISPR gRNA sequence
  source 1..20: mol_type = other DNA
ggagcactgaggcaggcgaa

SEQ ID NO: 30380 - DNA, 20 bp, synthetic construct
  misc_feature 1..20: note = CRISPR gRNA sequence
  source 1..20: mol_type = other DNA
aggcaggcgaatagcttgaa

SEQ ID NO: 30381 - DNA, 20 bp, synthetic construct
  misc_feature 1..20: note = CRISPR gRNA sequence
  source 1..20: mol_type = other DNA
gaacctgggggggggcagaa

SEQ ID NO: 30382 - DNA, 20 bp, synthetic construct
  misc_feature 1..20: note = CRISPR gRNA sequence
  source 1..20: mol_type = other DNA
aacctgggggggggcagaag

SEQ ID NO: 30383 - DNA, 20 bp, synthetic construct
  misc_feature 1..20: note = CRISPR gRNA sequence
  source 1..20: mol_type = other DNA
ggggggggcagaagttgcag

SEQ ID NO: 30384 - DNA, 20 bp, synthetic construct
  misc_feature 1..20: note = CRISPR gRNA sequence
  source 1..20: mol_type = other DNA
cagtgagctgagatcacacc

SEQ ID NO: 30385 - DNA, 20 bp, synthetic construct
  misc_feature 1..20: note = CRISPR gRNA sequence
  source 1..20: mol_type = other DNA
agatcacaccacttcactcc

SEQ ID NO: 30386 - DNA, 20 bp, synthetic construct
  misc_feature 1..20: note = CRISPR gRNA sequence
  source 1..20: mol_type = other DNA
cactccagcctgggtgacag

SEQ ID NO: 30387 - DNA, 20 bp, synthetic construct
  misc_feature 1..20: note = CRISPR gRNA sequence
  source 1..20: mol_type = other DNA
actccagcctgggtgacaga

SEQ ID NO: 30388 - DNA, 20 bp, synthetic construct
  misc_feature 1..20: note = CRISPR gRNA sequence
  source 1..20: mol_type = other DNA
cagcctgggtgacagagcga

SEQ ID NO: 30389 - DNA, 20 bp, synthetic construct
  misc_feature 1..20: note = CRISPR gRNA sequence
  source 1..20: mol_type = other DNA
ggtgacagagcgagactcca

SEQ ID NO: 30390 - DNA, 20 bp, synthetic construct
  misc_feature 1..20: note = CRISPR gRNA sequence
  source 1..20: mol_type = other DNA
catctcaaaaacagaaatta

SEQ ID NO: 30391 - DNA, 20 bp, synthetic construct
  misc_feature 1..20: note = CRISPR gRNA sequence
  source 1..20: mol_type = other DNA
aaaaacagaaattaaaaaaa

SEQ ID NO: 30392 - DNA, 20 bp, synthetic construct
  misc_feature 1..20: note = CRISPR gRNA sequence
  source 1..20: mol_type = other DNA
aaaaaattaaaaataaataa

SEQ ID NO: 30393 - DNA, 20 bp, synthetic construct
  misc_feature 1..20: note = CRISPR gRNA sequence
  source 1..20: mol_type = other DNA
aaaataaataaataataagg

SEQ ID NO: 30394 - DNA, 20 bp, synthetic construct
  misc_feature 1..20: note = CRISPR gRNA sequence
  source 1..20: mol_type = other DNA
tcctgggaatctgactctgg

SEQ ID NO: 30395 - DNA, 20 bp, synthetic construct
  misc_feature 1..20: note = CRISPR gRNA sequence
  source 1..20: mol_type = other DNA
cctgggaatctgactctggt

SEQ ID NO: 30396 - DNA, 20 bp, synthetic construct
  misc_feature 1..20: note = CRISPR gRNA sequence
  source 1..20: mol_type = other DNA
ctgggaatctgactctggtt

SEQ ID NO: 30397 - DNA, 20 bp, synthetic construct
  misc_feature 1..20: note = CRISPR gRNA sequence
  source 1..20: mol_type = other DNA
ggaatctgactctggttgtc

SEQ ID NO: 30398 - DNA, 20 bp, synthetic construct
  misc_feature 1..20: note = CRISPR gRNA sequence
  source 1..20: mol_type = other DNA
actctggttgtcctcagtaa

SEQ ID NO: 30399 - DNA, 20 bp, synthetic construct
  misc_feature 1..20: note = CRISPR gRNA sequence
  source 1..20: mol_type = other DNA
tggttgtcctcagtaagtga

SEQ ID NO: 30400 - DNA, 20 bp, synthetic construct
  misc_feature 1..20: note = CRISPR gRNA sequence
  source 1..20: mol_type = other DNA
gttgtcctcagtaagtgaag

SEQ ID NO: 30401 - DNA, 20 bp, synthetic construct
  misc_feature 1..20: note = CRISPR gRNA sequence
  source 1..20: mol_type = other DNA
tcctcagtaagtgaagagct

SEQ ID NO: 30402 - DNA, 20 bp, synthetic construct
  misc_feature 1..20: note = CRISPR gRNA sequence
  source 1..20: mol_type = other DNA
agtaagtgaagagctctggc

SEQ ID NO: 30403 - DNA, 20 bp, synthetic construct
  misc_feature 1..20: note = CRISPR gRNA sequence
  source 1..20: mol_type = other DNA
tggcgaagaggagagcagtt

SEQ ID NO: 30404 - DNA, 20 bp, synthetic construct
  misc_feature 1..20: note = CRISPR gRNA sequence
  source 1..20: mol_type = other DNA
gcgaagaggagagcagtttc

SEQ ID NO: 30405 - DNA, 20 bp, synthetic construct
  misc_feature 1..20: note = CRISPR gRNA sequence
  source 1..20: mol_type = other DNA
ctctcagtctggcgagtaag

SEQ ID NO: 30406 - DNA, 20 bp, synthetic construct
  misc_feature 1..20: note = CRISPR gRNA sequence
  source 1..20: mol_type = other DNA
tctcagtctggcgagtaaga

SEQ ID NO: 30407 - DNA, 20 bp, synthetic construct
  misc_feature 1..20: note = CRISPR gRNA sequence
  source 1..20: mol_type = other DNA
tcagtctggcgagtaagaag

SEQ ID NO: 30408 - DNA, 20 bp, synthetic construct
  misc_feature 1..20: note = CRISPR gRNA sequence
  source 1..20: mol_type = other DNA
agtctggcgagtaagaagag

SEQ ID NO: 30409 - DNA, 20 bp, synthetic construct
  misc_feature 1..20: note = CRISPR gRNA sequence
  source 1..20: mol_type = other DNA
gcgagtaagaagagctggta

SEQ ID NO: 30410 - DNA, 20 bp, synthetic construct
  misc_feature 1..20: note = CRISPR gRNA sequence
  source 1..20: mol_type = other DNA
gtaatgctgagttggatgac

SEQ ID NO: 30411 - DNA, 20 bp, synthetic construct
  misc_feature 1..20: note = CRISPR gRNA sequence
  source 1..20: mol_type = other DNA
agttggatgactggggctct

SEQ ID NO: 30412 - DNA, 20 bp, synthetic construct
  misc_feature 1..20: note = CRISPR gRNA sequence
  source 1..20: mol_type = other DNA
gatgactggggctctggtcc

SEQ ID NO: 30413 - DNA, 20 bp, synthetic construct
  misc_feature 1..20: note = CRISPR gRNA sequence
  source 1..20: mol_type = other DNA
gggctctggtccaagctcag

SEQ ID NO: 30414 - DNA, 20 bp, synthetic construct
  misc_feature 1..20: note = CRISPR gRNA sequence
  source 1..20: mol_type = other DNA
tggtccaagctcagtccgct

SEQ ID NO: 30415 - DNA, 20 bp, synthetic construct
  misc_feature 1..20: note = CRISPR gRNA sequence
  source 1..20: mol_type = other DNA
gtccaagctcagtccgctca

SEQ ID NO: 30416 - DNA, 20 bp, synthetic construct
  misc_feature 1..20: note = CRISPR gRNA sequence
  source 1..20: mol_type = other DNA
agtccgctcattacctctgg

SEQ ID NO: 30417 - DNA, 20 bp, synthetic construct
  misc_feature 1..20: note = CRISPR gRNA sequence
  source 1..20: mol_type = other DNA
attacctctgggaccacacc

SEQ ID NO: 30418 - DNA, 20 bp, synthetic construct
  misc_feature 1..20: note = CRISPR gRNA sequence
  source 1..20: mol_type = other DNA
cctctgggaccacaccaggg

SEQ ID NO: 30419 - DNA, 20 bp, synthetic construct
  misc_feature 1..20: note = CRISPR gRNA sequence
  source 1..20: mol_type = other DNA
tgggaccacaccagggcctg

SEQ ID NO: 30420 - DNA, 20 bp, synthetic construct
  misc_feature 1..20: note = CRISPR gRNA sequence
  source 1..20: mol_type = other DNA
ggaccacaccagggcctgga

SEQ ID NO: 30421 - DNA, 20 bp, synthetic construct
  misc_feature 1..20: note = CRISPR gRNA sequence
  source 1..20: mol_type = other DNA
gatggaagtcactcaaaagc

SEQ ID NO: 30422 - DNA, 20 bp, synthetic construct
  misc_feature 1..20: note = CRISPR gRNA sequence
  source 1..20: mol_type = other DNA
aaaagcaagaggtgctatgc

SEQ ID NO: 30423 - DNA, 20 bp, synthetic construct
  misc_feature 1..20: note = CRISPR gRNA sequence
  source 1..20: mol_type = other DNA
tgccaaggcctaccagaagg

SEQ ID NO: 30424 - DNA, 20 bp, synthetic construct
  misc_feature 1..20: note = CRISPR gRNA sequence
  source 1..20: mol_type = other DNA
ccagaaggtggcagtgaaac

SEQ ID NO: 30425 - DNA, 20 bp, synthetic construct
  misc_feature 1..20: note = CRISPR gRNA sequence
  source 1..20: mol_type = other DNA
accggcatgtaagtgacaag

SEQ ID NO: 30426 - DNA, 20 bp, synthetic construct
  misc_feature 1..20: note = CRISPR gRNA sequence
  source 1..20: mol_type = other DNA
acgtacgtggttagccttcc

SEQ ID NO: 30427 - DNA, 20 bp, synthetic construct
  misc_feature 1..20: note = CRISPR gRNA sequence
  source 1..20: mol_type = other DNA
gccttccagaagccaccacc

SEQ ID NO: 30428 - DNA, 20 bp, synthetic construct
  misc_feature 1..20: note = CRISPR gRNA sequence
  source 1..20: mol_type = other DNA
ccagaagccaccacccctag

SEQ ID NO: 30429 - DNA, 20 bp, synthetic construct
  misc_feature 1..20: note = CRISPR gRNA sequence
  source 1..20: mol_type = other DNA
cagaagccaccacccctagg

SEQ ID NO: 30430 - DNA, 20 bp, synthetic construct
  misc_feature 1..20: note = CRISPR gRNA sequence
  source 1..20: mol_type = other DNA
ggttccggaaaaagcctggt

SEQ ID NO: 30431 - DNA, 20 bp, synthetic construct
  misc_feature 1..20: note = CRISPR gRNA sequence
  source 1..20: mol_type = other DNA
cggaaaaagcctggtcccgc

SEQ ID NO: 30432 - DNA, 20 bp, synthetic construct
  misc_feature 1..20: note = CRISPR gRNA sequence
  source 1..20: mol_type = other DNA
gtcccgccatccctggggga

SEQ ID NO: 30433 - DNA, 20 bp, synthetic construct
  misc_feature 1..20: note = CRISPR gRNA sequence
  source 1..20: mol_type = other DNA
ggggaaaaggagcaatattt

SEQ ID NO: 30434 - DNA, 20 bp, synthetic construct
  misc_feature 1..20: note = CRISPR gRNA sequence
  source 1..20: mol_type = other DNA
attgcataacagaacctggc

SEQ ID NO: 30435 - DNA, 20 bp, synthetic construct
  misc_feature 1..20: note = CRISPR gRNA sequence
  source 1..20: mol_type = other DNA
ttgcataacagaacctggca

SEQ ID NO: 30436 - DNA, 20 bp, synthetic construct
  misc_feature 1..20: note = CRISPR gRNA sequence
  source 1..20: mol_type = other DNA
cataacagaacctggcattg

SEQ ID NO: 30437 - DNA, 20 bp, synthetic construct
  misc_feature 1..20: note = CRISPR gRNA sequence
  source 1..20: mol_type = other DNA
gcattgtgacaagtgcttac

SEQ ID NO: 30438 - DNA, 20 bp, synthetic construct
  misc_feature 1..20: note = CRISPR gRNA sequence
  source 1..20: mol_type = other DNA
tgacaagtgcttacatagac

SEQ ID NO: 30439 - DNA, 20 bp, synthetic construct
  misc_feature 1..20: note = CRISPR gRNA sequence
  source 1..20: mol_type = other DNA
acatagaccattaggatggt

SEQ ID NO: 30440 - DNA, 20 bp, synthetic construct
  misc_feature 1..20: note = CRISPR gRNA sequence
  source 1..20: mol_type = other DNA
catagaccattaggatggtt

SEQ ID NO: 30441 - DNA, 20 bp, synthetic construct
  misc_feature 1..20: note = CRISPR gRNA sequence
  source 1..20: mol_type = other DNA
ggatggttcccattttccag

SEQ ID NO: 30442 - DNA, 20 bp, synthetic construct
  misc_feature 1..20: note = CRISPR gRNA sequence
  source 1..20: mol_type = other DNA
ccattttccaggtaagaaaa

SEQ ID NO: 30443 - DNA, 20 bp, synthetic construct
  misc_feature 1..20: note = CRISPR gRNA sequence
  source 1..20: mol_type = other DNA
tccaggtaagaaaacagcgg

SEQ ID NO: 30444 - DNA, 20 bp, synthetic construct
  misc_feature 1..20: note = CRISPR gRNA sequence
  source 1..20: mol_type = other DNA
ccaggtaagaaaacagcggc

SEQ ID NO: 30445 - DNA, 20 bp, synthetic construct
  misc_feature 1..20: note = CRISPR gRNA sequence
  source 1..20: mol_type = other DNA
caggtaagaaaacagcggct

SEQ ID NO: 30446 - DNA, 20 bp, synthetic construct
  misc_feature 1..20: note = CRISPR gRNA sequence
  source 1..20: mol_type = other DNA
ggaatgaataactgacttgc

SEQ ID NO: 30447 - DNA, 20 bp, synthetic construct
  misc_feature 1..20: note = CRISPR gRNA sequence
  source 1..20: mol_type = other DNA
acttgctcagagtttctttc

SEQ ID NO: 30448 - DNA, 20 bp, synthetic construct
  misc_feature 1..20: note = CRISPR gRNA sequence
  source 1..20: mol_type = other DNA
gctcagagtttctttcacca

SEQ ID NO: 30449 - DNA, 20 bp, synthetic construct
  misc_feature 1..20: note = CRISPR gRNA sequence
  source 1..20: mol_type = other DNA
ctcagagtttctttcaccac

SEQ ID NO: 30450 - DNA, 20 bp, synthetic construct
  misc_feature 1..20: note = CRISPR gRNA sequence
  source 1..20: mol_type = other DNA
agagtttctttcaccacgtc

SEQ ID NO: 30451 - DNA, 20 bp, synthetic construct
  misc_feature 1..20: note = CRISPR gRNA sequence
  source 1..20: mol_type = other DNA
ctttcaccacgtcccgctaa

SEQ ID NO: 30452 - DNA, 20 bp, synthetic construct
  misc_feature 1..20: note = CRISPR gRNA sequence
  source 1..20: mol_type = other DNA
tttcaccacgtcccgctaat

SEQ ID NO: 30453 - DNA, 20 bp, synthetic construct
  misc_feature 1..20: note = CRISPR gRNA sequence
  source 1..20: mol_type = other DNA
tcaccacgtcccgctaatcc

SEQ ID NO: 30454 - DNA, 20 bp, synthetic construct
  misc_feature 1..20: note = CRISPR gRNA sequence
  source 1..20: mol_type = other DNA
caccacgtcccgctaatcct

SEQ ID NO: 30455 - DNA, 20 bp, synthetic construct
  misc_feature 1..20: note = CRISPR gRNA sequence
  source 1..20: mol_type = other DNA
accacgtcccgctaatcctt

SEQ ID NO: 30456 - DNA, 20 bp, synthetic construct
  misc_feature 1..20: note = CRISPR gRNA sequence
  source 1..20: mol_type = other DNA
atccttttgttcagggctgt

SEQ ID NO: 30457 - DNA, 20 bp, synthetic construct
  misc_feature 1..20: note = CRISPR gRNA sequence
  source 1..20: mol_type = other DNA
ttgttcagggctgtggtgat

SEQ ID NO: 30458 - DNA, 20 bp, synthetic construct
  misc_feature 1..20: note = CRISPR gRNA sequence
  source 1..20: mol_type = other DNA
tgttcagggctgtggtgatt

SEQ ID NO: 30459 - DNA, 20 bp, synthetic construct
  misc_feature 1..20: note = CRISPR gRNA sequence
  source 1..20: mol_type = other DNA
gttcagggctgtggtgattg

SEQ ID NO: 30460 - DNA, 20 bp, synthetic construct
  misc_feature 1..20: note = CRISPR gRNA sequence
  source 1..20: mol_type = other DNA
ttcagggctgtggtgattgc

SEQ ID NO: 30461 - DNA, 20 bp, synthetic construct
  misc_feature 1..20: note = CRISPR gRNA sequence
  source 1..20: mol_type = other DNA
agggctgtggtgattgcttc

SEQ ID NO: 30462 - DNA, 20 bp, synthetic construct
  misc_feature 1..20: note = CRISPR gRNA sequence
  source 1..20: mol_type = other DNA
tggtgattgcttctagggtc

SEQ ID NO: 30463 - DNA, 20 bp, synthetic construct
  misc_feature 1..20: note = CRISPR gRNA sequence
  source 1..20: mol_type = other DNA
cttctagggtctcagtgtcc

SEQ ID NO: 30464 - DNA, 20 bp, synthetic construct
  misc_feature 1..20: note = CRISPR gRNA sequence
  source 1..20: mol_type = other DNA
ctagggtctcagtgtcccct

SEQ ID NO: 30465 - DNA, 20 bp, synthetic construct
  misc_feature 1..20: note = CRISPR gRNA sequence
  source 1..20: mol_type = other DNA
tagggtctcagtgtcccctg

SEQ ID NO: 30466 - DNA, 20 bp, synthetic construct
  misc_feature 1..20: note = CRISPR gRNA sequence
  source 1..20: mol_type = other DNA
gggtctcagtgtcccctgca

SEQ ID NO: 30467 - DNA, 20 bp, synthetic construct
  misc_feature 1..20: note = CRISPR gRNA sequence
  source 1..20: mol_type = other DNA
agtgtcccctgcagccagca

SEQ ID NO: 30468 - DNA, 20 bp, synthetic construct
  misc_feature 1..20: note = CRISPR gRNA sequence
  source 1..20: mol_type = other DNA
cagccagcacgatgtgggtt

SEQ ID NO: 30469 - DNA, 20 bp, synthetic construct
  misc_feature 1..20: note = CRISPR gRNA sequence
  source 1..20: mol_type = other DNA
cctgcgctctgcagcccccc

SEQ ID NO: 30470 - DNA, 20 bp, synthetic construct
  misc_feature 1..20: note = CRISPR gRNA sequence
  source 1..20: mol_type = other DNA
cgctctgcagccccccagct

SEQ ID NO: 30471 - DNA, 20 bp, synthetic construct
  misc_feature 1..20: note = CRISPR gRNA sequence
  source 1..20: mol_type = other DNA
tgcagccccccagctcagca

SEQ ID NO: 30472 - DNA, 20 bp, synthetic construct
  misc_feature 1..20: note = CRISPR gRNA sequence
  source 1..20: mol_type = other DNA
cagccccccagctcagcacc

SEQ ID NO: 30473 - DNA, 20 bp, synthetic construct
  misc_feature 1..20: note = CRISPR gRNA sequence
  source 1..20: mol_type = other DNA
agcacctgaccggtatccgg

SEQ ID NO: 30474 - DNA, 20 bp, synthetic construct
  misc_feature 1..20: note = CRISPR gRNA sequence
  source 1..20: mol_type = other DNA
accggtatccggggccccac

SEQ ID NO: 30475 - DNA, 20 bp, synthetic construct
  misc_feature 1..20: note = CRISPR gRNA sequence
  source 1..20: mol_type = other DNA
accttagcctgagcagggat

SEQ ID NO: 30476 - DNA, 20 bp, synthetic construct
  misc_feature 1..20: note = CRISPR gRNA sequence
  source 1..20: mol_type = other DNA
agcctgagcagggatgcagc

SEQ ID NO: 30477 - DNA, 20 bp, synthetic construct
  misc_feature 1..20: note = CRISPR gRNA sequence
  source 1..20: mol_type = other DNA
gcctgagcagggatgcagcg

SEQ ID NO: 30478 - DNA, 20 bp, synthetic construct
  misc_feature 1..20: note = CRISPR gRNA sequence
  source 1..20: mol_type = other DNA
agcagggatgcagcgagcga

SEQ ID NO: 30479 - DNA, 20 bp, synthetic construct
  misc_feature 1..20: note = CRISPR gRNA sequence
  source 1..20: mol_type = other DNA
ggcgagtttgtaggcaccca

SEQ ID NO: 30480 - DNA, 20 bp, synthetic construct
  misc_feature 1..20: note = CRISPR gRNA sequence
  source 1..20: mol_type = other DNA
gtaggcacccaggtcagtga

SEQ ID NO: 30481 - DNA, 20 bp, synthetic construct
  misc_feature 1..20: note = CRISPR gRNA sequence
  source 1..20: mol_type = other DNA
taggcacccaggtcagtgat

SEQ ID NO: 30482 - DNA, 20 bp, synthetic construct
  misc_feature 1..20: note = CRISPR gRNA sequence
  source 1..20: mol_type = other DNA
ttctgggacagactgcgggg

SEQ ID NO: 30483 - DNA, 20 bp, synthetic construct
  misc_feature 1..20: note = CRISPR gRNA sequence
  source 1..20: mol_type = other DNA
tgggacagactgcggggaca

SEQ ID NO: 30484 - DNA, 20 bp, synthetic construct
  misc_feature 1..20: note = CRISPR gRNA sequence
  source 1..20: mol_type = other DNA
ggacagactgcggggacaca

SEQ ID NO: 30485 - DNA, 20 bp, synthetic construct
  misc_feature 1..20: note = CRISPR gRNA sequence
  source 1..20: mol_type = other DNA
cggggacacagtgaggggga

SEQ ID NO: 30486 - DNA, 20 bp, synthetic construct
  misc_feature 1..20: note = CRISPR gRNA sequence
  source 1..20: mol_type = other DNA
aggaccaaacttgcatgcct

SEQ ID NO: 30487 - DNA, 20 bp, synthetic construct
  misc_feature 1..20: note = CRISPR gRNA sequence
  source 1..20: mol_type = other DNA
gcatgcctcactttgacctc

SEQ ID NO: 30488 - DNA, 20 bp, synthetic construct
  misc_feature 1..20: note = CRISPR gRNA sequence
  source 1..20: mol_type = other DNA
catgcctcactttgacctca

SEQ ID NO: 30489 - DNA, 20 bp, synthetic construct
  misc_feature 1..20: note = CRISPR gRNA sequence
  source 1..20: mol_type = other DNA
actttgacctcaaggagagt

SEQ ID NO: 30490 - DNA, 20 bp, synthetic construct
  misc_feature 1..20: note = CRISPR gRNA sequence
  source 1..20: mol_type = other DNA
tgacctcaaggagagttctg

SEQ ID NO: 30491 - DNA, 20 bp, synthetic construct
  misc_feature 1..20: note = CRISPR gRNA sequence
  source 1..20: mol_type = other DNA
gacctcaaggagagttctgg

SEQ ID NO: 30492 - DNA, 20 bp, synthetic construct
  misc_feature 1..20: note = CRISPR gRNA sequence
  source 1..20: mol_type = other DNA
acctcaaggagagttctggg

SEQ ID NO: 30493 - DNA, 20 bp, synthetic construct
  misc_feature 1..20: note = CRISPR gRNA sequence
  source 1..20: mol_type = other DNA
aaggagagttctgggtcata

SEQ ID NO: 30494 - DNA, 20 bp, synthetic construct
  misc_feature 1..20: note = CRISPR gRNA sequence
  source 1..20: mol_type = other DNA
tgggtcataggctgtgaatg

SEQ ID NO: 30495 - DNA, 20 bp, synthetic construct
  misc_feature 1..20: note = CRISPR gRNA sequence
  source 1..20: mol_type = other DNA
ggtcataggctgtgaatggc

SEQ ID NO: 30496 - DNA, 20 bp, synthetic construct
  misc_feature 1..20: note = CRISPR gRNA sequence
  source 1..20: mol_type = other DNA
tgaatggcgctgtcgacaga

SEQ ID NO: 30497 - DNA, 20 bp, synthetic construct
  misc_feature 1..20: note = CRISPR gRNA sequence
  source 1..20: mol_type = other DNA
tcgacagacttaagctacct

SEQ ID NO: 30498 - DNA, 20 bp, synthetic construct
  misc_feature 1..20: note = CRISPR gRNA sequence
  source 1..20: mol_type = other DNA
aagctacctctcggtaaata

SEQ ID NO: 30499 - DNA, 20 bp, synthetic construct
  misc_feature 1..20: note = CRISPR gRNA sequence
  source 1..20: mol_type = other DNA
agctacctctcggtaaatag

SEQ ID NO: 30500 - DNA, 20 bp, synthetic construct
  misc_feature 1..20: note = CRISPR gRNA sequence
  source 1..20: mol_type = other DNA
cctctcggtaaataggagga

SEQ ID NO: 30501 - DNA, 20 bp, synthetic construct
  misc_feature 1..20: note = CRISPR gRNA sequence
  source 1..20: mol_type = other DNA
tcggtaaataggaggatact

SEQ ID NO: 30502 - DNA, 20 bp, synthetic construct
  misc_feature 1..20: note = CRISPR gRNA sequence
  source 1..20: mol_type = other DNA
ggtaaataggaggatactgt

SEQ ID NO: 30503 - DNA, 20 bp, synthetic construct
  misc_feature 1..20: note = CRISPR gRNA sequence
  source 1..20: mol_type = other DNA
ttaggtcctgtggccaagtg

SEQ ID NO: 30504 - DNA, 20 bp, synthetic construct
  misc_feature 1..20: note = CRISPR gRNA sequence
  source 1..20: mol_type = other DNA
ggtcctgtggccaagtggga

SEQ ID NO: 30505 - DNA, 20 bp, synthetic construct
  misc_feature 1..20: note = CRISPR gRNA sequence
  source 1..20: mol_type = other DNA
tggccaagtgggagggcagg

SEQ ID NO: 30506 - DNA, 20 bp, synthetic construct
  misc_feature 1..20: note = CRISPR gRNA sequence
  source 1..20: mol_type = other DNA
ctgcccccacctgtcccatg

SEQ ID NO: 30507 - DNA, 20 bp, synthetic construct
  misc_feature 1..20: note = CRISPR gRNA sequence
  source 1..20: mol_type = other DNA
cccccacctgtcccatgact

SEQ ID NO: 30508 - DNA, 20 bp, synthetic construct
  misc_feature 1..20: note = CRISPR gRNA sequence
  source 1..20: mol_type = other DNA
tcccatgactttacaacatc

SEQ ID NO: 30509 - DNA, 20 bp, synthetic construct
  misc_feature 1..20: note = CRISPR gRNA sequence
  source 1..20: mol_type = other DNA
tacaacatcccctcttttcc

SEQ ID NO: 30510 - DNA, 20 bp, synthetic construct
  misc_feature 1..20: note = CRISPR gRNA sequence
  source 1..20: mol_type = other DNA
acaacatcccctcttttccc

SEQ ID NO: 30511 - DNA, 20 bp, synthetic construct
  misc_feature 1..20: note = CRISPR gRNA sequence
  source 1..20: mol_type = other DNA
caacatcccctcttttccct

SEQ ID NO: 30512 - DNA, 20 bp, synthetic construct
  misc_feature 1..20: note = CRISPR gRNA sequence
  source 1..20: mol_type = other DNA
ttttccctctgcgccacttt

SEQ ID NO: 30513 - DNA, 20 bp, synthetic construct
  misc_feature 1..20: note = CRISPR gRNA sequence
  source 1..20: mol_type = other DNA
ttccctctgcgccacttttc

SEQ ID NO: 30514 - DNA, 20 bp, synthetic construct
  misc_feature 1..20: note = CRISPR gRNA sequence
  source 1..20: mol_type = other DNA
tccctctgcgccacttttca

SEQ ID NO: 30515 - DNA, 20 bp, synthetic construct
  misc_feature 1..20: note = CRISPR gRNA sequence
  source 1..20: mol_type = other DNA
ccctctgcgccacttttcag

SEQ ID NO: 30516 - DNA, 20 bp, synthetic construct
  misc_feature 1..20: note = CRISPR gRNA sequence
  source 1..20: mol_type = other DNA
cctctgcgccacttttcagc

SEQ ID NO: 30517 - DNA, 20 bp, synthetic construct
  misc_feature 1..20: note = CRISPR gRNA sequence
  source 1..20: mol_type = other DNA
tgcgccacttttcagcacta

SEQ ID NO: 30518 - DNA, 20 bp, synthetic construct
  misc_feature 1..20: note = CRISPR gRNA sequence
  source 1..20: mol_type = other DNA
cgccacttttcagcactata

SEQ ID NO: 30519 - DNA, 20 bp, synthetic construct
  misc_feature 1..20: note = CRISPR gRNA sequence
  source 1..20: mol_type = other DNA
ttcagcactataatgaaata

SEQ ID NO: 30520 - DNA, 20 bp, synthetic construct
  misc_feature 1..20: note = CRISPR gRNA sequence
  source 1..20: mol_type = other DNA
tcagcactataatgaaataa

SEQ ID NO: 30521 - DNA, 20 bp, synthetic construct
  misc_feature 1..20: note = CRISPR gRNA sequence
  source 1..20: mol_type = other DNA
cagcactataatgaaataag

SEQ ID NO: 30522 - DNA, 20 bp, synthetic construct
  misc_feature 1..20: note = CRISPR gRNA sequence
  source 1..20: mol_type = other DNA
agcactataatgaaataagt

SEQ ID NO: 30523 - DNA, 20 bp, synthetic construct
  misc_feature 1..20: note = CRISPR gRNA sequence
  source 1..20: mol_type = other DNA
taatgaaataagtgttggca

SEQ ID NO: 30524 - DNA, 20 bp, synthetic construct
  misc_feature 1..20: note = CRISPR gRNA sequence
  source 1..20: mol_type = other DNA
gcattatttgtttaatggct

SEQ ID NO: 30525 - DNA, 20 bp, synthetic construct
  misc_feature 1..20: note = CRISPR gRNA sequence
  source 1..20: mol_type = other DNA
tttgtttaatggctgtgtaa

SEQ ID NO: 30526 - DNA, 20 bp, synthetic construct
  misc_feature 1..20: note = CRISPR gRNA sequence
  source 1..20: mol_type = other DNA
gtttaatggctgtgtaatcc

SEQ ID NO: 30527 - DNA, 20 bp, synthetic construct
  misc_feature 1..20: note = CRISPR gRNA sequence
  source 1..20: mol_type = other DNA
tttaatggctgtgtaatcct

SEQ ID NO: 30528 - DNA, 20 bp, synthetic construct
  misc_feature 1..20: note = CRISPR gRNA sequence
  source 1..20: mol_type = other DNA
aatggctgtgtaatcctttc

SEQ ID NO: 30529 - DNA, 20 bp, synthetic construct
  misc_feature 1..20: note = CRISPR gRNA sequence
  source 1..20: mol_type = other DNA
atggctgtgtaatcctttct

SEQ ID NO: 30530 - DNA, 20 bp, synthetic construct
  misc_feature 1..20: note = CRISPR gRNA sequence
  source 1..20: mol_type = other DNA
tgtaatcctttctgccgggt

SEQ ID NO: 30531 - DNA, 20 bp, synthetic construct
  misc_feature 1..20: note = CRISPR gRNA sequence
  source 1..20: mol_type = other DNA
tctgccgggttgtgggcttc

SEQ ID NO: 30532 - DNA, 20 bp, synthetic construct
  misc_feature 1..20: note = CRISPR gRNA sequence
  source 1..20: mol_type = other DNA
ctgccgggttgtgggcttca

SEQ ID NO: 30533 - DNA, 20 bp, synthetic construct
  misc_feature 1..20: note = CRISPR gRNA sequence
  source 1..20: mol_type = other DNA
tgccgggttgtgggcttcac

SEQ ID NO: 30534 - DNA, 20 bp, synthetic construct
  misc_feature 1..20: note = CRISPR gRNA sequence
  source 1..20: mol_type = other DNA
ccgggttgtgggcttcacat

SEQ ID NO: 30535 - DNA, 20 bp, synthetic construct
  misc_feature 1..20: note = CRISPR gRNA sequence
  source 1..20: mol_type = other DNA
tgggcttcacatggagcagg

SEQ ID NO: 30536 - DNA, 20 bp, synthetic construct
  misc_feature 1..20: note = CRISPR gRNA sequence
  source 1..20: mol_type = other DNA
cacatggagcagggctgtgt

SEQ ID NO: 30537 - DNA, 20 bp, synthetic construct
  misc_feature 1..20: note = CRISPR gRNA sequence
  source 1..20: mol_type = other DNA
acatggagcagggctgtgtc

SEQ ID NO: 30538 - DNA, 20 bp, synthetic construct
  misc_feature 1..20: note = CRISPR gRNA sequence
  source 1..20: mol_type = other DNA
tgtctgttttgctcattact

SEQ ID NO: 30539 - DNA, 20 bp, synthetic construct
  misc_feature 1..20: note = CRISPR gRNA sequence
  source 1..20: mol_type = other DNA
ttttgctcattactgtatcc

SEQ ID NO: 30540 - DNA, 20 bp, synthetic construct
  misc_feature 1..20: note = CRISPR gRNA sequence
  source 1..20: mol_type = other DNA
tgctcattactgtatccctg

SEQ ID NO: 30541 - DNA, 20 bp, synthetic construct
  misc_feature 1..20: note = CRISPR gRNA sequence
  source 1..20: mol_type = other DNA
gctcattactgtatccctgt

SEQ ID NO: 30542 - DNA, 20 bp, synthetic construct
  misc_feature 1..20: note = CRISPR gRNA sequence
  source 1..20: mol_type = other DNA
ctcattactgtatccctgtg

SEQ ID NO: 30543 - DNA, 20 bp, synthetic construct
  misc_feature 1..20: note = CRISPR gRNA sequence
  source 1..20: mol_type = other DNA
attactgtatccctgtgcct

SEQ ID NO: 30544 - DNA, 20 bp, synthetic construct
  misc_feature 1..20: note = CRISPR gRNA sequence
  source 1..20: mol_type = other DNA
ctgtatccctgtgcctagag

SEQ ID NO: 30545 - DNA, 20 bp, synthetic construct
  misc_feature 1..20: note = CRISPR gRNA sequence
  source 1..20: mol_type = other DNA
tatccctgtgcctagagcac

SEQ ID NO: 30546 - DNA, 20 bp, synthetic construct
  misc_feature 1..20: note = CRISPR gRNA sequence
  source 1..20: mol_type = other DNA
tgcctagagcactgccaggc

SEQ ID NO: 30547 - DNA, 20 bp, synthetic construct
  misc_feature 1..20: note = CRISPR gRNA sequence
  source 1..20: mol_type = other DNA
gagcactgccaggcacatag

SEQ ID NO: 30548 - DNA, 20 bp, synthetic construct
  misc_feature 1..20: note = CRISPR gRNA sequence
  source 1..20: mol_type = other DNA
ccaggcacatagtaggtgct

SEQ ID NO: 30549 - DNA, 20 bp, synthetic construct
  misc_feature 1..20: note = CRISPR gRNA sequence
  source 1..20: mol_type = other DNA
aataaatacttaagtggggt

SEQ ID NO: 30550 - DNA, 20 bp, synthetic construct
  misc_feature 1..20: note = CRISPR gRNA sequence
  source 1..20: mol_type = other DNA
aagtggggtggcgggtaaga

SEQ ID NO: 30551 - DNA, 20 bp, synthetic construct
  misc_feature 1..20: note = CRISPR gRNA sequence
  source 1..20: mol_type = other DNA
agtggggtggcgggtaagaa

SEQ ID NO: 30552 - DNA, 20 bp, synthetic construct
  misc_feature 1..20: note = CRISPR gRNA sequence
  source 1..20: mol_type = other DNA
aggagaagaaatctagctta

SEQ ID NO: 30553 - DNA, 20 bp, synthetic construct
  misc_feature 1..20: note = CRISPR gRNA sequence
  source 1..20: mol_type = other DNA
gcttacagtgttacctagga

SEQ ID NO: 30554 - DNA, 20 bp, synthetic construct
  misc_feature 1..20: note = CRISPR gRNA sequence
  source 1..20: mol_type = other DNA
acagtgttacctaggacact

SEQ ID NO: 30555 - DNA, 20 bp, synthetic construct
  misc_feature 1..20: note = CRISPR gRNA sequence
  source 1..20: mol_type = other DNA
cagtgttacctaggacacta

SEQ ID NO: 30556 - DNA, 20 bp, synthetic construct
  misc_feature 1..20: note = CRISPR gRNA sequence
  source 1..20: mol_type = other DNA
cctaggacactagaaattac

SEQ ID NO: 30557 - DNA, 20 bp, synthetic construct
  misc_feature 1..20: note = CRISPR gRNA sequence
  source 1..20: mol_type = other DNA
ggacactagaaattactgga

SEQ ID NO: 30558 - DNA, 20 bp, synthetic construct
  misc_feature 1..20: note = CRISPR gRNA sequence
  source 1..20: mol_type = other DNA
gaaattactggagaagtccc

SEQ ID NO: 30559 - DNA, 20 bp, synthetic construct
  misc_feature 1..20: note = CRISPR gRNA sequence
  source 1..20: mol_type = other DNA
ctggagaagtcccacagtcc

SEQ ID NO: 30560 - DNA, 20 bp, synthetic construct
  misc_feature 1..20: note = CRISPR gRNA sequence
  source 1..20: mol_type = other DNA
gagaagtcccacagtcctac

SEQ ID NO: 30561 - DNA, 20 bp, synthetic construct
  misc_feature 1..20: note = CRISPR gRNA sequence
  source 1..20: mol_type = other DNA
caattaaggaaattgctaag

SEQ ID NO: 30562 - DNA, 20 bp, synthetic construct
  misc_feature 1..20: note = CRISPR gRNA sequence
  source 1..20: mol_type = other DNA
aggaaattgctaagtaaatt

SEQ ID NO: 30563 - DNA, 20 bp, synthetic construct
  misc_feature 1..20: note = CRISPR gRNA sequence
  source 1..20: mol_type = other DNA
ctaagtaaattccggtaaat

SEQ ID NO: 30564 - DNA, 20 bp, synthetic construct
  misc_feature 1..20: note = CRISPR gRNA sequence
  source 1..20: mol_type = other DNA
agtaaattccggtaaattat

SEQ ID NO: 30565 - DNA, 20 bp, synthetic construct
  misc_feature 1..20: note = CRISPR gRNA sequence
  source 1..20: mol_type = other DNA
cggtaaattatttggccatc

SEQ ID NO: 30566 - DNA, 20 bp, synthetic construct
  misc_feature 1..20: note = CRISPR gRNA sequence
  source 1..20: mol_type = other DNA
tttggccatcctaagacctt

SEQ ID NO: 30567 - DNA, 20 bp, synthetic construct
  misc_feature 1..20: note = CRISPR gRNA sequence
  source 1..20: mol_type = other DNA
ggccatcctaagaccttggt

SEQ ID NO: 30568 - DNA, 20 bp, synthetic construct
  misc_feature 1..20: note = CRISPR gRNA sequence
  source 1..20: mol_type = other DNA
gccatcctaagaccttggtt

SEQ ID NO: 30569 - DNA, 20 bp, synthetic construct
  misc_feature 1..20: note = CRISPR gRNA sequence
  source 1..20: mol_type = other DNA
agaccttggttgtgaggggg

SEQ ID NO: 30570 - DNA, 20 bp, synthetic construct
  misc_feature 1..20: note = CRISPR gRNA sequence
  source 1..20: mol_type = other DNA
ggttgtgagggggagtgtgg

SEQ ID NO: 30571 - DNA, 20 bp, synthetic construct
  misc_feature 1..20: note = CRISPR gRNA sequence
  source 1..20: mol_type = other DNA
gttgtgagggggagtgtggg

SEQ ID NO: 30572 - DNA, 20 bp, synthetic construct
  misc_feature 1..20: note = CRISPR gRNA sequence
  source 1..20: mol_type = other DNA
tgagggggagtgtgggaaga

SEQ ID NO: 30573 - DNA, 20 bp, synthetic construct
  misc_feature 1..20: note = CRISPR gRNA sequence
  source 1..20: mol_type = other DNA
tgatatcctctaggttcagt

SEQ ID NO: 30574 - DNA, 20 bp, synthetic construct
  misc_feature 1..20: note = CRISPR gRNA sequence
  source 1..20: mol_type = other DNA
gatatcctctaggttcagta

SEQ ID NO: 30575 - DNA, 20 bp, synthetic construct
  misc_feature 1..20: note = CRISPR gRNA sequence
  source 1..20: mol_type = other DNA
atatcctctaggttcagtaa

SEQ ID NO: 30576 - DNA, 20 bp, synthetic construct
  misc_feature 1..20: note = CRISPR gRNA sequence
  source 1..20: mol_type = other DNA
taggttcagtaaaaaatcat

SEQ ID NO: 30577 - DNA, 20 bp, synthetic construct
  misc_feature 1..20: note = CRISPR gRNA sequence
  source 1..20: mol_type = other DNA
ggttcagtaaaaaatcatgt

SEQ ID NO: 30578 - DNA, 20 bp, synthetic construct
  misc_feature 1..20: note = CRISPR gRNA sequence
  source 1..20: mol_type = other DNA
agtaaaaaatcatgttgaac

SEQ ID NO: 30579 - DNA, 20 bp, synthetic construct
  misc_feature 1..20: note = CRISPR gRNA sequence
  source 1..20: mol_type = other DNA
aactgggcgtggtggctcat

SEQ ID NO: 30580 - DNA, 20 bp, synthetic construct
  misc_feature 1..20: note = CRISPR gRNA sequence
  source 1..20: mol_type = other DNA
ggcgtggtggctcatgccgg

SEQ ID NO: 30581 - DNA, 20 bp, synthetic construct
  misc_feature 1..20: note = CRISPR gRNA sequence
  source 1..20: mol_type = other DNA
atgccggtaatcccagcact

SEQ ID NO: 30582 - DNA, 20 bp, synthetic construct
  misc_feature 1..20: note = CRISPR gRNA sequence
  source 1..20: mol_type = other DNA
tgggaggctgaggtgggcgg

SEQ ID NO: 30583 - DNA, 20 bp, synthetic construct
  misc_feature 1..20: note = CRISPR gRNA sequence
  source 1..20: mol_type = other DNA
gggaggctgaggtgggcgga

SEQ ID NO: 30584 - DNA, 20 bp, synthetic construct
  misc_feature 1..20: note = CRISPR gRNA sequence
  source 1..20: mol_type = other DNA
ggaggctgaggtgggcggat

SEQ ID NO: 30585 - DNA, 20 bp, synthetic construct
  misc_feature 1..20: note = CRISPR gRNA sequence
  source 1..20: mol_type = other DNA
aggtgggcggatcacttgag

SEQ ID NO: 30586 - DNA, 20 bp, synthetic construct
  misc_feature 1..20: note = CRISPR gRNA sequence
  source 1..20: mol_type = other DNA
gaggtcaggagttcaagacc

SEQ ID NO: 30587 - DNA, 20 bp, synthetic construct
  misc_feature 1..20: note = CRISPR gRNA sequence
  source 1..20: mol_type = other DNA
aggtcaggagttcaagacca

SEQ ID NO: 30588 - DNA, 20 bp, synthetic construct
  misc_feature 1..20: note = CRISPR gRNA sequence
  source 1..20: mol_type = other DNA
aagaccagcctggccaacct

SEQ ID NO: 30589 - DNA, 20 bp, synthetic construct
  misc_feature 1..20: note = CRISPR gRNA sequence
  source 1..20: mol_type = other DNA
gccaacctggtgaaaccccg

SEQ ID NO: 30590 - DNA, 20 bp, synthetic construct
  misc_feature 1..20: note = CRISPR gRNA sequence
  source 1..20: mol_type = other DNA
gtgaaaccccgtctctacta

SEQ ID NO: 30591 - DNA, 20 bp, synthetic construct
  misc_feature 1..20: note = CRISPR gRNA sequence
  source 1..20: mol_type = other DNA
tactaaaaatacaaaaatta

SEQ ID NO: 30592 - DNA, 20 bp, synthetic construct
  misc_feature 1..20: note = CRISPR gRNA sequence
  source 1..20: mol_type = other DNA
ctaaaaatacaaaaattagt

SEQ ID NO: 30593 - DNA, 20 bp, synthetic construct
  misc_feature 1..20: note = CRISPR gRNA sequence
  source 1..20: mol_type = other DNA
aaaatacaaaaattagttgg

SEQ ID NO: 30594 - DNA, 20 bp, synthetic construct
  misc_feature 1..20: note = CRISPR gRNA sequence
  source 1..20: mol_type = other DNA
gttgggtgtagtggtgcatg

SEQ ID NO: 30595 - DNA, 20 bp, synthetic construct
  misc_feature 1..20: note = CRISPR gRNA sequence
  source 1..20: mol_type = other DNA
ggtgtagtggtgcatgcctg

SEQ ID NO: 30596 - DNA, 20 bp, synthetic construct
  misc_feature 1..20: note = CRISPR gRNA sequence
  source 1..20: mol_type = other DNA
taattccagctacttgggag

SEQ ID NO: 30597 - DNA, 20 bp, synthetic construct
  misc_feature 1..20: note = CRISPR gRNA sequence
  source 1..20: mol_type = other DNA
cagctacttgggaggctgag

SEQ ID NO: 30598 - DNA, 20 bp, synthetic construct
  misc_feature 1..20: note = CRISPR gRNA sequence
  source 1..20: mol_type = other DNA
cttgggaggctgaggtgtga

SEQ ID NO: 30599 - DNA, 20 bp, synthetic construct
  misc_feature 1..20: note = CRISPR gRNA sequence
  source 1..20: mol_type = other DNA
gggaggctgaggtgtgagaa

SEQ ID NO: 30600 - DNA, 20 bp, synthetic construct
  misc_feature 1..20: note = CRISPR gRNA sequence
  source 1..20: mol_type = other DNA
ggaggctgaggtgtgagaat

SEQ ID NO: 30601 - DNA, 20 bp, synthetic construct
  misc_feature 1..20: note = CRISPR gRNA sequence
  source 1..20: mol_type = other DNA
aggtgtgagaattgcttgaa

SEQ ID NO: 30602 - DNA, 20 bp, synthetic construct
  misc_feature 1..20: note = CRISPR gRNA sequence
  source 1..20: mol_type = other DNA
cttgaacccaggaggtgaag

SEQ ID NO: 30603 - DNA, 20 bp, synthetic construct
  misc_feature 1..20: note = CRISPR gRNA sequence
  source 1..20: mol_type = other DNA
gaacccaggaggtgaagttt

SEQ ID NO: 30604 - DNA, 20 bp, synthetic construct
  misc_feature 1..20: note = CRISPR gRNA sequence
  source 1..20: mol_type = other DNA
aacccaggaggtgaagtttg

SEQ ID NO: 30605 - DNA, 20 bp, synthetic construct
  misc_feature 1..20: note = CRISPR gRNA sequence
  source 1..20: mol_type = other DNA
gcaataaatagatcgtacca

SEQ ID NO: 30606 - DNA, 20 bp, synthetic construct
  misc_feature 1..20: note = CRISPR gRNA sequence
  source 1..20: mol_type = other DNA
caataaatagatcgtaccac

SEQ ID NO: 30607 - DNA, 20 bp, synthetic construct
  misc_feature 1..20: note = CRISPR gRNA sequence
  source 1..20: mol_type = other DNA
cactccagcctgggctacag

SEQ ID NO: 30608 - DNA, 20 bp, synthetic construct
  misc_feature 1..20: note = CRISPR gRNA sequence
  source 1..20: mol_type = other DNA
cagcctgggctacagagcga

SEQ ID NO: 30609 - DNA, 20 bp, synthetic construct
  misc_feature 1..20: note = CRISPR gRNA sequence
  source 1..20: mol_type = other DNA
ggctacagagcgagactccg

SEQ ID NO: 30610 - DNA, 20 bp, synthetic construct
  misc_feature 1..20: note = CRISPR gRNA sequence
  source 1..20: mol_type = other DNA
cagagcgagactccgtgtca

SEQ ID NO: 30611 - DNA, 20 bp, synthetic construct
  misc_feature 1..20: note = CRISPR gRNA sequence
  source 1..20: mol_type = other DNA
cgtgtcaaaaaaaaaaaaaa

SEQ ID NO: 30612 - DNA, 20 bp, synthetic construct
  misc_feature 1..20: note = CRISPR gRNA sequence
  source 1..20: mol_type = other DNA
aaccaggcacagtgactcat

SEQ ID NO: 30613 - DNA, 20 bp, synthetic construct
  misc_feature 1..20: note = CRISPR gRNA sequence
  source 1..20: mol_type = other DNA
atgcctgtaatcccagtact

SEQ ID NO: 30614 - DNA, 20 bp, synthetic construct
  misc_feature 1..20: note = CRISPR gRNA sequence
  source 1..20: mol_type = other DNA
taatcccagtactttgggag

SEQ ID NO: 30615 - DNA, 20 bp, synthetic construct
  misc_feature 1..20: note = CRISPR gRNA sequence
  source 1..20: mol_type = other DNA
tgggaggcagaggcaggagg

SEQ ID NO: 30616 - DNA, 20 bp, synthetic construct
  misc_feature 1..20: note = CRISPR gRNA sequence
  source 1..20: mol_type = other DNA
gggaggcagaggcaggagga

SEQ ID NO: 30617 - DNA, 20 bp, synthetic construct
  misc_feature 1..20: note = CRISPR gRNA sequence
  source 1..20: mol_type = other DNA
ggaggcagaggcaggaggat

SEQ ID NO: 30618 - DNA, 20 bp, synthetic construct
  misc_feature 1..20: note = CRISPR gRNA sequence
  source 1..20: mol_type = other DNA
gagctcagaagttcaagacc

SEQ ID NO: 30619 - DNA, 20 bp, synthetic construct
  misc_feature 1..20: note = CRISPR gRNA sequence
  source 1..20: mol_type = other DNA
agctcagaagttcaagacca

SEQ ID NO: 30620 - DNA, 20 bp, synthetic construct
  misc_feature 1..20: note = CRISPR gRNA sequence
  source 1..20: mol_type = other DNA
agaagttcaagaccagcctg

SEQ ID NO: 30621 - DNA, 20 bp, synthetic construct
  misc_feature 1..20: note = CRISPR gRNA sequence
  source 1..20: mol_type = other DNA
aagaccagcctgggcaacgt

SEQ ID NO: 30622 - DNA, 20 bp, synthetic construct
  misc_feature 1..20: note = CRISPR gRNA sequence
  source 1..20: mol_type = other DNA
ggcaacgtggtgaaaccacg

SEQ ID NO: 30623 - DNA, 20 bp, synthetic construct
  misc_feature 1..20: note = CRISPR gRNA sequence
  source 1..20: mol_type = other DNA
tacaaaaaaatacaaaaatt

SEQ ID NO: 30624 - DNA, 20 bp, synthetic construct
  misc_feature 1..20: note = CRISPR gRNA sequence
  source 1..20: mol_type = other DNA
caaaaaaatacaaaaattag

SEQ ID NO: 30625 - DNA, 20 bp, synthetic construct
  misc_feature 1..20: note = CRISPR gRNA sequence
  source 1..20: mol_type = other DNA
gcgggacgtggtggcatgca

SEQ ID NO: 30626 - DNA, 20 bp, synthetic construct
  misc_feature 1..20: note = CRISPR gRNA sequence
  source 1..20: mol_type = other DNA
tcccagctactcagaaggtt

SEQ ID NO: 30627 - DNA, 20 bp, synthetic construct
  misc_feature 1..20: note = CRISPR gRNA sequence
  source 1..20: mol_type = other DNA
ctcagaaggttgagatggga

SEQ ID NO: 30628 - DNA, 20 bp, synthetic construct
  misc_feature 1..20: note = CRISPR gRNA sequence
  source 1..20: mol_type = other DNA
agaaggttgagatgggagga

SEQ ID NO: 30629 - DNA, 20 bp, synthetic construct
  misc_feature 1..20: note = CRISPR gRNA sequence
  source 1..20: mol_type = other DNA
agatgggaggattgcttgag

SEQ ID NO: 30630 - DNA, 20 bp, synthetic construct
  misc_feature 1..20: note = CRISPR gRNA sequence
  source 1..20: mol_type = other DNA
cttgagcctaggagattgag

SEQ ID NO: 30631 - DNA, 20 bp, synthetic construct
  misc_feature 1..20: note = CRISPR gRNA sequence
  source 1..20: mol_type = other DNA
gagcctaggagattgaggct

SEQ ID NO: 30632 - DNA, 20 bp, synthetic construct
  misc_feature 1..20: note = CRISPR gRNA sequence
  source 1..20: mol_type = other DNA
agcctaggagattgaggctg

SEQ ID NO: 30633 - DNA, 20 bp, synthetic construct
  misc_feature 1..20: note = CRISPR gRNA sequence
  source 1..20: mol_type = other DNA
ggagattgaggctgcagtga

SEQ ID NO: 30634 - DNA, 20 bp, synthetic construct
  misc_feature 1..20: note = CRISPR gRNA sequence
  source 1..20: mol_type = other DNA
aggctgcagtgagccatgat

SEQ ID NO: 30635 - DNA, 20 bp, synthetic construct
  misc_feature 1..20: note = CRISPR gRNA sequence
  source 1..20: mol_type = other DNA
cagtgagccatgattacacc

SEQ ID NO: 30636 - DNA, 20 bp, synthetic construct
  misc_feature 1..20: note = CRISPR gRNA sequence
  source 1..20: mol_type = other DNA
caccactgcactccaccctg

SEQ ID NO: 30637 - DNA, 20 bp, synthetic construct
  misc_feature 1..20: note = CRISPR gRNA sequence
  source 1..20: mol_type = other DNA
cactccaccctgggtgacag

SEQ ID NO: 30638 - DNA, 20 bp, synthetic construct
  misc_feature 1..20: note = CRISPR gRNA sequence
  source 1..20: mol_type = other DNA
caccctgggtgacagagcga

SEQ ID NO: 30639 - DNA, 20 bp, synthetic construct
  misc_feature 1..20: note = CRISPR gRNA sequence
  source 1..20: mol_type = other DNA
ggtgacagagcgagaccttg

SEQ ID NO: 30640 - DNA, 20 bp, synthetic construct
  misc_feature 1..20: note = CRISPR gRNA sequence
  source 1..20: mol_type = other DNA
gtctgaaaaaaagaaaaaaa

SEQ ID NO: 30641 - DNA, 20 bp, synthetic construct
  misc_feature 1..20: note = CRISPR gRNA sequence
  source 1..20: mol_type = other DNA
tctgaaaaaaagaaaaaaaa

SEQ ID NO: 30642 - DNA, 20 bp, synthetic construct
  misc_feature 1..20: note = CRISPR gRNA sequence
  source 1..20: mol_type = other DNA
aaaaaaagaaaaaaaatcac

SEQ ID NO: 30643 - DNA, 20 bp, synthetic construct
  misc_feature 1..20: note = CRISPR gRNA sequence
  source 1..20: mol_type = other DNA
atcctcctgtatcttatcca

SEQ ID NO: 30644 - DNA, 20 bp, synthetic construct
  misc_feature 1..20: note = CRISPR gRNA sequence
  source 1..20: mol_type = other DNA
ctgtatcttatccatctcca

SEQ ID NO: 30645 - DNA, 20 bp, synthetic construct
  misc_feature 1..20: note = CRISPR gRNA sequence
  source 1..20: mol_type = other DNA
tatcttatccatctccaact

SEQ ID NO: 30646 - DNA, 20 bp, synthetic construct
  misc_feature 1..20: note = CRISPR gRNA sequence
  source 1..20: mol_type = other DNA
atccatctccaacttcccag

SEQ ID NO: 30647 - DNA, 20 bp, synthetic construct
  misc_feature 1..20: note = CRISPR gRNA sequence
  source 1..20: mol_type = other DNA
tccatctccaacttcccaga

SEQ ID NO: 30648 - DNA, 20 bp, synthetic construct
  misc_feature 1..20: note = CRISPR gRNA sequence
  source 1..20: mol_type = other DNA
caacttcccagagcccagaa

SEQ ID NO: 30649 - DNA, 20 bp, synthetic construct
  misc_feature 1..20: note = CRISPR gRNA sequence
  source 1..20: mol_type = other DNA
cccagagcccagaacagttt

SEQ ID NO: 30650 - DNA, 20 bp, synthetic construct
  misc_feature 1..20: note = CRISPR gRNA sequence
  source 1..20: mol_type = other DNA
ccagagcccagaacagtttt

SEQ ID NO: 30651 - DNA, 20 bp, synthetic construct
  misc_feature 1..20: note = CRISPR gRNA sequence
  source 1..20: mol_type = other DNA
ttaaaaagttttactgtttt

SEQ ID NO: 30652 - DNA, 20 bp, synthetic construct
  misc_feature 1..20: note = CRISPR gRNA sequence
  source 1..20: mol_type = other DNA
taaaaagttttactgttttg

SEQ ID NO: 30653 - DNA, 20 bp, synthetic construct
  misc_feature 1..20: note = CRISPR gRNA sequence
  source 1..20: mol_type = other DNA
aaaaagttttactgttttga

SEQ ID NO: 30654 - DNA, 20 bp, synthetic construct
  misc_feature 1..20: note = CRISPR gRNA sequence
  source 1..20: mol_type = other DNA
aaaagttttactgttttgat

SEQ ID NO: 30655 - DNA, 20 bp, synthetic construct
  misc_feature 1..20: note = CRISPR gRNA sequence
  source 1..20: mol_type = other DNA
tactgttttgataataatgc

SEQ ID NO: 30656 - DNA, 20 bp, synthetic construct
  misc_feature 1..20: note = CRISPR gRNA sequence
  source 1..20: mol_type = other DNA
actgttttgataataatgct

SEQ ID NO: 30657 - DNA, 20 bp, synthetic construct
  misc_feature 1..20: note = CRISPR gRNA sequence
  source 1..20: mol_type = other DNA
ctgttttgataataatgctt

SEQ ID NO: 30658 - DNA, 20 bp, synthetic construct
  misc_feature 1..20: note = CRISPR gRNA sequence
  source 1..20: mol_type = other DNA
ttttgataataatgctttat

SEQ ID NO: 30659 - DNA, 20 bp, synthetic construct
  misc_feature 1..20: note = CRISPR gRNA sequence
  source 1..20: mol_type = other DNA
tgataataatgctttattga

SEQ ID NO: 30660 - DNA, 20 bp, synthetic construct
  misc_feature 1..20: note = CRISPR gRNA sequence
  source 1..20: mol_type = other DNA
gataataatgctttattgat

SEQ ID NO: 30661 - DNA, 20 bp, synthetic construct
  misc_feature 1..20: note = CRISPR gRNA sequence
  source 1..20: mol_type = other DNA
ataataatgctttattgata

SEQ ID NO: 30662 - DNA, 20 bp, synthetic construct
  misc_feature 1..20: note = CRISPR gRNA sequence
  source 1..20: mol_type = other DNA
tattgataaatcctaatcta

SEQ ID NO: 30663 - DNA, 20 bp, synthetic construct
  misc_feature 1..20: note = CRISPR gRNA sequence
  source 1..20: mol_type = other DNA
attgataaatcctaatctat

SEQ ID NO: 30664 - DNA, 20 bp, synthetic construct
  misc_feature 1..20: note = CRISPR gRNA sequence
  source 1..20: mol_type = other DNA
ttgataaatcctaatctatc

SEQ ID NO: 30665 - DNA, 20 bp, synthetic construct
  misc_feature 1..20: note = CRISPR gRNA sequence
  source 1..20: mol_type = other DNA
ataaatcctaatctatctct

SEQ ID NO: 30666 - DNA, 20 bp, synthetic construct
  misc_feature 1..20: note = CRISPR gRNA sequence
  source 1..20: mol_type = other DNA
atctatctctcctatttcac

SEQ ID NO: 30667 - DNA, 20 bp, synthetic construct
  misc_feature 1..20: note = CRISPR gRNA sequence
  source 1..20: mol_type = other DNA
tctctcctatttcacccccc

SEQ ID NO: 30668 - DNA, 20 bp, synthetic construct
  misc_feature 1..20: note = CRISPR gRNA sequence
  source 1..20: mol_type = other DNA
tcctatttcaccccccagta

SEQ ID NO: 30669 - DNA, 20 bp, synthetic construct
  misc_feature 1..20: note = CRISPR gRNA sequence
  source 1..20: mol_type = other DNA
ctatttcaccccccagtata

SEQ ID NO: 30670 - DNA, 20 bp, synthetic construct
  misc_feature 1..20: note = CRISPR gRNA sequence
  source 1..20: mol_type = other DNA
tttcaccccccagtataatt

SEQ ID NO: 30671 - DNA, 20 bp, synthetic construct
  misc_feature 1..20: note = CRISPR gRNA sequence
  source 1..20: mol_type = other DNA
caccccccagtataattttc

SEQ ID NO: 30672 - DNA, 20 bp, synthetic construct
  misc_feature 1..20: note = CRISPR gRNA sequence
  source 1..20: mol_type = other DNA
accccccagtataattttct

SEQ ID NO: 30673 - DNA, 20 bp, synthetic construct
  misc_feature 1..20: note = CRISPR gRNA sequence
  source 1..20: mol_type = other DNA
tctgtcaccaaacattattt

SEQ ID NO: 30674 - DNA, 20 bp, synthetic construct
  misc_feature 1..20: note = CRISPR gRNA sequence
  source 1..20: mol_type = other DNA
ctgtcaccaaacattatttt

SEQ ID NO: 30675 - DNA, 20 bp, synthetic construct
  misc_feature 1..20: note = CRISPR gRNA sequence
  source 1..20: mol_type = other DNA
tgtcaccaaacattattttc

SEQ ID NO: 30676 - DNA, 20 bp, synthetic construct
  misc_feature 1..20: note = CRISPR gRNA sequence
  source 1..20: mol_type = other DNA
tcaccaaacattattttcat

SEQ ID NO: 30677 - DNA, 20 bp, synthetic construct
  misc_feature 1..20: note = CRISPR gRNA sequence
  source 1..20: mol_type = other DNA
ttttcattactgtatacttt

SEQ ID NO: 30678 - DNA, 20 bp, synthetic construct
  misc_feature 1..20: note = CRISPR gRNA sequence
  source 1..20: mol_type = other DNA
tcattactgtatactttata

SEQ ID NO: 30679 - DNA, 20 bp, synthetic construct
  misc_feature 1..20: note = CRISPR gRNA sequence
  source 1..20: mol_type = other DNA
cattactgtatactttataa

SEQ ID NO: 30680 - DNA, 20 bp, synthetic construct
  misc_feature 1..20: note = CRISPR gRNA sequence
  source 1..20: mol_type = other DNA
attactgtatactttataat

SEQ ID NO: 30681 - DNA, 20 bp, synthetic construct
  misc_feature 1..20: note = CRISPR gRNA sequence
  source 1..20: mol_type = other DNA
ctgtatactttataattacc

SEQ ID NO: 30682 - DNA, 20 bp, synthetic construct
  misc_feature 1..20: note = CRISPR gRNA sequence
  source 1..20: mol_type = other DNA
tatactttataattaccgac

SEQ ID NO: 30683 - DNA, 20 bp, synthetic construct
  misc_feature 1..20: note = CRISPR gRNA sequence
  source 1..20: mol_type = other DNA
tataattaccgacttgttta

SEQ ID NO: 30684 - DNA, 20 bp, synthetic construct
  misc_feature 1..20: note = CRISPR gRNA sequence
  source 1..20: mol_type = other DNA
ataattaccgacttgtttac

SEQ ID NO: 30685 - DNA, 20 bp, synthetic construct
  misc_feature 1..20: note = CRISPR gRNA sequence
  source 1..20: mol_type = other DNA
taattaccgacttgtttact

SEQ ID NO: 30686 - DNA, 20 bp, synthetic construct
  misc_feature 1..20: note = CRISPR gRNA sequence
  source 1..20: mol_type = other DNA
ccgacttgtttacttgttca

SEQ ID NO: 30687 - DNA, 20 bp, synthetic construct
  misc_feature 1..20: note = CRISPR gRNA sequence
  source 1..20: mol_type = other DNA
gtttacttgttcattgtgtc

SEQ ID NO: 30688 - DNA, 20 bp, synthetic construct
  misc_feature 1..20: note = CRISPR gRNA sequence
  source 1..20: mol_type = other DNA
tttacttgttcattgtgtct

SEQ ID NO: 30689 - DNA, 20 bp, synthetic construct
  misc_feature 1..20: note = CRISPR gRNA sequence
  source 1..20: mol_type = other DNA
acttgttcattgtgtctcct

SEQ ID NO: 30690 - DNA, 20 bp, synthetic construct
  misc_feature 1..20: note = CRISPR gRNA sequence
  source 1..20: mol_type = other DNA
cttgttcattgtgtctcctc

SEQ ID NO: 30691 - DNA, 20 bp, synthetic construct
  misc_feature 1..20: note = CRISPR gRNA sequence
  source 1..20: mol_type = other DNA
gttcattgtgtctcctcact

SEQ ID NO: 30692 - DNA, 20 bp, synthetic construct
  misc_feature 1..20: note = CRISPR gRNA sequence
  source 1..20: mol_type = other DNA
ttcattgtgtctcctcacta

SEQ ID NO: 30693 - DNA, 20 bp, synthetic construct
  misc_feature 1..20: note = CRISPR gRNA sequence
  source 1..20: mol_type = other DNA
attgtgtctcctcactagaa

SEQ ID NO: 30694 - DNA, 20 bp, synthetic construct
  misc_feature 1..20: note = CRISPR gRNA sequence
  source 1..20: mol_type = other DNA
tgtctcctcactagaattta

SEQ ID NO: 30695 - DNA, 20 bp, synthetic construct
  misc_feature 1..20: note = CRISPR gRNA sequence
  source 1..20: mol_type = other DNA
ctcactagaatttaagattc

SEQ ID NO: 30696 - DNA, 20 bp, synthetic construct
  misc_feature 1..20: note = CRISPR gRNA sequence
  source 1..20: mol_type = other DNA
actagaatttaagattcctg

SEQ ID NO: 30697 - DNA, 20 bp, synthetic construct
  misc_feature 1..20: note = CRISPR gRNA sequence
  source 1..20: mol_type = other DNA
gaatttaagattcctgaggt

SEQ ID NO: 30698 - DNA, 20 bp, synthetic construct
  misc_feature 1..20: note = CRISPR gRNA sequence
  source 1..20: mol_type = other DNA
aagattcctgaggtcagggg

SEQ ID NO: 30699 - DNA, 20 bp, synthetic construct
  misc_feature 1..20: note = CRISPR gRNA sequence
  source 1..20: mol_type = other DNA
agattcctgaggtcagggga

SEQ ID NO: 30700 - DNA, 20 bp, synthetic construct
  misc_feature 1..20: note = CRISPR gRNA sequence
  source 1..20: mol_type = other DNA
ctgaggtcaggggatttatt

SEQ ID NO: 30701 - DNA, 20 bp, synthetic construct
  misc_feature 1..20: note = CRISPR gRNA sequence
  source 1..20: mol_type = other DNA
aggtcaggggatttatttgt

SEQ ID NO: 30702 - DNA, 20 bp, synthetic construct
  misc_feature 1..20: note = CRISPR gRNA sequence
  source 1..20: mol_type = other DNA
atttgttttgtttaaagctg

SEQ ID NO: 30703 - DNA, 20 bp, synthetic construct
  misc_feature 1..20: note = CRISPR gRNA sequence
  source 1..20: mol_type = other DNA
tttgttttgtttaaagctgg

SEQ ID NO: 30704 - DNA, 20 bp, synthetic construct
  misc_feature 1..20: note = CRISPR gRNA sequence
  source 1..20: mol_type = other DNA
gttttgtttaaagctgggtc

SEQ ID NO: 30705 - DNA, 20 bp, synthetic construct
  misc_feature 1..20: note = CRISPR gRNA sequence
  source 1..20: mol_type = other DNA
ttttgtttaaagctgggtct

SEQ ID NO: 30706 - DNA, 20 bp, synthetic construct
  misc_feature 1..20: note = CRISPR gRNA sequence
  source 1..20: mol_type = other DNA
tgtttaaagctgggtctcca

SEQ ID NO: 30707 - DNA, 20 bp, synthetic construct
  misc_feature 1..20: note = CRISPR gRNA sequence
  source 1..20: mol_type = other DNA
gtttaaagctgggtctccag

SEQ ID NO: 30708 - DNA, 20 bp, synthetic construct
  misc_feature 1..20: note = CRISPR gRNA sequence
  source 1..20: mol_type = other DNA
tttaaagctgggtctccagg

SEQ ID NO: 30709 - DNA, 20 bp, synthetic construct
  misc_feature 1..20: note = CRISPR gRNA sequence
  source 1..20: mol_type = other DNA
aaagctgggtctccagggcc

SEQ ID NO: 30710 - DNA, 20 bp, synthetic construct
  misc_feature 1..20: note = CRISPR gRNA sequence
  source 1..20: mol_type = other DNA
aagctgggtctccagggcct

SEQ ID NO: 30711 - DNA, 20 bp, synthetic construct
  misc_feature 1..20: note = CRISPR gRNA sequence
  source 1..20: mol_type = other DNA
ggtctccagggcctagaaag

SEQ ID NO: 30712 - DNA, 20 bp, synthetic construct
  misc_feature 1..20: note = CRISPR gRNA sequence
  source 1..20: mol_type = other DNA
cagggcctagaaaggtgcct

SEQ ID NO: 30713 - DNA, 20 bp, synthetic construct
  misc_feature 1..20: note = CRISPR gRNA sequence
  source 1..20: mol_type = other DNA
gaaaggtgcctgcacatagt

SEQ ID NO: 30714 - DNA, 20 bp, synthetic construct
  misc_feature 1..20: note = CRISPR gRNA sequence
  source 1..20: mol_type = other DNA
cacatagtaggtcctcctta

SEQ ID NO: 30715 - DNA, 20 bp, synthetic construct
  misc_feature 1..20: note = CRISPR gRNA sequence
  source 1..20: mol_type = other DNA
cttaaatatttgttgattaa

SEQ ID NO: 30716 - DNA, 20 bp, synthetic construct
  misc_feature 1..20: note = CRISPR gRNA sequence
  source 1..20: mol_type = other DNA
aaatatttgttgattaaatt

SEQ ID NO: 30717 - DNA, 20 bp, synthetic construct
  misc_feature 1..20: note = CRISPR gRNA sequence
  source 1..20: mol_type = other DNA
aatatttgttgattaaatta

SEQ ID NO: 30718 - DNA, 20 bp, synthetic construct
  misc_feature 1..20: note = CRISPR gRNA sequence
  source 1..20: mol_type = other DNA
gttgattaaattaataaatg

SEQ ID NO: 30719 - DNA, 20 bp, synthetic construct
  misc_feature 1..20: note = CRISPR gRNA sequence
  source 1..20: mol_type = other DNA
ttgattaaattaataaatgg

SEQ ID NO: 30720 - DNA, 20 bp, synthetic construct
  misc_feature 1..20: note = CRISPR gRNA sequence
  source 1..20: mol_type = other DNA
attaaattaataaatggttg

SEQ ID NO: 30721 - DNA, 20 bp, synthetic construct
  misc_feature 1..20: note = CRISPR gRNA sequence
  source 1..20: mol_type = other DNA
aattaataaatggttgggta

SEQ ID NO: 30722 - DNA, 20 bp, synthetic construct
  misc_feature 1..20: note = CRISPR gRNA sequence
  source 1..20: mol_type = other DNA
ataaatggttgggtaagtaa

SEQ ID NO: 30723 - DNA, 20 bp, synthetic construct
  misc_feature 1..20: note = CRISPR gRNA sequence
  source 1..20: mol_type = other DNA
ggtaagtaaagaaatgattg

SEQ ID NO: 30724 - DNA, 20 bp, synthetic construct
  misc_feature 1..20: note = CRISPR gRNA sequence
  source 1..20: mol_type = other DNA
agtgagcggttggatgaggg

SEQ ID NO: 30725 - DNA, 20 bp, synthetic construct
  misc_feature 1..20: note = CRISPR gRNA sequence
  source 1..20: mol_type = other DNA
gatgagggagtaaagaaatg

SEQ ID NO: 30726 - DNA, 20 bp, synthetic construct
  misc_feature 1..20: note = CRISPR gRNA sequence
  source 1..20: mol_type = other DNA
cataagtgaatggatgaatc

SEQ ID NO: 30727 - DNA, 20 bp, synthetic construct
  misc_feature 1..20: note = CRISPR gRNA sequence
  source 1..20: mol_type = other DNA
aatggaaggatgaatggctg

SEQ ID NO: 30728 - DNA, 20 bp, synthetic construct
  misc_feature 1..20: note = CRISPR gRNA sequence
  source 1..20: mol_type = other DNA
attgaataggtgaatgagtg

SEQ ID NO: 30729 - DNA, 20 bp, synthetic construct
  misc_feature 1..20: note = CRISPR gRNA sequence
  source 1..20: mol_type = other DNA
aataggtgaatgagtgaatg

SEQ ID NO: 30730 - DNA, 20 bp, synthetic construct
  misc_feature 1..20: note = CRISPR gRNA sequence
  source 1..20: mol_type = other DNA
gggctgggcatggtaagtca

SEQ ID NO: 30731 - DNA, 20 bp, synthetic construct
  misc_feature 1..20: note = CRISPR gRNA sequence
  source 1..20: mol_type = other DNA
ggcatggtaagtcacaccta

SEQ ID NO: 30732 - DNA, 20 bp, synthetic construct
  misc_feature 1..20: note = CRISPR gRNA sequence
  source 1..20: mol_type = other DNA
taatcccagcactttgggaa

SEQ ID NO: 30733 - DNA, 20 bp, synthetic construct
  misc_feature 1..20: note = CRISPR gRNA sequence
  source 1..20: mol_type = other DNA
tgggaagcggaggtgaggag

SEQ ID NO: 30734 - DNA, 20 bp, synthetic construct
  misc_feature 1..20: note = CRISPR gRNA sequence
  source 1..20: mol_type = other DNA
gggaagcggaggtgaggaga

SEQ ID NO: 30735 - DNA, 20 bp, synthetic construct
  misc_feature 1..20: note = CRISPR gRNA sequence
  source 1..20: mol_type = other DNA
ggaagcggaggtgaggagat

SEQ ID NO: 30736 - DNA, 20 bp, synthetic construct
  misc_feature 1..20: note = CRISPR gRNA sequence
  source 1..20: mol_type = other DNA
cttgaggccaggagttcaag

SEQ ID NO: 30737 - DNA, 20 bp, synthetic construct
  misc_feature 1..20: note = CRISPR gRNA sequence
  source 1..20: mol_type = other DNA
gaggccaggagttcaaggct

SEQ ID NO: 30738 - DNA, 20 bp, synthetic construct
  misc_feature 1..20: note = CRISPR gRNA sequence
  source 1..20: mol_type = other DNA
aggccaggagttcaaggctg

SEQ ID NO: 30739 - DNA, 20 bp, synthetic construct
  misc_feature 1..20: note = CRISPR gRNA sequence
  source 1..20: mol_type = other DNA
aaggctgcagaggtatgatc

SEQ ID NO: 30740 - DNA, 20 bp, synthetic construct
  misc_feature 1..20: note = CRISPR gRNA sequence
  source 1..20: mol_type = other DNA
cagaggtatgatcatagcac

SEQ ID NO: 30741 - DNA, 20 bp, synthetic construct
  misc_feature 1..20: note = CRISPR gRNA sequence
  source 1..20: mol_type = other DNA
tattctagcctgggtgacac

SEQ ID NO: 30742 - DNA, 20 bp, synthetic construct
  misc_feature 1..20: note = CRISPR gRNA sequence
  source 1..20: mol_type = other DNA
tagcctgggtgacacagcga

SEQ ID NO: 30743 - DNA, 20 bp, synthetic construct
  misc_feature 1..20: note = CRISPR gRNA sequence
  source 1..20: mol_type = other DNA
gcctgggtgacacagcgagc

SEQ ID NO: 30744 - DNA, 20 bp, synthetic construct
  misc_feature 1..20: note = CRISPR gRNA sequence
  source 1..20: mol_type = other DNA
ggtgacacagcgagcccttg

SEQ ID NO: 30745 - DNA, 20 bp, synthetic construct
  misc_feature 1..20: note = CRISPR gRNA sequence
  source 1..20: mol_type = other DNA
gtctaaaaaaacaaatttaa

SEQ ID NO: 30746 - DNA, 20 bp, synthetic construct
  misc_feature 1..20: note = CRISPR gRNA sequence
  source 1..20: mol_type = other DNA
tctaaaaaaacaaatttaaa

SEQ ID NO: 30747 - DNA, 20 bp, synthetic construct
  misc_feature 1..20: note = CRISPR gRNA sequence
  source 1..20: mol_type = other DNA
aaaaaacaaatttaaattaa

SEQ ID NO: 30748 - DNA, 20 bp, synthetic construct
  misc_feature 1..20: note = CRISPR gRNA sequence
  source 1..20: mol_type = other DNA
aaattaattttgaaaaagtc

SEQ ID NO: 30749 - DNA, 20 bp, synthetic construct
  misc_feature 1..20: note = CRISPR gRNA sequence
  source 1..20: mol_type = other DNA
aattaattttgaaaaagtca

SEQ ID NO: 30750 - DNA, 20 bp, synthetic construct
  misc_feature 1..20: note = CRISPR gRNA sequence
  source 1..20: mol_type = other DNA
attttgaaaaagtcagccgg

SEQ ID NO: 30751 - DNA, 20 bp, synthetic construct
  misc_feature 1..20: note = CRISPR gRNA sequence
  source 1..20: mol_type = other DNA
tgaaaaagtcagccggactt

SEQ ID NO: 30752 - DNA, 20 bp, synthetic construct
  misc_feature 1..20: note = CRISPR gRNA sequence
  source 1..20: mol_type = other DNA
gaaaaagtcagccggacttt

SEQ ID NO: 30753 - DNA, 20 bp, synthetic construct
  misc_feature 1..20: note = CRISPR gRNA sequence
  source 1..20: mol_type = other DNA
aaaaagtcagccggactttg

SEQ ID NO: 30754 - DNA, 20 bp, synthetic construct
  misc_feature 1..20: note = CRISPR gRNA sequence
  source 1..20: mol_type = other DNA
tgggggcccgattcagcagg

SEQ ID NO: 30755 - DNA, 20 bp, synthetic construct
  misc_feature 1..20: note = CRISPR gRNA sequence
  source 1..20: mol_type = other DNA
gggggcccgattcagcagga

SEQ ID NO: 30756 - DNA, 20 bp, synthetic construct
  misc_feature 1..20: note = CRISPR gRNA sequence
  source 1..20: mol_type = other DNA
ggggcccgattcagcaggaa

SEQ ID NO: 30757 - DNA, 20 bp, synthetic construct
  misc_feature 1..20: note = CRISPR gRNA sequence
  source 1..20: mol_type = other DNA
agcaggaagggcaggcccag

SEQ ID NO: 30758 - DNA, 20 bp, synthetic construct
  misc_feature 1..20: note = CRISPR gRNA sequence
  source 1..20: mol_type = other DNA
actcacttgagggtttccaa

SEQ ID NO: 30759 - DNA, 20 bp, synthetic construct
  misc_feature 1..20: note = CRISPR gRNA sequence
  source 1..20: mol_type = other DNA
acttgagggtttccaaggac

SEQ ID NO: 30760 - DNA, 20 bp, synthetic construct
  misc_feature 1..20: note = CRISPR gRNA sequence
  source 1..20: mol_type = other DNA
gagggtttccaaggacttca

SEQ ID NO: 30761 - DNA, 20 bp, synthetic construct
  misc_feature 1..20: note = CRISPR gRNA sequence
  source 1..20: mol_type = other DNA
agggtttccaaggacttcag

SEQ ID NO: 30762 - DNA, 20 bp, synthetic construct
  misc_feature 1..20: note = CRISPR gRNA sequence
  source 1..20: mol_type = other DNA
ccaaggacttcagctggggg

SEQ ID NO: 30763 - DNA, 20 bp, synthetic construct
  misc_feature 1..20: note = CRISPR gRNA sequence
  source 1..20: mol_type = other DNA
caaggacttcagctggggga

SEQ ID NO: 30764 - DNA, 20 bp, synthetic construct
  misc_feature 1..20: note = CRISPR gRNA sequence
  source 1..20: mol_type = other DNA
cagctgggggaaggtggctg

SEQ ID NO: 30765 - DNA, 20 bp, synthetic construct
  misc_feature 1..20: note = CRISPR gRNA sequence
  source 1..20: mol_type = other DNA
agctgggggaaggtggctga

SEQ ID NO: 30766 - DNA, 20 bp, synthetic construct
  misc_feature 1..20: note = CRISPR gRNA sequence
  source 1..20: mol_type = other DNA
ggggaaggtggctgagagct

SEQ ID NO: 30767 - DNA, 20 bp, synthetic construct
  misc_feature 1..20: note = CRISPR gRNA sequence
  source 1..20: mol_type = other DNA
agagctgcgagacaccctcg

SEQ ID NO: 30768 - DNA, 20 bp, synthetic construct
  misc_feature 1..20: note = CRISPR gRNA sequence
  source 1..20: mol_type = other DNA
cgagacaccctcgtccccga

SEQ ID NO: 30769 - DNA, 20 bp, synthetic construct
  misc_feature 1..20: note = CRISPR gRNA sequence
  source 1..20: mol_type = other DNA
gtccccgatcttgttctcac

SEQ ID NO: 30770 - DNA, 20 bp, synthetic construct
  misc_feature 1..20: note = CRISPR gRNA sequence
  source 1..20: mol_type = other DNA
gttctcactcagcgcatcca

SEQ ID NO: 30771 - DNA, 20 bp, synthetic construct
  misc_feature 1..20: note = CRISPR gRNA sequence
  source 1..20: mol_type = other DNA
ttctcactcagcgcatccag

SEQ ID NO: 30772 - DNA, 20 bp, synthetic construct
  misc_feature 1..20: note = CRISPR gRNA sequence
  source 1..20: mol_type = other DNA
tcactcagcgcatccaggct

SEQ ID NO: 30773 - DNA, 20 bp, synthetic construct
  misc_feature 1..20: note = CRISPR gRNA sequence
  source 1..20: mol_type = other DNA
actcagcgcatccaggctgc

SEQ ID NO: 30774 - DNA, 20 bp, synthetic construct
  misc_feature 1..20: note = CRISPR gRNA sequence
  source 1..20: mol_type = other DNA
agcgcatccaggctgcaggt

SEQ ID NO: 30775 - DNA, 20 bp, synthetic construct
  misc_feature 1..20: note = CRISPR gRNA sequence
  source 1..20: mol_type = other DNA
caggtggaatcagatggggg

SEQ ID NO: 30776 - DNA, 20 bp, synthetic construct
  misc_feature 1..20: note = CRISPR gRNA sequence
  source 1..20: mol_type = other DNA
gcgtcctggggccatctgac

SEQ ID NO: 30777 - DNA, 20 bp, synthetic construct
  misc_feature 1..20: note = CRISPR gRNA sequence
  source 1..20: mol_type = other DNA
gggccatctgacccttccca

SEQ ID NO: 30778 - DNA, 20 bp, synthetic construct
  misc_feature 1..20: note = CRISPR gRNA sequence
  source 1..20: mol_type = other DNA
acccttcccatcccagtgag

SEQ ID NO: 30779 - DNA, 20 bp, synthetic construct
  misc_feature 1..20: note = CRISPR gRNA sequence
  source 1..20: mol_type = other DNA
cccatcccagtgagggcctc

SEQ ID NO: 30780 - DNA, 20 bp, synthetic construct
  misc_feature 1..20: note = CRISPR gRNA sequence
  source 1..20: mol_type = other DNA
ccatcccagtgagggcctcc

SEQ ID NO: 30781 - DNA, 20 bp, synthetic construct
  misc_feature 1..20: note = CRISPR gRNA sequence
  source 1..20: mol_type = other DNA
ctcagccctggcacctgccc

SEQ ID NO: 30782 - DNA, 20 bp, synthetic construct
  misc_feature 1..20: note = CRISPR gRNA sequence
  source 1..20: mol_type = other DNA
agccctggcacctgcccttc

SEQ ID NO: 30783 - DNA, 20 bp, synthetic construct
  misc_feature 1..20: note = CRISPR gRNA sequence
  source 1..20: mol_type = other DNA
gcacctgcccttcccacccc

SEQ ID NO: 30784 - DNA, 20 bp, synthetic construct
  misc_feature 1..20: note = CRISPR gRNA sequence
  source 1..20: mol_type = other DNA
cccttcccaccccccagctc

SEQ ID NO: 30785 - DNA, 20 bp, synthetic construct
  misc_feature 1..20: note = CRISPR gRNA sequence
  source 1..20: mol_type = other DNA
cccaccccccagctctaata

SEQ ID NO: 30786 - DNA, 20 bp, synthetic construct
  misc_feature 1..20: note = CRISPR gRNA sequence
  source 1..20: mol_type = other DNA
ccaccccccagctctaatac

SEQ ID NO: 30787 - DNA, 20 bp, synthetic construct
  misc_feature 1..20: note = CRISPR gRNA sequence
  source 1..20: mol_type = other DNA
taatacaccataggcagccg

SEQ ID NO: 30788 - DNA, 20 bp, synthetic construct
  misc_feature 1..20: note = CRISPR gRNA sequence
  source 1..20: mol_type = other DNA
atacaccataggcagccggc

SEQ ID NO: 30789 - DNA, 20 bp, synthetic construct
  misc_feature 1..20: note = CRISPR gRNA sequence
  source 1..20: mol_type = other DNA
ctgagcttttcagacgagga

SEQ ID NO: 30790 - DNA, 20 bp, synthetic construct
  misc_feature 1..20: note = CRISPR gRNA sequence
  source 1..20: mol_type = other DNA
agcttttcagacgaggactt

SEQ ID NO: 30791 - DNA, 20 bp, synthetic construct
  misc_feature 1..20: note = CRISPR gRNA sequence
  source 1..20: mol_type = other DNA
ttcagacgaggacttcatca

SEQ ID NO: 30792 - DNA, 20 bp, synthetic construct
  misc_feature 1..20: note = CRISPR gRNA sequence
  source 1..20: mol_type = other DNA
tcagacgaggacttcatcac

SEQ ID NO: 30793 - DNA, 20 bp, synthetic construct
  misc_feature 1..20: note = CRISPR gRNA sequence
  source 1..20: mol_type = other DNA
cagacgaggacttcatcacc

SEQ ID NO: 30794 - DNA, 20 bp, synthetic construct
  misc_feature 1..20: note = CRISPR gRNA sequence
  source 1..20: mol_type = other DNA
agacgaggacttcatcacct

SEQ ID NO: 30795 - DNA, 20 bp, synthetic construct
  misc_feature 1..20: note = CRISPR gRNA sequence
  source 1..20: mol_type = other DNA
catcacctgggggctccaac

SEQ ID NO: 30796 - DNA, 20 bp, synthetic construct
  misc_feature 1..20: note = CRISPR gRNA sequence
  source 1..20: mol_type = other DNA
atcacctgggggctccaacc

SEQ ID NO: 30797 - DNA, 20 bp, synthetic construct
  misc_feature 1..20: note = CRISPR gRNA sequence
  source 1..20: mol_type = other DNA
ggggctccaaccaggcagcc

SEQ ID NO: 30798 - DNA, 20 bp, synthetic construct
  misc_feature 1..20: note = CRISPR gRNA sequence
  source 1..20: mol_type = other DNA
caaccaggcagccagagggc

SEQ ID NO: 30799 - DNA, 20 bp, synthetic construct
  misc_feature 1..20: note = CRISPR gRNA sequence
  source 1..20: mol_type = other DNA
actcatgatggacttgaatc

SEQ ID NO: 30800 - DNA, 20 bp, synthetic construct
  misc_feature 1..20: note = CRISPR gRNA sequence
  source 1..20: mol_type = other DNA
atgatggacttgaatccctg

SEQ ID NO: 30801 - DNA, 20 bp, synthetic construct
  misc_feature 1..20: note = CRISPR gRNA sequence
  source 1..20: mol_type = other DNA
gaatccctgtttagcttctt

SEQ ID NO: 30802 - DNA, 20 bp, synthetic construct
  misc_feature 1..20: note = CRISPR gRNA sequence
  source 1..20: mol_type = other DNA
aatccctgtttagcttctta

SEQ ID NO: 30803 - DNA, 20 bp, synthetic construct
  misc_feature 1..20: note = CRISPR gRNA sequence
  source 1..20: mol_type = other DNA
tttagcttcttaggaactaa

SEQ ID NO: 30804 - DNA, 20 bp, synthetic construct
  misc_feature 1..20: note = CRISPR gRNA sequence
  source 1..20: mol_type = other DNA
agcttcttaggaactaagcc

SEQ ID NO: 30805 - DNA, 20 bp, synthetic construct
  misc_feature 1..20: note = CRISPR gRNA sequence
  source 1..20: mol_type = other DNA
gcttcttaggaactaagccc

SEQ ID NO: 30806 - DNA, 20 bp, synthetic construct
  misc_feature 1..20: note = CRISPR gRNA sequence
  source 1..20: mol_type = other DNA
cttaggaactaagcccctga

SEQ ID NO: 30807 - DNA, 20 bp, synthetic construct
  misc_feature 1..20: note = CRISPR gRNA sequence
  source 1..20: mol_type = other DNA
ttaggaactaagcccctgag

SEQ ID NO: 30808 - DNA, 20 bp, synthetic construct
  misc_feature 1..20: note = CRISPR gRNA sequence
  source 1..20: mol_type = other DNA
aggaactaagcccctgaggc

SEQ ID NO: 30809 - DNA, 20 bp, synthetic construct
  misc_feature 1..20: note = CRISPR gRNA sequence
  source 1..20: mol_type = other DNA
ggaactaagcccctgaggct

SEQ ID NO: 30810 - DNA, 20 bp, synthetic construct
  misc_feature 1..20: note = CRISPR gRNA sequence
  source 1..20: mol_type = other DNA
agcccctgaggcttggcaac

SEQ ID NO: 30811 - DNA, 20 bp, synthetic construct
  misc_feature 1..20: note = CRISPR gRNA sequence
  source 1..20: mol_type = other DNA
aggcttggcaacttccttaa

SEQ ID NO: 30812 - DNA, 20 bp, synthetic construct
  misc_feature 1..20: note = CRISPR gRNA sequence
  source 1..20: mol_type = other DNA
ggcaacttccttaacctcca

SEQ ID NO: 30813 - DNA, 20 bp, synthetic construct
  misc_feature 1..20: note = CRISPR gRNA sequence
  source 1..20: mol_type = other DNA
gcaacttccttaacctccac

SEQ ID NO: 30814 - DNA, 20 bp, synthetic construct
  misc_feature 1..20: note = CRISPR gRNA sequence
  source 1..20: mol_type = other DNA
ccttaacctccactgtaaag

SEQ ID NO: 30815 - DNA, 20 bp, synthetic construct
  misc_feature 1..20: note = CRISPR gRNA sequence
  source 1..20: mol_type = other DNA
cttaacctccactgtaaagt

SEQ ID NO: 30816 - DNA, 20 bp, synthetic construct
  misc_feature 1..20: note = CRISPR gRNA sequence
  source 1..20: mol_type = other DNA
aacctccactgtaaagtagg

SEQ ID NO: 30817 - DNA, 20 bp, synthetic construct
  misc_feature 1..20: note = CRISPR gRNA sequence
  source 1..20: mol_type = other DNA
acctccactgtaaagtagga

SEQ ID NO: 30818 - DNA, 20 bp, synthetic construct
  misc_feature 1..20: note = CRISPR gRNA sequence
  source 1..20: mol_type = other DNA
cactgtaaagtaggactatg

SEQ ID NO: 30819 - DNA, 20 bp, synthetic construct
  misc_feature 1..20: note = CRISPR gRNA sequence
  source 1..20: mol_type = other DNA
taaagtaggactatgctccc

SEQ ID NO: 30820 - DNA, 20 bp, synthetic construct
  misc_feature 1..20: note = CRISPR gRNA sequence
  source 1..20: mol_type = other DNA
tgctccccaatccctcccca

SEQ ID NO: 30821 - DNA, 20 bp, synthetic construct
  misc_feature 1..20: note = CRISPR gRNA sequence
  source 1..20: mol_type = other DNA
cccaatccctccccagctga

SEQ ID NO: 30822 - DNA, 20 bp, synthetic construct
  misc_feature 1..20: note = CRISPR gRNA sequence
  source 1..20: mol_type = other DNA
cccagctgaattgctgagag

SEQ ID NO: 30823 - DNA, 20 bp, synthetic construct
  misc_feature 1..20: note = CRISPR gRNA sequence
  source 1..20: mol_type = other DNA
aattgctgagagcagcaaat

SEQ ID NO: 30824 - DNA, 20 bp, synthetic construct
  misc_feature 1..20: note = CRISPR gRNA sequence
  source 1..20: mol_type = other DNA
ctgagagcagcaaatgaggt

SEQ ID NO: 30825 - DNA, 20 bp, synthetic construct
  misc_feature 1..20: note = CRISPR gRNA sequence
  source 1..20: mol_type = other DNA
agagcagcaaatgaggttgt

SEQ ID NO: 30826 - DNA, 20 bp, synthetic construct
  misc_feature 1..20: note = CRISPR gRNA sequence
  source 1..20: mol_type = other DNA
tgaggaaaggagtttcaaag

SEQ ID NO: 30827 - DNA, 20 bp, synthetic construct
  misc_feature 1..20: note = CRISPR gRNA sequence
  source 1..20: mol_type = other DNA
caaaggtcacgaaaggatct

SEQ ID NO: 30828 - DNA, 20 bp, synthetic construct
  misc_feature 1..20: note = CRISPR gRNA sequence
  source 1..20: mol_type = other DNA
aaaggtcacgaaaggatcta

SEQ ID NO: 30829 - DNA, 20 bp, synthetic construct
  misc_feature 1..20: note = CRISPR gRNA sequence
  source 1..20: mol_type = other DNA
caactttttttgtcactggg

SEQ ID NO: 30830 - DNA, 20 bp, synthetic construct
  misc_feature 1..20: note = CRISPR gRNA sequence
  source 1..20: mol_type = other DNA
tttttgtcactggggattcc

SEQ ID NO: 30831 - DNA, 20 bp, synthetic construct
  misc_feature 1..20: note = CRISPR gRNA sequence
  source 1..20: mol_type = other DNA
ttttgtcactggggattccc

SEQ ID NO: 30832 - DNA, 20 bp, synthetic construct
  misc_feature 1..20: note = CRISPR gRNA sequence
  source 1..20: mol_type = other DNA
tttgtcactggggattccca

SEQ ID NO: 30833 - DNA, 20 bp, synthetic construct
  misc_feature 1..20: note = CRISPR gRNA sequence
  source 1..20: mol_type = other DNA
ttgtcactggggattcccat

SEQ ID NO: 30834 - DNA, 20 bp, synthetic construct
  misc_feature 1..20: note = CRISPR gRNA sequence
  source 1..20: mol_type = other DNA
tgtcactggggattcccatc

SEQ ID NO: 30835 - DNA, 20 bp, synthetic construct
  misc_feature 1..20: note = CRISPR gRNA sequence
  source 1..20: mol_type = other DNA
gtcactggggattcccatct

SEQ ID NO: 30836 - DNA, 20 bp, synthetic construct
  misc_feature 1..20: note = CRISPR gRNA sequence
  source 1..20: mol_type = other DNA
tcactggggattcccatctg

SEQ ID NO: 30837 - DNA, 20 bp, synthetic construct
  misc_feature 1..20: note = CRISPR gRNA sequence
  source 1..20: mol_type = other DNA
gggattcccatctgatgtgg

SEQ ID NO: 30838 - DNA, 20 bp, synthetic construct
  misc_feature 1..20: note = CRISPR gRNA sequence
  source 1..20: mol_type = other DNA
ccatctgatgtggcgtcatc

SEQ ID NO: 30839 - DNA, 20 bp, synthetic construct
  misc_feature 1..20: note = CRISPR gRNA sequence
  source 1..20: mol_type = other DNA
atgtggcgtcatctcatcac

SEQ ID NO: 30840 - DNA, 20 bp, synthetic construct
  misc_feature 1..20: note = CRISPR gRNA sequence
  source 1..20: mol_type = other DNA
atcactcatgtgccagccac

SEQ ID NO: 30841 - DNA, 20 bp, synthetic construct
  misc_feature 1..20: note = CRISPR gRNA sequence
  source 1..20: mol_type = other DNA
atgtgccagccacattgagg

SEQ ID NO: 30842 - DNA, 20 bp, synthetic construct
  misc_feature 1..20: note = CRISPR gRNA sequence
  source 1..20: mol_type = other DNA
aggatgcagtaggcggaaga

SEQ ID NO: 30843 - DNA, 20 bp, synthetic construct
  misc_feature 1..20: note = CRISPR gRNA sequence
  source 1..20: mol_type = other DNA
ttctttctgcaggtgccttg

SEQ ID NO: 30844 - DNA, 20 bp, synthetic construct
  misc_feature 1..20: note = CRISPR gRNA sequence
  source 1..20: mol_type = other DNA
tctttctgcaggtgccttgg

SEQ ID NO: 30845 - DNA, 20 bp, synthetic construct
  misc_feature 1..20: note = CRISPR gRNA sequence
  source 1..20: mol_type = other DNA
ctttctgcaggtgccttggg

SEQ ID NO: 30846 - DNA, 20 bp, synthetic construct
  misc_feature 1..20: note = CRISPR gRNA sequence
  source 1..20: mol_type = other DNA
tttctgcaggtgccttgggg

SEQ ID NO: 30847 - DNA, 20 bp, synthetic construct
  misc_feature 1..20: note = CRISPR gRNA sequence
  source 1..20: mol_type = other DNA
tctgcaggtgccttgggggc

SEQ ID NO: 30848 - DNA, 20 bp, synthetic construct
  misc_feature 1..20: note = CRISPR gRNA sequence
  source 1..20: mol_type = other DNA
ctgcaggtgccttgggggca

SEQ ID NO: 30849 - DNA, 20 bp, synthetic construct
  misc_feature 1..20: note = CRISPR gRNA sequence
  source 1..20: mol_type = other DNA
tgcaggtgccttgggggcag

SEQ ID NO: 30850 - DNA, 20 bp, synthetic construct
  misc_feature 1..20: note = CRISPR gRNA sequence
  source 1..20: mol_type = other DNA
caggtgccttgggggcagga

SEQ ID NO: 30851 - DNA, 20 bp, synthetic construct
  misc_feature 1..20: note = CRISPR gRNA sequence
  source 1..20: mol_type = other DNA
gggggcaggatttggggttg

SEQ ID NO: 30852 - DNA, 20 bp, synthetic construct
  misc_feature 1..20: note = CRISPR gRNA sequence
  source 1..20: mol_type = other DNA
ggggcaggatttggggttgt

SEQ ID NO: 30853 - DNA, 20 bp, synthetic construct
  misc_feature 1..20: note = CRISPR gRNA sequence
  source 1..20: mol_type = other DNA
ggggttgtcaaaacccagag

SEQ ID NO: 30854 - DNA, 20 bp, synthetic construct
  misc_feature 1..20: note = CRISPR gRNA sequence
  source 1..20: mol_type = other DNA
gggttgtcaaaacccagagg

SEQ ID NO: 30855 - DNA, 20 bp, synthetic construct
  misc_feature 1..20: note = CRISPR gRNA sequence
  source 1..20: mol_type = other DNA
tcaaaacccagaggttgctg

SEQ ID NO: 30856 - DNA, 20 bp, synthetic construct
  misc_feature 1..20: note = CRISPR gRNA sequence
  source 1..20: mol_type = other DNA
ctgggcactgtagcatgcac

SEQ ID NO: 30857 - DNA, 20 bp, synthetic construct
  misc_feature 1..20: note = CRISPR gRNA sequence
  source 1..20: mol_type = other DNA
ggcactgtagcatgcacctg

SEQ ID NO: 30858 - DNA, 20 bp, synthetic construct
  misc_feature 1..20: note = CRISPR gRNA sequence
  source 1..20: mol_type = other DNA
tagcatgcacctgtggtccc

SEQ ID NO: 30859 - DNA, 20 bp, synthetic construct
  misc_feature 1..20: note = CRISPR gRNA sequence
  source 1..20: mol_type = other DNA
tggtcccagctactcaggag

SEQ ID NO: 30860 - DNA, 20 bp, synthetic construct
  misc_feature 1..20: note = CRISPR gRNA sequence
  source 1..20: mol_type = other DNA
ctcaggaggctgaggcagga

SEQ ID NO: 30861 - DNA, 20 bp, synthetic construct
  misc_feature 1..20: note = CRISPR gRNA sequence
  source 1..20: mol_type = other DNA
aggaggctgaggcaggagga

SEQ ID NO: 30862 - DNA, 20 bp, synthetic construct
  misc_feature 1..20: note = CRISPR gRNA sequence
  source 1..20: mol_type = other DNA
aggcaggaggactacttgag

SEQ ID NO: 30863 - DNA, 20 bp, synthetic construct
  misc_feature 1..20: note = CRISPR gRNA sequence
  source 1..20: mol_type = other DNA
cttgaggccaggaattcgag

SEQ ID NO: 30864 - DNA, 20 bp, synthetic construct
  misc_feature 1..20: note = CRISPR gRNA sequence
  source 1..20: mol_type = other DNA
gaggccaggaattcgaggct

SEQ ID NO: 30865 - DNA, 20 bp, synthetic construct
  misc_feature 1..20: note = CRISPR gRNA sequence
  source 1..20: mol_type = other DNA
aggccaggaattcgaggctg

SEQ ID NO: 30866 - DNA, 20 bp, synthetic construct
  misc_feature 1..20: note = CRISPR gRNA sequence
  source 1..20: mol_type = other DNA
gaggctgcagtgagctatga

SEQ ID NO: 30867 - DNA, 20 bp, synthetic construct
  misc_feature 1..20: note = CRISPR gRNA sequence
  source 1..20: mol_type = other DNA
cagtgagctatgatcacagc

SEQ ID NO: 30868 - DNA, 20 bp, synthetic construct
  misc_feature 1..20: note = CRISPR gRNA sequence
  source 1..20: mol_type = other DNA
tgatcacagcactgcaccca

SEQ ID NO: 30869 - DNA, 20 bp, synthetic construct
  misc_feature 1..20: note = CRISPR gRNA sequence
  source 1..20: mol_type = other DNA
cacccagatgttgagaggaa

SEQ ID NO: 30870 - DNA, 20 bp, synthetic construct
  misc_feature 1..20: note = CRISPR gRNA sequence
  source 1..20: mol_type = other DNA
agaggaaggggtcccagagt

SEQ ID NO: 30871 - DNA, 20 bp, synthetic construct
  misc_feature 1..20: note = CRISPR gRNA sequence
  source 1..20: mol_type = other DNA
tactcactccagatgctgca

SEQ ID NO: 30872 - DNA, 20 bp, synthetic construct
  misc_feature 1..20: note = CRISPR gRNA sequence
  source 1..20: mol_type = other DNA
actccagatgctgcagggag

SEQ ID NO: 30873 - DNA, 20 bp, synthetic construct
  misc_feature 1..20: note = CRISPR gRNA sequence
  source 1..20: mol_type = other DNA
cagatgctgcagggaggaaa

SEQ ID NO: 30874 - DNA, 20 bp, synthetic construct
  misc_feature 1..20: note = CRISPR gRNA sequence
  source 1..20: mol_type = other DNA
cagggaggaaaaggccgtga

SEQ ID NO: 30875 - DNA, 20 bp, synthetic construct
  misc_feature 1..20: note = CRISPR gRNA sequence
  source 1..20: mol_type = other DNA
ggggaaagcctgggggcctg

SEQ ID NO: 30876 - DNA, 20 bp, synthetic construct
  misc_feature 1..20: note = CRISPR gRNA sequence
  source 1..20: mol_type = other DNA
gggaaagcctgggggcctga

SEQ ID NO: 30877 - DNA, 20 bp, synthetic construct
  misc_feature 1..20: note = CRISPR gRNA sequence
  source 1..20: mol_type = other DNA
ggggcctgagacagggccca

SEQ ID NO: 30878 - DNA, 20 bp, synthetic construct
  misc_feature 1..20: note = CRISPR gRNA sequence
  source 1..20: mol_type = other DNA
agacagggcccagcctagga

SEQ ID NO: 30879 - DNA, 20 bp, synthetic construct
  misc_feature 1..20: note = CRISPR gRNA sequence
  source 1..20: mol_type = other DNA
ggaggcaaagagcaagggta

SEQ ID NO: 30880 - DNA, 20 bp, synthetic construct
  misc_feature 1..20: note = CRISPR gRNA sequence
  source 1..20: mol_type = other DNA
cagtcacagtcacagcccct

SEQ ID NO: 30881 - DNA, 20 bp, synthetic construct
  misc_feature 1..20: note = CRISPR gRNA sequence
  source 1..20: mol_type = other DNA
attcagccccagggtggggc

SEQ ID NO: 30882 - DNA, 20 bp, synthetic construct
  misc_feature 1..20: note = CRISPR gRNA sequence
  source 1..20: mol_type = other DNA
agccccagggtggggcagag

SEQ ID NO: 30883 - DNA, 20 bp, synthetic construct
  misc_feature 1..20: note = CRISPR gRNA sequence
  source 1..20: mol_type = other DNA
tctgaggcccctcctcttcc

SEQ ID NO: 30884 - DNA, 20 bp, synthetic construct
  misc_feature 1..20: note = CRISPR gRNA sequence
  source 1..20: mol_type = other DNA
aggcccctcctcttcccttc

SEQ ID NO: 30885 - DNA, 20 bp, synthetic construct
  misc_feature 1..20: note = CRISPR gRNA sequence
  source 1..20: mol_type = other DNA
ctcttcccttccaccccagc

SEQ ID NO: 30886 - DNA, 20 bp, synthetic construct
  misc_feature 1..20: note = CRISPR gRNA sequence
  source 1..20: mol_type = other DNA
ttcccttccaccccagcctc

SEQ ID NO: 30887 - DNA, 20 bp, synthetic construct
  misc_feature 1..20: note = CRISPR gRNA sequence
  source 1..20: mol_type = other DNA
cccttccaccccagcctctt

SEQ ID NO: 30888 - DNA, 20 bp, synthetic construct
  misc_feature 1..20: note = CRISPR gRNA sequence
  source 1..20: mol_type = other DNA
ccttccaccccagcctctta

SEQ ID NO: 30889 - DNA, 20 bp, synthetic construct
  misc_feature 1..20: note = CRISPR gRNA sequence
  source 1..20: mol_type = other DNA
ccaccccagcctcttaggtc

SEQ ID NO: 30890 - DNA, 20 bp, synthetic construct
  misc_feature 1..20: note = CRISPR gRNA sequence
  source 1..20: mol_type = other DNA
caccccagcctcttaggtcc

SEQ ID NO: 30891 - DNA, 20 bp, synthetic construct
  misc_feature 1..20: note = CRISPR gRNA sequence
  source 1..20: mol_type = other DNA
ttaggtccctgcaacccttc

SEQ ID NO: 30892 - DNA, 20 bp, synthetic construct
  misc_feature 1..20: note = CRISPR gRNA sequence
  source 1..20: mol_type = other DNA
aggtccctgcaacccttcca

SEQ ID NO: 30893 - DNA, 20 bp, synthetic construct
  misc_feature 1..20: note = CRISPR gRNA sequence
  source 1..20: mol_type = other DNA
ggtccctgcaacccttccac

SEQ ID NO: 30894 - DNA, 20 bp, synthetic construct
  misc_feature 1..20: note = CRISPR gRNA sequence
  source 1..20: mol_type = other DNA
caacccttccacgtaggacc

SEQ ID NO: 30895 - DNA, 20 bp, synthetic construct
  misc_feature 1..20: note = CRISPR gRNA sequence
  source 1..20: mol_type = other DNA
ccacgtaggaccccaatctt

SEQ ID NO: 30896 - DNA, 20 bp, synthetic construct
  misc_feature 1..20: note = CRISPR gRNA sequence
  source 1..20: mol_type = other DNA
cacgtaggaccccaatcttt

SEQ ID NO: 30897 - DNA, 20 bp, synthetic construct
  misc_feature 1..20: note = CRISPR gRNA sequence
  source 1..20: mol_type = other DNA
ttctgcttggggtagatttc

SEQ ID NO: 30898 - DNA, 20 bp, synthetic construct
  misc_feature 1..20: note = CRISPR gRNA sequence
  source 1..20: mol_type = other DNA
tctgcttggggtagatttca

SEQ ID NO: 30899 - DNA, 20 bp, synthetic construct
  misc_feature 1..20: note = CRISPR gRNA sequence
  source 1..20: mol_type = other DNA
ctgcttggggtagatttcat

SEQ ID NO: 30900 - DNA, 20 bp, synthetic construct
  misc_feature 1..20: note = CRISPR gRNA sequence
  source 1..20: mol_type = other DNA
tgcttggggtagatttcata

SEQ ID NO: 30901 - DNA, 20 bp, synthetic construct
  misc_feature 1..20: note = CRISPR gRNA sequence
  source 1..20: mol_type = other DNA
cttggggtagatttcatagc

SEQ ID NO: 30902 - DNA, 20 bp, synthetic construct
  misc_feature 1..20: note = CRISPR gRNA sequence
  source 1..20: mol_type = other DNA
ggggtagatttcatagcccc

SEQ ID NO: 30903 - DNA, 20 bp, synthetic construct
  misc_feature 1..20: note = CRISPR gRNA sequence
  source 1..20: mol_type = other DNA
gggtagatttcatagccccc

SEQ ID NO: 30904 - DNA, 20 bp, synthetic construct
  misc_feature 1..20: note = CRISPR gRNA sequence
  source 1..20: mol_type = other DNA
catagccccccataagaggc

SEQ ID NO: 30905 - DNA, 20 bp, synthetic construct
  misc_feature 1..20: note = CRISPR gRNA sequence
  source 1..20: mol_type = other DNA
atagccccccataagaggcc

SEQ ID NO: 30906 - DNA, 20 bp, synthetic construct
  misc_feature 1..20: note = CRISPR gRNA sequence
  source 1..20: mol_type = other DNA
aggctgggaacagtggctca

SEQ ID NO: 30907 - DNA, 20 bp, synthetic construct
  misc_feature 1..20: note = CRISPR gRNA sequence
  source 1..20: mol_type = other DNA
ggaacagtggctcatgtctg

SEQ ID NO: 30908 - DNA, 20 bp, synthetic construct
  misc_feature 1..20: note = CRISPR gRNA sequence
  source 1..20: mol_type = other DNA
atgtctgtaattccagcatt

SEQ ID NO: 30909 - DNA, 20 bp, synthetic construct
  misc_feature 1..20: note = CRISPR gRNA sequence
  source 1..20: mol_type = other DNA
taattccagcattttgggag

SEQ ID NO: 30910 - DNA, 20 bp, synthetic construct
  misc_feature 1..20: note = CRISPR gRNA sequence
  source 1..20: mol_type = other DNA
cagcattttgggaggccaag

SEQ ID NO: 30911 - DNA, 20 bp, synthetic construct
  misc_feature 1..20: note = CRISPR gRNA sequence
  source 1..20: mol_type = other DNA
tgggaggccaaggtaagagg

SEQ ID NO: 30912 - DNA, 20 bp, synthetic construct
  misc_feature 1..20: note = CRISPR gRNA sequence
  source 1..20: mol_type = other DNA
gggaggccaaggtaagagga

SEQ ID NO: 30913 - DNA, 20 bp, synthetic construct
  misc_feature 1..20: note = CRISPR gRNA sequence
  source 1..20: mol_type = other DNA
ggaggccaaggtaagaggac

SEQ ID NO: 30914 - DNA, 20 bp, synthetic construct
  misc_feature 1..20: note = CRISPR gRNA sequence
  source 1..20: mol_type = other DNA
cttgagcccaggagttcaag

SEQ ID NO: 30915 - DNA, 20 bp, synthetic construct
  misc_feature 1..20: note = CRISPR gRNA sequence
  source 1..20: mol_type = other DNA
gagcccaggagttcaagacc

SEQ ID NO: 30916 - DNA, 20 bp, synthetic construct
  misc_feature 1..20: note = CRISPR gRNA sequence
  source 1..20: mol_type = other DNA
agcccaggagttcaagacca

SEQ ID NO: 30917 - DNA, 20 bp, synthetic construct
  misc_feature 1..20: note = CRISPR gRNA sequence
  source 1..20: mol_type = other DNA
aagaccagcttgggcaacat

SEQ ID NO: 30918 - DNA, 20 bp, synthetic construct
  misc_feature 1..20: note = CRISPR gRNA sequence
  source 1..20: mol_type = other DNA
gggcaacatagtgagactca

SEQ ID NO: 30919 - DNA, 20 bp, synthetic construct
  misc_feature 1..20: note = CRISPR gRNA sequence
  source 1..20: mol_type = other DNA
ggcaacatagtgagactcag

SEQ ID NO: 30920 - DNA, 20 bp, synthetic construct
  misc_feature 1..20: note = CRISPR gRNA sequence
  source 1..20: mol_type = other DNA
agtctctacaaaaaacacaa

SEQ ID NO: 30921 - DNA, 20 bp, synthetic construct
  misc_feature 1..20: note = CRISPR gRNA sequence
  source 1..20: mol_type = other DNA
tacaaaaaacacaataatta

SEQ ID NO: 30922 - DNA, 20 bp, synthetic construct
  misc_feature 1..20: note = CRISPR gRNA sequence
  source 1..20: mol_type = other DNA
caaaaaacacaataattagc

SEQ ID NO: 30923 - DNA, 20 bp, synthetic construct
  misc_feature 1..20: note = CRISPR gRNA sequence
  source 1..20: mol_type = other DNA
gccaagtgtggtggtgtgtc

SEQ ID NO: 30924 - DNA, 20 bp, synthetic construct
  misc_feature 1..20: note = CRISPR gRNA sequence
  source 1..20: mol_type = other DNA
tggtctcagcttcttaggag

SEQ ID NO: 30925 - DNA, 20 bp, synthetic construct
  misc_feature 1..20: note = CRISPR gRNA sequence
  source 1..20: mol_type = other DNA
agcttcttaggaggctgagg

SEQ ID NO: 30926 - DNA, 20 bp, synthetic construct
  misc_feature 1..20: note = CRISPR gRNA sequence
  source 1..20: mol_type = other DNA
cttaggaggctgaggtggaa

SEQ ID NO: 30927 - DNA, 20 bp, synthetic construct
  misc_feature 1..20: note = CRISPR gRNA sequence
  source 1..20: mol_type = other DNA
ttaggaggctgaggtggaag

SEQ ID NO: 30928 - DNA, 20 bp, synthetic construct
  misc_feature 1..20: note = CRISPR gRNA sequence
  source 1..20: mol_type = other DNA
aggaggctgaggtggaagca

SEQ ID NO: 30929 - DNA, 20 bp, synthetic construct
  misc_feature 1..20: note = CRISPR gRNA sequence
  source 1..20: mol_type = other DNA
ggaggctgaggtggaagcat

SEQ ID NO: 30930 - DNA, 20 bp, synthetic construct
  misc_feature 1..20: note = CRISPR gRNA sequence
  source 1..20: mol_type = other DNA
aggtggaagcatcgcttgag

SEQ ID NO: 30931 - DNA, 20 bp, synthetic construct
  misc_feature 1..20: note = CRISPR gRNA sequence
  source 1..20: mol_type = other DNA
gagcccaggaggtggaggat

SEQ ID NO: 30932 - DNA, 20 bp, synthetic construct
  misc_feature 1..20: note = CRISPR gRNA sequence
  source 1..20: mol_type = other DNA
agcccaggaggtggaggatg

SEQ ID NO: 30933 - DNA, 20 bp, synthetic construct
  misc_feature 1..20: note = CRISPR gRNA sequence
  source 1..20: mol_type = other DNA
cactccagcctgggtaagag

SEQ ID NO: 30934 - DNA, 20 bp, synthetic construct
  misc_feature 1..20: note = CRISPR gRNA sequence
  source 1..20: mol_type = other DNA
cagcctgggtaagagcgaga

SEQ ID NO: 30935 - DNA, 20 bp, synthetic construct
  misc_feature 1..20: note = CRISPR gRNA sequence
  source 1..20: mol_type = other DNA
ggtaagagcgagaccctgtc

SEQ ID NO: 30936 - DNA, 20 bp, synthetic construct
  misc_feature 1..20: note = CRISPR gRNA sequence
  source 1..20: mol_type = other DNA
tctcaaaaaagaaaaaaaac

SEQ ID NO: 30937 - DNA, 20 bp, synthetic construct
  misc_feature 1..20: note = CRISPR gRNA sequence
  source 1..20: mol_type = other DNA
aaaaaagaaaaaaaacaaaa

SEQ ID NO: 30938 - DNA, 20 bp, synthetic construct
  misc_feature 1..20: note = CRISPR gRNA sequence
  source 1..20: mol_type = other DNA
ggctcccatcttggggctcc

SEQ ID NO: 30939 - DNA, 20 bp, synthetic construct
  misc_feature 1..20: note = CRISPR gRNA sequence
  source 1..20: mol_type = other DNA
ccatcttggggctccccagc

SEQ ID NO: 30940 - DNA, 20 bp, synthetic construct
  misc_feature 1..20: note = CRISPR gRNA sequence
  source 1..20: mol_type = other DNA
ggggctccccagcttttgtc

SEQ ID NO: 30941 - DNA, 20 bp, synthetic construct
  misc_feature 1..20: note = CRISPR gRNA sequence
  source 1..20: mol_type = other DNA
gggctccccagcttttgtct

SEQ ID NO: 30942 - DNA, 20 bp, synthetic construct
  misc_feature 1..20: note = CRISPR gRNA sequence
  source 1..20: mol_type = other DNA
cccagcttttgtctctaagt

SEQ ID NO: 30943 - DNA, 20 bp, synthetic construct
  misc_feature 1..20: note = CRISPR gRNA sequence
  source 1..20: mol_type = other DNA
ttgtctctaagtagggagcc

SEQ ID NO: 30944 - DNA, 20 bp, synthetic construct
  misc_feature 1..20: note = CRISPR gRNA sequence
  source 1..20: mol_type = other DNA
tgtctctaagtagggagcca

SEQ ID NO: 30945 - DNA, 20 bp, synthetic construct
  misc_feature 1..20: note = CRISPR gRNA sequence
  source 1..20: mol_type = other DNA
gtctctaagtagggagccag

SEQ ID NO: 30946 - DNA, 20 bp, synthetic construct
  misc_feature 1..20: note = CRISPR gRNA sequence
  source 1..20: mol_type = other DNA
tctctaagtagggagccagt

SEQ ID NO: 30947 - DNA, 20 bp, synthetic construct
  misc_feature 1..20: note = CRISPR gRNA sequence
  source 1..20: mol_type = other DNA
taagtagggagccagttctt

SEQ ID NO: 30948 - DNA, 20 bp, synthetic construct
  misc_feature 1..20: note = CRISPR gRNA sequence
  source 1..20: mol_type = other DNA
agtagggagccagttcttac

SEQ ID NO: 30949 - DNA, 20 bp, synthetic construct
  misc_feature 1..20: note = CRISPR gRNA sequence
  source 1..20: mol_type = other DNA
ttactcttcccaacatccac

SEQ ID NO: 30950 - DNA, 20 bp, synthetic construct
  misc_feature 1..20: note = CRISPR gRNA sequence
  source 1..20: mol_type = other DNA
actcttcccaacatccacag

SEQ ID NO: 30951 - DNA, 20 bp, synthetic construct
  misc_feature 1..20: note = CRISPR gRNA sequence
  source 1..20: mol_type = other DNA
ctcttcccaacatccacaga

SEQ ID NO: 30952 - DNA, 20 bp, synthetic construct
  misc_feature 1..20: note = CRISPR gRNA sequence
  source 1..20: mol_type = other DNA
ttcccaacatccacagatac

SEQ ID NO: 30953 - DNA, 20 bp, synthetic construct
  misc_feature 1..20: note = CRISPR gRNA sequence
  source 1..20: mol_type = other DNA
cccaacatccacagataccc

SEQ ID NO: 30954 - DNA, 20 bp, synthetic construct
  misc_feature 1..20: note = CRISPR gRNA sequence
  source 1..20: mol_type = other DNA
ccaacatccacagataccct

SEQ ID NO: 30955 - DNA, 20 bp, synthetic construct
  misc_feature 1..20: note = CRISPR gRNA sequence
  source 1..20: mol_type = other DNA
ctcccgccgcagcctgggga

SEQ ID NO: 30956 - DNA, 20 bp, synthetic construct
  misc_feature 1..20: note = CRISPR gRNA sequence
  source 1..20: mol_type = other DNA
tcccgccgcagcctggggaa

SEQ ID NO: 30957 - DNA, 20 bp, synthetic construct
  misc_feature 1..20: note = CRISPR gRNA sequence
  source 1..20: mol_type = other DNA
ccgccgcagcctggggaagg

SEQ ID NO: 30958 - DNA, 20 bp, synthetic construct
  misc_feature 1..20: note = CRISPR gRNA sequence
  source 1..20: mol_type = other DNA
gggaaggggtcctgaaatgc

SEQ ID NO: 30959 - DNA, 20 bp, synthetic construct
  misc_feature 1..20: note = CRISPR gRNA sequence
  source 1..20: mol_type = other DNA
aaatgccagctgacgaccac

SEQ ID NO: 30960 - DNA, 20 bp, synthetic construct
  misc_feature 1..20: note = CRISPR gRNA sequence
  source 1..20: mol_type = other DNA
acgaccactgccagtggtaa

SEQ ID NO: 30961 - DNA, 20 bp, synthetic construct
  misc_feature 1..20: note = CRISPR gRNA sequence
  source 1..20: mol_type = other DNA
ccagtggtaaaccaggtggt

SEQ ID NO: 30962 - DNA, 20 bp, synthetic construct
  misc_feature 1..20: note = CRISPR gRNA sequence
  source 1..20: mol_type = other DNA
actaatatgcctttgcattt

SEQ ID NO: 30963 - DNA, 20 bp, synthetic construct
  misc_feature 1..20: note = CRISPR gRNA sequence
  source 1..20: mol_type = other DNA
atatgcctttgcattttaat

SEQ ID NO: 30964 - DNA, 20 bp, synthetic construct
  misc_feature 1..20: note = CRISPR gRNA sequence
  source 1..20: mol_type = other DNA
tgcattttaataacaaaagg

SEQ ID NO: 30965 - DNA, 20 bp, synthetic construct
  misc_feature 1..20: note = CRISPR gRNA sequence
  source 1..20: mol_type = other DNA
gcattttaataacaaaagga

SEQ ID NO: 30966 - DNA, 20 bp, synthetic construct
  misc_feature 1..20: note = CRISPR gRNA sequence
  source 1..20: mol_type = other DNA
cattttaataacaaaaggaa

SEQ ID NO: 30967 - DNA, 20 bp, synthetic construct
  misc_feature 1..20: note = CRISPR gRNA sequence
  source 1..20: mol_type = other DNA
taataacaaaaggaaccatt

SEQ ID NO: 30968 - DNA, 20 bp, synthetic construct
  misc_feature 1..20: note = CRISPR gRNA sequence
  source 1..20: mol_type = other DNA
aataacaaaaggaaccattt

SEQ ID NO: 30969 - DNA, 20 bp, synthetic construct
  misc_feature 1..20: note = CRISPR gRNA sequence
  source 1..20: mol_type = other DNA
ataacaaaaggaaccatttg

SEQ ID NO: 30970 - DNA, 20 bp, synthetic construct
  misc_feature 1..20: note = CRISPR gRNA sequence
  source 1..20: mol_type = other DNA
gttgagcatttattataagc

SEQ ID NO: 30971 - DNA, 20 bp, synthetic construct
  misc_feature 1..20: note = CRISPR gRNA sequence
  source 1..20: mol_type = other DNA
ttgagcatttattataagcc

SEQ ID NO: 30972 - DNA, 20 bp, synthetic construct
  misc_feature 1..20: note = CRISPR gRNA sequence
  source 1..20: mol_type = other DNA
agcatttattataagccagg

SEQ ID NO: 30973 - DNA, 20 bp, synthetic construct
  misc_feature 1..20: note = CRISPR gRNA sequence
  source 1..20: mol_type = other DNA
attataagccaggggcatgc

SEQ ID NO: 30974 - DNA, 20 bp, synthetic construct
  misc_feature 1..20: note = CRISPR gRNA sequence
  source 1..20: mol_type = other DNA
ttataagccaggggcatgct

SEQ ID NO: 30975 - DNA, 20 bp, synthetic construct
  misc_feature 1..20: note = CRISPR gRNA sequence
  source 1..20: mol_type = other DNA
taagccaggggcatgctagg

SEQ ID NO: 30976 - DNA, 20 bp, synthetic construct
  misc_feature 1..20: note = CRISPR gRNA sequence
  source 1..20: mol_type = other DNA
ggcccttccctcggcctaga

SEQ ID NO: 30977 - DNA, 20 bp, synthetic construct
  misc_feature 1..20: note = CRISPR gRNA sequence
  source 1..20: mol_type = other DNA
ccctcggcctagatctcatt

SEQ ID NO: 30978 - DNA, 20 bp, synthetic construct
  misc_feature 1..20: note = CRISPR gRNA sequence
  source 1..20: mol_type = other DNA
cctcggcctagatctcattt

SEQ ID NO: 30979 - DNA, 20 bp, synthetic construct
  misc_feature 1..20: note = CRISPR gRNA sequence
  source 1..20: mol_type = other DNA
ggcctagatctcatttactc

SEQ ID NO: 30980 - DNA, 20 bp, synthetic construct
  misc_feature 1..20: note = CRISPR gRNA sequence
  source 1..20: mol_type = other DNA
gatctcatttactcctcaag

SEQ ID NO: 30981 - DNA, 20 bp, synthetic construct
  misc_feature 1..20: note = CRISPR gRNA sequence
  source 1..20: mol_type = other DNA
atttactcctcaagactctg

SEQ ID NO: 30982 - DNA, 20 bp, synthetic construct
  misc_feature 1..20: note = CRISPR gRNA sequence
  source 1..20: mol_type = other DNA
actcctcaagactctgagct

SEQ ID NO: 30983 - DNA, 20 bp, synthetic construct
  misc_feature 1..20: note = CRISPR gRNA sequence
  source 1..20: mol_type = other DNA
ctcctcaagactctgagcta

SEQ ID NO: 30984 - DNA, 20 bp, synthetic construct
  misc_feature 1..20: note = CRISPR gRNA sequence
  source 1..20: mol_type = other DNA
ctcaagactctgagctatgg

SEQ ID NO: 30985 - DNA, 20 bp, synthetic construct
  misc_feature 1..20: note = CRISPR gRNA sequence
  source 1..20: mol_type = other DNA
aagactctgagctatgggct

SEQ ID NO: 30986 - DNA, 20 bp, synthetic construct
  misc_feature 1..20: note = CRISPR gRNA sequence
  source 1..20: mol_type = other DNA
tgagctatgggctcttatct

SEQ ID NO: 30987 - DNA, 20 bp, synthetic construct
  misc_feature 1..20: note = CRISPR gRNA sequence
  source 1..20: mol_type = other DNA
agctatgggctcttatctcc

SEQ ID NO: 30988 - DNA, 20 bp, synthetic construct
  misc_feature 1..20: note = CRISPR gRNA sequence
  source 1..20: mol_type = other DNA
tgggctcttatctccatttt

SEQ ID NO: 30989 - DNA, 20 bp, synthetic construct
  misc_feature 1..20: note = CRISPR gRNA sequence
  source 1..20: mol_type = other DNA
ttatctccattttacatata

SEQ ID NO: 30990 - DNA, 20 bp, synthetic construct
  misc_feature 1..20: note = CRISPR gRNA sequence
  source 1..20: mol_type = other DNA
atctccattttacatatagg

SEQ ID NO: 30991 - DNA, 20 bp, synthetic construct
  misc_feature 1..20: note = CRISPR gRNA sequence
  source 1..20: mol_type = other DNA
tctccattttacatataggg

SEQ ID NO: 30992 - DNA, 20 bp, synthetic construct
  misc_feature 1..20: note = CRISPR gRNA sequence
  source 1..20: mol_type = other DNA
cattttacatatagggaaac

SEQ ID NO: 30993 - DNA, 20 bp, synthetic construct
  misc_feature 1..20: note = CRISPR gRNA sequence
  source 1..20: mol_type = other DNA
tacatatagggaaactgagg

SEQ ID NO: 30994 - DNA, 20 bp, synthetic construct
  misc_feature 1..20: note = CRISPR gRNA sequence
  source 1..20: mol_type = other DNA
acatatagggaaactgaggc

SEQ ID NO: 30995 - DNA, 20 bp, synthetic construct
  misc_feature 1..20: note = CRISPR gRNA sequence
  source 1..20: mol_type = other DNA
catatagggaaactgaggca

SEQ ID NO: 30996 - DNA, 20 bp, synthetic construct
  misc_feature 1..20: note = CRISPR gRNA sequence
  source 1..20: mol_type = other DNA
aggcactaggcgatcaaata

SEQ ID NO: 30997 - DNA, 20 bp, synthetic construct
  misc_feature 1..20: note = CRISPR gRNA sequence
  source 1..20: mol_type = other DNA
ggcgatcaaatagctcacac

SEQ ID NO: 30998 - DNA, 20 bp, synthetic construct
  misc_feature 1..20: note = CRISPR gRNA sequence
  source 1..20: mol_type = other DNA
acacagggtcacacagcctg

SEQ ID NO: 30999 - DNA, 20 bp, synthetic construct
  misc_feature 1..20: note = CRISPR gRNA sequence
  source 1..20: mol_type = other DNA
gatcaacatttagagcagac

SEQ ID NO: 31000 - DNA, 20 bp, synthetic construct
  misc_feature 1..20: note = CRISPR gRNA sequence
  source 1..20: mol_type = other DNA
agagcagacttcaaggggat

SEQ ID NO: 31001 - DNA, 20 bp, synthetic construct
  misc_feature 1..20: note = CRISPR gRNA sequence
  source 1..20: mol_type = other DNA
gagcagacttcaaggggatg

SEQ ID NO: 31002 - DNA, 20 bp, synthetic construct
  misc_feature 1..20: note = CRISPR gRNA sequence
  source 1..20: mol_type = other DNA
caaggggatgagaaaaataa

SEQ ID NO: 31003 - DNA, 20 bp, synthetic construct
  misc_feature 1..20: note = CRISPR gRNA sequence
  source 1..20: mol_type = other DNA
aaggggatgagaaaaataag

SEQ ID NO: 31004 - DNA, 20 bp, synthetic construct
  misc_feature 1..20: note = CRISPR gRNA sequence
  source 1..20: mol_type = other DNA
agtttaaaaatatggttaaa

SEQ ID NO: 31005 - DNA, 20 bp, synthetic construct
  misc_feature 1..20: note = CRISPR gRNA sequence
  source 1..20: mol_type = other DNA
gtttaaaaatatggttaaat

SEQ ID NO: 31006 - DNA, 20 bp, synthetic construct
  misc_feature 1..20: note = CRISPR gRNA sequence
  source 1..20: mol_type = other DNA
aaaaatatggttaaatgcat

SEQ ID NO: 31007 - DNA, 20 bp, synthetic construct
  misc_feature 1..20: note = CRISPR gRNA sequence
  source 1..20: mol_type = other DNA
aaaatatggttaaatgcatt

SEQ ID NO: 31008 - DNA, 20 bp, synthetic construct
  misc_feature 1..20: note = CRISPR gRNA sequence
  source 1..20: mol_type = other DNA
aatgcattccatataaagag

SEQ ID NO: 31009 - DNA, 20 bp, synthetic construct
  misc_feature 1..20: note = CRISPR gRNA sequence
  source 1..20: mol_type = other DNA
catataaagagctgtctttt

SEQ ID NO: 31010 - DNA, 20 bp, synthetic construct
  misc_feature 1..20: note = CRISPR gRNA sequence
  source 1..20: mol_type = other DNA
tcttttattctgcaattatg

SEQ ID NO: 31011 - DNA, 20 bp, synthetic construct
  misc_feature 1..20: note = CRISPR gRNA sequence
  source 1..20: mol_type = other DNA
ttattctgcaattatgtcct

SEQ ID NO: 31012 - DNA, 20 bp, synthetic construct
  misc_feature 1..20: note = CRISPR gRNA sequence
  source 1..20: mol_type = other DNA
tattctgcaattatgtcctt

SEQ ID NO: 31013 - DNA, 20 bp, synthetic construct
  misc_feature 1..20: note = CRISPR gRNA sequence
  source 1..20: mol_type = other DNA
attctgcaattatgtccttt

SEQ ID NO: 31014 - DNA, 20 bp, synthetic construct
  misc_feature 1..20: note = CRISPR gRNA sequence
  source 1..20: mol_type = other DNA
ttctgcaattatgtcctttg

SEQ ID NO: 31015 - DNA, 20 bp, synthetic construct
  misc_feature 1..20: note = CRISPR gRNA sequence
  source 1..20: mol_type = other DNA
tgcaattatgtcctttgaac

SEQ ID NO: 31016 - DNA, 20 bp, synthetic construct
  misc_feature 1..20: note = CRISPR gRNA sequence
  source 1..20: mol_type = other DNA
caattatgtcctttgaactt

SEQ ID NO: 31017 - DNA, 20 bp, synthetic construct
  misc_feature 1..20: note = CRISPR gRNA sequence
  source 1..20: mol_type = other DNA
tgtcctttgaactttttcaa

SEQ ID NO: 31018 - DNA, 20 bp, synthetic construct
  misc_feature 1..20: note = CRISPR gRNA sequence
  source 1..20: mol_type = other DNA
tgaactttttcaatattaga

SEQ ID NO: 31019 - DNA, 20 bp, synthetic construct
  misc_feature 1..20: note = CRISPR gRNA sequence
  source 1..20: mol_type = other DNA
gaactttttcaatattagaa

SEQ ID NO: 31020 - DNA, 20 bp, synthetic construct
  misc_feature 1..20: note = CRISPR gRNA sequence
  source 1..20: mol_type = other DNA
aactttttcaatattagaat

SEQ ID NO: 31021 - DNA, 20 bp, synthetic construct
  misc_feature 1..20: note = CRISPR gRNA sequence
  source 1..20: mol_type = other DNA
tttcaatattagaatgatca

SEQ ID NO: 31022 - DNA, 20 bp, synthetic construct
  misc_feature 1..20: note = CRISPR gRNA sequence
  source 1..20: mol_type = other DNA
ttcaatattagaatgatcat

SEQ ID NO: 31023 - DNA, 20 bp, synthetic construct
  misc_feature 1..20: note = CRISPR gRNA sequence
  source 1..20: mol_type = other DNA
tcaatattagaatgatcatt

SEQ ID NO: 31024 - DNA, 20 bp, synthetic construct
  misc_feature 1..20: note = CRISPR gRNA sequence
  source 1..20: mol_type = other DNA
caatattagaatgatcattc

SEQ ID NO: 31025 - DNA, 20 bp, synthetic construct
  misc_feature 1..20: note = CRISPR gRNA sequence
  source 1..20: mol_type = other DNA
aatattagaatgatcattct

SEQ ID NO: 31026 - DNA, 20 bp, synthetic construct
  misc_feature 1..20: note = CRISPR gRNA sequence
  source 1..20: mol_type = other DNA
gaatgatcattctttggtaa

SEQ ID NO: 31027 - DNA, 20 bp, synthetic construct
  misc_feature 1..20: note = CRISPR gRNA sequence
  source 1..20: mol_type = other DNA
tttggtaaaattatggtgcc

SEQ ID NO: 31028 - DNA, 20 bp, synthetic construct
  misc_feature 1..20: note = CRISPR gRNA sequence
  source 1..20: mol_type = other DNA
tggtaaaattatggtgccag

SEQ ID NO: 31029 - DNA, 20 bp, synthetic construct
  misc_feature 1..20: note = CRISPR gRNA sequence
  source 1..20: mol_type = other DNA
ggtaaaattatggtgccagc

SEQ ID NO: 31030 - DNA, 20 bp, synthetic construct
  misc_feature 1..20: note = CRISPR gRNA sequence
  source 1..20: mol_type = other DNA
gtaaaattatggtgccagca

SEQ ID NO: 31031 - DNA, 20 bp, synthetic construct
  misc_feature 1..20: note = CRISPR gRNA sequence
  source 1..20: mol_type = other DNA
tggtgccagcagtgggtatt

SEQ ID NO: 31032 - DNA, 20 bp, synthetic construct
  misc_feature 1..20: note = CRISPR gRNA sequence
  source 1..20: mol_type = other DNA
tgttgttatttgtttgtttg

SEQ ID NO: 31033 - DNA, 20 bp, synthetic construct
  misc_feature 1..20: note = CRISPR gRNA sequence
  source 1..20: mol_type = other DNA
gttgttatttgtttgtttga

SEQ ID NO: 31034 - DNA, 20 bp, synthetic construct
  misc_feature 1..20: note = CRISPR gRNA sequence
  source 1..20: mol_type = other DNA
ttgttatttgtttgtttgaa

SEQ ID NO: 31035 - DNA, 20 bp, synthetic construct
  misc_feature 1..20: note = CRISPR gRNA sequence
  source 1..20: mol_type = other DNA
ttatttgtttgtttgaatga

SEQ ID NO: 31036 - DNA, 20 bp, synthetic construct
  misc_feature 1..20: note = CRISPR gRNA sequence
  source 1..20: mol_type = other DNA
tttgtttgtttgaatgagca

SEQ ID NO: 31037 - DNA, 20 bp, synthetic construct
  misc_feature 1..20: note = CRISPR gRNA sequence
  source 1..20: mol_type = other DNA
gtttgtttgaatgagcatcc

SEQ ID NO: 31038 - DNA, 20 bp, synthetic construct
  misc_feature 1..20: note = CRISPR gRNA sequence
  source 1..20: mol_type = other DNA
tttgtttgaatgagcatcct

SEQ ID NO: 31039 - DNA, 20 bp, synthetic construct
  misc_feature 1..20: note = CRISPR gRNA sequence
  source 1..20: mol_type = other DNA
gtttgaatgagcatccttga

SEQ ID NO: 31040 - DNA, 20 bp, synthetic construct
  misc_feature 1..20: note = CRISPR gRNA sequence
  source 1..20: mol_type = other DNA
tttgaatgagcatccttgat

SEQ ID NO: 31041 - DNA, 20 bp, synthetic construct
  misc_feature 1..20: note = CRISPR gRNA sequence
  source 1..20: mol_type = other DNA
gaatgagcatccttgataaa

SEQ ID NO: 31042 - DNA, 20 bp, synthetic construct
  misc_feature 1..20: note = CRISPR gRNA sequence
  source 1..20: mol_type = other DNA
aatgagcatccttgataaac

SEQ ID NO: 31043 - DNA, 20 bp, synthetic construct
  misc_feature 1..20: note = CRISPR gRNA sequence
  source 1..20: mol_type = other DNA
gataaacattaaaaaacagt

SEQ ID NO: 31044 - DNA, 20 bp, synthetic construct
  misc_feature 1..20: note = CRISPR gRNA sequence
  source 1..20: mol_type = other DNA
ataaacattaaaaaacagta

SEQ ID NO: 31045 - DNA, 20 bp, synthetic construct
  misc_feature 1..20: note = CRISPR gRNA sequence
  source 1..20: mol_type = other DNA
aaaaacagtaaccgcgcacg

SEQ ID NO: 31046 - DNA, 20 bp, synthetic construct
  misc_feature 1..20: note = CRISPR gRNA sequence
  source 1..20: mol_type = other DNA
gaattcattccgaaatgttc

SEQ ID NO: 31047 - DNA, 20 bp, synthetic construct
  misc_feature 1..20: note = CRISPR gRNA sequence
  source 1..20: mol_type = other DNA
attccgaaatgttctcggcc

SEQ ID NO: 31048 - DNA, 20 bp, synthetic construct
  misc_feature 1..20: note = CRISPR gRNA sequence
  source 1..20: mol_type = other DNA
cgaaatgttctcggcctctg

SEQ ID NO: 31049 - DNA, 20 bp, synthetic construct
  misc_feature 1..20: note = CRISPR gRNA sequence
  source 1..20: mol_type = other DNA
tcggcctctgaaatcctgaa

SEQ ID NO: 31050 - DNA, 20 bp, synthetic construct
  misc_feature 1..20: note = CRISPR gRNA sequence
  source 1..20: mol_type = other DNA
ggcctctgaaatcctgaagt

SEQ ID NO: 31051 - DNA, 20 bp, synthetic construct
  misc_feature 1..20: note = CRISPR gRNA sequence
  source 1..20: mol_type = other DNA
tgaaatcctgaagtctgaga

SEQ ID NO: 31052 - DNA, 20 bp, synthetic construct
  misc_feature 1..20: note = CRISPR gRNA sequence
  source 1..20: mol_type = other DNA
aaatcctgaagtctgagaac

SEQ ID NO: 31053 - DNA, 20 bp, synthetic construct
  misc_feature 1..20: note = CRISPR gRNA sequence
  source 1..20: mol_type = other DNA
aagtctgagaacactggcct

SEQ ID NO: 31054 - DNA, 20 bp, synthetic construct
  misc_feature 1..20: note = CRISPR gRNA sequence
  source 1..20: mol_type = other DNA
agaacactggcctcagcaaa

SEQ ID NO: 31055 - DNA, 20 bp, synthetic construct
  misc_feature 1..20: note = CRISPR gRNA sequence
  source 1..20: mol_type = other DNA
gcctcagcaaaaggccacag

SEQ ID NO: 31056 - DNA, 20 bp, synthetic construct
  misc_feature 1..20: note = CRISPR gRNA sequence
  source 1..20: mol_type = other DNA
agcaaaaggccacaggatca

SEQ ID NO: 31057 - DNA, 20 bp, synthetic construct
  misc_feature 1..20: note = CRISPR gRNA sequence
  source 1..20: mol_type = other DNA
gactccaggatctggcattt

SEQ ID NO: 31058 - DNA, 20 bp, synthetic construct
  misc_feature 1..20: note = CRISPR gRNA sequence
  source 1..20: mol_type = other DNA
actccaggatctggcatttg

SEQ ID NO: 31059 - DNA, 20 bp, synthetic construct
  misc_feature 1..20: note = CRISPR gRNA sequence
  source 1..20: mol_type = other DNA
caggatctggcatttggctc

SEQ ID NO: 31060 - DNA, 20 bp, synthetic construct
  misc_feature 1..20: note = CRISPR gRNA sequence
  source 1..20: mol_type = other DNA
gcatttggctccctgctaaa

SEQ ID NO: 31061 - DNA, 20 bp, synthetic construct
  misc_feature 1..20: note = CRISPR gRNA sequence
  source 1..20: mol_type = other DNA
ggctccctgctaaaggcctt

SEQ ID NO: 31062 - DNA, 20 bp, synthetic construct
  misc_feature 1..20: note = CRISPR gRNA sequence
  source 1..20: mol_type = other DNA
gctccctgctaaaggccttg

SEQ ID NO: 31063 - DNA, 20 bp, synthetic construct
  misc_feature 1..20: note = CRISPR gRNA sequence
  source 1..20: mol_type = other DNA
cctgctaaaggccttggcaa

SEQ ID NO: 31064 - DNA, 20 bp, synthetic construct
  misc_feature 1..20: note = CRISPR gRNA sequence
  source 1..20: mol_type = other DNA
ctaaaggccttggcaaatcc

SEQ ID NO: 31065 - DNA, 20 bp, synthetic construct
  misc_feature 1..20: note = CRISPR gRNA sequence
  source 1..20: mol_type = other DNA
aaggccttggcaaatccctt

SEQ ID NO: 31066 - DNA, 20 bp, synthetic construct
  misc_feature 1..20: note = CRISPR gRNA sequence
  source 1..20: mol_type = other DNA
ggcaaatcccttcaccctta

SEQ ID NO: 31067 - DNA, 20 bp, synthetic construct
  misc_feature 1..20: note = CRISPR gRNA sequence
  source 1..20: mol_type = other DNA
gcaaatcccttcacccttaa

SEQ ID NO: 31068 - DNA, 20 bp, synthetic construct
  misc_feature 1..20: note = CRISPR gRNA sequence
  source 1..20: mol_type = other DNA
cacccttaagtcttgatctc

SEQ ID NO: 31069 - DNA, 20 bp, synthetic construct
  misc_feature 1..20: note = CRISPR gRNA sequence
  source 1..20: mol_type = other DNA
acccttaagtcttgatctcc

SEQ ID NO: 31070 - DNA, 20 bp, synthetic construct
  misc_feature 1..20: note = CRISPR gRNA sequence
  source 1..20: mol_type = other DNA
aagtcttgatctcctcaaat

SEQ ID NO: 31071 - DNA, 20 bp, synthetic construct
  misc_feature 1..20: note = CRISPR gRNA sequence
  source 1..20: mol_type = other DNA
agtcttgatctcctcaaata

SEQ ID NO: 31072 - DNA, 20 bp, synthetic construct
  misc_feature 1..20: note = CRISPR gRNA sequence
  source 1..20: mol_type = other DNA
gatctcctcaaatatttcac

SEQ ID NO: 31073 - DNA, 20 bp, synthetic construct
  misc_feature 1..20: note = CRISPR gRNA sequence
  source 1..20: mol_type = other DNA
atctcctcaaatatttcacc

SEQ ID NO: 31074 - DNA, 20 bp, synthetic construct
  misc_feature 1..20: note = CRISPR gRNA sequence
  source 1..20: mol_type = other DNA
ctcaaatatttcaccccaat

SEQ ID NO: 31075 - DNA, 20 bp, synthetic construct
  misc_feature 1..20: note = CRISPR gRNA sequence
  source 1..20: mol_type = other DNA
aaatatttcaccccaatctt

SEQ ID NO: 31076 - DNA, 20 bp, synthetic construct
  misc_feature 1..20: note = CRISPR gRNA sequence
  source 1..20: mol_type = other DNA
caccccaatcttatgggggt

SEQ ID NO: 31077 - DNA, 20 bp, synthetic construct
  misc_feature 1..20: note = CRISPR gRNA sequence
  source 1..20: mol_type = other DNA
accccaatcttatgggggtt

SEQ ID NO: 31078 - DNA, 20 bp, synthetic construct
  misc_feature 1..20: note = CRISPR gRNA sequence
  source 1..20: mol_type = other DNA
atgggggttcttggattaag

SEQ ID NO: 31079 - DNA, 20 bp, synthetic construct
  misc_feature 1..20: note = CRISPR gRNA sequence
  source 1..20: mol_type = other DNA
tgggggttcttggattaagg

SEQ ID NO: 31080 - DNA, 20 bp, synthetic construct
  misc_feature 1..20: note = CRISPR gRNA sequence
  source 1..20: mol_type = other DNA
ttggattaaggcattcgttg

SEQ ID NO: 31081 - DNA, 20 bp, synthetic construct
  misc_feature 1..20: note = CRISPR gRNA sequence
  source 1..20: mol_type = other DNA
ggattaaggcattcgttgtt

SEQ ID NO: 31082 - DNA, 20 bp, synthetic construct
  misc_feature 1..20: note = CRISPR gRNA sequence
  source 1..20: mol_type = other DNA
gattaaggcattcgttgtta

SEQ ID NO: 31083 - DNA, 20 bp, synthetic construct
  misc_feature 1..20: note = CRISPR gRNA sequence
  source 1..20: mol_type = other DNA
aggcattcgttgttaaatat

SEQ ID NO: 31084 - DNA, 20 bp, synthetic construct
  misc_feature 1..20: note = CRISPR gRNA sequence
  source 1..20: mol_type = other DNA
gttgttaaatattgaccgct

SEQ ID NO: 31085 - DNA, 20 bp, synthetic construct
  misc_feature 1..20: note = CRISPR gRNA sequence
  source 1..20: mol_type = other DNA
ttaaatattgaccgcttgcc

SEQ ID NO: 31086 - DNA, 20 bp, synthetic construct
  misc_feature 1..20: note = CRISPR gRNA sequence
  source 1..20: mol_type = other DNA
aatattgaccgcttgcctac

SEQ ID NO: 31087 - DNA, 20 bp, synthetic construct
  misc_feature 1..20: note = CRISPR gRNA sequence
  source 1..20: mol_type = other DNA
accgcttgcctactatgtgc

SEQ ID NO: 31088 - DNA, 20 bp, synthetic construct
  misc_feature 1..20: note = CRISPR gRNA sequence
  source 1..20: mol_type = other DNA
gcctactatgtgccaggccc

SEQ ID NO: 31089 - DNA, 20 bp, synthetic construct
  misc_feature 1..20: note = CRISPR gRNA sequence
  source 1..20: mol_type = other DNA
cctactatgtgccaggccca

SEQ ID NO: 31090 - DNA, 20 bp, synthetic construct
  misc_feature 1..20: note = CRISPR gRNA sequence
  source 1..20: mol_type = other DNA
ctatgtgccaggcccaggga

SEQ ID NO: 31091 - DNA, 20 bp, synthetic construct
  misc_feature 1..20: note = CRISPR gRNA sequence
  source 1..20: mol_type = other DNA
tgtgccaggcccagggagga

SEQ ID NO: 31092 - DNA, 20 bp, synthetic construct
  misc_feature 1..20: note = CRISPR gRNA sequence
  source 1..20: mol_type = other DNA
tgggccaaacagacgaaaat

SEQ ID NO: 31093 - DNA, 20 bp, synthetic construct
  misc_feature 1..20: note = CRISPR gRNA sequence
  source 1..20: mol_type = other DNA
ccttctgggtgctgacattc

SEQ ID NO: 31094 - DNA, 20 bp, synthetic construct
  misc_feature 1..20: note = CRISPR gRNA sequence
  source 1..20: mol_type = other DNA
ctgggtgctgacattccagg

SEQ ID NO: 31095 - DNA, 20 bp, synthetic construct
  misc_feature 1..20: note = CRISPR gRNA sequence
  source 1..20: mol_type = other DNA
tgggtgctgacattccaggg

SEQ ID NO: 31096 - DNA, 20 bp, synthetic construct
  misc_feature 1..20: note = CRISPR gRNA sequence
  source 1..20: mol_type = other DNA
ggtgctgacattccaggggg

SEQ ID NO: 31097 - DNA, 20 bp, synthetic construct
  misc_feature 1..20: note = CRISPR gRNA sequence
  source 1..20: mol_type = other DNA
acattccaggggggaagata

SEQ ID NO: 31098 - DNA, 20 bp, synthetic construct
  misc_feature 1..20: note = CRISPR gRNA sequence
  source 1..20: mol_type = other DNA
caggggggaagatagacaga

SEQ ID NO: 31099 - DNA, 20 bp, synthetic construct
  misc_feature 1..20: note = CRISPR gRNA sequence
  source 1..20: mol_type = other DNA
atgtctgagacaatgaatca

SEQ ID NO: 31100 - DNA, 20 bp, synthetic construct
  misc_feature 1..20: note = CRISPR gRNA sequence
  source 1..20: mol_type = other DNA
agacaatgaatcatatggaa

SEQ ID NO: 31101 - DNA, 20 bp, synthetic construct
  misc_feature 1..20: note = CRISPR gRNA sequence
  source 1..20: mol_type = other DNA
tttttttaaccatgagggga

SEQ ID NO: 31102 - DNA, 20 bp, synthetic construct
  misc_feature 1..20: note = CRISPR gRNA sequence
  source 1..20: mol_type = other DNA
ttttttaaccatgaggggaa

SEQ ID NO: 31103 - DNA, 20 bp, synthetic construct
  misc_feature 1..20: note = CRISPR gRNA sequence
  source 1..20: mol_type = other DNA
tttttaaccatgaggggaat

SEQ ID NO: 31104 - DNA, 20 bp, synthetic construct
  misc_feature 1..20: note = CRISPR gRNA sequence
  source 1..20: mol_type = other DNA
ttttaaccatgaggggaatg

SEQ ID NO: 31105 - DNA, 20 bp, synthetic construct
  misc_feature 1..20: note = CRISPR gRNA sequence
  source 1..20: mol_type = other DNA
tttaaccatgaggggaatgg

SEQ ID NO: 31106 - DNA, 20 bp, synthetic construct
  misc_feature 1..20: note = CRISPR gRNA sequence
  source 1..20: mol_type = other DNA
ttaaccatgaggggaatgga

SEQ ID NO: 31107 - DNA, 20 bp, synthetic construct
  misc_feature 1..20: note = CRISPR gRNA sequence
  source 1..20: mol_type = other DNA
taaccatgaggggaatggag

SEQ ID NO: 31108 - DNA, 20 bp, synthetic construct
  misc_feature 1..20: note = CRISPR gRNA sequence
  source 1..20: mol_type = other DNA
aaccatgaggggaatggagt

SEQ ID NO: 31109 - DNA, 20 bp, synthetic construct
  misc_feature 1..20: note = CRISPR gRNA sequence
  source 1..20: mol_type = other DNA
accatgaggggaatggagtt

SEQ ID NO: 31110 - DNA, 20 bp, synthetic construct
  misc_feature 1..20: note = CRISPR gRNA sequence
  source 1..20: mol_type = other DNA
tatttatttatttatttatt

SEQ ID NO: 31111 - DNA, 20 bp, synthetic construct
  misc_feature 1..20: note = CRISPR gRNA sequence
  source 1..20: mol_type = other DNA
tttatttatttatttattta

SEQ ID NO: 31112 - DNA, 20 bp, synthetic construct
  misc_feature 1..20: note = CRISPR gRNA sequence
  source 1..20: mol_type = other DNA
atttatttatttatttattt

SEQ ID NO: 31113 - DNA, 20 bp, synthetic construct
  misc_feature 1..20: note = CRISPR gRNA sequence
  source 1..20: mol_type = other DNA
tttatttatttatttatttt

SEQ ID NO: 31114 - DNA, 20 bp, synthetic construct
  misc_feature 1..20: note = CRISPR gRNA sequence
  source 1..20: mol_type = other DNA
atttatttatttatttttga

SEQ ID NO: 31115 - DNA, 20 bp, synthetic construct
  misc_feature 1..20: note = CRISPR gRNA sequence
  source 1..20: mol_type = other DNA
tttatttatttatttttgag

SEQ ID NO: 31116 - DNA, 20 bp, synthetic construct
  misc_feature 1..20: note = CRISPR gRNA sequence
  source 1..20: mol_type = other DNA
atttatttatttttgagatg

SEQ ID NO: 31117 - DNA, 20 bp, synthetic construct
  misc_feature 1..20: note = CRISPR gRNA sequence
  source 1..20: mol_type = other DNA
tttatttatttttgagatgg

SEQ ID NO: 31118 - DNA, 20 bp, synthetic construct
  misc_feature 1..20: note = CRISPR gRNA sequence
  source 1..20: mol_type = other DNA
atttatttttgagatggggt

SEQ ID NO: 31119 - DNA, 20 bp, synthetic construct
  misc_feature 1..20: note = CRISPR gRNA sequence
  source 1..20: mol_type = other DNA
tttatttttgagatggggtc

SEQ ID NO: 31120 - DNA, 20 bp, synthetic construct
  misc_feature 1..20: note = CRISPR gRNA sequence
  source 1..20: mol_type = other DNA
atttttgagatggggtctca

SEQ ID NO: 31121 - DNA, 20 bp, synthetic construct
  misc_feature 1..20: note = CRISPR gRNA sequence
  source 1..20: mol_type = other DNA
tttttgagatggggtctcac

SEQ ID NO: 31122 - DNA, 20 bp, synthetic construct
  misc_feature 1..20: note = CRISPR gRNA sequence
  source 1..20: mol_type = other DNA
ttgagatggggtctcactct

SEQ ID NO: 31123 - DNA, 20 bp, synthetic construct
  misc_feature 1..20: note = CRISPR gRNA sequence
  source 1..20: mol_type = other DNA
tgagatggggtctcactctg

SEQ ID NO: 31124 - DNA, 20 bp, synthetic construct
  misc_feature 1..20: note = CRISPR gRNA sequence
  source 1..20: mol_type = other DNA
gagatggggtctcactctgt

SEQ ID NO: 31125 - DNA, 20 bp, synthetic construct
  misc_feature 1..20: note = CRISPR gRNA sequence
  source 1..20: mol_type = other DNA
agatggggtctcactctgtc

SEQ ID NO: 31126 - DNA, 20 bp, synthetic construct
  misc_feature 1..20: note = CRISPR gRNA sequence
  source 1..20: mol_type = other DNA
actctgtcatccaagctgga

SEQ ID NO: 31127 - DNA, 20 bp, synthetic construct
  misc_feature 1..20: note = CRISPR gRNA sequence
  source 1..20: mol_type = other DNA
tgtcatccaagctggactgc

SEQ ID NO: 31128 - DNA, 20 bp, synthetic construct
  misc_feature 1..20: note = CRISPR gRNA sequence
  source 1..20: mol_type = other DNA
tcatccaagctggactgcag

SEQ ID NO: 31129 - DNA, 20 bp, synthetic construct
  misc_feature 1..20: note = CRISPR gRNA sequence
  source 1..20: mol_type = other DNA
gactgcagtggcgtgatctc

SEQ ID NO: 31130 - DNA, 20 bp, synthetic construct
  misc_feature 1..20: note = CRISPR gRNA sequence
  source 1..20: mol_type = other DNA
cagtggcgtgatctcagctc

SEQ ID NO: 31131 - DNA, 20 bp, synthetic construct
  misc_feature 1..20: note = CRISPR gRNA sequence
  source 1..20: mol_type = other DNA
agctcaccgcaacctccgcc

SEQ ID NO: 31132 - DNA, 20 bp, synthetic construct
  misc_feature 1..20: note = CRISPR gRNA sequence
  source 1..20: mol_type = other DNA
accgcaacctccgcctcccg

SEQ ID NO: 31133 - DNA, 20 bp, synthetic construct
  misc_feature 1..20: note = CRISPR gRNA sequence
  source 1..20: mol_type = other DNA
cgcctcccggtttcaaatga

SEQ ID NO: 31134 - DNA, 20 bp, synthetic construct
  misc_feature 1..20: note = CRISPR gRNA sequence
  source 1..20: mol_type = other DNA
ccggtttcaaatgattctcc

SEQ ID NO: 31135 - DNA, 20 bp, synthetic construct
  misc_feature 1..20: note = CRISPR gRNA sequence
  source 1..20: mol_type = other DNA
caaatgattctcctgcctca

SEQ ID NO: 31136 - DNA, 20 bp, synthetic construct
  misc_feature 1..20: note = CRISPR gRNA sequence
  source 1..20: mol_type = other DNA
aaatgattctcctgcctcag

SEQ ID NO: 31137 - DNA, 20 bp, synthetic construct
  misc_feature 1..20: note = CRISPR gRNA sequence
  source 1..20: mol_type = other DNA
tcctgcctcagcctcccaag

SEQ ID NO: 31138 - DNA, 20 bp, synthetic construct
  misc_feature 1..20: note = CRISPR gRNA sequence
  source 1..20: mol_type = other DNA
ctgcctcagcctcccaagta

SEQ ID NO: 31139 - DNA, 20 bp, synthetic construct
  misc_feature 1..20: note = CRISPR gRNA sequence
  source 1..20: mol_type = other DNA
cctcagcctcccaagtagct

SEQ ID NO: 31140 - DNA, 20 bp, synthetic construct
  misc_feature 1..20: note = CRISPR gRNA sequence
  source 1..20: mol_type = other DNA
agcctcccaagtagctgtga

SEQ ID NO: 31141 - DNA, 20 bp, synthetic construct
  misc_feature 1..20: note = CRISPR gRNA sequence
  source 1..20: mol_type = other DNA
ccaagtagctgtgactacag

SEQ ID NO: 31142 - DNA, 20 bp, synthetic construct
  misc_feature 1..20: note = CRISPR gRNA sequence
  source 1..20: mol_type = other DNA
tgactacaggcacctgccac

SEQ ID NO: 31143 - DNA, 20 bp, synthetic construct
  misc_feature 1..20: note = CRISPR gRNA sequence
  source 1..20: mol_type = other DNA
caggcacctgccaccatgcc

SEQ ID NO: 31144 - DNA, 20 bp, synthetic construct
  misc_feature 1..20: note = CRISPR gRNA sequence
  source 1..20: mol_type = other DNA
ccaccatgcccagctaattt

SEQ ID NO: 31145 - DNA, 20 bp, synthetic construct
  misc_feature 1..20: note = CRISPR gRNA sequence
  source 1..20: mol_type = other DNA
atttgttttgtatatttagt

SEQ ID NO: 31146 - DNA, 20 bp, synthetic construct
  misc_feature 1..20: note = CRISPR gRNA sequence
  source 1..20: mol_type = other DNA
gttttgtatatttagtagag

SEQ ID NO: 31147 - DNA, 20 bp, synthetic construct
  misc_feature 1..20: note = CRISPR gRNA sequence
  source 1..20: mol_type = other DNA
ttttgtatatttagtagaga

SEQ ID NO: 31148 - DNA, 20 bp, synthetic construct
  misc_feature 1..20: note = CRISPR gRNA sequence
  source 1..20: mol_type = other DNA
tgtatatttagtagagatgg

SEQ ID NO: 31149 - DNA, 20 bp, synthetic construct
  misc_feature 1..20: note = CRISPR gRNA sequence
  source 1..20: mol_type = other DNA
gtatatttagtagagatggg

SEQ ID NO: 31150 - DNA, 20 bp, synthetic construct
  misc_feature 1..20: note = CRISPR gRNA sequence
  source 1..20: mol_type = other DNA
tatatttagtagagatgggg

SEQ ID NO: 31151 - DNA, 20 bp, synthetic construct
  misc_feature 1..20: note = CRISPR gRNA sequence
  source 1..20: mol_type = other DNA
agtagagatggggtttcact

SEQ ID NO: 31152 - DNA, 20 bp, synthetic construct
  misc_feature 1..20: note = CRISPR gRNA sequence
  source 1..20: mol_type = other DNA
gtagagatggggtttcacta

SEQ ID NO: 31153 - DNA, 20 bp, synthetic construct
  misc_feature 1..20: note = CRISPR gRNA sequence
  source 1..20: mol_type = other DNA
cactatgttggccaggctgg

SEQ ID NO: 31154 - DNA, 20 bp, synthetic construct
  misc_feature 1..20: note = CRISPR gRNA sequence
  source 1..20: mol_type = other DNA
actatgttggccaggctggt

SEQ ID NO: 31155 - DNA, 20 bp, synthetic construct
  misc_feature 1..20: note = CRISPR gRNA sequence
  source 1..20: mol_type = other DNA
tgttggccaggctggtctca

SEQ ID NO: 31156 - DNA, 20 bp, synthetic construct
  misc_feature 1..20: note = CRISPR gRNA sequence
  source 1..20: mol_type = other DNA
gccaggctggtctcaaactc

SEQ ID NO: 31157 - DNA, 20 bp, synthetic construct
  misc_feature 1..20: note = CRISPR gRNA sequence
  source 1..20: mol_type = other DNA
gtctcaaactcctggccttg

SEQ ID NO: 31158 - DNA, 20 bp, synthetic construct
  misc_feature 1..20: note = CRISPR gRNA sequence
  source 1..20: mol_type = other DNA
aaactcctggccttgtgatc

SEQ ID NO: 31159 - DNA, 20 bp, synthetic construct
  misc_feature 1..20: note = CRISPR gRNA sequence
  source 1..20: mol_type = other DNA
ctggccttgtgatccacctg

SEQ ID NO: 31160 - DNA, 20 bp, synthetic construct
  misc_feature 1..20: note = CRISPR gRNA sequence
  source 1..20: mol_type = other DNA
gccttgtgatccacctgcct

SEQ ID NO: 31161 - DNA, 20 bp, synthetic construct
  misc_feature 1..20: note = CRISPR gRNA sequence
  source 1..20: mol_type = other DNA
gtgatccacctgcctcggcc

SEQ ID NO: 31162 - DNA, 20 bp, synthetic construct
  misc_feature 1..20: note = CRISPR gRNA sequence
  source 1..20: mol_type = other DNA
tgatccacctgcctcggcct

SEQ ID NO: 31163 - DNA, 20 bp, synthetic construct
  misc_feature 1..20: note = CRISPR gRNA sequence
  source 1..20: mol_type = other DNA
cctcggcctcccaaagtgct

SEQ ID NO: 31164 - DNA, 20 bp, synthetic construct
  misc_feature 1..20: note = CRISPR gRNA sequence
  source 1..20: mol_type = other DNA
ggcctcccaaagtgctggga

SEQ ID NO: 31165 - DNA, 20 bp, synthetic construct
  misc_feature 1..20: note = CRISPR gRNA sequence
  source 1..20: mol_type = other DNA
ccaaagtgctgggattacag

SEQ ID NO: 31166 - DNA, 20 bp, synthetic construct
  misc_feature 1..20: note = CRISPR gRNA sequence
  source 1..20: mol_type = other DNA
ggattacaggcataagccac

SEQ ID NO: 31167 - DNA, 20 bp, synthetic construct
  misc_feature 1..20: note = CRISPR gRNA sequence
  source 1..20: mol_type = other DNA
caggcataagccactgcgcc

SEQ ID NO: 31168 - DNA, 20 bp, synthetic construct
  misc_feature 1..20: note = CRISPR gRNA sequence
  source 1..20: mol_type = other DNA
cgcctggccagagttttatt

SEQ ID NO: 31169 - DNA, 20 bp, synthetic construct
  misc_feature 1..20: note = CRISPR gRNA sequence
  source 1..20: mol_type = other DNA
gccagagttttatttttaac

SEQ ID NO: 31170 - DNA, 20 bp, synthetic construct
  misc_feature 1..20: note = CRISPR gRNA sequence
  source 1..20: mol_type = other DNA
tatttttaactgtgagggtc

SEQ ID NO: 31171 - DNA, 20 bp, synthetic construct
  misc_feature 1..20: note = CRISPR gRNA sequence
  source 1..20: mol_type = other DNA
atttttaactgtgagggtca

SEQ ID NO: 31172 - DNA, 20 bp, synthetic construct
  misc_feature 1..20: note = CRISPR gRNA sequence
  source 1..20: mol_type = other DNA
tttttaactgtgagggtcag

SEQ ID NO: 31173 - DNA, 20 bp, synthetic construct
  misc_feature 1..20: note = CRISPR gRNA sequence
  source 1..20: mol_type = other DNA
ttaactgtgagggtcagaaa

SEQ ID NO: 31174 - DNA, 20 bp, synthetic construct
  misc_feature 1..20: note = CRISPR gRNA sequence
  source 1..20: mol_type = other DNA
taactgtgagggtcagaaaa

SEQ ID NO: 31175 - DNA, 20 bp, synthetic construct
  misc_feature 1..20: note = CRISPR gRNA sequence
  source 1..20: mol_type = other DNA
aactgtgagggtcagaaaag

SEQ ID NO: 31176 - DNA, 20 bp, synthetic construct
  misc_feature 1..20: note = CRISPR gRNA sequence
  source 1..20: mol_type = other DNA
actgtgagggtcagaaaaga

SEQ ID NO: 31177 - DNA, 20 bp, synthetic construct
  misc_feature 1..20: note = CRISPR gRNA sequence
  source 1..20: mol_type = other DNA
tgagggtcagaaaagacctc

SEQ ID NO: 31178 - DNA, 20 bp, synthetic construct
  misc_feature 1..20: note = CRISPR gRNA sequence
  source 1..20: mol_type = other DNA
actgaggccgggtgtggtgg

SEQ ID NO: 31179 - DNA, 20 bp, synthetic construct
  misc_feature 1..20: note = CRISPR gRNA sequence
  source 1..20: mol_type = other DNA
aggccgggtgtggtggctca

SEQ ID NO: 31180 - DNA, 20 bp, synthetic construct
  misc_feature 1..20: note = CRISPR gRNA sequence
  source 1..20: mol_type = other DNA
acgcctgtaatcccagcact

SEQ ID NO: 31181 - DNA, 20 bp, synthetic construct
  misc_feature 1..20: note = CRISPR gRNA sequence
  source 1..20: mol_type = other DNA
taatcccagcactttgggag

SEQ ID NO: 31182 - DNA, 20 bp, synthetic construct
  misc_feature 1..20: note = CRISPR gRNA sequence
  source 1..20: mol_type = other DNA
tgggaggccgaggtgggggg

SEQ ID NO: 31183 - DNA, 20 bp, synthetic construct
  misc_feature 1..20: note = CRISPR gRNA sequence
  source 1..20: mol_type = other DNA
gggaggccgaggtgggggga

SEQ ID NO: 31184 - DNA, 20 bp, synthetic construct
  misc_feature 1..20: note = CRISPR gRNA sequence
  source 1..20: mol_type = other DNA
ggaggccgaggtggggggat

SEQ ID NO: 31185 - DNA, 20 bp, synthetic construct
  misc_feature 1..20: note = CRISPR gRNA sequence
  source 1..20: mol_type = other DNA
agaccatcctggctaacacg

SEQ ID NO: 31186 - DNA, 20 bp, synthetic construct
  misc_feature 1..20: note = CRISPR gRNA sequence
  source 1..20: mol_type = other DNA
gctaacacggtgaaaccccg

SEQ ID NO: 31187 - DNA, 20 bp, synthetic construct
  misc_feature 1..20: note = CRISPR gRNA sequence
  source 1..20: mol_type = other DNA
acacggtgaaaccccgtctc

SEQ ID NO: 31188 - DNA, 20 bp, synthetic construct
  misc_feature 1..20: note = CRISPR gRNA sequence
  source 1..20: mol_type = other DNA
tactaaaaatacaaaaaatt

SEQ ID NO: 31189 - DNA, 20 bp, synthetic construct
  misc_feature 1..20: note = CRISPR gRNA sequence
  source 1..20: mol_type = other DNA
ctaaaaatacaaaaaattag

SEQ ID NO: 31190 - DNA, 20 bp, synthetic construct
  misc_feature 1..20: note = CRISPR gRNA sequence
  source 1..20: mol_type = other DNA
aaaatacaaaaaattagcca

SEQ ID NO: 31191 - DNA, 20 bp, synthetic construct
  misc_feature 1..20: note = CRISPR gRNA sequence
  source 1..20: mol_type = other DNA
gccagatgtggtgacatgtg

SEQ ID NO: 31192 - DNA, 20 bp, synthetic construct
  misc_feature 1..20: note = CRISPR gRNA sequence
  source 1..20: mol_type = other DNA
tagtcccagctactcgggag

SEQ ID NO: 31193 - DNA, 20 bp, synthetic construct
  misc_feature 1..20: note = CRISPR gRNA sequence
  source 1..20: mol_type = other DNA
ctcgggaggctgaggcaaga

SEQ ID NO: 31194 - DNA, 20 bp, synthetic construct
  misc_feature 1..20: note = CRISPR gRNA sequence
  source 1..20: mol_type = other DNA
gggaggctgaggcaagagaa

SEQ ID NO: 31195 - DNA, 20 bp, synthetic construct
  misc_feature 1..20: note = CRISPR gRNA sequence
  source 1..20: mol_type = other DNA
aggcaagagaatcacttgga

SEQ ID NO: 31196 - DNA, 20 bp, synthetic construct
  misc_feature 1..20: note = CRISPR gRNA sequence
  source 1..20: mol_type = other DNA
ggacttgggaggaggaggtt

SEQ ID NO: 31197 - DNA, 20 bp, synthetic construct
  misc_feature 1..20: note = CRISPR gRNA sequence
  source 1..20: mol_type = other DNA
gacttgggaggaggaggttg

SEQ ID NO: 31198 - DNA, 20 bp, synthetic construct
  misc_feature 1..20: note = CRISPR gRNA sequence
  source 1..20: mol_type = other DNA
gggaggaggaggttgcagtg

SEQ ID NO: 31199 - DNA, 20 bp, synthetic construct
  misc_feature 1..20: note = CRISPR gRNA sequence
  source 1..20: mol_type = other DNA
ggaggaggaggttgcagtga

SEQ ID NO: 31200 - DNA, 20 bp, synthetic construct
  misc_feature 1..20: note = CRISPR gRNA sequence
  source 1..20: mol_type = other DNA
cagtgagtcgagattgtgcc

SEQ ID NO: 31201 - DNA, 20 bp, synthetic construct
  misc_feature 1..20: note = CRISPR gRNA sequence
  source 1..20: mol_type = other DNA
tgccactgcactccagcctg

SEQ ID NO: 31202 - DNA, 20 bp, synthetic construct
  misc_feature 1..20: note = CRISPR gRNA sequence
  source 1..20: mol_type = other DNA
cactccagcctgggtgacag

SEQ ID NO: 31203 - DNA, 20 bp, synthetic construct
  misc_feature 1..20: note = CRISPR gRNA sequence
  source 1..20: mol_type = other DNA
cagcctgggtgacagagcga

SEQ ID NO: 31204 - DNA, 20 bp, synthetic construct
  misc_feature 1..20: note = CRISPR gRNA sequence
  source 1..20: mol_type = other DNA
ggtgacagagcgagactcca

SEQ ID NO: 31205 - DNA, 20 bp, synthetic construct
  misc_feature 1..20: note = CRISPR gRNA sequence
  source 1..20: mol_type = other DNA
cacctcaaaaaaagaaaaag

SEQ ID NO: 31206 - DNA, 20 bp, synthetic construct
  misc_feature 1..20: note = CRISPR gRNA sequence
  source 1..20: mol_type = other DNA
aaaaaaagaaaaagaaaaaa

SEQ ID NO: 31207 - DNA, 20 bp, synthetic construct
  misc_feature 1..20: note = CRISPR gRNA sequence
  source 1..20: mol_type = other DNA
actgagtaaagaccagagga

SEQ ID NO: 31208 - DNA, 20 bp, synthetic construct
  misc_feature 1..20: note = CRISPR gRNA sequence
  source 1..20: mol_type = other DNA
agtaaagaccagaggaggtg

SEQ ID NO: 31209 - DNA, 20 bp, synthetic construct
  misc_feature 1..20: note = CRISPR gRNA sequence
  source 1..20: mol_type = other DNA
gggagaagtattccaggcag

SEQ ID NO: 31210 - DNA, 20 bp, synthetic construct
  misc_feature 1..20: note = CRISPR gRNA sequence
  source 1..20: mol_type = other DNA
caggcagagggcacagccgg

SEQ ID NO: 31211 - DNA, 20 bp, synthetic construct
  misc_feature 1..20: note = CRISPR gRNA sequence
  source 1..20: mol_type = other DNA
gaggcagaagcatgcctagg

SEQ ID NO: 31212 - DNA, 20 bp, synthetic construct
  misc_feature 1..20: note = CRISPR gRNA sequence
  source 1..20: mol_type = other DNA
ggaggttgaaagccagcaag

SEQ ID NO: 31213 - DNA, 20 bp, synthetic construct
  misc_feature 1..20: note = CRISPR gRNA sequence
  source 1..20: mol_type = other DNA
aaagccagcaaggaggccct

SEQ ID NO: 31214 - DNA, 20 bp, synthetic construct
  misc_feature 1..20: note = CRISPR gRNA sequence
  source 1..20: mol_type = other DNA
tggctggaatggagagagca

SEQ ID NO: 31215 - DNA, 20 bp, synthetic construct
  misc_feature 1..20: note = CRISPR gRNA sequence
  source 1..20: mol_type = other DNA
gaatggagagagcacccagc

SEQ ID NO: 31216 - DNA, 20 bp, synthetic construct
  misc_feature 1..20: note = CRISPR gRNA sequence
  source 1..20: mol_type = other DNA
aactggggaaggactctgtg

SEQ ID NO: 31217 - DNA, 20 bp, synthetic construct
  misc_feature 1..20: note = CRISPR gRNA sequence
  source 1..20: mol_type = other DNA
gggaaggactctgtgtacaa

SEQ ID NO: 31218 - DNA, 20 bp, synthetic construct
  misc_feature 1..20: note = CRISPR gRNA sequence
  source 1..20: mol_type = other DNA
tgtgtacaaacgaagtccct

SEQ ID NO: 31219 - DNA, 20 bp, synthetic construct
  misc_feature 1..20: note = CRISPR gRNA sequence
  source 1..20: mol_type = other DNA
tgtacaaacgaagtccctgt

SEQ ID NO: 31220 - DNA, 20 bp, synthetic construct
  misc_feature 1..20: note = CRISPR gRNA sequence
  source 1..20: mol_type = other DNA
tagggttgtgagtggctaag

SEQ ID NO: 31221 - DNA, 20 bp, synthetic construct
  misc_feature 1..20: note = CRISPR gRNA sequence
  source 1..20: mol_type = other DNA
tgagtggctaagaaccctga

SEQ ID NO: 31222 - DNA, 20 bp, synthetic construct
  misc_feature 1..20: note = CRISPR gRNA sequence
  source 1..20: mol_type = other DNA
agaaccctgatttgacagac

SEQ ID NO: 31223 - DNA, 20 bp, synthetic construct
  misc_feature 1..20: note = CRISPR gRNA sequence
  source 1..20: mol_type = other DNA
atttgacagacagatgaggt

SEQ ID NO: 31224 - DNA, 20 bp, synthetic construct
  misc_feature 1..20: note = CRISPR gRNA sequence
  source 1..20: mol_type = other DNA
gacagacagatgaggtctac

SEQ ID NO: 31225 - DNA, 20 bp, synthetic construct
  misc_feature 1..20: note = CRISPR gRNA sequence
  source 1..20: mol_type = other DNA
acagacagatgaggtctaca

SEQ ID NO: 31226 - DNA, 20 bp, synthetic construct
  misc_feature 1..20: note = CRISPR gRNA sequence
  source 1..20: mol_type = other DNA
cagggtgcctgggcacagta

SEQ ID NO: 31227 - DNA, 20 bp, synthetic construct
  misc_feature 1..20: note = CRISPR gRNA sequence
  source 1..20: mol_type = other DNA
ggcacagtagaagcctgaga

SEQ ID NO: 31228 - DNA, 20 bp, synthetic construct
  misc_feature 1..20: note = CRISPR gRNA sequence
  source 1..20: mol_type = other DNA
agaaaatgccagaaatagtc

SEQ ID NO: 31229 - DNA, 20 bp, synthetic construct
  misc_feature 1..20: note = CRISPR gRNA sequence
  source 1..20: mol_type = other DNA
ttccttccttccttccttcc

SEQ ID NO: 31230 - DNA, 20 bp, synthetic construct
  misc_feature 1..20: note = CRISPR gRNA sequence
  source 1..20: mol_type = other DNA
tccttccttccttccttcct

SEQ ID NO: 31231 - DNA, 20 bp, synthetic construct
  misc_feature 1..20: note = CRISPR gRNA sequence
  source 1..20: mol_type = other DNA
ccttccttccttccttcctc

SEQ ID NO: 31232 - DNA, 20 bp, synthetic construct
  misc_feature 1..20: note = CRISPR gRNA sequence
  source 1..20: mol_type = other DNA
cttccttccttccttcctca

SEQ ID NO: 31233 - DNA, 20 bp, synthetic construct
  misc_feature 1..20: note = CRISPR gRNA sequence
  source 1..20: mol_type = other DNA
ccttccttccttcctcagaa

SEQ ID NO: 31234 - DNA, 20 bp, synthetic construct
  misc_feature 1..20: note = CRISPR gRNA sequence
  source 1..20: mol_type = other DNA
cttccttccttcctcagaac

SEQ ID NO: 31235 - DNA, 20 bp, synthetic construct
  misc_feature 1..20: note = CRISPR gRNA sequence
  source 1..20: mol_type = other DNA
ccttccttcctcagaacctc

SEQ ID NO: 31236 - DNA, 20 bp, synthetic construct
  misc_feature 1..20: note = CRISPR gRNA sequence
  source 1..20: mol_type = other DNA
cttccttcctcagaacctcc

SEQ ID NO: 31237 - DNA, 20 bp, synthetic construct
  misc_feature 1..20: note = CRISPR gRNA sequence
  source 1..20: mol_type = other DNA
ccttcctcagaacctcctcg

SEQ ID NO: 31238 - DNA, 20 bp, synthetic construct
  misc_feature 1..20: note = CRISPR gRNA sequence
  source 1..20: mol_type = other DNA
cttcctcagaacctcctcgg

SEQ ID NO: 31239 - DNA, 20 bp, synthetic construct
  misc_feature 1..20: note = CRISPR gRNA sequence
  source 1..20: mol_type = other DNA
cctcagaacctcctcggggg

SEQ ID NO: 31240 - DNA, 20 bp, synthetic construct
  misc_feature 1..20: note = CRISPR gRNA sequence
  source 1..20: mol_type = other DNA
ctcagaacctcctcgggggc

SEQ ID NO: 31241 - DNA, 20 bp, synthetic construct
  misc_feature 1..20: note = CRISPR gRNA sequence
  source 1..20: mol_type = other DNA
agaacctcctcgggggcttc

SEQ ID NO: 31242 - DNA, 20 bp, synthetic construct
  misc_feature 1..20: note = CRISPR gRNA sequence
  source 1..20: mol_type = other DNA
ctcgggggcttccggtctcc

SEQ ID NO: 31243 - DNA, 20 bp, synthetic construct
  misc_feature 1..20: note = CRISPR gRNA sequence
  source 1..20: mol_type = other DNA
gggggcttccggtctccagg

SEQ ID NO: 31244 - DNA, 20 bp, synthetic construct
  misc_feature 1..20: note = CRISPR gRNA sequence
  source 1..20: mol_type = other DNA
ccggtctccaggtggctgat

SEQ ID NO: 31245 - DNA, 20 bp, synthetic construct
  misc_feature 1..20: note = CRISPR gRNA sequence
  source 1..20: mol_type = other DNA
cggtctccaggtggctgatc

SEQ ID NO: 31246 - DNA, 20 bp, synthetic construct
  misc_feature 1..20: note = CRISPR gRNA sequence
  source 1..20: mol_type = other DNA
caggtggctgatcacccggc

SEQ ID NO: 31247 - DNA, 20 bp, synthetic construct
  misc_feature 1..20: note = CRISPR gRNA sequence
  source 1..20: mol_type = other DNA
atcacccggctctaggctgt

SEQ ID NO: 31248 - DNA, 20 bp, synthetic construct
  misc_feature 1..20: note = CRISPR gRNA sequence
  source 1..20: mol_type = other DNA
taggctgttccaccccatgg

SEQ ID NO: 31249 - DNA, 20 bp, synthetic construct
  misc_feature 1..20: note = CRISPR gRNA sequence
  source 1..20: mol_type = other DNA
ggctgttccaccccatggcc

SEQ ID NO: 31250 - DNA, 20 bp, synthetic construct
  misc_feature 1..20: note = CRISPR gRNA sequence
  source 1..20: mol_type = other DNA
ttccaccccatggccgctgt

SEQ ID NO: 31251 - DNA, 20 bp, synthetic construct
  misc_feature 1..20: note = CRISPR gRNA sequence
  source 1..20: mol_type = other DNA
caccccatggccgctgttcc

SEQ ID NO: 31252 - DNA, 20 bp, synthetic construct
  misc_feature 1..20: note = CRISPR gRNA sequence
  source 1..20: mol_type = other DNA
ttccccagagcgcagttccg

SEQ ID NO: 31253 - DNA, 20 bp, synthetic construct
  misc_feature 1..20: note = CRISPR gRNA sequence
  source 1..20: mol_type = other DNA
cccagagcgcagttccgatc

SEQ ID NO: 31254 - DNA, 20 bp, synthetic construct
  misc_feature 1..20: note = CRISPR gRNA sequence
  source 1..20: mol_type = other DNA
cgatcttgaactaggggctt

SEQ ID NO: 31255 - DNA, 20 bp, synthetic construct
  misc_feature 1..20: note = CRISPR gRNA sequence
  source 1..20: mol_type = other DNA
gaactaggggctttttcagc

SEQ ID NO: 31256 - DNA, 20 bp, synthetic construct
  misc_feature 1..20: note = CRISPR gRNA sequence
  source 1..20: mol_type = other DNA
aactaggggctttttcagct

SEQ ID NO: 31257 - DNA, 20 bp, synthetic construct
  misc_feature 1..20: note = CRISPR gRNA sequence
  source 1..20: mol_type = other DNA
ggggctttttcagctgaaaa

SEQ ID NO: 31258 - DNA, 20 bp, synthetic construct
  misc_feature 1..20: note = CRISPR gRNA sequence
  source 1..20: mol_type = other DNA
tttcagctgaaaataattta

SEQ ID NO: 31259 - DNA, 20 bp, synthetic construct
  misc_feature 1..20: note = CRISPR gRNA sequence
  source 1..20: mol_type = other DNA
ttcagctgaaaataatttaa

SEQ ID NO: 31260 - DNA, 20 bp, synthetic construct
  misc_feature 1..20: note = CRISPR gRNA sequence
  source 1..20: mol_type = other DNA
tcagctgaaaataatttaag

SEQ ID NO: 31261 - DNA, 20 bp, synthetic construct
  misc_feature 1..20: note = CRISPR gRNA sequence
  source 1..20: mol_type = other DNA
cagctgaaaataatttaagg

SEQ ID NO: 31262 - DNA, 20 bp, synthetic construct
  misc_feature 1..20: note = CRISPR gRNA sequence
  source 1..20: mol_type = other DNA
agctgaaaataatttaaggc

SEQ ID NO: 31263 - DNA, 20 bp, synthetic construct
  misc_feature 1..20: note = CRISPR gRNA sequence
  source 1..20: mol_type = other DNA
aaaataatttaaggccagaa

SEQ ID NO: 31264 - DNA, 20 bp, synthetic construct
  misc_feature 1..20: note = CRISPR gRNA sequence
  source 1..20: mol_type = other DNA
aaggccagaaagggccctca

SEQ ID NO: 31265 - DNA, 20 bp, synthetic construct
  misc_feature 1..20: note = CRISPR gRNA sequence
  source 1..20: mol_type = other DNA
aggccagaaagggccctcag

SEQ ID NO: 31266 - DNA, 20 bp, synthetic construct
  misc_feature 1..20: note = CRISPR gRNA sequence
  source 1..20: mol_type = other DNA
agttattgttttcagacatt

SEQ ID NO: 31267 - DNA, 20 bp, synthetic construct
  misc_feature 1..20: note = CRISPR gRNA sequence
  source 1..20: mol_type = other DNA
ttgttttcagacatttcccc

SEQ ID NO: 31268 - DNA, 20 bp, synthetic construct
  misc_feature 1..20: note = CRISPR gRNA sequence
  source 1..20: mol_type = other DNA
ttttcagacatttccccttt

SEQ ID NO: 31269 - DNA, 20 bp, synthetic construct
  misc_feature 1..20: note = CRISPR gRNA sequence
  source 1..20: mol_type = other DNA
tcagacatttccccttttca

SEQ ID NO: 31270 - DNA, 20 bp, synthetic construct
  misc_feature 1..20: note = CRISPR gRNA sequence
  source 1..20: mol_type = other DNA
cagacatttccccttttcag

SEQ ID NO: 31271 - DNA, 20 bp, synthetic construct
  misc_feature 1..20: note = CRISPR gRNA sequence
  source 1..20: mol_type = other DNA
agacatttccccttttcagc

SEQ ID NO: 31272 - DNA, 20 bp, synthetic construct
  misc_feature 1..20: note = CRISPR gRNA sequence
  source 1..20: mol_type = other DNA
ccccttttcagcatcatttt

SEQ ID NO: 31273 - DNA, 20 bp, synthetic construct
  misc_feature 1..20: note = CRISPR gRNA sequence
  source 1..20: mol_type = other DNA
cccttttcagcatcattttt

SEQ ID NO: 31274 - DNA, 20 bp, synthetic construct
  misc_feature 1..20: note = CRISPR gRNA sequence
  source 1..20: mol_type = other DNA
ttcagcatcatttttacctc

SEQ ID NO: 31275 - DNA, 20 bp, synthetic construct
  misc_feature 1..20: note = CRISPR gRNA sequence
  source 1..20: mol_type = other DNA
tcagcatcatttttacctct

SEQ ID NO: 31276 - DNA, 20 bp, synthetic construct
  misc_feature 1..20: note = CRISPR gRNA sequence
  source 1..20: mol_type = other DNA
cagcatcatttttacctctg

SEQ ID NO: 31277 - DNA, 20 bp, synthetic construct
  misc_feature 1..20: note = CRISPR gRNA sequence
  source 1..20: mol_type = other DNA
agcatcatttttacctctgg

SEQ ID NO: 31278 - DNA, 20 bp, synthetic construct
  misc_feature 1..20: note = CRISPR gRNA sequence
  source 1..20: mol_type = other DNA
ttacctctggacaaatttag

SEQ ID NO: 31279 - DNA, 20 bp, synthetic construct
  misc_feature 1..20: note = CRISPR gRNA sequence
  source 1..20: mol_type = other DNA
tacctctggacaaatttagc

SEQ ID NO: 31280 - DNA, 20 bp, synthetic construct
  misc_feature 1..20: note = CRISPR gRNA sequence
  source 1..20: mol_type = other DNA
acctctggacaaatttagca

SEQ ID NO: 31281 - DNA, 20 bp, synthetic construct
  misc_feature 1..20: note = CRISPR gRNA sequence
  source 1..20: mol_type = other DNA
cctctggacaaatttagcac

SEQ ID NO: 31282 - DNA, 20 bp, synthetic construct
  misc_feature 1..20: note = CRISPR gRNA sequence
  source 1..20: mol_type = other DNA
tggacaaatttagcaccttg

SEQ ID NO: 31283 - DNA, 20 bp, synthetic construct
  misc_feature 1..20: note = CRISPR gRNA sequence
  source 1..20: mol_type = other DNA
gacaaatttagcaccttgtc

SEQ ID NO: 31284 - DNA, 20 bp, synthetic construct
  misc_feature 1..20: note = CRISPR gRNA sequence
  source 1..20: mol_type = other DNA
agcaccttgtctctgttcaa

SEQ ID NO: 31285 - DNA, 20 bp, synthetic construct
  misc_feature 1..20: note = CRISPR gRNA sequence
  source 1..20: mol_type = other DNA
gcaccttgtctctgttcaaa

SEQ ID NO: 31286 - DNA, 20 bp, synthetic construct
  misc_feature 1..20: note = CRISPR gRNA sequence
  source 1..20: mol_type = other DNA
gtctctgttcaaaacaagag

SEQ ID NO: 31287 - DNA, 20 bp, synthetic construct
  misc_feature 1..20: note = CRISPR gRNA sequence
  source 1..20: mol_type = other DNA
tctctgttcaaaacaagaga

SEQ ID NO: 31288 - DNA, 20 bp, synthetic construct
  misc_feature 1..20: note = CRISPR gRNA sequence
  source 1..20: mol_type = other DNA
tgttcaaaacaagagacact

SEQ ID NO: 31289 - DNA, 20 bp, synthetic construct
  misc_feature 1..20: note = CRISPR gRNA sequence
  source 1..20: mol_type = other DNA
ttcaaaacaagagacactgg

SEQ ID NO: 31290 - DNA, 20 bp, synthetic construct
  misc_feature 1..20: note = CRISPR gRNA sequence
  source 1..20: mol_type = other DNA
aaaacaagagacactggctt

SEQ ID NO: 31291 - DNA, 20 bp, synthetic construct
  misc_feature 1..20: note = CRISPR gRNA sequence
  source 1..20: mol_type = other DNA
gcttttttctggggcacagg

SEQ ID NO: 31292 - DNA, 20 bp, synthetic construct
  misc_feature 1..20: note = CRISPR gRNA sequence
  source 1..20: mol_type = other DNA
ttttctggggcacaggggag

SEQ ID NO: 31293 - DNA, 20 bp, synthetic construct
  misc_feature 1..20: note = CRISPR gRNA sequence
  source 1..20: mol_type = other DNA
tttctggggcacaggggagc

SEQ ID NO: 31294 - DNA, 20 bp, synthetic construct
  misc_feature 1..20: note = CRISPR gRNA sequence
  source 1..20: mol_type = other DNA
ttctggggcacaggggagca

SEQ ID NO: 31295 - DNA, 20 bp, synthetic construct
  misc_feature 1..20: note = CRISPR gRNA sequence
  source 1..20: mol_type = other DNA
tctggggcacaggggagcag

SEQ ID NO: 31296 - DNA, 20 bp, synthetic construct
  misc_feature 1..20: note = CRISPR gRNA sequence
  source 1..20: mol_type = other DNA
ctggggcacaggggagcagt

SEQ ID NO: 31297 - DNA, 20 bp, synthetic construct
  misc_feature 1..20: note = CRISPR gRNA sequence
  source 1..20: mol_type = other DNA
tggggcacaggggagcagtg

SEQ ID NO: 31298 - DNA, 20 bp, synthetic construct
  misc_feature 1..20: note = CRISPR gRNA sequence
  source 1..20: mol_type = other DNA
gggcacaggggagcagtgat

SEQ ID NO: 31299 - DNA, 20 bp, synthetic construct
  misc_feature 1..20: note = CRISPR gRNA sequence
  source 1..20: mol_type = other DNA
atagcttgtgggtgaccagc

SEQ ID NO: 31300 - DNA, 20 bp, synthetic construct
  misc_feature 1..20: note = CRISPR gRNA sequence
  source 1..20: mol_type = other DNA
gtgggtgaccagctggggga

SEQ ID NO: 31301 - DNA, 20 bp, synthetic construct
  misc_feature 1..20: note = CRISPR gRNA sequence
  source 1..20: mol_type = other DNA
tgggtgaccagctgggggac

SEQ ID NO: 31302 - DNA, 20 bp, synthetic construct
  misc_feature 1..20: note = CRISPR gRNA sequence
  source 1..20: mol_type = other DNA
ggggaccacgggcaagtcac

SEQ ID NO: 31303 - DNA, 20 bp, synthetic construct
  misc_feature 1..20: note = CRISPR gRNA sequence
  source 1..20: mol_type = other DNA
aacctcaccaggcctccgtc

SEQ ID NO: 31304 - DNA, 20 bp, synthetic construct
  misc_feature 1..20: note = CRISPR gRNA sequence
  source 1..20: mol_type = other DNA
acctcaccaggcctccgtct

SEQ ID NO: 31305 - DNA, 20 bp, synthetic construct
  misc_feature 1..20: note = CRISPR gRNA sequence
  source 1..20: mol_type = other DNA
accaggcctccgtctcctca

SEQ ID NO: 31306 - DNA, 20 bp, synthetic construct
  misc_feature 1..20: note = CRISPR gRNA sequence
  source 1..20: mol_type = other DNA
cgtctcctcatctgtaaaat

SEQ ID NO: 31307 - DNA, 20 bp, synthetic construct
  misc_feature 1..20: note = CRISPR gRNA sequence
  source 1..20: mol_type = other DNA
ctcatctgtaaaatggggaa

SEQ ID NO: 31308 - DNA, 20 bp, synthetic construct
  misc_feature 1..20: note = CRISPR gRNA sequence
  source 1..20: mol_type = other DNA
atctgtaaaatggggaagat

SEQ ID NO: 31309 - DNA, 20 bp, synthetic construct
  misc_feature 1..20: note = CRISPR gRNA sequence
  source 1..20: mol_type = other DNA
taaaatggggaagatgatga

SEQ ID NO: 31310 - DNA, 20 bp, synthetic construct
  misc_feature 1..20: note = CRISPR gRNA sequence
  source 1..20: mol_type = other DNA
tctgtcttccacagtagctc

SEQ ID NO: 31311 - DNA, 20 bp, synthetic construct
  misc_feature 1..20: note = CRISPR gRNA sequence
  source 1..20: mol_type = other DNA
tcttccacagtagctcttga

SEQ ID NO: 31312 - DNA, 20 bp, synthetic construct
  misc_feature 1..20: note = CRISPR gRNA sequence
  source 1..20: mol_type = other DNA
ccacagtagctcttgagatt

SEQ ID NO: 31313 - DNA, 20 bp, synthetic construct
  misc_feature 1..20: note = CRISPR gRNA sequence
  source 1..20: mol_type = other DNA
cacagtagctcttgagatta

SEQ ID NO: 31314 - DNA, 20 bp, synthetic construct
  misc_feature 1..20: note = CRISPR gRNA sequence
  source 1..20: mol_type = other DNA
ttgagattaatgagattata

SEQ ID NO: 31315 - DNA, 20 bp, synthetic construct
  misc_feature 1..20: note = CRISPR gRNA sequence
  source 1..20: mol_type = other DNA
gagattaatgagattatata

SEQ ID NO: 31316 - DNA, 20 bp, synthetic construct
  misc_feature 1..20: note = CRISPR gRNA sequence
  source 1..20: mol_type = other DNA
agattaatgagattatatat

SEQ ID NO: 31317 - DNA, 20 bp, synthetic construct
  misc_feature 1..20: note = CRISPR gRNA sequence
  source 1..20: mol_type = other DNA
atgagattatatataaaatg

SEQ ID NO: 31318 - DNA, 20 bp, synthetic construct
  misc_feature 1..20: note = CRISPR gRNA sequence
  source 1..20: mol_type = other DNA
tatataaaatgcactgaatt

SEQ ID NO: 31319 - DNA, 20 bp, synthetic construct
  misc_feature 1..20: note = CRISPR gRNA sequence
  source 1..20: mol_type = other DNA
aattataagctgggcatggt

SEQ ID NO: 31320 - DNA, 20 bp, synthetic construct
  misc_feature 1..20: note = CRISPR gRNA sequence
  source 1..20: mol_type = other DNA
taagctgggcatggtggctt

SEQ ID NO: 31321 - DNA, 20 bp, synthetic construct
  misc_feature 1..20: note = CRISPR gRNA sequence
  source 1..20: mol_type = other DNA
ggcatggtggcttacacctg

SEQ ID NO: 31322 - DNA, 20 bp, synthetic construct
  misc_feature 1..20: note = CRISPR gRNA sequence
  source 1..20: mol_type = other DNA
acacctgtaatcccagcact

SEQ ID NO: 31323 - DNA, 20 bp, synthetic construct
  misc_feature 1..20: note = CRISPR gRNA sequence
  source 1..20: mol_type = other DNA
cacctgtaatcccagcactt

SEQ ID NO: 31324 - DNA, 20 bp, synthetic construct
  misc_feature 1..20: note = CRISPR gRNA sequence
  source 1..20: mol_type = other DNA
taatcccagcactttgggag

SEQ ID NO: 31325 - DNA, 20 bp, synthetic construct
  misc_feature 1..20: note = CRISPR gRNA sequence
  source 1..20: mol_type = other DNA
tgggaggctgaggtgggagg

SEQ ID NO: 31326 - DNA, 20 bp, synthetic construct
  misc_feature 1..20: note = CRISPR gRNA sequence
  source 1..20: mol_type = other DNA
gggaggctgaggtgggagga

SEQ ID NO: 31327 - DNA, 20 bp, synthetic construct
  misc_feature 1..20: note = CRISPR gRNA sequence
  source 1..20: mol_type = other DNA
ggaggctgaggtgggaggaa

SEQ ID NO: 31328 - DNA, 20 bp, synthetic construct
  misc_feature 1..20: note = CRISPR gRNA sequence
  source 1..20: mol_type = other DNA
aggtgggaggaacatctgag

SEQ ID NO: 31329 - DNA, 20 bp, synthetic construct
  misc_feature 1..20: note = CRISPR gRNA sequence
  source 1..20: mol_type = other DNA
aggccaggagttcaagacca

SEQ ID NO: 31330 - DNA, 20 bp, synthetic construct
  misc_feature 1..20: note = CRISPR gRNA sequence
  source 1..20: mol_type = other DNA
aagaccagcctggccaacat

SEQ ID NO: 31331 - DNA, 20 bp, synthetic construct
  misc_feature 1..20: note = CRISPR gRNA sequence
  source 1..20: mol_type = other DNA
gccaacatggttaaagcccg

SEQ ID NO: 31332 - DNA, 20 bp, synthetic construct
  misc_feature 1..20: note = CRISPR gRNA sequence
  source 1..20: mol_type = other DNA
aagcccgtctctactaaaaa

SEQ ID NO: 31333 - DNA, 20 bp, synthetic construct
  misc_feature 1..20: note = CRISPR gRNA sequence
  source 1..20: mol_type = other DNA
tactaaaaatacaaaaatta

SEQ ID NO: 31334 - DNA, 20 bp, synthetic construct
  misc_feature 1..20: note = CRISPR gRNA sequence
  source 1..20: mol_type = other DNA
ctaaaaatacaaaaattagc

SEQ ID NO: 31335 - DNA, 20 bp, synthetic construct
  misc_feature 1..20: note = CRISPR gRNA sequence
  source 1..20: mol_type = other DNA
aaaatacaaaaattagccag

SEQ ID NO: 31336 - DNA, 20 bp, synthetic construct
  misc_feature 1..20: note = CRISPR gRNA sequence
  source 1..20: mol_type = other DNA
gccaggtgtagtggtgtaca

SEQ ID NO: 31337 - DNA, 20 bp, synthetic construct
  misc_feature 1..20: note = CRISPR gRNA sequence
  source 1..20: mol_type = other DNA
taatcccagctactcgggag

SEQ ID NO: 31338 - DNA, 20 bp, synthetic construct
  misc_feature 1..20: note = CRISPR gRNA sequence
  source 1..20: mol_type = other DNA
ctcgggaggctgaggcagga

SEQ ID NO: 31339 - DNA, 20 bp, synthetic construct
  misc_feature 1..20: note = CRISPR gRNA sequence
  source 1..20: mol_type = other DNA
gggaggctgaggcaggaaaa

SEQ ID NO: 31340 - DNA, 20 bp, synthetic construct
  misc_feature 1..20: note = CRISPR gRNA sequence
  source 1..20: mol_type = other DNA
aggcaggaaaattgcttgaa

SEQ ID NO: 31341 - DNA, 20 bp, synthetic construct
  misc_feature 1..20: note = CRISPR gRNA sequence
  source 1..20: mol_type = other DNA
cttgaaccgagaggtggaga

SEQ ID NO: 31342 - DNA, 20 bp, synthetic construct
  misc_feature 1..20: note = CRISPR gRNA sequence
  source 1..20: mol_type = other DNA
gaaccgagaggtggagattg

SEQ ID NO: 31343 - DNA, 20 bp, synthetic construct
  misc_feature 1..20: note = CRISPR gRNA sequence
  source 1..20: mol_type = other DNA
aaccgagaggtggagattgc

SEQ ID NO: 31344 - DNA, 20 bp, synthetic construct
  misc_feature 1..20: note = CRISPR gRNA sequence
  source 1..20: mol_type = other DNA
cagtgagccaagatcatacc

SEQ ID NO: 31345 - DNA, 20 bp, synthetic construct
  misc_feature 1..20: note = CRISPR gRNA sequence
  source 1..20: mol_type = other DNA
cattctagcctgggtgacag

SEQ ID NO: 31346 - DNA, 20 bp, synthetic construct
  misc_feature 1..20: note = CRISPR gRNA sequence
  source 1..20: mol_type = other DNA
tagcctgggtgacagagcaa

SEQ ID NO: 31347 - DNA, 20 bp, synthetic construct
  misc_feature 1..20: note = CRISPR gRNA sequence
  source 1..20: mol_type = other DNA
gcctgggtgacagagcaaga

SEQ ID NO: 31348 - DNA, 20 bp, synthetic construct
  misc_feature 1..20: note = CRISPR gRNA sequence
  source 1..20: mol_type = other DNA
ggtgacagagcaagacccca

SEQ ID NO: 31349 - DNA, 20 bp, synthetic construct
  misc_feature 1..20: note = CRISPR gRNA sequence
  source 1..20: mol_type = other DNA
caaaaaaaaacagcaccgaa

SEQ ID NO: 31350 - DNA, 20 bp, synthetic construct
  misc_feature 1..20: note = CRISPR gRNA sequence
  source 1..20: mol_type = other DNA
cttcctaatcattagatgat

SEQ ID NO: 31351 - DNA, 20 bp, synthetic construct
  misc_feature 1..20: note = CRISPR gRNA sequence
  source 1..20: mol_type = other DNA
cctaatcattagatgatcta

SEQ ID NO: 31352 - DNA, 20 bp, synthetic construct
  misc_feature 1..20: note = CRISPR gRNA sequence
  source 1..20: mol_type = other DNA
ctaatcattagatgatctag

SEQ ID NO: 31353 - DNA, 20 bp, synthetic construct
  misc_feature 1..20: note = CRISPR gRNA sequence
  source 1..20: mol_type = other DNA
atcattagatgatctagacc

SEQ ID NO: 31354 - DNA, 20 bp, synthetic construct
  misc_feature 1..20: note = CRISPR gRNA sequence
  source 1..20: mol_type = other DNA
gatgatctagacccctacca

SEQ ID NO: 31355 - DNA, 20 bp, synthetic construct
  misc_feature 1..20: note = CRISPR gRNA sequence
  source 1..20: mol_type = other DNA
gacccctaccaaggaacaaa

SEQ ID NO: 31356 - DNA, 20 bp, synthetic construct
  misc_feature 1..20: note = CRISPR gRNA sequence
  source 1..20: mol_type = other DNA
ccaaggaacaaacattcatt

SEQ ID NO: 31357 - DNA, 20 bp, synthetic construct
  misc_feature 1..20: note = CRISPR gRNA sequence
  source 1..20: mol_type = other DNA
atttagctttttctgtggaa

SEQ ID NO: 31358 - DNA, 20 bp, synthetic construct
  misc_feature 1..20: note = CRISPR gRNA sequence
  source 1..20: mol_type = other DNA
agctttttctgtggaaggag

SEQ ID NO: 31359 - DNA, 20 bp, synthetic construct
  misc_feature 1..20: note = CRISPR gRNA sequence
  source 1..20: mol_type = other DNA
gctttttctgtggaaggagc

SEQ ID NO: 31360 - DNA, 20 bp, synthetic construct
  misc_feature 1..20: note = CRISPR gRNA sequence
  source 1..20: mol_type = other DNA
tttctgtggaaggagcttag

SEQ ID NO: 31361 - DNA, 20 bp, synthetic construct
  misc_feature 1..20: note = CRISPR gRNA sequence
  source 1..20: mol_type = other DNA
ttctgtggaaggagcttagg

SEQ ID NO: 31362 - DNA, 20 bp, synthetic construct
  misc_feature 1..20: note = CRISPR gRNA sequence
  source 1..20: mol_type = other DNA
tctgtggaaggagcttaggg

SEQ ID NO: 31363 - DNA, 20 bp, synthetic construct
  misc_feature 1..20: note = CRISPR gRNA sequence
  source 1..20: mol_type = other DNA
ctgtggaaggagcttagggc

SEQ ID NO: 31364 - DNA, 20 bp, synthetic construct
  misc_feature 1..20: note = CRISPR gRNA sequence
  source 1..20: mol_type = other DNA
tgtggaaggagcttagggcc

SEQ ID NO: 31365 - DNA, 20 bp, synthetic construct
  misc_feature 1..20: note = CRISPR gRNA sequence
  source 1..20: mol_type = other DNA
tggaaggagcttagggccag

SEQ ID NO: 31366 - DNA, 20 bp, synthetic construct
  misc_feature 1..20: note = CRISPR gRNA sequence
  source 1..20: mol_type = other DNA
agggccaggctgacctgacc

SEQ ID NO: 31367 - DNA, 20 bp, synthetic construct
  misc_feature 1..20: note = CRISPR gRNA sequence
  source 1..20: mol_type = other DNA
gggccaggctgacctgacct

SEQ ID NO: 31368 - DNA, 20 bp, synthetic construct
  misc_feature 1..20: note = CRISPR gRNA sequence
  source 1..20: mol_type = other DNA
acctgacctttatgactttg

SEQ ID NO: 31369 - DNA, 20 bp, synthetic construct
  misc_feature 1..20: note = CRISPR gRNA sequence
  source 1..20: mol_type = other DNA
acctttatgactttggataa

SEQ ID NO: 31370 - DNA, 20 bp, synthetic construct
  misc_feature 1..20: note = CRISPR gRNA sequence
  source 1..20: mol_type = other DNA
tatgactttggataaacaat

SEQ ID NO: 31371 - DNA, 20 bp, synthetic construct
  misc_feature 1..20: note = CRISPR gRNA sequence
  source 1..20: mol_type = other DNA
atgactttggataaacaatt

SEQ ID NO: 31372 - DNA, 20 bp, synthetic construct
  misc_feature 1..20: note = CRISPR gRNA sequence
  source 1..20: mol_type = other DNA
tgactttggataaacaattt

SEQ ID NO: 31373 - DNA, 20 bp, synthetic construct
  misc_feature 1..20: note = CRISPR gRNA sequence
  source 1..20: mol_type = other DNA
tggataaacaatttaaagtc

SEQ ID NO: 31374 - DNA, 20 bp, synthetic construct
  misc_feature 1..20: note = CRISPR gRNA sequence
  source 1..20: mol_type = other DNA
ggataaacaatttaaagtct

SEQ ID NO: 31375 - DNA, 20 bp, synthetic construct
  misc_feature 1..20: note = CRISPR gRNA sequence
  source 1..20: mol_type = other DNA
gataaacaatttaaagtctc

SEQ ID NO: 31376 - DNA, 20 bp, synthetic construct
  misc_feature 1..20: note = CRISPR gRNA sequence
  source 1..20: mol_type = other DNA
aaagtctcttgttctcagca

SEQ ID NO: 31377 - DNA, 20 bp, synthetic construct
  misc_feature 1..20: note = CRISPR gRNA sequence
  source 1..20: mol_type = other DNA
aagtctcttgttctcagcat

SEQ ID NO: 31378 - DNA, 20 bp, synthetic construct
  misc_feature 1..20: note = CRISPR gRNA sequence
  source 1..20: mol_type = other DNA
ttgttctcagcattgccatt

SEQ ID NO: 31379 - DNA, 20 bp, synthetic construct
  misc_feature 1..20: note = CRISPR gRNA sequence
  source 1..20: mol_type = other DNA
gttctcagcattgccatttg

SEQ ID NO: 31380 - DNA, 20 bp, synthetic construct
  misc_feature 1..20: note = CRISPR gRNA sequence
  source 1..20: mol_type = other DNA
ttctcagcattgccatttgt

SEQ ID NO: 31381 - DNA, 20 bp, synthetic construct
  misc_feature 1..20: note = CRISPR gRNA sequence
  source 1..20: mol_type = other DNA
tcagcattgccatttgtaca

SEQ ID NO: 31382 - DNA, 20 bp, synthetic construct
  misc_feature 1..20: note = CRISPR gRNA sequence
  source 1..20: mol_type = other DNA
agcattgccatttgtacaat

SEQ ID NO: 31383 - DNA, 20 bp, synthetic construct
  misc_feature 1..20: note = CRISPR gRNA sequence
  source 1..20: mol_type = other DNA
ccatttgtacaatggggaga

SEQ ID NO: 31384 - DNA, 20 bp, synthetic construct
  misc_feature 1..20: note = CRISPR gRNA sequence
  source 1..20: mol_type = other DNA
gtacaatggggagatgatga

SEQ ID NO: 31385 - DNA, 20 bp, synthetic construct
  misc_feature 1..20: note = CRISPR gRNA sequence
  source 1..20: mol_type = other DNA
tacaatggggagatgatgac

SEQ ID NO: 31386 - DNA, 20 bp, synthetic construct
  misc_feature 1..20: note = CRISPR gRNA sequence
  source 1..20: mol_type = other DNA
tagaggagggtggcctgaga

SEQ ID NO: 31387 - DNA, 20 bp, synthetic construct
  misc_feature 1..20: note = CRISPR gRNA sequence
  source 1..20: mol_type = other DNA
agataattgagatggaaggt

SEQ ID NO: 31388 - DNA, 20 bp, synthetic construct
  misc_feature 1..20: note = CRISPR gRNA sequence
  source 1..20: mol_type = other DNA
agatggaaggtgagctgcaa

SEQ ID NO: 31389 - DNA, 20 bp, synthetic construct
  misc_feature 1..20: note = CRISPR gRNA sequence
  source 1..20: mol_type = other DNA
caaatttaaaagcctgttct

SEQ ID NO: 31390 - DNA, 20 bp, synthetic construct
  misc_feature 1..20: note = CRISPR gRNA sequence
  source 1..20: mol_type = other DNA
aaaagcctgttctggccagg

SEQ ID NO: 31391 - DNA, 20 bp, synthetic construct
  misc_feature 1..20: note = CRISPR gRNA sequence
  source 1..20: mol_type = other DNA
aaagcctgttctggccaggt

SEQ ID NO: 31392 - DNA, 20 bp, synthetic construct
  misc_feature 1..20: note = CRISPR gRNA sequence
  source 1..20: mol_type = other DNA
ttctggccaggtgcgggagc

SEQ ID NO: 31393 - DNA, 20 bp, synthetic construct
  misc_feature 1..20: note = CRISPR gRNA sequence
  source 1..20: mol_type = other DNA
tggccaggtgcgggagctcg

SEQ ID NO: 31394 - DNA, 20 bp, synthetic construct
  misc_feature 1..20: note = CRISPR gRNA sequence
  source 1..20: mol_type = other DNA
gccaggtgcgggagctcgca

SEQ ID NO: 31395 - DNA, 20 bp, synthetic construct
  misc_feature 1..20: note = CRISPR gRNA sequence
  source 1..20: mol_type = other DNA
gcacctgtaatcctagcact

SEQ ID NO: 31396 - DNA, 20 bp, synthetic construct
  misc_feature 1..20: note = CRISPR gRNA sequence
  source 1..20: mol_type = other DNA
taatcctagcactttgggag

SEQ ID NO: 31397 - DNA, 20 bp, synthetic construct
  misc_feature 1..20: note = CRISPR gRNA sequence
  source 1..20: mol_type = other DNA
gcactttgggaggctgaggt

SEQ ID NO: 31398 - DNA, 20 bp, synthetic construct
  misc_feature 1..20: note = CRISPR gRNA sequence
  source 1..20: mol_type = other DNA
tgggaggctgaggtgggagg

SEQ ID NO: 31399 - DNA, 20 bp, synthetic construct
  misc_feature 1..20: note = CRISPR gRNA sequence
  source 1..20: mol_type = other DNA
gggaggctgaggtgggagga

SEQ ID NO: 31400 - DNA, 20 bp, synthetic construct
  misc_feature 1..20: note = CRISPR gRNA sequence
  source 1..20: mol_type = other DNA
ggaggctgaggtgggaggat

SEQ ID NO: 31401 - DNA, 20 bp, synthetic construct
  misc_feature 1..20: note = CRISPR gRNA sequence
  source 1..20: mol_type = other DNA
aggtgggaggattgcttgag

SEQ ID NO: 31402 - DNA, 20 bp, synthetic construct
  misc_feature 1..20: note = CRISPR gRNA sequence
  source 1..20: mol_type = other DNA
cttgagcccaggagctcgag

SEQ ID NO: 31403 - DNA, 20 bp, synthetic construct
  misc_feature 1..20: note = CRISPR gRNA sequence
  source 1..20: mol_type = other DNA
gagcccaggagctcgagacc

SEQ ID NO: 31404 - DNA, 20 bp, synthetic construct
  misc_feature 1..20: note = CRISPR gRNA sequence
  source 1..20: mol_type = other DNA
agcccaggagctcgagacca

SEQ ID NO: 31405 - DNA, 20 bp, synthetic construct
  misc_feature 1..20: note = CRISPR gRNA sequence
  source 1..20: mol_type = other DNA
gagaccagactgggcaacat

SEQ ID NO: 31406 - DNA, 20 bp, synthetic construct
  misc_feature 1..20: note = CRISPR gRNA sequence
  source 1..20: mol_type = other DNA
ggcaacatggtgaaatcctg

SEQ ID NO: 31407 - DNA, 20 bp, synthetic construct
  misc_feature 1..20: note = CRISPR gRNA sequence
  source 1..20: mol_type = other DNA
tctctacaaaaaatacaaaa

SEQ ID NO: 31408 - DNA, 20 bp, synthetic construct
  misc_feature 1..20: note = CRISPR gRNA sequence
  source 1..20: mol_type = other DNA
tacaaaaaatacaaaaatta

SEQ ID NO: 31409 - DNA, 20 bp, synthetic construct
  misc_feature 1..20: note = CRISPR gRNA sequence
  source 1..20: mol_type = other DNA
caaaaaatacaaaaattagt

SEQ ID NO: 31410 - DNA, 20 bp, synthetic construct
  misc_feature 1..20: note = CRISPR gRNA sequence
  source 1..20: mol_type = other DNA
gtcaggtggggcatgcctgt

SEQ ID NO: 31411 - DNA, 20 bp, synthetic construct
  misc_feature 1..20: note = CRISPR gRNA sequence
  source 1..20: mol_type = other DNA
tagtcccagctactagggag

SEQ ID NO: 31412 - DNA, 20 bp, synthetic construct
  misc_feature 1..20: note = CRISPR gRNA sequence
  source 1..20: mol_type = other DNA
ctagggaggctgaggtggga

SEQ ID NO: 31413 - DNA, 20 bp, synthetic construct
  misc_feature 1..20: note = CRISPR gRNA sequence
  source 1..20: mol_type = other DNA
gggaggctgaggtgggagga

SEQ ID NO: 31414 - DNA, 20 bp, synthetic construct
  misc_feature 1..20: note = CRISPR gRNA sequence
  source 1..20: mol_type = other DNA
aggtgggaggatcacttgag

SEQ ID NO: 31415 - DNA, 20 bp, synthetic construct
  misc_feature 1..20: note = CRISPR gRNA sequence
  source 1..20: mol_type = other DNA
gagcctagggaggttgaggc

SEQ ID NO: 31416 - DNA, 20 bp, synthetic construct
  misc_feature 1..20: note = CRISPR gRNA sequence
  source 1..20: mol_type = other DNA
agcctagggaggttgaggct

SEQ ID NO: 31417 - DNA, 20 bp, synthetic construct
  misc_feature 1..20: note = CRISPR gRNA sequence
  source 1..20: mol_type = other DNA
gggaggttgaggctgtggtg

SEQ ID NO: 31418 - DNA, 20 bp, synthetic construct
  misc_feature 1..20: note = CRISPR gRNA sequence
  source 1..20: mol_type = other DNA
aggctgtggtgagctgtgat

SEQ ID NO: 31419 - DNA, 20 bp, synthetic construct
  misc_feature 1..20: note = CRISPR gRNA sequence
  source 1..20: mol_type = other DNA
tggtgagctgtgattgtgcc

SEQ ID NO: 31420 - DNA, 20 bp, synthetic construct
  misc_feature 1..20: note = CRISPR gRNA sequence
  source 1..20: mol_type = other DNA
tgattgtgccactgaactcc

SEQ ID NO: 31421 - DNA, 20 bp, synthetic construct
  misc_feature 1..20: note = CRISPR gRNA sequence
  source 1..20: mol_type = other DNA
tgccactgaactccagcctg

SEQ ID NO: 31422 - DNA, 20 bp, synthetic construct
  misc_feature 1..20: note = CRISPR gRNA sequence
  source 1..20: mol_type = other DNA
aactccagcctgagggacag

SEQ ID NO: 31423 - DNA, 20 bp, synthetic construct
  misc_feature 1..20: note = CRISPR gRNA sequence
  source 1..20: mol_type = other DNA
cagcctgagggacagagtaa

SEQ ID NO: 31424 - DNA, 20 bp, synthetic construct
  misc_feature 1..20: note = CRISPR gRNA sequence
  source 1..20: mol_type = other DNA
agggacagagtaagactctg

SEQ ID NO: 31425 - DNA, 20 bp, synthetic construct
  misc_feature 1..20: note = CRISPR gRNA sequence
  source 1..20: mol_type = other DNA
tgcctcaagaaagaaaagaa

SEQ ID NO: 31426 - DNA, 20 bp, synthetic construct
  misc_feature 1..20: note = CRISPR gRNA sequence
  source 1..20: mol_type = other DNA
cctcaagaaagaaaagaaaa

SEQ ID NO: 31427 - DNA, 20 bp, synthetic construct
  misc_feature 1..20: note = CRISPR gRNA sequence
  source 1..20: mol_type = other DNA
aagaaagaaaagaaaaggaa

SEQ ID NO: 31428 - DNA, 20 bp, synthetic construct
  misc_feature 1..20: note = CRISPR gRNA sequence
  source 1..20: mol_type = other DNA
tattctgacagatctaaata

SEQ ID NO: 31429 - DNA, 20 bp, synthetic construct
  misc_feature 1..20: note = CRISPR gRNA sequence
  source 1..20: mol_type = other DNA
tgacagatctaaatataata

SEQ ID NO: 31430 - DNA, 20 bp, synthetic construct
  misc_feature 1..20: note = CRISPR gRNA sequence
  source 1..20: mol_type = other DNA
acagatctaaatataataat

SEQ ID NO: 31431 - DNA, 20 bp, synthetic construct
  misc_feature 1..20: note = CRISPR gRNA sequence
  source 1..20: mol_type = other DNA
aatataataattattgtgct

SEQ ID NO: 31432 - DNA, 20 bp, synthetic construct
  misc_feature 1..20: note = CRISPR gRNA sequence
  source 1..20: mol_type = other DNA
ttgtgctttcttggggccca

SEQ ID NO: 31433 - DNA, 20 bp, synthetic construct
  misc_feature 1..20: note = CRISPR gRNA sequence
  source 1..20: mol_type = other DNA
tgctttcttggggcccatgt

SEQ ID NO: 31434 - DNA, 20 bp, synthetic construct
  misc_feature 1..20: note = CRISPR gRNA sequence
  source 1..20: mol_type = other DNA
tcttggggcccatgtatggt

SEQ ID NO: 31435 - DNA, 20 bp, synthetic construct
  misc_feature 1..20: note = CRISPR gRNA sequence
  source 1..20: mol_type = other DNA
cttggggcccatgtatggtg

SEQ ID NO: 31436 - DNA, 20 bp, synthetic construct
  misc_feature 1..20: note = CRISPR gRNA sequence
  source 1..20: mol_type = other DNA
ttggggcccatgtatggtgg

SEQ ID NO: 31437 - DNA, 20 bp, synthetic construct
  misc_feature 1..20: note = CRISPR gRNA sequence
  source 1..20: mol_type = other DNA
ggggcccatgtatggtgggc

SEQ ID NO: 31438 - DNA, 20 bp, synthetic construct
  misc_feature 1..20: note = CRISPR gRNA sequence
  source 1..20: mol_type = other DNA
gggcccatgtatggtgggct

SEQ ID NO: 31439 - DNA, 20 bp, synthetic construct
  misc_feature 1..20: note = CRISPR gRNA sequence
  source 1..20: mol_type = other DNA
cccctcctcagtgacccaga

SEQ ID NO: 31440 - DNA, 20 bp, synthetic construct
  misc_feature 1..20: note = CRISPR gRNA sequence
  source 1..20: mol_type = other DNA
ctcagtgacccagacacaac

SEQ ID NO: 31441 - DNA, 20 bp, synthetic construct
  misc_feature 1..20: note = CRISPR gRNA sequence
  source 1..20: mol_type = other DNA
agtgacccagacacaactgg

SEQ ID NO: 31442 - DNA, 20 bp, synthetic construct
  misc_feature 1..20: note = CRISPR gRNA sequence
  source 1..20: mol_type = other DNA
gactccctagagccttgcct

SEQ ID NO: 31443 - DNA, 20 bp, synthetic construct
  misc_feature 1..20: note = CRISPR gRNA sequence
  source 1..20: mol_type = other DNA
cctagagccttgcctaggtc

SEQ ID NO: 31444 - DNA, 20 bp, synthetic construct
  misc_feature 1..20: note = CRISPR gRNA sequence
  source 1..20: mol_type = other DNA
gagccttgcctaggtctcca

SEQ ID NO: 31445 - DNA, 20 bp, synthetic construct
  misc_feature 1..20: note = CRISPR gRNA sequence
  source 1..20: mol_type = other DNA
gcctaggtctccatttctgt

SEQ ID NO: 31446 - DNA, 20 bp, synthetic construct
  misc_feature 1..20: note = CRISPR gRNA sequence
  source 1..20: mol_type = other DNA
cctaggtctccatttctgtc

SEQ ID NO: 31447 - DNA, 20 bp, synthetic construct
  misc_feature 1..20: note = CRISPR gRNA sequence
  source 1..20: mol_type = other DNA
ggtctccatttctgtcaccc

SEQ ID NO: 31448 - DNA, 20 bp, synthetic construct
  misc_feature 1..20: note = CRISPR gRNA sequence
  source 1..20: mol_type = other DNA
catttctgtcaccccagcaa

SEQ ID NO: 31449 - DNA, 20 bp, synthetic construct
  misc_feature 1..20: note = CRISPR gRNA sequence
  source 1..20: mol_type = other DNA
ctgtcaccccagcaacactg

SEQ ID NO: 31450 - DNA, 20 bp, synthetic construct
  misc_feature 1..20: note = CRISPR gRNA sequence
  source 1..20: mol_type = other DNA
tgtcaccccagcaacactgc

SEQ ID NO: 31451 - DNA, 20 bp, synthetic construct
  misc_feature 1..20: note = CRISPR gRNA sequence
  source 1..20: mol_type = other DNA
tcaccccagcaacactgcct

SEQ ID NO: 31452 - DNA, 20 bp, synthetic construct
  misc_feature 1..20: note = CRISPR gRNA sequence
  source 1..20: mol_type = other DNA
cctagggtgtggcccccagc

SEQ ID NO: 31453 - DNA, 20 bp, synthetic construct
  misc_feature 1..20: note = CRISPR gRNA sequence
  source 1..20: mol_type = other DNA
gggtgtggcccccagccctg

SEQ ID NO: 31454 - DNA, 20 bp, synthetic construct
  misc_feature 1..20: note = CRISPR gRNA sequence
  source 1..20: mol_type = other DNA
gccacacatagagcaaccaa

SEQ ID NO: 31455 - DNA, 20 bp, synthetic construct
  misc_feature 1..20: note = CRISPR gRNA sequence
  source 1..20: mol_type = other DNA
tcccagtttgcctgggacta

SEQ ID NO: 31456 - DNA, 20 bp, synthetic construct
  misc_feature 1..20: note = CRISPR gRNA sequence
  source 1..20: mol_type = other DNA
gcctgggactaaggggcttc

SEQ ID NO: 31457 - DNA, 20 bp, synthetic construct
  misc_feature 1..20: note = CRISPR gRNA sequence
  source 1..20: mol_type = other DNA
cctgggactaaggggcttct

SEQ ID NO: 31458 - DNA, 20 bp, synthetic construct
  misc_feature 1..20: note = CRISPR gRNA sequence
  source 1..20: mol_type = other DNA
ggactaaggggcttcttggg

SEQ ID NO: 31459 - DNA, 20 bp, synthetic construct
  misc_feature 1..20: note = CRISPR gRNA sequence
  source 1..20: mol_type = other DNA
aggggcttcttgggatgcaa

SEQ ID NO: 31460 - DNA, 20 bp, synthetic construct
  misc_feature 1..20: note = CRISPR gRNA sequence
  source 1..20: mol_type = other DNA
cttgggatgcaagactttca

SEQ ID NO: 31461 - DNA, 20 bp, synthetic construct
  misc_feature 1..20: note = CRISPR gRNA sequence
  source 1..20: mol_type = other DNA
ttgggatgcaagactttcag

SEQ ID NO: 31462 - DNA, 20 bp, synthetic construct
  misc_feature 1..20: note = CRISPR gRNA sequence
  source 1..20: mol_type = other DNA
gggatgcaagactttcagtt

SEQ ID NO: 31463 - DNA, 20 bp, synthetic construct
  misc_feature 1..20: note = CRISPR gRNA sequence
  source 1..20: mol_type = other DNA
ggatgcaagactttcagttt

SEQ ID NO: 31464 - DNA, 20 bp, synthetic construct
  misc_feature 1..20: note = CRISPR gRNA sequence
  source 1..20: mol_type = other DNA
tcagttttcaaaccaggata

SEQ ID NO: 31465 - DNA, 20 bp, synthetic construct
  misc_feature 1..20: note = CRISPR gRNA sequence
  source 1..20: mol_type = other DNA
cagttttcaaaccaggatag

SEQ ID NO: 31466 - DNA, 20 bp, synthetic construct
  misc_feature 1..20: note = CRISPR gRNA sequence
  source 1..20: mol_type = other DNA
agttttcaaaccaggatagt

SEQ ID NO: 31467 - DNA, 20 bp, synthetic construct
  misc_feature 1..20: note = CRISPR gRNA sequence
  source 1..20: mol_type = other DNA
tcaaaccaggatagtcccag

SEQ ID NO: 31468 - DNA, 20 bp, synthetic construct
  misc_feature 1..20: note = CRISPR gRNA sequence
  source 1..20: mol_type = other DNA
caaaccaggatagtcccagg

SEQ ID NO: 31469 - DNA, 20 bp, synthetic construct
  misc_feature 1..20: note = CRISPR gRNA sequence
  source 1..20: mol_type = other DNA
aaaccaggatagtcccaggc

SEQ ID NO: 31470 - DNA, 20 bp, synthetic construct
  misc_feature 1..20: note = CRISPR gRNA sequence
  source 1..20: mol_type = other DNA
ctttttcatcctagctgcac

SEQ ID NO: 31471 - DNA, 20 bp, synthetic construct
  misc_feature 1..20: note = CRISPR gRNA sequence
  source 1..20: mol_type = other DNA
tttcatcctagctgcacatc

SEQ ID NO: 31472 - DNA, 20 bp, synthetic construct
  misc_feature 1..20: note = CRISPR gRNA sequence
  source 1..20: mol_type = other DNA
ttcatcctagctgcacatca

SEQ ID NO: 31473 - DNA, 20 bp, synthetic construct
  misc_feature 1..20: note = CRISPR gRNA sequence
  source 1..20: mol_type = other DNA
tcatcctagctgcacatcaa

SEQ ID NO: 31474 - DNA, 20 bp, synthetic construct
  misc_feature 1..20: note = CRISPR gRNA sequence
  source 1..20: mol_type = other DNA
catcctagctgcacatcaaa

SEQ ID NO: 31475 - DNA, 20 bp, synthetic construct
  misc_feature 1..20: note = CRISPR gRNA sequence
  source 1..20: mol_type = other DNA
atcctagctgcacatcaaaa

SEQ ID NO: 31476 - DNA, 20 bp, synthetic construct
  misc_feature 1..20: note = CRISPR gRNA sequence
  source 1..20: mol_type = other DNA
gctgcacatcaaaagctcct

SEQ ID NO: 31477 - DNA, 20 bp, synthetic construct
  misc_feature 1..20: note = CRISPR gRNA sequence
  source 1..20: mol_type = other DNA
cacatcaaaagctcctggga

SEQ ID NO: 31478 - DNA, 20 bp, synthetic construct
  misc_feature 1..20: note = CRISPR gRNA sequence
  source 1..20: mol_type = other DNA
ctgggaatttcaaaatgggg

SEQ ID NO: 31479 - DNA, 20 bp, synthetic construct
  misc_feature 1..20: note = CRISPR gRNA sequence
  source 1..20: mol_type = other DNA
ggaatttcaaaatgggggaa

SEQ ID NO: 31480 - DNA, 20 bp, synthetic construct
  misc_feature 1..20: note = CRISPR gRNA sequence
  source 1..20: mol_type = other DNA
caaaatgggggaaagattct

SEQ ID NO: 31481 - DNA, 20 bp, synthetic construct
  misc_feature 1..20: note = CRISPR gRNA sequence
  source 1..20: mol_type = other DNA
aaaatgggggaaagattctc

SEQ ID NO: 31482 - DNA, 20 bp, synthetic construct
  misc_feature 1..20: note = CRISPR gRNA sequence
  source 1..20: mol_type = other DNA
tccctggggaggccatccct

SEQ ID NO: 31483 - DNA, 20 bp, synthetic construct
  misc_feature 1..20: note = CRISPR gRNA sequence
  source 1..20: mol_type = other DNA
cctggggaggccatcccttg

SEQ ID NO: 31484 - DNA, 20 bp, synthetic construct
  misc_feature 1..20: note = CRISPR gRNA sequence
  source 1..20: mol_type = other DNA
gggaggccatcccttggctg

SEQ ID NO: 31485 - DNA, 20 bp, synthetic construct
  misc_feature 1..20: note = CRISPR gRNA sequence
  source 1..20: mol_type = other DNA
ggctgtggaagtaaacaagc

SEQ ID NO: 31486 - DNA, 20 bp, synthetic construct
  misc_feature 1..20: note = CRISPR gRNA sequence
  source 1..20: mol_type = other DNA
gctgtggaagtaaacaagct

SEQ ID NO: 31487 - DNA, 20 bp, synthetic construct
  misc_feature 1..20: note = CRISPR gRNA sequence
  source 1..20: mol_type = other DNA
tggaagtaaacaagctcagg

SEQ ID NO: 31488 - DNA, 20 bp, synthetic construct
  misc_feature 1..20: note = CRISPR gRNA sequence
  source 1..20: mol_type = other DNA
aggcacaagggacgttgtgc

SEQ ID NO: 31489 - DNA, 20 bp, synthetic construct
  misc_feature 1..20: note = CRISPR gRNA sequence
  source 1..20: mol_type = other DNA
tgcagttcctggccacagga

SEQ ID NO: 31490 - DNA, 20 bp, synthetic construct
  misc_feature 1..20: note = CRISPR gRNA sequence
  source 1..20: mol_type = other DNA
ctggccacaggagggaaaag

SEQ ID NO: 31491 - DNA, 20 bp, synthetic construct
  misc_feature 1..20: note = CRISPR gRNA sequence
  source 1..20: mol_type = other DNA
gccacaggagggaaaaggac

SEQ ID NO: 31492 - DNA, 20 bp, synthetic construct
  misc_feature 1..20: note = CRISPR gRNA sequence
  source 1..20: mol_type = other DNA
catagtcatagtggcatcct

SEQ ID NO: 31493 - DNA, 20 bp, synthetic construct
  misc_feature 1..20: note = CRISPR gRNA sequence
  source 1..20: mol_type = other DNA
ctatggaaggttggggacac

SEQ ID NO: 31494 - DNA, 20 bp, synthetic construct
  misc_feature 1..20: note = CRISPR gRNA sequence
  source 1..20: mol_type = other DNA
tggaaggttggggacacatt

SEQ ID NO: 31495 - DNA, 20 bp, synthetic construct
  misc_feature 1..20: note = CRISPR gRNA sequence
  source 1..20: mol_type = other DNA
gggacacattgggccttttc

SEQ ID NO: 31496 - DNA, 20 bp, synthetic construct
  misc_feature 1..20: note = CRISPR gRNA sequence
  source 1..20: mol_type = other DNA
ggccttttctgatccctggc

SEQ ID NO: 31497 - DNA, 20 bp, synthetic construct
  misc_feature 1..20: note = CRISPR gRNA sequence
  source 1..20: mol_type = other DNA
ttctgatccctggcgaaatt

SEQ ID NO: 31498 - DNA, 20 bp, synthetic construct
  misc_feature 1..20: note = CRISPR gRNA sequence
  source 1..20: mol_type = other DNA
tctgatccctggcgaaatta

SEQ ID NO: 31499 - DNA, 20 bp, synthetic construct
  misc_feature 1..20: note = CRISPR gRNA sequence
  source 1..20: mol_type = other DNA
ctgatccctggcgaaattac

SEQ ID NO: 31500 - DNA, 20 bp, synthetic construct
  misc_feature 1..20: note = CRISPR gRNA sequence
  source 1..20: mol_type = other DNA
tgatccctggcgaaattaca

SEQ ID NO: 31501 - DNA, 20 bp, synthetic construct
  misc_feature 1..20: note = CRISPR gRNA sequence
  source 1..20: mol_type = other DNA
atccctggcgaaattacaat

SEQ ID NO: 31502 - DNA, 20 bp, synthetic construct
  misc_feature 1..20: note = CRISPR gRNA sequence
  source 1..20: mol_type = other DNA
gcgaaattacaattcctgga

SEQ ID NO: 31503 - DNA, 20 bp, synthetic construct
  misc_feature 1..20: note = CRISPR gRNA sequence
  source 1..20: mol_type = other DNA
caattcctggaaagcctttc

SEQ ID NO: 31504 - DNA, 20 bp, synthetic construct
  misc_feature 1..20: note = CRISPR gRNA sequence
  source 1..20: mol_type = other DNA
ctggaaagcctttcttactc

SEQ ID NO: 31505 - DNA, 20 bp, synthetic construct
  misc_feature 1..20: note = CRISPR gRNA sequence
  source 1..20: mol_type = other DNA
gaaagcctttcttactcccc

SEQ ID NO: 31506 - DNA, 20 bp, synthetic construct
  misc_feature 1..20: note = CRISPR gRNA sequence
  source 1..20: mol_type = other DNA
tcttactcccctctccccac

SEQ ID NO: 31507 - DNA, 20 bp, synthetic construct
  misc_feature 1..20: note = CRISPR gRNA sequence
  source 1..20: mol_type = other DNA
cttactcccctctccccact

SEQ ID NO: 31508 - DNA, 20 bp, synthetic construct
  misc_feature 1..20: note = CRISPR gRNA sequence
  source 1..20: mol_type = other DNA
ttactcccctctccccactc

SEQ ID NO: 31509 - DNA, 20 bp, synthetic construct
  misc_feature 1..20: note = CRISPR gRNA sequence
  source 1..20: mol_type = other DNA
actcccctctccccactcag

SEQ ID NO: 31510 - DNA, 20 bp, synthetic construct
  misc_feature 1..20: note = CRISPR gRNA sequence
  source 1..20: mol_type = other DNA
ctcccctctccccactcagc

SEQ ID NO: 31511 - DNA, 20 bp, synthetic construct
  misc_feature 1..20: note = CRISPR gRNA sequence
  source 1..20: mol_type = other DNA
ccctctccccactcagctca

SEQ ID NO: 31512 - DNA, 20 bp, synthetic construct
  misc_feature 1..20: note = CRISPR gRNA sequence
  source 1..20: mol_type = other DNA
tccccactcagctcattcct

SEQ ID NO: 31513 - DNA, 20 bp, synthetic construct
  misc_feature 1..20: note = CRISPR gRNA sequence
  source 1..20: mol_type = other DNA
cccactcagctcattcctta

SEQ ID NO: 31514 - DNA, 20 bp, synthetic construct
  misc_feature 1..20: note = CRISPR gRNA sequence
  source 1..20: mol_type = other DNA
agctcattccttatcctcac

SEQ ID NO: 31515 - DNA, 20 bp, synthetic construct
  misc_feature 1..20: note = CRISPR gRNA sequence
  source 1..20: mol_type = other DNA
attccttatcctcactgaag

SEQ ID NO: 31516 - DNA, 20 bp, synthetic construct
  misc_feature 1..20: note = CRISPR gRNA sequence
  source 1..20: mol_type = other DNA
cttatcctcactgaagcttc

SEQ ID NO: 31517 - DNA, 20 bp, synthetic construct
  misc_feature 1..20: note = CRISPR gRNA sequence
  source 1..20: mol_type = other DNA
atcctcactgaagcttcagt

SEQ ID NO: 31518 - DNA, 20 bp, synthetic construct
  misc_feature 1..20: note = CRISPR gRNA sequence
  source 1..20: mol_type = other DNA
tcctcactgaagcttcagtg

SEQ ID NO: 31519 - DNA, 20 bp, synthetic construct
  misc_feature 1..20: note = CRISPR gRNA sequence
  source 1..20: mol_type = other DNA
actgaagcttcagtgcagat

SEQ ID NO: 31520 - DNA, 20 bp, synthetic construct
  misc_feature 1..20: note = CRISPR gRNA sequence
  source 1..20: mol_type = other DNA
aagcttcagtgcagatatca

SEQ ID NO: 31521 - DNA, 20 bp, synthetic construct
  misc_feature 1..20: note = CRISPR gRNA sequence
  source 1..20: mol_type = other DNA
cagtgcagatatcacctcct

SEQ ID NO: 31522 - DNA, 20 bp, synthetic construct
  misc_feature 1..20: note = CRISPR gRNA sequence
  source 1..20: mol_type = other DNA
agtgcagatatcacctcctc

SEQ ID NO: 31523 - DNA, 20 bp, synthetic construct
  misc_feature 1..20: note = CRISPR gRNA sequence
  source 1..20: mol_type = other DNA
ctccaggaagtccccctgac

SEQ ID NO: 31524 - DNA, 20 bp, synthetic construct
  misc_feature 1..20: note = CRISPR gRNA sequence
  source 1..20: mol_type = other DNA
caggaagtccccctgacctc

SEQ ID NO: 31525 - DNA, 20 bp, synthetic construct
  misc_feature 1..20: note = CRISPR gRNA sequence
  source 1..20: mol_type = other DNA
acctcctccagaggggagtt

SEQ ID NO: 31526 - DNA, 20 bp, synthetic construct
  misc_feature 1..20: note = CRISPR gRNA sequence
  source 1..20: mol_type = other DNA
ctccagaggggagttgatta

SEQ ID NO: 31527 - DNA, 20 bp, synthetic construct
  misc_feature 1..20: note = CRISPR gRNA sequence
  source 1..20: mol_type = other DNA
cagaggggagttgattagac

SEQ ID NO: 31528 - DNA, 20 bp, synthetic construct
  misc_feature 1..20: note = CRISPR gRNA sequence
  source 1..20: mol_type = other DNA
attagactgtcagctcatga

SEQ ID NO: 31529 - DNA, 20 bp, synthetic construct
  misc_feature 1..20: note = CRISPR gRNA sequence
  source 1..20: mol_type = other DNA
gactgtcagctcatgaggac

SEQ ID NO: 31530 - DNA, 20 bp, synthetic construct
  misc_feature 1..20: note = CRISPR gRNA sequence
  source 1..20: mol_type = other DNA
tcagctcatgaggacagcag

SEQ ID NO: 31531 - DNA, 20 bp, synthetic construct
  misc_feature 1..20: note = CRISPR gRNA sequence
  source 1..20: mol_type = other DNA
atgaggacagcagcctcagt

SEQ ID NO: 31532 - DNA, 20 bp, synthetic construct
  misc_feature 1..20: note = CRISPR gRNA sequence
  source 1..20: mol_type = other DNA
agtcattcaagtgctcaata

SEQ ID NO: 31533 - DNA, 20 bp, synthetic construct
  misc_feature 1..20: note = CRISPR gRNA sequence
  source 1..20: mol_type = other DNA
aagtgctcaatacctctgtt

SEQ ID NO: 31534 - DNA, 20 bp, synthetic construct
  misc_feature 1..20: note = CRISPR gRNA sequence
  source 1..20: mol_type = other DNA
aatacctctgttgaatgagt

SEQ ID NO: 31535 - DNA, 20 bp, synthetic construct
  misc_feature 1..20: note = CRISPR gRNA sequence
  source 1..20: mol_type = other DNA
tgttgaatgagtgatgggaa

SEQ ID NO: 31536 - DNA, 20 bp, synthetic construct
  misc_feature 1..20: note = CRISPR gRNA sequence
  source 1..20: mol_type = other DNA
ttgaatgagtgatgggaatg

SEQ ID NO: 31537 - DNA, 20 bp, synthetic construct
  misc_feature 1..20: note = CRISPR gRNA sequence
  source 1..20: mol_type = other DNA
aatgagtgatgggaatgacc

SEQ ID NO: 31538 - DNA, 20 bp, synthetic construct
  misc_feature 1..20: note = CRISPR gRNA sequence
  source 1..20: mol_type = other DNA
accagcaaacgggtccatta

SEQ ID NO: 31539 - DNA, 20 bp, synthetic construct
  misc_feature 1..20: note = CRISPR gRNA sequence
  source 1..20: mol_type = other DNA
gcttcaaatctgagaacctc

SEQ ID NO: 31540 - DNA, 20 bp, synthetic construct
  misc_feature 1..20: note = CRISPR gRNA sequence
  source 1..20: mol_type = other DNA
caaatctgagaacctccagc

SEQ ID NO: 31541 - DNA, 20 bp, synthetic construct
  misc_feature 1..20: note = CRISPR gRNA sequence
  source 1..20: mol_type = other DNA
aaatctgagaacctccagca

SEQ ID NO: 31542 - DNA, 20 bp, synthetic construct
  misc_feature 1..20: note = CRISPR gRNA sequence
  source 1..20: mol_type = other DNA
agaacctccagcatttgccc

SEQ ID NO: 31543 - DNA, 20 bp, synthetic construct
  misc_feature 1..20: note = CRISPR gRNA sequence
  source 1..20: mol_type = other DNA
cagcatttgcccacactggt

SEQ ID NO: 31544 - DNA, 20 bp, synthetic construct
  misc_feature 1..20: note = CRISPR gRNA sequence
  source 1..20: mol_type = other DNA
gcccacactggtcactttcc

SEQ ID NO: 31545 - DNA, 20 bp, synthetic construct
  misc_feature 1..20: note = CRISPR gRNA sequence
  source 1..20: mol_type = other DNA
cccacactggtcactttcca

SEQ ID NO: 31546 - DNA, 20 bp, synthetic construct
  misc_feature 1..20: note = CRISPR gRNA sequence
  source 1..20: mol_type = other DNA
gtcactttccagctgctgga

SEQ ID NO: 31547 - DNA, 20 bp, synthetic construct
  misc_feature 1..20: note = CRISPR gRNA sequence
  source 1..20: mol_type = other DNA
tccagctgctggaagctatt

SEQ ID NO: 31548 - DNA, 20 bp, synthetic construct
  misc_feature 1..20: note = CRISPR gRNA sequence
  source 1..20: mol_type = other DNA
ccagctgctggaagctattt

SEQ ID NO: 31549 - DNA, 20 bp, synthetic construct
  misc_feature 1..20: note = CRISPR gRNA sequence
  source 1..20: mol_type = other DNA
cagctgctggaagctatttc

SEQ ID NO: 31550 - DNA, 20 bp, synthetic construct
  misc_feature 1..20: note = CRISPR gRNA sequence
  source 1..20: mol_type = other DNA
ctggaagctatttccaaagt

SEQ ID NO: 31551 - DNA, 20 bp, synthetic construct
  misc_feature 1..20: note = CRISPR gRNA sequence
  source 1..20: mol_type = other DNA
gaagctatttccaaagtggt

SEQ ID NO: 31552 - DNA, 20 bp, synthetic construct
  misc_feature 1..20: note = CRISPR gRNA sequence
  source 1..20: mol_type = other DNA
tttccaaagtggtgggcaag

SEQ ID NO: 31553 - DNA, 20 bp, synthetic construct
  misc_feature 1..20: note = CRISPR gRNA sequence
  source 1..20: mol_type = other DNA
ccaaagtggtgggcaagagg

SEQ ID NO: 31554 - DNA, 20 bp, synthetic construct
  misc_feature 1..20: note = CRISPR gRNA sequence
  source 1..20: mol_type = other DNA
caaagtggtgggcaagaggg

SEQ ID NO: 31555 - DNA, 20 bp, synthetic construct
  misc_feature 1..20: note = CRISPR gRNA sequence
  source 1..20: mol_type = other DNA
tggagatctatctccattca

SEQ ID NO: 31556 - DNA, 20 bp, synthetic construct
  misc_feature 1..20: note = CRISPR gRNA sequence
  source 1..20: mol_type = other DNA
gagatctatctccattcagg

SEQ ID NO: 31557 - DNA, 20 bp, synthetic construct
  misc_feature 1..20: note = CRISPR gRNA sequence
  source 1..20: mol_type = other DNA
tctccattcaggtggtacaa

SEQ ID NO: 31558 - DNA, 20 bp, synthetic construct
  misc_feature 1..20: note = CRISPR gRNA sequence
  source 1..20: mol_type = other DNA
cattcaggtggtacaagccc

SEQ ID NO: 31559 - DNA, 20 bp, synthetic construct
  misc_feature 1..20: note = CRISPR gRNA sequence
  source 1..20: mol_type = other DNA
aggtggtacaagcccagcta

SEQ ID NO: 31560 - DNA, 20 bp, synthetic construct
  misc_feature 1..20: note = CRISPR gRNA sequence
  source 1..20: mol_type = other DNA
atgctgcaggggaaaccttg

SEQ ID NO: 31561 - DNA, 20 bp, synthetic construct
  misc_feature 1..20: note = CRISPR gRNA sequence
  source 1..20: mol_type = other DNA
caggggaaaccttgcgcaga

SEQ ID NO: 31562 - DNA, 20 bp, synthetic construct
  misc_feature 1..20: note = CRISPR gRNA sequence
  source 1..20: mol_type = other DNA
gcgcagacccacaagacaat

SEQ ID NO: 31563 - DNA, 20 bp, synthetic construct
  misc_feature 1..20: note = CRISPR gRNA sequence
  source 1..20: mol_type = other DNA
cgcagacccacaagacaatc

SEQ ID NO: 31564 - DNA, 20 bp, synthetic construct
  misc_feature 1..20: note = CRISPR gRNA sequence
  source 1..20: mol_type = other DNA
tgcttacgcaaactccagtt

SEQ ID NO: 31565 - DNA, 20 bp, synthetic construct
  misc_feature 1..20: note = CRISPR gRNA sequence
  source 1..20: mol_type = other DNA
gcttacgcaaactccagttt

SEQ ID NO: 31566 - DNA, 20 bp, synthetic construct
  misc_feature 1..20: note = CRISPR gRNA sequence
  source 1..20: mol_type = other DNA
cttacgcaaactccagtttc

SEQ ID NO: 31567 - DNA, 20 bp, synthetic construct
  misc_feature 1..20: note = CRISPR gRNA sequence
  source 1..20: mol_type = other DNA
acgcaaactccagtttcttt

SEQ ID NO: 31568 - DNA, 20 bp, synthetic construct
  misc_feature 1..20: note = CRISPR gRNA sequence
  source 1..20: mol_type = other DNA
cgcaaactccagtttcttta

SEQ ID NO: 31569 - DNA, 20 bp, synthetic construct
  misc_feature 1..20: note = CRISPR gRNA sequence
  source 1..20: mol_type = other DNA
cagtttctttaggtcccgaa

SEQ ID NO: 31570 - DNA, 20 bp, synthetic construct
  misc_feature 1..20: note = CRISPR gRNA sequence
  source 1..20: mol_type = other DNA
ctttaggtcccgaacagcag

SEQ ID NO: 31571 - DNA, 20 bp, synthetic construct
  misc_feature 1..20: note = CRISPR gRNA sequence
  source 1..20: mol_type = other DNA
tttaggtcccgaacagcagg

SEQ ID NO: 31572 - DNA, 20 bp, synthetic construct
  misc_feature 1..20: note = CRISPR gRNA sequence
  source 1..20: mol_type = other DNA
taggtcccgaacagcaggga

SEQ ID NO: 31573 - DNA, 20 bp, synthetic construct
  misc_feature 1..20: note = CRISPR gRNA sequence
  source 1..20: mol_type = other DNA
aggtcccgaacagcagggag

SEQ ID NO: 31574 - DNA, 20 bp, synthetic construct
  misc_feature 1..20: note = CRISPR gRNA sequence
  source 1..20: mol_type = other DNA
ggtcccgaacagcagggagc

SEQ ID NO: 31575 - DNA, 20 bp, synthetic construct
  misc_feature 1..20: note = CRISPR gRNA sequence
  source 1..20: mol_type = other DNA
cccagctgtgtcttccgagg

SEQ ID NO: 31576 - DNA, 20 bp, synthetic construct
  misc_feature 1..20: note = CRISPR gRNA sequence
  source 1..20: mol_type = other DNA
tgtcttccgaggaacttctc

SEQ ID NO: 31577 - DNA, 20 bp, synthetic construct
  misc_feature 1..20: note = CRISPR gRNA sequence
  source 1..20: mol_type = other DNA
ccgaggaacttctcgtcctg

SEQ ID NO: 31578 - DNA, 20 bp, synthetic construct
  misc_feature 1..20: note = CRISPR gRNA sequence
  source 1..20: mol_type = other DNA
cgaggaacttctcgtcctgg

SEQ ID NO: 31579 - DNA, 20 bp, synthetic construct
  misc_feature 1..20: note = CRISPR gRNA sequence
  source 1..20: mol_type = other DNA
ctcgtcctggagagaacagg

SEQ ID NO: 31580 - DNA, 20 bp, synthetic construct
  misc_feature 1..20: note = CRISPR gRNA sequence
  source 1..20: mol_type = other DNA
tcgtcctggagagaacaggc

SEQ ID NO: 31581 - DNA, 20 bp, synthetic construct
  misc_feature 1..20: note = CRISPR gRNA sequence
  source 1..20: mol_type = other DNA
gtcctggagagaacaggcaa

SEQ ID NO: 31582 - DNA, 20 bp, synthetic construct
  misc_feature 1..20: note = CRISPR gRNA sequence
  source 1..20: mol_type = other DNA
gagagaacaggcaatgttag

SEQ ID NO: 31583 - DNA, 20 bp, synthetic construct
  misc_feature 1..20: note = CRISPR gRNA sequence
  source 1..20: mol_type = other DNA
gggggagcaggcactgctgt

SEQ ID NO: 31584 - DNA, 20 bp, synthetic construct
  misc_feature 1..20: note = CRISPR gRNA sequence
  source 1..20: mol_type = other DNA
ctgtcactgagcccttaccc

SEQ ID NO: 31585 - DNA, 20 bp, synthetic construct
  misc_feature 1..20: note = CRISPR gRNA sequence
  source 1..20: mol_type = other DNA
tcactgagcccttacccatg

SEQ ID NO: 31586 - DNA, 20 bp, synthetic construct
  misc_feature 1..20: note = CRISPR gRNA sequence
  source 1..20: mol_type = other DNA
agcccttacccatgggtccc

SEQ ID NO: 31587 - DNA, 20 bp, synthetic construct
  misc_feature 1..20: note = CRISPR gRNA sequence
  source 1..20: mol_type = other DNA
acccatgggtcccatgatgg

SEQ ID NO: 31588 - DNA, 20 bp, synthetic construct
  misc_feature 1..20: note = CRISPR gRNA sequence
  source 1..20: mol_type = other DNA
cccatgggtcccatgatggc

SEQ ID NO: 31589 - DNA, 20 bp, synthetic construct
  misc_feature 1..20: note = CRISPR gRNA sequence
  source 1..20: mol_type = other DNA
ccccagtgccccaaattccc

SEQ ID NO: 31590 - DNA, 20 bp, synthetic construct
  misc_feature 1..20: note = CRISPR gRNA sequence
  source 1..20: mol_type = other DNA
cccagggggattgctttcct

SEQ ID NO: 31591 - DNA, 20 bp, synthetic construct
  misc_feature 1..20: note = CRISPR gRNA sequence
  source 1..20: mol_type = other DNA
ctttccttggggcaactgtt

SEQ ID NO: 31592 - DNA, 20 bp, synthetic construct
  misc_feature 1..20: note = CRISPR gRNA sequence
  source 1..20: mol_type = other DNA
tccttggggcaactgttgtc

SEQ ID NO: 31593 - DNA, 20 bp, synthetic construct
  misc_feature 1..20: note = CRISPR gRNA sequence
  source 1..20: mol_type = other DNA
ccttggggcaactgttgtcc

SEQ ID NO: 31594 - DNA, 20 bp, synthetic construct
  misc_feature 1..20: note = CRISPR gRNA sequence
  source 1..20: mol_type = other DNA
cttggggcaactgttgtccc

SEQ ID NO: 31595 - DNA, 20 bp, synthetic construct
  misc_feature 1..20: note = CRISPR gRNA sequence
  source 1..20: mol_type = other DNA
ggggcaactgttgtccccct

SEQ ID NO: 31596 - DNA, 20 bp, synthetic construct
  misc_feature 1..20: note = CRISPR gRNA sequence
  source 1..20: mol_type = other DNA
gggcaactgttgtccccctc

SEQ ID NO: 31597 - DNA, 20 bp, synthetic construct
  misc_feature 1..20: note = CRISPR gRNA sequence
  source 1..20: mol_type = other DNA
ttgtccccctcttaaaaaaa

SEQ ID NO: 31598 - DNA, 20 bp, synthetic construct
  misc_feature 1..20: note = CRISPR gRNA sequence
  source 1..20: mol_type = other DNA
tccccctcttaaaaaaaaag

SEQ ID NO: 31599 - DNA, 20 bp, synthetic construct
  misc_feature 1..20: note = CRISPR gRNA sequence
  source 1..20: mol_type = other DNA
ttaaaaaaaaagatctgtct

SEQ ID NO: 31600 - DNA, 20 bp, synthetic construct
  misc_feature 1..20: note = CRISPR gRNA sequence
  source 1..20: mol_type = other DNA
aaaaaaaaagatctgtctgg

SEQ ID NO: 31601 - DNA, 20 bp, synthetic construct
  misc_feature 1..20: note = CRISPR gRNA sequence
  source 1..20: mol_type = other DNA
aaaaaaaagatctgtctggg

SEQ ID NO: 31602 - DNA, 20 bp, synthetic construct
  misc_feature 1..20: note = CRISPR gRNA sequence
  source 1..20: mol_type = other DNA
tctgggtgcggtgcctcgtg

SEQ ID NO: 31603 - DNA, 20 bp, synthetic construct
  misc_feature 1..20: note = CRISPR gRNA sequence
  source 1..20: mol_type = other DNA
ggtgcggtgcctcgtgactg

SEQ ID NO: 31604 - DNA, 20 bp, synthetic construct
  misc_feature 1..20: note = CRISPR gRNA sequence
  source 1..20: mol_type = other DNA
gtgactgtagtcccagcact

SEQ ID NO: 31605 - DNA, 20 bp, synthetic construct
  misc_feature 1..20: note = CRISPR gRNA sequence
  source 1..20: mol_type = other DNA
tagtcccagcactttgggag

SEQ ID NO: 31606 - DNA, 20 bp, synthetic construct
  misc_feature 1..20: note = CRISPR gRNA sequence
  source 1..20: mol_type = other DNA
tgggaggctgaggcaggagg

SEQ ID NO: 31607 - DNA, 20 bp, synthetic construct
  misc_feature 1..20: note = CRISPR gRNA sequence
  source 1..20: mol_type = other DNA
gggaggctgaggcaggagga

SEQ ID NO: 31608 - DNA, 20 bp, synthetic construct
  misc_feature 1..20: note = CRISPR gRNA sequence
  source 1..20: mol_type = other DNA
ggaggctgaggcaggaggat

SEQ ID NO: 31609 - DNA, 20 bp, synthetic construct
  misc_feature 1..20: note = CRISPR gRNA sequence
  source 1..20: mol_type = other DNA
aggcaggaggattgcttgag

SEQ ID NO: 31610 - DNA, 20 bp, synthetic construct
  misc_feature 1..20: note = CRISPR gRNA sequence
  source 1..20: mol_type = other DNA
cttgaggccaggagttcaag

SEQ ID NO: 31611 - DNA, 20 bp, synthetic construct
  misc_feature 1..20: note = CRISPR gRNA sequence
  source 1..20: mol_type = other DNA
gaggccaggagttcaagacc

SEQ ID NO: 31612 - DNA, 20 bp, synthetic construct
  misc_feature 1..20: note = CRISPR gRNA sequence
  source 1..20: mol_type = other DNA
aggccaggagttcaagacca

SEQ ID NO: 31613 - DNA, 20 bp, synthetic construct
  misc_feature 1..20: note = CRISPR gRNA sequence
  source 1..20: mol_type = other DNA
aagaccagcctgggcaacat

SEQ ID NO: 31614 - DNA, 20 bp, synthetic construct
  misc_feature 1..20: note = CRISPR gRNA sequence
  source 1..20: mol_type = other DNA
ggcaacatagcaagatccct

SEQ ID NO: 31615 - DNA, 20 bp, synthetic construct
  misc_feature 1..20: note = CRISPR gRNA sequence
  source 1..20: mol_type = other DNA
tgtctacaaaaacttaaaaa

SEQ ID NO: 31616 - DNA, 20 bp, synthetic construct
  misc_feature 1..20: note = CRISPR gRNA sequence
  source 1..20: mol_type = other DNA
caaaaacttaaaaaatcatc

SEQ ID NO: 31617 - DNA, 20 bp, synthetic construct
  misc_feature 1..20: note = CRISPR gRNA sequence
  source 1..20: mol_type = other DNA
aaaaaatcatccggtgtgat

SEQ ID NO: 31618 - DNA, 20 bp, synthetic construct
  misc_feature 1..20: note = CRISPR gRNA sequence
  source 1..20: mol_type = other DNA
aaaaatcatccggtgtgatg

SEQ ID NO: 31619 - DNA, 20 bp, synthetic construct
  misc_feature 1..20: note = CRISPR gRNA sequence
  source 1..20: mol_type = other DNA
taatcccagctacttgggag

SEQ ID NO: 31620 - DNA, 20 bp, synthetic construct
  misc_feature 1..20: note = CRISPR gRNA sequence
  source 1..20: mol_type = other DNA
cttgggaggctgaggcagga

SEQ ID NO: 31621 - DNA, 20 bp, synthetic construct
  misc_feature 1..20: note = CRISPR gRNA sequence
  source 1..20: mol_type = other DNA
gggaggctgaggcaggagga

SEQ ID NO: 31622 - DNA, 20 bp, synthetic construct
  misc_feature 1..20: note = CRISPR gRNA sequence
  source 1..20: mol_type = other DNA
ggaggctgaggcaggaggat

SEQ ID NO: 31623 - DNA, 20 bp, synthetic construct
  misc_feature 1..20: note = CRISPR gRNA sequence
  source 1..20: mol_type = other DNA
aggcaggaggatcgcttgag

SEQ ID NO: 31624 - DNA, 20 bp, synthetic construct
  misc_feature 1..20: note = CRISPR gRNA sequence
  source 1..20: mol_type = other DNA
gagctcaggagttccgaagc

SEQ ID NO: 31625 - DNA, 20 bp, synthetic construct
  misc_feature 1..20: note = CRISPR gRNA sequence
  source 1..20: mol_type = other DNA
agctcaggagttccgaagct

SEQ ID NO: 31626 - DNA, 20 bp, synthetic construct
  misc_feature 1..20: note = CRISPR gRNA sequence
  source 1..20: mol_type = other DNA
aggagttccgaagctacagt

SEQ ID NO: 31627 - DNA, 20 bp, synthetic construct
  misc_feature 1..20: note = CRISPR gRNA sequence
  source 1..20: mol_type = other DNA
cgaagctacagtaagctatg

SEQ ID NO: 31628 - DNA, 20 bp, synthetic construct
  misc_feature 1..20: note = CRISPR gRNA sequence
  source 1..20: mol_type = other DNA
cagtaagctatgatcgcact

SEQ ID NO: 31629 - DNA, 20 bp, synthetic construct
  misc_feature 1..20: note = CRISPR gRNA sequence
  source 1..20: mol_type = other DNA
tgatcgcactactgtattct

SEQ ID NO: 31630 - DNA, 20 bp, synthetic construct
  misc_feature 1..20: note = CRISPR gRNA sequence
  source 1..20: mol_type = other DNA
ctgtattctagcctggtaga

SEQ ID NO: 31631 - DNA, 20 bp, synthetic construct
  misc_feature 1..20: note = CRISPR gRNA sequence
  source 1..20: mol_type = other DNA
tattctagcctggtagacac

SEQ ID NO: 31632 - DNA, 20 bp, synthetic construct
  misc_feature 1..20: note = CRISPR gRNA sequence
  source 1..20: mol_type = other DNA
tagcctggtagacacagcga

SEQ ID NO: 31633 - DNA, 20 bp, synthetic construct
  misc_feature 1..20: note = CRISPR gRNA sequence
  source 1..20: mol_type = other DNA
gcctggtagacacagcgaga

SEQ ID NO: 31634 - DNA, 20 bp, synthetic construct
  misc_feature 1..20: note = CRISPR gRNA sequence
  source 1..20: mol_type = other DNA
gtagacacagcgagaccctg

SEQ ID NO: 31635 - DNA, 20 bp, synthetic construct
  misc_feature 1..20: note = CRISPR gRNA sequence
  source 1..20: mol_type = other DNA
tctttaagaaataataaaaa

SEQ ID NO: 31636 - DNA, 20 bp, synthetic construct
  misc_feature 1..20: note = CRISPR gRNA sequence
  source 1..20: mol_type = other DNA
taagaaataataaaaataaa

SEQ ID NO: 31637 - DNA, 20 bp, synthetic construct
  misc_feature 1..20: note = CRISPR gRNA sequence
  source 1..20: mol_type = other DNA
aagaaataataaaaataaaa

SEQ ID NO: 31638 - DNA, 20 bp, synthetic construct
  misc_feature 1..20: note = CRISPR gRNA sequence
  source 1..20: mol_type = other DNA
agaaataataaaaataaaaa

SEQ ID NO: 31639 - DNA, 20 bp, synthetic construct
  misc_feature 1..20: note = CRISPR gRNA sequence
  source 1..20: mol_type = other DNA
aggactgtatctttcatgga

SEQ ID NO: 31640 - DNA, 20 bp, synthetic construct
  misc_feature 1..20: note = CRISPR gRNA sequence
  source 1..20: mol_type = other DNA
tatctttcatggaaatgagc

SEQ ID NO: 31641 - DNA, 20 bp, synthetic construct
  misc_feature 1..20: note = CRISPR gRNA sequence
  source 1..20: mol_type = other DNA
tcatggaaatgagcctcaga

SEQ ID NO: 31642 - DNA, 20 bp, synthetic construct
  misc_feature 1..20: note = CRISPR gRNA sequence
  source 1..20: mol_type = other DNA
catggaaatgagcctcagat

SEQ ID NO: 31643 - DNA, 20 bp, synthetic construct
  misc_feature 1..20: note = CRISPR gRNA sequence
  source 1..20: mol_type = other DNA
atggaaatgagcctcagatt

SEQ ID NO: 31644 - DNA, 20 bp, synthetic construct
  misc_feature 1..20: note = CRISPR gRNA sequence
  source 1..20: mol_type = other DNA
agattaggcacttaccagta

SEQ ID NO: 31645 - DNA, 20 bp, synthetic construct
  misc_feature 1..20: note = CRISPR gRNA sequence
  source 1..20: mol_type = other DNA
ggcacttaccagtacctatc

SEQ ID NO: 31646 - DNA, 20 bp, synthetic construct
  misc_feature 1..20: note = CRISPR gRNA sequence
  source 1..20: mol_type = other DNA
accagtacctatcccagaca

SEQ ID NO: 31647 - DNA, 20 bp, synthetic construct
  misc_feature 1..20: note = CRISPR gRNA sequence
  source 1..20: mol_type = other DNA
ccagtacctatcccagacag

SEQ ID NO: 31648 - DNA, 20 bp, synthetic construct
  misc_feature 1..20: note = CRISPR gRNA sequence
  source 1..20: mol_type = other DNA
tcccagacagcacttaagag

SEQ ID NO: 31649 - DNA, 20 bp, synthetic construct
  misc_feature 1..20: note = CRISPR gRNA sequence
  source 1..20: mol_type = other DNA
aagaggcgctcaaacaatgt

SEQ ID NO: 31650 - DNA, 20 bp, synthetic construct
  misc_feature 1..20: note = CRISPR gRNA sequence
  source 1..20: mol_type = other DNA
agaggcgctcaaacaatgtg

SEQ ID NO: 31651 - DNA, 20 bp, synthetic construct
  misc_feature 1..20: note = CRISPR gRNA sequence
  source 1..20: mol_type = other DNA
aaacaatgtgtgatgaagga

SEQ ID NO: 31652 - DNA, 20 bp, synthetic construct
  misc_feature 1..20: note = CRISPR gRNA sequence
  source 1..20: mol_type = other DNA
acttgttctgtaatcaagtt

SEQ ID NO: 31653 - DNA, 20 bp, synthetic construct
  misc_feature 1..20: note = CRISPR gRNA sequence
  source 1..20: mol_type = other DNA
gttctgtaatcaagttttgt

SEQ ID NO: 31654 - DNA, 20 bp, synthetic construct
  misc_feature 1..20: note = CRISPR gRNA sequence
  source 1..20: mol_type = other DNA
ttctgtaatcaagttttgtc

SEQ ID NO: 31655 - DNA, 20 bp, synthetic construct
  misc_feature 1..20: note = CRISPR gRNA sequence
  source 1..20: mol_type = other DNA
tgtaatcaagttttgtctgc

SEQ ID NO: 31656 - DNA, 20 bp, synthetic construct
  misc_feature 1..20: note = CRISPR gRNA sequence
  source 1..20: mol_type = other DNA
taatcaagttttgtctgcct

SEQ ID NO: 31657 - DNA, 20 bp, synthetic construct
  misc_feature 1..20: note = CRISPR gRNA sequence
  source 1..20: mol_type = other DNA
tgtctgccttctggacctta

SEQ ID NO: 31658 - DNA, 20 bp, synthetic construct
  misc_feature 1..20: note = CRISPR gRNA sequence
  source 1..20: mol_type = other DNA
gtctgccttctggaccttag

SEQ ID NO: 31659 - DNA, 20 bp, synthetic construct
  misc_feature 1..20: note = CRISPR gRNA sequence
  source 1..20: mol_type = other DNA
tctgccttctggaccttagc

SEQ ID NO: 31660 - DNA, 20 bp, synthetic construct
  misc_feature 1..20: note = CRISPR gRNA sequence
  source 1..20: mol_type = other DNA
ccttctggaccttagctctg

SEQ ID NO: 31661 - DNA, 20 bp, synthetic construct
  misc_feature 1..20: note = CRISPR gRNA sequence
  source 1..20: mol_type = other DNA
ctggaccttagctctgccgt

SEQ ID NO: 31662 - DNA, 20 bp, synthetic construct
  misc_feature 1..20: note = CRISPR gRNA sequence
  source 1..20: mol_type = other DNA
tggaccttagctctgccgtc

SEQ ID NO: 31663 - DNA, 20 bp, synthetic construct
  misc_feature 1..20: note = CRISPR gRNA sequence
  source 1..20: mol_type = other DNA
gaccttagctctgccgtcta

SEQ ID NO: 31664 - DNA, 20 bp, synthetic construct
  misc_feature 1..20: note = CRISPR gRNA sequence
  source 1..20: mol_type = other DNA
agctctgccgtctataaatt

SEQ ID NO: 31665 - DNA, 20 bp, synthetic construct
  misc_feature 1..20: note = CRISPR gRNA sequence
  source 1..20: mol_type = other DNA
gctctgccgtctataaattt

SEQ ID NO: 31666 - DNA, 20 bp, synthetic construct
  misc_feature 1..20: note = CRISPR gRNA sequence
  source 1..20: mol_type = other DNA
tgccgtctataaatttggga

SEQ ID NO: 31667 - DNA, 20 bp, synthetic construct
  misc_feature 1..20: note = CRISPR gRNA sequence
  source 1..20: mol_type = other DNA
ccgtctataaatttgggaca

SEQ ID NO: 31668 - DNA, 20 bp, synthetic construct
  misc_feature 1..20: note = CRISPR gRNA sequence
  source 1..20: mol_type = other DNA
taaatttgggacaacagttg

SEQ ID NO: 31669 - DNA, 20 bp, synthetic construct
  misc_feature 1..20: note = CRISPR gRNA sequence
  source 1..20: mol_type = other DNA
gggacaacagttgtcctaaa

SEQ ID NO: 31670 - DNA, 20 bp, synthetic construct
  misc_feature 1..20: note = CRISPR gRNA sequence
  source 1..20: mol_type = other DNA
ggacaacagttgtcctaaat

SEQ ID NO: 31671 - DNA, 20 bp, synthetic construct
  misc_feature 1..20: note = CRISPR gRNA sequence
  source 1..20: mol_type = other DNA
tcctaaatgcctcaaagggt

SEQ ID NO: 31672 - DNA, 20 bp, synthetic construct
  misc_feature 1..20: note = CRISPR gRNA sequence
  source 1..20: mol_type = other DNA
aatgcctcaaagggtggcag

SEQ ID NO: 31673 - DNA, 20 bp, synthetic construct
  misc_feature 1..20: note = CRISPR gRNA sequence
  source 1..20: mol_type = other DNA
aaagggtggcagtaggtgtc

SEQ ID NO: 31674 - DNA, 20 bp, synthetic construct
  misc_feature 1..20: note = CRISPR gRNA sequence
  source 1..20: mol_type = other DNA
ctgttactaggtgcacaagg

SEQ ID NO: 31675 - DNA, 20 bp, synthetic construct
  misc_feature 1..20: note = CRISPR gRNA sequence
  source 1..20: mol_type = other DNA
tgttactaggtgcacaaggc

SEQ ID NO: 31676 - DNA, 20 bp, synthetic construct
  misc_feature 1..20: note = CRISPR gRNA sequence
  source 1..20: mol_type = other DNA
ttactaggtgcacaaggcat

SEQ ID NO: 31677 - DNA, 20 bp, synthetic construct
  misc_feature 1..20: note = CRISPR gRNA sequence
  source 1..20: mol_type = other DNA
ctaggtgcacaaggcatcct

SEQ ID NO: 31678 - DNA, 20 bp, synthetic construct
  misc_feature 1..20: note = CRISPR gRNA sequence
  source 1..20: mol_type = other DNA
ggtgcacaaggcatccttgt

SEQ ID NO: 31679 - DNA, 20 bp, synthetic construct
  misc_feature 1..20: note = CRISPR gRNA sequence
  source 1..20: mol_type = other DNA
gttaactcctagaaggggag

SEQ ID NO: 31680 - DNA, 20 bp, synthetic construct
  misc_feature 1..20: note = CRISPR gRNA sequence
  source 1..20: mol_type = other DNA
ttaactcctagaaggggaga

SEQ ID NO: 31681 - DNA, 20 bp, synthetic construct
  misc_feature 1..20: note = CRISPR gRNA sequence
  source 1..20: mol_type = other DNA
actcctagaaggggagaggt

SEQ ID NO: 31682 - DNA, 20 bp, synthetic construct
  misc_feature 1..20: note = CRISPR gRNA sequence
  source 1..20: mol_type = other DNA
ctagaaggggagaggttctc

SEQ ID NO: 31683 - DNA, 20 bp, synthetic construct
  misc_feature 1..20: note = CRISPR gRNA sequence
  source 1..20: mol_type = other DNA
gaaggggagaggttctccat

SEQ ID NO: 31684 - DNA, 20 bp, synthetic construct
  misc_feature 1..20: note = CRISPR gRNA sequence
  source 1..20: mol_type = other DNA
tccatggctttagctaagac

SEQ ID NO: 31685 - DNA, 20 bp, synthetic construct
  misc_feature 1..20: note = CRISPR gRNA sequence
  source 1..20: mol_type = other DNA
catggctttagctaagactt

SEQ ID NO: 31686 - DNA, 20 bp, synthetic construct
  misc_feature 1..20: note = CRISPR gRNA sequence
  source 1..20: mol_type = other DNA
tagctaagacttgggcacat

SEQ ID NO: 31687 - DNA, 20 bp, synthetic construct
  misc_feature 1..20: note = CRISPR gRNA sequence
  source 1..20: mol_type = other DNA
agctaagacttgggcacatg

SEQ ID NO: 31688 - DNA, 20 bp, synthetic construct
  misc_feature 1..20: note = CRISPR gRNA sequence
  source 1..20: mol_type = other DNA
gctaagacttgggcacatga

SEQ ID NO: 31689 - DNA, 20 bp, synthetic construct
  misc_feature 1..20: note = CRISPR gRNA sequence
  source 1..20: mol_type = other DNA
agacttgggcacatgatggc

SEQ ID NO: 31690 - DNA, 20 bp, synthetic construct
  misc_feature 1..20: note = CRISPR gRNA sequence
  source 1..20: mol_type = other DNA
gggcacatgatggcaggttt

SEQ ID NO: 31691 - DNA, 20 bp, synthetic construct
  misc_feature 1..20: note = CRISPR gRNA sequence
  source 1..20: mol_type = other DNA
ggcacatgatggcaggtttt

SEQ ID NO: 31692 - DNA, 20 bp, synthetic construct
  misc_feature 1..20: note = CRISPR gRNA sequence
  source 1..20: mol_type = other DNA
tgaatgcagcaaagttttca

SEQ ID NO: 31693 - DNA, 20 bp, synthetic construct
  misc_feature 1..20: note = CRISPR gRNA sequence
  source 1..20: mol_type = other DNA
gaatgcagcaaagttttcaa

SEQ ID NO: 31694 - DNA, 20 bp, synthetic construct
  misc_feature 1..20: note = CRISPR gRNA sequence
  source 1..20: mol_type = other DNA
aatgcagcaaagttttcaat

SEQ ID NO: 31695 - DNA, 20 bp, synthetic construct
  misc_feature 1..20: note = CRISPR gRNA sequence
  source 1..20: mol_type = other DNA
tcaattctagaggctccgcc

SEQ ID NO: 31696 - DNA, 20 bp, synthetic construct
  misc_feature 1..20: note = CRISPR gRNA sequence
  source 1..20: mol_type = other DNA
caattctagaggctccgcct

SEQ ID NO: 31697 - DNA, 20 bp, synthetic construct
  misc_feature 1..20: note = CRISPR gRNA sequence
  source 1..20: mol_type = other DNA
aattctagaggctccgcctg

SEQ ID NO: 31698 - DNA, 20 bp, synthetic construct
  misc_feature 1..20: note = CRISPR gRNA sequence
  source 1..20: mol_type = other DNA
tagaggctccgcctgggcag

SEQ ID NO: 31699 - DNA, 20 bp, synthetic construct
  misc_feature 1..20: note = CRISPR gRNA sequence
  source 1..20: mol_type = other DNA
gaggctccgcctgggcagcg

SEQ ID NO: 31700 - DNA, 20 bp, synthetic construct
  misc_feature 1..20: note = CRISPR gRNA sequence
  source 1..20: mol_type = other DNA
cgcctgggcagcgagtgcag

SEQ ID NO: 31701 - DNA, 20 bp, synthetic construct
  misc_feature 1..20: note = CRISPR gRNA sequence
  source 1..20: mol_type = other DNA
ggcagcgagtgcagtgagag

SEQ ID NO: 31702 - DNA, 20 bp, synthetic construct
  misc_feature 1..20: note = CRISPR gRNA sequence
  source 1..20: mol_type = other DNA
tggttagccattgcccagaa

SEQ ID NO: 31703 - DNA, 20 bp, synthetic construct
  misc_feature 1..20: note = CRISPR gRNA sequence
  source 1..20: mol_type = other DNA
gttagccattgcccagaaag

SEQ ID NO: 31704 - DNA, 20 bp, synthetic construct
  misc_feature 1..20: note = CRISPR gRNA sequence
  source 1..20: mol_type = other DNA
gccattgcccagaaagaggg

SEQ ID NO: 31705 - DNA, 20 bp, synthetic construct
  misc_feature 1..20: note = CRISPR gRNA sequence
  source 1..20: mol_type = other DNA
cccagaaagagggcatgggg

SEQ ID NO: 31706 - DNA, 20 bp, synthetic construct
  misc_feature 1..20: note = CRISPR gRNA sequence
  source 1..20: mol_type = other DNA
gaaatgcccatgacaaactt

SEQ ID NO: 31707 - DNA, 20 bp, synthetic construct
  misc_feature 1..20: note = CRISPR gRNA sequence
  source 1..20: mol_type = other DNA
gagaatgggtcctacatgtc

SEQ ID NO: 31708 - DNA, 20 bp, synthetic construct
  misc_feature 1..20: note = CRISPR gRNA sequence
  source 1..20: mol_type = other DNA
agaatgggtcctacatgtcc

SEQ ID NO: 31709 - DNA, 20 bp, synthetic construct
  misc_feature 1..20: note = CRISPR gRNA sequence
  source 1..20: mol_type = other DNA
catgtcctcaacctgcatgg

SEQ ID NO: 31710 - DNA, 20 bp, synthetic construct
  misc_feature 1..20: note = CRISPR gRNA sequence
  source 1..20: mol_type = other DNA
aacctgcatggcgtgaacca

SEQ ID NO: 31711 - DNA, 20 bp, synthetic construct
  misc_feature 1..20: note = CRISPR gRNA sequence
  source 1..20: mol_type = other DNA
catggcgtgaaccacctccc

SEQ ID NO: 31712 - DNA, 20 bp, synthetic construct
  misc_feature 1..20: note = CRISPR gRNA sequence
  source 1..20: mol_type = other DNA
ccatccgcctctcctctcac

SEQ ID NO: 31713 - DNA, 20 bp, synthetic construct
  misc_feature 1..20: note = CRISPR gRNA sequence
  source 1..20: mol_type = other DNA
tcctctcacctctgagtctg

SEQ ID NO: 31714 - DNA, 20 bp, synthetic construct
  misc_feature 1..20: note = CRISPR gRNA sequence
  source 1..20: mol_type = other DNA
ctctcacctctgagtctgca

SEQ ID NO: 31715 - DNA, 20 bp, synthetic construct
  misc_feature 1..20: note = CRISPR gRNA sequence
  source 1..20: mol_type = other DNA
tcacctctgagtctgcacaa

SEQ ID NO: 31716 - DNA, 20 bp, synthetic construct
  misc_feature 1..20: note = CRISPR gRNA sequence
  source 1..20: mol_type = other DNA
acctctgagtctgcacaagc

SEQ ID NO: 31717 - DNA, 20 bp, synthetic construct
  misc_feature 1..20: note = CRISPR gRNA sequence
  source 1..20: mol_type = other DNA
tgagtctgcacaagctttcc

SEQ ID NO: 31718 - DNA, 20 bp, synthetic construct
  misc_feature 1..20: note = CRISPR gRNA sequence
  source 1..20: mol_type = other DNA
agtctgcacaagctttccca

SEQ ID NO: 31719 - DNA, 20 bp, synthetic construct
  misc_feature 1..20: note = CRISPR gRNA sequence
  source 1..20: mol_type = other DNA
cacaagctttcccaggtctt

SEQ ID NO: 31720 - DNA, 20 bp, synthetic construct
  misc_feature 1..20: note = CRISPR gRNA sequence
  source 1..20: mol_type = other DNA
tcccaggtcttccacatcct

SEQ ID NO: 31721 - DNA, 20 bp, synthetic construct
  misc_feature 1..20: note = CRISPR gRNA sequence
  source 1..20: mol_type = other DNA
cccaggtcttccacatcctt

SEQ ID NO: 31722 - DNA, 20 bp, synthetic construct
  misc_feature 1..20: note = CRISPR gRNA sequence
  source 1..20: mol_type = other DNA
ccaggtcttccacatccttc

SEQ ID NO: 31723 - DNA, 20 bp, synthetic construct
  misc_feature 1..20: note = CRISPR gRNA sequence
  source 1..20: mol_type = other DNA
ccacatccttcagggacttg

SEQ ID NO: 31724 - DNA, 20 bp, synthetic construct
  misc_feature 1..20: note = CRISPR gRNA sequence
  source 1..20: mol_type = other DNA
cacatccttcagggacttgg

SEQ ID NO: 31725 - DNA, 20 bp, synthetic construct
  misc_feature 1..20: note = CRISPR gRNA sequence
  source 1..20: mol_type = other DNA
cagggacttggctttgaaag

SEQ ID NO: 31726 - DNA, 20 bp, synthetic construct
  misc_feature 1..20: note = CRISPR gRNA sequence
  source 1..20: mol_type = other DNA
agggacttggctttgaaagg

SEQ ID NO: 31727 - DNA, 20 bp, synthetic construct
  misc_feature 1..20: note = CRISPR gRNA sequence
  source 1..20: mol_type = other DNA
ggctttgaaaggctcgatgg

SEQ ID NO: 31728 - DNA, 20 bp, synthetic construct
  misc_feature 1..20: note = CRISPR gRNA sequence
  source 1..20: mol_type = other DNA
gctttgaaaggctcgatggt

SEQ ID NO: 31729 - DNA, 20 bp, synthetic construct
  misc_feature 1..20: note = CRISPR gRNA sequence
  source 1..20: mol_type = other DNA
tgaaaggctcgatggtgaac

SEQ ID NO: 31730 - DNA, 20 bp, synthetic construct
  misc_feature 1..20: note = CRISPR gRNA sequence
  source 1..20: mol_type = other DNA
gaaaggctcgatggtgaact

SEQ ID NO: 31731 - DNA, 20 bp, synthetic construct
  misc_feature 1..20: note = CRISPR gRNA sequence
  source 1..20: mol_type = other DNA
aaaggctcgatggtgaactt

SEQ ID NO: 31732 - DNA, 20 bp, synthetic construct
  misc_feature 1..20: note = CRISPR gRNA sequence
  source 1..20: mol_type = other DNA
gatggtgaacttctcctctg

SEQ ID NO: 31733 - DNA, 20 bp, synthetic construct
  misc_feature 1..20: note = CRISPR gRNA sequence
  source 1..20: mol_type = other DNA
ctcctctgctgcctgaagta

SEQ ID NO: 31734 - DNA, 20 bp, synthetic construct
  misc_feature 1..20: note = CRISPR gRNA sequence
  source 1..20: mol_type = other DNA
tcctctgctgcctgaagtag

SEQ ID NO: 31735 - DNA, 20 bp, synthetic construct
  misc_feature 1..20: note = CRISPR gRNA sequence
  source 1..20: mol_type = other DNA
ctctgctgcctgaagtagct

SEQ ID NO: 31736 - DNA, 20 bp, synthetic construct
  misc_feature 1..20: note = CRISPR gRNA sequence
  source 1..20: mol_type = other DNA
tgctgcctgaagtagcttgg

SEQ ID NO: 31737 - DNA, 20 bp, synthetic construct
  misc_feature 1..20: note = CRISPR gRNA sequence
  source 1..20: mol_type = other DNA
ctgcctgaagtagcttggtc

SEQ ID NO: 31738 - DNA, 20 bp, synthetic construct
  misc_feature 1..20: note = CRISPR gRNA sequence
  source 1..20: mol_type = other DNA
cctgaagtagcttggtctcc

SEQ ID NO: 31739 - DNA, 20 bp, synthetic construct
  misc_feature 1..20: note = CRISPR gRNA sequence
  source 1..20: mol_type = other DNA
aagtagcttggtctccccat

SEQ ID NO: 31740 - DNA, 20 bp, synthetic construct
  misc_feature 1..20: note = CRISPR gRNA sequence
  source 1..20: mol_type = other DNA
ggtctccccatgctgctgca

SEQ ID NO: 31741 - DNA, 20 bp, synthetic construct
  misc_feature 1..20: note = CRISPR gRNA sequence
  source 1..20: mol_type = other DNA
gtctccccatgctgctgcag

SEQ ID NO: 31742 - DNA, 20 bp, synthetic construct
  misc_feature 1..20: note = CRISPR gRNA sequence
  source 1..20: mol_type = other DNA
cccatgctgctgcagggact

SEQ ID NO: 31743 - DNA, 20 bp, synthetic construct
  misc_feature 1..20: note = CRISPR gRNA sequence
  source 1..20: mol_type = other DNA
ctgcagggactcccacagcg

SEQ ID NO: 31744 - DNA, 20 bp, synthetic construct
  misc_feature 1..20: note = CRISPR gRNA sequence
  source 1..20: mol_type = other DNA
cagggactcccacagcgcca

SEQ ID NO: 31745 - DNA, 20 bp, synthetic construct
  misc_feature 1..20: note = CRISPR gRNA sequence
  source 1..20: mol_type = other DNA
ccacagcgccaccgtgtcgc

SEQ ID NO: 31746 - DNA, 20 bp, synthetic construct
  misc_feature 1..20: note = CRISPR gRNA sequence
  source 1..20: mol_type = other DNA
aaggcagccctgtggaggga

SEQ ID NO: 31747 - DNA, 20 bp, synthetic construct
  misc_feature 1..20: note = CRISPR gRNA sequence
  source 1..20: mol_type = other DNA
tggagggagggcctcagacc

SEQ ID NO: 31748 - DNA, 20 bp, synthetic construct
  misc_feature 1..20: note = CRISPR gRNA sequence
  source 1..20: mol_type = other DNA
agacccaggcacggtgacca

SEQ ID NO: 31749 - DNA, 20 bp, synthetic construct
  misc_feature 1..20: note = CRISPR gRNA sequence
  source 1..20: mol_type = other DNA
gaccttaatggaagggcagc

SEQ ID NO: 31750 - DNA, 20 bp, synthetic construct
  misc_feature 1..20: note = CRISPR gRNA sequence
  source 1..20: mol_type = other DNA
aatggaagggcagctccatg

SEQ ID NO: 31751 - DNA, 20 bp, synthetic construct
  misc_feature 1..20: note = CRISPR gRNA sequence
  source 1..20: mol_type = other DNA
atggaagggcagctccatga

SEQ ID NO: 31752 - DNA, 20 bp, synthetic construct
  misc_feature 1..20: note = CRISPR gRNA sequence
  source 1..20: mol_type = other DNA
catgaagggtcctcctacct

SEQ ID NO: 31753 - DNA, 20 bp, synthetic construct
  misc_feature 1..20: note = CRISPR gRNA sequence
  source 1..20: mol_type = other DNA
ctacctattaaaatactttc

SEQ ID NO: 31754 - DNA, 20 bp, synthetic construct
  misc_feature 1..20: note = CRISPR gRNA sequence
  source 1..20: mol_type = other DNA
cctattaaaatactttcttt

SEQ ID NO: 31755 - DNA, 20 bp, synthetic construct
  misc_feature 1..20: note = CRISPR gRNA sequence
  source 1..20: mol_type = other DNA
ttaaaatactttctttcctt

SEQ ID NO: 31756 - DNA, 20 bp, synthetic construct
  misc_feature 1..20: note = CRISPR gRNA sequence
  source 1..20: mol_type = other DNA
aaatactttctttccttagc

SEQ ID NO: 31757 - DNA, 20 bp, synthetic construct
  misc_feature 1..20: note = CRISPR gRNA sequence
  source 1..20: mol_type = other DNA
tctttccttagctcaacctc

SEQ ID NO: 31758 - DNA, 20 bp, synthetic construct
  misc_feature 1..20: note = CRISPR gRNA sequence
  source 1..20: mol_type = other DNA
ctttccttagctcaacctct

SEQ ID NO: 31759 - DNA, 20 bp, synthetic construct
  misc_feature 1..20: note = CRISPR gRNA sequence
  source 1..20: mol_type = other DNA
tttccttagctcaacctcta

SEQ ID NO: 31760 - DNA, 20 bp, synthetic construct
  misc_feature 1..20: note = CRISPR gRNA sequence
  source 1..20: mol_type = other DNA
tccttagctcaacctctacc

SEQ ID NO: 31761 - DNA, 20 bp, synthetic construct
  misc_feature 1..20: note = CRISPR gRNA sequence
  source 1..20: mol_type = other DNA
ccttagctcaacctctacct

SEQ ID NO: 31762 - DNA, 20 bp, synthetic construct
  misc_feature 1..20: note = CRISPR gRNA sequence
  source 1..20: mol_type = other DNA
cttagctcaacctctacctt

SEQ ID NO: 31763 - DNA, 20 bp, synthetic construct
  misc_feature 1..20: note = CRISPR gRNA sequence
  source 1..20: mol_type = other DNA
agctcaacctctacctttcc

SEQ ID NO: 31764 - DNA, 20 bp, synthetic construct
  misc_feature 1..20: note = CRISPR gRNA sequence
  source 1..20: mol_type = other DNA
gctcaacctctacctttccc

SEQ ID NO: 31765 - DNA, 20 bp, synthetic construct
  misc_feature 1..20: note = CRISPR gRNA sequence
  source 1..20: mol_type = other DNA
aacctctacctttcccagaa

SEQ ID NO: 31766 - DNA, 20 bp, synthetic construct
  misc_feature 1..20: note = CRISPR gRNA sequence
  source 1..20: mol_type = other DNA
tacctttcccagaaagcctt

SEQ ID NO: 31767 - DNA, 20 bp, synthetic construct
  misc_feature 1..20: note = CRISPR gRNA sequence
  source 1..20: mol_type = other DNA
cctttcccagaaagccttcc

SEQ ID NO: 31768 - DNA, 20 bp, synthetic construct
  misc_feature 1..20: note = CRISPR gRNA sequence
  source 1..20: mol_type = other DNA
tcccagaaagccttccatga

SEQ ID NO: 31769 - DNA, 20 bp, synthetic construct
  misc_feature 1..20: note = CRISPR gRNA sequence
  source 1..20: mol_type = other DNA
cccagaaagccttccatgac

SEQ ID NO: 31770 - DNA, 20 bp, synthetic construct
  misc_feature 1..20: note = CRISPR gRNA sequence
  source 1..20: mol_type = other DNA
ccagaaagccttccatgacc

SEQ ID NO: 31771 - DNA, 20 bp, synthetic construct
  misc_feature 1..20: note = CRISPR gRNA sequence
  source 1..20: mol_type = other DNA
ccatgaccactccagccttt

SEQ ID NO: 31772 - DNA, 20 bp, synthetic construct
  misc_feature 1..20: note = CRISPR gRNA sequence
  source 1..20: mol_type = other DNA
catgaccactccagccttta

SEQ ID NO: 31773 - DNA, 20 bp, synthetic construct
  misc_feature 1..20: note = CRISPR gRNA sequence
  source 1..20: mol_type = other DNA
cagcctttattgattcctac

SEQ ID NO: 31774 - DNA, 20 bp, synthetic construct
  misc_feature 1..20: note = CRISPR gRNA sequence
  source 1..20: mol_type = other DNA
tattgattcctactttctca

SEQ ID NO: 31775 - DNA, 20 bp, synthetic construct
  misc_feature 1..20: note = CRISPR gRNA sequence
  source 1..20: mol_type = other DNA
attgattcctactttctcac

SEQ ID NO: 31776 - DNA, 20 bp, synthetic construct
  misc_feature 1..20: note = CRISPR gRNA sequence
  source 1..20: mol_type = other DNA
ttgattcctactttctcaca

SEQ ID NO: 31777 - DNA, 20 bp, synthetic construct
  misc_feature 1..20: note = CRISPR gRNA sequence
  source 1..20: mol_type = other DNA
attcctactttctcacaact

SEQ ID NO: 31778 - DNA, 20 bp, synthetic construct
  misc_feature 1..20: note = CRISPR gRNA sequence
  source 1..20: mol_type = other DNA
ctactttctcacaactcaca

SEQ ID NO: 31779 - DNA, 20 bp, synthetic construct
  misc_feature 1..20: note = CRISPR gRNA sequence
  source 1..20: mol_type = other DNA
ctttctcacaactcacacag

SEQ ID NO: 31780 - DNA, 20 bp, synthetic construct
  misc_feature 1..20: note = CRISPR gRNA sequence
  source 1..20: mol_type = other DNA
tctcacaactcacacagtgg

SEQ ID NO: 31781 - DNA, 20 bp, synthetic construct
  misc_feature 1..20: note = CRISPR gRNA sequence
  source 1..20: mol_type = other DNA
ctcacaactcacacagtggt

SEQ ID NO: 31782 - DNA, 20 bp, synthetic construct
  misc_feature 1..20: note = CRISPR gRNA sequence
  source 1..20: mol_type = other DNA
tcacaactcacacagtggtt

SEQ ID NO: 31783 - DNA, 20 bp, synthetic construct
  misc_feature 1..20: note = CRISPR gRNA sequence
  source 1..20: mol_type = other DNA
acaactcacacagtggtttt

SEQ ID NO: 31784 - DNA, 20 bp, synthetic construct
  misc_feature 1..20: note = CRISPR gRNA sequence
  source 1..20: mol_type = other DNA
acacagtggttttctttccc

SEQ ID NO: 31785 - DNA, 20 bp, synthetic construct
  misc_feature 1..20: note = CRISPR gRNA sequence
  source 1..20: mol_type = other DNA
tctttccctttttgcttcgg

SEQ ID NO: 31786 - DNA, 20 bp, synthetic construct
  misc_feature 1..20: note = CRISPR gRNA sequence
  source 1..20: mol_type = other DNA
ctttccctttttgcttcggc

SEQ ID NO: 31787 - DNA, 20 bp, synthetic construct
  misc_feature 1..20: note = CRISPR gRNA sequence
  source 1..20: mol_type = other DNA
tttccctttttgcttcggct

SEQ ID NO: 31788 - DNA, 20 bp, synthetic construct
  misc_feature 1..20: note = CRISPR gRNA sequence
  source 1..20: mol_type = other DNA
tccctttttgcttcggctac

SEQ ID NO: 31789 - DNA, 20 bp, synthetic construct
  misc_feature 1..20: note = CRISPR gRNA sequence
  source 1..20: mol_type = other DNA
ccctttttgcttcggctacc

SEQ ID NO: 31790 - DNA, 20 bp, synthetic construct
  misc_feature 1..20: note = CRISPR gRNA sequence
  source 1..20: mol_type = other DNA
cctttttgcttcggctacca

SEQ ID NO: 31791 - DNA, 20 bp, synthetic construct
  misc_feature 1..20: note = CRISPR gRNA sequence
  source 1..20: mol_type = other DNA
tttgcttcggctaccaggaa

SEQ ID NO: 31792 - DNA, 20 bp, synthetic construct
  misc_feature 1..20: note = CRISPR gRNA sequence
  source 1..20: mol_type = other DNA
ttgcttcggctaccaggaag

SEQ ID NO: 31793 - DNA, 20 bp, synthetic construct
  misc_feature 1..20: note = CRISPR gRNA sequence
  source 1..20: mol_type = other DNA
tgcttcggctaccaggaagc

SEQ ID NO: 31794 - DNA, 20 bp, synthetic construct
  misc_feature 1..20: note = CRISPR gRNA sequence
  source 1..20: mol_type = other DNA
gcttcggctaccaggaagct

SEQ ID NO: 31795 - DNA, 20 bp, synthetic construct
  misc_feature 1..20: note = CRISPR gRNA sequence
  source 1..20: mol_type = other DNA
cttcggctaccaggaagctc

SEQ ID NO: 31796 - DNA, 20 bp, synthetic construct
  misc_feature 1..20: note = CRISPR gRNA sequence
  source 1..20: mol_type = other DNA
cggctaccaggaagctcact

SEQ ID NO: 31797 - DNA, 20 bp, synthetic construct
  misc_feature 1..20: note = CRISPR gRNA sequence
  source 1..20: mol_type = other DNA
ggctaccaggaagctcactg

SEQ ID NO: 31798 - DNA, 20 bp, synthetic construct
  misc_feature 1..20: note = CRISPR gRNA sequence
  source 1..20: mol_type = other DNA
ccaggaagctcactgctaaa

SEQ ID NO: 31799 - DNA, 20 bp, synthetic construct
  misc_feature 1..20: note = CRISPR gRNA sequence
  source 1..20: mol_type = other DNA
actgctaaattattggcaca

SEQ ID NO: 31800 - DNA, 20 bp, synthetic construct
  misc_feature 1..20: note = CRISPR gRNA sequence
  source 1..20: mol_type = other DNA
ctaaattattggcacaatta

SEQ ID NO: 31801 - DNA, 20 bp, synthetic construct
  misc_feature 1..20: note = CRISPR gRNA sequence
  source 1..20: mol_type = other DNA
aattattggcacaattatgt

SEQ ID NO: 31802 - DNA, 20 bp, synthetic construct
  misc_feature 1..20: note = CRISPR gRNA sequence
  source 1..20: mol_type = other DNA
ttggcacaattatgtaggac

SEQ ID NO: 31803 - DNA, 20 bp, synthetic construct
  misc_feature 1..20: note = CRISPR gRNA sequence
  source 1..20: mol_type = other DNA
gcacaattatgtaggacctt

SEQ ID NO: 31804 - DNA, 20 bp, synthetic construct
  misc_feature 1..20: note = CRISPR gRNA sequence
  source 1..20: mol_type = other DNA
tgtaggaccttacagcttgg

SEQ ID NO: 31805 - DNA, 20 bp, synthetic construct
  misc_feature 1..20: note = CRISPR gRNA sequence
  source 1..20: mol_type = other DNA
acagcttgggtaaagtatgt

SEQ ID NO: 31806 - DNA, 20 bp, synthetic construct
  misc_feature 1..20: note = CRISPR gRNA sequence
  source 1..20: mol_type = other DNA
cagcttgggtaaagtatgtt

SEQ ID NO: 31807 - DNA, 20 bp, synthetic construct
  misc_feature 1..20: note = CRISPR gRNA sequence
  source 1..20: mol_type = other DNA
gggtaaagtatgtttagggg

SEQ ID NO: 31808 - DNA, 20 bp, synthetic construct
  misc_feature 1..20: note = CRISPR gRNA sequence
  source 1..20: mol_type = other DNA
ggtaaagtatgtttaggggg

SEQ ID NO: 31809 - DNA, 20 bp, synthetic construct
  misc_feature 1..20: note = CRISPR gRNA sequence
  source 1..20: mol_type = other DNA
agggggaaatatggaagcaa

SEQ ID NO: 31810 - DNA, 20 bp, synthetic construct
  misc_feature 1..20: note = CRISPR gRNA sequence
  source 1..20: mol_type = other DNA
gggggaaatatggaagcaat

SEQ ID NO: 31811 - DNA, 20 bp, synthetic construct
  misc_feature 1..20: note = CRISPR gRNA sequence
  source 1..20: mol_type = other DNA
tggcgattaagctgaaatgc

SEQ ID NO: 31812 - DNA, 20 bp, synthetic construct
  misc_feature 1..20: note = CRISPR gRNA sequence
  source 1..20: mol_type = other DNA
gcgattaagctgaaatgctc

SEQ ID NO: 31813 - DNA, 20 bp, synthetic construct
  misc_feature 1..20: note = CRISPR gRNA sequence
  source 1..20: mol_type = other DNA
agctgaaatgctcaagcaga

SEQ ID NO: 31814 - DNA, 20 bp, synthetic construct
  misc_feature 1..20: note = CRISPR gRNA sequence
  source 1..20: mol_type = other DNA
aaatgctcaagcagattgca

SEQ ID NO: 31815 - DNA, 20 bp, synthetic construct
  misc_feature 1..20: note = CRISPR gRNA sequence
  source 1..20: mol_type = other DNA
aagcagattgcagaccgact

SEQ ID NO: 31816 - DNA, 20 bp, synthetic construct
  misc_feature 1..20: note = CRISPR gRNA sequence
  source 1..20: mol_type = other DNA
cagaccgacttaatgaaacc

SEQ ID NO: 31817 - DNA, 20 bp, synthetic construct
  misc_feature 1..20: note = CRISPR gRNA sequence
  source 1..20: mol_type = other DNA
aatgaaaccaaattaaggaa

SEQ ID NO: 31818 - DNA, 20 bp, synthetic construct
  misc_feature 1..20: note = CRISPR gRNA sequence
  source 1..20: mol_type = other DNA
atgaaaccaaattaaggaat

SEQ ID NO: 31819 - DNA, 20 bp, synthetic construct
  misc_feature 1..20: note = CRISPR gRNA sequence
  source 1..20: mol_type = other DNA
aggaatttagccttcatcct

SEQ ID NO: 31820 - DNA, 20 bp, synthetic construct
  misc_feature 1..20: note = CRISPR gRNA sequence
  source 1..20: mol_type = other DNA
agccttcatcctgacagtgg

SEQ ID NO: 31821 - DNA, 20 bp, synthetic construct
  misc_feature 1..20: note = CRISPR gRNA sequence
  source 1..20: mol_type = other DNA
gccttcatcctgacagtggt

SEQ ID NO: 31822 - DNA, 20 bp, synthetic construct
  misc_feature 1..20: note = CRISPR gRNA sequence
  source 1..20: mol_type = other DNA
catcctgacagtggtggagt

SEQ ID NO: 31823 - DNA, 20 bp, synthetic construct
  misc_feature 1..20: note = CRISPR gRNA sequence
  source 1..20: mol_type = other DNA
atcctgacagtggtggagtg

SEQ ID NO: 31824 - DNA, 20 bp, synthetic construct
  misc_feature 1..20: note = CRISPR gRNA sequence
  source 1..20: mol_type = other DNA
acagtggtggagtgtccctg

SEQ ID NO: 31825 - DNA, 20 bp, synthetic construct
  misc_feature 1..20: note = CRISPR gRNA sequence
  source 1..20: mol_type = other DNA
aaggattgtaagcagggatg

SEQ ID NO: 31826 - DNA, 20 bp, synthetic construct
  misc_feature 1..20: note = CRISPR gRNA sequence
  source 1..20: mol_type = other DNA
taagcagggatgggatacaa

SEQ ID NO: 31827 - DNA, 20 bp, synthetic construct
  misc_feature 1..20: note = CRISPR gRNA sequence
  source 1..20: mol_type = other DNA
aagttctgagaagattggtc

SEQ ID NO: 31828 - DNA, 20 bp, synthetic construct
  misc_feature 1..20: note = CRISPR gRNA sequence
  source 1..20: mol_type = other DNA
tgagaagattggtctggttg

SEQ ID NO: 31829 - DNA, 20 bp, synthetic construct
  misc_feature 1..20: note = CRISPR gRNA sequence
  source 1..20: mol_type = other DNA
agaagattggtctggttgct

SEQ ID NO: 31830 - DNA, 20 bp, synthetic construct
  misc_feature 1..20: note = CRISPR gRNA sequence
  source 1..20: mol_type = other DNA
gtctggttgctgaatacaaa

SEQ ID NO: 31831 - DNA, 20 bp, synthetic construct
  misc_feature 1..20: note = CRISPR gRNA sequence
  source 1..20: mol_type = other DNA
gttgctgaatacaaaatgga

SEQ ID NO: 31832 - DNA, 20 bp, synthetic construct
  misc_feature 1..20: note = CRISPR gRNA sequence
  source 1..20: mol_type = other DNA
ctgaatacaaaatggagtgg

SEQ ID NO: 31833 - DNA, 20 bp, synthetic construct
  misc_feature 1..20: note = CRISPR gRNA sequence
  source 1..20: mol_type = other DNA
aatacaaaatggagtggaag

SEQ ID NO: 31834 - DNA, 20 bp, synthetic construct
  misc_feature 1..20: note = CRISPR gRNA sequence
  source 1..20: mol_type = other DNA
tactcttagcataagaaaac

SEQ ID NO: 31835 - DNA, 20 bp, synthetic construct
  misc_feature 1..20: note = CRISPR gRNA sequence
  source 1..20: mol_type = other DNA
actcttagcataagaaaacg

SEQ ID NO: 31836 - DNA, 20 bp, synthetic construct
  misc_feature 1..20: note = CRISPR gRNA sequence
  source 1..20: mol_type = other DNA
ctcttagcataagaaaacgg

SEQ ID NO: 31837 - DNA, 20 bp, synthetic construct
  misc_feature 1..20: note = CRISPR gRNA sequence
  source 1..20: mol_type = other DNA
ttagcataagaaaacggtgg

SEQ ID NO: 31838 - DNA, 20 bp, synthetic construct
  misc_feature 1..20: note = CRISPR gRNA sequence
  source 1..20: mol_type = other DNA
agcataagaaaacggtggcg

SEQ ID NO: 31839 - DNA, 20 bp, synthetic construct
  misc_feature 1..20: note = CRISPR gRNA sequence
  source 1..20: mol_type = other DNA
gcataagaaaacggtggcgt

SEQ ID NO: 31840 - DNA, 20 bp, synthetic construct
  misc_feature 1..20: note = CRISPR gRNA sequence
  source 1..20: mol_type = other DNA
agggggtggaaagaataaaa

SEQ ID NO: 31841 - DNA, 20 bp, synthetic construct
  misc_feature 1..20: note = CRISPR gRNA sequence
  source 1..20: mol_type = other DNA
gagcccaggtcagtctcaga

SEQ ID NO: 31842 - DNA, 20 bp, synthetic construct
  misc_feature 1..20: note = CRISPR gRNA sequence
  source 1..20: mol_type = other DNA
agcccaggtcagtctcagat

SEQ ID NO: 31843 - DNA, 20 bp, synthetic construct
  misc_feature 1..20: note = CRISPR gRNA sequence
  source 1..20: mol_type = other DNA
agattctagacataccccag

SEQ ID NO: 31844 - DNA, 20 bp, synthetic construct
  misc_feature 1..20: note = CRISPR gRNA sequence
  source 1..20: mol_type = other DNA
tagacataccccagtgactg

SEQ ID NO: 31845 - DNA, 20 bp, synthetic construct
  misc_feature 1..20: note = CRISPR gRNA sequence
  source 1..20: mol_type = other DNA
gacataccccagtgactggc

SEQ ID NO: 31846 - DNA, 20 bp, synthetic construct
  misc_feature 1..20: note = CRISPR gRNA sequence
  source 1..20: mol_type = other DNA
gcacatggcgggccttcaaa

SEQ ID NO: 31847 - DNA, 20 bp, synthetic construct
  misc_feature 1..20: note = CRISPR gRNA sequence
  source 1..20: mol_type = other DNA
caaatattgactgggagaat

SEQ ID NO: 31848 - DNA, 20 bp, synthetic construct
  misc_feature 1..20: note = CRISPR gRNA sequence
  source 1..20: mol_type = other DNA
aaatattgactgggagaatg

SEQ ID NO: 31849 - DNA, 20 bp, synthetic construct
  misc_feature 1..20: note = CRISPR gRNA sequence
  source 1..20: mol_type = other DNA
actgggagaatgccattgcc

SEQ ID NO: 31850 - DNA, 20 bp, synthetic construct
  misc_feature 1..20: note = CRISPR gRNA sequence
  source 1..20: mol_type = other DNA
ggagaatgccattgcctctc

SEQ ID NO: 31851 - DNA, 20 bp, synthetic construct
  misc_feature 1..20: note = CRISPR gRNA sequence
  source 1..20: mol_type = other DNA
cctctcacttgctgtgtggc

SEQ ID NO: 31852 - DNA, 20 bp, synthetic construct
  misc_feature 1..20: note = CRISPR gRNA sequence
  source 1..20: mol_type = other DNA
tcacttgctgtgtggcaagt

SEQ ID NO: 31853 - DNA, 20 bp, synthetic construct
  misc_feature 1..20: note = CRISPR gRNA sequence
  source 1..20: mol_type = other DNA
acttgctgtgtggcaagtgg

SEQ ID NO: 31854 - DNA, 20 bp, synthetic construct
  misc_feature 1..20: note = CRISPR gRNA sequence
  source 1..20: mol_type = other DNA
gctgtgtggcaagtggctgc

SEQ ID NO: 31855 - DNA, 20 bp, synthetic construct
  misc_feature 1..20: note = CRISPR gRNA sequence
  source 1..20: mol_type = other DNA
ctgtgtggcaagtggctgcc

SEQ ID NO: 31856 - DNA, 20 bp, synthetic construct
  misc_feature 1..20: note = CRISPR gRNA sequence
  source 1..20: mol_type = other DNA
tgtggcaagtggctgcccct

SEQ ID NO: 31857 - DNA, 20 bp, synthetic construct
  misc_feature 1..20: note = CRISPR gRNA sequence
  source 1..20: mol_type = other DNA
cccctctctgagcctcaaca

SEQ ID NO: 31858 - DNA, 20 bp, synthetic construct
  misc_feature 1..20: note = CRISPR gRNA sequence
  source 1..20: mol_type = other DNA
tctgagcctcaacatcctca

SEQ ID NO: 31859 - DNA, 20 bp, synthetic construct
  misc_feature 1..20: note = CRISPR gRNA sequence
  source 1..20: mol_type = other DNA
tgagcctcaacatcctcatc

SEQ ID NO: 31860 - DNA, 20 bp, synthetic construct
  misc_feature 1..20: note = CRISPR gRNA sequence
  source 1..20: mol_type = other DNA
agcctcaacatcctcatctt

SEQ ID NO: 31861 - DNA, 20 bp, synthetic construct
  misc_feature 1..20: note = CRISPR gRNA sequence
  source 1..20: mol_type = other DNA
aacatcctcatcttaaaaat

SEQ ID NO: 31862 - DNA, 20 bp, synthetic construct
  misc_feature 1..20: note = CRISPR gRNA sequence
  source 1..20: mol_type = other DNA
atcttaaaaatggagagaat

SEQ ID NO: 31863 - DNA, 20 bp, synthetic construct
  misc_feature 1..20: note = CRISPR gRNA sequence
  source 1..20: mol_type = other DNA
aaaaatggagagaatccatt

SEQ ID NO: 31864 - DNA, 20 bp, synthetic construct
  misc_feature 1..20: note = CRISPR gRNA sequence
  source 1..20: mol_type = other DNA
aaaatggagagaatccattc

SEQ ID NO: 31865 - DNA, 20 bp, synthetic construct
  misc_feature 1..20: note = CRISPR gRNA sequence
  source 1..20: mol_type = other DNA
tgccccacccggctgctctg

SEQ ID NO: 31866 - DNA, 20 bp, synthetic construct
  misc_feature 1..20: note = CRISPR gRNA sequence
  source 1..20: mol_type = other DNA
ccccacccggctgctctgca

SEQ ID NO: 31867 - DNA, 20 bp, synthetic construct
  misc_feature 1..20: note = CRISPR gRNA sequence
  source 1..20: mol_type = other DNA
ctctgcatactaaaagagac

SEQ ID NO: 31868 - DNA, 20 bp, synthetic construct
  misc_feature 1..20: note = CRISPR gRNA sequence
  source 1..20: mol_type = other DNA
tgcatactaaaagagacccc

SEQ ID NO: 31869 - DNA, 20 bp, synthetic construct
  misc_feature 1..20: note = CRISPR gRNA sequence
  source 1..20: mol_type = other DNA
catactaaaagagaccccac

SEQ ID NO: 31870 - DNA, 20 bp, synthetic construct
  misc_feature 1..20: note = CRISPR gRNA sequence
  source 1..20: mol_type = other DNA
aaagagaccccacagagcac

SEQ ID NO: 31871 - DNA, 20 bp, synthetic construct
  misc_feature 1..20: note = CRISPR gRNA sequence
  source 1..20: mol_type = other DNA
ggcttggcaccaagaccgca

SEQ ID NO: 31872 - DNA, 20 bp, synthetic construct
  misc_feature 1..20: note = CRISPR gRNA sequence
  source 1..20: mol_type = other DNA
ggcaccaagaccgcagttaa

SEQ ID NO: 31873 - DNA, 20 bp, synthetic construct
  misc_feature 1..20: note = CRISPR gRNA sequence
  source 1..20: mol_type = other DNA
gcaccaagaccgcagttaat

SEQ ID NO: 31874 - DNA, 20 bp, synthetic construct
  misc_feature 1..20: note = CRISPR gRNA sequence
  source 1..20: mol_type = other DNA
atgcccaacacaaggatgtc

SEQ ID NO: 31875 - DNA, 20 bp, synthetic construct
  misc_feature 1..20: note = CRISPR gRNA sequence
  source 1..20: mol_type = other DNA
ttccccaagcccctcacccc

SEQ ID NO: 31876 - DNA, 20 bp, synthetic construct
  misc_feature 1..20: note = CRISPR gRNA sequence
  source 1..20: mol_type = other DNA
ccccaagcccctcaccccac

SEQ ID NO: 31877 - DNA, 20 bp, synthetic construct
  misc_feature 1..20: note = CRISPR gRNA sequence
  source 1..20: mol_type = other DNA
cccaagcccctcaccccacc

SEQ ID NO: 31878 - DNA, 20 bp, synthetic construct
  misc_feature 1..20: note = CRISPR gRNA sequence
  source 1..20: mol_type = other DNA
accccacctgaaacgggtga

SEQ ID NO: 31879 - DNA, 20 bp, synthetic construct
  misc_feature 1..20: note = CRISPR gRNA sequence
  source 1..20: mol_type = other DNA
aaacgggtgacacagctgag

SEQ ID NO: 31880 - DNA, 20 bp, synthetic construct
  misc_feature 1..20: note = CRISPR gRNA sequence
  source 1..20: mol_type = other DNA
agtcccacgaggctccccaa

SEQ ID NO: 31881 - DNA, 20 bp, synthetic construct
  misc_feature 1..20: note = CRISPR gRNA sequence
  source 1..20: mol_type = other DNA
cccaatccagaggggcaaat

SEQ ID NO: 31882 - DNA, 20 bp, synthetic construct
  misc_feature 1..20: note = CRISPR gRNA sequence
  source 1..20: mol_type = other DNA
cggaggtccagggagaagtc

SEQ ID NO: 31883 - DNA, 20 bp, synthetic construct
  misc_feature 1..20: note = CRISPR gRNA sequence
  source 1..20: mol_type = other DNA
ggcccgccgcctccaaggcc

SEQ ID NO: 31884 - DNA, 20 bp, synthetic construct
  misc_feature 1..20: note = CRISPR gRNA sequence
  source 1..20: mol_type = other DNA
gcccgccgcctccaaggcct

SEQ ID NO: 31885 - DNA, 20 bp, synthetic construct
  misc_feature 1..20: note = CRISPR gRNA sequence
  source 1..20: mol_type = other DNA
caaggccttgcccagtacat

SEQ ID NO: 31886 - DNA, 20 bp, synthetic construct
  misc_feature 1..20: note = CRISPR gRNA sequence
  source 1..20: mol_type = other DNA
gcccagtacatgtgcatcag

SEQ ID NO: 31887 - DNA, 20 bp, synthetic construct
  misc_feature 1..20: note = CRISPR gRNA sequence
  source 1..20: mol_type = other DNA
cccagtacatgtgcatcagg

SEQ ID NO: 31888 - DNA, 20 bp, synthetic construct
  misc_feature 1..20: note = CRISPR gRNA sequence
  source 1..20: mol_type = other DNA
ctgtaccacgtgctgccaaa

SEQ ID NO: 31889 - DNA, 20 bp, synthetic construct
  misc_feature 1..20: note = CRISPR gRNA sequence
  source 1..20: mol_type = other DNA
taccacgtgctgccaaattc

SEQ ID NO: 31890 - DNA, 20 bp, synthetic construct
  misc_feature 1..20: note = CRISPR gRNA sequence
  source 1..20: mol_type = other DNA
ccaaattccagcctcctcgg

SEQ ID NO: 31891 - DNA, 20 bp, synthetic construct
  misc_feature 1..20: note = CRISPR gRNA sequence
  source 1..20: mol_type = other DNA
cagcctcctcggcctcgtgg

SEQ ID NO: 31892 - DNA, 20 bp, synthetic construct
  misc_feature 1..20: note = CRISPR gRNA sequence
  source 1..20: mol_type = other DNA
ctcggcctcgtgggcgcagt

SEQ ID NO: 31893 - DNA, 20 bp, synthetic construct
  misc_feature 1..20: note = CRISPR gRNA sequence
  source 1..20: mol_type = other DNA
ggcctcgtgggcgcagtgca

SEQ ID NO: 31894 - DNA, 20 bp, synthetic construct
  misc_feature 1..20: note = CRISPR gRNA sequence
  source 1..20: mol_type = other DNA
gtgggcgcagtgcagcagct

SEQ ID NO: 31895 - DNA, 20 bp, synthetic construct
  misc_feature 1..20: note = CRISPR gRNA sequence
  source 1..20: mol_type = other DNA
cagcagctgccgcgcccgca

SEQ ID NO: 31896 - DNA, 20 bp, synthetic construct
  misc_feature 1..20: note = CRISPR gRNA sequence
  source 1..20: mol_type = other DNA
ccgcgcccgcagtgtccccg

SEQ ID NO: 31897 - DNA, 20 bp, synthetic construct
  misc_feature 1..20: note = CRISPR gRNA sequence
  source 1..20: mol_type = other DNA
cagccgcttcaggtacctcg

SEQ ID NO: 31898 - DNA, 20 bp, synthetic construct
  misc_feature 1..20: note = CRISPR gRNA sequence
  source 1..20: mol_type = other DNA
caggtacctcgcaagcacct

SEQ ID NO: 31899 - DNA, 20 bp, synthetic construct
  misc_feature 1..20: note = CRISPR gRNA sequence
  source 1..20: mol_type = other DNA
aggtacctcgcaagcacctt

SEQ ID NO: 31900 - DNA, 20 bp, synthetic construct
  misc_feature 1..20: note = CRISPR gRNA sequence
  source 1..20: mol_type = other DNA
gcaagcaccttctgcttcct

SEQ ID NO: 31901 - DNA, 20 bp, synthetic construct
  misc_feature 1..20: note = CRISPR gRNA sequence
  source 1..20: mol_type = other DNA
ctgcttcctgtccaccgagg

SEQ ID NO: 31902 - DNA, 20 bp, synthetic construct
  misc_feature 1..20: note = CRISPR gRNA sequence
  source 1..20: mol_type = other DNA
tgcttcctgtccaccgaggc

SEQ ID NO: 31903 - DNA, 20 bp, synthetic construct
  misc_feature 1..20: note = CRISPR gRNA sequence
  source 1..20: mol_type = other DNA
cttcctgtccaccgaggcag

SEQ ID NO: 31904 - DNA, 20 bp, synthetic construct
  misc_feature 1..20: note = CRISPR gRNA sequence
  source 1..20: mol_type = other DNA
cctgtccaccgaggcagccg

SEQ ID NO: 31905 - DNA, 20 bp, synthetic construct
  misc_feature 1..20: note = CRISPR gRNA sequence
  source 1..20: mol_type = other DNA
ctgtccaccgaggcagccgc

SEQ ID NO: 31906 - DNA, 20 bp, synthetic construct
  misc_feature 1..20: note = CRISPR gRNA sequence
  source 1..20: mol_type = other DNA
tccaccgaggcagccgccga

SEQ ID NO: 31907 - DNA, 20 bp, synthetic construct
  misc_feature 1..20: note = CRISPR gRNA sequence
  source 1..20: mol_type = other DNA
ccaggcagcgggcgggaggc

SEQ ID NO: 31908 - DNA, 20 bp, synthetic construct
  misc_feature 1..20: note = CRISPR gRNA sequence
  source 1..20: mol_type = other DNA
gaagatcagcccagccagaa

SEQ ID NO: 31909 - DNA, 20 bp, synthetic construct
  misc_feature 1..20: note = CRISPR gRNA sequence
  source 1..20: mol_type = other DNA
cagccagttgtcatagggcc

SEQ ID NO: 31910 - DNA, 20 bp, synthetic construct
  misc_feature 1..20: note = CRISPR gRNA sequence
  source 1..20: mol_type = other DNA
tcatagggcctcttcttcct

SEQ ID NO: 31911 - DNA, 20 bp, synthetic construct
  misc_feature 1..20: note = CRISPR gRNA sequence
  source 1..20: mol_type = other DNA
ttcttccttggggtcaatgc

SEQ ID NO: 31912 - DNA, 20 bp, synthetic construct
  misc_feature 1..20: note = CRISPR gRNA sequence
  source 1..20: mol_type = other DNA
cttccttggggtcaatgcta

SEQ ID NO: 31913 - DNA, 20 bp, synthetic construct
  misc_feature 1..20: note = CRISPR gRNA sequence
  source 1..20: mol_type = other DNA
ttccttggggtcaatgctag

SEQ ID NO: 31914 - DNA, 20 bp, synthetic construct
  misc_feature 1..20: note = CRISPR gRNA sequence
  source 1..20: mol_type = other DNA
ccttggggtcaatgctaggt

SEQ ID NO: 31915 - DNA, 20 bp, synthetic construct
  misc_feature 1..20: note = CRISPR gRNA sequence
  source 1..20: mol_type = other DNA
cttggggtcaatgctaggta

SEQ ID NO: 31916 - DNA, 20 bp, synthetic construct
  misc_feature 1..20: note = CRISPR gRNA sequence
  source 1..20: mol_type = other DNA
ggggtcaatgctaggtactg

SEQ ID NO: 31917 - DNA, 20 bp, synthetic construct
  misc_feature 1..20: note = CRISPR gRNA sequence
  source 1..20: mol_type = other DNA
gggtcaatgctaggtactgc

SEQ ID NO: 31918 - DNA, 20 bp, synthetic construct
  misc_feature 1..20: note = CRISPR gRNA sequence
  source 1..20: mol_type = other DNA
ggtactgcgggagctccttg

SEQ ID NO: 31919 - DNA, 20 bp, synthetic construct
  misc_feature 1..20: note = CRISPR gRNA sequence
  source 1..20: mol_type = other DNA
cgggagctccttgtccttga

SEQ ID NO: 31920 - DNA, 20 bp, synthetic construct
  misc_feature 1..20: note = CRISPR gRNA sequence
  source 1..20: mol_type = other DNA
cttgtccttgatttcgccac

SEQ ID NO: 31921 - DNA, 20 bp, synthetic construct
  misc_feature 1..20: note = CRISPR gRNA sequence
  source 1..20: mol_type = other DNA
gtccttgatttcgccactca

SEQ ID NO: 31922 - DNA, 20 bp, synthetic construct
  misc_feature 1..20: note = CRISPR gRNA sequence
  source 1..20: mol_type = other DNA
tccttgatttcgccactcag

SEQ ID NO: 31923 - DNA, 20 bp, synthetic construct
  misc_feature 1..20: note = CRISPR gRNA sequence
  source 1..20: mol_type = other DNA
gatttcgccactcagagcca

SEQ ID NO: 31924 - DNA, 20 bp, synthetic construct
  misc_feature 1..20: note = CRISPR gRNA sequence
  source 1..20: mol_type = other DNA
atttcgccactcagagccag

SEQ ID NO: 31925 - DNA, 20 bp, synthetic construct
  misc_feature 1..20: note = CRISPR gRNA sequence
  source 1..20: mol_type = other DNA
cgccactcagagccagccac

SEQ ID NO: 31926 - DNA, 20 bp, synthetic construct
  misc_feature 1..20: note = CRISPR gRNA sequence
  source 1..20: mol_type = other DNA
gccactcagagccagccaca

SEQ ID NO: 31927 - DNA, 20 bp, synthetic construct
  misc_feature 1..20: note = CRISPR gRNA sequence
  source 1..20: mol_type = other DNA
agagccagccacagggcccc

SEQ ID NO: 31928 - DNA, 20 bp, synthetic construct
  misc_feature 1..20: note = CRISPR gRNA sequence
  source 1..20: mol_type = other DNA
caggaggaagctggggaagg

SEQ ID NO: 31929 - DNA, 20 bp, synthetic construct
  misc_feature 1..20: note = CRISPR gRNA sequence
  source 1..20: mol_type = other DNA
gggaaggccagctcggactc

SEQ ID NO: 31930 - DNA, 20 bp, synthetic construct
  misc_feature 1..20: note = CRISPR gRNA sequence
  source 1..20: mol_type = other DNA
ggactctgcggcccgcggtg

SEQ ID NO: 31931 - DNA, 20 bp, synthetic construct
  misc_feature 1..20: note = CRISPR gRNA sequence
  source 1..20: mol_type = other DNA
tgcggcccgcggtgggtgtt

SEQ ID NO: 31932 - DNA, 20 bp, synthetic construct
  misc_feature 1..20: note = CRISPR gRNA sequence
  source 1..20: mol_type = other DNA
cggcccgcggtgggtgttgg

SEQ ID NO: 31933 - DNA, 20 bp, synthetic construct
  misc_feature 1..20: note = CRISPR gRNA sequence
  source 1..20: mol_type = other DNA
gactaagcctttggccatcg

SEQ ID NO: 31934 - DNA, 20 bp, synthetic construct
  misc_feature 1..20: note = CRISPR gRNA sequence
  source 1..20: mol_type = other DNA
agcctttggccatcgcccag

SEQ ID NO: 31935 - DNA, 20 bp, synthetic construct
  misc_feature 1..20: note = CRISPR gRNA sequence
  source 1..20: mol_type = other DNA
tggccatcgcccaggtcctc

SEQ ID NO: 31936 - DNA, 20 bp, synthetic construct
  misc_feature 1..20: note = CRISPR gRNA sequence
  source 1..20: mol_type = other DNA
ggccatcgcccaggtcctca

SEQ ID NO: 31937 - DNA, 20 bp, synthetic construct
  misc_feature 1..20: note = CRISPR gRNA sequence
  source 1..20: mol_type = other DNA
gccatcgcccaggtcctcac

SEQ ID NO: 31938 - DNA, 20 bp, synthetic construct
  misc_feature 1..20: note = CRISPR gRNA sequence
  source 1..20: mol_type = other DNA
acgtctgcggatgggaactg

SEQ ID NO: 31939 - DNA, 20 bp, synthetic construct
  misc_feature 1..20: note = CRISPR gRNA sequence
  source 1..20: mol_type = other DNA
cggatgggaactggtcctcc

SEQ ID NO: 31940 - DNA, 20 bp, synthetic construct
  misc_feature 1..20: note = CRISPR gRNA sequence
  source 1..20: mol_type = other DNA
gtcctcctgtagggtacttt

SEQ ID NO: 31941 - DNA, 20 bp, synthetic construct
  misc_feature 1..20: note = CRISPR gRNA sequence
  source 1..20: mol_type = other DNA
ctgtagggtactttgatgtc

SEQ ID NO: 31942 - DNA, 20 bp, synthetic construct
  misc_feature 1..20: note = CRISPR gRNA sequence
  source 1..20: mol_type = other DNA
tagggtactttgatgtctgc

SEQ ID NO: 31943 - DNA, 20 bp, synthetic construct
  misc_feature 1..20: note = CRISPR gRNA sequence
  source 1..20: mol_type = other DNA
tgatgtctgcggcccagctc

SEQ ID NO: 31944 - DNA, 20 bp, synthetic construct
  misc_feature 1..20: note = CRISPR gRNA sequence
  source 1..20: mol_type = other DNA
gatgtctgcggcccagctcc

SEQ ID NO: 31945 - DNA, 20 bp, synthetic construct
  misc_feature 1..20: note = CRISPR gRNA sequence
  source 1..20: mol_type = other DNA
atgtctgcggcccagctccc

SEQ ID NO: 31946 - DNA, 20 bp, synthetic construct
  misc_feature 1..20: note = CRISPR gRNA sequence
  source 1..20: mol_type = other DNA
cggcccagctcccaggccag

SEQ ID NO: 31947 - DNA, 20 bp, synthetic construct
  misc_feature 1..20: note = CRISPR gRNA sequence
  source 1..20: mol_type = other DNA
ccaggccagcttggccagct

SEQ ID NO: 31948 - DNA, 20 bp, synthetic construct
  misc_feature 1..20: note = CRISPR gRNA sequence
  source 1..20: mol_type = other DNA
ggccagctctgccagggccc

SEQ ID NO: 31949 - DNA, 20 bp, synthetic construct
  misc_feature 1..20: note = CRISPR gRNA sequence
  source 1..20: mol_type = other DNA
gccagctctgccagggcccc

SEQ ID NO: 31950 - DNA, 20 bp, synthetic construct
  misc_feature 1..20: note = CRISPR gRNA sequence
  source 1..20: mol_type = other DNA
tgccagggccccgggggggc

SEQ ID NO: 31951 - DNA, 20 bp, synthetic construct
  misc_feature 1..20: note = CRISPR gRNA sequence
  source 1..20: mol_type = other DNA
ccagggccccgggggggctg

SEQ ID NO: 31952 - DNA, 20 bp, synthetic construct
  misc_feature 1..20: note = CRISPR gRNA sequence
  source 1..20: mol_type = other DNA
tcgagggctgcacggcccag

SEQ ID NO: 31953 - DNA, 20 bp, synthetic construct
  misc_feature 1..20: note = CRISPR gRNA sequence
  source 1..20: mol_type = other DNA
cacggcccagcaggccgaca

SEQ ID NO: 31954 - DNA, 20 bp, synthetic construct
  misc_feature 1..20: note = CRISPR gRNA sequence
  source 1..20: mol_type = other DNA
ggcgtcctccccaagctcca

SEQ ID NO: 31955 - DNA, 20 bp, synthetic construct
  misc_feature 1..20: note = CRISPR gRNA sequence
  source 1..20: mol_type = other DNA
gcgtcctccccaagctccag

SEQ ID NO: 31956 - DNA, 20 bp, synthetic construct
  misc_feature 1..20: note = CRISPR gRNA sequence
  source 1..20: mol_type = other DNA
cccaagctccagcagggcct

SEQ ID NO: 31957 - DNA, 20 bp, synthetic construct
  misc_feature 1..20: note = CRISPR gRNA sequence
  source 1..20: mol_type = other DNA
cagcagggcctctgagagct

SEQ ID NO: 31958 - DNA, 20 bp, synthetic construct
  misc_feature 1..20: note = CRISPR gRNA sequence
  source 1..20: mol_type = other DNA
tgagagctggcacactgccc

SEQ ID NO: 31959 - DNA, 20 bp, synthetic construct
  misc_feature 1..20: note = CRISPR gRNA sequence
  source 1..20: mol_type = other DNA
agagctggcacactgcccgg

SEQ ID NO: 31960 - DNA, 20 bp, synthetic construct
  misc_feature 1..20: note = CRISPR gRNA sequence
  source 1..20: mol_type = other DNA
gcacactgcccggcacaaag

SEQ ID NO: 31961 - DNA, 20 bp, synthetic construct
  misc_feature 1..20: note = CRISPR gRNA sequence
  source 1..20: mol_type = other DNA
cccggcacaaagtagggctg

SEQ ID NO: 31962 - DNA, 20 bp, synthetic construct
  misc_feature 1..20: note = CRISPR gRNA sequence
  source 1..20: mol_type = other DNA
tggctgtgactgagaagaag

SEQ ID NO: 31963 - DNA, 20 bp, synthetic construct
  misc_feature 1..20: note = CRISPR gRNA sequence
  source 1..20: mol_type = other DNA
tgactgagaagaagtggccg

SEQ ID NO: 31964 - DNA, 20 bp, synthetic construct
  misc_feature 1..20: note = CRISPR gRNA sequence
  source 1..20: mol_type = other DNA
agaagaagtggccggtcccg

SEQ ID NO: 31965 - DNA, 20 bp, synthetic construct
  misc_feature 1..20: note = CRISPR gRNA sequence
  source 1..20: mol_type = other DNA
tgtcttggtgctctgtcatc

SEQ ID NO: 31966 - DNA, 20 bp, synthetic construct
  misc_feature 1..20: note = CRISPR gRNA sequence
  source 1..20: mol_type = other DNA
tcttggtgctctgtcatccc

SEQ ID NO: 31967 - DNA, 20 bp, synthetic construct
  misc_feature 1..20: note = CRISPR gRNA sequence
  source 1..20: mol_type = other DNA
ggtgctctgtcatccctgag

SEQ ID NO: 31968 - DNA, 20 bp, synthetic construct
  misc_feature 1..20: note = CRISPR gRNA sequence
  source 1..20: mol_type = other DNA
gtgctctgtcatccctgagc

SEQ ID NO: 31969 - DNA, 20 bp, synthetic construct
  misc_feature 1..20: note = CRISPR gRNA sequence
  source 1..20: mol_type = other DNA
tgtcatccctgagctctcaa

SEQ ID NO: 31970 - DNA, 20 bp, synthetic construct
  misc_feature 1..20: note = CRISPR gRNA sequence
  source 1..20: mol_type = other DNA
tcatccctgagctctcaaag

SEQ ID NO: 31971 - DNA, 20 bp, synthetic construct
  misc_feature 1..20: note = CRISPR gRNA sequence
  source 1..20: mol_type = other DNA
agctctcaaagtagcgcatc

SEQ ID NO: 31972 - DNA, 20 bp, synthetic construct
  misc_feature 1..20: note = CRISPR gRNA sequence
  source 1..20: mol_type = other DNA
tcaaagtagcgcatcacgta

SEQ ID NO: 31973 - DNA, 20 bp, synthetic construct
  misc_feature 1..20: note = CRISPR gRNA sequence
  source 1..20: mol_type = other DNA
aaagtagcgcatcacgtatg

SEQ ID NO: 31974 - DNA, 20 bp, synthetic construct
  misc_feature 1..20: note = CRISPR gRNA sequence
  source 1..20: mol_type = other DNA
ggcctgctccatggagaagc

SEQ ID NO: 31975 - DNA, 20 bp, synthetic construct
  misc_feature 1..20: note = CRISPR gRNA sequence
  source 1..20: mol_type = other DNA
ctccatggagaagccggaca

SEQ ID NO: 31976 - DNA, 20 bp, synthetic construct
  misc_feature 1..20: note = CRISPR gRNA sequence
  source 1..20: mol_type = other DNA
catggagaagccggacagct

SEQ ID NO: 31977 - DNA, 20 bp, synthetic construct
  misc_feature 1..20: note = CRISPR gRNA sequence
  source 1..20: mol_type = other DNA
aaatagggcgtcggccttgc

SEQ ID NO: 31978 - DNA, 20 bp, synthetic construct
  misc_feature 1..20: note = CRISPR gRNA sequence
  source 1..20: mol_type = other DNA
gctcaggctctggaccaggc

SEQ ID NO: 31979 - DNA, 20 bp, synthetic construct
  misc_feature 1..20: note = CRISPR gRNA sequence
  source 1..20: mol_type = other DNA
ctcaggctctggaccaggcg

SEQ ID NO: 31980 - DNA, 20 bp, synthetic construct
  misc_feature 1..20: note = CRISPR gRNA sequence
  source 1..20: mol_type = other DNA
aggctctggaccaggcggcc

SEQ ID NO: 31981 - DNA, 20 bp, synthetic construct
  misc_feature 1..20: note = CRISPR gRNA sequence
  source 1..20: mol_type = other DNA
tggaccaggcggccccgggg

SEQ ID NO: 31982 - DNA, 20 bp, synthetic construct
  misc_feature 1..20: note = CRISPR gRNA sequence
  source 1..20: mol_type = other DNA
gaccaggcggccccggggcc

SEQ ID NO: 31983 - DNA, 20 bp, synthetic construct
  misc_feature 1..20: note = CRISPR gRNA sequence
  source 1..20: mol_type = other DNA
tgaggaggagggtgcaacct

SEQ ID NO: 31984 - DNA, 20 bp, synthetic construct
  misc_feature 1..20: note = CRISPR gRNA sequence
  source 1..20: mol_type = other DNA
ggagcagcttcttctggaaa

SEQ ID NO: 31985 - DNA, 20 bp, synthetic construct
  misc_feature 1..20: note = CRISPR gRNA sequence
  source 1..20: mol_type = other DNA
cttctggaaaaggccggcca

SEQ ID NO: 31986 - DNA, 20 bp, synthetic construct
  misc_feature 1..20: note = CRISPR gRNA sequence
  source 1..20: mol_type = other DNA
ttctggaaaaggccggccag

SEQ ID NO: 31987 - DNA, 20 bp, synthetic construct
  misc_feature 1..20: note = CRISPR gRNA sequence
  source 1..20: mol_type = other DNA
ctggaaaaggccggccagca

SEQ ID NO: 31988 - DNA, 20 bp, synthetic construct
  misc_feature 1..20: note = CRISPR gRNA sequence
  source 1..20: mol_type = other DNA
tggaaaaggccggccagcag

SEQ ID NO: 31989 - DNA, 20 bp, synthetic construct
  misc_feature 1..20: note = CRISPR gRNA sequence
  source 1..20: mol_type = other DNA
gaaaaggccggccagcagcc

SEQ ID NO: 31990 - DNA, 20 bp, synthetic construct
  misc_feature 1..20: note = CRISPR gRNA sequence
  source 1..20: mol_type = other DNA
cgccggtgccggtccgcacg

SEQ ID NO: 31991 - DNA, 20 bp, synthetic construct
  misc_feature 1..20: note = CRISPR gRNA sequence
  source 1..20: mol_type = other DNA
tgcaggaagccatcttgcgc

SEQ ID NO: 31992 - DNA, 20 bp, synthetic construct
  misc_feature 1..20: note = CRISPR gRNA sequence
  source 1..20: mol_type = other DNA
gcgcttccagctcctcgaag

SEQ ID NO: 31993 - DNA, 20 bp, synthetic construct
  misc_feature 1..20: note = CRISPR gRNA sequence
  source 1..20: mol_type = other DNA
cgcttccagctcctcgaagc

SEQ ID NO: 31994 - DNA, 20 bp, synthetic construct
  misc_feature 1..20: note = CRISPR gRNA sequence
  source 1..20: mol_type = other DNA
ccagctcctcgaagccgtct

SEQ ID NO: 31995 - DNA, 20 bp, synthetic construct
  misc_feature 1..20: note = CRISPR gRNA sequence
  source 1..20: mol_type = other DNA
cagctcctcgaagccgtcta

SEQ ID NO: 31996 - DNA, 20 bp, synthetic construct
  misc_feature 1..20: note = CRISPR gRNA sequence
  source 1..20: mol_type = other DNA
ctcgaagccgtctaggatga

SEQ ID NO: 31997 - DNA, 20 bp, synthetic construct
  misc_feature 1..20: note = CRISPR gRNA sequence
  source 1..20: mol_type = other DNA
gaagccgtctaggatgagca

SEQ ID NO: 31998 - DNA, 20 bp, synthetic construct
  misc_feature 1..20: note = CRISPR gRNA sequence
  source 1..20: mol_type = other DNA
ggatgagcagaacgcggtca

SEQ ID NO: 31999 - DNA, 20 bp, synthetic construct
  misc_feature 1..20: note = CRISPR gRNA sequence
  source 1..20: mol_type = other DNA
ttcaagatgtggctgaaaac

SEQ ID NO: 32000 - DNA, 20 bp, synthetic construct
  misc_feature 1..20: note = CRISPR gRNA sequence
  source 1..20: mol_type = other DNA
caagatgtggctgaaaacct

SEQ ID NO: 32001 - DNA, 20 bp, synthetic construct
  misc_feature 1..20: note = CRISPR gRNA sequence
  source 1..20: mol_type = other DNA
aagatgtggctgaaaacctc

SEQ ID NO: 32002 - DNA, 20 bp, synthetic construct
  misc_feature 1..20: note = CRISPR gRNA sequence
  source 1..20: mol_type = other DNA
aaaacctcatcggccgccac

SEQ ID NO: 32003 - DNA, 20 bp, synthetic construct
  misc_feature 1..20: note = CRISPR gRNA sequence
  source 1..20: mol_type = other DNA
atcggccgccacgagtggct

SEQ ID NO: 32004 - DNA, 20 bp, synthetic construct
  misc_feature 1..20: note = CRISPR gRNA sequence
  source 1..20: mol_type = other DNA
tgggcccagggagaagagca

SEQ ID NO: 32005 - DNA, 20 bp, synthetic construct
  misc_feature 1..20: note = CRISPR gRNA sequence
  source 1..20: mol_type = other DNA
caggccataggcatcccccg

SEQ ID NO: 32006 - DNA, 20 bp, synthetic construct
  misc_feature 1..20: note = CRISPR gRNA sequence
  source 1..20: mol_type = other DNA
aagcaatggcaggggacaga

SEQ ID NO: 32007 - DNA, 20 bp, synthetic construct
  misc_feature 1..20: note = CRISPR gRNA sequence
  source 1..20: mol_type = other DNA
gggaagccggccacaagccc

SEQ ID NO: 32008 - DNA, 20 bp, synthetic construct
  misc_feature 1..20: note = CRISPR gRNA sequence
  source 1..20: mol_type = other DNA
actgccccagcccaatagct

SEQ ID NO: 32009 - DNA, 20 bp, synthetic construct
  misc_feature 1..20: note = CRISPR gRNA sequence
  source 1..20: mol_type = other DNA
ccccagcccaatagctcttg

SEQ ID NO: 32010 - DNA, 20 bp, synthetic construct
  misc_feature 1..20: note = CRISPR gRNA sequence
  source 1..20: mol_type = other DNA
ttgccctgaccagctttgcc

SEQ ID NO: 32011 - DNA, 20 bp, synthetic construct
  misc_feature 1..20: note = CRISPR gRNA sequence
  source 1..20: mol_type = other DNA
gccctgaccagctttgccca

SEQ ID NO: 32012 - DNA, 20 bp, synthetic construct
  misc_feature 1..20: note = CRISPR gRNA sequence
  source 1..20: mol_type = other DNA
ccctgaccagctttgcccag

SEQ ID NO: 32013 - DNA, 20 bp, synthetic construct
  misc_feature 1..20: note = CRISPR gRNA sequence
  source 1..20: mol_type = other DNA
accagctttgcccagcacag

SEQ ID NO: 32014 - DNA, 20 bp, synthetic construct
  misc_feature 1..20: note = CRISPR gRNA sequence
  source 1..20: mol_type = other DNA
tgcccagcacagcaatcact

SEQ ID NO: 32015 - DNA, 20 bp, synthetic construct
  misc_feature 1..20: note = CRISPR gRNA sequence
  source 1..20: mol_type = other DNA
gcccagcacagcaatcactc

SEQ ID NO: 32016 - DNA, 20 bp, synthetic construct
  misc_feature 1..20: note = CRISPR gRNA sequence
  source 1..20: mol_type = other DNA
cccagcacagcaatcactcg

SEQ ID NO: 32017 - DNA, 20 bp, synthetic construct
  misc_feature 1..20: note = CRISPR gRNA sequence
  source 1..20: mol_type = other DNA
gtgtctcacgcggccgccgg

SEQ ID NO: 32018 - DNA, 20 bp, synthetic construct
  misc_feature 1..20: note = CRISPR gRNA sequence
  source 1..20: mol_type = other DNA
acgcggccgccggtgctcct

SEQ ID NO: 32019 - DNA, 20 bp, synthetic construct
  misc_feature 1..20: note = CRISPR gRNA sequence
  source 1..20: mol_type = other DNA
cttggcagccaacagcacct

SEQ ID NO: 32020 - DNA, 20 bp, synthetic construct
  misc_feature 1..20: note = CRISPR gRNA sequence
  source 1..20: mol_type = other DNA
ggcagccaacagcacctcag

SEQ ID NO: 32021 - DNA, 20 bp, synthetic construct
  misc_feature 1..20: note = CRISPR gRNA sequence
  source 1..20: mol_type = other DNA
gcagccaacagcacctcagc

SEQ ID NO: 32022 - DNA, 20 bp, synthetic construct
  misc_feature 1..20: note = CRISPR gRNA sequence
  source 1..20: mol_type = other DNA
agccaggcctccttgggcca

SEQ ID NO: 32023 - DNA, 20 bp, synthetic construct
  misc_feature 1..20: note = CRISPR gRNA sequence
  source 1..20: mol_type = other DNA
cttgggccagctgccgttct

SEQ ID NO: 32024 - DNA, 20 bp, synthetic construct
  misc_feature 1..20: note = CRISPR gRNA sequence
  source 1..20: mol_type = other DNA
gggccagctgccgttctgcc

SEQ ID NO: 32025 - DNA, 20 bp, synthetic construct
  misc_feature 1..20: note = CRISPR gRNA sequence
  source 1..20: mol_type = other DNA
ggccagctgccgttctgccc

SEQ ID NO: 32026 - DNA, 20 bp, synthetic construct
  misc_feature 1..20: note = CRISPR gRNA sequence
  source 1..20: mol_type = other DNA
ccgttctgcccagtccgggg

SEQ ID NO: 32027 - DNA, 20 bp, synthetic construct
  misc_feature 1..20: note = CRISPR gRNA sequence
  source 1..20: mol_type = other DNA
tgcccagtccggggtggcca

SEQ ID NO: 32028 - DNA, 20 bp, synthetic construct
  misc_feature 1..20: note = CRISPR gRNA sequence
  source 1..20: mol_type = other DNA
cccagtccggggtggccagt

SEQ ID NO: 32029 - DNA, 20 bp, synthetic construct
  misc_feature 1..20: note = CRISPR gRNA sequence
  source 1..20: mol_type = other DNA
ccgctccaggctcttgctgc

SEQ ID NO: 32030 - DNA, 20 bp, synthetic construct
  misc_feature 1..20: note = CRISPR gRNA sequence
  source 1..20: mol_type = other DNA
caggctcttgctgctgctcc

SEQ ID NO: 32031 - DNA, 20 bp, synthetic construct
  misc_feature 1..20: note = CRISPR gRNA sequence
  source 1..20: mol_type = other DNA
ttgctgctgctcctctccag

SEQ ID NO: 32032 - DNA, 20 bp, synthetic construct
  misc_feature 1..20: note = CRISPR gRNA sequence
  source 1..20: mol_type = other DNA
gctgctgctcctctccagcc

SEQ ID NO: 32033 - DNA, 20 bp, synthetic construct
  misc_feature 1..20: note = CRISPR gRNA sequence
  source 1..20: mol_type = other DNA
ctgctgctcctctccagcct

SEQ ID NO: 32034 - DNA, 20 bp, synthetic construct
  misc_feature 1..20: note = CRISPR gRNA sequence
  source 1..20: mol_type = other DNA
ctgctcctctccagcctggc

SEQ ID NO: 32035 - DNA, 20 bp, synthetic construct
  misc_feature 1..20: note = CRISPR gRNA sequence
  source 1..20: mol_type = other DNA
ctcctctccagcctggcctg

SEQ ID NO: 32036 - DNA, 20 bp, synthetic construct
  misc_feature 1..20: note = CRISPR gRNA sequence
  source 1..20: mol_type = other DNA
ctctccagcctggcctgcac

SEQ ID NO: 32037 - DNA, 20 bp, synthetic construct
  misc_feature 1..20: note = CRISPR gRNA sequence
  source 1..20: mol_type = other DNA
tccagcctggcctgcaccag

SEQ ID NO: 32038 - DNA, 20 bp, synthetic construct
  misc_feature 1..20: note = CRISPR gRNA sequence
  source 1..20: mol_type = other DNA
cagcctggcctgcaccagat

SEQ ID NO: 32039 - DNA, 20 bp, synthetic construct
  misc_feature 1..20: note = CRISPR gRNA sequence
  source 1..20: mol_type = other DNA
gcctgcaccagatccacctc

SEQ ID NO: 32040 - DNA, 20 bp, synthetic construct
  misc_feature 1..20: note = CRISPR gRNA sequence
  source 1..20: mol_type = other DNA
caccagatccacctccacta

SEQ ID NO: 32041 - DNA, 20 bp, synthetic construct
  misc_feature 1..20: note = CRISPR gRNA sequence
  source 1..20: mol_type = other DNA
cactaggatgccatccgggc

SEQ ID NO: 32042 - DNA, 20 bp, synthetic construct
  misc_feature 1..20: note = CRISPR gRNA sequence
  source 1..20: mol_type = other DNA
ggatgccatccgggcctgcg

SEQ ID NO: 32043 - DNA, 20 bp, synthetic construct
  misc_feature 1..20: note = CRISPR gRNA sequence
  source 1..20: mol_type = other DNA
cgggctcggcaccatacgtg

SEQ ID NO: 32044 - DNA, 20 bp, synthetic construct
  misc_feature 1..20: note = CRISPR gRNA sequence
  source 1..20: mol_type = other DNA
ggcaccatacgtgtcctgca

SEQ ID NO: 32045 - DNA, 20 bp, synthetic construct
  misc_feature 1..20: note = CRISPR gRNA sequence
  source 1..20: mol_type = other DNA
cagtgagcggtagaactgct

SEQ ID NO: 32046 - DNA, 20 bp, synthetic construct
  misc_feature 1..20: note = CRISPR gRNA sequence
  source 1..20: mol_type = other DNA
ctccaccggctctgcaaagg

SEQ ID NO: 32047 - DNA, 20 bp, synthetic construct
  misc_feature 1..20: note = CRISPR gRNA sequence
  source 1..20: mol_type = other DNA
caccggctctgcaaaggcca

SEQ ID NO: 32048 - DNA, 20 bp, synthetic construct
  misc_feature 1..20: note = CRISPR gRNA sequence
  source 1..20: mol_type = other DNA
tgcaaaggccaggggcgtgt

SEQ ID NO: 32049 - DNA, 20 bp, synthetic construct
  misc_feature 1..20: note = CRISPR gRNA sequence
  source 1..20: mol_type = other DNA
caaaggccaggggcgtgtca

SEQ ID NO: 32050 - DNA, 20 bp, synthetic construct
  misc_feature 1..20: note = CRISPR gRNA sequence
  source 1..20: mol_type = other DNA
ccaccatcatttacatctgt

SEQ ID NO: 32051 - DNA, 20 bp, synthetic construct
  misc_feature 1..20: note = CRISPR gRNA sequence
  source 1..20: mol_type = other DNA
acatctgttccccacacagt

SEQ ID NO: 32052 - DNA, 20 bp, synthetic construct
  misc_feature 1..20: note = CRISPR gRNA sequence
  source 1..20: mol_type = other DNA
catctgttccccacacagtt

SEQ ID NO: 32053 - DNA, 20 bp, synthetic construct
  misc_feature 1..20: note = CRISPR gRNA sequence
  source 1..20: mol_type = other DNA
ttccccacacagtttttttg

SEQ ID NO: 32054 - DNA, 20 bp, synthetic construct
  misc_feature 1..20: note = CRISPR gRNA sequence
  source 1..20: mol_type = other DNA
cccacacagtttttttgttt

SEQ ID NO: 32055 - DNA, 20 bp, synthetic construct
  misc_feature 1..20: note = CRISPR gRNA sequence
  source 1..20: mol_type = other DNA
ttttgtttgtttgttttgtt

SEQ ID NO: 32056 - DNA, 20 bp, synthetic construct
  misc_feature 1..20: note = CRISPR gRNA sequence
  source 1..20: mol_type = other DNA
tttgtttgtttgttttgttt

SEQ ID NO: 32057 - DNA, 20 bp, synthetic construct
  misc_feature 1..20: note = CRISPR gRNA sequence
  source 1..20: mol_type = other DNA
ttgtttgtttgttttgtttt

SEQ ID NO: 32058 - DNA, 20 bp, synthetic construct
  misc_feature 1..20: note = CRISPR gRNA sequence
  source 1..20: mol_type = other DNA
tgtttgtttgttttgttttg

SEQ ID NO: 32059 - DNA, 20 bp, synthetic construct
  misc_feature 1..20: note = CRISPR gRNA sequence
  source 1..20: mol_type = other DNA
gtttgtttgttttgttttgt

SEQ ID NO: 32060 - DNA, 20 bp, synthetic construct
  misc_feature 1..20: note = CRISPR gRNA sequence
  source 1..20: mol_type = other DNA
tttgtttgttttgttttgtt

SEQ ID NO: 32061 - DNA, 20 bp, synthetic construct
  misc_feature 1..20: note = CRISPR gRNA sequence
  source 1..20: mol_type = other DNA
gtttgttttgttttgttttg

SEQ ID NO: 32062 - DNA, 20 bp, synthetic construct
  misc_feature 1..20: note = CRISPR gRNA sequence
  source 1..20: mol_type = other DNA
tttgttttgttttgttttga

SEQ ID NO: 32063 - DNA, 20 bp, synthetic construct
  misc_feature 1..20: note = CRISPR gRNA sequence
  source 1..20: mol_type = other DNA
gttttgttttgttttgagac

SEQ ID NO: 32064 - DNA, 20 bp, synthetic construct
  misc_feature 1..20: note = CRISPR gRNA sequence
  source 1..20: mol_type = other DNA
ttttgttttgttttgagaca

SEQ ID NO: 32065 - DNA, 20 bp, synthetic construct
  misc_feature 1..20: note = CRISPR gRNA sequence
  source 1..20: mol_type = other DNA
tgttttgttttgagacaggg

SEQ ID NO: 32066 - DNA, 20 bp, synthetic construct
  misc_feature 1..20: note = CRISPR gRNA sequence
  source 1..20: mol_type = other DNA
gttttgttttgagacagggt

SEQ ID NO: 32067 - DNA, 20 bp, synthetic construct
  misc_feature 1..20: note = CRISPR gRNA sequence
  source 1..20: mol_type = other DNA
ttttgttttgagacagggtc

SEQ ID NO: 32068 - DNA, 20 bp, synthetic construct
  misc_feature 1..20: note = CRISPR gRNA sequence
  source 1..20: mol_type = other DNA
tgttttgagacagggtctgg

SEQ ID NO: 32069 - DNA, 20 bp, synthetic construct
  misc_feature 1..20: note = CRISPR gRNA sequence
  source 1..20: mol_type = other DNA
gttttgagacagggtctggc

SEQ ID NO: 32070 - DNA, 20 bp, synthetic construct
  misc_feature 1..20: note = CRISPR gRNA sequence
  source 1..20: mol_type = other DNA
ttttgagacagggtctggct

SEQ ID NO: 32071 - DNA, 20 bp, synthetic construct
  misc_feature 1..20: note = CRISPR gRNA sequence
  source 1..20: mol_type = other DNA
tgagacagggtctggctttt

SEQ ID NO: 32072 - DNA, 20 bp, synthetic construct
  misc_feature 1..20: note = CRISPR gRNA sequence
  source 1..20: mol_type = other DNA
gagacagggtctggcttttt

SEQ ID NO: 32073 - DNA, 20 bp, synthetic construct
  misc_feature 1..20: note = CRISPR gRNA sequence
  source 1..20: mol_type = other DNA
agacagggtctggctttttt

SEQ ID NO: 32074 - DNA, 20 bp, synthetic construct
  misc_feature 1..20: note = CRISPR gRNA sequence
  source 1..20: mol_type = other DNA
gcttttttgcccaggctgga

SEQ ID NO: 32075 - DNA, 20 bp, synthetic construct
  misc_feature 1..20: note = CRISPR gRNA sequence
  source 1..20: mol_type = other DNA
ttttgcccaggctggaatgc

SEQ ID NO: 32076 - DNA, 20 bp, synthetic construct
  misc_feature 1..20: note = CRISPR gRNA sequence
  source 1..20: mol_type = other DNA
tttgcccaggctggaatgca

SEQ ID NO: 32077 - DNA, 20 bp, synthetic construct
  misc_feature 1..20: note = CRISPR gRNA sequence
  source 1..20: mol_type = other DNA
ttgcccaggctggaatgcag

SEQ ID NO: 32078 - DNA, 20 bp, synthetic construct
  misc_feature 1..20: note = CRISPR gRNA sequence
  source 1..20: mol_type = other DNA
tgcccaggctggaatgcagt

SEQ ID NO: 32079 - DNA, 20 bp, synthetic construct
  misc_feature 1..20: note = CRISPR gRNA sequence
  source 1..20: mol_type = other DNA
gcccaggctggaatgcagtg

SEQ ID NO: 32080 - DNA, 20 bp, synthetic construct
  misc_feature 1..20: note = CRISPR gRNA sequence
  source 1..20: mol_type = other DNA
cccaggctggaatgcagtgg

SEQ ID NO: 32081 - DNA, 20 bp, synthetic construct
  misc_feature 1..20: note = CRISPR gRNA sequence
  source 1..20: mol_type = other DNA
gaatgcagtggtgtgatcac

SEQ ID NO: 32082 - DNA, 20 bp, synthetic construct
  misc_feature 1..20: note = CRISPR gRNA sequence
  source 1..20: mol_type = other DNA
gctgcaacctcaacctcctg

SEQ ID NO: 32083 - DNA, 20 bp, synthetic construct
  misc_feature 1..20: note = CRISPR gRNA sequence
  source 1..20: mol_type = other DNA
caacctcaacctcctgggct

SEQ ID NO: 32084 - DNA, 20 bp, synthetic construct
  misc_feature 1..20: note = CRISPR gRNA sequence
  source 1..20: mol_type = other DNA
aacctcctgggctcatgcga

SEQ ID NO: 32085 - DNA, 20 bp, synthetic construct
  misc_feature 1..20: note = CRISPR gRNA sequence
  source 1..20: mol_type = other DNA
ctgggctcatgcgatcctcc

SEQ ID NO: 32086 - DNA, 20 bp, synthetic construct
  misc_feature 1..20: note = CRISPR gRNA sequence
  source 1..20: mol_type = other DNA
ggctcatgcgatcctcctga

SEQ ID NO: 32087 - DNA, 20 bp, synthetic construct
  misc_feature 1..20: note = CRISPR gRNA sequence
  source 1..20: mol_type = other DNA
atgcgatcctcctgactcca

SEQ ID NO: 32088 - DNA, 20 bp, synthetic construct
  misc_feature 1..20: note = CRISPR gRNA sequence
  source 1..20: mol_type = other DNA
ctgactccacctcccaagta

SEQ ID NO: 32089 - DNA, 20 bp, synthetic construct
  misc_feature 1..20: note = CRISPR gRNA sequence
  source 1..20: mol_type = other DNA
actccacctcccaagtagct

SEQ ID NO: 32090 - DNA, 20 bp, synthetic construct
  misc_feature 1..20: note = CRISPR gRNA sequence
  source 1..20: mol_type = other DNA
cacctcccaagtagctggga

SEQ ID NO: 32091 - DNA, 20 bp, synthetic construct
  misc_feature 1..20: note = CRISPR gRNA sequence
  source 1..20: mol_type = other DNA
ccaagtagctgggaccacag

SEQ ID NO: 32092 - DNA, 20 bp, synthetic construct
  misc_feature 1..20: note = CRISPR gRNA sequence
  source 1..20: mol_type = other DNA
ggaccacagacatgtgacac

SEQ ID NO: 32093 - DNA, 20 bp, synthetic construct
  misc_feature 1..20: note = CRISPR gRNA sequence
  source 1..20: mol_type = other DNA
tttgatttttttgtagagat

SEQ ID NO: 32094 - DNA, 20 bp, synthetic construct
  misc_feature 1..20: note = CRISPR gRNA sequence
  source 1..20: mol_type = other DNA
ttgatttttttgtagagatg

SEQ ID NO: 32095 - DNA, 20 bp, synthetic construct
  misc_feature 1..20: note = CRISPR gRNA sequence
  source 1..20: mol_type = other DNA
tgatttttttgtagagatgg

SEQ ID NO: 32096 - DNA, 20 bp, synthetic construct
  misc_feature 1..20: note = CRISPR gRNA sequence
  source 1..20: mol_type = other DNA
gatttttttgtagagatggg

SEQ ID NO: 32097 - DNA, 20 bp, synthetic construct
  misc_feature 1..20: note = CRISPR gRNA sequence
  source 1..20: mol_type = other DNA
atttttttgtagagatgggg

SEQ ID NO: 32098 - DNA, 20 bp, synthetic construct
  misc_feature 1..20: note = CRISPR gRNA sequence
  source 1..20: mol_type = other DNA
ttttgtagagatggggtctc

SEQ ID NO: 32099 - DNA, 20 bp, synthetic construct
  misc_feature 1..20: note = CRISPR gRNA sequence
  source 1..20: mol_type = other DNA
tttgtagagatggggtctca

SEQ ID NO: 32100 - DNA, 20 bp, synthetic construct
  misc_feature 1..20: note = CRISPR gRNA sequence
  source 1..20: mol_type = other DNA
ttgtagagatggggtctcac

SEQ ID NO: 32101 - DNA, 20 bp, synthetic construct
  misc_feature 1..20: note = CRISPR gRNA sequence
  source 1..20: mol_type = other DNA
tgtagagatggggtctcact

SEQ ID NO: 32102 - DNA, 20 bp, synthetic construct
  misc_feature 1..20: note = CRISPR gRNA sequence
  source 1..20: mol_type = other DNA
gtagagatggggtctcacta

SEQ ID NO: 32103 - DNA, 20 bp, synthetic construct
  misc_feature 1..20: note = CRISPR gRNA sequence
  source 1..20: mol_type = other DNA
tagagatggggtctcactat

SEQ ID NO: 32104 - DNA, 20 bp, synthetic construct
  misc_feature 1..20: note = CRISPR gRNA sequence
  source 1..20: mol_type = other DNA
actatgtcgcccaggctggc

SEQ ID NO: 32105 - DNA, 20 bp, synthetic construct
  misc_feature 1..20: note = CRISPR gRNA sequence
  source 1..20: mol_type = other DNA
tgtcgcccaggctggcgtgc

SEQ ID NO: 32106 - DNA, 20 bp, synthetic construct
  misc_feature 1..20: note = CRISPR gRNA sequence
  source 1..20: mol_type = other DNA
gcgtgcaatggcacaatcat

SEQ ID NO: 32107 - DNA, 20 bp, synthetic construct
  misc_feature 1..20: note = CRISPR gRNA sequence
  source 1..20: mol_type = other DNA
caacctcacaggctcaagca

SEQ ID NO: 32108 - DNA, 20 bp, synthetic construct
  misc_feature 1..20: note = CRISPR gRNA sequence
  source 1..20: mol_type = other DNA
aacctcacaggctcaagcaa

SEQ ID NO: 32109 - DNA, 20 bp, synthetic construct
  misc_feature 1..20: note = CRISPR gRNA sequence
  source 1..20: mol_type = other DNA
acaggctcaagcaatcctcc

SEQ ID NO: 32110 - DNA, 20 bp, synthetic construct
  misc_feature 1..20: note = CRISPR gRNA sequence
  source 1..20: mol_type = other DNA
aagcaatcctcccacctcag

SEQ ID NO: 32111 - DNA, 20 bp, synthetic construct
  misc_feature 1..20: note = CRISPR gRNA sequence
  source 1..20: mol_type = other DNA
ccacctcagcctcctgagta

SEQ ID NO: 32112 - DNA, 20 bp, synthetic construct
  misc_feature 1..20: note = CRISPR gRNA sequence
  source 1..20: mol_type = other DNA
agcctcctgagtagctggga

SEQ ID NO: 32113 - DNA, 20 bp, synthetic construct
  misc_feature 1..20: note = CRISPR gRNA sequence
  source 1..20: mol_type = other DNA
ctgagtagctgggactacag

SEQ ID NO: 32114 - DNA, 20 bp, synthetic construct
  misc_feature 1..20: note = CRISPR gRNA sequence
  source 1..20: mol_type = other DNA
agtagctgggactacaggcg

SEQ ID NO: 32115 - DNA, 20 bp, synthetic construct
  misc_feature 1..20: note = CRISPR gRNA sequence
  source 1..20: mol_type = other DNA
ggactacaggcgcccactgc

SEQ ID NO: 32116 - DNA, 20 bp, synthetic construct
  misc_feature 1..20: note = CRISPR gRNA sequence
  source 1..20: mol_type = other DNA
caggcgcccactgccatgcc

SEQ ID NO: 32117 - DNA, 20 bp, synthetic construct
  misc_feature 1..20: note = CRISPR gRNA sequence
  source 1..20: mol_type = other DNA
ccatgcctggctaatttttc

SEQ ID NO: 32118 - DNA, 20 bp, synthetic construct
  misc_feature 1..20: note = CRISPR gRNA sequence
  source 1..20: mol_type = other DNA
gctaatttttcttttttgtt

SEQ ID NO: 32119 - DNA, 20 bp, synthetic construct
  misc_feature 1..20: note = CRISPR gRNA sequence
  source 1..20: mol_type = other DNA
atttttcttttttgtttttt

SEQ ID NO: 32120 - DNA, 20 bp, synthetic construct
  misc_feature 1..20: note = CRISPR gRNA sequence
  source 1..20: mol_type = other DNA
ttcttttttgtttttttgtg

SEQ ID NO: 32121 - DNA, 20 bp, synthetic construct
  misc_feature 1..20: note = CRISPR gRNA sequence
  source 1..20: mol_type = other DNA
tcttttttgtttttttgtgg

SEQ ID NO: 32122 - DNA, 20 bp, synthetic construct
  misc_feature 1..20: note = CRISPR gRNA sequence
  source 1..20: mol_type = other DNA
cttttttgtttttttgtgga

SEQ ID NO: 32123 - DNA, 20 bp, synthetic construct
  misc_feature 1..20: note = CRISPR gRNA sequence
  source 1..20: mol_type = other DNA
ttttttgtttttttgtggag

SEQ ID NO: 32124 - DNA, 20 bp, synthetic construct
  misc_feature 1..20: note = CRISPR gRNA sequence
  source 1..20: mol_type = other DNA
ttttgtttttttgtggagat

SEQ ID NO: 32125 - DNA, 20 bp, synthetic construct
  misc_feature 1..20: note = CRISPR gRNA sequence
  source 1..20: mol_type = other DNA
tttgtttttttgtggagata

SEQ ID NO: 32126 - DNA, 20 bp, synthetic construct
  misc_feature 1..20: note = CRISPR gRNA sequence
  source 1..20: mol_type = other DNA
ttgtttttttgtggagataa

SEQ ID NO: 32127 - DNA, 20 bp, synthetic construct
  misc_feature 1..20: note = CRISPR gRNA sequence
  source 1..20: mol_type = other DNA
tgtttttttgtggagataag

SEQ ID NO: 32128 - DNA, 20 bp, synthetic construct
  misc_feature 1..20: note = CRISPR gRNA sequence
  source 1..20: mol_type = other DNA
gtttttttgtggagataagt

SEQ ID NO: 32129 - DNA, 20 bp, synthetic construct
  misc_feature 1..20: note = CRISPR gRNA sequence
  source 1..20: mol_type = other DNA
tttttttgtggagataagtt

SEQ ID NO: 32130 - DNA, 20 bp, synthetic construct
  misc_feature 1..20: note = CRISPR gRNA sequence
  source 1..20: mol_type = other DNA
ttttgtggagataagttctc

SEQ ID NO: 32131 - DNA, 20 bp, synthetic construct
  misc_feature 1..20: note = CRISPR gRNA sequence
  source 1..20: mol_type = other DNA
tttgtggagataagttctca

SEQ ID NO: 32132 - DNA, 20 bp, synthetic construct
  misc_feature 1..20: note = CRISPR gRNA sequence
  source 1..20: mol_type = other DNA
ttgtggagataagttctcac

SEQ ID NO: 32133 - DNA, 20 bp, synthetic construct
  misc_feature 1..20: note = CRISPR gRNA sequence
  source 1..20: mol_type = other DNA
tgtggagataagttctcact

SEQ ID NO: 32134 - DNA, 20 bp, synthetic construct
  misc_feature 1..20: note = CRISPR gRNA sequence
  source 1..20: mol_type = other DNA
gtggagataagttctcacta

SEQ ID NO: 32135 - DNA, 20 bp, synthetic construct
  misc_feature 1..20: note = CRISPR gRNA sequence
  source 1..20: mol_type = other DNA
tggagataagttctcactat

SEQ ID NO: 32136 - DNA, 20 bp, synthetic construct
  misc_feature 1..20: note = CRISPR gRNA sequence
  source 1..20: mol_type = other DNA
tcactattttgcccaggctg

SEQ ID NO: 32137 - DNA, 20 bp, synthetic construct
  misc_feature 1..20: note = CRISPR gRNA sequence
  source 1..20: mol_type = other DNA
actattttgcccaggctggt

SEQ ID NO: 32138 - DNA, 20 bp, synthetic construct
  misc_feature 1..20: note = CRISPR gRNA sequence
  source 1..20: mol_type = other DNA
ttttgcccaggctggtcttg

SEQ ID NO: 32139 - DNA, 20 bp, synthetic construct
  misc_feature 1..20: note = CRISPR gRNA sequence
  source 1..20: mol_type = other DNA
tgcccaggctggtcttgagc

SEQ ID NO: 32140 - DNA, 20 bp, synthetic construct
  misc_feature 1..20: note = CRISPR gRNA sequence
  source 1..20: mol_type = other DNA
gcccaggctggtcttgagct

SEQ ID NO: 32141 - DNA, 20 bp, synthetic construct
  misc_feature 1..20: note = CRISPR gRNA sequence
  source 1..20: mol_type = other DNA
cccaggctggtcttgagctc

SEQ ID NO: 32142 - DNA, 20 bp, synthetic construct
  misc_feature 1..20: note = CRISPR gRNA sequence
  source 1..20: mol_type = other DNA
gtcttgagctcctgggctca

SEQ ID NO: 32143 - DNA, 20 bp, synthetic construct
  misc_feature 1..20: note = CRISPR gRNA sequence
  source 1..20: mol_type = other DNA
gagctcctgggctcaagcaa

SEQ ID NO: 32144 - DNA, 20 bp, synthetic construct
  misc_feature 1..20: note = CRISPR gRNA sequence
  source 1..20: mol_type = other DNA
agctcctgggctcaagcaat

SEQ ID NO: 32145 - DNA, 20 bp, synthetic construct
  misc_feature 1..20: note = CRISPR gRNA sequence
  source 1..20: mol_type = other DNA
ctgggctcaagcaatcgttc

SEQ ID NO: 32146 - DNA, 20 bp, synthetic construct
  misc_feature 1..20: note = CRISPR gRNA sequence
  source 1..20: mol_type = other DNA
ggctcaagcaatcgttccgc

SEQ ID NO: 32147 - DNA, 20 bp, synthetic construct
  misc_feature 1..20: note = CRISPR gRNA sequence
  source 1..20: mol_type = other DNA
aagcaatcgttccgccttgg

SEQ ID NO: 32148 - DNA, 20 bp, synthetic construct
  misc_feature 1..20: note = CRISPR gRNA sequence
  source 1..20: mol_type = other DNA
cgccttggcctcccaaagtg

SEQ ID NO: 32149 - DNA, 20 bp, synthetic construct
  misc_feature 1..20: note = CRISPR gRNA sequence
  source 1..20: mol_type = other DNA
ggcctcccaaagtgctggga

SEQ ID NO: 32150 - DNA, 20 bp, synthetic construct
  misc_feature 1..20: note = CRISPR gRNA sequence
  source 1..20: mol_type = other DNA
gcctcccaaagtgctgggat

SEQ ID NO: 32151 - DNA, 20 bp, synthetic construct
  misc_feature 1..20: note = CRISPR gRNA sequence
  source 1..20: mol_type = other DNA
ccaaagtgctgggattacag

SEQ ID NO: 32152 - DNA, 20 bp, synthetic construct
  misc_feature 1..20: note = CRISPR gRNA sequence
  source 1..20: mol_type = other DNA
ggattacaggtgtgagccac

SEQ ID NO: 32153 - DNA, 20 bp, synthetic construct
  misc_feature 1..20: note = CRISPR gRNA sequence
  source 1..20: mol_type = other DNA
caggtgtgagccaccacatc

SEQ ID NO: 32154 - DNA, 20 bp, synthetic construct
  misc_feature 1..20: note = CRISPR gRNA sequence
  source 1..20: mol_type = other DNA
gcccccatacagtcttcatc

SEQ ID NO: 32155 - DNA, 20 bp, synthetic construct
  misc_feature 1..20: note = CRISPR gRNA sequence
  source 1..20: mol_type = other DNA
catcatttgcttcattcagt

SEQ ID NO: 32156 - DNA, 20 bp, synthetic construct
  misc_feature 1..20: note = CRISPR gRNA sequence
  source 1..20: mol_type = other DNA
atcatttgcttcattcagtc

SEQ ID NO: 32157 - DNA, 20 bp, synthetic construct
  misc_feature 1..20: note = CRISPR gRNA sequence
  source 1..20: mol_type = other DNA
gcttcattcagtcacccacc

SEQ ID NO: 32158 - DNA, 20 bp, synthetic construct
  misc_feature 1..20: note = CRISPR gRNA sequence
  source 1..20: mol_type = other DNA
cttcattcagtcacccacca

SEQ ID NO: 32159 - DNA, 20 bp, synthetic construct
  misc_feature 1..20: note = CRISPR gRNA sequence
  source 1..20: mol_type = other DNA
cattcagtcacccaccactc

SEQ ID NO: 32160 - DNA, 20 bp, synthetic construct
  misc_feature 1..20: note = CRISPR gRNA sequence
  source 1..20: mol_type = other DNA
attcagtcacccaccactca

SEQ ID NO: 32161 - DNA, 20 bp, synthetic construct
  misc_feature 1..20: note = CRISPR gRNA sequence
  source 1..20: mol_type = other DNA
agtcacccaccactcattca

SEQ ID NO: 32162 - DNA, 20 bp, synthetic construct
  misc_feature 1..20: note = CRISPR gRNA sequence
  source 1..20: mol_type = other DNA
attcattagttcactcattt

SEQ ID NO: 32163 - DNA, 20 bp, synthetic construct
  misc_feature 1..20: note = CRISPR gRNA sequence
  source 1..20: mol_type = other DNA
attagttcactcatttccac

SEQ ID NO: 32164 - DNA, 20 bp, synthetic construct
  misc_feature 1..20: note = CRISPR gRNA sequence
  source 1..20: mol_type = other DNA
gttcactcatttccacaccc

SEQ ID NO: 32165 - DNA, 20 bp, synthetic construct
  misc_feature 1..20: note = CRISPR gRNA sequence
  source 1..20: mol_type = other DNA
actcatttccacacccattc

SEQ ID NO: 32166 - DNA, 20 bp, synthetic construct
  misc_feature 1..20: note = CRISPR gRNA sequence
  source 1..20: mol_type = other DNA
atttccacacccattccttc

SEQ ID NO: 32167 - DNA, 20 bp, synthetic construct
  misc_feature 1..20: note = CRISPR gRNA sequence
  source 1..20: mol_type = other DNA
ccacacccattccttcactc

SEQ ID NO: 32168 - DNA, 20 bp, synthetic construct
  misc_feature 1..20: note = CRISPR gRNA sequence
  source 1..20: mol_type = other DNA
cacacccattccttcactca

SEQ ID NO: 32169 - DNA, 20 bp, synthetic construct
  misc_feature 1..20: note = CRISPR gRNA sequence
  source 1..20: mol_type = other DNA
cttcactcatcgtctctctt

SEQ ID NO: 32170 - DNA, 20 bp, synthetic construct
  misc_feature 1..20: note = CRISPR gRNA sequence
  source 1..20: mol_type = other DNA
cactcatcgtctctcttgtt

SEQ ID NO: 32171 - DNA, 20 bp, synthetic construct
  misc_feature 1..20: note = CRISPR gRNA sequence
  source 1..20: mol_type = other DNA
actcatcgtctctcttgttt

SEQ ID NO: 32172 - DNA, 20 bp, synthetic construct
  misc_feature 1..20: note = CRISPR gRNA sequence
  source 1..20: mol_type = other DNA
atcgtctctcttgtttaagt

SEQ ID NO: 32173 - DNA, 20 bp, synthetic construct
  misc_feature 1..20: note = CRISPR gRNA sequence
  source 1..20: mol_type = other DNA
tcttgtttaagtgtccactc

SEQ ID NO: 32174 - DNA, 20 bp, synthetic construct
  misc_feature 1..20: note = CRISPR gRNA sequence
  source 1..20: mol_type = other DNA
ttgtttaagtgtccactcct

SEQ ID NO: 32175 - DNA, 20 bp, synthetic construct
  misc_feature 1..20: note = CRISPR gRNA sequence
  source 1..20: mol_type = other DNA
gtttaagtgtccactccttt

SEQ ID NO: 32176 - DNA, 20 bp, synthetic construct
  misc_feature 1..20: note = CRISPR gRNA sequence
  source 1..20: mol_type = other DNA
tttaagtgtccactcctttt

SEQ ID NO: 32177 - DNA, 20 bp, synthetic construct
  misc_feature 1..20: note = CRISPR gRNA sequence
  source 1..20: mol_type = other DNA
aagtgtccactccttttaga

SEQ ID NO: 32178 - DNA, 20 bp, synthetic construct
  misc_feature 1..20: note = CRISPR gRNA sequence
  source 1..20: mol_type = other DNA
agtgtccactccttttagac

SEQ ID NO: 32179 - DNA, 20 bp, synthetic construct
  misc_feature 1..20: note = CRISPR gRNA sequence
  source 1..20: mol_type = other DNA
cttttagaccttttctctct

SEQ ID NO: 32180 - DNA, 20 bp, synthetic construct
  misc_feature 1..20: note = CRISPR gRNA sequence
  source 1..20: mol_type = other DNA
ttagaccttttctctctttt

SEQ ID NO: 32181 - DNA, 20 bp, synthetic construct
  misc_feature 1..20: note = CRISPR gRNA sequence
  source 1..20: mol_type = other DNA
tagaccttttctctcttttt

SEQ ID NO: 32182 - DNA, 20 bp, synthetic construct
  misc_feature 1..20: note = CRISPR gRNA sequence
  source 1..20: mol_type = other DNA
agaccttttctctctttttt

SEQ ID NO: 32183 - DNA, 20 bp, synthetic construct
  misc_feature 1..20: note = CRISPR gRNA sequence
  source 1..20: mol_type = other DNA
gaccttttctctcttttttt

SEQ ID NO: 32184 - DNA, 20 bp, synthetic construct
  misc_feature 1..20: note = CRISPR gRNA sequence
  source 1..20: mol_type = other DNA
ttctctcttttttttttttg

SEQ ID NO: 32185 - DNA, 20 bp, synthetic construct
  misc_feature 1..20: note = CRISPR gRNA sequence
  source 1..20: mol_type = other DNA
tctctcttttttttttttga

SEQ ID NO: 32186 - DNA, 20 bp, synthetic construct
  misc_feature 1..20: note = CRISPR gRNA sequence
  source 1..20: mol_type = other DNA
ctctcttttttttttttgag

SEQ ID NO: 32187 - DNA, 20 bp, synthetic construct
  misc_feature 1..20: note = CRISPR gRNA sequence
  source 1..20: mol_type = other DNA
tctcttttttttttttgaga

SEQ ID NO: 32188 - DNA, 20 bp, synthetic construct
  misc_feature 1..20: note = CRISPR gRNA sequence
  source 1..20: mol_type = other DNA
tcttttttttttttgagatg

SEQ ID NO: 32189 - DNA, 20 bp, synthetic construct
  misc_feature 1..20: note = CRISPR gRNA sequence
  source 1..20: mol_type = other DNA
ttttttttttttgagatgga

SEQ ID NO: 32190 - DNA, 20 bp, synthetic construct
  misc_feature 1..20: note = CRISPR gRNA sequence
  source 1..20: mol_type = other DNA
ttttttttttgagatggatc

SEQ ID NO: 32191 - DNA, 20 bp, synthetic construct
  misc_feature 1..20: note = CRISPR gRNA sequence
  source 1..20: mol_type = other DNA
tttttttttgagatggatcc

SEQ ID NO: 32192 - DNA, 20 bp, synthetic construct
  misc_feature 1..20: note = CRISPR gRNA sequence
  source 1..20: mol_type = other DNA
ttttttttgagatggatcct

SEQ ID NO: 32193 - DNA, 20 bp, synthetic construct
  misc_feature 1..20: note = CRISPR gRNA sequence
  source 1..20: mol_type = other DNA
tttttttgagatggatcctg

SEQ ID NO: 32194 - DNA, 20 bp, synthetic construct
  misc_feature 1..20: note = CRISPR gRNA sequence
  source 1..20: mol_type = other DNA
ttttttgagatggatcctgc

SEQ ID NO: 32195 - DNA, 20 bp, synthetic construct
  misc_feature 1..20: note = CRISPR gRNA sequence
  source 1..20: mol_type = other DNA
tttttgagatggatcctgcc

SEQ ID NO: 32196 - DNA, 20 bp, synthetic construct
  misc_feature 1..20: note = CRISPR gRNA sequence
  source 1..20: mol_type = other DNA
ttttgagatggatcctgccc

SEQ ID NO: 32197 - DNA, 20 bp, synthetic construct
  misc_feature 1..20: note = CRISPR gRNA sequence
  source 1..20: mol_type = other DNA
tttgagatggatcctgccct

SEQ ID NO: 32198 - DNA, 20 bp, synthetic construct
  misc_feature 1..20: note = CRISPR gRNA sequence
  source 1..20: mol_type = other DNA
ttgagatggatcctgccctg

SEQ ID NO: 32199 - DNA, 20 bp, synthetic construct
  misc_feature 1..20: note = CRISPR gRNA sequence
  source 1..20: mol_type = other DNA
tgagatggatcctgccctgt

SEQ ID NO: 32200 - DNA, 20 bp, synthetic construct
  misc_feature 1..20: note = CRISPR gRNA sequence
  source 1..20: mol_type = other DNA
gagatggatcctgccctgtg

SEQ ID NO: 32201 - DNA, 20 bp, synthetic construct
  misc_feature 1..20: note = CRISPR gRNA sequence
  source 1..20: mol_type = other DNA
agatggatcctgccctgtgc

SEQ ID NO: 32202 - DNA, 20 bp, synthetic construct
  misc_feature 1..20: note = CRISPR gRNA sequence
  source 1..20: mol_type = other DNA
ccctgtgccccaggctggag

SEQ ID NO: 32203 - DNA, 20 bp, synthetic construct
  misc_feature 1..20: note = CRISPR gRNA sequence
  source 1..20: mol_type = other DNA
tgccccaggctggagtgcac

SEQ ID NO: 32204 - DNA, 20 bp, synthetic construct
  misc_feature 1..20: note = CRISPR gRNA sequence
  source 1..20: mol_type = other DNA
gagtgcactggcgcaatctc

SEQ ID NO: 32205 - DNA, 20 bp, synthetic construct
  misc_feature 1..20: note = CRISPR gRNA sequence
  source 1..20: mol_type = other DNA
gcgcaatctcagctcacggc

SEQ ID NO: 32206 - DNA, 20 bp, synthetic construct
  misc_feature 1..20: note = CRISPR gRNA sequence
  source 1..20: mol_type = other DNA
agctcacggcaacctccacc

SEQ ID NO: 32207 - DNA, 20 bp, synthetic construct
  misc_feature 1..20: note = CRISPR gRNA sequence
  source 1..20: mol_type = other DNA
acggcaacctccacctcctg

SEQ ID NO: 32208 - DNA, 20 bp, synthetic construct
  misc_feature 1..20: note = CRISPR gRNA sequence
  source 1..20: mol_type = other DNA
cacctcctgggtttaggcga

SEQ ID NO: 32209 - DNA, 20 bp, synthetic construct
  misc_feature 1..20: note = CRISPR gRNA sequence
  source 1..20: mol_type = other DNA
ctgggtttaggcgattctcc

SEQ ID NO: 32210 - DNA, 20 bp, synthetic construct
  misc_feature 1..20: note = CRISPR gRNA sequence
  source 1..20: mol_type = other DNA
ggtttaggcgattctcctgc

SEQ ID NO: 32211 - DNA, 20 bp, synthetic construct
  misc_feature 1..20: note = CRISPR gRNA sequence
  source 1..20: mol_type = other DNA
aggcgattctcctgcctcgg

SEQ ID NO: 32212 - DNA, 20 bp, synthetic construct
  misc_feature 1..20: note = CRISPR gRNA sequence
  source 1..20: mol_type = other DNA
ggcgattctcctgcctcggc

SEQ ID NO: 32213 - DNA, 20 bp, synthetic construct
  misc_feature 1..20: note = CRISPR gRNA sequence
  source 1..20: mol_type = other DNA
tcctgcctcggcctgccaag

SEQ ID NO: 32214 - DNA, 20 bp, synthetic construct
  misc_feature 1..20: note = CRISPR gRNA sequence
  source 1..20: mol_type = other DNA
ctgcctcggcctgccaagta

SEQ ID NO: 32215 - DNA, 20 bp, synthetic construct
  misc_feature 1..20: note = CRISPR gRNA sequence
  source 1..20: mol_type = other DNA
cctcggcctgccaagtagct

SEQ ID NO: 32216 - DNA, 20 bp, synthetic construct
  misc_feature 1..20: note = CRISPR gRNA sequence
  source 1..20: mol_type = other DNA
ggcctgccaagtagctggga

SEQ ID NO: 32217 - DNA, 20 bp, synthetic construct
  misc_feature 1..20: note = CRISPR gRNA sequence
  source 1..20: mol_type = other DNA
ccaagtagctgggattacag

SEQ ID NO: 32218 - DNA, 20 bp, synthetic construct
  misc_feature 1..20: note = CRISPR gRNA sequence
  source 1..20: mol_type = other DNA
ggattacaggcacccactac

SEQ ID NO: 32219 - DNA, 20 bp, synthetic construct
  misc_feature 1..20: note = CRISPR gRNA sequence
  source 1..20: mol_type = other DNA
caggcacccactaccacgtc

SEQ ID NO: 32220 - DNA, 20 bp, synthetic construct
  misc_feature 1..20: note = CRISPR gRNA sequence
  source 1..20: mol_type = other DNA
ccacgtctggctaatttttg

SEQ ID NO: 32221 - DNA, 20 bp, synthetic construct
  misc_feature 1..20: note = CRISPR gRNA sequence
  source 1..20: mol_type = other DNA
gctaatttttgtatttttta

SEQ ID NO: 32222 - DNA, 20 bp, synthetic construct
  misc_feature 1..20: note = CRISPR gRNA sequence
  source 1..20: mol_type = other DNA
atttttgtattttttaatgg

SEQ ID NO: 32223 - DNA, 20 bp, synthetic construct
  misc_feature 1..20: note = CRISPR gRNA sequence
  source 1..20: mol_type = other DNA
ttgtattttttaatggagac

SEQ ID NO: 32224 - DNA, 20 bp, synthetic construct
  misc_feature 1..20: note = CRISPR gRNA sequence
  source 1..20: mol_type = other DNA
tgtattttttaatggagacg

SEQ ID NO: 32225 - DNA, 20 bp, synthetic construct
  misc_feature 1..20: note = CRISPR gRNA sequence
  source 1..20: mol_type = other DNA
gtattttttaatggagacgg

SEQ ID NO: 32226 - DNA, 20 bp, synthetic construct
  misc_feature 1..20: note = CRISPR gRNA sequence
  source 1..20: mol_type = other DNA
tattttttaatggagacggg

SEQ ID NO: 32227 - DNA, 20 bp, synthetic construct
  misc_feature 1..20: note = CRISPR gRNA sequence
  source 1..20: mol_type = other DNA
tttaatggagacggggtttc

SEQ ID NO: 32228 - DNA, 20 bp, synthetic construct
  misc_feature 1..20: note = CRISPR gRNA sequence
  source 1..20: mol_type = other DNA
ttaatggagacggggtttca

SEQ ID NO: 32229 - DNA, 20 bp, synthetic construct
  misc_feature 1..20: note = CRISPR gRNA sequence
  source 1..20: mol_type = other DNA
taatggagacggggtttcac

SEQ ID NO: 32230 - DNA, 20 bp, synthetic construct
  misc_feature 1..20: note = CRISPR gRNA sequence
  source 1..20: mol_type = other DNA
aatggagacggggtttcact

SEQ ID NO: 32231 - DNA, 20 bp, synthetic construct
  misc_feature 1..20: note = CRISPR gRNA sequence
  source 1..20: mol_type = other DNA
atggagacggggtttcacta

SEQ ID NO: 32232 - DNA, 20 bp, synthetic construct
  misc_feature 1..20: note = CRISPR gRNA sequence
  source 1..20: mol_type = other DNA
cactatgttggccaggctgg

SEQ ID NO: 32233 - DNA, 20 bp, synthetic construct
  misc_feature 1..20: note = CRISPR gRNA sequence
  source 1..20: mol_type = other DNA
actatgttggccaggctggt

SEQ ID NO: 32234 - DNA, 20 bp, synthetic construct
  misc_feature 1..20: note = CRISPR gRNA sequence
  source 1..20: mol_type = other DNA
tgttggccaggctggtctcg

SEQ ID NO: 32235 - DNA, 20 bp, synthetic construct
  misc_feature 1..20: note = CRISPR gRNA sequence
  source 1..20: mol_type = other DNA
gccaggctggtctcgaactc

SEQ ID NO: 32236 - DNA, 20 bp, synthetic construct
  misc_feature 1..20: note = CRISPR gRNA sequence
  source 1..20: mol_type = other DNA
gtctcgaactcctgacctca

SEQ ID NO: 32237 - DNA, 20 bp, synthetic construct
  misc_feature 1..20: note = CRISPR gRNA sequence
  source 1..20: mol_type = other DNA
gaactcctgacctcaggtga

SEQ ID NO: 32238 - DNA, 20 bp, synthetic construct
  misc_feature 1..20: note = CRISPR gRNA sequence
  source 1..20: mol_type = other DNA
ctgacctcaggtgatccacc

SEQ ID NO: 32239 - DNA, 20 bp, synthetic construct
  misc_feature 1..20: note = CRISPR gRNA sequence
  source 1..20: mol_type = other DNA
acctcaggtgatccacctgc

SEQ ID NO: 32240 - DNA, 20 bp, synthetic construct
  misc_feature 1..20: note = CRISPR gRNA sequence
  source 1..20: mol_type = other DNA
aggtgatccacctgccttgg

SEQ ID NO: 32241 - DNA, 20 bp, synthetic construct
  misc_feature 1..20: note = CRISPR gRNA sequence
  source 1..20: mol_type = other DNA
ccttggcctcccaaagtgct

SEQ ID NO: 32242 - DNA, 20 bp, synthetic construct
  misc_feature 1..20: note = CRISPR gRNA sequence
  source 1..20: mol_type = other DNA
ggcctcccaaagtgctggga

SEQ ID NO: 32243 - DNA, 20 bp, synthetic construct
  misc_feature 1..20: note = CRISPR gRNA sequence
  source 1..20: mol_type = other DNA
gcctcccaaagtgctgggat

SEQ ID NO: 32244 - DNA, 20 bp, synthetic construct
  misc_feature 1..20: note = CRISPR gRNA sequence
  source 1..20: mol_type = other DNA
ccaaagtgctgggattacag

SEQ ID NO: 32245 - DNA, 20 bp, synthetic construct
  misc_feature 1..20: note = CRISPR gRNA sequence
  source 1..20: mol_type = other DNA
ggattacaggcataaggcac

SEQ ID NO: 32246 - DNA, 20 bp, synthetic construct
  misc_feature 1..20: note = CRISPR gRNA sequence
  source 1..20: mol_type = other DNA
caggcataaggcaccatgca

SEQ ID NO: 32247 - DNA, 20 bp, synthetic construct
  misc_feature 1..20: note = CRISPR gRNA sequence
  source 1..20: mol_type = other DNA
ttctcattccttcatttact

SEQ ID NO: 32248 - DNA, 20 bp, synthetic construct
  misc_feature 1..20: note = CRISPR gRNA sequence
  source 1..20: mol_type = other DNA
tctcattccttcatttactc

SEQ ID NO: 32249 - DNA, 20 bp, synthetic construct
  misc_feature 1..20: note = CRISPR gRNA sequence
  source 1..20: mol_type = other DNA
ctcattccttcatttactca

SEQ ID NO: 32250 - DNA, 20 bp, synthetic construct
  misc_feature 1..20: note = CRISPR gRNA sequence
  source 1..20: mol_type = other DNA
tcattccttcatttactcac

SEQ ID NO: 32251 - DNA, 20 bp, synthetic construct
  misc_feature 1..20: note = CRISPR gRNA sequence
  source 1..20: mol_type = other DNA
attccttcatttactcacta

SEQ ID NO: 32252 - DNA, 20 bp, synthetic construct
  misc_feature 1..20: note = CRISPR gRNA sequence
  source 1..20: mol_type = other DNA
cttcatttactcactaagct

SEQ ID NO: 32253 - DNA, 20 bp, synthetic construct
  misc_feature 1..20: note = CRISPR gRNA sequence
  source 1..20: mol_type = other DNA
catttactcactaagctttt

SEQ ID NO: 32254 - DNA, 20 bp, synthetic construct
  misc_feature 1..20: note = CRISPR gRNA sequence
  source 1..20: mol_type = other DNA
atttactcactaagcttttt

SEQ ID NO: 32255 - DNA, 20 bp, synthetic construct
  misc_feature 1..20: note = CRISPR gRNA sequence
  source 1..20: mol_type = other DNA
actcactaagctttttcttc

SEQ ID NO: 32256 - DNA, 20 bp, synthetic construct
  misc_feature 1..20: note = CRISPR gRNA sequence
  source 1..20: mol_type = other DNA
ctcactaagctttttcttcg

SEQ ID NO: 32257 - DNA, 20 bp, synthetic construct
  misc_feature 1..20: note = CRISPR gRNA sequence
  source 1..20: mol_type = other DNA
actaagctttttcttcgctt

SEQ ID NO: 32258 - DNA, 20 bp, synthetic construct
  misc_feature 1..20: note = CRISPR gRNA sequence
  source 1..20: mol_type = other DNA
agctttttcttcgcttgatc

SEQ ID NO: 32259 - DNA, 20 bp, synthetic construct
  misc_feature 1..20: note = CRISPR gRNA sequence
  source 1..20: mol_type = other DNA
tttcttcgcttgatcactac

SEQ ID NO: 32260 - DNA, 20 bp, synthetic construct
  misc_feature 1..20: note = CRISPR gRNA sequence
  source 1..20: mol_type = other DNA
ttcttcgcttgatcactact

SEQ ID NO: 32261 - DNA, 20 bp, synthetic construct
  misc_feature 1..20: note = CRISPR gRNA sequence
  source 1..20: mol_type = other DNA
tcttcgcttgatcactactc

SEQ ID NO: 32262 - DNA, 20 bp, synthetic construct
  misc_feature 1..20: note = CRISPR gRNA sequence
  source 1..20: mol_type = other DNA
cttcgcttgatcactactca

SEQ ID NO: 32263 - DNA, 20 bp, synthetic construct
  misc_feature 1..20: note = CRISPR gRNA sequence
  source 1..20: mol_type = other DNA
ttcgcttgatcactactcac

SEQ ID NO: 32264 - DNA, 20 bp, synthetic construct
  misc_feature 1..20: note = CRISPR gRNA sequence
  source 1..20: mol_type = other DNA
cgcttgatcactactcactc

SEQ ID NO: 32265 - DNA, 20 bp, synthetic construct
  misc_feature 1..20: note = CRISPR gRNA sequence
  source 1..20: mol_type = other DNA
gcttgatcactactcactca

SEQ ID NO: 32266 - DNA, 20 bp, synthetic construct
  misc_feature 1..20: note = CRISPR gRNA sequence
  source 1..20: mol_type = other DNA
gatcactactcactcaccat

SEQ ID NO: 32267 - DNA, 20 bp, synthetic construct
  misc_feature 1..20: note = CRISPR gRNA sequence
  source 1..20: mol_type = other DNA
atcactactcactcaccatg

SEQ ID NO: 32268 - DNA, 20 bp, synthetic construct
  misc_feature 1..20: note = CRISPR gRNA sequence
  source 1..20: mol_type = other DNA
ctcactcaccatggggaggt

SEQ ID NO: 32269 - DNA, 20 bp, synthetic construct
  misc_feature 1..20: note = CRISPR gRNA sequence
  source 1..20: mol_type = other DNA
actcaccatggggaggtcat

SEQ ID NO: 32270 - DNA, 20 bp, synthetic construct
  misc_feature 1..20: note = CRISPR gRNA sequence
  source 1..20: mol_type = other DNA
accatggggaggtcatggga

SEQ ID NO: 32271 - DNA, 20 bp, synthetic construct
  misc_feature 1..20: note = CRISPR gRNA sequence
  source 1..20: mol_type = other DNA
agagttaagacagtggagcc

SEQ ID NO: 32272 - DNA, 20 bp, synthetic construct
  misc_feature 1..20: note = CRISPR gRNA sequence
  source 1..20: mol_type = other DNA
agacagtggagcccacgtgt

SEQ ID NO: 32273 - DNA, 20 bp, synthetic construct
  misc_feature 1..20: note = CRISPR gRNA sequence
  source 1..20: mol_type = other DNA
ggttcaaatcccggttctac

SEQ ID NO: 32274 - DNA, 20 bp, synthetic construct
  misc_feature 1..20: note = CRISPR gRNA sequence
  source 1..20: mol_type = other DNA
aaatcccggttctaccactt

SEQ ID NO: 32275 - DNA, 20 bp, synthetic construct
  misc_feature 1..20: note = CRISPR gRNA sequence
  source 1..20: mol_type = other DNA
taccacttgctggagcaatt

SEQ ID NO: 32276 - DNA, 20 bp, synthetic construct
  misc_feature 1..20: note = CRISPR gRNA sequence
  source 1..20: mol_type = other DNA
ccacttgctggagcaattct

SEQ ID NO: 32277 - DNA, 20 bp, synthetic construct
  misc_feature 1..20: note = CRISPR gRNA sequence
  source 1..20: mol_type = other DNA
gctggagcaattctgagcat

SEQ ID NO: 32278 - DNA, 20 bp, synthetic construct
  misc_feature 1..20: note = CRISPR gRNA sequence
  source 1..20: mol_type = other DNA
ctggagcaattctgagcatg

SEQ ID NO: 32279 - DNA, 20 bp, synthetic construct
  misc_feature 1..20: note = CRISPR gRNA sequence
  source 1..20: mol_type = other DNA
gagcaattctgagcatgcta

SEQ ID NO: 32280 - DNA, 20 bp, synthetic construct
  misc_feature 1..20: note = CRISPR gRNA sequence
  source 1..20: mol_type = other DNA
tgagcatgctatacatccca

SEQ ID NO: 32281 - DNA, 20 bp, synthetic construct
  misc_feature 1..20: note = CRISPR gRNA sequence
  source 1..20: mol_type = other DNA
agcatgctatacatcccacc

SEQ ID NO: 32282 - DNA, 20 bp, synthetic construct
  misc_feature 1..20: note = CRISPR gRNA sequence
  source 1..20: mol_type = other DNA
tacatcccaccatgcctcag

SEQ ID NO: 32283 - DNA, 20 bp, synthetic construct
  misc_feature 1..20: note = CRISPR gRNA sequence
  source 1..20: mol_type = other DNA
agtagcctcatctggaaaat

SEQ ID NO: 32284 - DNA, 20 bp, synthetic construct
  misc_feature 1..20: note = CRISPR gRNA sequence
  source 1..20: mol_type = other DNA
atctggaaaatggggataat

SEQ ID NO: 32285 - DNA, 20 bp, synthetic construct
  misc_feature 1..20: note = CRISPR gRNA sequence
  source 1..20: mol_type = other DNA
gaaaatggggataatattgg

SEQ ID NO: 32286 - DNA, 20 bp, synthetic construct
  misc_feature 1..20: note = CRISPR gRNA sequence
  source 1..20: mol_type = other DNA
ggattgtgtgagatgttaat

SEQ ID NO: 32287 - DNA, 20 bp, synthetic construct
  misc_feature 1..20: note = CRISPR gRNA sequence
  source 1..20: mol_type = other DNA
tgtgagatgttaatgattta

SEQ ID NO: 32288 - DNA, 20 bp, synthetic construct
  misc_feature 1..20: note = CRISPR gRNA sequence
  source 1..20: mol_type = other DNA
atgatttagcatacctaaca

SEQ ID NO: 32289 - DNA, 20 bp, synthetic construct
  misc_feature 1..20: note = CRISPR gRNA sequence
  source 1..20: mol_type = other DNA
agcatacctaacatgcttag

SEQ ID NO: 32290 - DNA, 20 bp, synthetic construct
  misc_feature 1..20: note = CRISPR gRNA sequence
  source 1..20: mol_type = other DNA
gcatacctaacatgcttaga

SEQ ID NO: 32291 - DNA, 20 bp, synthetic construct
  misc_feature 1..20: note = CRISPR gRNA sequence
  source 1..20: mol_type = other DNA
acatgcttagaccagtatgt

SEQ ID NO: 32292 - DNA, 20 bp, synthetic construct
  misc_feature 1..20: note = CRISPR gRNA sequence
  source 1..20: mol_type = other DNA
agaccagtatgtgagagtaa

SEQ ID NO: 32293 - DNA, 20 bp, synthetic construct
  misc_feature 1..20: note = CRISPR gRNA sequence
  source 1..20: mol_type = other DNA
gaccagtatgtgagagtaag

SEQ ID NO: 32294 - DNA, 20 bp, synthetic construct
  misc_feature 1..20: note = CRISPR gRNA sequence
  source 1..20: mol_type = other DNA
agtaatttagtaattctctt

SEQ ID NO: 32295 - DNA, 20 bp, synthetic construct
  misc_feature 1..20: note = CRISPR gRNA sequence
  source 1..20: mol_type = other DNA
gtaatttagtaattctctta

SEQ ID NO: 32296 - DNA, 20 bp, synthetic construct
  misc_feature 1..20: note = CRISPR gRNA sequence
  source 1..20: mol_type = other DNA
agtaattctcttattcactg

SEQ ID NO: 32297 - DNA, 20 bp, synthetic construct
  misc_feature 1..20: note = CRISPR gRNA sequence
  source 1..20: mol_type = other DNA
gtaattctcttattcactgg

SEQ ID NO: 32298 - DNA, 20 bp, synthetic construct
  misc_feature 1..20: note = CRISPR gRNA sequence
  source 1..20: mol_type = other DNA
tcttattcactggtttattc

SEQ ID NO: 32299 - DNA, 20 bp, synthetic construct
  misc_feature 1..20: note = CRISPR gRNA sequence
  source 1..20: mol_type = other DNA
ttattcactggtttattccc

SEQ ID NO: 32300 - DNA, 20 bp, synthetic construct
  misc_feature 1..20: note = CRISPR gRNA sequence
  source 1..20: mol_type = other DNA
attcactggtttattcccac

SEQ ID NO: 32301 - DNA, 20 bp, synthetic construct
  misc_feature 1..20: note = CRISPR gRNA sequence
  source 1..20: mol_type = other DNA
ttcactggtttattcccact

SEQ ID NO: 32302 - DNA, 20 bp, synthetic construct
  misc_feature 1..20: note = CRISPR gRNA sequence
  source 1..20: mol_type = other DNA
actggtttattcccactttc

SEQ ID NO: 32303 - DNA, 20 bp, synthetic construct
  misc_feature 1..20: note = CRISPR gRNA sequence
  source 1..20: mol_type = other DNA
gtttattcccactttccatt

SEQ ID NO: 32304 - DNA, 20 bp, synthetic construct
  misc_feature 1..20: note = CRISPR gRNA sequence
  source 1..20: mol_type = other DNA
attcccactttccattgctc

SEQ ID NO: 32305 - DNA, 20 bp, synthetic construct
  misc_feature 1..20: note = CRISPR gRNA sequence
  source 1..20: mol_type = other DNA
ttcccactttccattgctcc

SEQ ID NO: 32306 - DNA, 20 bp, synthetic construct
  misc_feature 1..20: note = CRISPR gRNA sequence
  source 1..20: mol_type = other DNA
ccactttccattgctcccat

SEQ ID NO: 32307 - DNA, 20 bp, synthetic construct
  misc_feature 1..20: note = CRISPR gRNA sequence
  source 1..20: mol_type = other DNA
tccattgctcccatcctcat

SEQ ID NO: 32308 - DNA, 20 bp, synthetic construct
  misc_feature 1..20: note = CRISPR gRNA sequence
  source 1..20: mol_type = other DNA
ccattgctcccatcctcatc

SEQ ID NO: 32309 - DNA, 20 bp, synthetic construct
  misc_feature 1..20: note = CRISPR gRNA sequence
  source 1..20: mol_type = other DNA
cattgctcccatcctcatca

SEQ ID NO: 32310 - DNA, 20 bp, synthetic construct
  misc_feature 1..20: note = CRISPR gRNA sequence
  source 1..20: mol_type = other DNA
ctcccatcctcatcaacttc

SEQ ID NO: 32311 - DNA, 20 bp, synthetic construct
  misc_feature 1..20: note = CRISPR gRNA sequence
  source 1..20: mol_type = other DNA
ccatcctcatcaacttctca

SEQ ID NO: 32312 - DNA, 20 bp, synthetic construct
  misc_feature 1..20: note = CRISPR gRNA sequence
  source 1..20: mol_type = other DNA
atcaacttctcacttcatcc

SEQ ID NO: 32313 - DNA, 20 bp, synthetic construct
  misc_feature 1..20: note = CRISPR gRNA sequence
  source 1..20: mol_type = other DNA
ctcacttcatccactcactc

SEQ ID NO: 32314 - DNA, 20 bp, synthetic construct
  misc_feature 1..20: note = CRISPR gRNA sequence
  source 1..20: mol_type = other DNA
tcacttcatccactcactca

SEQ ID NO: 32315 - DNA, 20 bp, synthetic construct
  misc_feature 1..20: note = CRISPR gRNA sequence
  source 1..20: mol_type = other DNA
acttcatccactcactcact

SEQ ID NO: 32316 - DNA, 20 bp, synthetic construct
  misc_feature 1..20: note = CRISPR gRNA sequence
  source 1..20: mol_type = other DNA
catccactcactcacttcat

SEQ ID NO: 32317 - DNA, 20 bp, synthetic construct
  misc_feature 1..20: note = CRISPR gRNA sequence
  source 1..20: mol_type = other DNA
atccactcactcacttcatc

SEQ ID NO: 32318 - DNA, 20 bp, synthetic construct
  misc_feature 1..20: note = CRISPR gRNA sequence
  source 1..20: mol_type = other DNA
actcacttcatcattcgctt

SEQ ID NO: 32319 - DNA, 20 bp, synthetic construct
  misc_feature 1..20: note = CRISPR gRNA sequence
  source 1..20: mol_type = other DNA
acttcatcattcgcttgccc

SEQ ID NO: 32320 - DNA, 20 bp, synthetic construct
  misc_feature 1..20: note = CRISPR gRNA sequence
  source 1..20: mol_type = other DNA
catcattcgcttgcccctca

SEQ ID NO: 32321 - DNA, 20 bp, synthetic construct
  misc_feature 1..20: note = CRISPR gRNA sequence
  source 1..20: mol_type = other DNA
atcattcgcttgcccctcat

SEQ ID NO: 32322 - DNA, 20 bp, synthetic construct
  misc_feature 1..20: note = CRISPR gRNA sequence
  source 1..20: mol_type = other DNA
gcttgcccctcattcattct

SEQ ID NO: 32323 - DNA, 20 bp, synthetic construct
  misc_feature 1..20: note = CRISPR gRNA sequence
  source 1..20: mol_type = other DNA
gcccctcattcattctctca

SEQ ID NO: 32324 - DNA, 20 bp, synthetic construct
  misc_feature 1..20: note = CRISPR gRNA sequence
  source 1..20: mol_type = other DNA
cccctcattcattctctcag

SEQ ID NO: 32325 - DNA, 20 bp, synthetic construct
  misc_feature 1..20: note = CRISPR gRNA sequence
  source 1..20: mol_type = other DNA
attcattctctcagcctgac

SEQ ID NO: 32326 - DNA, 20 bp, synthetic construct
  misc_feature 1..20: note = CRISPR gRNA sequence
  source 1..20: mol_type = other DNA
attctctcagcctgacaatg

SEQ ID NO: 32327 - DNA, 20 bp, synthetic construct
  misc_feature 1..20: note = CRISPR gRNA sequence
  source 1..20: mol_type = other DNA
tctcagcctgacaatgaagt

SEQ ID NO: 32328 - DNA, 20 bp, synthetic construct
  misc_feature 1..20: note = CRISPR gRNA sequence
  source 1..20: mol_type = other DNA
tcagcctgacaatgaagtgt

SEQ ID NO: 32329 - DNA, 20 bp, synthetic construct
  misc_feature 1..20: note = CRISPR gRNA sequence
  source 1..20: mol_type = other DNA
agcctgacaatgaagtgtta

SEQ ID NO: 32330 - DNA, 20 bp, synthetic construct
  misc_feature 1..20: note = CRISPR gRNA sequence
  source 1..20: mol_type = other DNA
acaatgaagtgttaacaccc

SEQ ID NO: 32331 - DNA, 20 bp, synthetic construct
  misc_feature 1..20: note = CRISPR gRNA sequence
  source 1..20: mol_type = other DNA
acacccagtgcaggcttatt

SEQ ID NO: 32332 - DNA, 20 bp, synthetic construct
  misc_feature 1..20: note = CRISPR gRNA sequence
  source 1..20: mol_type = other DNA
attgaagggcaataaatatt

SEQ ID NO: 32333 - DNA, 20 bp, synthetic construct
  misc_feature 1..20: note = CRISPR gRNA sequence
  source 1..20: mol_type = other DNA
ttgaagggcaataaatatta

SEQ ID NO: 32334 - DNA, 20 bp, synthetic construct
  misc_feature 1..20: note = CRISPR gRNA sequence
  source 1..20: mol_type = other DNA
aagggcaataaatattattt

SEQ ID NO: 32335 - DNA, 20 bp, synthetic construct
  misc_feature 1..20: note = CRISPR gRNA sequence
  source 1..20: mol_type = other DNA
tttgagggagtggtggagtg

SEQ ID NO: 32336 - DNA, 20 bp, synthetic construct
  misc_feature 1..20: note = CRISPR gRNA sequence
  source 1..20: mol_type = other DNA
gagggagtggtggagtgaat

SEQ ID NO: 32337 - DNA, 20 bp, synthetic construct
  misc_feature 1..20: note = CRISPR gRNA sequence
  source 1..20: mol_type = other DNA
agggagtggtggagtgaatg

SEQ ID NO: 32338 - DNA, 20 bp, synthetic construct
  misc_feature 1..20: note = CRISPR gRNA sequence
  source 1..20: mol_type = other DNA
aataagtgtcaagtgaatga

SEQ ID NO: 32339 - DNA, 20 bp, synthetic construct
  misc_feature 1..20: note = CRISPR gRNA sequence
  source 1..20: mol_type = other DNA
ccatctccaccacccagggc

SEQ ID NO: 32340 - DNA, 20 bp, synthetic construct
  misc_feature 1..20: note = CRISPR gRNA sequence
  source 1..20: mol_type = other DNA
catctccaccacccagggca

SEQ ID NO: 32341 - DNA, 20 bp, synthetic construct
  misc_feature 1..20: note = CRISPR gRNA sequence
  source 1..20: mol_type = other DNA
caccacccagggcagagaga

SEQ ID NO: 32342 - DNA, 20 bp, synthetic construct
  misc_feature 1..20: note = CRISPR gRNA sequence
  source 1..20: mol_type = other DNA
accaggccattttggaagct

SEQ ID NO: 32343 - DNA, 20 bp, synthetic construct
  misc_feature 1..20: note = CRISPR gRNA sequence
  source 1..20: mol_type = other DNA
tggaagcttgttggagacct

SEQ ID NO: 32344 - DNA, 20 bp, synthetic construct
  misc_feature 1..20: note = CRISPR gRNA sequence
  source 1..20: mol_type = other DNA
ggaagcttgttggagacctc

SEQ ID NO: 32345 - DNA, 20 bp, synthetic construct
  misc_feature 1..20: note = CRISPR gRNA sequence
  source 1..20: mol_type = other DNA
gaagcttgttggagacctct

SEQ ID NO: 32346 - DNA, 20 bp, synthetic construct
  misc_feature 1..20: note = CRISPR gRNA sequence
  source 1..20: mol_type = other DNA
gttggagacctctccagctg

SEQ ID NO: 32347 - DNA, 20 bp, synthetic construct
  misc_feature 1..20: note = CRISPR gRNA sequence
  source 1..20: mol_type = other DNA
ttggagacctctccagctgc

SEQ ID NO: 32348 - DNA, 20 bp, synthetic construct
  misc_feature 1..20: note = CRISPR gRNA sequence
  source 1..20: mol_type = other DNA
gagacctctccagctgccgg

SEQ ID NO: 32349 - DNA, 20 bp, synthetic construct
  misc_feature 1..20: note = CRISPR gRNA sequence
  source 1..20: mol_type = other DNA
tccagctgccgggcattggg

SEQ ID NO: 32350 - DNA, 20 bp, synthetic construct
  misc_feature 1..20: note = CRISPR gRNA sequence
  source 1..20: mol_type = other DNA
cagctgccgggcattgggtg

SEQ ID NO: 32351 - DNA, 20 bp, synthetic construct
  misc_feature 1..20: note = CRISPR gRNA sequence
  source 1..20: mol_type = other DNA
ccgggcattgggtgggggac

SEQ ID NO: 32352 - DNA, 20 bp, synthetic construct
  misc_feature 1..20: note = CRISPR gRNA sequence
  source 1..20: mol_type = other DNA
ggtgggggacgtcttgtgct

SEQ ID NO: 32353 - DNA, 20 bp, synthetic construct
  misc_feature 1..20: note = CRISPR gRNA sequence
  source 1..20: mol_type = other DNA
gtgctctggagatggagaag

SEQ ID NO: 32354 - DNA, 20 bp, synthetic construct
  misc_feature 1..20: note = CRISPR gRNA sequence
  source 1..20: mol_type = other DNA
tgctctggagatggagaagc

SEQ ID NO: 32355 - DNA, 20 bp, synthetic construct
  misc_feature 1..20: note = CRISPR gRNA sequence
  source 1..20: mol_type = other DNA
tggagatggagaagcaggtg

SEQ ID NO: 32356 - DNA, 20 bp, synthetic construct
  misc_feature 1..20: note = CRISPR gRNA sequence
  source 1..20: mol_type = other DNA
gagatggagaagcaggtgcc

SEQ ID NO: 32357 - DNA, 20 bp, synthetic construct
  misc_feature 1..20: note = CRISPR gRNA sequence
  source 1..20: mol_type = other DNA
agggtgagggttacccctgg

SEQ ID NO: 32358 - DNA, 20 bp, synthetic construct
  misc_feature 1..20: note = CRISPR gRNA sequence
  source 1..20: mol_type = other DNA
gggtgagggttacccctggg

SEQ ID NO: 32359 - DNA, 20 bp, synthetic construct
  misc_feature 1..20: note = CRISPR gRNA sequence
  source 1..20: mol_type = other DNA
cccctggggacccccctccc

SEQ ID NO: 32360 - DNA, 20 bp, synthetic construct
  misc_feature 1..20: note = CRISPR gRNA sequence
  source 1..20: mol_type = other DNA
gggacccccctccctctggg

SEQ ID NO: 32361 - DNA, 20 bp, synthetic construct
  misc_feature 1..20: note = CRISPR gRNA sequence
  source 1..20: mol_type = other DNA
cctctgggccacttagtcct

SEQ ID NO: 32362 - DNA, 20 bp, synthetic construct
  misc_feature 1..20: note = CRISPR gRNA sequence
  source 1..20: mol_type = other DNA
tgggccacttagtccttaca

SEQ ID NO: 32363 - DNA, 20 bp, synthetic construct
  misc_feature 1..20: note = CRISPR gRNA sequence
  source 1..20: mol_type = other DNA
ggccacttagtccttacagc

SEQ ID NO: 32364 - DNA, 20 bp, synthetic construct
  misc_feature 1..20: note = CRISPR gRNA sequence
  source 1..20: mol_type = other DNA
agtccttacagccttcatgg

SEQ ID NO: 32365 - DNA, 20 bp, synthetic construct
  misc_feature 1..20: note = CRISPR gRNA sequence
  source 1..20: mol_type = other DNA
gtccttacagccttcatggg

SEQ ID NO: 32366 - DNA, 20 bp, synthetic construct
  misc_feature 1..20: note = CRISPR gRNA sequence
  source 1..20: mol_type = other DNA
acagccttcatgggctgagt

SEQ ID NO: 32367 - DNA, 20 bp, synthetic construct
  misc_feature 1..20: note = CRISPR gRNA sequence
  source 1..20: mol_type = other DNA
cagccttcatgggctgagtt

SEQ ID NO: 32368 - DNA, 20 bp, synthetic construct
  misc_feature 1..20: note = CRISPR gRNA sequence
  source 1..20: mol_type = other DNA
catgggctgagtttcccaag

SEQ ID NO: 32369 - DNA, 20 bp, synthetic construct
  misc_feature 1..20: note = CRISPR gRNA sequence
  source 1..20: mol_type = other DNA
atgggctgagtttcccaaga

SEQ ID NO: 32370 - DNA, 20 bp, synthetic construct
  misc_feature 1..20: note = CRISPR gRNA sequence
  source 1..20: mol_type = other DNA
agtttcccaagatggaggtt

SEQ ID NO: 32371 - DNA, 20 bp, synthetic construct
  misc_feature 1..20: note = CRISPR gRNA sequence
  source 1..20: mol_type = other DNA
cccaagatggaggttataag

SEQ ID NO: 32372 - DNA, 20 bp, synthetic construct
  misc_feature 1..20: note = CRISPR gRNA sequence
  source 1..20: mol_type = other DNA
ccaagatggaggttataaga

SEQ ID NO: 32373 - DNA, 20 bp, synthetic construct
  misc_feature 1..20: note = CRISPR gRNA sequence
  source 1..20: mol_type = other DNA
taagatagcggcctgaggct

SEQ ID NO: 32374 - DNA, 20 bp, synthetic construct
  misc_feature 1..20: note = CRISPR gRNA sequence
  source 1..20: mol_type = other DNA
aggctgtatctaactcaaat

SEQ ID NO: 32375 - DNA, 20 bp, synthetic construct
  misc_feature 1..20: note = CRISPR gRNA sequence
  source 1..20: mol_type = other DNA
tatctaactcaaatatgtct

SEQ ID NO: 32376 - DNA, 20 bp, synthetic construct
  misc_feature 1..20: note = CRISPR gRNA sequence
  source 1..20: mol_type = other DNA
actcaaatatgtctttcttt

SEQ ID NO: 32377 - DNA, 20 bp, synthetic construct
  misc_feature 1..20: note = CRISPR gRNA sequence
  source 1..20: mol_type = other DNA
aaatatgtctttctttggcc

SEQ ID NO: 32378 - DNA, 20 bp, synthetic construct
  misc_feature 1..20: note = CRISPR gRNA sequence
  source 1..20: mol_type = other DNA
tctttggccaactgtacttt

SEQ ID NO: 32379 - DNA, 20 bp, synthetic construct
  misc_feature 1..20: note = CRISPR gRNA sequence
  source 1..20: mol_type = other DNA
ctttggccaactgtactttt

SEQ ID NO: 32380 - DNA, 20 bp, synthetic construct
  misc_feature 1..20: note = CRISPR gRNA sequence
  source 1..20: mol_type = other DNA
tttggccaactgtactttta

SEQ ID NO: 32381 - DNA, 20 bp, synthetic construct
  misc_feature 1..20: note = CRISPR gRNA sequence
  source 1..20: mol_type = other DNA
tggccaactgtacttttaaa

SEQ ID NO: 32382 - DNA, 20 bp, synthetic construct
  misc_feature 1..20: note = CRISPR gRNA sequence
  source 1..20: mol_type = other DNA
ggccaactgtacttttaaaa

SEQ ID NO: 32383 - DNA, 20 bp, synthetic construct
  misc_feature 1..20: note = CRISPR gRNA sequence
  source 1..20: mol_type = other DNA
gccaactgtacttttaaaaa

SEQ ID NO: 32384 - DNA, 20 bp, synthetic construct
  misc_feature 1..20: note = CRISPR gRNA sequence
  source 1..20: mol_type = other DNA
tacttttaaaaatttcactc

SEQ ID NO: 32385 - DNA, 20 bp, synthetic construct
  misc_feature 1..20: note = CRISPR gRNA sequence
  source 1..20: mol_type = other DNA
ttaaaaatttcactcatgtt

SEQ ID NO: 32386 - DNA, 20 bp, synthetic construct
  misc_feature 1..20: note = CRISPR gRNA sequence
  source 1..20: mol_type = other DNA
taaaaatttcactcatgttt

SEQ ID NO: 32387 - DNA, 20 bp, synthetic construct
  misc_feature 1..20: note = CRISPR gRNA sequence
  source 1..20: mol_type = other DNA
aaaaatttcactcatgttta

SEQ ID NO: 32388 - DNA, 20 bp, synthetic construct
  misc_feature 1..20: note = CRISPR gRNA sequence
  source 1..20: mol_type = other DNA
aaaatttcactcatgtttaa

SEQ ID NO: 32389 - DNA, 20 bp, synthetic construct
  misc_feature 1..20: note = CRISPR gRNA sequence
  source 1..20: mol_type = other DNA
cactcatgtttaaaaaagaa

SEQ ID NO: 32390 - DNA, 20 bp, synthetic construct
  misc_feature 1..20: note = CRISPR gRNA sequence
  source 1..20: mol_type = other DNA
actcatgtttaaaaaagaaa

SEQ ID NO: 32391 - DNA, 20 bp, synthetic construct
  misc_feature 1..20: note = CRISPR gRNA sequence
  source 1..20: mol_type = other DNA
atgtttaaaaaagaaaatcg

SEQ ID NO: 32392 - DNA, 20 bp, synthetic construct
  misc_feature 1..20: note = CRISPR gRNA sequence
  source 1..20: mol_type = other DNA
aaaaaagaaaatcgcaatat

SEQ ID NO: 32393 - DNA, 20 bp, synthetic construct
  misc_feature 1..20: note = CRISPR gRNA sequence
  source 1..20: mol_type = other DNA
aaaaagaaaatcgcaatatc

SEQ ID NO: 32394 - DNA, 20 bp, synthetic construct
  misc_feature 1..20: note = CRISPR gRNA sequence
  source 1..20: mol_type = other DNA
ggtgcagtggctcacacctg

SEQ ID NO: 32395 - DNA, 20 bp, synthetic construct
  misc_feature 1..20: note = CRISPR gRNA sequence
  source 1..20: mol_type = other DNA
acacctgtaatcccagcact

SEQ ID NO: 32396 - DNA, 20 bp, synthetic construct
  misc_feature 1..20: note = CRISPR gRNA sequence
  source 1..20: mol_type = other DNA
taatcccagcactttgggag

SEQ ID NO: 32397 - DNA, 20 bp, synthetic construct
  misc_feature 1..20: note = CRISPR gRNA sequence
  source 1..20: mol_type = other DNA
tgggaggtcgaggcaggtgg

SEQ ID NO: 32398 - DNA, 20 bp, synthetic construct
  misc_feature 1..20: note = CRISPR gRNA sequence
  source 1..20: mol_type = other DNA
gggaggtcgaggcaggtgga

SEQ ID NO: 32399 - DNA, 20 bp, synthetic construct
  misc_feature 1..20: note = CRISPR gRNA sequence
  source 1..20: mol_type = other DNA
ggaggtcgaggcaggtggat

SEQ ID NO: 32400 - DNA, 20 bp, synthetic construct
  misc_feature 1..20: note = CRISPR gRNA sequence
  source 1..20: mol_type = other DNA
gagatcaggagttcgagacc

SEQ ID NO: 32401 - DNA, 20 bp, synthetic construct
  misc_feature 1..20: note = CRISPR gRNA sequence
  source 1..20: mol_type = other DNA
agatcaggagttcgagacca

SEQ ID NO: 32402 - DNA, 20 bp, synthetic construct
  misc_feature 1..20: note = CRISPR gRNA sequence
  source 1..20: mol_type = other DNA
gagaccagcctggccaacat

SEQ ID NO: 32403 - DNA, 20 bp, synthetic construct
  misc_feature 1..20: note = CRISPR gRNA sequence
  source 1..20: mol_type = other DNA
gccaacatggttaaacttgt

SEQ ID NO: 32404 - DNA, 20 bp, synthetic construct
  misc_feature 1..20: note = CRISPR gRNA sequence
  source 1..20: mol_type = other DNA
aacttgtctctactgaaatt

SEQ ID NO: 32405 - DNA, 20 bp, synthetic construct
  misc_feature 1..20: note = CRISPR gRNA sequence
  source 1..20: mol_type = other DNA
gtctctactgaaattacaaa

SEQ ID NO: 32406 - DNA, 20 bp, synthetic construct
  misc_feature 1..20: note = CRISPR gRNA sequence
  source 1..20: mol_type = other DNA
tctctactgaaattacaaaa

SEQ ID NO: 32407 - DNA, 20 bp, synthetic construct
  misc_feature 1..20: note = CRISPR gRNA sequence
  source 1..20: mol_type = other DNA
tactgaaattacaaaaattg

SEQ ID NO: 32408 - DNA, 20 bp, synthetic construct
  misc_feature 1..20: note = CRISPR gRNA sequence
  source 1..20: mol_type = other DNA
ctgaaattacaaaaattggc

SEQ ID NO: 32409 - DNA, 20 bp, synthetic construct
  misc_feature 1..20: note = CRISPR gRNA sequence
  source 1..20: mol_type = other DNA
aaattacaaaaattggctgg

SEQ ID NO: 32410 - DNA, 20 bp, synthetic construct
  misc_feature 1..20: note = CRISPR gRNA sequence
  source 1..20: mol_type = other DNA
caaaaattggctgggtgtga

SEQ ID NO: 32411 - DNA, 20 bp, synthetic construct
  misc_feature 1..20: note = CRISPR gRNA sequence
  source 1..20: mol_type = other DNA
gctgggtgtgacggtgcaca

SEQ ID NO: 32412 - DNA, 20 bp, synthetic construct
  misc_feature 1..20: note = CRISPR gRNA sequence
  source 1..20: mol_type = other DNA
ggtgtgacggtgcacacctg

SEQ ID NO: 32413 - DNA, 20 bp, synthetic construct
  misc_feature 1..20: note = CRISPR gRNA sequence
  source 1..20: mol_type = other DNA
taattccagctgctccggag

SEQ ID NO: 32414 - DNA, 20 bp, synthetic construct
  misc_feature 1..20: note = CRISPR gRNA sequence
  source 1..20: mol_type = other DNA
cagctgctccggaggctgag

SEQ ID NO: 32415 - DNA, 20 bp, synthetic construct
  misc_feature 1..20: note = CRISPR gRNA sequence
  source 1..20: mol_type = other DNA
ctccggaggctgaggcagga

SEQ ID NO: 32416 - DNA, 20 bp, synthetic construct
  misc_feature 1..20: note = CRISPR gRNA sequence
  source 1..20: mol_type = other DNA
cggaggctgaggcaggagaa

SEQ ID NO: 32417 - DNA, 20 bp, synthetic construct
  misc_feature 1..20: note = CRISPR gRNA sequence
  source 1..20: mol_type = other DNA
aggcaggagaatcacttgaa

SEQ ID NO: 32418 - DNA, 20 bp, synthetic construct
  misc_feature 1..20: note = CRISPR gRNA sequence
  source 1..20: mol_type = other DNA
gaacctgtagggcggaggtt

SEQ ID NO: 32419 - DNA, 20 bp, synthetic construct
  misc_feature 1..20: note = CRISPR gRNA sequence
  source 1..20: mol_type = other DNA
aacctgtagggcggaggttg

SEQ ID NO: 32420 - DNA, 20 bp, synthetic construct
  misc_feature 1..20: note = CRISPR gRNA sequence
  source 1..20: mol_type = other DNA
tagggcggaggttgcagtga

SEQ ID NO: 32421 - DNA, 20 bp, synthetic construct
  misc_feature 1..20: note = CRISPR gRNA sequence
  source 1..20: mol_type = other DNA
cagtgatctgagatcgcacc

SEQ ID NO: 32422 - DNA, 20 bp, synthetic construct
  misc_feature 1..20: note = CRISPR gRNA sequence
  source 1..20: mol_type = other DNA
agatcgcaccactgcactct

SEQ ID NO: 32423 - DNA, 20 bp, synthetic construct
  misc_feature 1..20: note = CRISPR gRNA sequence
  source 1..20: mol_type = other DNA
cactctagcctgggcaacag

SEQ ID NO: 32424 - DNA, 20 bp, synthetic construct
  misc_feature 1..20: note = CRISPR gRNA sequence
  source 1..20: mol_type = other DNA
tagcctgggcaacagagtga

SEQ ID NO: 32425 - DNA, 20 bp, synthetic construct
  misc_feature 1..20: note = CRISPR gRNA sequence
  source 1..20: mol_type = other DNA
gcctgggcaacagagtgaga

SEQ ID NO: 32426 - DNA, 20 bp, synthetic construct
  misc_feature 1..20: note = CRISPR gRNA sequence
  source 1..20: mol_type = other DNA
ggcaacagagtgagactcca

SEQ ID NO: 32427 - DNA, 20 bp, synthetic construct
  misc_feature 1..20: note = CRISPR gRNA sequence
  source 1..20: mol_type = other DNA
catctcaacaataaataaat

SEQ ID NO: 32428 - DNA, 20 bp, synthetic construct
  misc_feature 1..20: note = CRISPR gRNA sequence
  source 1..20: mol_type = other DNA
aacaataaataaataataaa

SEQ ID NO: 32429 - DNA, 20 bp, synthetic construct
  misc_feature 1..20: note = CRISPR gRNA sequence
  source 1..20: mol_type = other DNA
aaaaatcacaatatctatgt

SEQ ID NO: 32430 - DNA, 20 bp, synthetic construct
  misc_feature 1..20: note = CRISPR gRNA sequence
  source 1..20: mol_type = other DNA
tgtaaaaatcagggttttca

SEQ ID NO: 32431 - DNA, 20 bp, synthetic construct
  misc_feature 1..20: note = CRISPR gRNA sequence
  source 1..20: mol_type = other DNA
tcaacttcaaaagatctgac

SEQ ID NO: 32432 - DNA, 20 bp, synthetic construct
  misc_feature 1..20: note = CRISPR gRNA sequence
  source 1..20: mol_type = other DNA
caacttcaaaagatctgacc

SEQ ID NO: 32433 - DNA, 20 bp, synthetic construct
  misc_feature 1..20: note = CRISPR gRNA sequence
  source 1..20: mol_type = other DNA
aacttcaaaagatctgacca

SEQ ID NO: 32434 - DNA, 20 bp, synthetic construct
  misc_feature 1..20: note = CRISPR gRNA sequence
  source 1..20: mol_type = other DNA
caaaagatctgaccacattg

SEQ ID NO: 32435 - DNA, 20 bp, synthetic construct
  misc_feature 1..20: note = CRISPR gRNA sequence
  source 1..20: mol_type = other DNA
aaaagatctgaccacattgt

SEQ ID NO: 32436 - DNA, 20 bp, synthetic construct
  misc_feature 1..20: note = CRISPR gRNA sequence
  source 1..20: mol_type = other DNA
accacattgtctggcttttc

SEQ ID NO: 32437 - DNA, 20 bp, synthetic construct
  misc_feature 1..20: note = CRISPR gRNA sequence
  source 1..20: mol_type = other DNA
tctggcttttctgctgggta

SEQ ID NO: 32438 - DNA, 20 bp, synthetic construct
  misc_feature 1..20: note = CRISPR gRNA sequence
  source 1..20: mol_type = other DNA
gcttttctgctgggtaacaa

SEQ ID NO: 32439 - DNA, 20 bp, synthetic construct
  misc_feature 1..20: note = CRISPR gRNA sequence
  source 1..20: mol_type = other DNA
ttctgctgggtaacaagcag

SEQ ID NO: 32440 - DNA, 20 bp, synthetic construct
  misc_feature 1..20: note = CRISPR gRNA sequence
  source 1..20: mol_type = other DNA
tctgctgggtaacaagcagc

SEQ ID NO: 32441 - DNA, 20 bp, synthetic construct
  misc_feature 1..20: note = CRISPR gRNA sequence
  source 1..20: mol_type = other DNA
ctgctgggtaacaagcagct

SEQ ID NO: 32442 - DNA, 20 bp, synthetic construct
  misc_feature 1..20: note = CRISPR gRNA sequence
  source 1..20: mol_type = other DNA
tgctgggtaacaagcagctg

SEQ ID NO: 32443 - DNA, 20 bp, synthetic construct
  misc_feature 1..20: note = CRISPR gRNA sequence
  source 1..20: mol_type = other DNA
ctgggtaacaagcagctgaa

SEQ ID NO: 32444 - DNA, 20 bp, synthetic construct
  misc_feature 1..20: note = CRISPR gRNA sequence
  source 1..20: mol_type = other DNA
ggtaacaagcagctgaaggc

SEQ ID NO: 32445 - DNA, 20 bp, synthetic construct
  misc_feature 1..20: note = CRISPR gRNA sequence
  source 1..20: mol_type = other DNA
aaggctgatggctgtatttg

SEQ ID NO: 32446 - DNA, 20 bp, synthetic construct
  misc_feature 1..20: note = CRISPR gRNA sequence
  source 1..20: mol_type = other DNA
atggctgtatttggatggga

SEQ ID NO: 32447 - DNA, 20 bp, synthetic construct
  misc_feature 1..20: note = CRISPR gRNA sequence
  source 1..20: mol_type = other DNA
tatttggatgggatgtggat

SEQ ID NO: 32448 - DNA, 20 bp, synthetic construct
  misc_feature 1..20: note = CRISPR gRNA sequence
  source 1..20: mol_type = other DNA
ggatgggatgtggattctct

SEQ ID NO: 32449 - DNA, 20 bp, synthetic construct
  misc_feature 1..20: note = CRISPR gRNA sequence
  source 1..20: mol_type = other DNA
gatgggatgtggattctcta

SEQ ID NO: 32450 - DNA, 20 bp, synthetic construct
  misc_feature 1..20: note = CRISPR gRNA sequence
  source 1..20: mol_type = other DNA
tctagctgtccattccccca

SEQ ID NO: 32451 - DNA, 20 bp, synthetic construct
  misc_feature 1..20: note = CRISPR gRNA sequence
  source 1..20: mol_type = other DNA
tagctgtccattcccccaca

SEQ ID NO: 32452 - DNA, 20 bp, synthetic construct
  misc_feature 1..20: note = CRISPR gRNA sequence
  source 1..20: mol_type = other DNA
gctgtccattcccccacaac

SEQ ID NO: 32453 - DNA, 20 bp, synthetic construct
  misc_feature 1..20: note = CRISPR gRNA sequence
  source 1..20: mol_type = other DNA
tccattcccccacaaccatg

SEQ ID NO: 32454 - DNA, 20 bp, synthetic construct
  misc_feature 1..20: note = CRISPR gRNA sequence
  source 1..20: mol_type = other DNA
ccccacaaccatgcctccac

SEQ ID NO: 32455 - DNA, 20 bp, synthetic construct
  misc_feature 1..20: note = CRISPR gRNA sequence
  source 1..20: mol_type = other DNA
cactccctggagaccctccc

SEQ ID NO: 32456 - DNA, 20 bp, synthetic construct
  misc_feature 1..20: note = CRISPR gRNA sequence
  source 1..20: mol_type = other DNA
cctggagaccctccctgtcc

SEQ ID NO: 32457 - DNA, 20 bp, synthetic construct
  misc_feature 1..20: note = CRISPR gRNA sequence
  source 1..20: mol_type = other DNA
gagaccctccctgtcccgac

SEQ ID NO: 32458 - DNA, 20 bp, synthetic construct
  misc_feature 1..20: note = CRISPR gRNA sequence
  source 1..20: mol_type = other DNA
cctgtcccgactgaccccta

SEQ ID NO: 32459 - DNA, 20 bp, synthetic construct
  misc_feature 1..20: note = CRISPR gRNA sequence
  source 1..20: mol_type = other DNA
tcccgactgacccctaaaca

SEQ ID NO: 32460 - DNA, 20 bp, synthetic construct
  misc_feature 1..20: note = CRISPR gRNA sequence
  source 1..20: mol_type = other DNA
acccctaaacatgacctgtt

SEQ ID NO: 32461 - DNA, 20 bp, synthetic construct
  misc_feature 1..20: note = CRISPR gRNA sequence
  source 1..20: mol_type = other DNA
aacatgacctgttgtcccta

SEQ ID NO: 32462 - DNA, 20 bp, synthetic construct
  misc_feature 1..20: note = CRISPR gRNA sequence
  source 1..20: mol_type = other DNA
ttgtccctacaggcagcttt

SEQ ID NO: 32463 - DNA, 20 bp, synthetic construct
  misc_feature 1..20: note = CRISPR gRNA sequence
  source 1..20: mol_type = other DNA
tccctacaggcagctttgct

SEQ ID NO: 32464 - DNA, 20 bp, synthetic construct
  misc_feature 1..20: note = CRISPR gRNA sequence
  source 1..20: mol_type = other DNA
caggcagctttgcttgtgga

SEQ ID NO: 32465 - DNA, 20 bp, synthetic construct
  misc_feature 1..20: note = CRISPR gRNA sequence
  source 1..20: mol_type = other DNA
tgcttgtggatcttatttga

SEQ ID NO: 32466 - DNA, 20 bp, synthetic construct
  misc_feature 1..20: note = CRISPR gRNA sequence
  source 1..20: mol_type = other DNA
gcttgtggatcttatttgag

SEQ ID NO: 32467 - DNA, 20 bp, synthetic construct
  misc_feature 1..20: note = CRISPR gRNA sequence
  source 1..20: mol_type = other DNA
cttgtggatcttatttgaga

SEQ ID NO: 32468 - DNA, 20 bp, synthetic construct
  misc_feature 1..20: note = CRISPR gRNA sequence
  source 1..20: mol_type = other DNA
gtggatcttatttgagacaa

SEQ ID NO: 32469 - DNA, 20 bp, synthetic construct
  misc_feature 1..20: note = CRISPR gRNA sequence
  source 1..20: mol_type = other DNA
tggatcttatttgagacaat

SEQ ID NO: 32470 - DNA, 20 bp, synthetic construct
  misc_feature 1..20: note = CRISPR gRNA sequence
  source 1..20: mol_type = other DNA
atttgagacaattccttccc

SEQ ID NO: 32471 - DNA, 20 bp, synthetic construct
  misc_feature 1..20: note = CRISPR gRNA sequence
  source 1..20: mol_type = other DNA
tttgagacaattccttcccc

SEQ ID NO: 32472 - DNA, 20 bp, synthetic construct
  misc_feature 1..20: note = CRISPR gRNA sequence
  source 1..20: mol_type = other DNA
gagacaattccttccccagg

SEQ ID NO: 32473 - DNA, 20 bp, synthetic construct
  misc_feature 1..20: note = CRISPR gRNA sequence
  source 1..20: mol_type = other DNA
agacaattccttccccaggg

SEQ ID NO: 32474 - DNA, 20 bp, synthetic construct
  misc_feature 1..20: note = CRISPR gRNA sequence
  source 1..20: mol_type = other DNA
cttccccagggcctcgatcc

SEQ ID NO: 32475 - DNA, 20 bp, synthetic construct
  misc_feature 1..20: note = CRISPR gRNA sequence
  source 1..20: mol_type = other DNA
ccccagggcctcgatcctgc

SEQ ID NO: 32476 - DNA, 20 bp, synthetic construct
  misc_feature 1..20: note = CRISPR gRNA sequence
  source 1..20: mol_type = other DNA
cccagggcctcgatcctgct

SEQ ID NO: 32477 - DNA, 20 bp, synthetic construct
  misc_feature 1..20: note = CRISPR gRNA sequence
  source 1..20: mol_type = other DNA
gatcctgcttctagtacctc

SEQ ID NO: 32478 - DNA, 20 bp, synthetic construct
  misc_feature 1..20: note = CRISPR gRNA sequence
  source 1..20: mol_type = other DNA
cttctagtacctctcacagg

SEQ ID NO: 32479 - DNA, 20 bp, synthetic construct
  misc_feature 1..20: note = CRISPR gRNA sequence
  source 1..20: mol_type = other DNA
ctagtacctctcacaggccc

SEQ ID NO: 32480 - DNA, 20 bp, synthetic construct
  misc_feature 1..20: note = CRISPR gRNA sequence
  source 1..20: mol_type = other DNA
tagtacctctcacaggccct

SEQ ID NO: 32481 - DNA, 20 bp, synthetic construct
  misc_feature 1..20: note = CRISPR gRNA sequence
  source 1..20: mol_type = other DNA
gtacctctcacaggccctaa

SEQ ID NO: 32482 - DNA, 20 bp, synthetic construct
  misc_feature 1..20: note = CRISPR gRNA sequence
  source 1..20: mol_type = other DNA
tcacaggccctaagggtcct

SEQ ID NO: 32483 - DNA, 20 bp, synthetic construct
  misc_feature 1..20: note = CRISPR gRNA sequence
  source 1..20: mol_type = other DNA
acaggccctaagggtcctta

SEQ ID NO: 32484 - DNA, 20 bp, synthetic construct
  misc_feature 1..20: note = CRISPR gRNA sequence
  source 1..20: mol_type = other DNA
agggtccttacctgtcatgt

SEQ ID NO: 32485 - DNA, 20 bp, synthetic construct
  misc_feature 1..20: note = CRISPR gRNA sequence
  source 1..20: mol_type = other DNA
acctgtcatgtttgctcggg

SEQ ID NO: 32486 - DNA, 20 bp, synthetic construct
  misc_feature 1..20: note = CRISPR gRNA sequence
  source 1..20: mol_type = other DNA
cctgtcatgtttgctcggga

SEQ ID NO: 32487 - DNA, 20 bp, synthetic construct
  misc_feature 1..20: note = CRISPR gRNA sequence
  source 1..20: mol_type = other DNA
tcatgtttgctcgggaggtc

SEQ ID NO: 32488 - DNA, 20 bp, synthetic construct
  misc_feature 1..20: note = CRISPR gRNA sequence
  source 1..20: mol_type = other DNA
gctcgggaggtcagggcagg

SEQ ID NO: 32489 - DNA, 20 bp, synthetic construct
  misc_feature 1..20: note = CRISPR gRNA sequence
  source 1..20: mol_type = other DNA
ctcgggaggtcagggcaggt

SEQ ID NO: 32490 - DNA, 20 bp, synthetic construct
  misc_feature 1..20: note = CRISPR gRNA sequence
  source 1..20: mol_type = other DNA
gggaggtcagggcaggttca

SEQ ID NO: 32491 - DNA, 20 bp, synthetic construct
  misc_feature 1..20: note = CRISPR gRNA sequence
  source 1..20: mol_type = other DNA
aggcatgctgggcaggtcag

SEQ ID NO: 32492 - DNA, 20 bp, synthetic construct
  misc_feature 1..20: note = CRISPR gRNA sequence
  source 1..20: mol_type = other DNA
ggcaggtcagtggctgatgg

SEQ ID NO: 32493 - DNA, 20 bp, synthetic construct
  misc_feature 1..20: note = CRISPR gRNA sequence
  source 1..20: mol_type = other DNA
atggagcgaaggggctggtg

SEQ ID NO: 32494 - DNA, 20 bp, synthetic construct
  misc_feature 1..20: note = CRISPR gRNA sequence
  source 1..20: mol_type = other DNA
gtggagcctggccggtctgg

SEQ ID NO: 32495 - DNA, 20 bp, synthetic construct
  misc_feature 1..20: note = CRISPR gRNA sequence
  source 1..20: mol_type = other DNA
gccggtctggagatgttggg

SEQ ID NO: 32496 - DNA, 20 bp, synthetic construct
  misc_feature 1..20: note = CRISPR gRNA sequence
  source 1..20: mol_type = other DNA
gagatgttgggaggccgtgg

SEQ ID NO: 32497 - DNA, 20 bp, synthetic construct
  misc_feature 1..20: note = CRISPR gRNA sequence
  source 1..20: mol_type = other DNA
ggaggccgtggacagtgaat

SEQ ID NO: 32498 - DNA, 20 bp, synthetic construct
  misc_feature 1..20: note = CRISPR gRNA sequence
  source 1..20: mol_type = other DNA
ggagggggtacttggctggc

SEQ ID NO: 32499 - DNA, 20 bp, synthetic construct
  misc_feature 1..20: note = CRISPR gRNA sequence
  source 1..20: mol_type = other DNA
ggctggcctggggcacctca

SEQ ID NO: 32500 - DNA, 20 bp, synthetic construct
  misc_feature 1..20: note = CRISPR gRNA sequence
  source 1..20: mol_type = other DNA
gctggcctggggcacctcac

SEQ ID NO: 32501 - DNA, 20 bp, synthetic construct
  misc_feature 1..20: note = CRISPR gRNA sequence
  source 1..20: mol_type = other DNA
gcctggggcacctcacctac

SEQ ID NO: 32502 - DNA, 20 bp, synthetic construct
  misc_feature 1..20: note = CRISPR gRNA sequence
  source 1..20: mol_type = other DNA
gggcacctcacctacattgg

SEQ ID NO: 32503 - DNA, 20 bp, synthetic construct
  misc_feature 1..20: note = CRISPR gRNA sequence
  source 1..20: mol_type = other DNA
acctacattgggggtggaga

SEQ ID NO: 32504 - DNA, 20 bp, synthetic construct
  misc_feature 1..20: note = CRISPR gRNA sequence
  source 1..20: mol_type = other DNA
cattgggggtggagagtggt

SEQ ID NO: 32505 - DNA, 20 bp, synthetic construct
  misc_feature 1..20: note = CRISPR gRNA sequence
  source 1..20: mol_type = other DNA
ggggtggagagtggtgtgag

SEQ ID NO: 32506 - DNA, 20 bp, synthetic construct
  misc_feature 1..20: note = CRISPR gRNA sequence
  source 1..20: mol_type = other DNA
attccagaaatgcacttggg

SEQ ID NO: 32507 - DNA, 20 bp, synthetic construct
  misc_feature 1..20: note = CRISPR gRNA sequence
  source 1..20: mol_type = other DNA
cagaaatgcacttgggtcac

SEQ ID NO: 32508 - DNA, 20 bp, synthetic construct
  misc_feature 1..20: note = CRISPR gRNA sequence
  source 1..20: mol_type = other DNA
gggtcacccctactccaaac

SEQ ID NO: 32509 - DNA, 20 bp, synthetic construct
  misc_feature 1..20: note = CRISPR gRNA sequence
  source 1..20: mol_type = other DNA
ggtcacccctactccaaact

SEQ ID NO: 32510 - DNA, 20 bp, synthetic construct
  misc_feature 1..20: note = CRISPR gRNA sequence
  source 1..20: mol_type = other DNA
ctccaaactgggctgtggag

SEQ ID NO: 32511 - DNA, 20 bp, synthetic construct
  misc_feature 1..20: note = CRISPR gRNA sequence
  source 1..20: mol_type = other DNA
caaactgggctgtggagctc

SEQ ID NO: 32512 - DNA, 20 bp, synthetic construct
  misc_feature 1..20: note = CRISPR gRNA sequence
  source 1..20: mol_type = other DNA
ggctgtggagctcaggaagt

SEQ ID NO: 32513 - DNA, 20 bp, synthetic construct
  misc_feature 1..20: note = CRISPR gRNA sequence
  source 1..20: mol_type = other DNA
tggagctcaggaagtctgga

SEQ ID NO: 32514 - DNA, 20 bp, synthetic construct
  misc_feature 1..20: note = CRISPR gRNA sequence
  source 1..20: mol_type = other DNA
aggaagtctggagagaagag

SEQ ID NO: 32515 - DNA, 20 bp, synthetic construct
  misc_feature 1..20: note = CRISPR gRNA sequence
  source 1..20: mol_type = other DNA
gagagaagagagtagaactt

SEQ ID NO: 32516 - DNA, 20 bp, synthetic construct
  misc_feature 1..20: note = CRISPR gRNA sequence
  source 1..20: mol_type = other DNA
ccaaaggaagatatttcagg

SEQ ID NO: 32517 - DNA, 20 bp, synthetic construct
  misc_feature 1..20: note = CRISPR gRNA sequence
  source 1..20: mol_type = other DNA
caaaggaagatatttcagga

SEQ ID NO: 32518 - DNA, 20 bp, synthetic construct
  misc_feature 1..20: note = CRISPR gRNA sequence
  source 1..20: mol_type = other DNA
caggacagagctgaagaaag

SEQ ID NO: 32519 - DNA, 20 bp, synthetic construct
  misc_feature 1..20: note = CRISPR gRNA sequence
  source 1..20: mol_type = other DNA
aggacagagctgaagaaaga

SEQ ID NO: 32520 - DNA, 20 bp, synthetic construct
  misc_feature 1..20: note = CRISPR gRNA sequence
  source 1..20: mol_type = other DNA
aagaaagagctctggagtta

SEQ ID NO: 32521 - DNA, 20 bp, synthetic construct
  misc_feature 1..20: note = CRISPR gRNA sequence
  source 1..20: mol_type = other DNA
tggagttacatctagctcct

SEQ ID NO: 32522 - DNA, 20 bp, synthetic construct
  misc_feature 1..20: note = CRISPR gRNA sequence
  source 1..20: mol_type = other DNA
gagttacatctagctcctgg

SEQ ID NO: 32523 - DNA, 20 bp, synthetic construct
  misc_feature 1..20: note = CRISPR gRNA sequence
  source 1..20: mol_type = other DNA
catctagctcctggaacctt

SEQ ID NO: 32524 - DNA, 20 bp, synthetic construct
  misc_feature 1..20: note = CRISPR gRNA sequence
  source 1..20: mol_type = other DNA
gctcctggaaccttgctttt

SEQ ID NO: 32525 - DNA, 20 bp, synthetic construct
  misc_feature 1..20: note = CRISPR gRNA sequence
  source 1..20: mol_type = other DNA
ctggaaccttgcttttccaa

SEQ ID NO: 32526 - DNA, 20 bp, synthetic construct
  misc_feature 1..20: note = CRISPR gRNA sequence
  source 1..20: mol_type = other DNA
gaaccttgcttttccaatct

SEQ ID NO: 32527 - DNA, 20 bp, synthetic construct
  misc_feature 1..20: note = CRISPR gRNA sequence
  source 1..20: mol_type = other DNA
gcttttccaatctgtgaaat

SEQ ID NO: 32528 - DNA, 20 bp, synthetic construct
  misc_feature 1..20: note = CRISPR gRNA sequence
  source 1..20: mol_type = other DNA
cttttccaatctgtgaaatg

SEQ ID NO: 32529 - DNA, 20 bp, synthetic construct
  misc_feature 1..20: note = CRISPR gRNA sequence
  source 1..20: mol_type = other DNA
ttccaatctgtgaaatgggt

SEQ ID NO: 32530 - DNA, 20 bp, synthetic construct
  misc_feature 1..20: note = CRISPR gRNA sequence
  source 1..20: mol_type = other DNA
tccaatctgtgaaatgggtg

SEQ ID NO: 32531 - DNA, 20 bp, synthetic construct
  misc_feature 1..20: note = CRISPR gRNA sequence
  source 1..20: mol_type = other DNA
ccaatctgtgaaatgggtgc

SEQ ID NO: 32532 - DNA, 20 bp, synthetic construct
  misc_feature 1..20: note = CRISPR gRNA sequence
  source 1..20: mol_type = other DNA
caatctgtgaaatgggtgca

SEQ ID NO: 32533 - DNA, 20 bp, synthetic construct
  misc_feature 1..20: note = CRISPR gRNA sequence
  source 1..20: mol_type = other DNA
tgaaatgggtgcaattagct

SEQ ID NO: 32534 - DNA, 20 bp, synthetic construct
  misc_feature 1..20: note = CRISPR gRNA sequence
  source 1..20: mol_type = other DNA
gctcataaggaacttagggc

SEQ ID NO: 32535 - DNA, 20 bp, synthetic construct
  misc_feature 1..20: note = CRISPR gRNA sequence
  source 1..20: mol_type = other DNA
ataaggaacttagggcaggt

SEQ ID NO: 32536 - DNA, 20 bp, synthetic construct
  misc_feature 1..20: note = CRISPR gRNA sequence
  source 1..20: mol_type = other DNA
agggcaggtactactattgc

SEQ ID NO: 32537 - DNA, 20 bp, synthetic construct
  misc_feature 1..20: note = CRISPR gRNA sequence
  source 1..20: mol_type = other DNA
gggcaggtactactattgca

SEQ ID NO: 32538 - DNA, 20 bp, synthetic construct
  misc_feature 1..20: note = CRISPR gRNA sequence
  source 1..20: mol_type = other DNA
ctattgcactcttcctgctg

SEQ ID NO: 32539 - DNA, 20 bp, synthetic construct
  misc_feature 1..20: note = CRISPR gRNA sequence
  source 1..20: mol_type = other DNA
ttgcactcttcctgctgtgt

SEQ ID NO: 32540 - DNA, 20 bp, synthetic construct
  misc_feature 1..20: note = CRISPR gRNA sequence
  source 1..20: mol_type = other DNA
cactcttcctgctgtgtggt

SEQ ID NO: 32541 - DNA, 20 bp, synthetic construct
  misc_feature 1..20: note = CRISPR gRNA sequence
  source 1..20: mol_type = other DNA
ttcctgctgtgtggtcagtg

SEQ ID NO: 32542 - DNA, 20 bp, synthetic construct
  misc_feature 1..20: note = CRISPR gRNA sequence
  source 1..20: mol_type = other DNA
cctgctgtgtggtcagtgct

SEQ ID NO: 32543 - DNA, 20 bp, synthetic construct
  misc_feature 1..20: note = CRISPR gRNA sequence
  source 1..20: mol_type = other DNA
ctgctgtgtggtcagtgctc

SEQ ID NO: 32544 - DNA, 20 bp, synthetic construct
  misc_feature 1..20: note = CRISPR gRNA sequence
  source 1..20: mol_type = other DNA
ctgtgtggtcagtgctcatt

SEQ ID NO: 32545 - DNA, 20 bp, synthetic construct
  misc_feature 1..20: note = CRISPR gRNA sequence
  source 1..20: mol_type = other DNA
tgtggtcagtgctcattttc

SEQ ID NO: 32546 - DNA, 20 bp, synthetic construct
  misc_feature 1..20: note = CRISPR gRNA sequence
  source 1..20: mol_type = other DNA
attttcctagatatcaggaa

SEQ ID NO: 32547 - DNA, 20 bp, synthetic construct
  misc_feature 1..20: note = CRISPR gRNA sequence
  source 1..20: mol_type = other DNA
tcctagatatcaggaactgc

SEQ ID NO: 32548 - DNA, 20 bp, synthetic construct
  misc_feature 1..20: note = CRISPR gRNA sequence
  source 1..20: mol_type = other DNA
cctagatatcaggaactgct

SEQ ID NO: 32549 - DNA, 20 bp, synthetic construct
  misc_feature 1..20: note = CRISPR gRNA sequence
  source 1..20: mol_type = other DNA
ctagatatcaggaactgctt

SEQ ID NO: 32550 - DNA, 20 bp, synthetic construct
  misc_feature 1..20: note = CRISPR gRNA sequence
  source 1..20: mol_type = other DNA
gatatcaggaactgcttctc

SEQ ID NO: 32551 - DNA, 20 bp, synthetic construct
  misc_feature 1..20: note = CRISPR gRNA sequence
  source 1..20: mol_type = other DNA
cttctctgcttctgagatac

SEQ ID NO: 32552 - DNA, 20 bp, synthetic construct
  misc_feature 1..20: note = CRISPR gRNA sequence
  source 1..20: mol_type = other DNA
ctctgcttctgagataccag

SEQ ID NO: 32553 - DNA, 20 bp, synthetic construct
  misc_feature 1..20: note = CRISPR gRNA sequence
  source 1..20: mol_type = other DNA
tctgcttctgagataccagt

SEQ ID NO: 32554 - DNA, 20 bp, synthetic construct
  misc_feature 1..20: note = CRISPR gRNA sequence
  source 1..20: mol_type = other DNA
tgcttctgagataccagtgc

SEQ ID NO: 32555 - DNA, 20 bp, synthetic construct
  misc_feature 1..20: note = CRISPR gRNA sequence
  source 1..20: mol_type = other DNA
cttctgagataccagtgcgt

SEQ ID NO: 32556 - DNA, 20 bp, synthetic construct
  misc_feature 1..20: note = CRISPR gRNA sequence
  source 1..20: mol_type = other DNA
ctgagataccagtgcgttat

SEQ ID NO: 32557 - DNA, 20 bp, synthetic construct
  misc_feature 1..20: note = CRISPR gRNA sequence
  source 1..20: mol_type = other DNA
tgagataccagtgcgttata

SEQ ID NO: 32558 - DNA, 20 bp, synthetic construct
  misc_feature 1..20: note = CRISPR gRNA sequence
  source 1..20: mol_type = other DNA
agataccagtgcgttatact

SEQ ID NO: 32559 - DNA, 20 bp, synthetic construct
  misc_feature 1..20: note = CRISPR gRNA sequence
  source 1..20: mol_type = other DNA
tactgaaactgtcttgcaac

SEQ ID NO: 32560 - DNA, 20 bp, synthetic construct
  misc_feature 1..20: note = CRISPR gRNA sequence
  source 1..20: mol_type = other DNA
aaactgtcttgcaaccagga

SEQ ID NO: 32561 - DNA, 20 bp, synthetic construct
  misc_feature 1..20: note = CRISPR gRNA sequence
  source 1..20: mol_type = other DNA
tcttgcaaccaggaatggat

SEQ ID NO: 32562 - DNA, 20 bp, synthetic construct
  misc_feature 1..20: note = CRISPR gRNA sequence
  source 1..20: mol_type = other DNA
gcaaccaggaatggatgctc

SEQ ID NO: 32563 - DNA, 20 bp, synthetic construct
  misc_feature 1..20: note = CRISPR gRNA sequence
  source 1..20: mol_type = other DNA
caaccaggaatggatgctct

SEQ ID NO: 32564 - DNA, 20 bp, synthetic construct
  misc_feature 1..20: note = CRISPR gRNA sequence
  source 1..20: mol_type = other DNA
tggacttgagtggaagcatc

SEQ ID NO: 32565 - DNA, 20 bp, synthetic construct
  misc_feature 1..20: note = CRISPR gRNA sequence
  source 1..20: mol_type = other DNA
gacttgagtggaagcatcct

SEQ ID NO: 32566 - DNA, 20 bp, synthetic construct
  misc_feature 1..20: note = CRISPR gRNA sequence
  source 1..20: mol_type = other DNA
gagtggaagcatcctcctgg

SEQ ID NO: 32567 - DNA, 20 bp, synthetic construct
  misc_feature 1..20: note = CRISPR gRNA sequence
  source 1..20: mol_type = other DNA
agtggaagcatcctcctggt

SEQ ID NO: 32568 - DNA, 20 bp, synthetic construct
  misc_feature 1..20: note = CRISPR gRNA sequence
  source 1..20: mol_type = other DNA
ctggtctcatccctgacagc

SEQ ID NO: 32569 - DNA, 20 bp, synthetic construct
  misc_feature 1..20: note = CRISPR gRNA sequence
  source 1..20: mol_type = other DNA
gtctcatccctgacagccca

SEQ ID NO: 32570 - DNA, 20 bp, synthetic construct
  misc_feature 1..20: note = CRISPR gRNA sequence
  source 1..20: mol_type = other DNA
atccctgacagcccaaacac

SEQ ID NO: 32571 - DNA, 20 bp, synthetic construct
  misc_feature 1..20: note = CRISPR gRNA sequence
  source 1..20: mol_type = other DNA
acagcccaaacacaccttcc

SEQ ID NO: 32572 - DNA, 20 bp, synthetic construct
  misc_feature 1..20: note = CRISPR gRNA sequence
  source 1..20: mol_type = other DNA
ccctgagacaagtcacaacc

SEQ ID NO: 32573 - DNA, 20 bp, synthetic construct
  misc_feature 1..20: note = CRISPR gRNA sequence
  source 1..20: mol_type = other DNA
cctgagacaagtcacaaccc

SEQ ID NO: 32574 - DNA, 20 bp, synthetic construct
  misc_feature 1..20: note = CRISPR gRNA sequence
  source 1..20: mol_type = other DNA
agacaagtcacaacccctca

SEQ ID NO: 32575 - DNA, 20 bp, synthetic construct
  misc_feature 1..20: note = CRISPR gRNA sequence
  source 1..20: mol_type = other DNA
agtgtggtgggtcagtaggg

SEQ ID NO: 32576 - DNA, 20 bp, synthetic construct
  misc_feature 1..20: note = CRISPR gRNA sequence
  source 1..20: mol_type = other DNA
tactgattaggaaacaagac

SEQ ID NO: 32577 - DNA, 20 bp, synthetic construct
  misc_feature 1..20: note = CRISPR gRNA sequence
  source 1..20: mol_type = other DNA
actgattaggaaacaagaca

SEQ ID NO: 32578 - DNA, 20 bp, synthetic construct
  misc_feature 1..20: note = CRISPR gRNA sequence
  source 1..20: mol_type = other DNA
ctgattaggaaacaagacaa

SEQ ID NO: 32579 - DNA, 20 bp, synthetic construct
  misc_feature 1..20: note = CRISPR gRNA sequence
  source 1..20: mol_type = other DNA
attaggaaacaagacaaatc

SEQ ID NO: 32580 - DNA, 20 bp, synthetic construct
  misc_feature 1..20: note = CRISPR gRNA sequence
  source 1..20: mol_type = other DNA
ggaaacaagacaaatcagag

SEQ ID NO: 32581 - DNA, 20 bp, synthetic construct
  misc_feature 1..20: note = CRISPR gRNA sequence
  source 1..20: mol_type = other DNA
tgcaaggatgcacaccaaac

SEQ ID NO: 32582 - DNA, 20 bp, synthetic construct
  misc_feature 1..20: note = CRISPR gRNA sequence
  source 1..20: mol_type = other DNA
ttcacatcagtatactaaaa

SEQ ID NO: 32583 - DNA, 20 bp, synthetic construct
  misc_feature 1..20: note = CRISPR gRNA sequence
  source 1..20: mol_type = other DNA
acatcagtatactaaaagag

SEQ ID NO: 32584 - DNA, 20 bp, synthetic construct
  misc_feature 1..20: note = CRISPR gRNA sequence
  source 1..20: mol_type = other DNA
aaagagtgagagagacagtg

SEQ ID NO: 32585 - DNA, 20 bp, synthetic construct
  misc_feature 1..20: note = CRISPR gRNA sequence
  source 1..20: mol_type = other DNA
ttgtaaacatcacttgtcat

SEQ ID NO: 32586 - DNA, 20 bp, synthetic construct
  misc_feature 1..20: note = CRISPR gRNA sequence
  source 1..20: mol_type = other DNA
gtaaacatcacttgtcatta

SEQ ID NO: 32587 - DNA, 20 bp, synthetic construct
  misc_feature 1..20: note = CRISPR gRNA sequence
  source 1..20: mol_type = other DNA
taaacatcacttgtcattag

SEQ ID NO: 32588 - DNA, 20 bp, synthetic construct
  misc_feature 1..20: note = CRISPR gRNA sequence
  source 1..20: mol_type = other DNA
gtcattagcttattagtgag

SEQ ID NO: 32589 - DNA, 20 bp, synthetic construct
  misc_feature 1..20: note = CRISPR gRNA sequence
  source 1..20: mol_type = other DNA
tcattagcttattagtgagc

SEQ ID NO: 32590 - DNA, 20 bp, synthetic construct
  misc_feature 1..20: note = CRISPR gRNA sequence
  source 1..20: mol_type = other DNA
gcttattagtgagcatgtat

SEQ ID NO: 32591 - DNA, 20 bp, synthetic construct
  misc_feature 1..20: note = CRISPR gRNA sequence
  source 1..20: mol_type = other DNA
attagtgagcatgtattgat

SEQ ID NO: 32592 - DNA, 20 bp, synthetic construct
  misc_feature 1..20: note = CRISPR gRNA sequence
  source 1..20: mol_type = other DNA
ttagtgagcatgtattgatg

SEQ ID NO: 32593 - DNA, 20 bp, synthetic construct
  misc_feature 1..20: note = CRISPR gRNA sequence
  source 1..20: mol_type = other DNA
gtgagcatgtattgatgttg

SEQ ID NO: 32594 - DNA, 20 bp, synthetic construct
  misc_feature 1..20: note = CRISPR gRNA sequence
  source 1..20: mol_type = other DNA
atgttgcaatttaaaaacaa

SEQ ID NO: 32595 - DNA, 20 bp, synthetic construct
  misc_feature 1..20: note = CRISPR gRNA sequence
  source 1..20: mol_type = other DNA
caatttaaaaacaaaaacat

SEQ ID NO: 32596 - DNA, 20 bp, synthetic construct
  misc_feature 1..20: note = CRISPR gRNA sequence
  source 1..20: mol_type = other DNA
aaaaacaaaaacatttaaaa

SEQ ID NO: 32597 - DNA, 20 bp, synthetic construct
  misc_feature 1..20: note = CRISPR gRNA sequence
  source 1..20: mol_type = other DNA
aaaacaaaaacatttaaaaa

SEQ ID NO: 32598 - DNA, 20 bp, synthetic construct
  misc_feature 1..20: note = CRISPR gRNA sequence
  source 1..20: mol_type = other DNA
aaaaaaaataaggaaaaact

SEQ ID NO: 32599 - DNA, 20 bp, synthetic construct
  misc_feature 1..20: note = CRISPR gRNA sequence
  source 1..20: mol_type = other DNA
aaaaaaataaggaaaaacta

SEQ ID NO: 32600 - DNA, 20 bp, synthetic construct
  misc_feature 1..20: note = CRISPR gRNA sequence
  source 1..20: mol_type = other DNA
agggtcagaaggggaaagca

SEQ ID NO: 32601 - DNA, 20 bp, synthetic construct
  misc_feature 1..20: note = CRISPR gRNA sequence
  source 1..20: mol_type = other DNA
ttggtcatgcacccagacca

SEQ ID NO: 32602 - DNA, 20 bp, synthetic construct
  misc_feature 1..20: note = CRISPR gRNA sequence
  source 1..20: mol_type = other DNA
ggtcatgcacccagaccacc

SEQ ID NO: 32603 - DNA, 20 bp, synthetic construct
  misc_feature 1..20: note = CRISPR gRNA sequence
  source 1..20: mol_type = other DNA
gtcatgcacccagaccacct

SEQ ID NO: 32604 - DNA, 20 bp, synthetic construct
  misc_feature 1..20: note = CRISPR gRNA sequence
  source 1..20: mol_type = other DNA
aggaatctctgctcttctgc

SEQ ID NO: 32605 - DNA, 20 bp, synthetic construct
  misc_feature 1..20: note = CRISPR gRNA sequence
  source 1..20: mol_type = other DNA
tgctcttctgctttgatttt

SEQ ID NO: 32606 - DNA, 20 bp, synthetic construct
  misc_feature 1..20: note = CRISPR gRNA sequence
  source 1..20: mol_type = other DNA
ctcttctgctttgatttttg

SEQ ID NO: 32607 - DNA, 20 bp, synthetic construct
  misc_feature 1..20: note = CRISPR gRNA sequence
  source 1..20: mol_type = other DNA
ttctgctttgatttttggga

SEQ ID NO: 32608 - DNA, 20 bp, synthetic construct
  misc_feature 1..20: note = CRISPR gRNA sequence
  source 1..20: mol_type = other DNA
ctgctttgatttttgggaaa

SEQ ID NO: 32609 - DNA, 20 bp, synthetic construct
  misc_feature 1..20: note = CRISPR gRNA sequence
  source 1..20: mol_type = other DNA
tgctttgatttttgggaaat

SEQ ID NO: 32610 - DNA, 20 bp, synthetic construct
  misc_feature 1..20: note = CRISPR gRNA sequence
  source 1..20: mol_type = other DNA
ctttgatttttgggaaatag

SEQ ID NO: 32611 - DNA, 20 bp, synthetic construct
  misc_feature 1..20: note = CRISPR gRNA sequence
  source 1..20: mol_type = other DNA
tgatttttgggaaataggga

SEQ ID NO: 32612 - DNA, 20 bp, synthetic construct
  misc_feature 1..20: note = CRISPR gRNA sequence
  source 1..20: mol_type = other DNA
gatttttgggaaatagggac

SEQ ID NO: 32613 - DNA, 20 bp, synthetic construct
  misc_feature 1..20: note = CRISPR gRNA sequence
  source 1..20: mol_type = other DNA
atttttgggaaatagggaca

SEQ ID NO: 32614 - DNA, 20 bp, synthetic construct
  misc_feature 1..20: note = CRISPR gRNA sequence
  source 1..20: mol_type = other DNA
ttgggaaatagggacagaga

SEQ ID NO: 32615 - DNA, 20 bp, synthetic construct
  misc_feature 1..20: note = CRISPR gRNA sequence
  source 1..20: mol_type = other DNA
tgggaaatagggacagagaa

SEQ ID NO: 32616 - DNA, 20 bp, synthetic construct
  misc_feature 1..20: note = CRISPR gRNA sequence
  source 1..20: mol_type = other DNA
gggaaatagggacagagaaa

SEQ ID NO: 32617 - DNA, 20 bp, synthetic construct
  misc_feature 1..20: note = CRISPR gRNA sequence
  source 1..20: mol_type = other DNA
ggaaatagggacagagaaag

SEQ ID NO: 32618 - DNA, 20 bp, synthetic construct
  misc_feature 1..20: note = CRISPR gRNA sequence
  source 1..20: mol_type = other DNA
tgctggggagggaggatcat

SEQ ID NO: 32619 - DNA, 20 bp, synthetic construct
  misc_feature 1..20: note = CRISPR gRNA sequence
  source 1..20: mol_type = other DNA
gggagggaggatcatgagaa

SEQ ID NO: 32620 - DNA, 20 bp, synthetic construct
  misc_feature 1..20: note = CRISPR gRNA sequence
  source 1..20: mol_type = other DNA
gggcaccactgccaagtgca

SEQ ID NO: 32621 - DNA, 20 bp, synthetic construct
  misc_feature 1..20: note = CRISPR gRNA sequence
  source 1..20: mol_type = other DNA
ccaagtgcatggagtatggg

SEQ ID NO: 32622 - DNA, 20 bp, synthetic construct
  misc_feature 1..20: note = CRISPR gRNA sequence
  source 1..20: mol_type = other DNA
accatggtagatgaatatac

SEQ ID NO: 32623 - DNA, 20 bp, synthetic construct
  misc_feature 1..20: note = CRISPR gRNA sequence
  source 1..20: mol_type = other DNA
gagacccctgttccagcctc

SEQ ID NO: 32624 - DNA, 20 bp, synthetic construct
  misc_feature 1..20: note = CRISPR gRNA sequence
  source 1..20: mol_type = other DNA
ttccagcctcagagatttgc

SEQ ID NO: 32625 - DNA, 20 bp, synthetic construct
  misc_feature 1..20: note = CRISPR gRNA sequence
  source 1..20: mol_type = other DNA
cagcctcagagatttgccag

SEQ ID NO: 32626 - DNA, 20 bp, synthetic construct
  misc_feature 1..20: note = CRISPR gRNA sequence
  source 1..20: mol_type = other DNA
agagatttgccagagcccat

SEQ ID NO: 32627 - DNA, 20 bp, synthetic construct
  misc_feature 1..20: note = CRISPR gRNA sequence
  source 1..20: mol_type = other DNA
gccagagcccatggggcaga

SEQ ID NO: 32628 - DNA, 20 bp, synthetic construct
  misc_feature 1..20: note = CRISPR gRNA sequence
  source 1..20: mol_type = other DNA
ccagagcccatggggcagag

SEQ ID NO: 32629 - DNA, 20 bp, synthetic construct
  misc_feature 1..20: note = CRISPR gRNA sequence
  source 1..20: mol_type = other DNA
gatgggtccctcagggagat

SEQ ID NO: 32630 - DNA, 20 bp, synthetic construct
  misc_feature 1..20: note = CRISPR gRNA sequence
  source 1..20: mol_type = other DNA
agggagattcaggcagctca

SEQ ID NO: 32631 - DNA, 20 bp, synthetic construct
  misc_feature 1..20: note = CRISPR gRNA sequence
  source 1..20: mol_type = other DNA
aggcagctcaacgaggaact

SEQ ID NO: 32632 - DNA, 20 bp, synthetic construct
  misc_feature 1..20: note = CRISPR gRNA sequence
  source 1..20: mol_type = other DNA
aacgaggaactggagaaagg

SEQ ID NO: 32633 - DNA, 20 bp, synthetic construct
  misc_feature 1..20: note = CRISPR gRNA sequence
  source 1..20: mol_type = other DNA
gagaaaggcactgcaagaga

SEQ ID NO: 32634 - DNA, 20 bp, synthetic construct
  misc_feature 1..20: note = CRISPR gRNA sequence
  source 1..20: mol_type = other DNA
caagagacaaaggcagtgag

SEQ ID NO: 32635 - DNA, 20 bp, synthetic construct
  misc_feature 1..20: note = CRISPR gRNA sequence
  source 1..20: mol_type = other DNA
gcatagcacctgtgtttgcg

SEQ ID NO: 32636 - DNA, 20 bp, synthetic construct
  misc_feature 1..20: note = CRISPR gRNA sequence
  source 1..20: mol_type = other DNA
catagcacctgtgtttgcga

SEQ ID NO: 32637 - DNA, 20 bp, synthetic construct
  misc_feature 1..20: note = CRISPR gRNA sequence
  source 1..20: mol_type = other DNA
tgtttgcgattctgcttttg

SEQ ID NO: 32638 - DNA, 20 bp, synthetic construct
  misc_feature 1..20: note = CRISPR gRNA sequence
  source 1..20: mol_type = other DNA
gcgattctgcttttgcttat

SEQ ID NO: 32639 - DNA, 20 bp, synthetic construct
  misc_feature 1..20: note = CRISPR gRNA sequence
  source 1..20: mol_type = other DNA
cgattctgcttttgcttatt

SEQ ID NO: 32640 - DNA, 20 bp, synthetic construct
  misc_feature 1..20: note = CRISPR gRNA sequence
  source 1..20: mol_type = other DNA
tgcttttgcttatttgatta

SEQ ID NO: 32641 - DNA, 20 bp, synthetic construct
  misc_feature 1..20: note = CRISPR gRNA sequence
  source 1..20: mol_type = other DNA
cttttgcttatttgattaat

SEQ ID NO: 32642 - DNA, 20 bp, synthetic construct
  misc_feature 1..20: note = CRISPR gRNA sequence
  source 1..20: mol_type = other DNA
ttgcttatttgattaatgtc

SEQ ID NO: 32643 - DNA, 20 bp, synthetic construct
  misc_feature 1..20: note = CRISPR gRNA sequence
  source 1..20: mol_type = other DNA
tgcttatttgattaatgtct

SEQ ID NO: 32644 - DNA, 20 bp, synthetic construct
  misc_feature 1..20: note = CRISPR gRNA sequence
  source 1..20: mol_type = other DNA
gcttatttgattaatgtctg

SEQ ID NO: 32645 - DNA, 20 bp, synthetic construct
  misc_feature 1..20: note = CRISPR gRNA sequence
  source 1..20: mol_type = other DNA
cttatttgattaatgtctga

SEQ ID NO: 32646 - DNA, 20 bp, synthetic construct
  misc_feature 1..20: note = CRISPR gRNA sequence
  source 1..20: mol_type = other DNA
atttgattaatgtctgaccc

SEQ ID NO: 32647 - DNA, 20 bp, synthetic construct
  misc_feature 1..20: note = CRISPR gRNA sequence
  source 1..20: mol_type = other DNA
tttgattaatgtctgacccc

SEQ ID NO: 32648 - DNA, 20 bp, synthetic construct
  misc_feature 1..20: note = CRISPR gRNA sequence
  source 1..20: mol_type = other DNA
gattaatgtctgacccccct

SEQ ID NO: 32649 - DNA, 20 bp, synthetic construct
  misc_feature 1..20: note = CRISPR gRNA sequence
  source 1..20: mol_type = other DNA
attaatgtctgaccccccta

SEQ ID NO: 32650 - DNA, 20 bp, synthetic construct
  misc_feature 1..20: note = CRISPR gRNA sequence
  source 1..20: mol_type = other DNA
atgtctgacccccctaaagg

SEQ ID NO: 32651 - DNA, 20 bp, synthetic construct
  misc_feature 1..20: note = CRISPR gRNA sequence
  source 1..20: mol_type = other DNA
acccccctaaagggccctaa

SEQ ID NO: 32652 - DNA, 20 bp, synthetic construct
  misc_feature 1..20: note = CRISPR gRNA sequence
  source 1..20: mol_type = other DNA
aagggccctaatttccctaa

SEQ ID NO: 32653 - DNA, 20 bp, synthetic construct
  misc_feature 1..20: note = CRISPR gRNA sequence
  source 1..20: mol_type = other DNA
atttccctaagagcagtagc

SEQ ID NO: 32654 - DNA, 20 bp, synthetic construct
  misc_feature 1..20: note = CRISPR gRNA sequence
  source 1..20: mol_type = other DNA
ccctaagagcagtagctgtt

SEQ ID NO: 32655 - DNA, 20 bp, synthetic construct
  misc_feature 1..20: note = CRISPR gRNA sequence
  source 1..20: mol_type = other DNA
cctaagagcagtagctgttt

SEQ ID NO: 32656 - DNA, 20 bp, synthetic construct
  misc_feature 1..20: note = CRISPR gRNA sequence
  source 1..20: mol_type = other DNA
agagcagtagctgtttctgt

SEQ ID NO: 32657 - DNA, 20 bp, synthetic construct
  misc_feature 1..20: note = CRISPR gRNA sequence
  source 1..20: mol_type = other DNA
tttctgtcctgccctgatgg

SEQ ID NO: 32658 - DNA, 20 bp, synthetic construct
  misc_feature 1..20: note = CRISPR gRNA sequence
  source 1..20: mol_type = other DNA
ctgtcctgccctgatggaat

SEQ ID NO: 32659 - DNA, 20 bp, synthetic construct
  misc_feature 1..20: note = CRISPR gRNA sequence
  source 1..20: mol_type = other DNA
tgtcctgccctgatggaatt

SEQ ID NO: 32660 - DNA, 20 bp, synthetic construct
  misc_feature 1..20: note = CRISPR gRNA sequence
  source 1..20: mol_type = other DNA
tcctgccctgatggaattct

SEQ ID NO: 32661 - DNA, 20 bp, synthetic construct
  misc_feature 1..20: note = CRISPR gRNA sequence
  source 1..20: mol_type = other DNA
ccctgatggaattcttagca

SEQ ID NO: 32662 - DNA, 20 bp, synthetic construct
  misc_feature 1..20: note = CRISPR gRNA sequence
  source 1..20: mol_type = other DNA
atggaattcttagcacctag

SEQ ID NO: 32663 - DNA, 20 bp, synthetic construct
  misc_feature 1..20: note = CRISPR gRNA sequence
  source 1..20: mol_type = other DNA
ttagcacctagcagagcagt

SEQ ID NO: 32664 - DNA, 20 bp, synthetic construct
  misc_feature 1..20: note = CRISPR gRNA sequence
  source 1..20: mol_type = other DNA
agcacctagcagagcagttg

SEQ ID NO: 32665 - DNA, 20 bp, synthetic construct
  misc_feature 1..20: note = CRISPR gRNA sequence
  source 1..20: mol_type = other DNA
gcacctagcagagcagttgg

SEQ ID NO: 32666 - DNA, 20 bp, synthetic construct
  misc_feature 1..20: note = CRISPR gRNA sequence
  source 1..20: mol_type = other DNA
gcagagcagttggcacagag

SEQ ID NO: 32667 - DNA, 20 bp, synthetic construct
  misc_feature 1..20: note = CRISPR gRNA sequence
  source 1..20: mol_type = other DNA
gcacagagaaggggctccat

SEQ ID NO: 32668 - DNA, 20 bp, synthetic construct
  misc_feature 1..20: note = CRISPR gRNA sequence
  source 1..20: mol_type = other DNA
catgaagagctgatgaacga

SEQ ID NO: 32669 - DNA, 20 bp, synthetic construct
  misc_feature 1..20: note = CRISPR gRNA sequence
  source 1..20: mol_type = other DNA
atgaacgaataaggctggca

SEQ ID NO: 32670 - DNA, 20 bp, synthetic construct
  misc_feature 1..20: note = CRISPR gRNA sequence
  source 1..20: mol_type = other DNA
gcaggtgaatgctctaattg

SEQ ID NO: 32671 - DNA, 20 bp, synthetic construct
  misc_feature 1..20: note = CRISPR gRNA sequence
  source 1..20: mol_type = other DNA
taattggtggagattccctc

SEQ ID NO: 32672 - DNA, 20 bp, synthetic construct
  misc_feature 1..20: note = CRISPR gRNA sequence
  source 1..20: mol_type = other DNA
attggtggagattccctcct

SEQ ID NO: 32673 - DNA, 20 bp, synthetic construct
  misc_feature 1..20: note = CRISPR gRNA sequence
  source 1..20: mol_type = other DNA
gtggagattccctcctgatg

SEQ ID NO: 32674 - DNA, 20 bp, synthetic construct
  misc_feature 1..20: note = CRISPR gRNA sequence
  source 1..20: mol_type = other DNA
cctcctgatgctcgcacgga

SEQ ID NO: 32675 - DNA, 20 bp, synthetic construct
  misc_feature 1..20: note = CRISPR gRNA sequence
  source 1..20: mol_type = other DNA
ctgatgctcgcacggatgtg

SEQ ID NO: 32676 - DNA, 20 bp, synthetic construct
  misc_feature 1..20: note = CRISPR gRNA sequence
  source 1..20: mol_type = other DNA
atgctcgcacggatgtgttt

SEQ ID NO: 32677 - DNA, 20 bp, synthetic construct
  misc_feature 1..20: note = CRISPR gRNA sequence
  source 1..20: mol_type = other DNA
gcacggatgtgtttccttct

SEQ ID NO: 32678 - DNA, 20 bp, synthetic construct
  misc_feature 1..20: note = CRISPR gRNA sequence
  source 1..20: mol_type = other DNA
ccttctgaggcatgttctct

SEQ ID NO: 32679 - DNA, 20 bp, synthetic construct
  misc_feature 1..20: note = CRISPR gRNA sequence
  source 1..20: mol_type = other DNA
cttctgaggcatgttctctg

SEQ ID NO: 32680 - DNA, 20 bp, synthetic construct
  misc_feature 1..20: note = CRISPR gRNA sequence
  source 1..20: mol_type = other DNA
ctgaggcatgttctctgcca

SEQ ID NO: 32681 - DNA, 20 bp, synthetic construct
  misc_feature 1..20: note = CRISPR gRNA sequence
  source 1..20: mol_type = other DNA
tgaggcatgttctctgccag

SEQ ID NO: 32682 - DNA, 20 bp, synthetic construct
  misc_feature 1..20: note = CRISPR gRNA sequence
  source 1..20: mol_type = other DNA
aggcatgttctctgccaggg

SEQ ID NO: 32683 - DNA, 20 bp, synthetic construct
  misc_feature 1..20: note = CRISPR gRNA sequence
  source 1..20: mol_type = other DNA
tctgccagggattgagctga

SEQ ID NO: 32684 - DNA, 20 bp, synthetic construct
  misc_feature 1..20: note = CRISPR gRNA sequence
  source 1..20: mol_type = other DNA
tgccagggattgagctgacg

SEQ ID NO: 32685 - DNA, 20 bp, synthetic construct
  misc_feature 1..20: note = CRISPR gRNA sequence
  source 1..20: mol_type = other DNA
ccagggattgagctgacggg

SEQ ID NO: 32686 - DNA, 20 bp, synthetic construct
  misc_feature 1..20: note = CRISPR gRNA sequence
  source 1..20: mol_type = other DNA
agctgacgggggccccaagg

SEQ ID NO: 32687 - DNA, 20 bp, synthetic construct
  misc_feature 1..20: note = CRISPR gRNA sequence
  source 1..20: mol_type = other DNA
acgggggccccaaggataaa

SEQ ID NO: 32688 - DNA, 20 bp, synthetic construct
  misc_feature 1..20: note = CRISPR gRNA sequence
  source 1..20: mol_type = other DNA
gctggggcagaggtgagtga

SEQ ID NO: 32689 - DNA, 20 bp, synthetic construct
  misc_feature 1..20: note = CRISPR gRNA sequence
  source 1..20: mol_type = other DNA
gggcagaggtgagtgacact

SEQ ID NO: 32690 - DNA, 20 bp, synthetic construct
  misc_feature 1..20: note = CRISPR gRNA sequence
  source 1..20: mol_type = other DNA
atagggttggggagaggtga

SEQ ID NO: 32691 - DNA, 20 bp, synthetic construct
  misc_feature 1..20: note = CRISPR gRNA sequence
  source 1..20: mol_type = other DNA
gggagaggtgaggtccagtt

SEQ ID NO: 32692 - DNA, 20 bp, synthetic construct
  misc_feature 1..20: note = CRISPR gRNA sequence
  source 1..20: mol_type = other DNA
ctgacagtccctgccttagt

SEQ ID NO: 32693 - DNA, 20 bp, synthetic construct
  misc_feature 1..20: note = CRISPR gRNA sequence
  source 1..20: mol_type = other DNA
acagtccctgccttagtgtc

SEQ ID NO: 32694 - DNA, 20 bp, synthetic construct
  misc_feature 1..20: note = CRISPR gRNA sequence
  source 1..20: mol_type = other DNA
ccttagtgtcaactccttat

SEQ ID NO: 32695 - DNA, 20 bp, synthetic construct
  misc_feature 1..20: note = CRISPR gRNA sequence
  source 1..20: mol_type = other DNA
agtgtcaactccttatccac

SEQ ID NO: 32696 - DNA, 20 bp, synthetic construct
  misc_feature 1..20: note = CRISPR gRNA sequence
  source 1..20: mol_type = other DNA
gtgtcaactccttatccacc

SEQ ID NO: 32697 - DNA, 20 bp, synthetic construct
  misc_feature 1..20: note = CRISPR gRNA sequence
  source 1..20: mol_type = other DNA
cttatccacctcccaagagg

SEQ ID NO: 32698 - DNA, 20 bp, synthetic construct
  misc_feature 1..20: note = CRISPR gRNA sequence
  source 1..20: mol_type = other DNA
atccacctcccaagagggag

SEQ ID NO: 32699 - DNA, 20 bp, synthetic construct
  misc_feature 1..20: note = CRISPR gRNA sequence
  source 1..20: mol_type = other DNA
tccacctcccaagagggaga

SEQ ID NO: 32700 - DNA, 20 bp, synthetic construct
  misc_feature 1..20: note = CRISPR gRNA sequence
  source 1..20: mol_type = other DNA
ccaagagggagaaagcccac

SEQ ID NO: 32701 - DNA, 20 bp, synthetic construct
  misc_feature 1..20: note = CRISPR gRNA sequence
  source 1..20: mol_type = other DNA
tctccaagccccctaacata

SEQ ID NO: 32702 - DNA, 20 bp, synthetic construct
  misc_feature 1..20: note = CRISPR gRNA sequence
  source 1..20: mol_type = other DNA
tccaagccccctaacatact

SEQ ID NO: 32703 - DNA, 20 bp, synthetic construct
  misc_feature 1..20: note = CRISPR gRNA sequence
  source 1..20: mol_type = other DNA
caagccccctaacatactgg

SEQ ID NO: 32704 - DNA, 20 bp, synthetic construct
  misc_feature 1..20: note = CRISPR gRNA sequence
  source 1..20: mol_type = other DNA
acatactgggaatctggtcg

SEQ ID NO: 32705 - DNA, 20 bp, synthetic construct
  misc_feature 1..20: note = CRISPR gRNA sequence
  source 1..20: mol_type = other DNA
ggaatctggtcggttttctc

SEQ ID NO: 32706 - DNA, 20 bp, synthetic construct
  misc_feature 1..20: note = CRISPR gRNA sequence
  source 1..20: mol_type = other DNA
gtcggttttctccaggcgca

SEQ ID NO: 32707 - DNA, 20 bp, synthetic construct
  misc_feature 1..20: note = CRISPR gRNA sequence
  source 1..20: mol_type = other DNA
tctccaggcgcatctggccg

SEQ ID NO: 32708 - DNA, 20 bp, synthetic construct
  misc_feature 1..20: note = CRISPR gRNA sequence
  source 1..20: mol_type = other DNA
ctccaggcgcatctggccgg

SEQ ID NO: 32709 - DNA, 20 bp, synthetic construct
  misc_feature 1..20: note = CRISPR gRNA sequence
  source 1..20: mol_type = other DNA
tccaggcgcatctggccgga

SEQ ID NO: 32710 - DNA, 20 bp, synthetic construct
  misc_feature 1..20: note = CRISPR gRNA sequence
  source 1..20: mol_type = other DNA
caggcgcatctggccggagg

SEQ ID NO: 32711 - DNA, 20 bp, synthetic construct
  misc_feature 1..20: note = CRISPR gRNA sequence
  source 1..20: mol_type = other DNA
gccggaggctggctcctggt

SEQ ID NO: 32712 - DNA, 20 bp, synthetic construct
  misc_feature 1..20: note = CRISPR gRNA sequence
  source 1..20: mol_type = other DNA
gctcctggttgaacagcgca

SEQ ID NO: 32713 - DNA, 20 bp, synthetic construct
  misc_feature 1..20: note = CRISPR gRNA sequence
  source 1..20: mol_type = other DNA
ctggttgaacagcgcaggca

SEQ ID NO: 32714 - DNA, 20 bp, synthetic construct
  misc_feature 1..20: note = CRISPR gRNA sequence
  source 1..20: mol_type = other DNA
gttgaacagcgcaggcagtg

SEQ ID NO: 32715 - DNA, 20 bp, synthetic construct
  misc_feature 1..20: note = CRISPR gRNA sequence
  source 1..20: mol_type = other DNA
aacagcgcaggcagtggcag

SEQ ID NO: 32716 - DNA, 20 bp, synthetic construct
  misc_feature 1..20: note = CRISPR gRNA sequence
  source 1..20: mol_type = other DNA
actggtctcactaggagact

SEQ ID NO: 32717 - DNA, 20 bp, synthetic construct
  misc_feature 1..20: note = CRISPR gRNA sequence
  source 1..20: mol_type = other DNA
gtctcactaggagactgcca

SEQ ID NO: 32718 - DNA, 20 bp, synthetic construct
  misc_feature 1..20: note = CRISPR gRNA sequence
  source 1..20: mol_type = other DNA
actaggagactgccagtcac

SEQ ID NO: 32719 - DNA, 20 bp, synthetic construct
  misc_feature 1..20: note = CRISPR gRNA sequence
  source 1..20: mol_type = other DNA
ggagactgccagtcaccaca

SEQ ID NO: 32720 - DNA, 20 bp, synthetic construct
  misc_feature 1..20: note = CRISPR gRNA sequence
  source 1..20: mol_type = other DNA
ccagtcaccacagtgggggg

SEQ ID NO: 32721 - DNA, 20 bp, synthetic construct
  misc_feature 1..20: note = CRISPR gRNA sequence
  source 1..20: mol_type = other DNA
agctgtgaggaagtgggctg

SEQ ID NO: 32722 - DNA, 20 bp, synthetic construct
  misc_feature 1..20: note = CRISPR gRNA sequence
  source 1..20: mol_type = other DNA
tgaggaagtgggctgtgtta

SEQ ID NO: 32723 - DNA, 20 bp, synthetic construct
  misc_feature 1..20: note = CRISPR gRNA sequence
  source 1..20: mol_type = other DNA
tgttagagactgggtgcttg

SEQ ID NO: 32724 - DNA, 20 bp, synthetic construct
  misc_feature 1..20: note = CRISPR gRNA sequence
  source 1..20: mol_type = other DNA
gagactgggtgcttggaggg

SEQ ID NO: 32725 - DNA, 20 bp, synthetic construct
  misc_feature 1..20: note = CRISPR gRNA sequence
  source 1..20: mol_type = other DNA
ggtgcttggaggggccttcc

SEQ ID NO: 32726 - DNA, 20 bp, synthetic construct
  misc_feature 1..20: note = CRISPR gRNA sequence
  source 1..20: mol_type = other DNA
ggaggggccttcctgggatg

SEQ ID NO: 32727 - DNA, 20 bp, synthetic construct
  misc_feature 1..20: note = CRISPR gRNA sequence
  source 1..20: mol_type = other DNA
gaggggccttcctgggatgg

SEQ ID NO: 32728 - DNA, 20 bp, synthetic construct
  misc_feature 1..20: note = CRISPR gRNA sequence
  source 1..20: mol_type = other DNA
cctgggatggggagggccct

SEQ ID NO: 32729 - DNA, 20 bp, synthetic construct
  misc_feature 1..20: note = CRISPR gRNA sequence
  source 1..20: mol_type = other DNA
ctgggatggggagggccctg

SEQ ID NO: 32730 - DNA, 20 bp, synthetic construct
  misc_feature 1..20: note = CRISPR gRNA sequence
  source 1..20: mol_type = other DNA
ggatggggagggccctggag

SEQ ID NO: 32731 - DNA, 20 bp, synthetic construct
  misc_feature 1..20: note = CRISPR gRNA sequence
  source 1..20: mol_type = other DNA
gagtggcatggatgtctctc

SEQ ID NO: 32732 - DNA, 20 bp, synthetic construct
  misc_feature 1..20: note = CRISPR gRNA sequence
  source 1..20: mol_type = other DNA
tcctgacagaggaaatgctt

SEQ ID NO: 32733 - DNA, 20 bp, synthetic construct
  misc_feature 1..20: note = CRISPR gRNA sequence
  source 1..20: mol_type = other DNA
ctgacagaggaaatgcttgt

SEQ ID NO: 32734 - DNA, 20 bp, synthetic construct
  misc_feature 1..20: note = CRISPR gRNA sequence
  source 1..20: mol_type = other DNA
acagaggaaatgcttgtcat

SEQ ID NO: 32735 - DNA, 20 bp, synthetic construct
  misc_feature 1..20: note = CRISPR gRNA sequence
  source 1..20: mol_type = other DNA
gtcatcttctcagccctggc

SEQ ID NO: 32736 - DNA, 20 bp, synthetic construct
  misc_feature 1..20: note = CRISPR gRNA sequence
  source 1..20: mol_type = other DNA
tcatcttctcagccctggct

SEQ ID NO: 32737 - DNA, 20 bp, synthetic construct
  misc_feature 1..20: note = CRISPR gRNA sequence
  source 1..20: mol_type = other DNA
ctcagccctggctgcagctg

SEQ ID NO: 32738 - DNA, 20 bp, synthetic construct
  misc_feature 1..20: note = CRISPR gRNA sequence
  source 1..20: mol_type = other DNA
tcagccctggctgcagctgt

SEQ ID NO: 32739 - DNA, 20 bp, synthetic construct
  misc_feature 1..20: note = CRISPR gRNA sequence
  source 1..20: mol_type = other DNA
agccctggctgcagctgtgt

SEQ ID NO: 32740 - DNA, 20 bp, synthetic construct
  misc_feature 1..20: note = CRISPR gRNA sequence
  source 1..20: mol_type = other DNA
gctgcagctgtgttgatcag

SEQ ID NO: 32741 - DNA, 20 bp, synthetic construct
  misc_feature 1..20: note = CRISPR gRNA sequence
  source 1..20: mol_type = other DNA
cagctgtgttgatcagcaac

SEQ ID NO: 32742 - DNA, 20 bp, synthetic construct
  misc_feature 1..20: note = CRISPR gRNA sequence
  source 1..20: mol_type = other DNA
tgttgatcagcaactgctct

SEQ ID NO: 32743 - DNA, 20 bp, synthetic construct
  misc_feature 1..20: note = CRISPR gRNA sequence
  source 1..20: mol_type = other DNA
atcagcaactgctctgtgcc

SEQ ID NO: 32744 - DNA, 20 bp, synthetic construct
  misc_feature 1..20: note = CRISPR gRNA sequence
  source 1..20: mol_type = other DNA
ctctgtgccaggcagtcccc

SEQ ID NO: 32745 - DNA, 20 bp, synthetic construct
  misc_feature 1..20: note = CRISPR gRNA sequence
  source 1..20: mol_type = other DNA
tgtgccaggcagtcccccag

SEQ ID NO: 32746 - DNA, 20 bp, synthetic construct
  misc_feature 1..20: note = CRISPR gRNA sequence
  source 1..20: mol_type = other DNA
tgccaggcagtcccccagtc

SEQ ID NO: 32747 - DNA, 20 bp, synthetic construct
  misc_feature 1..20: note = CRISPR gRNA sequence
  source 1..20: mol_type = other DNA
tccttgtgacttggctctga

SEQ ID NO: 32748 - DNA, 20 bp, synthetic construct
  misc_feature 1..20: note = CRISPR gRNA sequence
  source 1..20: mol_type = other DNA
cttgtgacttggctctgaga

SEQ ID NO: 32749 - DNA, 20 bp, synthetic construct
  misc_feature 1..20: note = CRISPR gRNA sequence
  source 1..20: mol_type = other DNA
gtgacttggctctgagagct

SEQ ID NO: 32750 - DNA, 20 bp, synthetic construct
  misc_feature 1..20: note = CRISPR gRNA sequence
  source 1..20: mol_type = other DNA
tgacttggctctgagagcta

SEQ ID NO: 32751 - DNA, 20 bp, synthetic construct
  misc_feature 1..20: note = CRISPR gRNA sequence
  source 1..20: mol_type = other DNA
ggctctgagagctatgctga

SEQ ID NO: 32752 - DNA, 20 bp, synthetic construct
  misc_feature 1..20: note = CRISPR gRNA sequence
  source 1..20: mol_type = other DNA
gctctgagagctatgctgag

SEQ ID NO: 32753 - DNA, 20 bp, synthetic construct
  misc_feature 1..20: note = CRISPR gRNA sequence
  source 1..20: mol_type = other DNA
tgagagctatgctgagcagg

SEQ ID NO: 32754 - DNA, 20 bp, synthetic construct
  misc_feature 1..20: note = CRISPR gRNA sequence
  source 1..20: mol_type = other DNA
agagctatgctgagcaggac

SEQ ID NO: 32755 - DNA, 20 bp, synthetic construct
  misc_feature 1..20: note = CRISPR gRNA sequence
  source 1..20: mol_type = other DNA
tgctgagcaggaccctaggg

SEQ ID NO: 32756 - DNA, 20 bp, synthetic construct
  misc_feature 1..20: note = CRISPR gRNA sequence
  source 1..20: mol_type = other DNA
agcaggaccctagggcctcc

SEQ ID NO: 32757 - DNA, 20 bp, synthetic construct
  misc_feature 1..20: note = CRISPR gRNA sequence
  source 1..20: mol_type = other DNA
gggcctccacacggagagct

SEQ ID NO: 32758 - DNA, 20 bp, synthetic construct
  misc_feature 1..20: note = CRISPR gRNA sequence
  source 1..20: mol_type = other DNA
cacacggagagctggggcag

SEQ ID NO: 32759 - DNA, 20 bp, synthetic construct
  misc_feature 1..20: note = CRISPR gRNA sequence
  source 1..20: mol_type = other DNA
gggcagaatagaacctatga

SEQ ID NO: 32760 - DNA, 20 bp, synthetic construct
  misc_feature 1..20: note = CRISPR gRNA sequence
  source 1..20: mol_type = other DNA
tgaacaatctgttagctcca

SEQ ID NO: 32761 - DNA, 20 bp, synthetic construct
  misc_feature 1..20: note = CRISPR gRNA sequence
  source 1..20: mol_type = other DNA
ttagctccaagcccctacca

SEQ ID NO: 32762 - DNA, 20 bp, synthetic construct
  misc_feature 1..20: note = CRISPR gRNA sequence
  source 1..20: mol_type = other DNA
gctccaagcccctaccacct

SEQ ID NO: 32763 - DNA, 20 bp, synthetic construct
  misc_feature 1..20: note = CRISPR gRNA sequence
  source 1..20: mol_type = other DNA
caagcccctaccaccttcca

SEQ ID NO: 32764 - DNA, 20 bp, synthetic construct
  misc_feature 1..20: note = CRISPR gRNA sequence
  source 1..20: mol_type = other DNA
ccaccttccacaaacagtcg

SEQ ID NO: 32765 - DNA, 20 bp, synthetic construct
  misc_feature 1..20: note = CRISPR gRNA sequence
  source 1..20: mol_type = other DNA
ccacaaacagtcgtgagccc

SEQ ID NO: 32766 - DNA, 20 bp, synthetic construct
  misc_feature 1..20: note = CRISPR gRNA sequence
  source 1..20: mol_type = other DNA
cacaaacagtcgtgagcccc

SEQ ID NO: 32767 - DNA, 20 bp, synthetic construct
  misc_feature 1..20: note = CRISPR gRNA sequence
  source 1..20: mol_type = other DNA
agaggactctaagggacccc

SEQ ID NO: 32768 - DNA, 20 bp, synthetic construct
  misc_feature 1..20: note = CRISPR gRNA sequence
  source 1..20: mol_type = other DNA
gaggactctaagggacccca

SEQ ID NO: 32769 - DNA, 20 bp, synthetic construct
  misc_feature 1..20: note = CRISPR gRNA sequence
  source 1..20: mol_type = other DNA
taagggaccccaagctctca

SEQ ID NO: 32770 - DNA, 20 bp, synthetic construct
  misc_feature 1..20: note = CRISPR gRNA sequence
  source 1..20: mol_type = other DNA
agggaccccaagctctcagc

SEQ ID NO: 32771 - DNA, 20 bp, synthetic construct
  misc_feature 1..20: note = CRISPR gRNA sequence
  source 1..20: mol_type = other DNA
tcagcctctacccaaagaag

SEQ ID NO: 32772 - DNA, 20 bp, synthetic construct
  misc_feature 1..20: note = CRISPR gRNA sequence
  source 1..20: mol_type = other DNA
agcctctacccaaagaaggg

SEQ ID NO: 32773 - DNA, 20 bp, synthetic construct
  misc_feature 1..20: note = CRISPR gRNA sequence
  source 1..20: mol_type = other DNA
tacccaaagaagggcagggg

SEQ ID NO: 32774 - DNA, 20 bp, synthetic construct
  misc_feature 1..20: note = CRISPR gRNA sequence
  source 1..20: mol_type = other DNA
cccaaagaagggcaggggct

SEQ ID NO: 32775 - DNA, 20 bp, synthetic construct
  misc_feature 1..20: note = CRISPR gRNA sequence
  source 1..20: mol_type = other DNA
caccatgcaccatccccatc

SEQ ID NO: 32776 - DNA, 20 bp, synthetic construct
  misc_feature 1..20: note = CRISPR gRNA sequence
  source 1..20: mol_type = other DNA
gggccaggagttcaatctct

SEQ ID NO: 32777 - DNA, 20 bp, synthetic construct
  misc_feature 1..20: note = CRISPR gRNA sequence
  source 1..20: mol_type = other DNA
ggccaggagttcaatctctt

SEQ ID NO: 32778 - DNA, 20 bp, synthetic construct
  misc_feature 1..20: note = CRISPR gRNA sequence
  source 1..20: mol_type = other DNA
aatctcttccatcccctccc

SEQ ID NO: 32779 - DNA, 20 bp, synthetic construct
  misc_feature 1..20: note = CRISPR gRNA sequence
  source 1..20: mol_type = other DNA
ttccatcccctccccaaggc

SEQ ID NO: 32780 - DNA, 20 bp, synthetic construct
  misc_feature 1..20: note = CRISPR gRNA sequence
  source 1..20: mol_type = other DNA
ccatcccctccccaaggcat

SEQ ID NO: 32781 - DNA, 20 bp, synthetic construct
  misc_feature 1..20: note = CRISPR gRNA sequence
  source 1..20: mol_type = other DNA
catcccctccccaaggcatc

SEQ ID NO: 32782 - DNA, 20 bp, synthetic construct
  misc_feature 1..20: note = CRISPR gRNA sequence
  source 1..20: mol_type = other DNA
cccaaggcatccacccttcc

SEQ ID NO: 32783 - DNA, 20 bp, synthetic construct
  misc_feature 1..20: note = CRISPR gRNA sequence
  source 1..20: mol_type = other DNA
cccaaccccagcccacctgc

SEQ ID NO: 32784 - DNA, 20 bp, synthetic construct
  misc_feature 1..20: note = CRISPR gRNA sequence
  source 1..20: mol_type = other DNA
ccaaccccagcccacctgcc

SEQ ID NO: 32785 - DNA, 20 bp, synthetic construct
  misc_feature 1..20: note = CRISPR gRNA sequence
  source 1..20: mol_type = other DNA
ccctgcacacctggcttcca

SEQ ID NO: 32786 - DNA, 20 bp, synthetic construct
  misc_feature 1..20: note = CRISPR gRNA sequence
  source 1..20: mol_type = other DNA
cacacctggcttccagtgct

SEQ ID NO: 32787 - DNA, 20 bp, synthetic construct
  misc_feature 1..20: note = CRISPR gRNA sequence
  source 1..20: mol_type = other DNA
gcttccagtgcttcaggtct

SEQ ID NO: 32788 - DNA, 20 bp, synthetic construct
  misc_feature 1..20: note = CRISPR gRNA sequence
  source 1..20: mol_type = other DNA
ccagtgcttcaggtctgccg

SEQ ID NO: 32789 - DNA, 20 bp, synthetic construct
  misc_feature 1..20: note = CRISPR gRNA sequence
  source 1..20: mol_type = other DNA
cagtgcttcaggtctgccgg

SEQ ID NO: 32790 - DNA, 20 bp, synthetic construct
  misc_feature 1..20: note = CRISPR gRNA sequence
  source 1..20: mol_type = other DNA
caggtctgccggaagctcct

SEQ ID NO: 32791 - DNA, 20 bp, synthetic construct
  misc_feature 1..20: note = CRISPR gRNA sequence
  source 1..20: mol_type = other DNA
aggtctgccggaagctcctc

SEQ ID NO: 32792 - DNA, 20 bp, synthetic construct
  misc_feature 1..20: note = CRISPR gRNA sequence
  source 1..20: mol_type = other DNA
ccggaagctcctctgggaag

SEQ ID NO: 32793 - DNA, 20 bp, synthetic construct
  misc_feature 1..20: note = CRISPR gRNA sequence
  source 1..20: mol_type = other DNA
ctctgggaaggctgcagaga

SEQ ID NO: 32794 - DNA, 20 bp, synthetic construct
  misc_feature 1..20: note = CRISPR gRNA sequence
  source 1..20: mol_type = other DNA
tgggaaggctgcagagaaaa

SEQ ID NO: 32795 - DNA, 20 bp, synthetic construct
  misc_feature 1..20: note = CRISPR gRNA sequence
  source 1..20: mol_type = other DNA
ggaaggctgcagagaaaaca

SEQ ID NO: 32796 - DNA, 20 bp, synthetic construct
  misc_feature 1..20: note = CRISPR gRNA sequence
  source 1..20: mol_type = other DNA
cagagaaaacatgtgatcag

SEQ ID NO: 32797 - DNA, 20 bp, synthetic construct
  misc_feature 1..20: note = CRISPR gRNA sequence
  source 1..20: mol_type = other DNA
ccccagggagaggatgtccc

SEQ ID NO: 32798 - DNA, 20 bp, synthetic construct
  misc_feature 1..20: note = CRISPR gRNA sequence
  source 1..20: mol_type = other DNA
aggactctagcaggctatac

SEQ ID NO: 32799 - DNA, 20 bp, synthetic construct
  misc_feature 1..20: note = CRISPR gRNA sequence
  source 1..20: mol_type = other DNA
tagcaggctatacggcctta

SEQ ID NO: 32800 - DNA, 20 bp, synthetic construct
  misc_feature 1..20: note = CRISPR gRNA sequence
  source 1..20: mol_type = other DNA
gcaggctatacggccttaac

SEQ ID NO: 32801 - DNA, 20 bp, synthetic construct
  misc_feature 1..20: note = CRISPR gRNA sequence
  source 1..20: mol_type = other DNA
tacggccttaacttcaaggc

SEQ ID NO: 32802 - DNA, 20 bp, synthetic construct
  misc_feature 1..20: note = CRISPR gRNA sequence
  source 1..20: mol_type = other DNA
aacttcaaggctgggtagtg

SEQ ID NO: 32803 - DNA, 20 bp, synthetic construct
  misc_feature 1..20: note = CRISPR gRNA sequence
  source 1..20: mol_type = other DNA
acttcaaggctgggtagtgg

SEQ ID NO: 32804 - DNA, 20 bp, synthetic construct
  misc_feature 1..20: note = CRISPR gRNA sequence
  source 1..20: mol_type = other DNA
caaggctgggtagtggtctt

SEQ ID NO: 32805 - DNA, 20 bp, synthetic construct
  misc_feature 1..20: note = CRISPR gRNA sequence
  source 1..20: mol_type = other DNA
aaggctgggtagtggtcttg

SEQ ID NO: 32806 - DNA, 20 bp, synthetic construct
  misc_feature 1..20: note = CRISPR gRNA sequence
  source 1..20: mol_type = other DNA
ggtagtggtcttgggggtcc

SEQ ID NO: 32807 - DNA, 20 bp, synthetic construct
  misc_feature 1..20: note = CRISPR gRNA sequence
  source 1..20: mol_type = other DNA
gggggtccattttcctcccc

SEQ ID NO: 32808 - DNA, 20 bp, synthetic construct
  misc_feature 1..20: note = CRISPR gRNA sequence
  source 1..20: mol_type = other DNA
ggggtccattttcctcccct

SEQ ID NO: 32809 - DNA, 20 bp, synthetic construct
  misc_feature 1..20: note = CRISPR gRNA sequence
  source 1..20: mol_type = other DNA
tcctcccctcgctctaacat

SEQ ID NO: 32810 - DNA, 20 bp, synthetic construct
  misc_feature 1..20: note = CRISPR gRNA sequence
  source 1..20: mol_type = other DNA
cctcccctcgctctaacatt

SEQ ID NO: 32811 - DNA, 20 bp, synthetic construct
  misc_feature 1..20: note = CRISPR gRNA sequence
  source 1..20: mol_type = other DNA
ctcccctcgctctaacattc

SEQ ID NO: 32812 - DNA, 20 bp, synthetic construct
  misc_feature 1..20: note = CRISPR gRNA sequence
  source 1..20: mol_type = other DNA
ccctcgctctaacattccaa

SEQ ID NO: 32813 - DNA, 20 bp, synthetic construct
  misc_feature 1..20: note = CRISPR gRNA sequence
  source 1..20: mol_type = other DNA
gctctaacattccaacccca

SEQ ID NO: 32814 - DNA, 20 bp, synthetic construct
  misc_feature 1..20: note = CRISPR gRNA sequence
  source 1..20: mol_type = other DNA
taacattccaaccccagctc

SEQ ID NO: 32815 - DNA, 20 bp, synthetic construct
  misc_feature 1..20: note = CRISPR gRNA sequence
  source 1..20: mol_type = other DNA
acattccaaccccagctcct

SEQ ID NO: 32816 - DNA, 20 bp, synthetic construct
  misc_feature 1..20: note = CRISPR gRNA sequence
  source 1..20: mol_type = other DNA
caaccccagctccttggctt

SEQ ID NO: 32817 - DNA, 20 bp, synthetic construct
  misc_feature 1..20: note = CRISPR gRNA sequence
  source 1..20: mol_type = other DNA
cttggcttgaacccaaaccc

SEQ ID NO: 32818 - DNA, 20 bp, synthetic construct
  misc_feature 1..20: note = CRISPR gRNA sequence
  source 1..20: mol_type = other DNA
ggcttgaacccaaaccccat

SEQ ID NO: 32819 - DNA, 20 bp, synthetic construct
  misc_feature 1..20: note = CRISPR gRNA sequence
  source 1..20: mol_type = other DNA
gcttgaacccaaaccccatc

SEQ ID NO: 32820 - DNA, 20 bp, synthetic construct
  misc_feature 1..20: note = CRISPR gRNA sequence
  source 1..20: mol_type = other DNA
gaacccaaaccccatctcaa

SEQ ID NO: 32821 - DNA, 20 bp, synthetic construct
  misc_feature 1..20: note = CRISPR gRNA sequence
  source 1..20: mol_type = other DNA
aacccaaaccccatctcaaa

SEQ ID NO: 32822 - DNA, 20 bp, synthetic construct
  misc_feature 1..20: note = CRISPR gRNA sequence
  source 1..20: mol_type = other DNA
aaaccataccaggcagtgta

SEQ ID NO: 32823 - DNA, 20 bp, synthetic construct
  misc_feature 1..20: note = CRISPR gRNA sequence
  source 1..20: mol_type = other DNA
gagccaaaaaacaaaacaaa

SEQ ID NO: 32824 - DNA, 20 bp, synthetic construct
  misc_feature 1..20: note = CRISPR gRNA sequence
  source 1..20: mol_type = other DNA
agccaaaaaacaaaacaaaa

SEQ ID NO: 32825 - DNA, 20 bp, synthetic construct
  misc_feature 1..20: note = CRISPR gRNA sequence
  source 1..20: mol_type = other DNA
cttttgaaccgcttcctagc

SEQ ID NO: 32826 - DNA, 20 bp, synthetic construct
  misc_feature 1..20: note = CRISPR gRNA sequence
  source 1..20: mol_type = other DNA
ttgaaccgcttcctagctgt

SEQ ID NO: 32827 - DNA, 20 bp, synthetic construct
  misc_feature 1..20: note = CRISPR gRNA sequence
  source 1..20: mol_type = other DNA
tgaaccgcttcctagctgtg

SEQ ID NO: 32828 - DNA, 20 bp, synthetic construct
  misc_feature 1..20: note = CRISPR gRNA sequence
  source 1..20: mol_type = other DNA
gaaccgcttcctagctgtgt

SEQ ID NO: 32829 - DNA, 20 bp, synthetic construct
  misc_feature 1..20: note = CRISPR gRNA sequence
  source 1..20: mol_type = other DNA
aaccgcttcctagctgtgtg

SEQ ID NO: 32830 - DNA, 20 bp, synthetic construct
  misc_feature 1..20: note = CRISPR gRNA sequence
  source 1..20: mol_type = other DNA
cctagctgtgtgcctttgca

SEQ ID NO: 32831 - DNA, 20 bp, synthetic construct
  misc_feature 1..20: note = CRISPR gRNA sequence
  source 1..20: mol_type = other DNA
ctagctgtgtgcctttgcaa

SEQ ID NO: 32832 - DNA, 20 bp, synthetic construct
  misc_feature 1..20: note = CRISPR gRNA sequence
  source 1..20: mol_type = other DNA
gctgtgtgcctttgcaatgc

SEQ ID NO: 32833 - DNA, 20 bp, synthetic construct
  misc_feature 1..20: note = CRISPR gRNA sequence
  source 1..20: mol_type = other DNA
tgtgcctttgcaatgcagct

SEQ ID NO: 32834 - DNA, 20 bp, synthetic construct
  misc_feature 1..20: note = CRISPR gRNA sequence
  source 1..20: mol_type = other DNA
tgcaatgcagcttctctgaa

SEQ ID NO: 32835 - DNA, 20 bp, synthetic construct
  misc_feature 1..20: note = CRISPR gRNA sequence
  source 1..20: mol_type = other DNA
gcaatgcagcttctctgaac

SEQ ID NO: 32836 - DNA, 20 bp, synthetic construct
  misc_feature 1..20: note = CRISPR gRNA sequence
  source 1..20: mol_type = other DNA
caatgcagcttctctgaacc

SEQ ID NO: 32837 - DNA, 20 bp, synthetic construct
  misc_feature 1..20: note = CRISPR gRNA sequence
  source 1..20: mol_type = other DNA
ctctgaacctttgatctcac

SEQ ID NO: 32838 - DNA, 20 bp, synthetic construct
  misc_feature 1..20: note = CRISPR gRNA sequence
  source 1..20: mol_type = other DNA
tctgaacctttgatctcaca

SEQ ID NO: 32839 - DNA, 20 bp, synthetic construct
  misc_feature 1..20: note = CRISPR gRNA sequence
  source 1..20: mol_type = other DNA
tgaacctttgatctcacatc

SEQ ID NO: 32840 - DNA, 20 bp, synthetic construct
  misc_feature 1..20: note = CRISPR gRNA sequence
  source 1..20: mol_type = other DNA
aacctttgatctcacatcta

SEQ ID NO: 32841 - DNA, 20 bp, synthetic construct
  misc_feature 1..20: note = CRISPR gRNA sequence
  source 1..20: mol_type = other DNA
tgatctcacatctatgaaat

SEQ ID NO: 32842 - DNA, 20 bp, synthetic construct
  misc_feature 1..20: note = CRISPR gRNA sequence
  source 1..20: mol_type = other DNA
gatctcacatctatgaaatg

SEQ ID NO: 32843 - DNA, 20 bp, synthetic construct
  misc_feature 1..20: note = CRISPR gRNA sequence
  source 1..20: mol_type = other DNA
atctcacatctatgaaatgg

SEQ ID NO: 32844 - DNA, 20 bp, synthetic construct
  misc_feature 1..20: note = CRISPR gRNA sequence
  source 1..20: mol_type = other DNA
acatctatgaaatgggggtg

SEQ ID NO: 32845 - DNA, 20 bp, synthetic construct
  misc_feature 1..20: note = CRISPR gRNA sequence
  source 1..20: mol_type = other DNA
tgaaatgggggtggtggttc

SEQ ID NO: 32846 - DNA, 20 bp, synthetic construct
  misc_feature 1..20: note = CRISPR gRNA sequence
  source 1..20: mol_type = other DNA
ctacattgcaggagtatgcc

SEQ ID NO: 32847 - DNA, 20 bp, synthetic construct
  misc_feature 1..20: note = CRISPR gRNA sequence
  source 1..20: mol_type = other DNA
cattgcaggagtatgccaga

SEQ ID NO: 32848 - DNA, 20 bp, synthetic construct
  misc_feature 1..20: note = CRISPR gRNA sequence
  source 1..20: mol_type = other DNA
caggagtatgccagaaatca

SEQ ID NO: 32849 - DNA, 20 bp, synthetic construct
  misc_feature 1..20: note = CRISPR gRNA sequence
  source 1..20: mol_type = other DNA
acagcaacagattaaaaacc

SEQ ID NO: 32850 - DNA, 20 bp, synthetic construct
  misc_feature 1..20: note = CRISPR gRNA sequence
  source 1..20: mol_type = other DNA
aaaacccacgtgtcccttag

SEQ ID NO: 32851 - DNA, 20 bp, synthetic construct
  misc_feature 1..20: note = CRISPR gRNA sequence
  source 1..20: mol_type = other DNA
agcaagggactgcttaaaca

SEQ ID NO: 32852 - DNA, 20 bp, synthetic construct
  misc_feature 1..20: note = CRISPR gRNA sequence
  source 1..20: mol_type = other DNA
gcaagggactgcttaaacaa

SEQ ID NO: 32853 - DNA, 20 bp, synthetic construct
  misc_feature 1..20: note = CRISPR gRNA sequence
  source 1..20: mol_type = other DNA
cttaaacaaattatggttca

SEQ ID NO: 32854 - DNA, 20 bp, synthetic construct
  misc_feature 1..20: note = CRISPR gRNA sequence
  source 1..20: mol_type = other DNA
aaacaaattatggttcatct

SEQ ID NO: 32855 - DNA, 20 bp, synthetic construct
  misc_feature 1..20: note = CRISPR gRNA sequence
  source 1..20: mol_type = other DNA
aacaaattatggttcatcta

SEQ ID NO: 32856 - DNA, 20 bp, synthetic construct
  misc_feature 1..20: note = CRISPR gRNA sequence
  source 1..20: mol_type = other DNA
tggttcatctacccaacgaa

SEQ ID NO: 32857 - DNA, 20 bp, synthetic construct
  misc_feature 1..20: note = CRISPR gRNA sequence
  source 1..20: mol_type = other DNA
atctacccaacgaaacactg

SEQ ID NO: 32858 - DNA, 20 bp, synthetic construct
  misc_feature 1..20: note = CRISPR gRNA sequence
  source 1..20: mol_type = other DNA
cccaacgaaacactgcatgg

SEQ ID NO: 32859 - DNA, 20 bp, synthetic construct
  misc_feature 1..20: note = CRISPR gRNA sequence
  source 1..20: mol_type = other DNA
catggccttaaaagaaagga

SEQ ID NO: 32860 - DNA, 20 bp, synthetic construct
  misc_feature 1..20: note = CRISPR gRNA sequence
  source 1..20: mol_type = other DNA
aaaagaaaggatgctgaagt

SEQ ID NO: 32861 - DNA, 20 bp, synthetic construct
  misc_feature 1..20: note = CRISPR gRNA sequence
  source 1..20: mol_type = other DNA
aaagaaaggatgctgaagta

SEQ ID NO: 32862 - DNA, 20 bp, synthetic construct
  misc_feature 1..20: note = CRISPR gRNA sequence
  source 1..20: mol_type = other DNA
aagtacacgaggggagtgta

SEQ ID NO: 32863 - DNA, 20 bp, synthetic construct
  misc_feature 1..20: note = CRISPR gRNA sequence
  source 1..20: mol_type = other DNA
caatttacatttgaaatgta

SEQ ID NO: 32864 - DNA, 20 bp, synthetic construct
  misc_feature 1..20: note = CRISPR gRNA sequence
  source 1..20: mol_type = other DNA
acatttgaaatgtacattga

SEQ ID NO: 32865 - DNA, 20 bp, synthetic construct
  misc_feature 1..20: note = CRISPR gRNA sequence
  source 1..20: mol_type = other DNA
catttgaaatgtacattgaa

SEQ ID NO: 32866 - DNA, 20 bp, synthetic construct
  misc_feature 1..20: note = CRISPR gRNA sequence
  source 1..20: mol_type = other DNA
gaaatgtacattgaaatgta

SEQ ID NO: 32867 - DNA, 20 bp, synthetic construct
  misc_feature 1..20: note = CRISPR gRNA sequence
  source 1..20: mol_type = other DNA
aaatgtacattgaaatgtac

SEQ ID NO: 32868 - DNA, 20 bp, synthetic construct
  misc_feature 1..20: note = CRISPR gRNA sequence
  source 1..20: mol_type = other DNA
aaatgtaccaaaaatataat

SEQ ID NO: 32869 - DNA, 20 bp, synthetic construct
  misc_feature 1..20: note = CRISPR gRNA sequence
  source 1..20: mol_type = other DNA
attgtagaatcaaaatggta

SEQ ID NO: 32870 - DNA, 20 bp, synthetic construct
  misc_feature 1..20: note = CRISPR gRNA sequence
  source 1..20: mol_type = other DNA
tagaatcaaaatggtacatg

SEQ ID NO: 32871 - DNA, 20 bp, synthetic construct
  misc_feature 1..20: note = CRISPR gRNA sequence
  source 1..20: mol_type = other DNA
catagtaccattctttcact

SEQ ID NO: 32872 - DNA, 20 bp, synthetic construct
  misc_feature 1..20: note = CRISPR gRNA sequence
  source 1..20: mol_type = other DNA
atagtaccattctttcactt

SEQ ID NO: 32873 - DNA, 20 bp, synthetic construct
  misc_feature 1..20: note = CRISPR gRNA sequence
  source 1..20: mol_type = other DNA
tttcacttttattgtatctt

SEQ ID NO: 32874 - DNA, 20 bp, synthetic construct
  misc_feature 1..20: note = CRISPR gRNA sequence
  source 1..20: mol_type = other DNA
tcacttttattgtatcttga

SEQ ID NO: 32875 - DNA, 20 bp, synthetic construct
  misc_feature 1..20: note = CRISPR gRNA sequence
  source 1..20: mol_type = other DNA
cacttttattgtatcttgaa

SEQ ID NO: 32876 - DNA, 20 bp, synthetic construct
  misc_feature 1..20: note = CRISPR gRNA sequence
  source 1..20: mol_type = other DNA
acttttattgtatcttgaaa

SEQ ID NO: 32877 - DNA, 20 bp, synthetic construct
  misc_feature 1..20: note = CRISPR gRNA sequence
  source 1..20: mol_type = other DNA
ttattgtatcttgaaaacat

SEQ ID NO: 32878 - DNA, 20 bp, synthetic construct
  misc_feature 1..20: note = CRISPR gRNA sequence
  source 1..20: mol_type = other DNA
tattgtatcttgaaaacatt

SEQ ID NO: 32879 - DNA, 20 bp, synthetic construct
  misc_feature 1..20: note = CRISPR gRNA sequence
  source 1..20: mol_type = other DNA
attgtatcttgaaaacattt

SEQ ID NO: 32880 - DNA, 20 bp, synthetic construct
  misc_feature 1..20: note = CRISPR gRNA sequence
  source 1..20: mol_type = other DNA
ttgtatcttgaaaacatttt

SEQ ID NO: 32881 - DNA, 20 bp, synthetic construct
  misc_feature 1..20: note = CRISPR gRNA sequence
  source 1..20: mol_type = other DNA
tatcttgaaaacattttttt

SEQ ID NO: 32882 - DNA, 20 bp, synthetic construct
  misc_feature 1..20: note = CRISPR gRNA sequence
  source 1..20: mol_type = other DNA
gaaaacattttttttttttt

SEQ ID NO: 32883 - DNA, 20 bp, synthetic construct
  misc_feature 1..20: note = CRISPR gRNA sequence
  source 1..20: mol_type = other DNA
aaaacatttttttttttttt

SEQ ID NO: 32884 - DNA, 20 bp, synthetic construct
  misc_feature 1..20: note = CRISPR gRNA sequence
  source 1..20: mol_type = other DNA
ttttttttttttgaaacaga

SEQ ID NO: 32885 - DNA, 20 bp, synthetic construct
  misc_feature 1..20: note = CRISPR gRNA sequence
  source 1..20: mol_type = other DNA
tttttttttttgaaacagag

SEQ ID NO: 32886 - DNA, 20 bp, synthetic construct
  misc_feature 1..20: note = CRISPR gRNA sequence
  source 1..20: mol_type = other DNA
ttttttttttgaaacagagt

SEQ ID NO: 32887 - DNA, 20 bp, synthetic construct
  misc_feature 1..20: note = CRISPR gRNA sequence
  source 1..20: mol_type = other DNA
tttttttttgaaacagagtc

SEQ ID NO: 32888 - DNA, 20 bp, synthetic construct
  misc_feature 1..20: note = CRISPR gRNA sequence
  source 1..20: mol_type = other DNA
ttttttttgaaacagagtct

SEQ ID NO: 32889 - DNA, 20 bp, synthetic construct
  misc_feature 1..20: note = CRISPR gRNA sequence
  source 1..20: mol_type = other DNA
tttttttgaaacagagtcta

SEQ ID NO: 32890 - DNA, 20 bp, synthetic construct
  misc_feature 1..20: note = CRISPR gRNA sequence
  source 1..20: mol_type = other DNA
ttttttgaaacagagtctag

SEQ ID NO: 32891 - DNA, 20 bp, synthetic construct
  misc_feature 1..20: note = CRISPR gRNA sequence
  source 1..20: mol_type = other DNA
tttttgaaacagagtctagc

SEQ ID NO: 32892 - DNA, 20 bp, synthetic construct
  misc_feature 1..20: note = CRISPR gRNA sequence
  source 1..20: mol_type = other DNA
ttttgaaacagagtctagct

SEQ ID NO: 32893 - DNA, 20 bp, synthetic construct
  misc_feature 1..20: note = CRISPR gRNA sequence
  source 1..20: mol_type = other DNA
tttgaaacagagtctagctc

SEQ ID NO: 32894 - DNA, 20 bp, synthetic construct
  misc_feature 1..20: note = CRISPR gRNA sequence
  source 1..20: mol_type = other DNA
ttgaaacagagtctagctct

SEQ ID NO: 32895 - DNA, 20 bp, synthetic construct
  misc_feature 1..20: note = CRISPR gRNA sequence
  source 1..20: mol_type = other DNA
tgaaacagagtctagctctg

SEQ ID NO: 32896 - DNA, 20 bp, synthetic construct
  misc_feature 1..20: note = CRISPR gRNA sequence
  source 1..20: mol_type = other DNA
gaaacagagtctagctctgt

SEQ ID NO: 32897 - DNA, 20 bp, synthetic construct
  misc_feature 1..20: note = CRISPR gRNA sequence
  source 1..20: mol_type = other DNA
aaacagagtctagctctgtt

SEQ ID NO: 32898 - DNA, 20 bp, synthetic construct
  misc_feature 1..20: note = CRISPR gRNA sequence
  source 1..20: mol_type = other DNA
gctctgttgcccaggctgga

SEQ ID NO: 32899 - DNA, 20 bp, synthetic construct
  misc_feature 1..20: note = CRISPR gRNA sequence
  source 1..20: mol_type = other DNA
tgttgcccaggctggagtgc

SEQ ID NO: 32900 - DNA, 20 bp, synthetic construct
  misc_feature 1..20: note = CRISPR gRNA sequence
  source 1..20: mol_type = other DNA
ttgcccaggctggagtgcac

SEQ ID NO: 32901 - DNA, 20 bp, synthetic construct
  misc_feature 1..20: note = CRISPR gRNA sequence
  source 1..20: mol_type = other DNA
cccaggctggagtgcactgg

SEQ ID NO: 32902 - DNA, 20 bp, synthetic construct
  misc_feature 1..20: note = CRISPR gRNA sequence
  source 1..20: mol_type = other DNA
gagtgcactggcgcaatctt

SEQ ID NO: 32903 - DNA, 20 bp, synthetic construct
  misc_feature 1..20: note = CRISPR gRNA sequence
  source 1..20: mol_type = other DNA
gcgcaatcttggctcactgc

SEQ ID NO: 32904 - DNA, 20 bp, synthetic construct
  misc_feature 1..20: note = CRISPR gRNA sequence
  source 1..20: mol_type = other DNA
ggctcactgcaacctctgct

SEQ ID NO: 32905 - DNA, 20 bp, synthetic construct
  misc_feature 1..20: note = CRISPR gRNA sequence
  source 1..20: mol_type = other DNA
gctcactgcaacctctgctt

SEQ ID NO: 32906 - DNA, 20 bp, synthetic construct
  misc_feature 1..20: note = CRISPR gRNA sequence
  source 1..20: mol_type = other DNA
actgcaacctctgcttctta

SEQ ID NO: 32907 - DNA, 20 bp, synthetic construct
  misc_feature 1..20: note = CRISPR gRNA sequence
  source 1..20: mol_type = other DNA
caacctctgcttcttaggtt

SEQ ID NO: 32908 - DNA, 20 bp, synthetic construct
  misc_feature 1..20: note = CRISPR gRNA sequence
  source 1..20: mol_type = other DNA
tgcttcttaggttcaagcga

SEQ ID NO: 32909 - DNA, 20 bp, synthetic construct
  misc_feature 1..20: note = CRISPR gRNA sequence
  source 1..20: mol_type = other DNA
cttcttaggttcaagcgatt

SEQ ID NO: 32910 - DNA, 20 bp, synthetic construct
  misc_feature 1..20: note = CRISPR gRNA sequence
  source 1..20: mol_type = other DNA
cttaggttcaagcgattctc

SEQ ID NO: 32911 - DNA, 20 bp, synthetic construct
  misc_feature 1..20: note = CRISPR gRNA sequence
  source 1..20: mol_type = other DNA
ttaggttcaagcgattctcc

SEQ ID NO: 32912 - DNA, 20 bp, synthetic construct
  misc_feature 1..20: note = CRISPR gRNA sequence
  source 1..20: mol_type = other DNA
aggttcaagcgattctccca

SEQ ID NO: 32913 - DNA, 20 bp, synthetic construct
  misc_feature 1..20: note = CRISPR gRNA sequence
  source 1..20: mol_type = other DNA
ggttcaagcgattctcccac

SEQ ID NO: 32914 - DNA, 20 bp, synthetic construct
  misc_feature 1..20: note = CRISPR gRNA sequence
  source 1..20: mol_type = other DNA
aagcgattctcccaccctag

SEQ ID NO: 32915 - DNA, 20 bp, synthetic construct
  misc_feature 1..20: note = CRISPR gRNA sequence
  source 1..20: mol_type = other DNA
tcccaccctagcctccctgg

SEQ ID NO: 32916 - DNA, 20 bp, synthetic construct
  misc_feature 1..20: note = CRISPR gRNA sequence
  source 1..20: mol_type = other DNA
ccaccctagcctccctggta

SEQ ID NO: 32917 - DNA, 20 bp, synthetic construct
  misc_feature 1..20: note = CRISPR gRNA sequence
  source 1..20: mol_type = other DNA
gcctccctggtagctgggat

SEQ ID NO: 32918 - DNA, 20 bp, synthetic construct
  misc_feature 1..20: note = CRISPR gRNA sequence
  source 1..20: mol_type = other DNA
cctggtagctgggattacag

SEQ ID NO: 32919 - DNA, 20 bp, synthetic construct
  misc_feature 1..20: note = CRISPR gRNA sequence
  source 1..20: mol_type = other DNA
gtagctgggattacaggtgt

SEQ ID NO: 32920 - DNA, 20 bp, synthetic construct
  misc_feature 1..20: note = CRISPR gRNA sequence
  source 1..20: mol_type = other DNA
ggattacaggtgttcgccac

SEQ ID NO: 32921 - DNA, 20 bp, synthetic construct
  misc_feature 1..20: note = CRISPR gRNA sequence
  source 1..20: mol_type = other DNA
caggtgttcgccaccacgcc

SEQ ID NO: 32922 - DNA, 20 bp, synthetic construct
  misc_feature 1..20: note = CRISPR gRNA sequence
  source 1..20: mol_type = other DNA
gccaccacgcctggctaatt

SEQ ID NO: 32923 - DNA, 20 bp, synthetic construct
  misc_feature 1..20: note = CRISPR gRNA sequence
  source 1..20: mol_type = other DNA
gctaatttttgtatttttag

SEQ ID NO: 32924 - DNA, 20 bp, synthetic construct
  misc_feature 1..20: note = CRISPR gRNA sequence
  source 1..20: mol_type = other DNA
atttttgtatttttagtaga

SEQ ID NO: 32925 - DNA, 20 bp, synthetic construct
  misc_feature 1..20: note = CRISPR gRNA sequence
  source 1..20: mol_type = other DNA
ttgtatttttagtagagatg

SEQ ID NO: 32926 - DNA, 20 bp, synthetic construct
  misc_feature 1..20: note = CRISPR gRNA sequence
  source 1..20: mol_type = other DNA
tgtatttttagtagagatgg

SEQ ID NO: 32927 - DNA, 20 bp, synthetic construct
  misc_feature 1..20: note = CRISPR gRNA sequence
  source 1..20: mol_type = other DNA
gtatttttagtagagatggg

SEQ ID NO: 32928 - DNA, 20 bp, synthetic construct
  misc_feature 1..20: note = CRISPR gRNA sequence
  source 1..20: mol_type = other DNA
tatttttagtagagatgggg

SEQ ID NO: 32929 - DNA, 20 bp, synthetic construct
  misc_feature 1..20: note = CRISPR gRNA sequence
  source 1..20: mol_type = other DNA
ttagtagagatggggtttca

SEQ ID NO: 32930 - DNA, 20 bp, synthetic construct
  misc_feature 1..20: note = CRISPR gRNA sequence
  source 1..20: mol_type = other DNA
tagtagagatggggtttcac

SEQ ID NO: 32931 - DNA, 20 bp, synthetic construct
  misc_feature 1..20: note = CRISPR gRNA sequence
  source 1..20: mol_type = other DNA
agtagagatggggtttcacc

SEQ ID NO: 32932 - DNA, 20 bp, synthetic construct
  misc_feature 1..20: note = CRISPR gRNA sequence
  source 1..20: mol_type = other DNA
gtagagatggggtttcacca

SEQ ID NO: 32933 - DNA, 20 bp, synthetic construct
  misc_feature 1..20: note = CRISPR gRNA sequence
  source 1..20: mol_type = other DNA
caccatgttggccaggctgg

SEQ ID NO: 32934 - DNA, 20 bp, synthetic construct
  misc_feature 1..20: note = CRISPR gRNA sequence
  source 1..20: mol_type = other DNA
accatgttggccaggctggt

SEQ ID NO: 32935 - DNA, 20 bp, synthetic construct
  misc_feature 1..20: note = CRISPR gRNA sequence
  source 1..20: mol_type = other DNA
gccaggctggtctcaaactc

SEQ ID NO: 32936 - DNA, 20 bp, synthetic construct
  misc_feature 1..20: note = CRISPR gRNA sequence
  source 1..20: mol_type = other DNA
gtctcaaactcttgacctca

SEQ ID NO: 32937 - DNA, 20 bp, synthetic construct
  misc_feature 1..20: note = CRISPR gRNA sequence
  source 1..20: mol_type = other DNA
aaactcttgacctcaggtga

SEQ ID NO: 32938 - DNA, 20 bp, synthetic construct
  misc_feature 1..20: note = CRISPR gRNA sequence
  source 1..20: mol_type = other DNA
ttgacctcaggtgatctgcc

SEQ ID NO: 32939 - DNA, 20 bp, synthetic construct
  misc_feature 1..20: note = CRISPR gRNA sequence
  source 1..20: mol_type = other DNA
gacctcaggtgatctgccag

SEQ ID NO: 32940 - DNA, 20 bp, synthetic construct
  misc_feature 1..20: note = CRISPR gRNA sequence
  source 1..20: mol_type = other DNA
acctcaggtgatctgccagc

SEQ ID NO: 32941 - DNA, 20 bp, synthetic construct
  misc_feature 1..20: note = CRISPR gRNA sequence
  source 1..20: mol_type = other DNA
aggtgatctgccagccttgg

SEQ ID NO: 32942 - DNA, 20 bp, synthetic construct
  misc_feature 1..20: note = CRISPR gRNA sequence
  source 1..20: mol_type = other DNA
ccagccttggcctcccaaag

SEQ ID NO: 32943 - DNA, 20 bp, synthetic construct
  misc_feature 1..20: note = CRISPR gRNA sequence
  source 1..20: mol_type = other DNA
ggcctcccaaagtgctggga

SEQ ID NO: 32944 - DNA, 20 bp, synthetic construct
  misc_feature 1..20: note = CRISPR gRNA sequence
  source 1..20: mol_type = other DNA
gcctcccaaagtgctgggat

SEQ ID NO: 32945 - DNA, 20 bp, synthetic construct
  misc_feature 1..20: note = CRISPR gRNA sequence
  source 1..20: mol_type = other DNA
ccaaagtgctgggattacag

SEQ ID NO: 32946 - DNA, 20 bp, synthetic construct
  misc_feature 1..20: note = CRISPR gRNA sequence
  source 1..20: mol_type = other DNA
ggattacagatgtgagccac

SEQ ID NO: 32947 - DNA, 20 bp, synthetic construct
  misc_feature 1..20: note = CRISPR gRNA sequence
  source 1..20: mol_type = other DNA
cagatgtgagccaccacgcc

SEQ ID NO: 32948 - DNA, 20 bp, synthetic construct
  misc_feature 1..20: note = CRISPR gRNA sequence
  source 1..20: mol_type = other DNA
gccgaaaactttcacaataa

SEQ ID NO: 32949 - DNA, 20 bp, synthetic construct
  misc_feature 1..20: note = CRISPR gRNA sequence
  source 1..20: mol_type = other DNA
tcacaataaaatcttggggg

SEQ ID NO: 32950 - DNA, 20 bp, synthetic construct
  misc_feature 1..20: note = CRISPR gRNA sequence
  source 1..20: mol_type = other DNA
cacaataaaatcttgggggg

SEQ ID NO: 32951 - DNA, 20 bp, synthetic construct
  misc_feature 1..20: note = CRISPR gRNA sequence
  source 1..20: mol_type = other DNA
acaataaaatcttgggggga

SEQ ID NO: 32952 - DNA, 20 bp, synthetic construct
  misc_feature 1..20: note = CRISPR gRNA sequence
  source 1..20: mol_type = other DNA
ggggggaaatatttatcaaa

SEQ ID NO: 32953 - DNA, 20 bp, synthetic construct
  misc_feature 1..20: note = CRISPR gRNA sequence
  source 1..20: mol_type = other DNA
gggggaaatatttatcaaat

SEQ ID NO: 32954 - DNA, 20 bp, synthetic construct
  misc_feature 1..20: note = CRISPR gRNA sequence
  source 1..20: mol_type = other DNA
atcaaatgaaaacataaaga

SEQ ID NO: 32955 - DNA, 20 bp, synthetic construct
  misc_feature 1..20: note = CRISPR gRNA sequence
  source 1..20: mol_type = other DNA
tcaaatgaaaacataaagaa

SEQ ID NO: 32956 - DNA, 20 bp, synthetic construct
  misc_feature 1..20: note = CRISPR gRNA sequence
  source 1..20: mol_type = other DNA
ctgaagataggaccgtgtcc

SEQ ID NO: 32957 - DNA, 20 bp, synthetic construct
  misc_feature 1..20: note = CRISPR gRNA sequence
  source 1..20: mol_type = other DNA
aagataggaccgtgtcctct

SEQ ID NO: 32958 - DNA, 20 bp, synthetic construct
  misc_feature 1..20: note = CRISPR gRNA sequence
  source 1..20: mol_type = other DNA
tccctcaataatatggaacg

SEQ ID NO: 32959 - DNA, 20 bp, synthetic construct
  misc_feature 1..20: note = CRISPR gRNA sequence
  source 1..20: mol_type = other DNA
cctcaataatatggaacgtg

SEQ ID NO: 32960 - DNA, 20 bp, synthetic construct
  misc_feature 1..20: note = CRISPR gRNA sequence
  source 1..20: mol_type = other DNA
aataatatggaacgtgacct

SEQ ID NO: 32961 - DNA, 20 bp, synthetic construct
  misc_feature 1..20: note = CRISPR gRNA sequence
  source 1..20: mol_type = other DNA
ccagacagggagtaatgaag

SEQ ID NO: 32962 - DNA, 20 bp, synthetic construct
  misc_feature 1..20: note = CRISPR gRNA sequence
  source 1..20: mol_type = other DNA
gcatggaaaattaaagcaaa

SEQ ID NO: 32963 - DNA, 20 bp, synthetic construct
  misc_feature 1..20: note = CRISPR gRNA sequence
  source 1..20: mol_type = other DNA
catggaaaattaaagcaaat

SEQ ID NO: 32964 - DNA, 20 bp, synthetic construct
  misc_feature 1..20: note = CRISPR gRNA sequence
  source 1..20: mol_type = other DNA
aagcaaatacaggagctcgc

SEQ ID NO: 32965 - DNA, 20 bp, synthetic construct
  misc_feature 1..20: note = CRISPR gRNA sequence
  source 1..20: mol_type = other DNA
gctttatttctgacaaggca

SEQ ID NO: 32966 - DNA, 20 bp, synthetic construct
  misc_feature 1..20: note = CRISPR gRNA sequence
  source 1..20: mol_type = other DNA
tatttctgacaaggcaaaaa

SEQ ID NO: 32967 - DNA, 20 bp, synthetic construct
  misc_feature 1..20: note = CRISPR gRNA sequence
  source 1..20: mol_type = other DNA
atttctgacaaggcaaaaag

SEQ ID NO: 32968 - DNA, 20 bp, synthetic construct
  misc_feature 1..20: note = CRISPR gRNA sequence
  source 1..20: mol_type = other DNA
tttctgacaaggcaaaaagg

SEQ ID NO: 32969 - DNA, 20 bp, synthetic construct
  misc_feature 1..20: note = CRISPR gRNA sequence
  source 1..20: mol_type = other DNA
ctgacaaggcaaaaaggaag

SEQ ID NO: 32970 - DNA, 20 bp, synthetic construct
  misc_feature 1..20: note = CRISPR gRNA sequence
  source 1..20: mol_type = other DNA
tgacaaggcaaaaaggaagc

SEQ ID NO: 32971 - DNA, 20 bp, synthetic construct
  misc_feature 1..20: note = CRISPR gRNA sequence
  source 1..20: mol_type = other DNA
acaaggcaaaaaggaagctg

SEQ ID NO: 32972 - DNA, 20 bp, synthetic construct
  misc_feature 1..20: note = CRISPR gRNA sequence
  source 1..20: mol_type = other DNA
gtcacataggttgactaaga

SEQ ID NO: 32973 - DNA, 20 bp, synthetic construct
  misc_feature 1..20: note = CRISPR gRNA sequence
  source 1..20: mol_type = other DNA
actaagataggagcaaaact

SEQ ID NO: 32974 - DNA, 20 bp, synthetic construct
  misc_feature 1..20: note = CRISPR gRNA sequence
  source 1..20: mol_type = other DNA
agataggagcaaaactgagg

SEQ ID NO: 32975 - DNA, 20 bp, synthetic construct
  misc_feature 1..20: note = CRISPR gRNA sequence
  source 1..20: mol_type = other DNA
agggactacagaacaggagt

SEQ ID NO: 32976 - DNA, 20 bp, synthetic construct
  misc_feature 1..20: note = CRISPR gRNA sequence
  source 1..20: mol_type = other DNA
cagaacaggagtgggaggga

SEQ ID NO: 32977 - DNA, 20 bp, synthetic construct
  misc_feature 1..20: note = CRISPR gRNA sequence
  source 1..20: mol_type = other DNA
ttttttcactgaatattctt

SEQ ID NO: 32978 - DNA, 20 bp, synthetic construct
  misc_feature 1..20: note = CRISPR gRNA sequence
  source 1..20: mol_type = other DNA
tttttcactgaatattcttt

SEQ ID NO: 32979 - DNA, 20 bp, synthetic construct
  misc_feature 1..20: note = CRISPR gRNA sequence
  source 1..20: mol_type = other DNA
ttttcactgaatattctttt

SEQ ID NO: 32980 - DNA, 20 bp, synthetic construct
  misc_feature 1..20: note = CRISPR gRNA sequence
  source 1..20: mol_type = other DNA
tttcactgaatattcttttg

SEQ ID NO: 32981 - DNA, 20 bp, synthetic construct
  misc_feature 1..20: note = CRISPR gRNA sequence
  source 1..20: mol_type = other DNA
ttcactgaatattcttttgg

SEQ ID NO: 32982 - DNA, 20 bp, synthetic construct
  misc_feature 1..20: note = CRISPR gRNA sequence
  source 1..20: mol_type = other DNA
tcactgaatattcttttggt

SEQ ID NO: 32983 - DNA, 20 bp, synthetic construct
  misc_feature 1..20: note = CRISPR gRNA sequence
  source 1..20: mol_type = other DNA
cactgaatattcttttggtt

SEQ ID NO: 32984 - DNA, 20 bp, synthetic construct
  misc_feature 1..20: note = CRISPR gRNA sequence
  source 1..20: mol_type = other DNA
actgaatattcttttggttg

SEQ ID NO: 32985 - DNA, 20 bp, synthetic construct
  misc_feature 1..20: note = CRISPR gRNA sequence
  source 1..20: mol_type = other DNA
aatattcttttggttgttgt

SEQ ID NO: 32986 - DNA, 20 bp, synthetic construct
  misc_feature 1..20: note = CRISPR gRNA sequence
  source 1..20: mol_type = other DNA
ttttggttgttgttgtttga

SEQ ID NO: 32987 - DNA, 20 bp, synthetic construct
  misc_feature 1..20: note = CRISPR gRNA sequence
  source 1..20: mol_type = other DNA
ttggttgttgttgtttgaga

SEQ ID NO: 32988 - DNA, 20 bp, synthetic construct
  misc_feature 1..20: note = CRISPR gRNA sequence
  source 1..20: mol_type = other DNA
tggttgttgttgtttgagac

SEQ ID NO: 32989 - DNA, 20 bp, synthetic construct
  misc_feature 1..20: note = CRISPR gRNA sequence
  source 1..20: mol_type = other DNA
ggttgttgttgtttgagaca

SEQ ID NO: 32990 - DNA, 20 bp, synthetic construct
  misc_feature 1..20: note = CRISPR gRNA sequence
  source 1..20: mol_type = other DNA
gttgttgttgtttgagacag

SEQ ID NO: 32991 - DNA, 20 bp, synthetic construct
  misc_feature 1..20: note = CRISPR gRNA sequence
  source 1..20: mol_type = other DNA
ttgttgtttgagacagagtc

SEQ ID NO: 32992 - DNA, 20 bp, synthetic construct
  misc_feature 1..20: note = CRISPR gRNA sequence
  source 1..20: mol_type = other DNA
ttgtttgagacagagtctta

SEQ ID NO: 32993 - DNA, 20 bp, synthetic construct
  misc_feature 1..20: note = CRISPR gRNA sequence
  source 1..20: mol_type = other DNA
tttgagacagagtcttactc

SEQ ID NO: 32994 - DNA, 20 bp, synthetic construct
  misc_feature 1..20: note = CRISPR gRNA sequence
  source 1..20: mol_type = other DNA
gagacagagtcttactctgc

SEQ ID NO: 32995 - DNA, 20 bp, synthetic construct
  misc_feature 1..20: note = CRISPR gRNA sequence
  source 1..20: mol_type = other DNA
agacagagtcttactctgcc

SEQ ID NO: 32996 - DNA, 20 bp, synthetic construct
  misc_feature 1..20: note = CRISPR gRNA sequence
  source 1..20: mol_type = other DNA
actctgccacccaggctgga

SEQ ID NO: 32997 - DNA, 20 bp, synthetic construct
  misc_feature 1..20: note = CRISPR gRNA sequence
  source 1..20: mol_type = other DNA
ctctgccacccaggctggag

SEQ ID NO: 32998 - DNA, 20 bp, synthetic construct
  misc_feature 1..20: note = CRISPR gRNA sequence
  source 1..20: mol_type = other DNA
tgccacccaggctggagtgc

SEQ ID NO: 32999 - DNA, 20 bp, synthetic construct
  misc_feature 1..20: note = CRISPR gRNA sequence
  source 1..20: mol_type = other DNA
ccacccaggctggagtgcag

SEQ ID NO: 33000 - DNA, 20 bp, synthetic construct
  misc_feature 1..20: note = CRISPR gRNA sequence
  source 1..20: mol_type = other DNA
gagtgcagtggcgtgatctt

SEQ ID NO: 33001 - DNA, 20 bp, synthetic construct
  misc_feature 1..20: note = CRISPR gRNA sequence
  source 1..20: mol_type = other DNA
agctcactgcaacctccacc

SEQ ID NO: 33002 - DNA, 20 bp, synthetic construct
  misc_feature 1..20: note = CRISPR gRNA sequence
  source 1..20: mol_type = other DNA
gctcactgcaacctccacct

SEQ ID NO: 33003 - DNA, 20 bp, synthetic construct
  misc_feature 1..20: note = CRISPR gRNA sequence
  source 1..20: mol_type = other DNA
actgcaacctccacctcctg

SEQ ID NO: 33004 - DNA, 20 bp, synthetic construct
  misc_feature 1..20: note = CRISPR gRNA sequence
  source 1..20: mol_type = other DNA
caacctccacctcctgggtt

SEQ ID NO: 33005 - DNA, 20 bp, synthetic construct
  misc_feature 1..20: note = CRISPR gRNA sequence
  source 1..20: mol_type = other DNA
cacctcctgggttcaagcga

SEQ ID NO: 33006 - DNA, 20 bp, synthetic construct
  misc_feature 1..20: note = CRISPR gRNA sequence
  source 1..20: mol_type = other DNA
ctgggttcaagcgattctcc

SEQ ID NO: 33007 - DNA, 20 bp, synthetic construct
  misc_feature 1..20: note = CRISPR gRNA sequence
  source 1..20: mol_type = other DNA
ggttcaagcgattctcctgc

SEQ ID NO: 33008 - DNA, 20 bp, synthetic construct
  misc_feature 1..20: note = CRISPR gRNA sequence
  source 1..20: mol_type = other DNA
aagcgattctcctgcctcag

SEQ ID NO: 33009 - DNA, 20 bp, synthetic construct
  misc_feature 1..20: note = CRISPR gRNA sequence
  source 1..20: mol_type = other DNA
tcctgcctcagcctcccgag

SEQ ID NO: 33010 - DNA, 20 bp, synthetic construct
  misc_feature 1..20: note = CRISPR gRNA sequence
  source 1..20: mol_type = other DNA
ctgcctcagcctcccgagta

SEQ ID NO: 33011 - DNA, 20 bp, synthetic construct
  misc_feature 1..20: note = CRISPR gRNA sequence
  source 1..20: mol_type = other DNA
cctcagcctcccgagtagct

SEQ ID NO: 33012 - DNA, 20 bp, synthetic construct
  misc_feature 1..20: note = CRISPR gRNA sequence
  source 1..20: mol_type = other DNA
agcctcccgagtagctggga

SEQ ID NO: 33013 - DNA, 20 bp, synthetic construct
  misc_feature 1..20: note = CRISPR gRNA sequence
  source 1..20: mol_type = other DNA
ccgagtagctgggattacag

SEQ ID NO: 33014 - DNA, 20 bp, synthetic construct
  misc_feature 1..20: note = CRISPR gRNA sequence
  source 1..20: mol_type = other DNA
ggattacaggcgtgcaccac

SEQ ID NO: 33015 - DNA, 20 bp, synthetic construct
  misc_feature 1..20: note = CRISPR gRNA sequence
  source 1..20: mol_type = other DNA
caggcgtgcaccaccacacc

SEQ ID NO: 33016 - DNA, 20 bp, synthetic construct
  misc_feature 1..20: note = CRISPR gRNA sequence
  source 1..20: mol_type = other DNA
atttttgtattttttggtag

SEQ ID NO: 33017 - DNA, 20 bp, synthetic construct
  misc_feature 1..20: note = CRISPR gRNA sequence
  source 1..20: mol_type = other DNA
ttgtattttttggtagagac

SEQ ID NO: 33018 - DNA, 20 bp, synthetic construct
  misc_feature 1..20: note = CRISPR gRNA sequence
  source 1..20: mol_type = other DNA
tgtattttttggtagagacg

SEQ ID NO: 33019 - DNA, 20 bp, synthetic construct
  misc_feature 1..20: note = CRISPR gRNA sequence
  source 1..20: mol_type = other DNA
gtattttttggtagagacgc

SEQ ID NO: 33020 - DNA, 20 bp, synthetic construct
  misc_feature 1..20: note = CRISPR gRNA sequence
  source 1..20: mol_type = other DNA
tattttttggtagagacgcg

SEQ ID NO: 33021 - DNA, 20 bp, synthetic construct
  misc_feature 1..20: note = CRISPR gRNA sequence
  source 1..20: mol_type = other DNA
tttggtagagacgcggtttc

SEQ ID NO: 33022 - DNA, 20 bp, synthetic construct
  misc_feature 1..20: note = CRISPR gRNA sequence
  source 1..20: mol_type = other DNA
ttggtagagacgcggtttca

SEQ ID NO: 33023 - DNA, 20 bp, synthetic construct
  misc_feature 1..20: note = CRISPR gRNA sequence
  source 1..20: mol_type = other DNA
tggtagagacgcggtttcac

SEQ ID NO: 33024 - DNA, 20 bp, synthetic construct
  misc_feature 1..20: note = CRISPR gRNA sequence
  source 1..20: mol_type = other DNA
ggtagagacgcggtttcacc

SEQ ID NO: 33025 - DNA, 20 bp, synthetic construct
  misc_feature 1..20: note = CRISPR gRNA sequence
  source 1..20: mol_type = other DNA
gtagagacgcggtttcacca

SEQ ID NO: 33026 - DNA, 20 bp, synthetic construct
  misc_feature 1..20: note = CRISPR gRNA sequence
  source 1..20: mol_type = other DNA
caccatgttggccaggcagg

SEQ ID NO: 33027 - DNA, 20 bp, synthetic construct
  misc_feature 1..20: note = CRISPR gRNA sequence
  source 1..20: mol_type = other DNA
accatgttggccaggcaggt

SEQ ID NO: 33028 - DNA, 20 bp, synthetic construct
  misc_feature 1..20: note = CRISPR gRNA sequence
  source 1..20: mol_type = other DNA
gccaggcaggtatcaaactc

SEQ ID NO: 33029 - DNA, 20 bp, synthetic construct
  misc_feature 1..20: note = CRISPR gRNA sequence
  source 1..20: mol_type = other DNA
ctgacctcaagtgatccgtc

SEQ ID NO: 33030 - DNA, 20 bp, synthetic construct
  misc_feature 1..20: note = CRISPR gRNA sequence
  source 1..20: mol_type = other DNA
acctcaagtgatccgtcccc

SEQ ID NO: 33031 - DNA, 20 bp, synthetic construct
  misc_feature 1..20: note = CRISPR gRNA sequence
  source 1..20: mol_type = other DNA
aagtgatccgtcccccttgg

SEQ ID NO: 33032 - DNA, 20 bp, synthetic construct
  misc_feature 1..20: note = CRISPR gRNA sequence
  source 1..20: mol_type = other DNA
ggcctcccaaactgctggga

SEQ ID NO: 33033 - DNA, 20 bp, synthetic construct
  misc_feature 1..20: note = CRISPR gRNA sequence
  source 1..20: mol_type = other DNA
gcctcccaaactgctgggat

SEQ ID NO: 33034 - DNA, 20 bp, synthetic construct
  misc_feature 1..20: note = CRISPR gRNA sequence
  source 1..20: mol_type = other DNA
ccaaactgctgggattacag

SEQ ID NO: 33035 - DNA, 20 bp, synthetic construct
  misc_feature 1..20: note = CRISPR gRNA sequence
  source 1..20: mol_type = other DNA
ctgggattacaggtgtgagc

SEQ ID NO: 33036 - DNA, 20 bp, synthetic construct
  misc_feature 1..20: note = CRISPR gRNA sequence
  source 1..20: mol_type = other DNA
ggattacaggtgtgagccgc

SEQ ID NO: 33037 - DNA, 20 bp, synthetic construct
  misc_feature 1..20: note = CRISPR gRNA sequence
  source 1..20: mol_type = other DNA
caggtgtgagccgctgcgcc

SEQ ID NO: 33038 - DNA, 20 bp, synthetic construct
  misc_feature 1..20: note = CRISPR gRNA sequence
  source 1..20: mol_type = other DNA
cgcccagccttcactgaata

SEQ ID NO: 33039 - DNA, 20 bp, synthetic construct
  misc_feature 1..20: note = CRISPR gRNA sequence
  source 1..20: mol_type = other DNA
cactgaatattctttgcact

SEQ ID NO: 33040 - DNA, 20 bp, synthetic construct
  misc_feature 1..20: note = CRISPR gRNA sequence
  source 1..20: mol_type = other DNA
actgaatattctttgcactt

SEQ ID NO: 33041 - DNA, 20 bp, synthetic construct
  misc_feature 1..20: note = CRISPR gRNA sequence
  source 1..20: mol_type = other DNA
aatattctttgcacttttaa

SEQ ID NO: 33042 - DNA, 20 bp, synthetic construct
  misc_feature 1..20: note = CRISPR gRNA sequence
  source 1..20: mol_type = other DNA
tttgcacttttaaaatctca

SEQ ID NO: 33043 - DNA, 20 bp, synthetic construct
  misc_feature 1..20: note = CRISPR gRNA sequence
  source 1..20: mol_type = other DNA
tgcacttttaaaatctcata

SEQ ID NO: 33044 - DNA, 20 bp, synthetic construct
  misc_feature 1..20: note = CRISPR gRNA sequence
  source 1..20: mol_type = other DNA
gcacttttaaaatctcatac

SEQ ID NO: 33045 - DNA, 20 bp, synthetic construct
  misc_feature 1..20: note = CRISPR gRNA sequence
  source 1..20: mol_type = other DNA
cacttttaaaatctcatacc

SEQ ID NO: 33046 - DNA, 20 bp, synthetic construct
  misc_feature 1..20: note = CRISPR gRNA sequence
  source 1..20: mol_type = other DNA
ttaaaatctcataccctgtg

SEQ ID NO: 33047 - DNA, 20 bp, synthetic construct
  misc_feature 1..20: note = CRISPR gRNA sequence
  source 1..20: mol_type = other DNA
taaaatctcataccctgtgt

SEQ ID NO: 33048 - DNA, 20 bp, synthetic construct
  misc_feature 1..20: note = CRISPR gRNA sequence
  source 1..20: mol_type = other DNA
aaaatctcataccctgtgtg

SEQ ID NO: 33049 - DNA, 20 bp, synthetic construct
  misc_feature 1..20: note = CRISPR gRNA sequence
  source 1..20: mol_type = other DNA
aaatctcataccctgtgtgc

SEQ ID NO: 33050 - DNA, 20 bp, synthetic construct
  misc_feature 1..20: note = CRISPR gRNA sequence
  source 1..20: mol_type = other DNA
ataccctgtgtgcgattcac

SEQ ID NO: 33051 - DNA, 20 bp, synthetic construct
  misc_feature 1..20: note = CRISPR gRNA sequence
  source 1..20: mol_type = other DNA
tgtgcgattcacctgtttaa

SEQ ID NO: 33052 - DNA, 20 bp, synthetic construct
  misc_feature 1..20: note = CRISPR gRNA sequence
  source 1..20: mol_type = other DNA
acctgtttaagaactgaata

SEQ ID NO: 33053 - DNA, 20 bp, synthetic construct
  misc_feature 1..20: note = CRISPR gRNA sequence
  source 1..20: mol_type = other DNA
tttaagaactgaataaatag

SEQ ID NO: 33054 - DNA, 20 bp, synthetic construct
  misc_feature 1..20: note = CRISPR gRNA sequence
  source 1..20: mol_type = other DNA
aagaactgaataaatagata

SEQ ID NO: 33055 - DNA, 20 bp, synthetic construct
  misc_feature 1..20: note = CRISPR gRNA sequence
  source 1..20: mol_type = other DNA
agaactgaataaatagatac

SEQ ID NO: 33056 - DNA, 20 bp, synthetic construct
  misc_feature 1..20: note = CRISPR gRNA sequence
  source 1..20: mol_type = other DNA
aataaatagatacaggactt

SEQ ID NO: 33057 - DNA, 20 bp, synthetic construct
  misc_feature 1..20: note = CRISPR gRNA sequence
  source 1..20: mol_type = other DNA
acacatggtcagacccataa

SEQ ID NO: 33058 - DNA, 20 bp, synthetic construct
  misc_feature 1..20: note = CRISPR gRNA sequence
  source 1..20: mol_type = other DNA
cacatggtcagacccataat

SEQ ID NO: 33059 - DNA, 20 bp, synthetic construct
  misc_feature 1..20: note = CRISPR gRNA sequence
  source 1..20: mol_type = other DNA
agttaactgttacacccatt

SEQ ID NO: 33060 - DNA, 20 bp, synthetic construct
  misc_feature 1..20: note = CRISPR gRNA sequence
  source 1..20: mol_type = other DNA
actgttacacccattttaca

SEQ ID NO: 33061 - DNA, 20 bp, synthetic construct
  misc_feature 1..20: note = CRISPR gRNA sequence
  source 1..20: mol_type = other DNA
ttacacccattttacagatg

SEQ ID NO: 33062 - DNA, 20 bp, synthetic construct
  misc_feature 1..20: note = CRISPR gRNA sequence
  source 1..20: mol_type = other DNA
cacccattttacagatgttt

SEQ ID NO: 33063 - DNA, 20 bp, synthetic construct
  misc_feature 1..20: note = CRISPR gRNA sequence
  source 1..20: mol_type = other DNA
tacagatgttttcattcaac

SEQ ID NO: 33064 - DNA, 20 bp, synthetic construct
  misc_feature 1..20: note = CRISPR gRNA sequence
  source 1..20: mol_type = other DNA
acagatgttttcattcaaca

SEQ ID NO: 33065 - DNA, 20 bp, synthetic construct
  misc_feature 1..20: note = CRISPR gRNA sequence
  source 1..20: mol_type = other DNA
cagatgttttcattcaacag

SEQ ID NO: 33066 - DNA, 20 bp, synthetic construct
  misc_feature 1..20: note = CRISPR gRNA sequence
  source 1..20: mol_type = other DNA
tcattcaacagatatctact

SEQ ID NO: 33067 - DNA, 20 bp, synthetic construct
  misc_feature 1..20: note = CRISPR gRNA sequence
  source 1..20: mol_type = other DNA
cattcaacagatatctactg

SEQ ID NO: 33068 - DNA, 20 bp, synthetic construct
  misc_feature 1..20: note = CRISPR gRNA sequence
  source 1..20: mol_type = other DNA
attcaacagatatctactga

SEQ ID NO: 33069 - DNA, 20 bp, synthetic construct
  misc_feature 1..20: note = CRISPR gRNA sequence
  source 1..20: mol_type = other DNA
aacagatatctactgaggtg

SEQ ID NO: 33070 - DNA, 20 bp, synthetic construct
  misc_feature 1..20: note = CRISPR gRNA sequence
  source 1..20: mol_type = other DNA
ctgaggtgctactgcatacc

SEQ ID NO: 33071 - DNA, 20 bp, synthetic construct
  misc_feature 1..20: note = CRISPR gRNA sequence
  source 1..20: mol_type = other DNA
aggtgctactgcataccagg

SEQ ID NO: 33072 - DNA, 20 bp, synthetic construct
  misc_feature 1..20: note = CRISPR gRNA sequence
  source 1..20: mol_type = other DNA
ctgcataccaggcactgcac

SEQ ID NO: 33073 - DNA, 20 bp, synthetic construct
  misc_feature 1..20: note = CRISPR gRNA sequence
  source 1..20: mol_type = other DNA
cataccaggcactgcactag

SEQ ID NO: 33074 - DNA, 20 bp, synthetic construct
  misc_feature 1..20: note = CRISPR gRNA sequence
  source 1..20: mol_type = other DNA
cactagatgctggggaaaca

SEQ ID NO: 33075 - DNA, 20 bp, synthetic construct
  misc_feature 1..20: note = CRISPR gRNA sequence
  source 1..20: mol_type = other DNA
gatgctggggaaacagtcac

SEQ ID NO: 33076 - DNA, 20 bp, synthetic construct
  misc_feature 1..20: note = CRISPR gRNA sequence
  source 1..20: mol_type = other DNA
gggaaacagtcacgagcaag

SEQ ID NO: 33077 - DNA, 20 bp, synthetic construct
  misc_feature 1..20: note = CRISPR gRNA sequence
  source 1..20: mol_type = other DNA
tcctcacagtgggagagcaa

SEQ ID NO: 33078 - DNA, 20 bp, synthetic construct
  misc_feature 1..20: note = CRISPR gRNA sequence
  source 1..20: mol_type = other DNA
acagtgggagagcaaggcgt

SEQ ID NO: 33079 - DNA, 20 bp, synthetic construct
  misc_feature 1..20: note = CRISPR gRNA sequence
  source 1..20: mol_type = other DNA
aactgcaaggaaaaagacac

SEQ ID NO: 33080 - DNA, 20 bp, synthetic construct
  misc_feature 1..20: note = CRISPR gRNA sequence
  source 1..20: mol_type = other DNA
caaggaaaaagacacacaag

SEQ ID NO: 33081 - DNA, 20 bp, synthetic construct
  misc_feature 1..20: note = CRISPR gRNA sequence
  source 1..20: mol_type = other DNA
agctaatctacatggaagga

SEQ ID NO: 33082 - DNA, 20 bp, synthetic construct
  misc_feature 1..20: note = CRISPR gRNA sequence
  source 1..20: mol_type = other DNA
atctacatggaaggatggtc

SEQ ID NO: 33083 - DNA, 20 bp, synthetic construct
  misc_feature 1..20: note = CRISPR gRNA sequence
  source 1..20: mol_type = other DNA
catggaaggatggtcagaga

SEQ ID NO: 33084 - DNA, 20 bp, synthetic construct
  misc_feature 1..20: note = CRISPR gRNA sequence
  source 1..20: mol_type = other DNA
caggaagaggtgacagttta

SEQ ID NO: 33085 - DNA, 20 bp, synthetic construct
  misc_feature 1..20: note = CRISPR gRNA sequence
  source 1..20: mol_type = other DNA
agccaacaccagaaagattc

SEQ ID NO: 33086 - DNA, 20 bp, synthetic construct
  misc_feature 1..20: note = CRISPR gRNA sequence
  source 1..20: mol_type = other DNA
gccaacaccagaaagattca

SEQ ID NO: 33087 - DNA, 20 bp, synthetic construct
  misc_feature 1..20: note = CRISPR gRNA sequence
  source 1..20: mol_type = other DNA
aaaggagtcagccatgggaa

SEQ ID NO: 33088 - DNA, 20 bp, synthetic construct
  misc_feature 1..20: note = CRISPR gRNA sequence
  source 1..20: mol_type = other DNA
ggggaagggcattccagata

SEQ ID NO: 33089 - DNA, 20 bp, synthetic construct
  misc_feature 1..20: note = CRISPR gRNA sequence
  source 1..20: mol_type = other DNA
cagatagagactatagcaac

SEQ ID NO: 33090 - DNA, 20 bp, synthetic construct
  misc_feature 1..20: note = CRISPR gRNA sequence
  source 1..20: mol_type = other DNA
tagcaactgcaaaggccccg

SEQ ID NO: 33091 - DNA, 20 bp, synthetic construct
  misc_feature 1..20: note = CRISPR gRNA sequence
  source 1..20: mol_type = other DNA
caaaggccccgaggcttgaa

SEQ ID NO: 33092 - DNA, 20 bp, synthetic construct
  misc_feature 1..20: note = CRISPR gRNA sequence
  source 1..20: mol_type = other DNA
gaaagggcacatgggttata

SEQ ID NO: 33093 - DNA, 20 bp, synthetic construct
  misc_feature 1..20: note = CRISPR gRNA sequence
  source 1..20: mol_type = other DNA
aaagggcacatgggttatag

SEQ ID NO: 33094 - DNA, 20 bp, synthetic construct
  misc_feature 1..20: note = CRISPR gRNA sequence
  source 1..20: mol_type = other DNA
taggagtggagaagctggtg

SEQ ID NO: 33095 - DNA, 20 bp, synthetic construct
  misc_feature 1..20: note = CRISPR gRNA sequence
  source 1..20: mol_type = other DNA
gtggtggctgaagtgtggtg

SEQ ID NO: 33096 - DNA, 20 bp, synthetic construct
  misc_feature 1..20: note = CRISPR gRNA sequence
  source 1..20: mol_type = other DNA
aagtgtggtgtctcatagtg

SEQ ID NO: 33097 - DNA, 20 bp, synthetic construct
  misc_feature 1..20: note = CRISPR gRNA sequence
  source 1..20: mol_type = other DNA
atagtgggtttggagaggga

SEQ ID NO: 33098 - DNA, 20 bp, synthetic construct
  misc_feature 1..20: note = CRISPR gRNA sequence
  source 1..20: mol_type = other DNA
ggagagggaggaagggccat

SEQ ID NO: 33099 - DNA, 20 bp, synthetic construct
  misc_feature 1..20: note = CRISPR gRNA sequence
  source 1..20: mol_type = other DNA
gagagggaggaagggccata

SEQ ID NO: 33100 - DNA, 20 bp, synthetic construct
  misc_feature 1..20: note = CRISPR gRNA sequence
  source 1..20: mol_type = other DNA
gtggcatgtattttgtagcc

SEQ ID NO: 33101 - DNA, 20 bp, synthetic construct
  misc_feature 1..20: note = CRISPR gRNA sequence
  source 1..20: mol_type = other DNA
tggcatgtattttgtagcca

SEQ ID NO: 33102 - DNA, 20 bp, synthetic construct
  misc_feature 1..20: note = CRISPR gRNA sequence
  source 1..20: mol_type = other DNA
tgtagccattggagggttat

SEQ ID NO: 33103 - DNA, 20 bp, synthetic construct
  misc_feature 1..20: note = CRISPR gRNA sequence
  source 1..20: mol_type = other DNA
gtagccattggagggttatc

SEQ ID NO: 33104 - DNA, 20 bp, synthetic construct
  misc_feature 1..20: note = CRISPR gRNA sequence
  source 1..20: mol_type = other DNA
tagccattggagggttatca

SEQ ID NO: 33105 - DNA, 20 bp, synthetic construct
  misc_feature 1..20: note = CRISPR gRNA sequence
  source 1..20: mol_type = other DNA
gagggttatcagggccatga

SEQ ID NO: 33106 - DNA, 20 bp, synthetic construct
  misc_feature 1..20: note = CRISPR gRNA sequence
  source 1..20: mol_type = other DNA
tcagggccatgaaataatca

SEQ ID NO: 33107 - DNA, 20 bp, synthetic construct
  misc_feature 1..20: note = CRISPR gRNA sequence
  source 1..20: mol_type = other DNA
taaggctcctgttggctttt

SEQ ID NO: 33108 - DNA, 20 bp, synthetic construct
  misc_feature 1..20: note = CRISPR gRNA sequence
  source 1..20: mol_type = other DNA
aaggctcctgttggctttta

SEQ ID NO: 33109 - DNA, 20 bp, synthetic construct
  misc_feature 1..20: note = CRISPR gRNA sequence
  source 1..20: mol_type = other DNA
aggctcctgttggcttttaa

SEQ ID NO: 33110 - DNA, 20 bp, synthetic construct
  misc_feature 1..20: note = CRISPR gRNA sequence
  source 1..20: mol_type = other DNA
ctgttggcttttaaagggcc

SEQ ID NO: 33111 - DNA, 20 bp, synthetic construct
  misc_feature 1..20: note = CRISPR gRNA sequence
  source 1..20: mol_type = other DNA
ttggcttttaaagggcctcc

SEQ ID NO: 33112 - DNA, 20 bp, synthetic construct
  misc_feature 1..20: note = CRISPR gRNA sequence
  source 1..20: mol_type = other DNA
gcttttaaagggcctcccaa

SEQ ID NO: 33113 - DNA, 20 bp, synthetic construct
  misc_feature 1..20: note = CRISPR gRNA sequence
  source 1..20: mol_type = other DNA
ttaaagggcctcccaaccag

SEQ ID NO: 33114 - DNA, 20 bp, synthetic construct
  misc_feature 1..20: note = CRISPR gRNA sequence
  source 1..20: mol_type = other DNA
taaagggcctcccaaccaga

SEQ ID NO: 33115 - DNA, 20 bp, synthetic construct
  misc_feature 1..20: note = CRISPR gRNA sequence
  source 1..20: mol_type = other DNA
aaagggcctcccaaccagac

SEQ ID NO: 33116 - DNA, 20 bp, synthetic construct
  misc_feature 1..20: note = CRISPR gRNA sequence
  source 1..20: mol_type = other DNA
aagggcctcccaaccagaca

SEQ ID NO: 33117 - DNA, 20 bp, synthetic construct
  misc_feature 1..20: note = CRISPR gRNA sequence
  source 1..20: mol_type = other DNA
ccaaccagacaggacttagc

SEQ ID NO: 33118 - DNA, 20 bp, synthetic construct
  misc_feature 1..20: note = CRISPR gRNA sequence
  source 1..20: mol_type = other DNA
agcgagggaagcaagttgga

SEQ ID NO: 33119 - DNA, 20 bp, synthetic construct
  misc_feature 1..20: note = CRISPR gRNA sequence
  source 1..20: mol_type = other DNA
gcgagggaagcaagttggac

SEQ ID NO: 33120 - DNA, 20 bp, synthetic construct
  misc_feature 1..20: note = CRISPR gRNA sequence
  source 1..20: mol_type = other DNA
gacccacagcaggctttgga

SEQ ID NO: 33121 - DNA, 20 bp, synthetic construct
  misc_feature 1..20: note = CRISPR gRNA sequence
  source 1..20: mol_type = other DNA
tggagtcaaggaaaggccag

SEQ ID NO: 33122 - DNA, 20 bp, synthetic construct
  misc_feature 1..20: note = CRISPR gRNA sequence
  source 1..20: mol_type = other DNA
ggagtcaaggaaaggccagg

SEQ ID NO: 33123 - DNA, 20 bp, synthetic construct
  misc_feature 1..20: note = CRISPR gRNA sequence
  source 1..20: mol_type = other DNA
gagtcaaggaaaggccaggt

SEQ ID NO: 33124 - DNA, 20 bp, synthetic construct
  misc_feature 1..20: note = CRISPR gRNA sequence
  source 1..20: mol_type = other DNA
aagcaaggctaggttggatc

SEQ ID NO: 33125 - DNA, 20 bp, synthetic construct
  misc_feature 1..20: note = CRISPR gRNA sequence
  source 1..20: mol_type = other DNA
ggttggatcagggaggggct

SEQ ID NO: 33126 - DNA, 20 bp, synthetic construct
  misc_feature 1..20: note = CRISPR gRNA sequence
  source 1..20: mol_type = other DNA
gatcagggaggggctcactc

SEQ ID NO: 33127 - DNA, 20 bp, synthetic construct
  misc_feature 1..20: note = CRISPR gRNA sequence
  source 1..20: mol_type = other DNA
actcacgtcttttctgactt

SEQ ID NO: 33128 - DNA, 20 bp, synthetic construct
  misc_feature 1..20: note = CRISPR gRNA sequence
  source 1..20: mol_type = other DNA
acgtcttttctgacttttct

SEQ ID NO: 33129 - DNA, 20 bp, synthetic construct
  misc_feature 1..20: note = CRISPR gRNA sequence
  source 1..20: mol_type = other DNA
ttctgacttttctgcccaac

SEQ ID NO: 33130 - DNA, 20 bp, synthetic construct
  misc_feature 1..20: note = CRISPR gRNA sequence
  source 1..20: mol_type = other DNA
tctgacttttctgcccaact

SEQ ID NO: 33131 - DNA, 20 bp, synthetic construct
  misc_feature 1..20: note = CRISPR gRNA sequence
  source 1..20: mol_type = other DNA
ctgacttttctgcccaactt

SEQ ID NO: 33132 - DNA, 20 bp, synthetic construct
  misc_feature 1..20: note = CRISPR gRNA sequence
  source 1..20: mol_type = other DNA
tgacttttctgcccaacttc

SEQ ID NO: 33133 - DNA, 20 bp, synthetic construct
  misc_feature 1..20: note = CRISPR gRNA sequence
  source 1..20: mol_type = other DNA
acttttctgcccaacttctg

SEQ ID NO: 33134 - DNA, 20 bp, synthetic construct
  misc_feature 1..20: note = CRISPR gRNA sequence
  source 1..20: mol_type = other DNA
ttctgcccaacttctgctgg

SEQ ID NO: 33135 - DNA, 20 bp, synthetic construct
  misc_feature 1..20: note = CRISPR gRNA sequence
  source 1..20: mol_type = other DNA
tctgcccaacttctgctggc

SEQ ID NO: 33136 - DNA, 20 bp, synthetic construct
  misc_feature 1..20: note = CRISPR gRNA sequence
  source 1..20: mol_type = other DNA
ctgcccaacttctgctggca

SEQ ID NO: 33137 - DNA, 20 bp, synthetic construct
  misc_feature 1..20: note = CRISPR gRNA sequence
  source 1..20: mol_type = other DNA
tgcccaacttctgctggcat

SEQ ID NO: 33138 - DNA, 20 bp, synthetic construct
  misc_feature 1..20: note = CRISPR gRNA sequence
  source 1..20: mol_type = other DNA
cccaacttctgctggcatct

SEQ ID NO: 33139 - DNA, 20 bp, synthetic construct
  misc_feature 1..20: note = CRISPR gRNA sequence
  source 1..20: mol_type = other DNA
ctgctggcatctccatactc

SEQ ID NO: 33140 - DNA, 20 bp, synthetic construct
  misc_feature 1..20: note = CRISPR gRNA sequence
  source 1..20: mol_type = other DNA
tgctggcatctccatactct

SEQ ID NO: 33141 - DNA, 20 bp, synthetic construct
  misc_feature 1..20: note = CRISPR gRNA sequence
  source 1..20: mol_type = other DNA
ctggcatctccatactctca

SEQ ID NO: 33142 - DNA, 20 bp, synthetic construct
  misc_feature 1..20: note = CRISPR gRNA sequence
  source 1..20: mol_type = other DNA
gcatctccatactctcaccg

SEQ ID NO: 33143 - DNA, 20 bp, synthetic construct
  misc_feature 1..20: note = CRISPR gRNA sequence
  source 1..20: mol_type = other DNA
catactctcaccgatcactt

SEQ ID NO: 33144 - DNA, 20 bp, synthetic construct
  misc_feature 1..20: note = CRISPR gRNA sequence
  source 1..20: mol_type = other DNA
tcaccgatcacttcatctgg

SEQ ID NO: 33145 - DNA, 20 bp, synthetic construct
  misc_feature 1..20: note = CRISPR gRNA sequence
  source 1..20: mol_type = other DNA
accgatcacttcatctggtc

SEQ ID NO: 33146 - DNA, 20 bp, synthetic construct
  misc_feature 1..20: note = CRISPR gRNA sequence
  source 1..20: mol_type = other DNA
catctggtcctatgtgctct

SEQ ID NO: 33147 - DNA, 20 bp, synthetic construct
  misc_feature 1..20: note = CRISPR gRNA sequence
  source 1..20: mol_type = other DNA
atctggtcctatgtgctcta

SEQ ID NO: 33148 - DNA, 20 bp, synthetic construct
  misc_feature 1..20: note = CRISPR gRNA sequence
  source 1..20: mol_type = other DNA
gtcctatgtgctctactttg

SEQ ID NO: 33149 - DNA, 20 bp, synthetic construct
  misc_feature 1..20: note = CRISPR gRNA sequence
  source 1..20: mol_type = other DNA
tgtgctctactttgagaaaa

SEQ ID NO: 33150 - DNA, 20 bp, synthetic construct
  misc_feature 1..20: note = CRISPR gRNA sequence
  source 1..20: mol_type = other DNA
tactttgagaaaaaccagag

SEQ ID NO: 33151 - DNA, 20 bp, synthetic construct
  misc_feature 1..20: note = CRISPR gRNA sequence
  source 1..20: mol_type = other DNA
ctttgagaaaaaccagagac

SEQ ID NO: 33152 - DNA, 20 bp, synthetic construct
  misc_feature 1..20: note = CRISPR gRNA sequence
  source 1..20: mol_type = other DNA
tgagaaaaaccagagaccaa

SEQ ID NO: 33153 - DNA, 20 bp, synthetic construct
  misc_feature 1..20: note = CRISPR gRNA sequence
  source 1..20: mol_type = other DNA
gagaaaaaccagagaccaac

SEQ ID NO: 33154 - DNA, 20 bp, synthetic construct
  misc_feature 1..20: note = CRISPR gRNA sequence
  source 1..20: mol_type = other DNA
agaaaaaccagagaccaact

SEQ ID NO: 33155 - DNA, 20 bp, synthetic construct
  misc_feature 1..20: note = CRISPR gRNA sequence
  source 1..20: mol_type = other DNA
acacaatcaatgaaagccca

SEQ ID NO: 33156 - DNA, 20 bp, synthetic construct
  misc_feature 1..20: note = CRISPR gRNA sequence
  source 1..20: mol_type = other DNA
tattgtacccaccttgggga

SEQ ID NO: 33157 - DNA, 20 bp, synthetic construct
  misc_feature 1..20: note = CRISPR gRNA sequence
  source 1..20: mol_type = other DNA
ttgtacccaccttggggaga

SEQ ID NO: 33158 - DNA, 20 bp, synthetic construct
  misc_feature 1..20: note = CRISPR gRNA sequence
  source 1..20: mol_type = other DNA
tacccaccttggggagaggg

SEQ ID NO: 33159 - DNA, 20 bp, synthetic construct
  misc_feature 1..20: note = CRISPR gRNA sequence
  source 1..20: mol_type = other DNA
ggggagaggggtctgactgc

SEQ ID NO: 33160 - DNA, 20 bp, synthetic construct
  misc_feature 1..20: note = CRISPR gRNA sequence
  source 1..20: mol_type = other DNA
gggagaggggtctgactgcc

SEQ ID NO: 33161 - DNA, 20 bp, synthetic construct
  misc_feature 1..20: note = CRISPR gRNA sequence
  source 1..20: mol_type = other DNA
actgcccatcaatgaatggt

SEQ ID NO: 33162 - DNA, 20 bp, synthetic construct
  misc_feature 1..20: note = CRISPR gRNA sequence
  source 1..20: mol_type = other DNA
cccatcaatgaatggtcgtc

SEQ ID NO: 33163 - DNA, 20 bp, synthetic construct
  misc_feature 1..20: note = CRISPR gRNA sequence
  source 1..20: mol_type = other DNA
gggcaccccccagggaacaa

SEQ ID NO: 33164 - DNA, 20 bp, synthetic construct
  misc_feature 1..20: note = CRISPR gRNA sequence
  source 1..20: mol_type = other DNA
agccaagacctccccaccca

SEQ ID NO: 33165 - DNA, 20 bp, synthetic construct
  misc_feature 1..20: note = CRISPR gRNA sequence
  source 1..20: mol_type = other DNA
cccacccaccacaaacttac

SEQ ID NO: 33166 - DNA, 20 bp, synthetic construct
  misc_feature 1..20: note = CRISPR gRNA sequence
  source 1..20: mol_type = other DNA
actgaaaatgtccttgctca

SEQ ID NO: 33167 - DNA, 20 bp, synthetic construct
  misc_feature 1..20: note = CRISPR gRNA sequence
  source 1..20: mol_type = other DNA
ctgaaaatgtccttgctcag

SEQ ID NO: 33168 - DNA, 20 bp, synthetic construct
  misc_feature 1..20: note = CRISPR gRNA sequence
  source 1..20: mol_type = other DNA
aaaatgtccttgctcaggcc

SEQ ID NO: 33169 - DNA, 20 bp, synthetic construct
  misc_feature 1..20: note = CRISPR gRNA sequence
  source 1..20: mol_type = other DNA
gctcaggccctccagctggg

SEQ ID NO: 33170 - DNA, 20 bp, synthetic construct
  misc_feature 1..20: note = CRISPR gRNA sequence
  source 1..20: mol_type = other DNA
ctcaggccctccagctggga

SEQ ID NO: 33171 - DNA, 20 bp, synthetic construct
  misc_feature 1..20: note = CRISPR gRNA sequence
  source 1..20: mol_type = other DNA
aggccctccagctgggagtc

SEQ ID NO: 33172 - DNA, 20 bp, synthetic construct
  misc_feature 1..20: note = CRISPR gRNA sequence
  source 1..20: mol_type = other DNA
cagctgggagtcctggaaga

SEQ ID NO: 33173 - DNA, 20 bp, synthetic construct
  misc_feature 1..20: note = CRISPR gRNA sequence
  source 1..20: mol_type = other DNA
ggagtcctggaagacatact

SEQ ID NO: 33174 - DNA, 20 bp, synthetic construct
  misc_feature 1..20: note = CRISPR gRNA sequence
  source 1..20: mol_type = other DNA
gaagacatactggtccagtt

SEQ ID NO: 33175 - DNA, 20 bp, synthetic construct
  misc_feature 1..20: note = CRISPR gRNA sequence
  source 1..20: mol_type = other DNA
gtccagttccgctgcccaga

SEQ ID NO: 33176 - DNA, 20 bp, synthetic construct
  misc_feature 1..20: note = CRISPR gRNA sequence
  source 1..20: mol_type = other DNA
cgctgcccagacaaggaaaa

SEQ ID NO: 33177 - DNA, 20 bp, synthetic construct
  misc_feature 1..20: note = CRISPR gRNA sequence
  source 1..20: mol_type = other DNA
cccagacaaggaaaagcgca

SEQ ID NO: 33178 - DNA, 20 bp, synthetic construct
  misc_feature 1..20: note = CRISPR gRNA sequence
  source 1..20: mol_type = other DNA
actgaaggcccactgtgtgc

SEQ ID NO: 33179 - DNA, 20 bp, synthetic construct
  misc_feature 1..20: note = CRISPR gRNA sequence
  source 1..20: mol_type = other DNA
aaggcccactgtgtgccagg

SEQ ID NO: 33180 - DNA, 20 bp, synthetic construct
  misc_feature 1..20: note = CRISPR gRNA sequence
  source 1..20: mol_type = other DNA
tgtgccaggccttgggctgg

SEQ ID NO: 33181 - DNA, 20 bp, synthetic construct
  misc_feature 1..20: note = CRISPR gRNA sequence
  source 1..20: mol_type = other DNA
gggctggggaacctctgggc

SEQ ID NO: 33182 - DNA, 20 bp, synthetic construct
  misc_feature 1..20: note = CRISPR gRNA sequence
  source 1..20: mol_type = other DNA
ggctggggaacctctgggcc

SEQ ID NO: 33183 - DNA, 20 bp, synthetic construct
  misc_feature 1..20: note = CRISPR gRNA sequence
  source 1..20: mol_type = other DNA
gggaacctctgggcctggca

SEQ ID NO: 33184 - DNA, 20 bp, synthetic construct
  misc_feature 1..20: note = CRISPR gRNA sequence
  source 1..20: mol_type = other DNA
tgggcctggcacacagtggg

SEQ ID NO: 33185 - DNA, 20 bp, synthetic construct
  misc_feature 1..20: note = CRISPR gRNA sequence
  source 1..20: mol_type = other DNA
ggcctggcacacagtgggga

SEQ ID NO: 33186 - DNA, 20 bp, synthetic construct
  misc_feature 1..20: note = CRISPR gRNA sequence
  source 1..20: mol_type = other DNA
gcacacagtggggactcaag

SEQ ID NO: 33187 - DNA, 20 bp, synthetic construct
  misc_feature 1..20: note = CRISPR gRNA sequence
  source 1..20: mol_type = other DNA
aagaaatgtttgttgaatga

SEQ ID NO: 33188 - DNA, 20 bp, synthetic construct
  misc_feature 1..20: note = CRISPR gRNA sequence
  source 1..20: mol_type = other DNA
gttgaatgaatgaatgatca

SEQ ID NO: 33189 - DNA, 20 bp, synthetic construct
  misc_feature 1..20: note = CRISPR gRNA sequence
  source 1..20: mol_type = other DNA
ttgaatgaatgaatgatcaa

SEQ ID NO: 33190 - DNA, 20 bp, synthetic construct
  misc_feature 1..20: note = CRISPR gRNA sequence
  source 1..20: mol_type = other DNA
aatgaatgaatgatcaaaca

SEQ ID NO: 33191 - DNA, 20 bp, synthetic construct
  misc_feature 1..20: note = CRISPR gRNA sequence
  source 1..20: mol_type = other DNA
acactccaggggcccttaat

SEQ ID NO: 33192 - DNA, 20 bp, synthetic construct
  misc_feature 1..20: note = CRISPR gRNA sequence
  source 1..20: mol_type = other DNA
caggggcccttaatctaatc

SEQ ID NO: 33193 - DNA, 20 bp, synthetic construct
  misc_feature 1..20: note = CRISPR gRNA sequence
  source 1..20: mol_type = other DNA
aatctaatcaaaaggatgag

SEQ ID NO: 33194 - DNA, 20 bp, synthetic construct
  misc_feature 1..20: note = CRISPR gRNA sequence
  source 1..20: mol_type = other DNA
atctaatcaaaaggatgagg

SEQ ID NO: 33195 - DNA, 20 bp, synthetic construct
  misc_feature 1..20: note = CRISPR gRNA sequence
  source 1..20: mol_type = other DNA
atcaaaaggatgaggtatgt

SEQ ID NO: 33196 - DNA, 20 bp, synthetic construct
  misc_feature 1..20: note = CRISPR gRNA sequence
  source 1..20: mol_type = other DNA
atctactgctacaaagaaga

SEQ ID NO: 33197 - DNA, 20 bp, synthetic construct
  misc_feature 1..20: note = CRISPR gRNA sequence
  source 1..20: mol_type = other DNA
tctactgctacaaagaagag

SEQ ID NO: 33198 - DNA, 20 bp, synthetic construct
  misc_feature 1..20: note = CRISPR gRNA sequence
  source 1..20: mol_type = other DNA
ctgctacaaagaagagcaag

SEQ ID NO: 33199 - DNA, 20 bp, synthetic construct
  misc_feature 1..20: note = CRISPR gRNA sequence
  source 1..20: mol_type = other DNA
ctacaaagaagagcaaggca

SEQ ID NO: 33200 - DNA, 20 bp, synthetic construct
  misc_feature 1..20: note = CRISPR gRNA sequence
  source 1..20: mol_type = other DNA
caaagaagagcaaggcagaa

SEQ ID NO: 33201 - DNA, 20 bp, synthetic construct
  misc_feature 1..20: note = CRISPR gRNA sequence
  source 1..20: mol_type = other DNA
ctgcaggatttgagttcaaa

SEQ ID NO: 33202 - DNA, 20 bp, synthetic construct
  misc_feature 1..20: note = CRISPR gRNA sequence
  source 1..20: mol_type = other DNA
caggatttgagttcaaattc

SEQ ID NO: 33203 - DNA, 20 bp, synthetic construct
  misc_feature 1..20: note = CRISPR gRNA sequence
  source 1..20: mol_type = other DNA
gagttcaaattccacctcta

SEQ ID NO: 33204 - DNA, 20 bp, synthetic construct
  misc_feature 1..20: note = CRISPR gRNA sequence
  source 1..20: mol_type = other DNA
agttcaaattccacctctac

SEQ ID NO: 33205 - DNA, 20 bp, synthetic construct
  misc_feature 1..20: note = CRISPR gRNA sequence
  source 1..20: mol_type = other DNA
aaattccacctctactttcc

SEQ ID NO: 33206 - DNA, 20 bp, synthetic construct
  misc_feature 1..20: note = CRISPR gRNA sequence
  source 1..20: mol_type = other DNA
cacctctactttccactagc

SEQ ID NO: 33207 - DNA, 20 bp, synthetic construct
  misc_feature 1..20: note = CRISPR gRNA sequence
  source 1..20: mol_type = other DNA
tactttccactagccctact

SEQ ID NO: 33208 - DNA, 20 bp, synthetic construct
  misc_feature 1..20: note = CRISPR gRNA sequence
  source 1..20: mol_type = other DNA
ctttccactagccctactag

SEQ ID NO: 33209 - DNA, 20 bp, synthetic construct
  misc_feature 1..20: note = CRISPR gRNA sequence
  source 1..20: mol_type = other DNA
tccactagccctactagctg

SEQ ID NO: 33210 - DNA, 20 bp, synthetic construct
  misc_feature 1..20: note = CRISPR gRNA sequence
  source 1..20: mol_type = other DNA
ccactagccctactagctgt

SEQ ID NO: 33211 - DNA, 20 bp, synthetic construct
  misc_feature 1..20: note = CRISPR gRNA sequence
  source 1..20: mol_type = other DNA
cactagccctactagctgtg

SEQ ID NO: 33212 - DNA, 20 bp, synthetic construct
  misc_feature 1..20: note = CRISPR gRNA sequence
  source 1..20: mol_type = other DNA
gccctactagctgtgcaatc

SEQ ID NO: 33213 - DNA, 20 bp, synthetic construct
  misc_feature 1..20: note = CRISPR gRNA sequence
  source 1..20: mol_type = other DNA
ctagctgtgcaatcttgggc

SEQ ID NO: 33214 - DNA, 20 bp, synthetic construct
  misc_feature 1..20: note = CRISPR gRNA sequence
  source 1..20: mol_type = other DNA
gctgtgcaatcttgggctac

SEQ ID NO: 33215 - DNA, 20 bp, synthetic construct
  misc_feature 1..20: note = CRISPR gRNA sequence
  source 1..20: mol_type = other DNA
tgcaatcttgggctacttat

SEQ ID NO: 33216 - DNA, 20 bp, synthetic construct
  misc_feature 1..20: note = CRISPR gRNA sequence
  source 1..20: mol_type = other DNA
gggctacttatttaaccact

SEQ ID NO: 33217 - DNA, 20 bp, synthetic construct
  misc_feature 1..20: note = CRISPR gRNA sequence
  source 1..20: mol_type = other DNA
ggctacttatttaaccactg

SEQ ID NO: 33218 - DNA, 20 bp, synthetic construct
  misc_feature 1..20: note = CRISPR gRNA sequence
  source 1..20: mol_type = other DNA
cttatttaaccactgtgggc

SEQ ID NO: 33219 - DNA, 20 bp, synthetic construct
  misc_feature 1..20: note = CRISPR gRNA sequence
  source 1..20: mol_type = other DNA
atttaaccactgtgggcctc

SEQ ID NO: 33220 - DNA, 20 bp, synthetic construct
  misc_feature 1..20: note = CRISPR gRNA sequence
  source 1..20: mol_type = other DNA
tttaaccactgtgggcctcc

SEQ ID NO: 33221 - DNA, 20 bp, synthetic construct
  misc_feature 1..20: note = CRISPR gRNA sequence
  source 1..20: mol_type = other DNA
aaccactgtgggcctccatt

SEQ ID NO: 33222 - DNA, 20 bp, synthetic construct
  misc_feature 1..20: note = CRISPR gRNA sequence
  source 1..20: mol_type = other DNA
accactgtgggcctccattt

SEQ ID NO: 33223 - DNA, 20 bp, synthetic construct
  misc_feature 1..20: note = CRISPR gRNA sequence
  source 1..20: mol_type = other DNA
tgggcctccattttctcatc

SEQ ID NO: 33224 - DNA, 20 bp, synthetic construct
  misc_feature 1..20: note = CRISPR gRNA sequence
  source 1..20: mol_type = other DNA
cattttctcatctgtgtaag

SEQ ID NO: 33225 - DNA, 20 bp, synthetic construct
  misc_feature 1..20: note = CRISPR gRNA sequence
  source 1..20: mol_type = other DNA
tctcatctgtgtaagatgaa

SEQ ID NO: 33226 - DNA, 20 bp, synthetic construct
  misc_feature 1..20: note = CRISPR gRNA sequence
  source 1..20: mol_type = other DNA
ctcatctgtgtaagatgaat

SEQ ID NO: 33227 - DNA, 20 bp, synthetic construct
  misc_feature 1..20: note = CRISPR gRNA sequence
  source 1..20: mol_type = other DNA
tcatctgtgtaagatgaata

SEQ ID NO: 33228 - DNA, 20 bp, synthetic construct
  misc_feature 1..20: note = CRISPR gRNA sequence
  source 1..20: mol_type = other DNA
atctgtgtaagatgaataaa

SEQ ID NO: 33229 - DNA, 20 bp, synthetic construct
  misc_feature 1..20: note = CRISPR gRNA sequence
  source 1..20: mol_type = other DNA
tgtaagatgaataaataatg

SEQ ID NO: 33230 - DNA, 20 bp, synthetic construct
  misc_feature 1..20: note = CRISPR gRNA sequence
  source 1..20: mol_type = other DNA
ctacccaggaatcgatggtg

SEQ ID NO: 33231 - DNA, 20 bp, synthetic construct
  misc_feature 1..20: note = CRISPR gRNA sequence
  source 1..20: mol_type = other DNA
cccaggaatcgatggtgata

SEQ ID NO: 33232 - DNA, 20 bp, synthetic construct
  misc_feature 1..20: note = CRISPR gRNA sequence
  source 1..20: mol_type = other DNA
gaggttctacatctagagca

SEQ ID NO: 33233 - DNA, 20 bp, synthetic construct
  misc_feature 1..20: note = CRISPR gRNA sequence
  source 1..20: mol_type = other DNA
tacatctagagcatccaaca

SEQ ID NO: 33234 - DNA, 20 bp, synthetic construct
  misc_feature 1..20: note = CRISPR gRNA sequence
  source 1..20: mol_type = other DNA
catctagagcatccaacaca

SEQ ID NO: 33235 - DNA, 20 bp, synthetic construct
  misc_feature 1..20: note = CRISPR gRNA sequence
  source 1..20: mol_type = other DNA
gagcatccaacacagtagct

SEQ ID NO: 33236 - DNA, 20 bp, synthetic construct
  misc_feature 1..20: note = CRISPR gRNA sequence
  source 1..20: mol_type = other DNA
gtatacagtaggcactcagt

SEQ ID NO: 33237 - DNA, 20 bp, synthetic construct
  misc_feature 1..20: note = CRISPR gRNA sequence
  source 1..20: mol_type = other DNA
agtaaatagtggtaactata

SEQ ID NO: 33238 - DNA, 20 bp, synthetic construct
  misc_feature 1..20: note = CRISPR gRNA sequence
  source 1..20: mol_type = other DNA
tataaaggggtacatggctc

SEQ ID NO: 33239 - DNA, 20 bp, synthetic construct
  misc_feature 1..20: note = CRISPR gRNA sequence
  source 1..20: mol_type = other DNA
agagcccttggaatataggc

SEQ ID NO: 33240 - DNA, 20 bp, synthetic construct
  misc_feature 1..20: note = CRISPR gRNA sequence
  source 1..20: mol_type = other DNA
ggaatataggcaccatgaca

SEQ ID NO: 33241 - DNA, 20 bp, synthetic construct
  misc_feature 1..20: note = CRISPR gRNA sequence
  source 1..20: mol_type = other DNA
gaatataggcaccatgacat

SEQ ID NO: 33242 - DNA, 20 bp, synthetic construct
  misc_feature 1..20: note = CRISPR gRNA sequence
  source 1..20: mol_type = other DNA
cctggaggaagggatcctgg

SEQ ID NO: 33243 - DNA, 20 bp, synthetic construct
  misc_feature 1..20: note = CRISPR gRNA sequence
  source 1..20: mol_type = other DNA
ctggaggaagggatcctgga

SEQ ID NO: 33244 - DNA, 20 bp, synthetic construct
  misc_feature 1..20: note = CRISPR gRNA sequence
  source 1..20: mol_type = other DNA
gaggaagggatcctggaacc

SEQ ID NO: 33245 - DNA, 20 bp, synthetic construct
  misc_feature 1..20: note = CRISPR gRNA sequence
  source 1..20: mol_type = other DNA
gaaccaggccttgaaagatg

SEQ ID NO: 33246 - DNA, 20 bp, synthetic construct
  misc_feature 1..20: note = CRISPR gRNA sequence
  source 1..20: mol_type = other DNA
gaaagatgaggcagagtctg

SEQ ID NO: 33247 - DNA, 20 bp, synthetic construct
  misc_feature 1..20: note = CRISPR gRNA sequence
  source 1..20: mol_type = other DNA
aaagatgaggcagagtctgg

SEQ ID NO: 33248 - DNA, 20 bp, synthetic construct
  misc_feature 1..20: note = CRISPR gRNA sequence
  source 1..20: mol_type = other DNA
ggagaaggagaacagatagc

SEQ ID NO: 33249 - DNA, 20 bp, synthetic construct
  misc_feature 1..20: note = CRISPR gRNA sequence
  source 1..20: mol_type = other DNA
tctgggtcacagtggcagag

SEQ ID NO: 33250 - DNA, 20 bp, synthetic construct
  misc_feature 1..20: note = CRISPR gRNA sequence
  source 1..20: mol_type = other DNA
ctgggtcacagtggcagagt

SEQ ID NO: 33251 - DNA, 20 bp, synthetic construct
  misc_feature 1..20: note = CRISPR gRNA sequence
  source 1..20: mol_type = other DNA
tgggtcacagtggcagagtg

SEQ ID NO: 33252 - DNA, 20 bp, synthetic construct
  misc_feature 1..20: note = CRISPR gRNA sequence
  source 1..20: mol_type = other DNA
ggtcacagtggcagagtgag

SEQ ID NO: 33253 - DNA, 20 bp, synthetic construct
  misc_feature 1..20: note = CRISPR gRNA sequence
  source 1..20: mol_type = other DNA
gttcagagtatgtttaggaa

SEQ ID NO: 33254 - DNA, 20 bp, synthetic construct
  misc_feature 1..20: note = CRISPR gRNA sequence
  source 1..20: mol_type = other DNA
ttcagagtatgtttaggaaa

SEQ ID NO: 33255 - DNA, 20 bp, synthetic construct
  misc_feature 1..20: note = CRISPR gRNA sequence
  source 1..20: mol_type = other DNA
agagtatgtttaggaaaccc

SEQ ID NO: 33256 - DNA, 20 bp, synthetic construct
  misc_feature 1..20: note = CRISPR gRNA sequence
  source 1..20: mol_type = other DNA
aggaaaccctgagagatagg

SEQ ID NO: 33257 - DNA, 20 bp, synthetic construct
  misc_feature 1..20: note = CRISPR gRNA sequence
  source 1..20: mol_type = other DNA
ggaaaccctgagagataggt

SEQ ID NO: 33258 - DNA, 20 bp, synthetic construct
  misc_feature 1..20: note = CRISPR gRNA sequence
  source 1..20: mol_type = other DNA
agagataggtgacggtggta

SEQ ID NO: 33259 - DNA, 20 bp, synthetic construct
  misc_feature 1..20: note = CRISPR gRNA sequence
  source 1..20: mol_type = other DNA
catgctggggaaagttagga

SEQ ID NO: 33260 - DNA, 20 bp, synthetic construct
  misc_feature 1..20: note = CRISPR gRNA sequence
  source 1..20: mol_type = other DNA
atgctggggaaagttaggac

SEQ ID NO: 33261 - DNA, 20 bp, synthetic construct
  misc_feature 1..20: note = CRISPR gRNA sequence
  source 1..20: mol_type = other DNA
gggaaagttaggacttgatt

SEQ ID NO: 33262 - DNA, 20 bp, synthetic construct
  misc_feature 1..20: note = CRISPR gRNA sequence
  source 1..20: mol_type = other DNA
ggacttgattttataagcaa

SEQ ID NO: 33263 - DNA, 20 bp, synthetic construct
  misc_feature 1..20: note = CRISPR gRNA sequence
  source 1..20: mol_type = other DNA
gattttataagcaatgggga

SEQ ID NO: 33264 - DNA, 20 bp, synthetic construct
  misc_feature 1..20: note = CRISPR gRNA sequence
  source 1..20: mol_type = other DNA
attttataagcaatggggag

SEQ ID NO: 33265 - DNA, 20 bp, synthetic construct
  misc_feature 1..20: note = CRISPR gRNA sequence
  source 1..20: mol_type = other DNA
tataagcaatggggagccat

SEQ ID NO: 33266 - DNA, 20 bp, synthetic construct
  misc_feature 1..20: note = CRISPR gRNA sequence
  source 1..20: mol_type = other DNA
ataagcaatggggagccata

SEQ ID NO: 33267 - DNA, 20 bp, synthetic construct
  misc_feature 1..20: note = CRISPR gRNA sequence
  source 1..20: mol_type = other DNA
taagcaatggggagccatag

SEQ ID NO: 33268 - DNA, 20 bp, synthetic construct
  misc_feature 1..20: note = CRISPR gRNA sequence
  source 1..20: mol_type = other DNA
ctgagctgaggaatggaatg

SEQ ID NO: 33269 - DNA, 20 bp, synthetic construct
  misc_feature 1..20: note = CRISPR gRNA sequence
  source 1..20: mol_type = other DNA
tgagctgaggaatggaatga

SEQ ID NO: 33270 - DNA, 20 bp, synthetic construct
  misc_feature 1..20: note = CRISPR gRNA sequence
  source 1..20: mol_type = other DNA
agctgaggaatggaatgatg

SEQ ID NO: 33271 - DNA, 20 bp, synthetic construct
  misc_feature 1..20: note = CRISPR gRNA sequence
  source 1..20: mol_type = other DNA
aggaatggaatgatggccat

SEQ ID NO: 33272 - DNA, 20 bp, synthetic construct
  misc_feature 1..20: note = CRISPR gRNA sequence
  source 1..20: mol_type = other DNA
tggggtagtacctaacatct

SEQ ID NO: 33273 - DNA, 20 bp, synthetic construct
  misc_feature 1..20: note = CRISPR gRNA sequence
  source 1..20: mol_type = other DNA
acatctactgaatgcttact

SEQ ID NO: 33274 - DNA, 20 bp, synthetic construct
  misc_feature 1..20: note = CRISPR gRNA sequence
  source 1..20: mol_type = other DNA
ctgaatgcttactctgtgca

SEQ ID NO: 33275 - DNA, 20 bp, synthetic construct
  misc_feature 1..20: note = CRISPR gRNA sequence
  source 1..20: mol_type = other DNA
aatgcttactctgtgcaaat

SEQ ID NO: 33276 - DNA, 20 bp, synthetic construct
  misc_feature 1..20: note = CRISPR gRNA sequence
  source 1..20: mol_type = other DNA
actctgtgcaaattcctttt

SEQ ID NO: 33277 - DNA, 20 bp, synthetic construct
  misc_feature 1..20: note = CRISPR gRNA sequence
  source 1..20: mol_type = other DNA
ctctgtgcaaattccttttc

SEQ ID NO: 33278 - DNA, 20 bp, synthetic construct
  misc_feature 1..20: note = CRISPR gRNA sequence
  source 1..20: mol_type = other DNA
tgtgcaaattccttttctaa

SEQ ID NO: 33279 - DNA, 20 bp, synthetic construct
  misc_feature 1..20: note = CRISPR gRNA sequence
  source 1..20: mol_type = other DNA
tgcaaattccttttctaaat

SEQ ID NO: 33280 - DNA, 20 bp, synthetic construct
  misc_feature 1..20: note = CRISPR gRNA sequence
  source 1..20: mol_type = other DNA
cttttctaaatgctttacac

SEQ ID NO: 33281 - DNA, 20 bp, synthetic construct
  misc_feature 1..20: note = CRISPR gRNA sequence
  source 1..20: mol_type = other DNA
ttctaaatgctttacacatt

SEQ ID NO: 33282 - DNA, 20 bp, synthetic construct
  misc_feature 1..20: note = CRISPR gRNA sequence
  source 1..20: mol_type = other DNA
tctaaatgctttacacattg

SEQ ID NO: 33283 - DNA, 20 bp, synthetic construct
  misc_feature 1..20: note = CRISPR gRNA sequence
  source 1..20: mol_type = other DNA
ctaaatgctttacacattgt

SEQ ID NO: 33284 - DNA, 20 bp, synthetic construct
  misc_feature 1..20: note = CRISPR gRNA sequence
  source 1..20: mol_type = other DNA
taaatgctttacacattgta

SEQ ID NO: 33285 - DNA, 20 bp, synthetic construct
  misc_feature 1..20: note = CRISPR gRNA sequence
  source 1..20: mol_type = other DNA
aatgctttacacattgtaac

SEQ ID NO: 33286 - DNA, 20 bp, synthetic construct
  misc_feature 1..20: note = CRISPR gRNA sequence
  source 1..20: mol_type = other DNA
tacacattgtaacttattca

SEQ ID NO: 33287 - DNA, 20 bp, synthetic construct
  misc_feature 1..20: note = CRISPR gRNA sequence
  source 1..20: mol_type = other DNA
acacattgtaacttattcag

SEQ ID NO: 33288 - DNA, 20 bp, synthetic construct
  misc_feature 1..20: note = CRISPR gRNA sequence
  source 1..20: mol_type = other DNA
cacattgtaacttattcagt

SEQ ID NO: 33289 - DNA, 20 bp, synthetic construct
  misc_feature 1..20: note = CRISPR gRNA sequence
  source 1..20: mol_type = other DNA
taacttattcagtcttacaa

SEQ ID NO: 33290 - DNA, 20 bp, synthetic construct
  misc_feature 1..20: note = CRISPR gRNA sequence
  source 1..20: mol_type = other DNA
attcagtcttacaaccatcc

SEQ ID NO: 33291 - DNA, 20 bp, synthetic construct
  misc_feature 1..20: note = CRISPR gRNA sequence
  source 1..20: mol_type = other DNA
ttcagtcttacaaccatccc

SEQ ID NO: 33292 - DNA, 20 bp, synthetic construct
  misc_feature 1..20: note = CRISPR gRNA sequence
  source 1..20: mol_type = other DNA
agtcttacaaccatcccgtg

SEQ ID NO: 33293 - DNA, 20 bp, synthetic construct
  misc_feature 1..20: note = CRISPR gRNA sequence
  source 1..20: mol_type = other DNA
acaaccatcccgtgatggtg

SEQ ID NO: 33294 - DNA, 20 bp, synthetic construct
  misc_feature 1..20: note = CRISPR gRNA sequence
  source 1..20: mol_type = other DNA
caaccatcccgtgatggtgg

SEQ ID NO: 33295 - DNA, 20 bp, synthetic construct
  misc_feature 1..20: note = CRISPR gRNA sequence
  source 1..20: mol_type = other DNA
ttatctccattttacacatt

SEQ ID NO: 33296 - DNA, 20 bp, synthetic construct
  misc_feature 1..20: note = CRISPR gRNA sequence
  source 1..20: mol_type = other DNA
tctccattttacacatttag

SEQ ID NO: 33297 - DNA, 20 bp, synthetic construct
  misc_feature 1..20: note = CRISPR gRNA sequence
  source 1..20: mol_type = other DNA
cattttacacatttagaagc

SEQ ID NO: 33298 - DNA, 20 bp, synthetic construct
  misc_feature 1..20: note = CRISPR gRNA sequence
  source 1..20: mol_type = other DNA
tacacatttagaagctaagg

SEQ ID NO: 33299 - DNA, 20 bp, synthetic construct
  misc_feature 1..20: note = CRISPR gRNA sequence
  source 1..20: mol_type = other DNA
acacatttagaagctaaggt

SEQ ID NO: 33300 - DNA, 20 bp, synthetic construct
  misc_feature 1..20: note = CRISPR gRNA sequence
  source 1..20: mol_type = other DNA
cacatttagaagctaaggtc

SEQ ID NO: 33301 - DNA, 20 bp, synthetic construct
  misc_feature 1..20: note = CRISPR gRNA sequence
  source 1..20: mol_type = other DNA
agaagctaaggtcatatttc

SEQ ID NO: 33302 - DNA, 20 bp, synthetic construct
  misc_feature 1..20: note = CRISPR gRNA sequence
  source 1..20: mol_type = other DNA
gaagctaaggtcatatttca

SEQ ID NO: 33303 - DNA, 20 bp, synthetic construct
  misc_feature 1..20: note = CRISPR gRNA sequence
  source 1..20: mol_type = other DNA
aggtcatatttcaggatgct

SEQ ID NO: 33304 - DNA, 20 bp, synthetic construct
  misc_feature 1..20: note = CRISPR gRNA sequence
  source 1..20: mol_type = other DNA
caggatgctgcaaaagaata

SEQ ID NO: 33305 - DNA, 20 bp, synthetic construct
  misc_feature 1..20: note = CRISPR gRNA sequence
  source 1..20: mol_type = other DNA
aggatgctgcaaaagaatac

SEQ ID NO: 33306 - DNA, 20 bp, synthetic construct
  misc_feature 1..20: note = CRISPR gRNA sequence
  source 1..20: mol_type = other DNA
caaaagaatacttgcccagg

SEQ ID NO: 33307 - DNA, 20 bp, synthetic construct
  misc_feature 1..20: note = CRISPR gRNA sequence
  source 1..20: mol_type = other DNA
gcccaggcctgggcttcacc

SEQ ID NO: 33308 - DNA, 20 bp, synthetic construct
  misc_feature 1..20: note = CRISPR gRNA sequence
  source 1..20: mol_type = other DNA
cccaggcctgggcttcacct

SEQ ID NO: 33309 - DNA, 20 bp, synthetic construct
  misc_feature 1..20: note = CRISPR gRNA sequence
  source 1..20: mol_type = other DNA
ggcttcaccttccagaagca

SEQ ID NO: 33310 - DNA, 20 bp, synthetic construct
  misc_feature 1..20: note = CRISPR gRNA sequence
  source 1..20: mol_type = other DNA
caccttccagaagcagagag

SEQ ID NO: 33311 - DNA, 20 bp, synthetic construct
  misc_feature 1..20: note = CRISPR gRNA sequence
  source 1..20: mol_type = other DNA
accttccagaagcagagaga

SEQ ID NO: 33312 - DNA, 20 bp, synthetic construct
  misc_feature 1..20: note = CRISPR gRNA sequence
  source 1..20: mol_type = other DNA
ccagaagcagagagaaaacc

SEQ ID NO: 33313 - DNA, 20 bp, synthetic construct
  misc_feature 1..20: note = CRISPR gRNA sequence
  source 1..20: mol_type = other DNA
cagaagcagagagaaaaccc

SEQ ID NO: 33314 - DNA, 20 bp, synthetic construct
  misc_feature 1..20: note = CRISPR gRNA sequence
  source 1..20: mol_type = other DNA
gaggagcagacttgggtgaa

SEQ ID NO: 33315 - DNA, 20 bp, synthetic construct
  misc_feature 1..20: note = CRISPR gRNA sequence
  source 1..20: mol_type = other DNA
aggagcagacttgggtgaag

SEQ ID NO: 33316 - DNA, 20 bp, synthetic construct
  misc_feature 1..20: note = CRISPR gRNA sequence
  source 1..20: mol_type = other DNA
gggtgaagctgcctgttatg

SEQ ID NO: 33317 - DNA, 20 bp, synthetic construct
  misc_feature 1..20: note = CRISPR gRNA sequence
  source 1..20: mol_type = other DNA
ggtgaagctgcctgttatga

SEQ ID NO: 33318 - DNA, 20 bp, synthetic construct
  misc_feature 1..20: note = CRISPR gRNA sequence
  source 1..20: mol_type = other DNA
cctgttatgacgtgaatgtt

SEQ ID NO: 33319 - DNA, 20 bp, synthetic construct
  misc_feature 1..20: note = CRISPR gRNA sequence
  source 1..20: mol_type = other DNA
ttatgacgtgaatgtttgtc

SEQ ID NO: 33320 - DNA, 20 bp, synthetic construct
  misc_feature 1..20: note = CRISPR gRNA sequence
  source 1..20: mol_type = other DNA
tgacgtgaatgtttgtcttc

SEQ ID NO: 33321 - DNA, 20 bp, synthetic construct
  misc_feature 1..20: note = CRISPR gRNA sequence
  source 1..20: mol_type = other DNA
gtcttctccaaaactcatgt

SEQ ID NO: 33322 - DNA, 20 bp, synthetic construct
  misc_feature 1..20: note = CRISPR gRNA sequence
  source 1..20: mol_type = other DNA
tcttctccaaaactcatgta

SEQ ID NO: 33323 - DNA, 20 bp, synthetic construct
  misc_feature 1..20: note = CRISPR gRNA sequence
  source 1..20: mol_type = other DNA
ctccaaaactcatgtataaa

SEQ ID NO: 33324 - DNA, 20 bp, synthetic construct
  misc_feature 1..20: note = CRISPR gRNA sequence
  source 1..20: mol_type = other DNA
tccaaaactcatgtataaat

SEQ ID NO: 33325 - DNA, 20 bp, synthetic construct
  misc_feature 1..20: note = CRISPR gRNA sequence
  source 1..20: mol_type = other DNA
caaaactcatgtataaatgt

SEQ ID NO: 33326 - DNA, 20 bp, synthetic construct
  misc_feature 1..20: note = CRISPR gRNA sequence
  source 1..20: mol_type = other DNA
atgtataaatgtaatcccct

SEQ ID NO: 33327 - DNA, 20 bp, synthetic construct
  misc_feature 1..20: note = CRISPR gRNA sequence
  source 1..20: mol_type = other DNA
tgtggcagtattgagaggtg

SEQ ID NO: 33328 - DNA, 20 bp, synthetic construct
  misc_feature 1..20: note = CRISPR gRNA sequence
  source 1..20: mol_type = other DNA
agaggtggggcctttaagag

SEQ ID NO: 33329 - DNA, 20 bp, synthetic construct
  misc_feature 1..20: note = CRISPR gRNA sequence
  source 1..20: mol_type = other DNA
taagaggtgactggggcttt

SEQ ID NO: 33330 - DNA, 20 bp, synthetic construct
  misc_feature 1..20: note = CRISPR gRNA sequence
  source 1..20: mol_type = other DNA
aagaggtgactggggctttt

SEQ ID NO: 33331 - DNA, 20 bp, synthetic construct
  misc_feature 1..20: note = CRISPR gRNA sequence
  source 1..20: mol_type = other DNA
agaggtgactggggcttttc

SEQ ID NO: 33332 - DNA, 20 bp, synthetic construct
  misc_feature 1..20: note = CRISPR gRNA sequence
  source 1..20: mol_type = other DNA
gggcttttccttgatgaatg

SEQ ID NO: 33333 - DNA, 20 bp, synthetic construct
  misc_feature 1..20: note = CRISPR gRNA sequence
  source 1..20: mol_type = other DNA
ttccttgatgaatgggttaa

SEQ ID NO: 33334 - DNA, 20 bp, synthetic construct
  misc_feature 1..20: note = CRISPR gRNA sequence
  source 1..20: mol_type = other DNA
tccttgatgaatgggttaat

SEQ ID NO: 33335 - DNA, 20 bp, synthetic construct
  misc_feature 1..20: note = CRISPR gRNA sequence
  source 1..20: mol_type = other DNA
ccttgatgaatgggttaatc

SEQ ID NO: 33336 - DNA, 20 bp, synthetic construct
  misc_feature 1..20: note = CRISPR gRNA sequence
  source 1..20: mol_type = other DNA
cttgatgaatgggttaatcc

SEQ ID NO: 33337 - DNA, 20 bp, synthetic construct
  misc_feature 1..20: note = CRISPR gRNA sequence
  source 1..20: mol_type = other DNA
gatgaatgggttaatccgtt

SEQ ID NO: 33338 - DNA, 20 bp, synthetic construct
  misc_feature 1..20: note = CRISPR gRNA sequence
  source 1..20: mol_type = other DNA
atgaatgggttaatccgttc

SEQ ID NO: 33339 - DNA, 20 bp, synthetic construct
  misc_feature 1..20: note = CRISPR gRNA sequence
  source 1..20: mol_type = other DNA
atccgttcatggattagtgg

SEQ ID NO: 33340 - DNA, 20 bp, synthetic construct
  misc_feature 1..20: note = CRISPR gRNA sequence
  source 1..20: mol_type = other DNA
atggattagtggataaacag

SEQ ID NO: 33341 - DNA, 20 bp, synthetic construct
  misc_feature 1..20: note = CRISPR gRNA sequence
  source 1..20: mol_type = other DNA
gtggataaacaggttaataa

SEQ ID NO: 33342 - DNA, 20 bp, synthetic construct
  misc_feature 1..20: note = CRISPR gRNA sequence
  source 1..20: mol_type = other DNA
ataagttaatgggttgtcgt

SEQ ID NO: 33343 - DNA, 20 bp, synthetic construct
  misc_feature 1..20: note = CRISPR gRNA sequence
  source 1..20: mol_type = other DNA
atgggttgtcgtgggagtaa

SEQ ID NO: 33344 - DNA, 20 bp, synthetic construct
  misc_feature 1..20: note = CRISPR gRNA sequence
  source 1..20: mol_type = other DNA
tcgtgggagtaagactagtg

SEQ ID NO: 33345 - DNA, 20 bp, synthetic construct
  misc_feature 1..20: note = CRISPR gRNA sequence
  source 1..20: mol_type = other DNA
gtggttttatgagaagagga

SEQ ID NO: 33346 - DNA, 20 bp, synthetic construct
  misc_feature 1..20: note = CRISPR gRNA sequence
  source 1..20: mol_type = other DNA
tatgagaagaggaagagaga

SEQ ID NO: 33347 - DNA, 20 bp, synthetic construct
  misc_feature 1..20: note = CRISPR gRNA sequence
  source 1..20: mol_type = other DNA
atgagaagaggaagagagac

SEQ ID NO: 33348 - DNA, 20 bp, synthetic construct
  misc_feature 1..20: note = CRISPR gRNA sequence
  source 1..20: mol_type = other DNA
tgagaagaggaagagagact

SEQ ID NO: 33349 - DNA, 20 bp, synthetic construct
  misc_feature 1..20: note = CRISPR gRNA sequence
  source 1..20: mol_type = other DNA
tcacaccgaaacctcttgcc

SEQ ID NO: 33350 - DNA, 20 bp, synthetic construct
  misc_feature 1..20: note = CRISPR gRNA sequence
  source 1..20: mol_type = other DNA
ttgcctcgtgatgccccaca

SEQ ID NO: 33351 - DNA, 20 bp, synthetic construct
  misc_feature 1..20: note = CRISPR gRNA sequence
  source 1..20: mol_type = other DNA
gcctcgtgatgccccacact

SEQ ID NO: 33352 - DNA, 20 bp, synthetic construct
  misc_feature 1..20: note = CRISPR gRNA sequence
  source 1..20: mol_type = other DNA
cctcgtgatgccccacactg

SEQ ID NO: 33353 - DNA, 20 bp, synthetic construct
  misc_feature 1..20: note = CRISPR gRNA sequence
  source 1..20: mol_type = other DNA
gtgatgccccacactgcctt

SEQ ID NO: 33354 - DNA, 20 bp, synthetic construct
  misc_feature 1..20: note = CRISPR gRNA sequence
  source 1..20: mol_type = other DNA
ccttgggactctgcagagag

SEQ ID NO: 33355 - DNA, 20 bp, synthetic construct
  misc_feature 1..20: note = CRISPR gRNA sequence
  source 1..20: mol_type = other DNA
gggactctgcagagagtcct

SEQ ID NO: 33356 - DNA, 20 bp, synthetic construct
  misc_feature 1..20: note = CRISPR gRNA sequence
  source 1..20: mol_type = other DNA
ggactctgcagagagtcctc

SEQ ID NO: 33357 - DNA, 20 bp, synthetic construct
  misc_feature 1..20: note = CRISPR gRNA sequence
  source 1..20: mol_type = other DNA
tgcagagagtcctcaccagt

SEQ ID NO: 33358 - DNA, 20 bp, synthetic construct
  misc_feature 1..20: note = CRISPR gRNA sequence
  source 1..20: mol_type = other DNA
cagagagtcctcaccagtaa

SEQ ID NO: 33359 - DNA, 20 bp, synthetic construct
  misc_feature 1..20: note = CRISPR gRNA sequence
  source 1..20: mol_type = other DNA
accagtaagaaggccctcac

SEQ ID NO: 33360 - DNA, 20 bp, synthetic construct
  misc_feature 1..20: note = CRISPR gRNA sequence
  source 1..20: mol_type = other DNA
accagatgcagcccctaacc

SEQ ID NO: 33361 - DNA, 20 bp, synthetic construct
  misc_feature 1..20: note = CRISPR gRNA sequence
  source 1..20: mol_type = other DNA
accttggacttctcagcctc

SEQ ID NO: 33362 - DNA, 20 bp, synthetic construct
  misc_feature 1..20: note = CRISPR gRNA sequence
  source 1..20: mol_type = other DNA
ggacttctcagcctccataa

SEQ ID NO: 33363 - DNA, 20 bp, synthetic construct
  misc_feature 1..20: note = CRISPR gRNA sequence
  source 1..20: mol_type = other DNA
gacttctcagcctccataac

SEQ ID NO: 33364 - DNA, 20 bp, synthetic construct
  misc_feature 1..20: note = CRISPR gRNA sequence
  source 1..20: mol_type = other DNA
ctcagcctccataactgtaa

SEQ ID NO: 33365 - DNA, 20 bp, synthetic construct
  misc_feature 1..20: note = CRISPR gRNA sequence
  source 1..20: mol_type = other DNA
tcagcctccataactgtaag

SEQ ID NO: 33366 - DNA, 20 bp, synthetic construct
  misc_feature 1..20: note = CRISPR gRNA sequence
  source 1..20: mol_type = other DNA
agcctccataactgtaagaa

SEQ ID NO: 33367 - DNA, 20 bp, synthetic construct
  misc_feature 1..20: note = CRISPR gRNA sequence
  source 1..20: mol_type = other DNA
cataactgtaagaaatattt

SEQ ID NO: 33368 - DNA, 20 bp, synthetic construct
  misc_feature 1..20: note = CRISPR gRNA sequence
  source 1..20: mol_type = other DNA
taagaaatattttttttctt

SEQ ID NO: 33369 - DNA, 20 bp, synthetic construct
  misc_feature 1..20: note = CRISPR gRNA sequence
  source 1..20: mol_type = other DNA
tttttctttataaattactc

SEQ ID NO: 33370 - DNA, 20 bp, synthetic construct
  misc_feature 1..20: note = CRISPR gRNA sequence
  source 1..20: mol_type = other DNA
ttttctttataaattactca

SEQ ID NO: 33371 - DNA, 20 bp, synthetic construct
  misc_feature 1..20: note = CRISPR gRNA sequence
  source 1..20: mol_type = other DNA
tttctttataaattactcag

SEQ ID NO: 33372 - DNA, 20 bp, synthetic construct
  misc_feature 1..20: note = CRISPR gRNA sequence
  source 1..20: mol_type = other DNA
ttctttataaattactcagt

SEQ ID NO: 33373 - DNA, 20 bp, synthetic construct
  misc_feature 1..20: note = CRISPR gRNA sequence
  source 1..20: mol_type = other DNA
tctttataaattactcagtg

SEQ ID NO: 33374 - DNA, 20 bp, synthetic construct
  misc_feature 1..20: note = CRISPR gRNA sequence
  source 1..20: mol_type = other DNA
ctttataaattactcagtgt

SEQ ID NO: 33375 - DNA, 20 bp, synthetic construct
  misc_feature 1..20: note = CRISPR gRNA sequence
  source 1..20: mol_type = other DNA
tttataaattactcagtgtc

SEQ ID NO: 33376 - DNA, 20 bp, synthetic construct
  misc_feature 1..20: note = CRISPR gRNA sequence
  source 1..20: mol_type = other DNA
tataaattactcagtgtcag

SEQ ID NO: 33377 - DNA, 20 bp, synthetic construct
  misc_feature 1..20: note = CRISPR gRNA sequence
  source 1..20: mol_type = other DNA
ataaattactcagtgtcagg

SEQ ID NO: 33378 - DNA, 20 bp, synthetic construct
  misc_feature 1..20: note = CRISPR gRNA sequence
  source 1..20: mol_type = other DNA
taaattactcagtgtcaggt

SEQ ID NO: 33379 - DNA, 20 bp, synthetic construct
  misc_feature 1..20: note = CRISPR gRNA sequence
  source 1..20: mol_type = other DNA
ctcagtgtcaggtatgttgt

SEQ ID NO: 33380 - DNA, 20 bp, synthetic construct
  misc_feature 1..20: note = CRISPR gRNA sequence
  source 1..20: mol_type = other DNA
agtgtcaggtatgttgtttt

SEQ ID NO: 33381 - DNA, 20 bp, synthetic construct
  misc_feature 1..20: note = CRISPR gRNA sequence
  source 1..20: mol_type = other DNA
ttttaagcaacaaaaaatgg

SEQ ID NO: 33382 - DNA, 20 bp, synthetic construct
  misc_feature 1..20: note = CRISPR gRNA sequence
  source 1..20: mol_type = other DNA
taagcaacaaaaaatggact

SEQ ID NO: 33383 - DNA, 20 bp, synthetic construct
  misc_feature 1..20: note = CRISPR gRNA sequence
  source 1..20: mol_type = other DNA
aagcaacaaaaaatggacta

SEQ ID NO: 33384 - DNA, 20 bp, synthetic construct
  misc_feature 1..20: note = CRISPR gRNA sequence
  source 1..20: mol_type = other DNA
agcaacaaaaaatggactaa

SEQ ID NO: 33385 - DNA, 20 bp, synthetic construct
  misc_feature 1..20: note = CRISPR gRNA sequence
  source 1..20: mol_type = other DNA
acgcactgcctcacctattt

SEQ ID NO: 33386 - DNA, 20 bp, synthetic construct
  misc_feature 1..20: note = CRISPR gRNA sequence
  source 1..20: mol_type = other DNA
cctcacctatttgcttagac

SEQ ID NO: 33387 - DNA, 20 bp, synthetic construct
  misc_feature 1..20: note = CRISPR gRNA sequence
  source 1..20: mol_type = other DNA
acctatttgcttagacagct

SEQ ID NO: 33388 - DNA, 20 bp, synthetic construct
  misc_feature 1..20: note = CRISPR gRNA sequence
  source 1..20: mol_type = other DNA
tttgcttagacagctttcgc

SEQ ID NO: 33389 - DNA, 20 bp, synthetic construct
  misc_feature 1..20: note = CRISPR gRNA sequence
  source 1..20: mol_type = other DNA
gcttagacagctttcgctgc

SEQ ID NO: 33390 - DNA, 20 bp, synthetic construct
  misc_feature 1..20: note = CRISPR gRNA sequence
  source 1..20: mol_type = other DNA
cttagacagctttcgctgcc

SEQ ID NO: 33391 - DNA, 20 bp, synthetic construct
  misc_feature 1..20: note = CRISPR gRNA sequence
  source 1..20: mol_type = other DNA
agacagctttcgctgcctgt

SEQ ID NO: 33392 - DNA, 20 bp, synthetic construct
  misc_feature 1..20: note = CRISPR gRNA sequence
  source 1..20: mol_type = other DNA
gacagctttcgctgcctgtg

SEQ ID NO: 33393 - DNA, 20 bp, synthetic construct
  misc_feature 1..20: note = CRISPR gRNA sequence
  source 1..20: mol_type = other DNA
tcgctgcctgtggagatgcc

SEQ ID NO: 33394 - DNA, 20 bp, synthetic construct
  misc_feature 1..20: note = CRISPR gRNA sequence
  source 1..20: mol_type = other DNA
cgctgcctgtggagatgcca

SEQ ID NO: 33395 - DNA, 20 bp, synthetic construct
  misc_feature 1..20: note = CRISPR gRNA sequence
  source 1..20: mol_type = other DNA
gctgcctgtggagatgccac

SEQ ID NO: 33396 - DNA, 20 bp, synthetic construct
  misc_feature 1..20: note = CRISPR gRNA sequence
  source 1..20: mol_type = other DNA
cctgtggagatgccactaag

SEQ ID NO: 33397 - DNA, 20 bp, synthetic construct
  misc_feature 1..20: note = CRISPR gRNA sequence
  source 1..20: mol_type = other DNA
tggagatgccactaaggggg

SEQ ID NO: 33398 - DNA, 20 bp, synthetic construct
  misc_feature 1..20: note = CRISPR gRNA sequence
  source 1..20: mol_type = other DNA
aggggggagaaaaacaccca

SEQ ID NO: 33399 - DNA, 20 bp, synthetic construct
  misc_feature 1..20: note = CRISPR gRNA sequence
  source 1..20: mol_type = other DNA
tgacatgcccaaatccttaa

SEQ ID NO: 33400 - DNA, 20 bp, synthetic construct
  misc_feature 1..20: note = CRISPR gRNA sequence
  source 1..20: mol_type = other DNA
aatgactgcctccagttgtg

SEQ ID NO: 33401 - DNA, 20 bp, synthetic construct
  misc_feature 1..20: note = CRISPR gRNA sequence
  source 1..20: mol_type = other DNA
atgactgcctccagttgtga

SEQ ID NO: 33402 - DNA, 20 bp, synthetic construct
  misc_feature 1..20: note = CRISPR gRNA sequence
  source 1..20: mol_type = other DNA
cctccagttgtgaggaaatg

SEQ ID NO: 33403 - DNA, 20 bp, synthetic construct
  misc_feature 1..20: note = CRISPR gRNA sequence
  source 1..20: mol_type = other DNA
cagttgtgaggaaatgtgaa

SEQ ID NO: 33404 - DNA, 20 bp, synthetic construct
  misc_feature 1..20: note = CRISPR gRNA sequence
  source 1..20: mol_type = other DNA
tgaggaaatgtgaatgtcct

SEQ ID NO: 33405 - DNA, 20 bp, synthetic construct
  misc_feature 1..20: note = CRISPR gRNA sequence
  source 1..20: mol_type = other DNA
agccccaatcacttctgctt

SEQ ID NO: 33406 - DNA, 20 bp, synthetic construct
  misc_feature 1..20: note = CRISPR gRNA sequence
  source 1..20: mol_type = other DNA
ctgcttcccccatgtaaatc

SEQ ID NO: 33407 - DNA, 20 bp, synthetic construct
  misc_feature 1..20: note = CRISPR gRNA sequence
  source 1..20: mol_type = other DNA
tgcttcccccatgtaaatcc

SEQ ID NO: 33408 - DNA, 20 bp, synthetic construct
  misc_feature 1..20: note = CRISPR gRNA sequence
  source 1..20: mol_type = other DNA
cttcccccatgtaaatcccc

SEQ ID NO: 33409 - DNA, 20 bp, synthetic construct
  misc_feature 1..20: note = CRISPR gRNA sequence
  source 1..20: mol_type = other DNA
cccccatgtaaatccccagg

SEQ ID NO: 33410 - DNA, 20 bp, synthetic construct
  misc_feature 1..20: note = CRISPR gRNA sequence
  source 1..20: mol_type = other DNA
ccccatgtaaatccccagga

SEQ ID NO: 33411 - DNA, 20 bp, synthetic construct
  misc_feature 1..20: note = CRISPR gRNA sequence
  source 1..20: mol_type = other DNA
tcagttctgtaatttctgaa

SEQ ID NO: 33412 - DNA, 20 bp, synthetic construct
  misc_feature 1..20: note = CRISPR gRNA sequence
  source 1..20: mol_type = other DNA
agttctgtaatttctgaaac

SEQ ID NO: 33413 - DNA, 20 bp, synthetic construct
  misc_feature 1..20: note = CRISPR gRNA sequence
  source 1..20: mol_type = other DNA
tgtaatttctgaaacatgaa

SEQ ID NO: 33414 - DNA, 20 bp, synthetic construct
  misc_feature 1..20: note = CRISPR gRNA sequence
  source 1..20: mol_type = other DNA
taatttctgaaacatgaaca

SEQ ID NO: 33415 - DNA, 20 bp, synthetic construct
  misc_feature 1..20: note = CRISPR gRNA sequence
  source 1..20: mol_type = other DNA
ctgaaacatgaacaattact

SEQ ID NO: 33416 - DNA, 20 bp, synthetic construct
  misc_feature 1..20: note = CRISPR gRNA sequence
  source 1..20: mol_type = other DNA
tgaaacatgaacaattacta

SEQ ID NO: 33417 - DNA, 20 bp, synthetic construct
  misc_feature 1..20: note = CRISPR gRNA sequence
  source 1..20: mol_type = other DNA
aaacatgaacaattactagt

SEQ ID NO: 33418 - DNA, 20 bp, synthetic construct
  misc_feature 1..20: note = CRISPR gRNA sequence
  source 1..20: mol_type = other DNA
ctagtcccctccattttctt

SEQ ID NO: 33419 - DNA, 20 bp, synthetic construct
  misc_feature 1..20: note = CRISPR gRNA sequence
  source 1..20: mol_type = other DNA
gtcccctccattttcttcct

SEQ ID NO: 33420 - DNA, 20 bp, synthetic construct
  misc_feature 1..20: note = CRISPR gRNA sequence
  source 1..20: mol_type = other DNA
cattttcttccttggtatga

SEQ ID NO: 33421 - DNA, 20 bp, synthetic construct
  misc_feature 1..20: note = CRISPR gRNA sequence
  source 1..20: mol_type = other DNA
tcttccttggtatgattttc

SEQ ID NO: 33422 - DNA, 20 bp, synthetic construct
  misc_feature 1..20: note = CRISPR gRNA sequence
  source 1..20: mol_type = other DNA
cttccttggtatgattttca

SEQ ID NO: 33423 - DNA, 20 bp, synthetic construct
  misc_feature 1..20: note = CRISPR gRNA sequence
  source 1..20: mol_type = other DNA
ttccttggtatgattttcaa

SEQ ID NO: 33424 - DNA, 20 bp, synthetic construct
  misc_feature 1..20: note = CRISPR gRNA sequence
  source 1..20: mol_type = other DNA
ccttggtatgattttcaata

SEQ ID NO: 33425 - DNA, 20 bp, synthetic construct
  misc_feature 1..20: note = CRISPR gRNA sequence
  source 1..20: mol_type = other DNA
cttggtatgattttcaatac

SEQ ID NO: 33426 - DNA, 20 bp, synthetic construct
  misc_feature 1..20: note = CRISPR gRNA sequence
  source 1..20: mol_type = other DNA
ggtatgattttcaatacact

SEQ ID NO: 33427 - DNA, 20 bp, synthetic construct
  misc_feature 1..20: note = CRISPR gRNA sequence
  source 1..20: mol_type = other DNA
gtatgattttcaatacactg

SEQ ID NO: 33428 - DNA, 20 bp, synthetic construct
  misc_feature 1..20: note = CRISPR gRNA sequence
  source 1..20: mol_type = other DNA
tcaatacactgtgctctggg

SEQ ID NO: 33429 - DNA, 20 bp, synthetic construct
  misc_feature 1..20: note = CRISPR gRNA sequence
  source 1..20: mol_type = other DNA
caatacactgtgctctgggg

SEQ ID NO: 33430 - DNA, 20 bp, synthetic construct
  misc_feature 1..20: note = CRISPR gRNA sequence
  source 1..20: mol_type = other DNA
aatacactgtgctctgggga

SEQ ID NO: 33431 - DNA, 20 bp, synthetic construct
  misc_feature 1..20: note = CRISPR gRNA sequence
  source 1..20: mol_type = other DNA
tgctctggggaaaaattggc

SEQ ID NO: 33432 - DNA, 20 bp, synthetic construct
  misc_feature 1..20: note = CRISPR gRNA sequence
  source 1..20: mol_type = other DNA
tggggaaaaattggccacat

SEQ ID NO: 33433 - DNA, 20 bp, synthetic construct
  misc_feature 1..20: note = CRISPR gRNA sequence
  source 1..20: mol_type = other DNA
gggaaaaattggccacattt

SEQ ID NO: 33434 - DNA, 20 bp, synthetic construct
  misc_feature 1..20: note = CRISPR gRNA sequence
  source 1..20: mol_type = other DNA
gccacatttggatcaagcac

SEQ ID NO: 33435 - DNA, 20 bp, synthetic construct
  misc_feature 1..20: note = CRISPR gRNA sequence
  source 1..20: mol_type = other DNA
ggatcaagcacagaactgct

SEQ ID NO: 33436 - DNA, 20 bp, synthetic construct
  misc_feature 1..20: note = CRISPR gRNA sequence
  source 1..20: mol_type = other DNA
gatcaagcacagaactgctg

SEQ ID NO: 33437 - DNA, 20 bp, synthetic construct
  misc_feature 1..20: note = CRISPR gRNA sequence
  source 1..20: mol_type = other DNA
ctgaatgctgctgttcctgg

SEQ ID NO: 33438 - DNA, 20 bp, synthetic construct
  misc_feature 1..20: note = CRISPR gRNA sequence
  source 1..20: mol_type = other DNA
aatgctgctgttcctgggtt

SEQ ID NO: 33439 - DNA, 20 bp, synthetic construct
  misc_feature 1..20: note = CRISPR gRNA sequence
  source 1..20: mol_type = other DNA
ctgttcctgggttggcagga

SEQ ID NO: 33440 - DNA, 20 bp, synthetic construct
  misc_feature 1..20: note = CRISPR gRNA sequence
  source 1..20: mol_type = other DNA
ttcctgggttggcaggaaga

SEQ ID NO: 33441 - DNA, 20 bp, synthetic construct
  misc_feature 1..20: note = CRISPR gRNA sequence
  source 1..20: mol_type = other DNA
ctgggttggcaggaagaaga

SEQ ID NO: 33442 - DNA, 20 bp, synthetic construct
  misc_feature 1..20: note = CRISPR gRNA sequence
  source 1..20: mol_type = other DNA
ggttggcaggaagaagacca

SEQ ID NO: 33443 - DNA, 20 bp, synthetic construct
  misc_feature 1..20: note = CRISPR gRNA sequence
  source 1..20: mol_type = other DNA
gcaggaagaagaccactaag

SEQ ID NO: 33444 - DNA, 20 bp, synthetic construct
  misc_feature 1..20: note = CRISPR gRNA sequence
  source 1..20: mol_type = other DNA
agaagagttttgcaggttgt

SEQ ID NO: 33445 - DNA, 20 bp, synthetic construct
  misc_feature 1..20: note = CRISPR gRNA sequence
  source 1..20: mol_type = other DNA
tgcaggttgttcactgcaca

SEQ ID NO: 33446 - DNA, 20 bp, synthetic construct
  misc_feature 1..20: note = CRISPR gRNA sequence
  source 1..20: mol_type = other DNA
gcaggttgttcactgcacac

SEQ ID NO: 33447 - DNA, 20 bp, synthetic construct
  misc_feature 1..20: note = CRISPR gRNA sequence
  source 1..20: mol_type = other DNA
caggttgttcactgcacaca

SEQ ID NO: 33448 - DNA, 20 bp, synthetic construct
  misc_feature 1..20: note = CRISPR gRNA sequence
  source 1..20: mol_type = other DNA
ttcactgcacacaggtgccc

SEQ ID NO: 33449 - DNA, 20 bp, synthetic construct
  misc_feature 1..20: note = CRISPR gRNA sequence
  source 1..20: mol_type = other DNA
actgcacacaggtgcccaag

SEQ ID NO: 33450 - DNA, 20 bp, synthetic construct
  misc_feature 1..20: note = CRISPR gRNA sequence
  source 1..20: mol_type = other DNA
cacacaggtgcccaagccaa

SEQ ID NO: 33451 - DNA, 20 bp, synthetic construct
  misc_feature 1..20: note = CRISPR gRNA sequence
  source 1..20: mol_type = other DNA
cggcttgcactttgctagcc

SEQ ID NO: 33452 - DNA, 20 bp, synthetic construct
  misc_feature 1..20: note = CRISPR gRNA sequence
  source 1..20: mol_type = other DNA
gcactttgctagccaagcag

SEQ ID NO: 33453 - DNA, 20 bp, synthetic construct
  misc_feature 1..20: note = CRISPR gRNA sequence
  source 1..20: mol_type = other DNA
cactttgctagccaagcagt

SEQ ID NO: 33454 - DNA, 20 bp, synthetic construct
  misc_feature 1..20: note = CRISPR gRNA sequence
  source 1..20: mol_type = other DNA
tgctagccaagcagttactt

SEQ ID NO: 33455 - DNA, 20 bp, synthetic construct
  misc_feature 1..20: note = CRISPR gRNA sequence
  source 1..20: mol_type = other DNA
gctagccaagcagttacttc

SEQ ID NO: 33456 - DNA, 20 bp, synthetic construct
  misc_feature 1..20: note = CRISPR gRNA sequence
  source 1..20: mol_type = other DNA
ctagccaagcagttacttcc

SEQ ID NO: 33457 - DNA, 20 bp, synthetic construct
  misc_feature 1..20: note = CRISPR gRNA sequence
  source 1..20: mol_type = other DNA
gccaagcagttacttcctgg

SEQ ID NO: 33458 - DNA, 20 bp, synthetic construct
  misc_feature 1..20: note = CRISPR gRNA sequence
  source 1..20: mol_type = other DNA
cttcctggtaggggctgcat

SEQ ID NO: 33459 - DNA, 20 bp, synthetic construct
  misc_feature 1..20: note = CRISPR gRNA sequence
  source 1..20: mol_type = other DNA
cctggtaggggctgcatcct

SEQ ID NO: 33460 - DNA, 20 bp, synthetic construct
  misc_feature 1..20: note = CRISPR gRNA sequence
  source 1..20: mol_type = other DNA
ctggtaggggctgcatcctc

SEQ ID NO: 33461 - DNA, 20 bp, synthetic construct
  misc_feature 1..20: note = CRISPR gRNA sequence
  source 1..20: mol_type = other DNA
gtaggggctgcatcctccag

SEQ ID NO: 33462 - DNA, 20 bp, synthetic construct
  misc_feature 1..20: note = CRISPR gRNA sequence
  source 1..20: mol_type = other DNA
catcctccagaaaaaggcca

SEQ ID NO: 33463 - DNA, 20 bp, synthetic construct
  misc_feature 1..20: note = CRISPR gRNA sequence
  source 1..20: mol_type = other DNA
cagaaaaaggccactttttt

SEQ ID NO: 33464 - DNA, 20 bp, synthetic construct
  misc_feature 1..20: note = CRISPR gRNA sequence
  source 1..20: mol_type = other DNA
ttttctatttcaacataggc

SEQ ID NO: 33465 - DNA, 20 bp, synthetic construct
  misc_feature 1..20: note = CRISPR gRNA sequence
  source 1..20: mol_type = other DNA
tttctatttcaacataggct

SEQ ID NO: 33466 - DNA, 20 bp, synthetic construct
  misc_feature 1..20: note = CRISPR gRNA sequence
  source 1..20: mol_type = other DNA
ttctatttcaacataggctc

SEQ ID NO: 33467 - DNA, 20 bp, synthetic construct
  misc_feature 1..20: note = CRISPR gRNA sequence
  source 1..20: mol_type = other DNA
tctatttcaacataggctct

SEQ ID NO: 33468 - DNA, 20 bp, synthetic construct
  misc_feature 1..20: note = CRISPR gRNA sequence
  source 1..20: mol_type = other DNA
ctatttcaacataggctctg

SEQ ID NO: 33469 - DNA, 20 bp, synthetic construct
  misc_feature 1..20: note = CRISPR gRNA sequence
  source 1..20: mol_type = other DNA
tatttcaacataggctctgt

SEQ ID NO: 33470 - DNA, 20 bp, synthetic construct
  misc_feature 1..20: note = CRISPR gRNA sequence
  source 1..20: mol_type = other DNA
tttcaacataggctctgtat

SEQ ID NO: 33471 - DNA, 20 bp, synthetic construct
  misc_feature 1..20: note = CRISPR gRNA sequence
  source 1..20: mol_type = other DNA
caacataggctctgtatgag

SEQ ID NO: 33472 - DNA, 20 bp, synthetic construct
  misc_feature 1..20: note = CRISPR gRNA sequence
  source 1..20: mol_type = other DNA
aacataggctctgtatgagg

SEQ ID NO: 33473 - DNA, 20 bp, synthetic construct
  misc_feature 1..20: note = CRISPR gRNA sequence
  source 1..20: mol_type = other DNA
tgtatgaggtggtggtgatg

SEQ ID NO: 33474 - DNA, 20 bp, synthetic construct
  misc_feature 1..20: note = CRISPR gRNA sequence
  source 1..20: mol_type = other DNA
tatgaggtggtggtgatgct

SEQ ID NO: 33475 - DNA, 20 bp, synthetic construct
  misc_feature 1..20: note = CRISPR gRNA sequence
  source 1..20: mol_type = other DNA
gtgagaagagattctctatc

SEQ ID NO: 33476 - DNA, 20 bp, synthetic construct
  misc_feature 1..20: note = CRISPR gRNA sequence
  source 1..20: mol_type = other DNA
tctatcccacgtctctcccc

SEQ ID NO: 33477 - DNA, 20 bp, synthetic construct
  misc_feature 1..20: note = CRISPR gRNA sequence
  source 1..20: mol_type = other DNA
tatcccacgtctctccccca

SEQ ID NO: 33478 - DNA, 20 bp, synthetic construct
  misc_feature 1..20: note = CRISPR gRNA sequence
  source 1..20: mol_type = other DNA
tcccacgtctctcccccaaa

SEQ ID NO: 33479 - DNA, 20 bp, synthetic construct
  misc_feature 1..20: note = CRISPR gRNA sequence
  source 1..20: mol_type = other DNA
tcccccaaaaaacaaaccac

SEQ ID NO: 33480 - DNA, 20 bp, synthetic construct
  misc_feature 1..20: note = CRISPR gRNA sequence
  source 1..20: mol_type = other DNA
ccccaaaaaacaaaccacta

SEQ ID NO: 33481 - DNA, 20 bp, synthetic construct
  misc_feature 1..20: note = CRISPR gRNA sequence
  source 1..20: mol_type = other DNA
gcagcaacaccaccaccacc

SEQ ID NO: 33482 - DNA, 20 bp, synthetic construct
  misc_feature 1..20: note = CRISPR gRNA sequence
  source 1..20: mol_type = other DNA
tccccaagagtcctgccctt

SEQ ID NO: 33483 - DNA, 20 bp, synthetic construct
  misc_feature 1..20: note = CRISPR gRNA sequence
  source 1..20: mol_type = other DNA
cccaagagtcctgcccttgt

SEQ ID NO: 33484 - DNA, 20 bp, synthetic construct
  misc_feature 1..20: note = CRISPR gRNA sequence
  source 1..20: mol_type = other DNA
cccttgtctgaaagctgtag

SEQ ID NO: 33485 - DNA, 20 bp, synthetic construct
  misc_feature 1..20: note = CRISPR gRNA sequence
  source 1..20: mol_type = other DNA
gtctgaaagctgtagctctt

SEQ ID NO: 33486 - DNA, 20 bp, synthetic construct
  misc_feature 1..20: note = CRISPR gRNA sequence
  source 1..20: mol_type = other DNA
tctgaaagctgtagctcttc

SEQ ID NO: 33487 - DNA, 20 bp, synthetic construct
  misc_feature 1..20: note = CRISPR gRNA sequence
  source 1..20: mol_type = other DNA
aaagctgtagctcttcttaa

SEQ ID NO: 33488 - DNA, 20 bp, synthetic construct
  misc_feature 1..20: note = CRISPR gRNA sequence
  source 1..20: mol_type = other DNA
tagctcttcttaaggctaca

SEQ ID NO: 33489 - DNA, 20 bp, synthetic construct
  misc_feature 1..20: note = CRISPR gRNA sequence
  source 1..20: mol_type = other DNA
ttcttaaggctacaaattag

SEQ ID NO: 33490 - DNA, 20 bp, synthetic construct
  misc_feature 1..20: note = CRISPR gRNA sequence
  source 1..20: mol_type = other DNA
cttaaggctacaaattagct

SEQ ID NO: 33491 - DNA, 20 bp, synthetic construct
  misc_feature 1..20: note = CRISPR gRNA sequence
  source 1..20: mol_type = other DNA
ttaaggctacaaattagctt

SEQ ID NO: 33492 - DNA, 20 bp, synthetic construct
  misc_feature 1..20: note = CRISPR gRNA sequence
  source 1..20: mol_type = other DNA
aaggctacaaattagcttct

SEQ ID NO: 33493 - DNA, 20 bp, synthetic construct
  misc_feature 1..20: note = CRISPR gRNA sequence
  source 1..20: mol_type = other DNA
aggctacaaattagcttctc

SEQ ID NO: 33494 - DNA, 20 bp, synthetic construct
  misc_feature 1..20: note = CRISPR gRNA sequence
  source 1..20: mol_type = other DNA
caaattagcttctctgctta

SEQ ID NO: 33495 - DNA, 20 bp, synthetic construct
  misc_feature 1..20: note = CRISPR gRNA sequence
  source 1..20: mol_type = other DNA
gcttctctgcttaagcctta

SEQ ID NO: 33496 - DNA, 20 bp, synthetic construct
  misc_feature 1..20: note = CRISPR gRNA sequence
  source 1..20: mol_type = other DNA
ctctgcttaagccttagcaa

SEQ ID NO: 33497 - DNA, 20 bp, synthetic construct
  misc_feature 1..20: note = CRISPR gRNA sequence
  source 1..20: mol_type = other DNA
tctgcttaagccttagcaaa

SEQ ID NO: 33498 - DNA, 20 bp, synthetic construct
  misc_feature 1..20: note = CRISPR gRNA sequence
  source 1..20: mol_type = other DNA
tgcttaagccttagcaaatc

SEQ ID NO: 33499 - DNA, 20 bp, synthetic construct
  misc_feature 1..20: note = CRISPR gRNA sequence
  source 1..20: mol_type = other DNA
cttaagccttagcaaatctt

SEQ ID NO: 33500 - DNA, 20 bp, synthetic construct
  misc_feature 1..20: note = CRISPR gRNA sequence
  source 1..20: mol_type = other DNA
aagccttagcaaatcttcca

SEQ ID NO: 33501 - DNA, 20 bp, synthetic construct
  misc_feature 1..20: note = CRISPR gRNA sequence
  source 1..20: mol_type = other DNA
agccttagcaaatcttccaa

SEQ ID NO: 33502 - DNA, 20 bp, synthetic construct
  misc_feature 1..20: note = CRISPR gRNA sequence
  source 1..20: mol_type = other DNA
agcaaatcttccaaccccag

SEQ ID NO: 33503 - DNA, 20 bp, synthetic construct
  misc_feature 1..20: note = CRISPR gRNA sequence
  source 1..20: mol_type = other DNA
gcaaatcttccaaccccaga

SEQ ID NO: 33504 - DNA, 20 bp, synthetic construct
  misc_feature 1..20: note = CRISPR gRNA sequence
  source 1..20: mol_type = other DNA
ccaaccccagacactttctt

SEQ ID NO: 33505 - DNA, 20 bp, synthetic construct
  misc_feature 1..20: note = CRISPR gRNA sequence
  source 1..20: mol_type = other DNA
caaccccagacactttcttt

SEQ ID NO: 33506 - DNA, 20 bp, synthetic construct
  misc_feature 1..20: note = CRISPR gRNA sequence
  source 1..20: mol_type = other DNA
tctttttttgtggttaaaaa

SEQ ID NO: 33507 - DNA, 20 bp, synthetic construct
  misc_feature 1..20: note = CRISPR gRNA sequence
  source 1..20: mol_type = other DNA
ctttttttgtggttaaaaat

SEQ ID NO: 33508 - DNA, 20 bp, synthetic construct
  misc_feature 1..20: note = CRISPR gRNA sequence
  source 1..20: mol_type = other DNA
tttttttgtggttaaaaatg

SEQ ID NO: 33509 - DNA, 20 bp, synthetic construct
  misc_feature 1..20: note = CRISPR gRNA sequence
  source 1..20: mol_type = other DNA
tttttgtggttaaaaatgga

SEQ ID NO: 33510 - DNA, 20 bp, synthetic construct
  misc_feature 1..20: note = CRISPR gRNA sequence
  source 1..20: mol_type = other DNA
ttttgtggttaaaaatggag

SEQ ID NO: 33511 - DNA, 20 bp, synthetic construct
  misc_feature 1..20: note = CRISPR gRNA sequence
  source 1..20: mol_type = other DNA
tttgtggttaaaaatggaga

SEQ ID NO: 33512 - DNA, 20 bp, synthetic construct
  misc_feature 1..20: note = CRISPR gRNA sequence
  source 1..20: mol_type = other DNA
ttgtggttaaaaatggagac

SEQ ID NO: 33513 - DNA, 20 bp, synthetic construct
  misc_feature 1..20: note = CRISPR gRNA sequence
  source 1..20: mol_type = other DNA
tgtggttaaaaatggagact

SEQ ID NO: 33514 - DNA, 20 bp, synthetic construct
  misc_feature 1..20: note = CRISPR gRNA sequence
  source 1..20: mol_type = other DNA
gtggttaaaaatggagactt

SEQ ID NO: 33515 - DNA, 20 bp, synthetic construct
  misc_feature 1..20: note = CRISPR gRNA sequence
  source 1..20: mol_type = other DNA
tggttaaaaatggagacttt

SEQ ID NO: 33516 - DNA, 20 bp, synthetic construct
  misc_feature 1..20: note = CRISPR gRNA sequence
  source 1..20: mol_type = other DNA
aaaatggagactttgaaacg

SEQ ID NO: 33517 - DNA, 20 bp, synthetic construct
  misc_feature 1..20: note = CRISPR gRNA sequence
  source 1..20: mol_type = other DNA
tgaaacgagaaagacctagg

SEQ ID NO: 33518 - DNA, 20 bp, synthetic construct
  misc_feature 1..20: note = CRISPR gRNA sequence
  source 1..20: mol_type = other DNA
gaaacgagaaagacctaggt

SEQ ID NO: 33519 - DNA, 20 bp, synthetic construct
  misc_feature 1..20: note = CRISPR gRNA sequence
  source 1..20: mol_type = other DNA
aaacgagaaagacctaggtt

SEQ ID NO: 33520 - DNA, 20 bp, synthetic construct
  misc_feature 1..20: note = CRISPR gRNA sequence
  source 1..20: mol_type = other DNA
ggttagaatttcagatctgt

SEQ ID NO: 33521 - DNA, 20 bp, synthetic construct
  misc_feature 1..20: note = CRISPR gRNA sequence
  source 1..20: mol_type = other DNA
gaatttcagatctgtacatt

SEQ ID NO: 33522 - DNA, 20 bp, synthetic construct
  misc_feature 1..20: note = CRISPR gRNA sequence
  source 1..20: mol_type = other DNA
cagatctgtacattactatc

SEQ ID NO: 33523 - DNA, 20 bp, synthetic construct
  misc_feature 1..20: note = CRISPR gRNA sequence
  source 1..20: mol_type = other DNA
agatctgtacattactatct

SEQ ID NO: 33524 - DNA, 20 bp, synthetic construct
  misc_feature 1..20: note = CRISPR gRNA sequence
  source 1..20: mol_type = other DNA
tacattactatctctaatgc

SEQ ID NO: 33525 - DNA, 20 bp, synthetic construct
  misc_feature 1..20: note = CRISPR gRNA sequence
  source 1..20: mol_type = other DNA
ctatctctaatgcaaacttg

SEQ ID NO: 33526 - DNA, 20 bp, synthetic construct
  misc_feature 1..20: note = CRISPR gRNA sequence
  source 1..20: mol_type = other DNA
tctctaatgcaaacttgggt

SEQ ID NO: 33527 - DNA, 20 bp, synthetic construct
  misc_feature 1..20: note = CRISPR gRNA sequence
  source 1..20: mol_type = other DNA
taatgcaaacttgggtaggt

SEQ ID NO: 33528 - DNA, 20 bp, synthetic construct
  misc_feature 1..20: note = CRISPR gRNA sequence
  source 1..20: mol_type = other DNA
atgcaaacttgggtaggtcg

SEQ ID NO: 33529 - DNA, 20 bp, synthetic construct
  misc_feature 1..20: note = CRISPR gRNA sequence
  source 1..20: mol_type = other DNA
gggtaggtcgtttcacctct

SEQ ID NO: 33530 - DNA, 20 bp, synthetic construct
  misc_feature 1..20: note = CRISPR gRNA sequence
  source 1..20: mol_type = other DNA
ggtaggtcgtttcacctctc

SEQ ID NO: 33531 - DNA, 20 bp, synthetic construct
  misc_feature 1..20: note = CRISPR gRNA sequence
  source 1..20: mol_type = other DNA
cacctctctaaacctcaatt

SEQ ID NO: 33532 - DNA, 20 bp, synthetic construct
  misc_feature 1..20: note = CRISPR gRNA sequence
  source 1..20: mol_type = other DNA
acctctctaaacctcaattt

SEQ ID NO: 33533 - DNA, 20 bp, synthetic construct
  misc_feature 1..20: note = CRISPR gRNA sequence
  source 1..20: mol_type = other DNA
tctaaacctcaatttcctca

SEQ ID NO: 33534 - DNA, 20 bp, synthetic construct
  misc_feature 1..20: note = CRISPR gRNA sequence
  source 1..20: mol_type = other DNA
taaacctcaatttcctcatt

SEQ ID NO: 33535 - DNA, 20 bp, synthetic construct
  misc_feature 1..20: note = CRISPR gRNA sequence
  source 1..20: mol_type = other DNA
aacctcaatttcctcatttg

SEQ ID NO: 33536 - DNA, 20 bp, synthetic construct
  misc_feature 1..20: note = CRISPR gRNA sequence
  source 1..20: mol_type = other DNA
aatttcctcatttgtaaaag

SEQ ID NO: 33537 - DNA, 20 bp, synthetic construct
  misc_feature 1..20: note = CRISPR gRNA sequence
  source 1..20: mol_type = other DNA
cctcatttgtaaaagacaga

SEQ ID NO: 33538 - DNA, 20 bp, synthetic construct
  misc_feature 1..20: note = CRISPR gRNA sequence
  source 1..20: mol_type = other DNA
ctcatttgtaaaagacagaa

SEQ ID NO: 33539 - DNA, 20 bp, synthetic construct
  misc_feature 1..20: note = CRISPR gRNA sequence
  source 1..20: mol_type = other DNA
atttgtaaaagacagaaact

SEQ ID NO: 33540 - DNA, 20 bp, synthetic construct
  misc_feature 1..20: note = CRISPR gRNA sequence
  source 1..20: mol_type = other DNA
gtaaaagacagaaactaata

SEQ ID NO: 33541 - DNA, 20 bp, synthetic construct
  misc_feature 1..20: note = CRISPR gRNA sequence
  source 1..20: mol_type = other DNA
taaaagacagaaactaataa

SEQ ID NO: 33542 - DNA, 20 bp, synthetic construct
  misc_feature 1..20: note = CRISPR gRNA sequence
  source 1..20: mol_type = other DNA
ataatatgtatttcctttgt

SEQ ID NO: 33543 - DNA, 20 bp, synthetic construct
  misc_feature 1..20: note = CRISPR gRNA sequence
  source 1..20: mol_type = other DNA
cctttgttgttgtaaggatt

SEQ ID NO: 33544 - DNA, 20 bp, synthetic construct
  misc_feature 1..20: note = CRISPR gRNA sequence
  source 1..20: mol_type = other DNA
ctttgttgttgtaaggattc

SEQ ID NO: 33545 - DNA, 20 bp, synthetic construct
  misc_feature 1..20: note = CRISPR gRNA sequence
  source 1..20: mol_type = other DNA
tgttgttgtaaggattccag

SEQ ID NO: 33546 - DNA, 20 bp, synthetic construct
  misc_feature 1..20: note = CRISPR gRNA sequence
  source 1..20: mol_type = other DNA
gttgttgtaaggattccaga

SEQ ID NO: 33547 - DNA, 20 bp, synthetic construct
  misc_feature 1..20: note = CRISPR gRNA sequence
  source 1..20: mol_type = other DNA
ttgttgtaaggattccagat

SEQ ID NO: 33548 - DNA, 20 bp, synthetic construct
  misc_feature 1..20: note = CRISPR gRNA sequence
  source 1..20: mol_type = other DNA
ttgtaaggattccagatgat

SEQ ID NO: 33549 - DNA, 20 bp, synthetic construct
  misc_feature 1..20: note = CRISPR gRNA sequence
  source 1..20: mol_type = other DNA
taaggattccagatgataat

SEQ ID NO: 33550 - DNA, 20 bp, synthetic construct
  misc_feature 1..20: note = CRISPR gRNA sequence
  source 1..20: mol_type = other DNA
cagatgataatgtatggaca

SEQ ID NO: 33551 - DNA, 20 bp, synthetic construct
  misc_feature 1..20: note = CRISPR gRNA sequence
  source 1..20: mol_type = other DNA
tgagtatccagtaaatgcta

SEQ ID NO: 33552 - DNA, 20 bp, synthetic construct
  misc_feature 1..20: note = CRISPR gRNA sequence
  source 1..20: mol_type = other DNA
gttattacaaatactagagt

SEQ ID NO: 33553 - DNA, 20 bp, synthetic construct
  misc_feature 1..20: note = CRISPR gRNA sequence
  source 1..20: mol_type = other DNA
ttacaaatactagagtagct

SEQ ID NO: 33554 - DNA, 20 bp, synthetic construct
  misc_feature 1..20: note = CRISPR gRNA sequence
  source 1..20: mol_type = other DNA
caaatactagagtagcttgg

SEQ ID NO: 33555 - DNA, 20 bp, synthetic construct
  misc_feature 1..20: note = CRISPR gRNA sequence
  source 1..20: mol_type = other DNA
gagtagcttggctaaggagc

SEQ ID NO: 33556 - DNA, 20 bp, synthetic construct
  misc_feature 1..20: note = CRISPR gRNA sequence
  source 1..20: mol_type = other DNA
ggctaaggagctgggaggaa

SEQ ID NO: 33557 - DNA, 20 bp, synthetic construct
  misc_feature 1..20: note = CRISPR gRNA sequence
  source 1..20: mol_type = other DNA
gctaaggagctgggaggaaa

SEQ ID NO: 33558 - DNA, 20 bp, synthetic construct
  misc_feature 1..20: note = CRISPR gRNA sequence
  source 1..20: mol_type = other DNA
aggagctgggaggaaaaggg

SEQ ID NO: 33559 - DNA, 20 bp, synthetic construct
  misc_feature 1..20: note = CRISPR gRNA sequence
  source 1..20: mol_type = other DNA
ggaggaaaagggaaaggggt

SEQ ID NO: 33560 - DNA, 20 bp, synthetic construct
  misc_feature 1..20: note = CRISPR gRNA sequence
  source 1..20: mol_type = other DNA
tgtagaaaggatggacagaa

SEQ ID NO: 33561 - DNA, 20 bp, synthetic construct
  misc_feature 1..20: note = CRISPR gRNA sequence
  source 1..20: mol_type = other DNA
gtagaaaggatggacagaag

SEQ ID NO: 33562 - DNA, 20 bp, synthetic construct
  misc_feature 1..20: note = CRISPR gRNA sequence
  source 1..20: mol_type = other DNA
tagaaaggatggacagaaga

SEQ ID NO: 33563 - DNA, 20 bp, synthetic construct
  misc_feature 1..20: note = CRISPR gRNA sequence
  source 1..20: mol_type = other DNA
tgttttcttggtggtcatta

SEQ ID NO: 33564 - DNA, 20 bp, synthetic construct
  misc_feature 1..20: note = CRISPR gRNA sequence
  source 1..20: mol_type = other DNA
gttttcttggtggtcattag

SEQ ID NO: 33565 - DNA, 20 bp, synthetic construct
  misc_feature 1..20: note = CRISPR gRNA sequence
  source 1..20: mol_type = other DNA
ttttcttggtggtcattagt

SEQ ID NO: 33566 - DNA, 20 bp, synthetic construct
  misc_feature 1..20: note = CRISPR gRNA sequence
  source 1..20: mol_type = other DNA
tcttggtggtcattagtgaa

SEQ ID NO: 33567 - DNA, 20 bp, synthetic construct
  misc_feature 1..20: note = CRISPR gRNA sequence
  source 1..20: mol_type = other DNA
cttggtggtcattagtgaag

SEQ ID NO: 33568 - DNA, 20 bp, synthetic construct
  misc_feature 1..20: note = CRISPR gRNA sequence
  source 1..20: mol_type = other DNA
ttggtggtcattagtgaagg

SEQ ID NO: 33569 - DNA, 20 bp, synthetic construct
  misc_feature 1..20: note = CRISPR gRNA sequence
  source 1..20: mol_type = other DNA
ggtggtcattagtgaagggg

SEQ ID NO: 33570 - DNA, 20 bp, synthetic construct
  misc_feature 1..20: note = CRISPR gRNA sequence
  source 1..20: mol_type = other DNA
gtggtcattagtgaaggggc

SEQ ID NO: 33571 - DNA, 20 bp, synthetic construct
  misc_feature 1..20: note = CRISPR gRNA sequence
  source 1..20: mol_type = other DNA
gtgaaggggcctatttcccc

SEQ ID NO: 33572 - DNA, 20 bp, synthetic construct
  misc_feature 1..20: note = CRISPR gRNA sequence
  source 1..20: mol_type = other DNA
tttcccccactggcctccat

SEQ ID NO: 33573 - DNA, 20 bp, synthetic construct
  misc_feature 1..20: note = CRISPR gRNA sequence
  source 1..20: mol_type = other DNA
cccccactggcctccatctc

SEQ ID NO: 33574 - DNA, 20 bp, synthetic construct
  misc_feature 1..20: note = CRISPR gRNA sequence
  source 1..20: mol_type = other DNA
ccccactggcctccatctcc

SEQ ID NO: 33575 - DNA, 20 bp, synthetic construct
  misc_feature 1..20: note = CRISPR gRNA sequence
  source 1..20: mol_type = other DNA
gcctccatctcccctctctt

SEQ ID NO: 33576 - DNA, 20 bp, synthetic construct
  misc_feature 1..20: note = CRISPR gRNA sequence
  source 1..20: mol_type = other DNA
catctcccctctcttccctg

SEQ ID NO: 33577 - DNA, 20 bp, synthetic construct
  misc_feature 1..20: note = CRISPR gRNA sequence
  source 1..20: mol_type = other DNA
ccctctcttccctggagtct

SEQ ID NO: 33578 - DNA, 20 bp, synthetic construct
  misc_feature 1..20: note = CRISPR gRNA sequence
  source 1..20: mol_type = other DNA
tcttccctggagtctccgtt

SEQ ID NO: 33579 - DNA, 20 bp, synthetic construct
  misc_feature 1..20: note = CRISPR gRNA sequence
  source 1..20: mol_type = other DNA
ttccctggagtctccgttcc

SEQ ID NO: 33580 - DNA, 20 bp, synthetic construct
  misc_feature 1..20: note = CRISPR gRNA sequence
  source 1..20: mol_type = other DNA
ccctggagtctccgttcctc

SEQ ID NO: 33581 - DNA, 20 bp, synthetic construct
  misc_feature 1..20: note = CRISPR gRNA sequence
  source 1..20: mol_type = other DNA
cctggagtctccgttcctcc

SEQ ID NO: 33582 - DNA, 20 bp, synthetic construct
  misc_feature 1..20: note = CRISPR gRNA sequence
  source 1..20: mol_type = other DNA
gagtctccgttcctccagcc

SEQ ID NO: 33583 - DNA, 20 bp, synthetic construct
  misc_feature 1..20: note = CRISPR gRNA sequence
  source 1..20: mol_type = other DNA
cgttcctccagccattgctc

SEQ ID NO: 33584 - DNA, 20 bp, synthetic construct
  misc_feature 1..20: note = CRISPR gRNA sequence
  source 1..20: mol_type = other DNA
ctccagccattgctccgcat

SEQ ID NO: 33585 - DNA, 20 bp, synthetic construct
  misc_feature 1..20: note = CRISPR gRNA sequence
  source 1..20: mol_type = other DNA
cagccattgctccgcatccc

SEQ ID NO: 33586 - DNA, 20 bp, synthetic construct
  misc_feature 1..20: note = CRISPR gRNA sequence
  source 1..20: mol_type = other DNA
ctccgcatcccccttgcaat

SEQ ID NO: 33587 - DNA, 20 bp, synthetic construct
  misc_feature 1..20: note = CRISPR gRNA sequence
  source 1..20: mol_type = other DNA
cgcatcccccttgcaatgat

SEQ ID NO: 33588 - DNA, 20 bp, synthetic construct
  misc_feature 1..20: note = CRISPR gRNA sequence
  source 1..20: mol_type = other DNA
gcaatgatttctgtgggagg

SEQ ID NO: 33589 - DNA, 20 bp, synthetic construct
  misc_feature 1..20: note = CRISPR gRNA sequence
  source 1..20: mol_type = other DNA
caatgatttctgtgggaggg

SEQ ID NO: 33590 - DNA, 20 bp, synthetic construct
  misc_feature 1..20: note = CRISPR gRNA sequence
  source 1..20: mol_type = other DNA
ctgtgggaggggactgacgt

SEQ ID NO: 33591 - DNA, 20 bp, synthetic construct
  misc_feature 1..20: note = CRISPR gRNA sequence
  source 1..20: mol_type = other DNA
tgtgggaggggactgacgtg

SEQ ID NO: 33592 - DNA, 20 bp, synthetic construct
  misc_feature 1..20: note = CRISPR gRNA sequence
  source 1..20: mol_type = other DNA
tgggaggggactgacgtggc

SEQ ID NO: 33593 - DNA, 20 bp, synthetic construct
  misc_feature 1..20: note = CRISPR gRNA sequence
  source 1..20: mol_type = other DNA
acgtggctcatgatgaatgg

SEQ ID NO: 33594 - DNA, 20 bp, synthetic construct
  misc_feature 1..20: note = CRISPR gRNA sequence
  source 1..20: mol_type = other DNA
atgatgaatgggtgatattg

SEQ ID NO: 33595 - DNA, 20 bp, synthetic construct
  misc_feature 1..20: note = CRISPR gRNA sequence
  source 1..20: mol_type = other DNA
acaagtggcagcaaagaact

SEQ ID NO: 33596 - DNA, 20 bp, synthetic construct
  misc_feature 1..20: note = CRISPR gRNA sequence
  source 1..20: mol_type = other DNA
ttgcccttgattgtcctttt

SEQ ID NO: 33597 - DNA, 20 bp, synthetic construct
  misc_feature 1..20: note = CRISPR gRNA sequence
  source 1..20: mol_type = other DNA
gcccttgattgtccttttct

SEQ ID NO: 33598 - DNA, 20 bp, synthetic construct
  misc_feature 1..20: note = CRISPR gRNA sequence
  source 1..20: mol_type = other DNA
cccttgattgtccttttctg

SEQ ID NO: 33599 - DNA, 20 bp, synthetic construct
  misc_feature 1..20: note = CRISPR gRNA sequence
  source 1..20: mol_type = other DNA
gattgtccttttctgggctc

SEQ ID NO: 33600 - DNA, 20 bp, synthetic construct
  misc_feature 1..20: note = CRISPR gRNA sequence
  source 1..20: mol_type = other DNA
attgtccttttctgggctca

SEQ ID NO: 33601 - DNA, 20 bp, synthetic construct
  misc_feature 1..20: note = CRISPR gRNA sequence
  source 1..20: mol_type = other DNA
tccttttctgggctcaggtg

SEQ ID NO: 33602 - DNA, 20 bp, synthetic construct
  misc_feature 1..20: note = CRISPR gRNA sequence
  source 1..20: mol_type = other DNA
ttctgggctcaggtgcttcc

SEQ ID NO: 33603 - DNA, 20 bp, synthetic construct
  misc_feature 1..20: note = CRISPR gRNA sequence
  source 1..20: mol_type = other DNA
tctgggctcaggtgcttcct

SEQ ID NO: 33604 - DNA, 20 bp, synthetic construct
  misc_feature 1..20: note = CRISPR gRNA sequence
  source 1..20: mol_type = other DNA
ctgggctcaggtgcttcctc

SEQ ID NO: 33605 - DNA, 20 bp, synthetic construct
  misc_feature 1..20: note = CRISPR gRNA sequence
  source 1..20: mol_type = other DNA
tgggctcaggtgcttcctca

SEQ ID NO: 33606 - DNA, 20 bp, synthetic construct
  misc_feature 1..20: note = CRISPR gRNA sequence
  source 1..20: mol_type = other DNA
ggctcaggtgcttcctcacc

SEQ ID NO: 33607 - DNA, 20 bp, synthetic construct
  misc_feature 1..20: note = CRISPR gRNA sequence
  source 1..20: mol_type = other DNA
aggtgcttcctcaccgatat

SEQ ID NO: 33608 - DNA, 20 bp, synthetic construct
  misc_feature 1..20: note = CRISPR gRNA sequence
  source 1..20: mol_type = other DNA
cctcaccgatattggcataa

SEQ ID NO: 33609 - DNA, 20 bp, synthetic construct
  misc_feature 1..20: note = CRISPR gRNA sequence
  source 1..20: mol_type = other DNA
ctcaccgatattggcataag

SEQ ID NO: 33610 - DNA, 20 bp, synthetic construct
  misc_feature 1..20: note = CRISPR gRNA sequence
  source 1..20: mol_type = other DNA
accgatattggcataagcct

SEQ ID NO: 33611 - DNA, 20 bp, synthetic construct
  misc_feature 1..20: note = CRISPR gRNA sequence
  source 1..20: mol_type = other DNA
gcataagcctccctggtctc

SEQ ID NO: 33612 - DNA, 20 bp, synthetic construct
  misc_feature 1..20: note = CRISPR gRNA sequence
  source 1..20: mol_type = other DNA
cctggtctcttcatcacctt

SEQ ID NO: 33613 - DNA, 20 bp, synthetic construct
  misc_feature 1..20: note = CRISPR gRNA sequence
  source 1..20: mol_type = other DNA
gtctcttcatcaccttccat

SEQ ID NO: 33614 - DNA, 20 bp, synthetic construct
  misc_feature 1..20: note = CRISPR gRNA sequence
  source 1..20: mol_type = other DNA
ttcatcaccttccatgtcac

SEQ ID NO: 33615 - DNA, 20 bp, synthetic construct
  misc_feature 1..20: note = CRISPR gRNA sequence
  source 1..20: mol_type = other DNA
catcaccttccatgtcacac

SEQ ID NO: 33616 - DNA, 20 bp, synthetic construct
  misc_feature 1..20: note = CRISPR gRNA sequence
  source 1..20: mol_type = other DNA
atcaccttccatgtcacaca

SEQ ID NO: 33617 - DNA, 20 bp, synthetic construct
  misc_feature 1..20: note = CRISPR gRNA sequence
  source 1..20: mol_type = other DNA
ccatgtcacacaacagcctg

SEQ ID NO: 33618 - DNA, 20 bp, synthetic construct
  misc_feature 1..20: note = CRISPR gRNA sequence
  source 1..20: mol_type = other DNA
catgtcacacaacagcctgc

SEQ ID NO: 33619 - DNA, 20 bp, synthetic construct
  misc_feature 1..20: note = CRISPR gRNA sequence
  source 1..20: mol_type = other DNA
ctgaactggtcgcagttgat

SEQ ID NO: 33620 - DNA, 20 bp, synthetic construct
  misc_feature 1..20: note = CRISPR gRNA sequence
  source 1..20: mol_type = other DNA
aactggtcgcagttgatggt

SEQ ID NO: 33621 - DNA, 20 bp, synthetic construct
  misc_feature 1..20: note = CRISPR gRNA sequence
  source 1..20: mol_type = other DNA
gtcgcagttgatggtgtctg

SEQ ID NO: 33622 - DNA, 20 bp, synthetic construct
  misc_feature 1..20: note = CRISPR gRNA sequence
  source 1..20: mol_type = other DNA
atggtgtctgtgtcgggttc

SEQ ID NO: 33623 - DNA, 20 bp, synthetic construct
  misc_feature 1..20: note = CRISPR gRNA sequence
  source 1..20: mol_type = other DNA
tgtcgggttctgggaggaaa

SEQ ID NO: 33624 - DNA, 20 bp, synthetic construct
  misc_feature 1..20: note = CRISPR gRNA sequence
  source 1..20: mol_type = other DNA
tgggaggaaaagtcccttgg

SEQ ID NO: 33625 - DNA, 20 bp, synthetic construct
  misc_feature 1..20: note = CRISPR gRNA sequence
  source 1..20: mol_type = other DNA
ggaggaaaagtcccttggat

SEQ ID NO: 33626 - DNA, 20 bp, synthetic construct
  misc_feature 1..20: note = CRISPR gRNA sequence
  source 1..20: mol_type = other DNA
ggatgaagaaggaaatttct

SEQ ID NO: 33627 - DNA, 20 bp, synthetic construct
  misc_feature 1..20: note = CRISPR gRNA sequence
  source 1..20: mol_type = other DNA
gatgaagaaggaaatttctg

SEQ ID NO: 33628 - DNA, 20 bp, synthetic construct
  misc_feature 1..20: note = CRISPR gRNA sequence
  source 1..20: mol_type = other DNA
ctggaaagagggctggtggg

SEQ ID NO: 33629 - DNA, 20 bp, synthetic construct
  misc_feature 1..20: note = CRISPR gRNA sequence
  source 1..20: mol_type = other DNA
tggaaagagggctggtgggg

SEQ ID NO: 33630 - DNA, 20 bp, synthetic construct
  misc_feature 1..20: note = CRISPR gRNA sequence
  source 1..20: mol_type = other DNA
gaaagagggctggtggggaa

SEQ ID NO: 33631 - DNA, 20 bp, synthetic construct
  misc_feature 1..20: note = CRISPR gRNA sequence
  source 1..20: mol_type = other DNA
gtggggaacgagggagaggc

SEQ ID NO: 33632 - DNA, 20 bp, synthetic construct
  misc_feature 1..20: note = CRISPR gRNA sequence
  source 1..20: mol_type = other DNA
ggagatcatccccatctgca

SEQ ID NO: 33633 - DNA, 20 bp, synthetic construct
  misc_feature 1..20: note = CRISPR gRNA sequence
  source 1..20: mol_type = other DNA
cagagagcgtcccacagacg

SEQ ID NO: 33634 - DNA, 20 bp, synthetic construct
  misc_feature 1..20: note = CRISPR gRNA sequence
  source 1..20: mol_type = other DNA
tccgtggtgctgacgggagg

SEQ ID NO: 33635 - DNA, 20 bp, synthetic construct
  misc_feature 1..20: note = CRISPR gRNA sequence
  source 1..20: mol_type = other DNA
acgggagggcagggaccaga

SEQ ID NO: 33636 - DNA, 20 bp, synthetic construct
  misc_feature 1..20: note = CRISPR gRNA sequence
  source 1..20: mol_type = other DNA
cccctgattgccgtctctac

SEQ ID NO: 33637 - DNA, 20 bp, synthetic construct
  misc_feature 1..20: note = CRISPR gRNA sequence
  source 1..20: mol_type = other DNA
ccctgattgccgtctctaca

SEQ ID NO: 33638 - DNA, 20 bp, synthetic construct
  misc_feature 1..20: note = CRISPR gRNA sequence
  source 1..20: mol_type = other DNA
attgccgtctctacagcaag

SEQ ID NO: 33639 - DNA, 20 bp, synthetic construct
  misc_feature 1..20: note = CRISPR gRNA sequence
  source 1..20: mol_type = other DNA
ccgtctctacagcaagctga

SEQ ID NO: 33640 - DNA, 20 bp, synthetic construct
  misc_feature 1..20: note = CRISPR gRNA sequence
  source 1..20: mol_type = other DNA
tacagcaagctgaggggtgg

SEQ ID NO: 33641 - DNA, 20 bp, synthetic construct
  misc_feature 1..20: note = CRISPR gRNA sequence
  source 1..20: mol_type = other DNA
cagcaagctgaggggtgggg

SEQ ID NO: 33642 - DNA, 20 bp, synthetic construct
  misc_feature 1..20: note = CRISPR gRNA sequence
  source 1..20: mol_type = other DNA
aggggtgggggataccggaa

SEQ ID NO: 33643 - DNA, 20 bp, synthetic construct
  misc_feature 1..20: note = CRISPR gRNA sequence
  source 1..20: mol_type = other DNA
agtagagctcaatctcttct

SEQ ID NO: 33644 - DNA, 20 bp, synthetic construct
  misc_feature 1..20: note = CRISPR gRNA sequence
  source 1..20: mol_type = other DNA
aatctcttcttctccagcca

SEQ ID NO: 33645 - DNA, 20 bp, synthetic construct
  misc_feature 1..20: note = CRISPR gRNA sequence
  source 1..20: mol_type = other DNA
ttcttctccagccaggtcca

SEQ ID NO: 33646 - DNA, 20 bp, synthetic construct
  misc_feature 1..20: note = CRISPR gRNA sequence
  source 1..20: mol_type = other DNA
cttctccagccaggtccatc

SEQ ID NO: 33647 - DNA, 20 bp, synthetic construct
  misc_feature 1..20: note = CRISPR gRNA sequence
  source 1..20: mol_type = other DNA
ttctccagccaggtccatct

SEQ ID NO: 33648 - DNA, 20 bp, synthetic construct
  misc_feature 1..20: note = CRISPR gRNA sequence
  source 1..20: mol_type = other DNA
ctccagccaggtccatctgg

SEQ ID NO: 33649 - DNA, 20 bp, synthetic construct
  misc_feature 1..20: note = CRISPR gRNA sequence
  source 1..20: mol_type = other DNA
tccagccaggtccatctggt

SEQ ID NO: 33650 - DNA, 20 bp, synthetic construct
  misc_feature 1..20: note = CRISPR gRNA sequence
  source 1..20: mol_type = other DNA
cagccaggtccatctggtca

SEQ ID NO: 33651 - DNA, 20 bp, synthetic construct
  misc_feature 1..20: note = CRISPR gRNA sequence
  source 1..20: mol_type = other DNA
gtcatagaagtggtagaggc

SEQ ID NO: 33652 - DNA, 20 bp, synthetic construct
  misc_feature 1..20: note = CRISPR gRNA sequence
  source 1..20: mol_type = other DNA
ttaagaagctccaggtagcc

SEQ ID NO: 33653 - DNA, 20 bp, synthetic construct
  misc_feature 1..20: note = CRISPR gRNA sequence
  source 1..20: mol_type = other DNA
agaagctccaggtagccacc

SEQ ID NO: 33654 - DNA, 20 bp, synthetic construct
  misc_feature 1..20: note = CRISPR gRNA sequence
  source 1..20: mol_type = other DNA
caggtagccaccttctaggg

SEQ ID NO: 33655 - DNA, 20 bp, synthetic construct
  misc_feature 1..20: note = CRISPR gRNA sequence
  source 1..20: mol_type = other DNA
ctaggggccccaactccatg

SEQ ID NO: 33656 - DNA, 20 bp, synthetic construct
  misc_feature 1..20: note = CRISPR gRNA sequence
  source 1..20: mol_type = other DNA
taggggccccaactccatgg

SEQ ID NO: 33657 - DNA, 20 bp, synthetic construct
  misc_feature 1..20: note = CRISPR gRNA sequence
  source 1..20: mol_type = other DNA
ggggccccaactccatggtg

SEQ ID NO: 33658 - DNA, 20 bp, synthetic construct
  misc_feature 1..20: note = CRISPR gRNA sequence
  source 1..20: mol_type = other DNA
catggtggcacactgtgagc

SEQ ID NO: 33659 - DNA, 20 bp, synthetic construct
  misc_feature 1..20: note = CRISPR gRNA sequence
  source 1..20: mol_type = other DNA
tgagctgcctgggagggaag

SEQ ID NO: 33660 - DNA, 20 bp, synthetic construct
  misc_feature 1..20: note = CRISPR gRNA sequence
  source 1..20: mol_type = other DNA
cctgggagggaagacaatgc

SEQ ID NO: 33661 - DNA, 20 bp, synthetic construct
  misc_feature 1..20: note = CRISPR gRNA sequence
  source 1..20: mol_type = other DNA
ggagggaagacaatgctcag

SEQ ID NO: 33662 - DNA, 20 bp, synthetic construct
  misc_feature 1..20: note = CRISPR gRNA sequence
  source 1..20: mol_type = other DNA
agtcacctcacagggtgttg

SEQ ID NO: 33663 - DNA, 20 bp, synthetic construct
  misc_feature 1..20: note = CRISPR gRNA sequence
  source 1..20: mol_type = other DNA
acagggtgttggaaagaggc

SEQ ID NO: 33664 - DNA, 20 bp, synthetic construct
  misc_feature 1..20: note = CRISPR gRNA sequence
  source 1..20: mol_type = other DNA
gaaagaggcagaaaattgac

SEQ ID NO: 33665 - DNA, 20 bp, synthetic construct
  misc_feature 1..20: note = CRISPR gRNA sequence
  source 1..20: mol_type = other DNA
acacctacaacaactcccag

SEQ ID NO: 33666 - DNA, 20 bp, synthetic construct
  misc_feature 1..20: note = CRISPR gRNA sequence
  source 1..20: mol_type = other DNA
caacaactcccagctggtga

SEQ ID NO: 33667 - DNA, 20 bp, synthetic construct
  misc_feature 1..20: note = CRISPR gRNA sequence
  source 1..20: mol_type = other DNA
ccagctggtgagggctgggg

SEQ ID NO: 33668 - DNA, 20 bp, synthetic construct
  misc_feature 1..20: note = CRISPR gRNA sequence
  source 1..20: mol_type = other DNA
gtgagggctggggatgagag

SEQ ID NO: 33669 - DNA, 20 bp, synthetic construct
  misc_feature 1..20: note = CRISPR gRNA sequence
  source 1..20: mol_type = other DNA
gggatgagaggagtgaataa

SEQ ID NO: 33670 - DNA, 20 bp, synthetic construct
  misc_feature 1..20: note = CRISPR gRNA sequence
  source 1..20: mol_type = other DNA
attcagcacctcttatatgc

SEQ ID NO: 33671 - DNA, 20 bp, synthetic construct
  misc_feature 1..20: note = CRISPR gRNA sequence
  source 1..20: mol_type = other DNA
agcacctcttatatgctcag

SEQ ID NO: 33672 - DNA, 20 bp, synthetic construct
  misc_feature 1..20: note = CRISPR gRNA sequence
  source 1..20: mol_type = other DNA
ttatatgctcagcgtggtgg

SEQ ID NO: 33673 - DNA, 20 bp, synthetic construct
  misc_feature 1..20: note = CRISPR gRNA sequence
  source 1..20: mol_type = other DNA
atatgctcagcgtggtggag

SEQ ID NO: 33674 - DNA, 20 bp, synthetic construct
  misc_feature 1..20: note = CRISPR gRNA sequence
  source 1..20: mol_type = other DNA
tatgctcagcgtggtggaga

SEQ ID NO: 33675 - DNA, 20 bp, synthetic construct
  misc_feature 1..20: note = CRISPR gRNA sequence
  source 1..20: mol_type = other DNA
agcgtggtggagagagcaag

SEQ ID NO: 33676 - DNA, 20 bp, synthetic construct
  misc_feature 1..20: note = CRISPR gRNA sequence
  source 1..20: mol_type = other DNA
ccttcctccaaggaacttac

SEQ ID NO: 33677 - DNA, 20 bp, synthetic construct
  misc_feature 1..20: note = CRISPR gRNA sequence
  source 1..20: mol_type = other DNA
cctccaaggaacttacaacc

SEQ ID NO: 33678 - DNA, 20 bp, synthetic construct
  misc_feature 1..20: note = CRISPR gRNA sequence
  source 1..20: mol_type = other DNA
ctccaaggaacttacaacca

SEQ ID NO: 33679 - DNA, 20 bp, synthetic construct
  misc_feature 1..20: note = CRISPR gRNA sequence
  source 1..20: mol_type = other DNA
caaggaacttacaaccatat

SEQ ID NO: 33680 - DNA, 20 bp, synthetic construct
  misc_feature 1..20: note = CRISPR gRNA sequence
  source 1..20: mol_type = other DNA
acaaccatatgagaagatac

SEQ ID NO: 33681 - DNA, 20 bp, synthetic construct
  misc_feature 1..20: note = CRISPR gRNA sequence
  source 1..20: mol_type = other DNA
caaccatatgagaagatacc

SEQ ID NO: 33682 - DNA, 20 bp, synthetic construct
  misc_feature 1..20: note = CRISPR gRNA sequence
  source 1..20: mol_type = other DNA
gaaagtgtggattccatcaa

SEQ ID NO: 33683 - DNA, 20 bp, synthetic construct
  misc_feature 1..20: note = CRISPR gRNA sequence
  source 1..20: mol_type = other DNA
catcaatctcacaccagaga

SEQ ID NO: 33684 - DNA, 20 bp, synthetic construct
  misc_feature 1..20: note = CRISPR gRNA sequence
  source 1..20: mol_type = other DNA
acaccagagagtcaggagac

SEQ ID NO: 33685 - DNA, 20 bp, synthetic construct
  misc_feature 1..20: note = CRISPR gRNA sequence
  source 1..20: mol_type = other DNA
ggcaatgccatgagtggtaa

SEQ ID NO: 33686 - DNA, 20 bp, synthetic construct
  misc_feature 1..20: note = CRISPR gRNA sequence
  source 1..20: mol_type = other DNA
gcaatgccatgagtggtaac

SEQ ID NO: 33687 - DNA, 20 bp, synthetic construct
  misc_feature 1..20: note = CRISPR gRNA sequence
  source 1..20: mol_type = other DNA
aggtttataaagcacctcct

SEQ ID NO: 33688 - DNA, 20 bp, synthetic construct
  misc_feature 1..20: note = CRISPR gRNA sequence
  source 1..20: mol_type = other DNA
ataaagcacctcctatacgc

SEQ ID NO: 33689 - DNA, 20 bp, synthetic construct
  misc_feature 1..20: note = CRISPR gRNA sequence
  source 1..20: mol_type = other DNA
taaagcacctcctatacgcc

SEQ ID NO: 33690 - DNA, 20 bp, synthetic construct
  misc_feature 1..20: note = CRISPR gRNA sequence
  source 1..20: mol_type = other DNA
ctatacgccaggcacatgag

SEQ ID NO: 33691 - DNA, 20 bp, synthetic construct
  misc_feature 1..20: note = CRISPR gRNA sequence
  source 1..20: mol_type = other DNA
tacgccaggcacatgagctg

SEQ ID NO: 33692 - DNA, 20 bp, synthetic construct
  misc_feature 1..20: note = CRISPR gRNA sequence
  source 1..20: mol_type = other DNA
gcacatttaatactcatatc

SEQ ID NO: 33693 - DNA, 20 bp, synthetic construct
  misc_feature 1..20: note = CRISPR gRNA sequence
  source 1..20: mol_type = other DNA
aatactcatatcagtaacca

SEQ ID NO: 33694 - DNA, 20 bp, synthetic construct
  misc_feature 1..20: note = CRISPR gRNA sequence
  source 1..20: mol_type = other DNA
atactcatatcagtaaccat

SEQ ID NO: 33695 - DNA, 20 bp, synthetic construct
  misc_feature 1..20: note = CRISPR gRNA sequence
  source 1..20: mol_type = other DNA
atatcagtaaccatgtaagg

SEQ ID NO: 33696 - DNA, 20 bp, synthetic construct
  misc_feature 1..20: note = CRISPR gRNA sequence
  source 1..20: mol_type = other DNA
ttattatcctcactttgcat

SEQ ID NO: 33697 - DNA, 20 bp, synthetic construct
  misc_feature 1..20: note = CRISPR gRNA sequence
  source 1..20: mol_type = other DNA
ttatcctcactttgcatatg

SEQ ID NO: 33698 - DNA, 20 bp, synthetic construct
  misc_feature 1..20: note = CRISPR gRNA sequence
  source 1..20: mol_type = other DNA
tcctcactttgcatatgaga

SEQ ID NO: 33699 - DNA, 20 bp, synthetic construct
  misc_feature 1..20: note = CRISPR gRNA sequence
  source 1..20: mol_type = other DNA
actttgcatatgagaaaact

SEQ ID NO: 33700 - DNA, 20 bp, synthetic construct
  misc_feature 1..20: note = CRISPR gRNA sequence
  source 1..20: mol_type = other DNA
tgcatatgagaaaactgagg

SEQ ID NO: 33701 - DNA, 20 bp, synthetic construct
  misc_feature 1..20: note = CRISPR gRNA sequence
  source 1..20: mol_type = other DNA
gcatatgagaaaactgaggc

SEQ ID NO: 33702 - DNA, 20 bp, synthetic construct
  misc_feature 1..20: note = CRISPR gRNA sequence
  source 1..20: mol_type = other DNA
catatgagaaaactgaggct

SEQ ID NO: 33703 - DNA, 20 bp, synthetic construct
  misc_feature 1..20: note = CRISPR gRNA sequence
  source 1..20: mol_type = other DNA
aggctcagagaggtgaagtg

SEQ ID NO: 33704 - DNA, 20 bp, synthetic construct
  misc_feature 1..20: note = CRISPR gRNA sequence
  source 1..20: mol_type = other DNA
agagaggtgaagtgatttat

SEQ ID NO: 33705 - DNA, 20 bp, synthetic construct
  misc_feature 1..20: note = CRISPR gRNA sequence
  source 1..20: mol_type = other DNA
atgtaaggaaacccatgtcc

SEQ ID NO: 33706 - DNA, 20 bp, synthetic construct
  misc_feature 1..20: note = CRISPR gRNA sequence
  source 1..20: mol_type = other DNA
tgtaaggaaacccatgtcca

SEQ ID NO: 33707 - DNA, 20 bp, synthetic construct
  misc_feature 1..20: note = CRISPR gRNA sequence
  source 1..20: mol_type = other DNA
gaacccagacagtctgactg

SEQ ID NO: 33708 - DNA, 20 bp, synthetic construct
  misc_feature 1..20: note = CRISPR gRNA sequence
  source 1..20: mol_type = other DNA
aacccagacagtctgactga

SEQ ID NO: 33709 - DNA, 20 bp, synthetic construct
  misc_feature 1..20: note = CRISPR gRNA sequence
  source 1..20: mol_type = other DNA
actgaagtcctgcatttaac

SEQ ID NO: 33710 - DNA, 20 bp, synthetic construct
  misc_feature 1..20: note = CRISPR gRNA sequence
  source 1..20: mol_type = other DNA
aagtcctgcatttaaccaca

SEQ ID NO: 33711 - DNA, 20 bp, synthetic construct
  misc_feature 1..20: note = CRISPR gRNA sequence
  source 1..20: mol_type = other DNA
catttaaccacaatgctcta

SEQ ID NO: 33712 - DNA, 20 bp, synthetic construct
  misc_feature 1..20: note = CRISPR gRNA sequence
  source 1..20: mol_type = other DNA
aaccacaatgctctactgct

SEQ ID NO: 33713 - DNA, 20 bp, synthetic construct
  misc_feature 1..20: note = CRISPR gRNA sequence
  source 1..20: mol_type = other DNA
accacaatgctctactgctt

SEQ ID NO: 33714 - DNA, 20 bp, synthetic construct
  misc_feature 1..20: note = CRISPR gRNA sequence
  source 1..20: mol_type = other DNA
tactgctttgggtggacttg

SEQ ID NO: 33715 - DNA, 20 bp, synthetic construct
  misc_feature 1..20: note = CRISPR gRNA sequence
  source 1..20: mol_type = other DNA
ctgctttgggtggacttgag

SEQ ID NO: 33716 - DNA, 20 bp, synthetic construct
  misc_feature 1..20: note = CRISPR gRNA sequence
  source 1..20: mol_type = other DNA
ctttgggtggacttgagcaa

SEQ ID NO: 33717 - DNA, 20 bp, synthetic construct
  misc_feature 1..20: note = CRISPR gRNA sequence
  source 1..20: mol_type = other DNA
tgggtggacttgagcaagtc

SEQ ID NO: 33718 - DNA, 20 bp, synthetic construct
  misc_feature 1..20: note = CRISPR gRNA sequence
  source 1..20: mol_type = other DNA
gggtggacttgagcaagtct

SEQ ID NO: 33719 - DNA, 20 bp, synthetic construct
  misc_feature 1..20: note = CRISPR gRNA sequence
  source 1..20: mol_type = other DNA
ggtggacttgagcaagtctc

SEQ ID NO: 33720 - DNA, 20 bp, synthetic construct
  misc_feature 1..20: note = CRISPR gRNA sequence
  source 1..20: mol_type = other DNA
gagcaagtctctgctccttt

SEQ ID NO: 33721 - DNA, 20 bp, synthetic construct
  misc_feature 1..20: note = CRISPR gRNA sequence
  source 1..20: mol_type = other DNA
agcaagtctctgctcctttc

SEQ ID NO: 33722 - DNA, 20 bp, synthetic construct
  misc_feature 1..20: note = CRISPR gRNA sequence
  source 1..20: mol_type = other DNA
tgctcctttctgtgcctcag

SEQ ID NO: 33723 - DNA, 20 bp, synthetic construct
  misc_feature 1..20: note = CRISPR gRNA sequence
  source 1..20: mol_type = other DNA
ctcctttctgtgcctcagtt

SEQ ID NO: 33724 - DNA, 20 bp, synthetic construct
  misc_feature 1..20: note = CRISPR gRNA sequence
  source 1..20: mol_type = other DNA
ctttctgtgcctcagtttcc

SEQ ID NO: 33725 - DNA, 20 bp, synthetic construct
  misc_feature 1..20: note = CRISPR gRNA sequence
  source 1..20: mol_type = other DNA
tctgtgcctcagtttcctaa

SEQ ID NO: 33726 - DNA, 20 bp, synthetic construct
  misc_feature 1..20: note = CRISPR gRNA sequence
  source 1..20: mol_type = other DNA
ctgtgcctcagtttcctaat

SEQ ID NO: 33727 - DNA, 20 bp, synthetic construct
  misc_feature 1..20: note = CRISPR gRNA sequence
  source 1..20: mol_type = other DNA
tgtgcctcagtttcctaata

SEQ ID NO: 33728 - DNA, 20 bp, synthetic construct
  misc_feature 1..20: note = CRISPR gRNA sequence
  source 1..20: mol_type = other DNA
tgcctcagtttcctaatatg

SEQ ID NO: 33729 - DNA, 20 bp, synthetic construct
  misc_feature 1..20: note = CRISPR gRNA sequence
  source 1..20: mol_type = other DNA
agtttcctaatatgtaaact

SEQ ID NO: 33730 - DNA, 20 bp, synthetic construct
  misc_feature 1..20: note = CRISPR gRNA sequence
  source 1..20: mol_type = other DNA
cctaatatgtaaactgaagg

SEQ ID NO: 33731 - DNA, 20 bp, synthetic construct
  misc_feature 1..20: note = CRISPR gRNA sequence
  source 1..20: mol_type = other DNA
ctaatatgtaaactgaagga

SEQ ID NO: 33732 - DNA, 20 bp, synthetic construct
  misc_feature 1..20: note = CRISPR gRNA sequence
  source 1..20: mol_type = other DNA
atatgtaaactgaaggagtc

SEQ ID NO: 33733 - DNA, 20 bp, synthetic construct
  misc_feature 1..20: note = CRISPR gRNA sequence
  source 1..20: mol_type = other DNA
aaggagtctgagcagattct

SEQ ID NO: 33734 - DNA, 20 bp, synthetic construct
  misc_feature 1..20: note = CRISPR gRNA sequence
  source 1..20: mol_type = other DNA
agcagattctaagatttcct

SEQ ID NO: 33735 - DNA, 20 bp, synthetic construct
  misc_feature 1..20: note = CRISPR gRNA sequence
  source 1..20: mol_type = other DNA
taagatttcctcatcatttg

SEQ ID NO: 33736 - DNA, 20 bp, synthetic construct
  misc_feature 1..20: note = CRISPR gRNA sequence
  source 1..20: mol_type = other DNA
agatttcctcatcatttgtt

SEQ ID NO: 33737 - DNA, 20 bp, synthetic construct
  misc_feature 1..20: note = CRISPR gRNA sequence
  source 1..20: mol_type = other DNA
cctcatcatttgttgaaggg

SEQ ID NO: 33738 - DNA, 20 bp, synthetic construct
  misc_feature 1..20: note = CRISPR gRNA sequence
  source 1..20: mol_type = other DNA
ctcatcatttgttgaagggc

SEQ ID NO: 33739 - DNA, 20 bp, synthetic construct
  misc_feature 1..20: note = CRISPR gRNA sequence
  source 1..20: mol_type = other DNA
atcatttgttgaagggcata

SEQ ID NO: 33740 - DNA, 20 bp, synthetic construct
  misc_feature 1..20: note = CRISPR gRNA sequence
  source 1..20: mol_type = other DNA
gttgaagggcatattaaata

SEQ ID NO: 33741 - DNA, 20 bp, synthetic construct
  misc_feature 1..20: note = CRISPR gRNA sequence
  source 1..20: mol_type = other DNA
ttgaagggcatattaaatac

SEQ ID NO: 33742 - DNA, 20 bp, synthetic construct
  misc_feature 1..20: note = CRISPR gRNA sequence
  source 1..20: mol_type = other DNA
aagggcatattaaatacttt

SEQ ID NO: 33743 - DNA, 20 bp, synthetic construct
  misc_feature 1..20: note = CRISPR gRNA sequence
  source 1..20: mol_type = other DNA
aatacttttaacactatttc

SEQ ID NO: 33744 - DNA, 20 bp, synthetic construct
  misc_feature 1..20: note = CRISPR gRNA sequence
  source 1..20: mol_type = other DNA
ttaacactatttcatttaat

SEQ ID NO: 33745 - DNA, 20 bp, synthetic construct
  misc_feature 1..20: note = CRISPR gRNA sequence
  source 1..20: mol_type = other DNA
taacactatttcatttaatc

SEQ ID NO: 33746 - DNA, 20 bp, synthetic construct
  misc_feature 1..20: note = CRISPR gRNA sequence
  source 1..20: mol_type = other DNA
aacactatttcatttaatct

SEQ ID NO: 33747 - DNA, 20 bp, synthetic construct
  misc_feature 1..20: note = CRISPR gRNA sequence
  source 1..20: mol_type = other DNA
acactatttcatttaatctt

SEQ ID NO: 33748 - DNA, 20 bp, synthetic construct
  misc_feature 1..20: note = CRISPR gRNA sequence
  source 1..20: mol_type = other DNA
tttcatttaatctttaaaca

SEQ ID NO: 33749 - DNA, 20 bp, synthetic construct
  misc_feature 1..20: note = CRISPR gRNA sequence
  source 1..20: mol_type = other DNA
catttaatctttaaacaatc

SEQ ID NO: 33750 - DNA, 20 bp, synthetic construct
  misc_feature 1..20: note = CRISPR gRNA sequence
  source 1..20: mol_type = other DNA
atttaatctttaaacaatcc

SEQ ID NO: 33751 - DNA, 20 bp, synthetic construct
  misc_feature 1..20: note = CRISPR gRNA sequence
  source 1..20: mol_type = other DNA
aatctttaaacaatcccaaa

SEQ ID NO: 33752 - DNA, 20 bp, synthetic construct
  misc_feature 1..20: note = CRISPR gRNA sequence
  source 1..20: mol_type = other DNA
atctttaaacaatcccaaat

SEQ ID NO: 33753 - DNA, 20 bp, synthetic construct
  misc_feature 1..20: note = CRISPR gRNA sequence
  source 1..20: mol_type = other DNA
taaacaatcccaaatgtgga

SEQ ID NO: 33754 - DNA, 20 bp, synthetic construct
  misc_feature 1..20: note = CRISPR gRNA sequence
  source 1..20: mol_type = other DNA
aaacaatcccaaatgtggat

SEQ ID NO: 33755 - DNA, 20 bp, synthetic construct
  misc_feature 1..20: note = CRISPR gRNA sequence
  source 1..20: mol_type = other DNA
aacaatcccaaatgtggata

SEQ ID NO: 33756 - DNA, 20 bp, synthetic construct
  misc_feature 1..20: note = CRISPR gRNA sequence
  source 1..20: mol_type = other DNA
aaatatcctgacatgatcat

SEQ ID NO: 33757 - DNA, 20 bp, synthetic construct
  misc_feature 1..20: note = CRISPR gRNA sequence
  source 1..20: mol_type = other DNA
acatgatcattataccttct

SEQ ID NO: 33758 - DNA, 20 bp, synthetic construct
  misc_feature 1..20: note = CRISPR gRNA sequence
  source 1..20: mol_type = other DNA
taccttctatgcatgtaata

SEQ ID NO: 33759 - DNA, 20 bp, synthetic construct
  misc_feature 1..20: note = CRISPR gRNA sequence
  source 1..20: mol_type = other DNA
ctatgcatgtaataaatatt

SEQ ID NO: 33760 - DNA, 20 bp, synthetic construct
  misc_feature 1..20: note = CRISPR gRNA sequence
  source 1..20: mol_type = other DNA
tatgcatgtaataaatattc

SEQ ID NO: 33761 - DNA, 20 bp, synthetic construct
  misc_feature 1..20: note = CRISPR gRNA sequence
  source 1..20: mol_type = other DNA
tgcatgtaataaatattcac

SEQ ID NO: 33762 - DNA, 20 bp, synthetic construct
  misc_feature 1..20: note = CRISPR gRNA sequence
  source 1..20: mol_type = other DNA
acatataccccataaatatg

SEQ ID NO: 33763 - DNA, 20 bp, synthetic construct
  misc_feature 1..20: note = CRISPR gRNA sequence
  source 1..20: mol_type = other DNA
tgtattaataaaacaaaaga

SEQ ID NO: 33764 - DNA, 20 bp, synthetic construct
  misc_feature 1..20: note = CRISPR gRNA sequence
  source 1..20: mol_type = other DNA
ataaaacaaaagaaaacaag

SEQ ID NO: 33765 - DNA, 20 bp, synthetic construct
  misc_feature 1..20: note = CRISPR gRNA sequence
  source 1..20: mol_type = other DNA
tacacgaatgttcacagaag

SEQ ID NO: 33766 - DNA, 20 bp, synthetic construct
  misc_feature 1..20: note = CRISPR gRNA sequence
  source 1..20: mol_type = other DNA
acagaaggataattcaaaat

SEQ ID NO: 33767 - DNA, 20 bp, synthetic construct
  misc_feature 1..20: note = CRISPR gRNA sequence
  source 1..20: mol_type = other DNA
aaaatagccaaaatataaaa

SEQ ID NO: 33768 - DNA, 20 bp, synthetic construct
  misc_feature 1..20: note = CRISPR gRNA sequence
  source 1..20: mol_type = other DNA
cttatctatacaataaagta

SEQ ID NO: 33769 - DNA, 20 bp, synthetic construct
  misc_feature 1..20: note = CRISPR gRNA sequence
  source 1..20: mol_type = other DNA
atctatacaataaagtattc

SEQ ID NO: 33770 - DNA, 20 bp, synthetic construct
  misc_feature 1..20: note = CRISPR gRNA sequence
  source 1..20: mol_type = other DNA
tctatacaataaagtattcc

SEQ ID NO: 33771 - DNA, 20 bp, synthetic construct
  misc_feature 1..20: note = CRISPR gRNA sequence
  source 1..20: mol_type = other DNA
tacaataaagtattccacca

SEQ ID NO: 33772 - DNA, 20 bp, synthetic construct
  misc_feature 1..20: note = CRISPR gRNA sequence
  source 1..20: mol_type = other DNA
caccattaaagggagaaagc

SEQ ID NO: 33773 - DNA, 20 bp, synthetic construct
  misc_feature 1..20: note = CRISPR gRNA sequence
  source 1..20: mol_type = other DNA
aagggagaaagcactgatac

SEQ ID NO: 33774 - DNA, 20 bp, synthetic construct
  misc_feature 1..20: note = CRISPR gRNA sequence
  source 1..20: mol_type = other DNA
atacatgctggaacatggat

SEQ ID NO: 33775 - DNA, 20 bp, synthetic construct
  misc_feature 1..20: note = CRISPR gRNA sequence
  source 1..20: mol_type = other DNA
gaacatggatgaaccttaaa

SEQ ID NO: 33776 - DNA, 20 bp, synthetic construct
  misc_feature 1..20: note = CRISPR gRNA sequence
  source 1..20: mol_type = other DNA
aaaaaaaatgctaagtgaag

SEQ ID NO: 33777 - DNA, 20 bp, synthetic construct
  misc_feature 1..20: note = CRISPR gRNA sequence
  source 1..20: mol_type = other DNA
aaaaaaatgctaagtgaaga

SEQ ID NO: 33778 - DNA, 20 bp, synthetic construct
  misc_feature 1..20: note = CRISPR gRNA sequence
  source 1..20: mol_type = other DNA
agtgaagaagccggacacaa

SEQ ID NO: 33779 - DNA, 20 bp, synthetic construct
  misc_feature 1..20: note = CRISPR gRNA sequence
  source 1..20: mol_type = other DNA
tatgattctatttatttgaa

SEQ ID NO: 33780 - DNA, 20 bp, synthetic construct
  misc_feature 1..20: note = CRISPR gRNA sequence
  source 1..20: mol_type = other DNA
tatttatttgaaatgaccaa

SEQ ID NO: 33781 - DNA, 20 bp, synthetic construct
  misc_feature 1..20: note = CRISPR gRNA sequence
  source 1..20: mol_type = other DNA
tttatttgaaatgaccaaaa

SEQ ID NO: 33782 - DNA, 20 bp, synthetic construct
  misc_feature 1..20: note = CRISPR gRNA sequence
  source 1..20: mol_type = other DNA
atttgaaatgaccaaaacag

SEQ ID NO: 33783 - DNA, 20 bp, synthetic construct
  misc_feature 1..20: note = CRISPR gRNA sequence
  source 1..20: mol_type = other DNA
tttgaaatgaccaaaacagg

SEQ ID NO: 33784 - DNA, 20 bp, synthetic construct
  misc_feature 1..20: note = CRISPR gRNA sequence
  source 1..20: mol_type = other DNA
gaaatgaccaaaacaggcaa

SEQ ID NO: 33785 - DNA, 20 bp, synthetic construct
  misc_feature 1..20: note = CRISPR gRNA sequence
  source 1..20: mol_type = other DNA
aaatgaccaaaacaggcaaa

SEQ ID NO: 33786 - DNA, 20 bp, synthetic construct
  misc_feature 1..20: note = CRISPR gRNA sequence
  source 1..20: mol_type = other DNA
atgcctgaaatcccagcact

SEQ ID NO: 33787 - DNA, 20 bp, synthetic construct
  misc_feature 1..20: note = CRISPR gRNA sequence
  source 1..20: mol_type = other DNA
aaatcccagcactttgggag

SEQ ID NO: 33788 - DNA, 20 bp, synthetic construct
  misc_feature 1..20: note = CRISPR gRNA sequence
  source 1..20: mol_type = other DNA
tgggaggctgagacaggaga

SEQ ID NO: 33789 - DNA, 20 bp, synthetic construct
  misc_feature 1..20: note = CRISPR gRNA sequence
  source 1..20: mol_type = other DNA
gggaggctgagacaggagaa

SEQ ID NO: 33790 - DNA, 20 bp, synthetic construct
  misc_feature 1..20: note = CRISPR gRNA sequence
  source 1..20: mol_type = other DNA
ggaggctgagacaggagaat

SEQ ID NO: 33791 - DNA, 20 bp, synthetic construct
  misc_feature 1..20: note = CRISPR gRNA sequence
  source 1..20: mol_type = other DNA
agacaggagaatcgcttgag

SEQ ID NO: 33792 - DNA, 20 bp, synthetic construct
  misc_feature 1..20: note = CRISPR gRNA sequence
  source 1..20: mol_type = other DNA
gagcccaggtgttcaagacc

SEQ ID NO: 33793 - DNA, 20 bp, synthetic construct
  misc_feature 1..20: note = CRISPR gRNA sequence
  source 1..20: mol_type = other DNA
agcccaggtgttcaagacca

SEQ ID NO: 33794 - DNA, 20 bp, synthetic construct
  misc_feature 1..20: note = CRISPR gRNA sequence
  source 1..20: mol_type = other DNA
aagaccagcctgggcaacat

SEQ ID NO: 33795 - DNA, 20 bp, synthetic construct
  misc_feature 1..20: note = CRISPR gRNA sequence
  source 1..20: mol_type = other DNA
ggcaacatagcaaaagccta

SEQ ID NO: 33796 - DNA, 20 bp, synthetic construct
  misc_feature 1..20: note = CRISPR gRNA sequence
  source 1..20: mol_type = other DNA
tctctattaattttttttta

SEQ ID NO: 33797 - DNA, 20 bp, synthetic construct
  misc_feature 1..20: note = CRISPR gRNA sequence
  source 1..20: mol_type = other DNA
tattaatttttttttaagaa

SEQ ID NO: 33798 - DNA, 20 bp, synthetic construct
  misc_feature 1..20: note = CRISPR gRNA sequence
  source 1..20: mol_type = other DNA
ttaatttttttttaagaaag

SEQ ID NO: 33799 - DNA, 20 bp, synthetic construct
  misc_feature 1..20: note = CRISPR gRNA sequence
  source 1..20: mol_type = other DNA
atttttttttaagaaagaaa

SEQ ID NO: 33800 - DNA, 20 bp, synthetic construct
  misc_feature 1..20: note = CRISPR gRNA sequence
  source 1..20: mol_type = other DNA
ttttttaagaaagaaagcat

SEQ ID NO: 33801 - DNA, 20 bp, synthetic construct
  misc_feature 1..20: note = CRISPR gRNA sequence
  source 1..20: mol_type = other DNA
tttttaagaaagaaagcata

SEQ ID NO: 33802 - DNA, 20 bp, synthetic construct
  misc_feature 1..20: note = CRISPR gRNA sequence
  source 1..20: mol_type = other DNA
ttttaagaaagaaagcatat

SEQ ID NO: 33803 - DNA, 20 bp, synthetic construct
  misc_feature 1..20: note = CRISPR gRNA sequence
  source 1..20: mol_type = other DNA
tttaagaaagaaagcatatt

SEQ ID NO: 33804 - DNA, 20 bp, synthetic construct
  misc_feature 1..20: note = CRISPR gRNA sequence
  source 1..20: mol_type = other DNA
ttaagaaagaaagcatatta

SEQ ID NO: 33805 - DNA, 20 bp, synthetic construct
  misc_feature 1..20: note = CRISPR gRNA sequence
  source 1..20: mol_type = other DNA
taagaaagaaagcatattag

SEQ ID NO: 33806 - DNA, 20 bp, synthetic construct
  misc_feature 1..20: note = CRISPR gRNA sequence
  source 1..20: mol_type = other DNA
aagaaagaaagcatattagt

SEQ ID NO: 33807 - DNA, 20 bp, synthetic construct
  misc_feature 1..20: note = CRISPR gRNA sequence
  source 1..20: mol_type = other DNA
agaaagaaagcatattagtg

SEQ ID NO: 33808 - DNA, 20 bp, synthetic construct
  misc_feature 1..20: note = CRISPR gRNA sequence
  source 1..20: mol_type = other DNA
gtggttgcctagggcttggc

SEQ ID NO: 33809 - DNA, 20 bp, synthetic construct
  misc_feature 1..20: note = CRISPR gRNA sequence
  source 1..20: mol_type = other DNA
cctagggcttggcagagagg

SEQ ID NO: 33810 - DNA, 20 bp, synthetic construct
  misc_feature 1..20: note = CRISPR gRNA sequence
  source 1..20: mol_type = other DNA
gggcttggcagagagggatt

SEQ ID NO: 33811 - DNA, 20 bp, synthetic construct
  misc_feature 1..20: note = CRISPR gRNA sequence
  source 1..20: mol_type = other DNA
ggcagagagggattttggaa

SEQ ID NO: 33812 - DNA, 20 bp, synthetic construct
  misc_feature 1..20: note = CRISPR gRNA sequence
  source 1..20: mol_type = other DNA
gcagagagggattttggaag

SEQ ID NO: 33813 - DNA, 20 bp, synthetic construct
  misc_feature 1..20: note = CRISPR gRNA sequence
  source 1..20: mol_type = other DNA
tggaaggaaatggggaacaa

SEQ ID NO: 33814 - DNA, 20 bp, synthetic construct
  misc_feature 1..20: note = CRISPR gRNA sequence
  source 1..20: mol_type = other DNA
ggaaggaaatggggaacaac

SEQ ID NO: 33815 - DNA, 20 bp, synthetic construct
  misc_feature 1..20: note = CRISPR gRNA sequence
  source 1..20: mol_type = other DNA
gaaggaaatggggaacaact

SEQ ID NO: 33816 - DNA, 20 bp, synthetic construct
  misc_feature 1..20: note = CRISPR gRNA sequence
  source 1..20: mol_type = other DNA
ctgatgggtctggagtttct

SEQ ID NO: 33817 - DNA, 20 bp, synthetic construct
  misc_feature 1..20: note = CRISPR gRNA sequence
  source 1..20: mol_type = other DNA
atgggtctggagtttcttta

SEQ ID NO: 33818 - DNA, 20 bp, synthetic construct
  misc_feature 1..20: note = CRISPR gRNA sequence
  source 1..20: mol_type = other DNA
gagtttctttagggggtgat

SEQ ID NO: 33819 - DNA, 20 bp, synthetic construct
  misc_feature 1..20: note = CRISPR gRNA sequence
  source 1..20: mol_type = other DNA
ctttagggggtgatgaaatg

SEQ ID NO: 33820 - DNA, 20 bp, synthetic construct
  misc_feature 1..20: note = CRISPR gRNA sequence
  source 1..20: mol_type = other DNA
tttagggggtgatgaaatgt

SEQ ID NO: 33821 - DNA, 20 bp, synthetic construct
  misc_feature 1..20: note = CRISPR gRNA sequence
  source 1..20: mol_type = other DNA
tagggggtgatgaaatgtgc

SEQ ID NO: 33822 - DNA, 20 bp, synthetic construct
  misc_feature 1..20: note = CRISPR gRNA sequence
  source 1..20: mol_type = other DNA
agggggtgatgaaatgtgct

SEQ ID NO: 33823 - DNA, 20 bp, synthetic construct
  misc_feature 1..20: note = CRISPR gRNA sequence
  source 1..20: mol_type = other DNA
gggggtgatgaaatgtgcta

SEQ ID NO: 33824 - DNA, 20 bp, synthetic construct
  misc_feature 1..20: note = CRISPR gRNA sequence
  source 1..20: mol_type = other DNA
aaattgactgtggggatggg

SEQ ID NO: 33825 - DNA, 20 bp, synthetic construct
  misc_feature 1..20: note = CRISPR gRNA sequence
  source 1..20: mol_type = other DNA
actgtggggatgggagatgg

SEQ ID NO: 33826 - DNA, 20 bp, synthetic construct
  misc_feature 1..20: note = CRISPR gRNA sequence
  source 1..20: mol_type = other DNA
tggggatgggagatggtcac

SEQ ID NO: 33827 - DNA, 20 bp, synthetic construct
  misc_feature 1..20: note = CRISPR gRNA sequence
  source 1..20: mol_type = other DNA
tctgagtattcccaaaagaa

SEQ ID NO: 33828 - DNA, 20 bp, synthetic construct
  misc_feature 1..20: note = CRISPR gRNA sequence
  source 1..20: mol_type = other DNA
tgagtattcccaaaagaaca

SEQ ID NO: 33829 - DNA, 20 bp, synthetic construct
  misc_feature 1..20: note = CRISPR gRNA sequence
  source 1..20: mol_type = other DNA
agtattcccaaaagaacact

SEQ ID NO: 33830 - DNA, 20 bp, synthetic construct
  misc_feature 1..20: note = CRISPR gRNA sequence
  source 1..20: mol_type = other DNA
ccaaaagaacactgaactct

SEQ ID NO: 33831 - DNA, 20 bp, synthetic construct
  misc_feature 1..20: note = CRISPR gRNA sequence
  source 1..20: mol_type = other DNA
aactctactttttttttttt

SEQ ID NO: 33832 - DNA, 20 bp, synthetic construct
  misc_feature 1..20: note = CRISPR gRNA sequence
  source 1..20: mol_type = other DNA
tacttttttttttttttttt

SEQ ID NO: 33833 - DNA, 20 bp, synthetic construct
  misc_feature 1..20: note = CRISPR gRNA sequence
  source 1..20: mol_type = other DNA
cttttttttttttttttttt

SEQ ID NO: 33834 - DNA, 20 bp, synthetic construct
  misc_feature 1..20: note = CRISPR gRNA sequence
  source 1..20: mol_type = other DNA
tttttttttttttttttttt

SEQ ID NO: 33835 - DNA, 20 bp, synthetic construct
  misc_feature 1..20: note = CRISPR gRNA sequence
  source 1..20: mol_type = other DNA
tttttttttttttttttttt

SEQ ID NO: 33836 - DNA, 20 bp, synthetic construct
  misc_feature 1..20: note = CRISPR gRNA sequence
  source 1..20: mol_type = other DNA
tttttttttttttttttttt

SEQ ID NO: 33837 - DNA, 20 bp, synthetic construct
  misc_feature 1..20: note = CRISPR gRNA sequence
  source 1..20: mol_type = other DNA
tttttttttttttttttttt

SEQ ID NO: 33838 - DNA, 20 bp, synthetic construct
  misc_feature 1..20: note = CRISPR gRNA sequence
  source 1..20: mol_type = other DNA
tttttttttttttttttttt

SEQ ID NO: 33839 - DNA, 20 bp, synthetic construct
  misc_feature 1..20: note = CRISPR gRNA sequence
  source 1..20: mol_type = other DNA
tttttttttttttttttttt

SEQ ID NO: 33840 - DNA, 20 bp, synthetic construct
  misc_feature 1..20: note = CRISPR gRNA sequence
  source 1..20: mol_type = other DNA
tttttttttttttttttttt

SEQ ID NO: 33841 - DNA, 20 bp, synthetic construct
  misc_feature 1..20: note = CRISPR gRNA sequence
  source 1..20: mol_type = other DNA
tttttttttttttttttttt

SEQ ID NO: 33842 - DNA, 20 bp, synthetic construct
  misc_feature 1..20: note = CRISPR gRNA sequence
  source 1..20: mol_type = other DNA
tttttttttttttttttttt

SEQ ID NO: 33843 - DNA, 20 bp, synthetic construct
  misc_feature 1..20: note = CRISPR gRNA sequence
  source 1..20: mol_type = other DNA
ttttttttttttttttttta

SEQ ID NO: 33844 - DNA, 20 bp, synthetic construct
  misc_feature 1..20: note = CRISPR gRNA sequence
  source 1..20: mol_type = other DNA
ttttttttttttttttttaa

SEQ ID NO: 33845 - DNA, 20 bp, synthetic construct
  misc_feature 1..20: note = CRISPR gRNA sequence
  source 1..20: mol_type = other DNA
tttttttttttttttttaag

SEQ ID NO: 33846 - DNA, 20 bp, synthetic construct
  misc_feature 1..20: note = CRISPR gRNA sequence
  source 1..20: mol_type = other DNA
ttttttttttttttttaaga

SEQ ID NO: 33847 - DNA, 20 bp, synthetic construct
  misc_feature 1..20: note = CRISPR gRNA sequence
  source 1..20: mol_type = other DNA
tttttttttttttttaagac

SEQ ID NO: 33848 - DNA, 20 bp, synthetic construct
  misc_feature 1..20: note = CRISPR gRNA sequence
  source 1..20: mol_type = other DNA
ttttttttttttttaagacg

SEQ ID NO: 33849 - DNA, 20 bp, synthetic construct
  misc_feature 1..20: note = CRISPR gRNA sequence
  source 1..20: mol_type = other DNA
tttttttttttttaagacgg

SEQ ID NO: 33850 - DNA, 20 bp, synthetic construct
  misc_feature 1..20: note = CRISPR gRNA sequence
  source 1..20: mol_type = other DNA
ttttttttttttaagacgga

SEQ ID NO: 33851 - DNA, 20 bp, synthetic construct
  misc_feature 1..20: note = CRISPR gRNA sequence
  source 1..20: mol_type = other DNA
tttttttttttaagacggag

SEQ ID NO: 33852 - DNA, 20 bp, synthetic construct
  misc_feature 1..20: note = CRISPR gRNA sequence
  source 1..20: mol_type = other DNA
ttttttttttaagacggagt

SEQ ID NO: 33853 - DNA, 20 bp, synthetic construct
  misc_feature 1..20: note = CRISPR gRNA sequence
  source 1..20: mol_type = other DNA
tttttttttaagacggagtc

SEQ ID NO: 33854 - DNA, 20 bp, synthetic construct
  misc_feature 1..20: note = CRISPR gRNA sequence
  source 1..20: mol_type = other DNA
ttttttttaagacggagtct

SEQ ID NO: 33855 - DNA, 20 bp, synthetic construct
  misc_feature 1..20: note = CRISPR gRNA sequence
  source 1..20: mol_type = other DNA
tttttttaagacggagtctc

SEQ ID NO: 33856 - DNA, 20 bp, synthetic construct
  misc_feature 1..20: note = CRISPR gRNA sequence
  source 1..20: mol_type = other DNA
ttttttaagacggagtctct

SEQ ID NO: 33857 - DNA, 20 bp, synthetic construct
  misc_feature 1..20: note = CRISPR gRNA sequence
  source 1..20: mol_type = other DNA
tttttaagacggagtctctg

SEQ ID NO: 33858 - DNA, 20 bp, synthetic construct
  misc_feature 1..20: note = CRISPR gRNA sequence
  source 1..20: mol_type = other DNA
ttttaagacggagtctctgt

SEQ ID NO: 33859 - DNA, 20 bp, synthetic construct
  misc_feature 1..20: note = CRISPR gRNA sequence
  source 1..20: mol_type = other DNA
tttaagacggagtctctgtc

SEQ ID NO: 33860 - DNA, 20 bp, synthetic construct
  misc_feature 1..20: note = CRISPR gRNA sequence
  source 1..20: mol_type = other DNA
ttaagacggagtctctgtca

SEQ ID NO: 33861 - DNA, 20 bp, synthetic construct
  misc_feature 1..20: note = CRISPR gRNA sequence
  source 1..20: mol_type = other DNA
taagacggagtctctgtcac

SEQ ID NO: 33862 - DNA, 20 bp, synthetic construct
  misc_feature 1..20: note = CRISPR gRNA sequence
  source 1..20: mol_type = other DNA
aagacggagtctctgtcacc

SEQ ID NO: 33863 - DNA, 20 bp, synthetic construct
  misc_feature 1..20: note = CRISPR gRNA sequence
  source 1..20: mol_type = other DNA
agacggagtctctgtcaccc

SEQ ID NO: 33864 - DNA, 20 bp, synthetic construct
  misc_feature 1..20: note = CRISPR gRNA sequence
  source 1..20: mol_type = other DNA
tgtcacccaggctggagtgc

SEQ ID NO: 33865 - DNA, 20 bp, synthetic construct
  misc_feature 1..20: note = CRISPR gRNA sequence
  source 1..20: mol_type = other DNA
tcacccaggctggagtgcag

SEQ ID NO: 33866 - DNA, 20 bp, synthetic construct
  misc_feature 1..20: note = CRISPR gRNA sequence
  source 1..20: mol_type = other DNA
gagtgcaggggtgcaatctt

SEQ ID NO: 33867 - DNA, 20 bp, synthetic construct
  misc_feature 1..20: note = CRISPR gRNA sequence
  source 1..20: mol_type = other DNA
ggctcactgcaacgtctgcc

SEQ ID NO: 33868 - DNA, 20 bp, synthetic construct
  misc_feature 1..20: note = CRISPR gRNA sequence
  source 1..20: mol_type = other DNA
gctcactgcaacgtctgcct

SEQ ID NO: 33869 - DNA, 20 bp, synthetic construct
  misc_feature 1..20: note = CRISPR gRNA sequence
  source 1..20: mol_type = other DNA
actgcaacgtctgcctccca

SEQ ID NO: 33870 - DNA, 20 bp, synthetic construct
  misc_feature 1..20: note = CRISPR gRNA sequence
  source 1..20: mol_type = other DNA
caacgtctgcctcccaggtt

SEQ ID NO: 33871 - DNA, 20 bp, synthetic construct
  misc_feature 1..20: note = CRISPR gRNA sequence
  source 1..20: mol_type = other DNA
cctcccaggttcaagccatt

SEQ ID NO: 33872 - DNA, 20 bp, synthetic construct
  misc_feature 1..20: note = CRISPR gRNA sequence
  source 1..20: mol_type = other DNA
ccaggttcaagccattcttc

SEQ ID NO: 33873 - DNA, 20 bp, synthetic construct
  misc_feature 1..20: note = CRISPR gRNA sequence
  source 1..20: mol_type = other DNA
aagccattcttctgcctcag

SEQ ID NO: 33874 - DNA, 20 bp, synthetic construct
  misc_feature 1..20: note = CRISPR gRNA sequence
  source 1..20: mol_type = other DNA
ttctgcctcagcctcctgag

SEQ ID NO: 33875 - DNA, 20 bp, synthetic construct
  misc_feature 1..20: note = CRISPR gRNA sequence
  source 1..20: mol_type = other DNA
ctgcctcagcctcctgagca

SEQ ID NO: 33876 - DNA, 20 bp, synthetic construct
  misc_feature 1..20: note = CRISPR gRNA sequence
  source 1..20: mol_type = other DNA
tgcctcagcctcctgagcag

SEQ ID NO: 33877 - DNA, 20 bp, synthetic construct
  misc_feature 1..20: note = CRISPR gRNA sequence
  source 1..20: mol_type = other DNA
cctcagcctcctgagcagct

SEQ ID NO: 33878 - DNA, 20 bp, synthetic construct
  misc_feature 1..20: note = CRISPR gRNA sequence
  source 1..20: mol_type = other DNA
agcctcctgagcagctggga

SEQ ID NO: 33879 - DNA, 20 bp, synthetic construct
  misc_feature 1..20: note = CRISPR gRNA sequence
  source 1..20: mol_type = other DNA
ctgagcagctgggattacag

SEQ ID NO: 33880 - DNA, 20 bp, synthetic construct
  misc_feature 1..20: note = CRISPR gRNA sequence
  source 1..20: mol_type = other DNA
agcagctgggattacaggca

SEQ ID NO: 33881 - DNA, 20 bp, synthetic construct
  misc_feature 1..20: note = CRISPR gRNA sequence
  source 1..20: mol_type = other DNA
ggattacaggcacccaccac

SEQ ID NO: 33882 - DNA, 20 bp, synthetic construct
  misc_feature 1..20: note = CRISPR gRNA sequence
  source 1..20: mol_type = other DNA
caggcacccaccaccacacc

SEQ ID NO: 33883 - DNA, 20 bp, synthetic construct
  misc_feature 1..20: note = CRISPR gRNA sequence
  source 1..20: mol_type = other DNA
atttttgcatttttagtaga

SEQ ID NO: 33884 - DNA, 20 bp, synthetic construct
  misc_feature 1..20: note = CRISPR gRNA sequence
  source 1..20: mol_type = other DNA
ttgcatttttagtagagaca

SEQ ID NO: 33885 - DNA, 20 bp, synthetic construct
  misc_feature 1..20: note = CRISPR gRNA sequence
  source 1..20: mol_type = other DNA
tgcatttttagtagagacag

SEQ ID NO: 33886 - DNA, 20 bp, synthetic construct
  misc_feature 1..20: note = CRISPR gRNA sequence
  source 1..20: mol_type = other DNA
gcatttttagtagagacagt

SEQ ID NO: 33887 - DNA, 20 bp, synthetic construct
  misc_feature 1..20: note = CRISPR gRNA sequence
  source 1..20: mol_type = other DNA
catttttagtagagacagtg

SEQ ID NO: 33888 - DNA, 20 bp, synthetic construct
  misc_feature 1..20: note = CRISPR gRNA sequence
  source 1..20: mol_type = other DNA
ttagtagagacagtgtttca

SEQ ID NO: 33889 - DNA, 20 bp, synthetic construct
  misc_feature 1..20: note = CRISPR gRNA sequence
  source 1..20: mol_type = other DNA
tagtagagacagtgtttcac

SEQ ID NO: 33890 - DNA, 20 bp, synthetic construct
  misc_feature 1..20: note = CRISPR gRNA sequence
  source 1..20: mol_type = other DNA
agtagagacagtgtttcacc

SEQ ID NO: 33891 - DNA, 20 bp, synthetic construct
  misc_feature 1..20: note = CRISPR gRNA sequence
  source 1..20: mol_type = other DNA
gtagagacagtgtttcacca

SEQ ID NO: 33892 - DNA, 20 bp, synthetic construct
  misc_feature 1..20: note = CRISPR gRNA sequence
  source 1..20: mol_type = other DNA
caccattttggccaggctgt

SEQ ID NO: 33893 - DNA, 20 bp, synthetic construct
  misc_feature 1..20: note = CRISPR gRNA sequence
  source 1..20: mol_type = other DNA
accattttggccaggctgtt

SEQ ID NO: 33894 - DNA, 20 bp, synthetic construct
  misc_feature 1..20: note = CRISPR gRNA sequence
  source 1..20: mol_type = other DNA
tggccaggctgttctcaaac

SEQ ID NO: 33895 - DNA, 20 bp, synthetic construct
  misc_feature 1..20: note = CRISPR gRNA sequence
  source 1..20: mol_type = other DNA
ggccaggctgttctcaaact

SEQ ID NO: 33896 - DNA, 20 bp, synthetic construct
  misc_feature 1..20: note = CRISPR gRNA sequence
  source 1..20: mol_type = other DNA
gccaggctgttctcaaactc

SEQ ID NO: 33897 - DNA, 20 bp, synthetic construct
  misc_feature 1..20: note = CRISPR gRNA sequence
  source 1..20: mol_type = other DNA
ttctcaaactcctgacctca

SEQ ID NO: 33898 - DNA, 20 bp, synthetic construct
  misc_feature 1..20: note = CRISPR gRNA sequence
  source 1..20: mol_type = other DNA
tcaaactcctgacctcaagt

SEQ ID NO: 33899 - DNA, 20 bp, synthetic construct
  misc_feature 1..20: note = CRISPR gRNA sequence
  source 1..20: mol_type = other DNA
aaactcctgacctcaagtga

SEQ ID NO: 33900 - DNA, 20 bp, synthetic construct
  misc_feature 1..20: note = CRISPR gRNA sequence
  source 1..20: mol_type = other DNA
ctgacctcaagtgatccgcc

SEQ ID NO: 33901 - DNA, 20 bp, synthetic construct
  misc_feature 1..20: note = CRISPR gRNA sequence
  source 1..20: mol_type = other DNA
acctcaagtgatccgcctgt

SEQ ID NO: 33902 - DNA, 20 bp, synthetic construct
  misc_feature 1..20: note = CRISPR gRNA sequence
  source 1..20: mol_type = other DNA
aagtgatccgcctgtctcct

SEQ ID NO: 33903 - DNA, 20 bp, synthetic construct
  misc_feature 1..20: note = CRISPR gRNA sequence
  source 1..20: mol_type = other DNA
tctcctcggcctcccaaagt

SEQ ID NO: 33904 - DNA, 20 bp, synthetic construct
  misc_feature 1..20: note = CRISPR gRNA sequence
  source 1..20: mol_type = other DNA
ctcggcctcccaaagtgttg

SEQ ID NO: 33905 - DNA, 20 bp, synthetic construct
  misc_feature 1..20: note = CRISPR gRNA sequence
  source 1..20: mol_type = other DNA
ggcctcccaaagtgttggga

SEQ ID NO: 33906 - DNA, 20 bp, synthetic construct
  misc_feature 1..20: note = CRISPR gRNA sequence
  source 1..20: mol_type = other DNA
ccaaagtgttgggattacag

SEQ ID NO: 33907 - DNA, 20 bp, synthetic construct
  misc_feature 1..20: note = CRISPR gRNA sequence
  source 1..20: mol_type = other DNA
ggattacaggcatgaactgt

SEQ ID NO: 33908 - DNA, 20 bp, synthetic construct
  misc_feature 1..20: note = CRISPR gRNA sequence
  source 1..20: mol_type = other DNA
caggcatgaactgtactttt

SEQ ID NO: 33909 - DNA, 20 bp, synthetic construct
  misc_feature 1..20: note = CRISPR gRNA sequence
  source 1..20: mol_type = other DNA
tactttttaagtgggcaaat

SEQ ID NO: 33910 - DNA, 20 bp, synthetic construct
  misc_feature 1..20: note = CRISPR gRNA sequence
  source 1..20: mol_type = other DNA
tttaagtgggcaaattgtat

SEQ ID NO: 33911 - DNA, 20 bp, synthetic construct
  misc_feature 1..20: note = CRISPR gRNA sequence
  source 1..20: mol_type = other DNA
ttaagtgggcaaattgtata

SEQ ID NO: 33912 - DNA, 20 bp, synthetic construct
  misc_feature 1..20: note = CRISPR gRNA sequence
  source 1..20: mol_type = other DNA
taagtgggcaaattgtatat

SEQ ID NO: 33913 - DNA, 20 bp, synthetic construct
  misc_feature 1..20: note = CRISPR gRNA sequence
  source 1..20: mol_type = other DNA
aagtgggcaaattgtatatg

SEQ ID NO: 33914 - DNA, 20 bp, synthetic construct
  misc_feature 1..20: note = CRISPR gRNA sequence
  source 1..20: mol_type = other DNA
agtgggcaaattgtatatgt

SEQ ID NO: 33915 - DNA, 20 bp, synthetic construct
  misc_feature 1..20: note = CRISPR gRNA sequence
  source 1..20: mol_type = other DNA
tatatgtgaattacatctca

SEQ ID NO: 33916 - DNA, 20 bp, synthetic construct
  misc_feature 1..20: note = CRISPR gRNA sequence
  source 1..20: mol_type = other DNA
catctcaataaagctgttaa

SEQ ID NO: 33917 - DNA, 20 bp, synthetic construct
  misc_feature 1..20: note = CRISPR gRNA sequence
  source 1..20: mol_type = other DNA
aataaagctgttaaaaccta

SEQ ID NO: 33918 - DNA, 20 bp, synthetic construct
  misc_feature 1..20: note = CRISPR gRNA sequence
  source 1..20: mol_type = other DNA
ttaaaacctaggaagtaagc

SEQ ID NO: 33919 - DNA, 20 bp, synthetic construct
  misc_feature 1..20: note = CRISPR gRNA sequence
  source 1..20: mol_type = other DNA
aaacctaggaagtaagcatt

SEQ ID NO: 33920 - DNA, 20 bp, synthetic construct
  misc_feature 1..20: note = CRISPR gRNA sequence
  source 1..20: mol_type = other DNA
ggaagtaagcattattgtct

SEQ ID NO: 33921 - DNA, 20 bp, synthetic construct
  misc_feature 1..20: note = CRISPR gRNA sequence
  source 1..20: mol_type = other DNA
ttgtctccattggcagatga

SEQ ID NO: 33922 - DNA, 20 bp, synthetic construct
  misc_feature 1..20: note = CRISPR gRNA sequence
  source 1..20: mol_type = other DNA
tctccattggcagatgaaga

SEQ ID NO: 33923 - DNA, 20 bp, synthetic construct
  misc_feature 1..20: note = CRISPR gRNA sequence
  source 1..20: mol_type = other DNA
cattggcagatgaagaactt

SEQ ID NO: 33924 - DNA, 20 bp, synthetic construct
  misc_feature 1..20: note = CRISPR gRNA sequence
  source 1..20: mol_type = other DNA
gcagatgaagaacttgagac

SEQ ID NO: 33925 - DNA, 20 bp, synthetic construct
  misc_feature 1..20: note = CRISPR gRNA sequence
  source 1..20: mol_type = other DNA
gagacccagagaagacaagc

SEQ ID NO: 33926 - DNA, 20 bp, synthetic construct
  misc_feature 1..20: note = CRISPR gRNA sequence
  source 1..20: mol_type = other DNA
agacccagagaagacaagca

SEQ ID NO: 33927 - DNA, 20 bp, synthetic construct
  misc_feature 1..20: note = CRISPR gRNA sequence
  source 1..20: mol_type = other DNA
cctcaagatcatgtagctct

SEQ ID NO: 33928 - DNA, 20 bp, synthetic construct
  misc_feature 1..20: note = CRISPR gRNA sequence
  source 1..20: mol_type = other DNA
ctcaagatcatgtagctctt

SEQ ID NO: 33929 - DNA, 20 bp, synthetic construct
  misc_feature 1..20: note = CRISPR gRNA sequence
  source 1..20: mol_type = other DNA
aagatcatgtagctcttgct

SEQ ID NO: 33930 - DNA, 20 bp, synthetic construct
  misc_feature 1..20: note = CRISPR gRNA sequence
  source 1..20: mol_type = other DNA
ttgctggggaaagccaagct

SEQ ID NO: 33931 - DNA, 20 bp, synthetic construct
  misc_feature 1..20: note = CRISPR gRNA sequence
  source 1..20: mol_type = other DNA
gctggggaaagccaagctga

SEQ ID NO: 33932 - DNA, 20 bp, synthetic construct
  misc_feature 1..20: note = CRISPR gRNA sequence
  source 1..20: mol_type = other DNA
ctggggaaagccaagctgaa

SEQ ID NO: 33933 - DNA, 20 bp, synthetic construct
  misc_feature 1..20: note = CRISPR gRNA sequence
  source 1..20: mol_type = other DNA
gggaaagccaagctgaaggc

SEQ ID NO: 33934 - DNA, 20 bp, synthetic construct
  misc_feature 1..20: note = CRISPR gRNA sequence
  source 1..20: mol_type = other DNA
aaggctcatctgtgtggctc

SEQ ID NO: 33935 - DNA, 20 bp, synthetic construct
  misc_feature 1..20: note = CRISPR gRNA sequence
  source 1..20: mol_type = other DNA
atctgtgtggctctaaggct

SEQ ID NO: 33936 - DNA, 20 bp, synthetic construct
  misc_feature 1..20: note = CRISPR gRNA sequence
  source 1..20: mol_type = other DNA
tgtggctctaaggctcctgc

SEQ ID NO: 33937 - DNA, 20 bp, synthetic construct
  misc_feature 1..20: note = CRISPR gRNA sequence
  source 1..20: mol_type = other DNA
taaggctcctgccaggatcc

SEQ ID NO: 33938 - DNA, 20 bp, synthetic construct
  misc_feature 1..20: note = CRISPR gRNA sequence
  source 1..20: mol_type = other DNA
aggctcctgccaggatccgt

SEQ ID NO: 33939 - DNA, 20 bp, synthetic construct
  misc_feature 1..20: note = CRISPR gRNA sequence
  source 1..20: mol_type = other DNA
ctgccaggatccgtggttca

SEQ ID NO: 33940 - DNA, 20 bp, synthetic construct
  misc_feature 1..20: note = CRISPR gRNA sequence
  source 1..20: mol_type = other DNA
ccaggatccgtggttcaggt

SEQ ID NO: 33941 - DNA, 20 bp, synthetic construct
  misc_feature 1..20: note = CRISPR gRNA sequence
  source 1..20: mol_type = other DNA
aggtccatgtttccatggta

SEQ ID NO: 33942 - DNA, 20 bp, synthetic construct
  misc_feature 1..20: note = CRISPR gRNA sequence
  source 1..20: mol_type = other DNA
ccatggtatattcatttccc

SEQ ID NO: 33943 - DNA, 20 bp, synthetic construct
  misc_feature 1..20: note = CRISPR gRNA sequence
  source 1..20: mol_type = other DNA
catggtatattcatttccca

SEQ ID NO: 33944 - DNA, 20 bp, synthetic construct
  misc_feature 1..20: note = CRISPR gRNA sequence
  source 1..20: mol_type = other DNA
atttcccagggctgctgaaa

SEQ ID NO: 33945 - DNA, 20 bp, synthetic construct
  misc_feature 1..20: note = CRISPR gRNA sequence
  source 1..20: mol_type = other DNA
cccagggctgctgaaacaag

SEQ ID NO: 33946 - DNA, 20 bp, synthetic construct
  misc_feature 1..20: note = CRISPR gRNA sequence
  source 1..20: mol_type = other DNA
ccagggctgctgaaacaagg

SEQ ID NO: 33947 - DNA, 20 bp, synthetic construct
  misc_feature 1..20: note = CRISPR gRNA sequence
  source 1..20: mol_type = other DNA
ctgaaacaaggtaccagcat

SEQ ID NO: 33948 - DNA, 20 bp, synthetic construct
  misc_feature 1..20: note = CRISPR gRNA sequence
  source 1..20: mol_type = other DNA
aaacaaggtaccagcatcca

SEQ ID NO: 33949 - DNA, 20 bp, synthetic construct
  misc_feature 1..20: note = CRISPR gRNA sequence
  source 1..20: mol_type = other DNA
agaacaacagcactttattc

SEQ ID NO: 33950 - DNA, 20 bp, synthetic construct
  misc_feature 1..20: note = CRISPR gRNA sequence
  source 1..20: mol_type = other DNA
tattctctcatggttctgga

SEQ ID NO: 33951 - DNA, 20 bp, synthetic construct
  misc_feature 1..20: note = CRISPR gRNA sequence
  source 1..20: mol_type = other DNA
attctctcatggttctggag

SEQ ID NO: 33952 - DNA, 20 bp, synthetic construct
  misc_feature 1..20: note = CRISPR gRNA sequence
  source 1..20: mol_type = other DNA
ttctctcatggttctggagg

SEQ ID NO: 33953 - DNA, 20 bp, synthetic construct
  misc_feature 1..20: note = CRISPR gRNA sequence
  source 1..20: mol_type = other DNA
tctcatggttctggaggcca

SEQ ID NO: 33954 - DNA, 20 bp, synthetic construct
  misc_feature 1..20: note = CRISPR gRNA sequence
  source 1..20: mol_type = other DNA
tcatggttctggaggccaga

SEQ ID NO: 33955 - DNA, 20 bp, synthetic construct
  misc_feature 1..20: note = CRISPR gRNA sequence
  source 1..20: mol_type = other DNA
atggttctggaggccagaag

SEQ ID NO: 33956 - DNA, 20 bp, synthetic construct
  misc_feature 1..20: note = CRISPR gRNA sequence
  source 1..20: mol_type = other DNA
tggaggccagaagttgaagc

SEQ ID NO: 33957 - DNA, 20 bp, synthetic construct
  misc_feature 1..20: note = CRISPR gRNA sequence
  source 1..20: mol_type = other DNA
gaggccagaagttgaagcca

SEQ ID NO: 33958 - DNA, 20 bp, synthetic construct
  misc_feature 1..20: note = CRISPR gRNA sequence
  source 1..20: mol_type = other DNA
aagccaaggtgtcagcaggg

SEQ ID NO: 33959 - DNA, 20 bp, synthetic construct
  misc_feature 1..20: note = CRISPR gRNA sequence
  source 1..20: mol_type = other DNA
cctctggaggctcgagggga

SEQ ID NO: 33960 - DNA, 20 bp, synthetic construct
  misc_feature 1..20: note = CRISPR gRNA sequence
  source 1..20: mol_type = other DNA
tggaggctcgaggggagaat

SEQ ID NO: 33961 - DNA, 20 bp, synthetic construct
  misc_feature 1..20: note = CRISPR gRNA sequence
  source 1..20: mol_type = other DNA
gaggctcgaggggagaatgc

SEQ ID NO: 33962 - DNA, 20 bp, synthetic construct
  misc_feature 1..20: note = CRISPR gRNA sequence
  source 1..20: mol_type = other DNA
gaggggagaatgcttccttg

SEQ ID NO: 33963 - DNA, 20 bp, synthetic construct
  misc_feature 1..20: note = CRISPR gRNA sequence
  source 1..20: mol_type = other DNA
ccttgcctcctctagctgct

SEQ ID NO: 33964 - DNA, 20 bp, synthetic construct
  misc_feature 1..20: note = CRISPR gRNA sequence
  source 1..20: mol_type = other DNA
cttgcctcctctagctgctg

SEQ ID NO: 33965 - DNA, 20 bp, synthetic construct
  misc_feature 1..20: note = CRISPR gRNA sequence
  source 1..20: mol_type = other DNA
gcctcctctagctgctggga

SEQ ID NO: 33966 - DNA, 20 bp, synthetic construct
  misc_feature 1..20: note = CRISPR gRNA sequence
  source 1..20: mol_type = other DNA
cctcctctagctgctgggaa

SEQ ID NO: 33967 - DNA, 20 bp, synthetic construct
  misc_feature 1..20: note = CRISPR gRNA sequence
  source 1..20: mol_type = other DNA
ctctagctgctgggaactac

SEQ ID NO: 33968 - DNA, 20 bp, synthetic construct
  misc_feature 1..20: note = CRISPR gRNA sequence
  source 1..20: mol_type = other DNA
tagctgctgggaactactgg

SEQ ID NO: 33969 - DNA, 20 bp, synthetic construct
  misc_feature 1..20: note = CRISPR gRNA sequence
  source 1..20: mol_type = other DNA
gctgctgggaactactggtg

SEQ ID NO: 33970 - DNA, 20 bp, synthetic construct
  misc_feature 1..20: note = CRISPR gRNA sequence
  source 1..20: mol_type = other DNA
ctgggaactactggtgatcc

SEQ ID NO: 33971 - DNA, 20 bp, synthetic construct
  misc_feature 1..20: note = CRISPR gRNA sequence
  source 1..20: mol_type = other DNA
ggaactactggtgatccttg

SEQ ID NO: 33972 - DNA, 20 bp, synthetic construct
  misc_feature 1..20: note = CRISPR gRNA sequence
  source 1..20: mol_type = other DNA
ctggtgatccttgacttgtg

SEQ ID NO: 33973 - DNA, 20 bp, synthetic construct
  misc_feature 1..20: note = CRISPR gRNA sequence
  source 1..20: mol_type = other DNA
gtgatccttgacttgtggtc

SEQ ID NO: 33974 - DNA, 20 bp, synthetic construct
  misc_feature 1..20: note = CRISPR gRNA sequence
  source 1..20: mol_type = other DNA
gacttgtggtcttgtggctg

SEQ ID NO: 33975 - DNA, 20 bp, synthetic construct
  misc_feature 1..20: note = CRISPR gRNA sequence
  source 1..20: mol_type = other DNA
acttgtggtcttgtggctgc

SEQ ID NO: 33976 - DNA, 20 bp, synthetic construct
  misc_feature 1..20: note = CRISPR gRNA sequence
  source 1..20: mol_type = other DNA
gtggtcttgtggctgcatca

SEQ ID NO: 33977 - DNA, 20 bp, synthetic construct
  misc_feature 1..20: note = CRISPR gRNA sequence
  source 1..20: mol_type = other DNA
tggtcttgtggctgcatcac

SEQ ID NO: 33978 - DNA, 20 bp, synthetic construct
  misc_feature 1..20: note = CRISPR gRNA sequence
  source 1..20: mol_type = other DNA
gtggctgcatcactctaaac

SEQ ID NO: 33979 - DNA, 20 bp, synthetic construct
  misc_feature 1..20: note = CRISPR gRNA sequence
  source 1..20: mol_type = other DNA
tggctgcatcactctaaact

SEQ ID NO: 33980 - DNA, 20 bp, synthetic construct
  misc_feature 1..20: note = CRISPR gRNA sequence
  source 1..20: mol_type = other DNA
catcactctaaactcagctt

SEQ ID NO: 33981 - DNA, 20 bp, synthetic construct
  misc_feature 1..20: note = CRISPR gRNA sequence
  source 1..20: mol_type = other DNA
taaactcagctttagtggcc

SEQ ID NO: 33982 - DNA, 20 bp, synthetic construct
  misc_feature 1..20: note = CRISPR gRNA sequence
  source 1..20: mol_type = other DNA
aactcagctttagtggccac

SEQ ID NO: 33983 - DNA, 20 bp, synthetic construct
  misc_feature 1..20: note = CRISPR gRNA sequence
  source 1..20: mol_type = other DNA
agctttagtggccacatcac

SEQ ID NO: 33984 - DNA, 20 bp, synthetic construct
  misc_feature 1..20: note = CRISPR gRNA sequence
  source 1..20: mol_type = other DNA
tagtggccacatcacctact

SEQ ID NO: 33985 - DNA, 20 bp, synthetic construct
  misc_feature 1..20: note = CRISPR gRNA sequence
  source 1..20: mol_type = other DNA
agtggccacatcacctactc

SEQ ID NO: 33986 - DNA, 20 bp, synthetic construct
  misc_feature 1..20: note = CRISPR gRNA sequence
  source 1..20: mol_type = other DNA
gtggccacatcacctactcc

SEQ ID NO: 33987 - DNA, 20 bp, synthetic construct
  misc_feature 1..20: note = CRISPR gRNA sequence
  source 1..20: mol_type = other DNA
ctcctcatgtagcaagtctc

SEQ ID NO: 33988 - DNA, 20 bp, synthetic construct
  misc_feature 1..20: note = CRISPR gRNA sequence
  source 1..20: mol_type = other DNA
ctcatgtagcaagtctcttt

SEQ ID NO: 33989 - DNA, 20 bp, synthetic construct
  misc_feature 1..20: note = CRISPR gRNA sequence
  source 1..20: mol_type = other DNA
atgtagcaagtctctttctc

SEQ ID NO: 33990 - DNA, 20 bp, synthetic construct
  misc_feature 1..20: note = CRISPR gRNA sequence
  source 1..20: mol_type = other DNA
tttctcttataaagacactt

SEQ ID NO: 33991 - DNA, 20 bp, synthetic construct
  misc_feature 1..20: note = CRISPR gRNA sequence
  source 1..20: mol_type = other DNA
tctcttataaagacacttgt

SEQ ID NO: 33992 - DNA, 20 bp, synthetic construct
  misc_feature 1..20: note = CRISPR gRNA sequence
  source 1..20: mol_type = other DNA
ctcttataaagacacttgtc

SEQ ID NO: 33993 - DNA, 20 bp, synthetic construct
  misc_feature 1..20: note = CRISPR gRNA sequence
  source 1..20: mol_type = other DNA
tcttataaagacacttgtca

SEQ ID NO: 33994 - DNA, 20 bp, synthetic construct
  misc_feature 1..20: note = CRISPR gRNA sequence
  source 1..20: mol_type = other DNA
ttataaagacacttgtcatt

SEQ ID NO: 33995 - DNA, 20 bp, synthetic construct
  misc_feature 1..20: note = CRISPR gRNA sequence
  source 1..20: mol_type = other DNA
ataaagacacttgtcattgg

SEQ ID NO: 33996 - DNA, 20 bp, synthetic construct
  misc_feature 1..20: note = CRISPR gRNA sequence
  source 1..20: mol_type = other DNA
taaagacacttgtcattgga

SEQ ID NO: 33997 - DNA, 20 bp, synthetic construct
  misc_feature 1..20: note = CRISPR gRNA sequence
  source 1..20: mol_type = other DNA
gtcattggatttaggaccca

SEQ ID NO: 33998 - DNA, 20 bp, synthetic construct
  misc_feature 1..20: note = CRISPR gRNA sequence
  source 1..20: mol_type = other DNA
tcattggatttaggacccac

SEQ ID NO: 33999 - DNA, 20 bp, synthetic construct
  misc_feature 1..20: note = CRISPR gRNA sequence
  source 1..20: mol_type = other DNA
gatttaggacccacctagat

SEQ ID NO: 34000 - DNA, 20 bp, synthetic construct
  misc_feature 1..20: note = CRISPR gRNA sequence
  source 1..20: mol_type = other DNA
aggacccacctagataatcc

SEQ ID NO: 34001 - DNA, 20 bp, synthetic construct
  misc_feature 1..20: note = CRISPR gRNA sequence
  source 1..20: mol_type = other DNA
ggacccacctagataatcca

SEQ ID NO: 34002 - DNA, 20 bp, synthetic construct
  misc_feature 1..20: note = CRISPR gRNA sequence
  source 1..20: mol_type = other DNA
gataatccaggatgatgtca

SEQ ID NO: 34003 - DNA, 20 bp, synthetic construct
  misc_feature 1..20: note = CRISPR gRNA sequence
  source 1..20: mol_type = other DNA
caagatctttaattcttttt

SEQ ID NO: 34004 - DNA, 20 bp, synthetic construct
  misc_feature 1..20: note = CRISPR gRNA sequence
  source 1..20: mol_type = other DNA
aagatctttaattctttttt

SEQ ID NO: 34005 - DNA, 20 bp, synthetic construct
  misc_feature 1..20: note = CRISPR gRNA sequence
  source 1..20: mol_type = other DNA
taattctttttttgccttct

SEQ ID NO: 34006 - DNA, 20 bp, synthetic construct
  misc_feature 1..20: note = CRISPR gRNA sequence
  source 1..20: mol_type = other DNA
aattctttttttgccttctt

SEQ ID NO: 34007 - DNA, 20 bp, synthetic construct
  misc_feature 1..20: note = CRISPR gRNA sequence
  source 1..20: mol_type = other DNA
attctttttttgccttcttt

SEQ ID NO: 34008 - DNA, 20 bp, synthetic construct
  misc_feature 1..20: note = CRISPR gRNA sequence
  source 1..20: mol_type = other DNA
tttttttgccttcttttgag

SEQ ID NO: 34009 - DNA, 20 bp, synthetic construct
  misc_feature 1..20: note = CRISPR gRNA sequence
  source 1..20: mol_type = other DNA
tttttgccttcttttgagac

SEQ ID NO: 34010 - DNA, 20 bp, synthetic construct
  misc_feature 1..20: note = CRISPR gRNA sequence
  source 1..20: mol_type = other DNA
ttttgccttcttttgagaca

SEQ ID NO: 34011 - DNA, 20 bp, synthetic construct
  misc_feature 1..20: note = CRISPR gRNA sequence
  source 1..20: mol_type = other DNA
tttgccttcttttgagacag

SEQ ID NO: 34012 - DNA, 20 bp, synthetic construct
  misc_feature 1..20: note = CRISPR gRNA sequence
  source 1..20: mol_type = other DNA
ttgccttcttttgagacaga

SEQ ID NO: 34013 - DNA, 20 bp, synthetic construct
  misc_feature 1..20: note = CRISPR gRNA sequence
  source 1..20: mol_type = other DNA
tgccttcttttgagacagag

SEQ ID NO: 34014 - DNA, 20 bp, synthetic construct
  misc_feature 1..20: note = CRISPR gRNA sequence
  source 1..20: mol_type = other DNA
gccttcttttgagacagagg

SEQ ID NO: 34015 - DNA, 20 bp, synthetic construct
  misc_feature 1..20: note = CRISPR gRNA sequence
  source 1..20: mol_type = other DNA
ccttcttttgagacagaggc

SEQ ID NO: 34016 - DNA, 20 bp, synthetic construct
  misc_feature 1..20: note = CRISPR gRNA sequence
  source 1..20: mol_type = other DNA
cttttgagacagaggcttgc

SEQ ID NO: 34017 - DNA, 20 bp, synthetic construct
  misc_feature 1..20: note = CRISPR gRNA sequence
  source 1..20: mol_type = other DNA
ttttgagacagaggcttgct

SEQ ID NO: 34018 - DNA, 20 bp, synthetic construct
  misc_feature 1..20: note = CRISPR gRNA sequence
  source 1..20: mol_type = other DNA
ttgagacagaggcttgctct

SEQ ID NO: 34019 - DNA, 20 bp, synthetic construct
  misc_feature 1..20: note = CRISPR gRNA sequence
  source 1..20: mol_type = other DNA
tgagacagaggcttgctctg

SEQ ID NO: 34020 - DNA, 20 bp, synthetic construct
  misc_feature 1..20: note = CRISPR gRNA sequence
  source 1..20: mol_type = other DNA
gagacagaggcttgctctgt

SEQ ID NO: 34021 - DNA, 20 bp, synthetic construct
  misc_feature 1..20: note = CRISPR gRNA sequence
  source 1..20: mol_type = other DNA
agacagaggcttgctctgtt

SEQ ID NO: 34022 - DNA, 20 bp, synthetic construct
  misc_feature 1..20: note = CRISPR gRNA sequence
  source 1..20: mol_type = other DNA
gctctgttgcccaggctgga

SEQ ID NO: 34023 - DNA, 20 bp, synthetic construct
  misc_feature 1..20: note = CRISPR gRNA sequence
  source 1..20: mol_type = other DNA
ctctgttgcccaggctggaa

SEQ ID NO: 34024 - DNA, 20 bp, synthetic construct
  misc_feature 1..20: note = CRISPR gRNA sequence
  source 1..20: mol_type = other DNA
tgttgcccaggctggaatgc

SEQ ID NO: 34025 - DNA, 20 bp, synthetic construct
  misc_feature 1..20: note = CRISPR gRNA sequence
  source 1..20: mol_type = other DNA
ttgcccaggctggaatgcag

SEQ ID NO: 34026 - DNA, 20 bp, synthetic construct
  misc_feature 1..20: note = CRISPR gRNA sequence
  source 1..20: mol_type = other DNA
cccaggctggaatgcagtgg

SEQ ID NO: 34027 - DNA, 20 bp, synthetic construct
  misc_feature 1..20: note = CRISPR gRNA sequence
  source 1..20: mol_type = other DNA
gaatgcagtggcgctgtatc

SEQ ID NO: 34028 - DNA, 20 bp, synthetic construct
  misc_feature 1..20: note = CRISPR gRNA sequence
  source 1..20: mol_type = other DNA
tatcggctcactgcaacctc

SEQ ID NO: 34029 - DNA, 20 bp, synthetic construct
  misc_feature 1..20: note = CRISPR gRNA sequence
  source 1..20: mol_type = other DNA
actgcaacctccacctccca

SEQ ID NO: 34030 - DNA, 20 bp, synthetic construct
  misc_feature 1..20: note = CRISPR gRNA sequence
  source 1..20: mol_type = other DNA
caacctccacctcccagttc

SEQ ID NO: 34031 - DNA, 20 bp, synthetic construct
  misc_feature 1..20: note = CRISPR gRNA sequence
  source 1..20: mol_type = other DNA
cacctcccagttcaagcgat

SEQ ID NO: 34032 - DNA, 20 bp, synthetic construct
  misc_feature 1..20: note = CRISPR gRNA sequence
  source 1..20: mol_type = other DNA
ccagttcaagcgattctcct

SEQ ID NO: 34033 - DNA, 20 bp, synthetic construct
  misc_feature 1..20: note = CRISPR gRNA sequence
  source 1..20: mol_type = other DNA
aagcgattctcctgccccag

SEQ ID NO: 34034 - DNA, 20 bp, synthetic construct
  misc_feature 1..20: note = CRISPR gRNA sequence
  source 1..20: mol_type = other DNA
tcctgccccagtctcctgag

SEQ ID NO: 34035 - DNA, 20 bp, synthetic construct
  misc_feature 1..20: note = CRISPR gRNA sequence
  source 1..20: mol_type = other DNA
ctgccccagtctcctgagta

SEQ ID NO: 34036 - DNA, 20 bp, synthetic construct
  misc_feature 1..20: note = CRISPR gRNA sequence
  source 1..20: mol_type = other DNA
ccccagtctcctgagtagct

SEQ ID NO: 34037 - DNA, 20 bp, synthetic construct
  misc_feature 1..20: note = CRISPR gRNA sequence
  source 1..20: mol_type = other DNA
ctgagtagctgggattacag

SEQ ID NO: 34038 - DNA, 20 bp, synthetic construct
  misc_feature 1..20: note = CRISPR gRNA sequence
  source 1..20: mol_type = other DNA
agtagctgggattacaggtg

SEQ ID NO: 34039 - DNA, 20 bp, synthetic construct
  misc_feature 1..20: note = CRISPR gRNA sequence
  source 1..20: mol_type = other DNA
ggattacaggtgctcaccac

SEQ ID NO: 34040 - DNA, 20 bp, synthetic construct
  misc_feature 1..20: note = CRISPR gRNA sequence
  source 1..20: mol_type = other DNA
caggtgctcaccaccatgac

SEQ ID NO: 34041 - DNA, 20 bp, synthetic construct
  misc_feature 1..20: note = CRISPR gRNA sequence
  source 1..20: mol_type = other DNA
accaccatgaccagctaatt

SEQ ID NO: 34042 - DNA, 20 bp, synthetic construct
  misc_feature 1..20: note = CRISPR gRNA sequence
  source 1..20: mol_type = other DNA
atttttgtatttttagtaga

SEQ ID NO: 34043 - DNA, 20 bp, synthetic construct
  misc_feature 1..20: note = CRISPR gRNA sequence
  source 1..20: mol_type = other DNA
ttgtatttttagtagaaatg

SEQ ID NO: 34044 - DNA, 20 bp, synthetic construct
  misc_feature 1..20: note = CRISPR gRNA sequence
  source 1..20: mol_type = other DNA
tgtatttttagtagaaatgg

SEQ ID NO: 34045 - DNA, 20 bp, synthetic construct
  misc_feature 1..20: note = CRISPR gRNA sequence
  source 1..20: mol_type = other DNA
gtatttttagtagaaatggg

SEQ ID NO: 34046 - DNA, 20 bp, synthetic construct
  misc_feature 1..20: note = CRISPR gRNA sequence
  source 1..20: mol_type = other DNA
tatttttagtagaaatgggg

SEQ ID NO: 34047 - DNA, 20 bp, synthetic construct
  misc_feature 1..20: note = CRISPR gRNA sequence
  source 1..20: mol_type = other DNA
ttagtagaaatggggttttg

SEQ ID NO: 34048 - DNA, 20 bp, synthetic construct
  misc_feature 1..20: note = CRISPR gRNA sequence
  source 1..20: mol_type = other DNA
tagtagaaatggggttttgc

SEQ ID NO: 34049 - DNA, 20 bp, synthetic construct
  misc_feature 1..20: note = CRISPR gRNA sequence
  source 1..20: mol_type = other DNA
agtagaaatggggttttgcc

SEQ ID NO: 34050 - DNA, 20 bp, synthetic construct
  misc_feature 1..20: note = CRISPR gRNA sequence
  source 1..20: mol_type = other DNA
gtagaaatggggttttgcca

SEQ ID NO: 34051 - DNA, 20 bp, synthetic construct
  misc_feature 1..20: note = CRISPR gRNA sequence
  source 1..20: mol_type = other DNA
tgccatgttggccacgctgg

SEQ ID NO: 34052 - DNA, 20 bp, synthetic construct
  misc_feature 1..20: note = CRISPR gRNA sequence
  source 1..20: mol_type = other DNA
gccatgttggccacgctggt

SEQ ID NO: 34053 - DNA, 20 bp, synthetic construct
  misc_feature 1..20: note = CRISPR gRNA sequence
  source 1..20: mol_type = other DNA
ccatgttggccacgctggtc

SEQ ID NO: 34054 - DNA, 20 bp, synthetic construct
  misc_feature 1..20: note = CRISPR gRNA sequence
  source 1..20: mol_type = other DNA
gccacgctggtcttgaactc

SEQ ID NO: 34055 - DNA, 20 bp, synthetic construct
  misc_feature 1..20: note = CRISPR gRNA sequence
  source 1..20: mol_type = other DNA
gtcttgaactcctgacctca

SEQ ID NO: 34056 - DNA, 20 bp, synthetic construct
  misc_feature 1..20: note = CRISPR gRNA sequence
  source 1..20: mol_type = other DNA
gaactcctgacctcaggtga

SEQ ID NO: 34057 - DNA, 20 bp, synthetic construct
  misc_feature 1..20: note = CRISPR gRNA sequence
  source 1..20: mol_type = other DNA
aactcctgacctcaggtgat

SEQ ID NO: 34058 - DNA, 20 bp, synthetic construct
  misc_feature 1..20: note = CRISPR gRNA sequence
  source 1..20: mol_type = other DNA
ctgacctcaggtgatcctcc

SEQ ID NO: 34059 - DNA, 20 bp, synthetic construct
  misc_feature 1..20: note = CRISPR gRNA sequence
  source 1..20: mol_type = other DNA
acctcaggtgatcctccaat

SEQ ID NO: 34060 - DNA, 20 bp, synthetic construct
  misc_feature 1..20: note = CRISPR gRNA sequence
  source 1..20: mol_type = other DNA
aggtgatcctccaatctcag

SEQ ID NO: 34061 - DNA, 20 bp, synthetic construct
  misc_feature 1..20: note = CRISPR gRNA sequence
  source 1..20: mol_type = other DNA
caatctcagcttcccaaagt

SEQ ID NO: 34062 - DNA, 20 bp, synthetic construct
  misc_feature 1..20: note = CRISPR gRNA sequence
  source 1..20: mol_type = other DNA
agcttcccaaagtgctggga

SEQ ID NO: 34063 - DNA, 20 bp, synthetic construct
  misc_feature 1..20: note = CRISPR gRNA sequence
  source 1..20: mol_type = other DNA
cccaaagtgctgggattaca

SEQ ID NO: 34064 - DNA, 20 bp, synthetic construct
  misc_feature 1..20: note = CRISPR gRNA sequence
  source 1..20: mol_type = other DNA
ccaaagtgctgggattacag

SEQ ID NO: 34065 - DNA, 20 bp, synthetic construct
  misc_feature 1..20: note = CRISPR gRNA sequence
  source 1..20: mol_type = other DNA
ggattacaggcatgagccac

SEQ ID NO: 34066 - DNA, 20 bp, synthetic construct
  misc_feature 1..20: note = CRISPR gRNA sequence
  source 1..20: mol_type = other DNA
caggcatgagccactgcacc

SEQ ID NO: 34067 - DNA, 20 bp, synthetic construct
  misc_feature 1..20: note = CRISPR gRNA sequence
  source 1..20: mol_type = other DNA
cacccagccccttaacttaa

SEQ ID NO: 34068 - DNA, 20 bp, synthetic construct
  misc_feature 1..20: note = CRISPR gRNA sequence
  source 1..20: mol_type = other DNA
aacttaattctatctgcaaa

SEQ ID NO: 34069 - DNA, 20 bp, synthetic construct
  misc_feature 1..20: note = CRISPR gRNA sequence
  source 1..20: mol_type = other DNA
acttaattctatctgcaaag

SEQ ID NO: 34070 - DNA, 20 bp, synthetic construct
  misc_feature 1..20: note = CRISPR gRNA sequence
  source 1..20: mol_type = other DNA
aattctatctgcaaagaccc

SEQ ID NO: 34071 - DNA, 20 bp, synthetic construct
  misc_feature 1..20: note = CRISPR gRNA sequence
  source 1..20: mol_type = other DNA
attctatctgcaaagaccct

SEQ ID NO: 34072 - DNA, 20 bp, synthetic construct
  misc_feature 1..20: note = CRISPR gRNA sequence
  source 1..20: mol_type = other DNA
tatctgcaaagacccttttc

SEQ ID NO: 34073 - DNA, 20 bp, synthetic construct
  misc_feature 1..20: note = CRISPR gRNA sequence
  source 1..20: mol_type = other DNA
tctgcaaagacccttttccc

SEQ ID NO: 34074 - DNA, 20 bp, synthetic construct
  misc_feature 1..20: note = CRISPR gRNA sequence
  source 1..20: mol_type = other DNA
caaagacccttttcccaaat

SEQ ID NO: 34075 - DNA, 20 bp, synthetic construct
  misc_feature 1..20: note = CRISPR gRNA sequence
  source 1..20: mol_type = other DNA
ttcccaaataaagtcacact

SEQ ID NO: 34076 - DNA, 20 bp, synthetic construct
  misc_feature 1..20: note = CRISPR gRNA sequence
  source 1..20: mol_type = other DNA
tcccaaataaagtcacactg

SEQ ID NO: 34077 - DNA, 20 bp, synthetic construct
  misc_feature 1..20: note = CRISPR gRNA sequence
  source 1..20: mol_type = other DNA
cccaaataaagtcacactga

SEQ ID NO: 34078 - DNA, 20 bp, synthetic construct
  misc_feature 1..20: note = CRISPR gRNA sequence
  source 1..20: mol_type = other DNA
ccaaataaagtcacactgac

SEQ ID NO: 34079 - DNA, 20 bp, synthetic construct
  misc_feature 1..20: note = CRISPR gRNA sequence
  source 1..20: mol_type = other DNA
acaggttccagggatttgac

SEQ ID NO: 34080 - DNA, 20 bp, synthetic construct
  misc_feature 1..20: note = CRISPR gRNA sequence
  source 1..20: mol_type = other DNA
cagggatttgacatggacat

SEQ ID NO: 34081 - DNA, 20 bp, synthetic construct
  misc_feature 1..20: note = CRISPR gRNA sequence
  source 1..20: mol_type = other DNA
gacatggacatatcttttgg

SEQ ID NO: 34082 - DNA, 20 bp, synthetic construct
  misc_feature 1..20: note = CRISPR gRNA sequence
  source 1..20: mol_type = other DNA
acatggacatatcttttggg

SEQ ID NO: 34083 - DNA, 20 bp, synthetic construct
  misc_feature 1..20: note = CRISPR gRNA sequence
  source 1..20: mol_type = other DNA
ttggggggccacctttcaac

SEQ ID NO: 34084 - DNA, 20 bp, synthetic construct
  misc_feature 1..20: note = CRISPR gRNA sequence
  source 1..20: mol_type = other DNA
tggggggccacctttcaacc

SEQ ID NO: 34085 - DNA, 20 bp, synthetic construct
  misc_feature 1..20: note = CRISPR gRNA sequence
  source 1..20: mol_type = other DNA
ggggggccacctttcaaccc

SEQ ID NO: 34086 - DNA, 20 bp, synthetic construct
  misc_feature 1..20: note = CRISPR gRNA sequence
  source 1..20: mol_type = other DNA
gggggccacctttcaaccca

SEQ ID NO: 34087 - DNA, 20 bp, synthetic construct
  misc_feature 1..20: note = CRISPR gRNA sequence
  source 1..20: mol_type = other DNA
tcaacccaccacacatgaca

SEQ ID NO: 34088 - DNA, 20 bp, synthetic construct
  misc_feature 1..20: note = CRISPR gRNA sequence
  source 1..20: mol_type = other DNA
caacccaccacacatgacat

SEQ ID NO: 34089 - DNA, 20 bp, synthetic construct
  misc_feature 1..20: note = CRISPR gRNA sequence
  source 1..20: mol_type = other DNA
aacccaccacacatgacatg

SEQ ID NO: 34090 - DNA, 20 bp, synthetic construct
  misc_feature 1..20: note = CRISPR gRNA sequence
  source 1..20: mol_type = other DNA
gaaagaaacagagggagctt

SEQ ID NO: 34091 - DNA, 20 bp, synthetic construct
  misc_feature 1..20: note = CRISPR gRNA sequence
  source 1..20: mol_type = other DNA
cctggaggaggtaagaggag

SEQ ID NO: 34092 - DNA, 20 bp, synthetic construct
  misc_feature 1..20: note = CRISPR gRNA sequence
  source 1..20: mol_type = other DNA
ctggaggaggtaagaggaga

SEQ ID NO: 34093 - DNA, 20 bp, synthetic construct
  misc_feature 1..20: note = CRISPR gRNA sequence
  source 1..20: mol_type = other DNA
gaggaggtaagaggagagct

SEQ ID NO: 34094 - DNA, 20 bp, synthetic construct
  misc_feature 1..20: note = CRISPR gRNA sequence
  source 1..20: mol_type = other DNA
gccctgaagctggaagacca

SEQ ID NO: 34095 - DNA, 20 bp, synthetic construct
  misc_feature 1..20: note = CRISPR gRNA sequence
  source 1..20: mol_type = other DNA
aagctggaagaccagaggga

SEQ ID NO: 34096 - DNA, 20 bp, synthetic construct
  misc_feature 1..20: note = CRISPR gRNA sequence
  source 1..20: mol_type = other DNA
gaagaccagagggaggctcc

SEQ ID NO: 34097 - DNA, 20 bp, synthetic construct
  misc_feature 1..20: note = CRISPR gRNA sequence
  source 1..20: mol_type = other DNA
ctactgccctgttctgggcc

SEQ ID NO: 34098 - DNA, 20 bp, synthetic construct
  misc_feature 1..20: note = CRISPR gRNA sequence
  source 1..20: mol_type = other DNA
ctgccctgttctgggcccag

SEQ ID NO: 34099 - DNA, 20 bp, synthetic construct
  misc_feature 1..20: note = CRISPR gRNA sequence
  source 1..20: mol_type = other DNA
ccctgttctgggcccagaag

SEQ ID NO: 34100 - DNA, 20 bp, synthetic construct
  misc_feature 1..20: note = CRISPR gRNA sequence
  source 1..20: mol_type = other DNA
ttctgggcccagaagagaat

SEQ ID NO: 34101 - DNA, 20 bp, synthetic construct
  misc_feature 1..20: note = CRISPR gRNA sequence
  source 1..20: mol_type = other DNA
tgggcccagaagagaataca

SEQ ID NO: 34102 - DNA, 20 bp, synthetic construct
  misc_feature 1..20: note = CRISPR gRNA sequence
  source 1..20: mol_type = other DNA
ggcccagaagagaatacatt

SEQ ID NO: 34103 - DNA, 20 bp, synthetic construct
  misc_feature 1..20: note = CRISPR gRNA sequence
  source 1..20: mol_type = other DNA
aagagtaagctcatgagaaa

SEQ ID NO: 34104 - DNA, 20 bp, synthetic construct
  misc_feature 1..20: note = CRISPR gRNA sequence
  source 1..20: mol_type = other DNA
atgagaaaacacacactcaa

SEQ ID NO: 34105 - DNA, 20 bp, synthetic construct
  misc_feature 1..20: note = CRISPR gRNA sequence
  source 1..20: mol_type = other DNA
aacttgccaccccattcctg

SEQ ID NO: 34106 - DNA, 20 bp, synthetic construct
  misc_feature 1..20: note = CRISPR gRNA sequence
  source 1..20: mol_type = other DNA
gccaccccattcctgagact

SEQ ID NO: 34107 - DNA, 20 bp, synthetic construct
  misc_feature 1..20: note = CRISPR gRNA sequence
  source 1..20: mol_type = other DNA
ccaccccattcctgagactc

SEQ ID NO: 34108 - DNA, 20 bp, synthetic construct
  misc_feature 1..20: note = CRISPR gRNA sequence
  source 1..20: mol_type = other DNA
ctgagactcattttcttttt

SEQ ID NO: 34109 - DNA, 20 bp, synthetic construct
  misc_feature 1..20: note = CRISPR gRNA sequence
  source 1..20: mol_type = other DNA
agactcattttctttttctt

SEQ ID NO: 34110 - DNA, 20 bp, synthetic construct
  misc_feature 1..20: note = CRISPR gRNA sequence
  source 1..20: mol_type = other DNA
attttctttttctttttttt

SEQ ID NO: 34111 - DNA, 20 bp, synthetic construct
  misc_feature 1..20: note = CRISPR gRNA sequence
  source 1..20: mol_type = other DNA
tctttttctttttttttttg

SEQ ID NO: 34112 - DNA, 20 bp, synthetic construct
  misc_feature 1..20: note = CRISPR gRNA sequence
  source 1..20: mol_type = other DNA
ctttttctttttttttttga

SEQ ID NO: 34113 - DNA, 20 bp, synthetic construct
  misc_feature 1..20: note = CRISPR gRNA sequence
  source 1..20: mol_type = other DNA
tttttctttttttttttgag

SEQ ID NO: 34114 - DNA, 20 bp, synthetic construct
  misc_feature 1..20: note = CRISPR gRNA sequence
  source 1..20: mol_type = other DNA
tttctttttttttttgagac

SEQ ID NO: 34115 - DNA, 20 bp, synthetic construct
  misc_feature 1..20: note = CRISPR gRNA sequence
  source 1..20: mol_type = other DNA
ttctttttttttttgagaca

SEQ ID NO: 34116 - DNA, 20 bp, synthetic construct
  misc_feature 1..20: note = CRISPR gRNA sequence
  source 1..20: mol_type = other DNA
tctttttttttttgagacag

SEQ ID NO: 34117 - DNA, 20 bp, synthetic construct
  misc_feature 1..20: note = CRISPR gRNA sequence
  source 1..20: mol_type = other DNA
ctttttttttttgagacaga

SEQ ID NO: 34118 - DNA, 20 bp, synthetic construct
  misc_feature 1..20: note = CRISPR gRNA sequence
  source 1..20: mol_type = other DNA
tttttttttttgagacagag

SEQ ID NO: 34119 - DNA, 20 bp, synthetic construct
  misc_feature 1..20: note = CRISPR gRNA sequence
  source 1..20: mol_type = other DNA
tttttttttgagacagagtc

SEQ ID NO: 34120 - DNA, 20 bp, synthetic construct
  misc_feature 1..20: note = CRISPR gRNA sequence
  source 1..20: mol_type = other DNA
ttttttttgagacagagtct

SEQ ID NO: 34121 - DNA, 20 bp, synthetic construct
  misc_feature 1..20: note = CRISPR gRNA sequence
  source 1..20: mol_type = other DNA
tttttttgagacagagtctc

SEQ ID NO: 34122 - DNA, 20 bp, synthetic construct
  misc_feature 1..20: note = CRISPR gRNA sequence
  source 1..20: mol_type = other DNA
ttttttgagacagagtctca

SEQ ID NO: 34123 - DNA, 20 bp, synthetic construct
  misc_feature 1..20: note = CRISPR gRNA sequence
  source 1..20: mol_type = other DNA
tttttgagacagagtctcac

SEQ ID NO: 34124 - DNA, 20 bp, synthetic construct
  misc_feature 1..20: note = CRISPR gRNA sequence
  source 1..20: mol_type = other DNA
ttttgagacagagtctcact

SEQ ID NO: 34125 - DNA, 20 bp, synthetic construct
  misc_feature 1..20: note = CRISPR gRNA sequence
  source 1..20: mol_type = other DNA
tttgagacagagtctcactc

SEQ ID NO: 34126 - DNA, 20 bp, synthetic construct
  misc_feature 1..20: note = CRISPR gRNA sequence
  source 1..20: mol_type = other DNA
ttgagacagagtctcactct

SEQ ID NO: 34127 - DNA, 20 bp, synthetic construct
  misc_feature 1..20: note = CRISPR gRNA sequence
  source 1..20: mol_type = other DNA
tgagacagagtctcactctg

SEQ ID NO: 34128 - DNA, 20 bp, synthetic construct
  misc_feature 1..20: note = CRISPR gRNA sequence
  source 1..20: mol_type = other DNA
gagacagagtctcactctgt

SEQ ID NO: 34129 - DNA, 20 bp, synthetic construct
  misc_feature 1..20: note = CRISPR gRNA sequence
  source 1..20: mol_type = other DNA
agacagagtctcactctgtc

SEQ ID NO: 34130 - DNA, 20 bp, synthetic construct
  misc_feature 1..20: note = CRISPR gRNA sequence
  source 1..20: mol_type = other DNA
actctgtcgcccaggctgga

SEQ ID NO: 34131 - DNA, 20 bp, synthetic construct
  misc_feature 1..20: note = CRISPR gRNA sequence
  source 1..20: mol_type = other DNA
tgtcgcccaggctggagtgc

SEQ ID NO: 34132 - DNA, 20 bp, synthetic construct
  misc_feature 1..20: note = CRISPR gRNA sequence
  source 1..20: mol_type = other DNA
tcgcccaggctggagtgcag

SEQ ID NO: 34133 - DNA, 20 bp, synthetic construct
  misc_feature 1..20: note = CRISPR gRNA sequence
  source 1..20: mol_type = other DNA
gagtgcagtggtgcaatctt

SEQ ID NO: 34134 - DNA, 20 bp, synthetic construct
  misc_feature 1..20: note = CRISPR gRNA sequence
  source 1..20: mol_type = other DNA
ggctcactgcaacctctgcc

SEQ ID NO: 34135 - DNA, 20 bp, synthetic construct
  misc_feature 1..20: note = CRISPR gRNA sequence
  source 1..20: mol_type = other DNA
gctcactgcaacctctgcct

SEQ ID NO: 34136 - DNA, 20 bp, synthetic construct
  misc_feature 1..20: note = CRISPR gRNA sequence
  source 1..20: mol_type = other DNA
actgcaacctctgcctcccg

SEQ ID NO: 34137 - DNA, 20 bp, synthetic construct
  misc_feature 1..20: note = CRISPR gRNA sequence
  source 1..20: mol_type = other DNA
caacctctgcctcccggatt

SEQ ID NO: 34138 - DNA, 20 bp, synthetic construct
  misc_feature 1..20: note = CRISPR gRNA sequence
  source 1..20: mol_type = other DNA
tgcctcccggattcaagcaa

SEQ ID NO: 34139 - DNA, 20 bp, synthetic construct
  misc_feature 1..20: note = CRISPR gRNA sequence
  source 1..20: mol_type = other DNA
cctcccggattcaagcaatt

SEQ ID NO: 34140 - DNA, 20 bp, synthetic construct
  misc_feature 1..20: note = CRISPR gRNA sequence
  source 1..20: mol_type = other DNA
ccggattcaagcaattctcc

SEQ ID NO: 34141 - DNA, 20 bp, synthetic construct
  misc_feature 1..20: note = CRISPR gRNA sequence
  source 1..20: mol_type = other DNA
aagcaattctcctgcttcaa

SEQ ID NO: 34142 - DNA, 20 bp, synthetic construct
  misc_feature 1..20: note = CRISPR gRNA sequence
  source 1..20: mol_type = other DNA
tcctgcttcaacctcccaag

SEQ ID NO: 34143 - DNA, 20 bp, synthetic construct
  misc_feature 1..20: note = CRISPR gRNA sequence
  source 1..20: mol_type = other DNA
ctgcttcaacctcccaagta

SEQ ID NO: 34144 - DNA, 20 bp, synthetic construct
  misc_feature 1..20: note = CRISPR gRNA sequence
  source 1..20: mol_type = other DNA
cttcaacctcccaagtagct

SEQ ID NO: 34145 - DNA, 20 bp, synthetic construct
  misc_feature 1..20: note = CRISPR gRNA sequence
  source 1..20: mol_type = other DNA
caacctcccaagtagctggc

SEQ ID NO: 34146 - DNA, 20 bp, synthetic construct
  misc_feature 1..20: note = CRISPR gRNA sequence
  source 1..20: mol_type = other DNA
aacctcccaagtagctggca

SEQ ID NO: 34147 - DNA, 20 bp, synthetic construct
  misc_feature 1..20: note = CRISPR gRNA sequence
  source 1..20: mol_type = other DNA
ccaagtagctggcattacag

SEQ ID NO: 34148 - DNA, 20 bp, synthetic construct
  misc_feature 1..20: note = CRISPR gRNA sequence
  source 1..20: mol_type = other DNA
gcattacaggcacccgccac

SEQ ID NO: 34149 - DNA, 20 bp, synthetic construct
  misc_feature 1..20: note = CRISPR gRNA sequence
  source 1..20: mol_type = other DNA
caggcacccgccaccatgcc

SEQ ID NO: 34150 - DNA, 20 bp, synthetic construct
  misc_feature 1..20: note = CRISPR gRNA sequence
  source 1..20: mol_type = other DNA
gctaatttttttatttttag

SEQ ID NO: 34151 - DNA, 20 bp, synthetic construct
  misc_feature 1..20: note = CRISPR gRNA sequence
  source 1..20: mol_type = other DNA
atttttttatttttagtaaa

SEQ ID NO: 34152 - DNA, 20 bp, synthetic construct
  misc_feature 1..20: note = CRISPR gRNA sequence
  source 1..20: mol_type = other DNA
ttttatttttagtaaagatg

SEQ ID NO: 34153 - DNA, 20 bp, synthetic construct
  misc_feature 1..20: note = CRISPR gRNA sequence
  source 1..20: mol_type = other DNA
tttatttttagtaaagatgg

SEQ ID NO: 34154 - DNA, 20 bp, synthetic construct
  misc_feature 1..20: note = CRISPR gRNA sequence
  source 1..20: mol_type = other DNA
ttatttttagtaaagatggg

SEQ ID NO: 34155 - DNA, 20 bp, synthetic construct
  misc_feature 1..20: note = CRISPR gRNA sequence
  source 1..20: mol_type = other DNA
tatttttagtaaagatgggg

SEQ ID NO: 34156 - DNA, 20 bp, synthetic construct
  misc_feature 1..20: note = CRISPR gRNA sequence
  source 1..20: mol_type = other DNA
atttttagtaaagatggggt

SEQ ID NO: 34157 - DNA, 20 bp, synthetic construct
  misc_feature 1..20: note = CRISPR gRNA sequence
  source 1..20: mol_type = other DNA
tttttagtaaagatggggtt

SEQ ID NO: 34158 - DNA, 20 bp, synthetic construct
  misc_feature 1..20: note = CRISPR gRNA sequence
  source 1..20: mol_type = other DNA
ttagtaaagatggggtttca

SEQ ID NO: 34159 - DNA, 20 bp, synthetic construct
  misc_feature 1..20: note = CRISPR gRNA sequence
  source 1..20: mol_type = other DNA
tagtaaagatggggtttcac

SEQ ID NO: 34160 - DNA, 20 bp, synthetic construct
  misc_feature 1..20: note = CRISPR gRNA sequence
  source 1..20: mol_type = other DNA
agtaaagatggggtttcacc

SEQ ID NO: 34161 - DNA, 20 bp, synthetic construct
  misc_feature 1..20: note = CRISPR gRNA sequence
  source 1..20: mol_type = other DNA
gtaaagatggggtttcacca

SEQ ID NO: 34162 - DNA, 20 bp, synthetic construct
  misc_feature 1..20: note = CRISPR gRNA sequence
  source 1..20: mol_type = other DNA
caccatgttggtcaggctgg

SEQ ID NO: 34163 - DNA, 20 bp, synthetic construct
  misc_feature 1..20: note = CRISPR gRNA sequence
  source 1..20: mol_type = other DNA
accatgttggtcaggctggt

SEQ ID NO: 34164 - DNA, 20 bp, synthetic construct
  misc_feature 1..20: note = CRISPR gRNA sequence
  source 1..20: mol_type = other DNA
gtcaggctggtttcgaactc

SEQ ID NO: 34165 - DNA, 20 bp, synthetic construct
  misc_feature 1..20: note = CRISPR gRNA sequence
  source 1..20: mol_type = other DNA
gtttcgaactcccgacctca

SEQ ID NO: 34166 - DNA, 20 bp, synthetic construct
  misc_feature 1..20: note = CRISPR gRNA sequence
  source 1..20: mol_type = other DNA
cgaactcccgacctcaggtg

SEQ ID NO: 34167 - DNA, 20 bp, synthetic construct
  misc_feature 1..20: note = CRISPR gRNA sequence
  source 1..20: mol_type = other DNA
gaactcccgacctcaggtga

SEQ ID NO: 34168 - DNA, 20 bp, synthetic construct
  misc_feature 1..20: note = CRISPR gRNA sequence
  source 1..20: mol_type = other DNA
ccgacctcaggtgatccacc

SEQ ID NO: 34169 - DNA, 20 bp, synthetic construct
  misc_feature 1..20: note = CRISPR gRNA sequence
  source 1..20: mol_type = other DNA
aggtgatccacccgccttgg

SEQ ID NO: 34170 - DNA, 20 bp, synthetic construct
  misc_feature 1..20: note = CRISPR gRNA sequence
  source 1..20: mol_type = other DNA
ggcctcccaaagtgctggga

SEQ ID NO: 34171 - DNA, 20 bp, synthetic construct
  misc_feature 1..20: note = CRISPR gRNA sequence
  source 1..20: mol_type = other DNA
gcctcccaaagtgctgggat

SEQ ID NO: 34172 - DNA, 20 bp, synthetic construct
  misc_feature 1..20: note = CRISPR gRNA sequence
  source 1..20: mol_type = other DNA
ccaaagtgctgggattacag

SEQ ID NO: 34173 - DNA, 20 bp, synthetic construct
  misc_feature 1..20: note = CRISPR gRNA sequence
  source 1..20: mol_type = other DNA
ggattacaggtgtgagccac

SEQ ID NO: 34174 - DNA, 20 bp, synthetic construct
  misc_feature 1..20: note = CRISPR gRNA sequence
  source 1..20: mol_type = other DNA
caggtgtgagccaccacacc

SEQ ID NO: 34175 - DNA, 20 bp, synthetic construct
  misc_feature 1..20: note = CRISPR gRNA sequence
  source 1..20: mol_type = other DNA
tctttcacgcatccacagct

SEQ ID NO: 34176 - DNA, 20 bp, synthetic construct
  misc_feature 1..20: note = CRISPR gRNA sequence
  source 1..20: mol_type = other DNA
ctttcacgcatccacagctt

SEQ ID NO: 34177 - DNA, 20 bp, synthetic construct
  misc_feature 1..20: note = CRISPR gRNA sequence
  source 1..20: mol_type = other DNA
tttcacgcatccacagcttt

SEQ ID NO: 34178 - DNA, 20 bp, synthetic construct
  misc_feature 1..20: note = CRISPR gRNA sequence
  source 1..20: mol_type = other DNA
tcacgcatccacagctttca

SEQ ID NO: 34179 - DNA, 20 bp, synthetic construct
  misc_feature 1..20: note = CRISPR gRNA sequence
  source 1..20: mol_type = other DNA
cacgcatccacagctttcac

SEQ ID NO: 34180 - DNA, 20 bp, synthetic construct
  misc_feature 1..20: note = CRISPR gRNA sequence
  source 1..20: mol_type = other DNA
acgcatccacagctttcact

SEQ ID NO: 34181 - DNA, 20 bp, synthetic construct
  misc_feature 1..20: note = CRISPR gRNA sequence
  source 1..20: mol_type = other DNA
tcactgcctggggagaggct

SEQ ID NO: 34182 - DNA, 20 bp, synthetic construct
  misc_feature 1..20: note = CRISPR gRNA sequence
  source 1..20: mol_type = other DNA
cactgcctggggagaggctc

SEQ ID NO: 34183 - DNA, 20 bp, synthetic construct
  misc_feature 1..20: note = CRISPR gRNA sequence
  source 1..20: mol_type = other DNA
actgcctggggagaggctca

SEQ ID NO: 34184 - DNA, 20 bp, synthetic construct
  misc_feature 1..20: note = CRISPR gRNA sequence
  source 1..20: mol_type = other DNA
cctggggagaggctcagcac

SEQ ID NO: 34185 - DNA, 20 bp, synthetic construct
  misc_feature 1..20: note = CRISPR gRNA sequence
  source 1..20: mol_type = other DNA
gggagaggctcagcacagac

SEQ ID NO: 34186 - DNA, 20 bp, synthetic construct
  misc_feature 1..20: note = CRISPR gRNA sequence
  source 1..20: mol_type = other DNA
agcacagacccccggatgtc

SEQ ID NO: 34187 - DNA, 20 bp, synthetic construct
  misc_feature 1..20: note = CRISPR gRNA sequence
  source 1..20: mol_type = other DNA
tccagtccaagctggggcac

SEQ ID NO: 34188 - DNA, 20 bp, synthetic construct
  misc_feature 1..20: note = CRISPR gRNA sequence
  source 1..20: mol_type = other DNA
ccagtccaagctggggcact

SEQ ID NO: 34189 - DNA, 20 bp, synthetic construct
  misc_feature 1..20: note = CRISPR gRNA sequence
  source 1..20: mol_type = other DNA
cagtccaagctggggcactg

SEQ ID NO: 34190 - DNA, 20 bp, synthetic construct
  misc_feature 1..20: note = CRISPR gRNA sequence
  source 1..20: mol_type = other DNA
gggcactggctgggcccact

SEQ ID NO: 34191 - DNA, 20 bp, synthetic construct
  misc_feature 1..20: note = CRISPR gRNA sequence
  source 1..20: mol_type = other DNA
gctgggcccacttgttcatg

SEQ ID NO: 34192 - DNA, 20 bp, synthetic construct
  misc_feature 1..20: note = CRISPR gRNA sequence
  source 1..20: mol_type = other DNA
ggcccacttgttcatgacgg

SEQ ID NO: 34193 - DNA, 20 bp, synthetic construct
  misc_feature 1..20: note = CRISPR gRNA sequence
  source 1..20: mol_type = other DNA
gttcatgacggttgagcggg

SEQ ID NO: 34194 - DNA, 20 bp, synthetic construct
  misc_feature 1..20: note = CRISPR gRNA sequence
  source 1..20: mol_type = other DNA
ttcatgacggttgagcgggg

SEQ ID NO: 34195 - DNA, 20 bp, synthetic construct
  misc_feature 1..20: note = CRISPR gRNA sequence
  source 1..20: mol_type = other DNA
atgacggttgagcgggggct

SEQ ID NO: 34196 - DNA, 20 bp, synthetic construct
  misc_feature 1..20: note = CRISPR gRNA sequence
  source 1..20: mol_type = other DNA
agcgggggctgcaggaaccc

SEQ ID NO: 34197 - DNA, 20 bp, synthetic construct
  misc_feature 1..20: note = CRISPR gRNA sequence
  source 1..20: mol_type = other DNA
caggaacccaaacataaccg

SEQ ID NO: 34198 - DNA, 20 bp, synthetic construct
  misc_feature 1..20: note = CRISPR gRNA sequence
  source 1..20: mol_type = other DNA
gcagcgagatcccagccaac

SEQ ID NO: 34199 - DNA, 20 bp, synthetic construct
  misc_feature 1..20: note = CRISPR gRNA sequence
  source 1..20: mol_type = other DNA
cagcgagatcccagccaacc

SEQ ID NO: 34200 - DNA, 20 bp, synthetic construct
  misc_feature 1..20: note = CRISPR gRNA sequence
  source 1..20: mol_type = other DNA
gaggaagcagaactgaaaga

SEQ ID NO: 34201 - DNA, 20 bp, synthetic construct
  misc_feature 1..20: note = CRISPR gRNA sequence
  source 1..20: mol_type = other DNA
aaagatggggccaccgccct

SEQ ID NO: 34202 - DNA, 20 bp, synthetic construct
  misc_feature 1..20: note = CRISPR gRNA sequence
  source 1..20: mol_type = other DNA
ttcctggagcagggccaaag

SEQ ID NO: 34203 - DNA, 20 bp, synthetic construct
  misc_feature 1..20: note = CRISPR gRNA sequence
  source 1..20: mol_type = other DNA
tcctggagcagggccaaagc

SEQ ID NO: 34204 - DNA, 20 bp, synthetic construct
  misc_feature 1..20: note = CRISPR gRNA sequence
  source 1..20: mol_type = other DNA
cctggagcagggccaaagct

SEQ ID NO: 34205 - DNA, 20 bp, synthetic construct
  misc_feature 1..20: note = CRISPR gRNA sequence
  source 1..20: mol_type = other DNA
ctggagcagggccaaagctg

SEQ ID NO: 34206 - DNA, 20 bp, synthetic construct
  misc_feature 1..20: note = CRISPR gRNA sequence
  source 1..20: mol_type = other DNA
gagcagggccaaagctggga

SEQ ID NO: 34207 - DNA, 20 bp, synthetic construct
  misc_feature 1..20: note = CRISPR gRNA sequence
  source 1..20: mol_type = other DNA
ggagatggttgggggtgaga

SEQ ID NO: 34208 - DNA, 20 bp, synthetic construct
  misc_feature 1..20: note = CRISPR gRNA sequence
  source 1..20: mol_type = other DNA
ggggtgagatgctccacctc

SEQ ID NO: 34209 - DNA, 20 bp, synthetic construct
  misc_feature 1..20: note = CRISPR gRNA sequence
  source 1..20: mol_type = other DNA
cacctctcccagccccttgg

SEQ ID NO: 34210 - DNA, 20 bp, synthetic construct
  misc_feature 1..20: note = CRISPR gRNA sequence
  source 1..20: mol_type = other DNA
tcccagccccttggtcaggg

SEQ ID NO: 34211 - DNA, 20 bp, synthetic construct
  misc_feature 1..20: note = CRISPR gRNA sequence
  source 1..20: mol_type = other DNA
ccagccccttggtcagggac

SEQ ID NO: 34212 - DNA, 20 bp, synthetic construct
  misc_feature 1..20: note = CRISPR gRNA sequence
  source 1..20: mol_type = other DNA
ggtcagggacacaggcacaa

SEQ ID NO: 34213 - DNA, 20 bp, synthetic construct
  misc_feature 1..20: note = CRISPR gRNA sequence
  source 1..20: mol_type = other DNA
gtcagggacacaggcacaaa

SEQ ID NO: 34214 - DNA, 20 bp, synthetic construct
  misc_feature 1..20: note = CRISPR gRNA sequence
  source 1..20: mol_type = other DNA
ttctctcagagcagtgagaa

SEQ ID NO: 34215 - DNA, 20 bp, synthetic construct
  misc_feature 1..20: note = CRISPR gRNA sequence
  source 1..20: mol_type = other DNA
tctcagagcagtgagaaaag

SEQ ID NO: 34216 - DNA, 20 bp, synthetic construct
  misc_feature 1..20: note = CRISPR gRNA sequence
  source 1..20: mol_type = other DNA
tcagagcagtgagaaaagac

SEQ ID NO: 34217 - DNA, 20 bp, synthetic construct
  misc_feature 1..20: note = CRISPR gRNA sequence
  source 1..20: mol_type = other DNA
agagcagtgagaaaagacac

SEQ ID NO: 34218 - DNA, 20 bp, synthetic construct
  misc_feature 1..20: note = CRISPR gRNA sequence
  source 1..20: mol_type = other DNA
tgccccagctcctgcctgat

SEQ ID NO: 34219 - DNA, 20 bp, synthetic construct
  misc_feature 1..20: note = CRISPR gRNA sequence
  source 1..20: mol_type = other DNA
gccccagctcctgcctgatg

SEQ ID NO: 34220 - DNA, 20 bp, synthetic construct
  misc_feature 1..20: note = CRISPR gRNA sequence
  source 1..20: mol_type = other DNA
ccccagctcctgcctgatgc

SEQ ID NO: 34221 - DNA, 20 bp, synthetic construct
  misc_feature 1..20: note = CRISPR gRNA sequence
  source 1..20: mol_type = other DNA
ctgcctgatgcccgcctccc

SEQ ID NO: 34222 - DNA, 20 bp, synthetic construct
  misc_feature 1..20: note = CRISPR gRNA sequence
  source 1..20: mol_type = other DNA
cctgatgcccgcctcccatt

SEQ ID NO: 34223 - DNA, 20 bp, synthetic construct
  misc_feature 1..20: note = CRISPR gRNA sequence
  source 1..20: mol_type = other DNA
atgcccgcctcccattccac

SEQ ID NO: 34224 - DNA, 20 bp, synthetic construct
  misc_feature 1..20: note = CRISPR gRNA sequence
  source 1..20: mol_type = other DNA
ccattccacccatgctcttt

SEQ ID NO: 34225 - DNA, 20 bp, synthetic construct
  misc_feature 1..20: note = CRISPR gRNA sequence
  source 1..20: mol_type = other DNA
cacccatgctctttattaag

SEQ ID NO: 34226 - DNA, 20 bp, synthetic construct
  misc_feature 1..20: note = CRISPR gRNA sequence
  source 1..20: mol_type = other DNA
tttattaagaacctacattg

SEQ ID NO: 34227 - DNA, 20 bp, synthetic construct
  misc_feature 1..20: note = CRISPR gRNA sequence
  source 1..20: mol_type = other DNA
tattaagaacctacattgca

SEQ ID NO: 34228 - DNA, 20 bp, synthetic construct
  misc_feature 1..20: note = CRISPR gRNA sequence
  source 1..20: mol_type = other DNA
attaagaacctacattgcag

SEQ ID NO: 34229 - DNA, 20 bp, synthetic construct
  misc_feature 1..20: note = CRISPR gRNA sequence
  source 1..20: mol_type = other DNA
ttaagaacctacattgcagc

SEQ ID NO: 34230 - DNA, 20 bp, synthetic construct
  misc_feature 1..20: note = CRISPR gRNA sequence
  source 1..20: mol_type = other DNA
agaacctacattgcagcaat

SEQ ID NO: 34231 - DNA, 20 bp, synthetic construct
  misc_feature 1..20: note = CRISPR gRNA sequence
  source 1..20: mol_type = other DNA
cattgcagcaatctgcctcc

SEQ ID NO: 34232 - DNA, 20 bp, synthetic construct
  misc_feature 1..20: note = CRISPR gRNA sequence
  source 1..20: mol_type = other DNA
cagcaatctgcctcctcttt

SEQ ID NO: 34233 - DNA, 20 bp, synthetic construct
  misc_feature 1..20: note = CRISPR gRNA sequence
  source 1..20: mol_type = other DNA
cctcctctttgaggcagtgt

SEQ ID NO: 34234 - DNA, 20 bp, synthetic construct
  misc_feature 1..20: note = CRISPR gRNA sequence
  source 1..20: mol_type = other DNA
ctctttgaggcagtgtgatc

SEQ ID NO: 34235 - DNA, 20 bp, synthetic construct
  misc_feature 1..20: note = CRISPR gRNA sequence
  source 1..20: mol_type = other DNA
tttgaggcagtgtgatctcg

SEQ ID NO: 34236 - DNA, 20 bp, synthetic construct
  misc_feature 1..20: note = CRISPR gRNA sequence
  source 1..20: mol_type = other DNA
tgaggcagtgtgatctcgtg

SEQ ID NO: 34237 - DNA, 20 bp, synthetic construct
  misc_feature 1..20: note = CRISPR gRNA sequence
  source 1..20: mol_type = other DNA
gaggcagtgtgatctcgtga

SEQ ID NO: 34238 - DNA, 20 bp, synthetic construct
  misc_feature 1..20: note = CRISPR gRNA sequence
  source 1..20: mol_type = other DNA
aggcagtgtgatctcgtgac

SEQ ID NO: 34239 - DNA, 20 bp, synthetic construct
  misc_feature 1..20: note = CRISPR gRNA sequence
  source 1..20: mol_type = other DNA
gtgacaagagctccagactg

SEQ ID NO: 34240 - DNA, 20 bp, synthetic construct
  misc_feature 1..20: note = CRISPR gRNA sequence
  source 1..20: mol_type = other DNA
cagactgatcctagcaactc

SEQ ID NO: 34241 - DNA, 20 bp, synthetic construct
  misc_feature 1..20: note = CRISPR gRNA sequence
  source 1..20: mol_type = other DNA
atcctagcaactccgtgaat

SEQ ID NO: 34242 - DNA, 20 bp, synthetic construct
  misc_feature 1..20: note = CRISPR gRNA sequence
  source 1..20: mol_type = other DNA
gcaactccgtgaatgagttg

SEQ ID NO: 34243 - DNA, 20 bp, synthetic construct
  misc_feature 1..20: note = CRISPR gRNA sequence
  source 1..20: mol_type = other DNA
cgtgaatgagttgtgtgact

SEQ ID NO: 34244 - DNA, 20 bp, synthetic construct
  misc_feature 1..20: note = CRISPR gRNA sequence
  source 1..20: mol_type = other DNA
tgtgactttggactttgggc

SEQ ID NO: 34245 - DNA, 20 bp, synthetic construct
  misc_feature 1..20: note = CRISPR gRNA sequence
  source 1..20: mol_type = other DNA
tggactttgggccatatcta

SEQ ID NO: 34246 - DNA, 20 bp, synthetic construct
  misc_feature 1..20: note = CRISPR gRNA sequence
  source 1..20: mol_type = other DNA
ggactttgggccatatctat

SEQ ID NO: 34247 - DNA, 20 bp, synthetic construct
  misc_feature 1..20: note = CRISPR gRNA sequence
  source 1..20: mol_type = other DNA
gactttgggccatatctata

SEQ ID NO: 34248 - DNA, 20 bp, synthetic construct
  misc_feature 1..20: note = CRISPR gRNA sequence
  source 1..20: mol_type = other DNA
tgggccatatctataaaatg

SEQ ID NO: 34249 - DNA, 20 bp, synthetic construct
  misc_feature 1..20: note = CRISPR gRNA sequence
  source 1..20: mol_type = other DNA
gggccatatctataaaatga

SEQ ID NO: 34250 - DNA, 20 bp, synthetic construct
  misc_feature 1..20: note = CRISPR gRNA sequence
  source 1..20: mol_type = other DNA
ggccatatctataaaatgat

SEQ ID NO: 34251 - DNA, 20 bp, synthetic construct
  misc_feature 1..20: note = CRISPR gRNA sequence
  source 1..20: mol_type = other DNA
taaaatgattccatatctat

SEQ ID NO: 34252 - DNA, 20 bp, synthetic construct
  misc_feature 1..20: note = CRISPR gRNA sequence
  source 1..20: mol_type = other DNA
catatctataacatttctat

SEQ ID NO: 34253 - DNA, 20 bp, synthetic construct
  misc_feature 1..20: note = CRISPR gRNA sequence
  source 1..20: mol_type = other DNA
taacatttctataagataat

SEQ ID NO: 34254 - DNA, 20 bp, synthetic construct
  misc_feature 1..20: note = CRISPR gRNA sequence
  source 1..20: mol_type = other DNA
ctataagataattccatatc

SEQ ID NO: 34255 - DNA, 20 bp, synthetic construct
  misc_feature 1..20: note = CRISPR gRNA sequence
  source 1..20: mol_type = other DNA
tataagataattccatatct

SEQ ID NO: 34256 - DNA, 20 bp, synthetic construct
  misc_feature 1..20: note = CRISPR gRNA sequence
  source 1..20: mol_type = other DNA
taagataattccatatctat

SEQ ID NO: 34257 - DNA, 20 bp, synthetic construct
  misc_feature 1..20: note = CRISPR gRNA sequence
  source 1..20: mol_type = other DNA
catatctataaaataataag

SEQ ID NO: 34258 - DNA, 20 bp, synthetic construct
  misc_feature 1..20: note = CRISPR gRNA sequence
  source 1..20: mol_type = other DNA
taaaataataagttacccaa

SEQ ID NO: 34259 - DNA, 20 bp, synthetic construct
  misc_feature 1..20: note = CRISPR gRNA sequence
  source 1..20: mol_type = other DNA
cccaaactcagttttctcac

SEQ ID NO: 34260 - DNA, 20 bp, synthetic construct
  misc_feature 1..20: note = CRISPR gRNA sequence
  source 1..20: mol_type = other DNA
agttttctcacagggcattg

SEQ ID NO: 34261 - DNA, 20 bp, synthetic construct
  misc_feature 1..20: note = CRISPR gRNA sequence
  source 1..20: mol_type = other DNA
tctcacagggcattgggtct

SEQ ID NO: 34262 - DNA, 20 bp, synthetic construct
  misc_feature 1..20: note = CRISPR gRNA sequence
  source 1..20: mol_type = other DNA
ctcacagggcattgggtctg

SEQ ID NO: 34263 - DNA, 20 bp, synthetic construct
  misc_feature 1..20: note = CRISPR gRNA sequence
  source 1..20: mol_type = other DNA
tcacagggcattgggtctgc

SEQ ID NO: 34264 - DNA, 20 bp, synthetic construct
  misc_feature 1..20: note = CRISPR gRNA sequence
  source 1..20: mol_type = other DNA
acagggcattgggtctgcca

SEQ ID NO: 34265 - DNA, 20 bp, synthetic construct
  misc_feature 1..20: note = CRISPR gRNA sequence
  source 1..20: mol_type = other DNA
ggtctgccagggaccttcaa

SEQ ID NO: 34266 - DNA, 20 bp, synthetic construct
  misc_feature 1..20: note = CRISPR gRNA sequence
  source 1..20: mol_type = other DNA
ccagggaccttcaagcttga

SEQ ID NO: 34267 - DNA, 20 bp, synthetic construct
  misc_feature 1..20: note = CRISPR gRNA sequence
  source 1..20: mol_type = other DNA
caagcttgacctctttcctt

SEQ ID NO: 34268 - DNA, 20 bp, synthetic construct
  misc_feature 1..20: note = CRISPR gRNA sequence
  source 1..20: mol_type = other DNA
aagcttgacctctttccttc

SEQ ID NO: 34269 - DNA, 20 bp, synthetic construct
  misc_feature 1..20: note = CRISPR gRNA sequence
  source 1..20: mol_type = other DNA
gacctctttccttcactctg

SEQ ID NO: 34270 - DNA, 20 bp, synthetic construct
  misc_feature 1..20: note = CRISPR gRNA sequence
  source 1..20: mol_type = other DNA
acctctttccttcactctgc

SEQ ID NO: 34271 - DNA, 20 bp, synthetic construct
  misc_feature 1..20: note = CRISPR gRNA sequence
  source 1..20: mol_type = other DNA
tttccttcactctgcagatg

SEQ ID NO: 34272 - DNA, 20 bp, synthetic construct
  misc_feature 1..20: note = CRISPR gRNA sequence
  source 1..20: mol_type = other DNA
tccttcactctgcagatgac

SEQ ID NO: 34273 - DNA, 20 bp, synthetic construct
  misc_feature 1..20: note = CRISPR gRNA sequence
  source 1..20: mol_type = other DNA
ccttcactctgcagatgaca

SEQ ID NO: 34274 - DNA, 20 bp, synthetic construct
  misc_feature 1..20: note = CRISPR gRNA sequence
  source 1..20: mol_type = other DNA
cttcactctgcagatgacaa

SEQ ID NO: 34275 - DNA, 20 bp, synthetic construct
  misc_feature 1..20: note = CRISPR gRNA sequence
  source 1..20: mol_type = other DNA
cactctgcagatgacaagac

SEQ ID NO: 34276 - DNA, 20 bp, synthetic construct
  misc_feature 1..20: note = CRISPR gRNA sequence
  source 1..20: mol_type = other DNA
actctgcagatgacaagact

SEQ ID NO: 34277 - DNA, 20 bp, synthetic construct
  misc_feature 1..20: note = CRISPR gRNA sequence
  source 1..20: mol_type = other DNA
tgcagatgacaagactgaga

SEQ ID NO: 34278 - DNA, 20 bp, synthetic construct
  misc_feature 1..20: note = CRISPR gRNA sequence
  source 1..20: mol_type = other DNA
cagatgacaagactgagacc

SEQ ID NO: 34279 - DNA, 20 bp, synthetic construct
  misc_feature 1..20: note = CRISPR gRNA sequence
  source 1..20: mol_type = other DNA
agaccccgggaaggacgtga

SEQ ID NO: 34280 - DNA, 20 bp, synthetic construct
  misc_feature 1..20: note = CRISPR gRNA sequence
  source 1..20: mol_type = other DNA
gcacaagacctcatagcctg

SEQ ID NO: 34281 - DNA, 20 bp, synthetic construct
  misc_feature 1..20: note = CRISPR gRNA sequence
  source 1..20: mol_type = other DNA
cacaagacctcatagcctgt

SEQ ID NO: 34282 - DNA, 20 bp, synthetic construct
  misc_feature 1..20: note = CRISPR gRNA sequence
  source 1..20: mol_type = other DNA
atagcctgtcggtggctgcc

SEQ ID NO: 34283 - DNA, 20 bp, synthetic construct
  misc_feature 1..20: note = CRISPR gRNA sequence
  source 1..20: mol_type = other DNA
tcggtggctgcccctgcccc

SEQ ID NO: 34284 - DNA, 20 bp, synthetic construct
  misc_feature 1..20: note = CRISPR gRNA sequence
  source 1..20: mol_type = other DNA
cccctgccccttctccccca

SEQ ID NO: 34285 - DNA, 20 bp, synthetic construct
  misc_feature 1..20: note = CRISPR gRNA sequence
  source 1..20: mol_type = other DNA
ccccttctcccccactcccc

SEQ ID NO: 34286 - DNA, 20 bp, synthetic construct
  misc_feature 1..20: note = CRISPR gRNA sequence
  source 1..20: mol_type = other DNA
ctcccccactccccctgcca

SEQ ID NO: 34287 - DNA, 20 bp, synthetic construct
  misc_feature 1..20: note = CRISPR gRNA sequence
  source 1..20: mol_type = other DNA
tcccccactccccctgccaa

SEQ ID NO: 34288 - DNA, 20 bp, synthetic construct
  misc_feature 1..20: note = CRISPR gRNA sequence
  source 1..20: mol_type = other DNA
ccccactccccctgccaaga

SEQ ID NO: 34289 - DNA, 20 bp, synthetic construct
  misc_feature 1..20: note = CRISPR gRNA sequence
  source 1..20: mol_type = other DNA
cccctgccaagactcccagg

SEQ ID NO: 34290 - DNA, 20 bp, synthetic construct
  misc_feature 1..20: note = CRISPR gRNA sequence
  source 1..20: mol_type = other DNA
ccaagactcccaggctggtg

SEQ ID NO: 34291 - DNA, 20 bp, synthetic construct
  misc_feature 1..20: note = CRISPR gRNA sequence
  source 1..20: mol_type = other DNA
ccaggctggtgctctttccc

SEQ ID NO: 34292 - DNA, 20 bp, synthetic construct
  misc_feature 1..20: note = CRISPR gRNA sequence
  source 1..20: mol_type = other DNA
gtgctctttccccccagtca

SEQ ID NO: 34293 - DNA, 20 bp, synthetic construct
  misc_feature 1..20: note = CRISPR gRNA sequence
  source 1..20: mol_type = other DNA
tttccccccagtcaaaatgt

SEQ ID NO: 34294 - DNA, 20 bp, synthetic construct
  misc_feature 1..20: note = CRISPR gRNA sequence
  source 1..20: mol_type = other DNA
tccccccagtcaaaatgttc

SEQ ID NO: 34295 - DNA, 20 bp, synthetic construct
  misc_feature 1..20: note = CRISPR gRNA sequence
  source 1..20: mol_type = other DNA
ccccccagtcaaaatgttcc

SEQ ID NO: 34296 - DNA, 20 bp, synthetic construct
  misc_feature 1..20: note = CRISPR gRNA sequence
  source 1..20: mol_type = other DNA
cccccagtcaaaatgttccc

SEQ ID NO: 34297 - DNA, 20 bp, synthetic construct
  misc_feature 1..20: note = CRISPR gRNA sequence
  source 1..20: mol_type = other DNA
ccaatgaaatgatcaccctt

SEQ ID NO: 34298 - DNA, 20 bp, synthetic construct
  misc_feature 1..20: note = CRISPR gRNA sequence
  source 1..20: mol_type = other DNA
gtcctgtctgggctcaagca

SEQ ID NO: 34299 - DNA, 20 bp, synthetic construct
  misc_feature 1..20: note = CRISPR gRNA sequence
  source 1..20: mol_type = other DNA
tcctgtctgggctcaagcat

SEQ ID NO: 34300 - DNA, 20 bp, synthetic construct
  misc_feature 1..20: note = CRISPR gRNA sequence
  source 1..20: mol_type = other DNA
tctgggctcaagcatagaga

SEQ ID NO: 34301 - DNA, 20 bp, synthetic construct
  misc_feature 1..20: note = CRISPR gRNA sequence
  source 1..20: mol_type = other DNA
ggctcaagcatagagacaca

SEQ ID NO: 34302 - DNA, 20 bp, synthetic construct
  misc_feature 1..20: note = CRISPR gRNA sequence
  source 1..20: mol_type = other DNA
aagcatagagacacaggtgg

SEQ ID NO: 34303 - DNA, 20 bp, synthetic construct
  misc_feature 1..20: note = CRISPR gRNA sequence
  source 1..20: mol_type = other DNA
gagacatttagcccaccccc

SEQ ID NO: 34304 - DNA, 20 bp, synthetic construct
  misc_feature 1..20: note = CRISPR gRNA sequence
  source 1..20: mol_type = other DNA
agcccacccccacttattga

SEQ ID NO: 34305 - DNA, 20 bp, synthetic construct
  misc_feature 1..20: note = CRISPR gRNA sequence
  source 1..20: mol_type = other DNA
gcccacccccacttattgat

SEQ ID NO: 34306 - DNA, 20 bp, synthetic construct
  misc_feature 1..20: note = CRISPR gRNA sequence
  source 1..20: mol_type = other DNA
attgatgagctctgcttcaa

SEQ ID NO: 34307 - DNA, 20 bp, synthetic construct
  misc_feature 1..20: note = CRISPR gRNA sequence
  source 1..20: mol_type = other DNA
ttgatgagctctgcttcaaa

SEQ ID NO: 34308 - DNA, 20 bp, synthetic construct
  misc_feature 1..20: note = CRISPR gRNA sequence
  source 1..20: mol_type = other DNA
atgagctctgcttcaaactc

SEQ ID NO: 34309 - DNA, 20 bp, synthetic construct
  misc_feature 1..20: note = CRISPR gRNA sequence
  source 1..20: mol_type = other DNA
tgcttcaaactctggatgac

SEQ ID NO: 34310 - DNA, 20 bp, synthetic construct
  misc_feature 1..20: note = CRISPR gRNA sequence
  source 1..20: mol_type = other DNA
cttcaaactctggatgacac

SEQ ID NO: 34311 - DNA, 20 bp, synthetic construct
  misc_feature 1..20: note = CRISPR gRNA sequence
  source 1..20: mol_type = other DNA
caaactctggatgacactgc

SEQ ID NO: 34312 - DNA, 20 bp, synthetic construct
  misc_feature 1..20: note = CRISPR gRNA sequence
  source 1..20: mol_type = other DNA
aaactctggatgacactgct

SEQ ID NO: 34313 - DNA, 20 bp, synthetic construct
  misc_feature 1..20: note = CRISPR gRNA sequence
  source 1..20: mol_type = other DNA
tggatgacactgctgtgtgg

SEQ ID NO: 34314 - DNA, 20 bp, synthetic construct
  misc_feature 1..20: note = CRISPR gRNA sequence
  source 1..20: mol_type = other DNA
gatgacactgctgtgtggtt

SEQ ID NO: 34315 - DNA, 20 bp, synthetic construct
  misc_feature 1..20: note = CRISPR gRNA sequence
  source 1..20: mol_type = other DNA
ctgtgtggttaagcacacag

SEQ ID NO: 34316 - DNA, 20 bp, synthetic construct
  misc_feature 1..20: note = CRISPR gRNA sequence
  source 1..20: mol_type = other DNA
tgtggttaagcacacagtca

SEQ ID NO: 34317 - DNA, 20 bp, synthetic construct
  misc_feature 1..20: note = CRISPR gRNA sequence
  source 1..20: mol_type = other DNA
agcacacagtcagagaaata

SEQ ID NO: 34318 - DNA, 20 bp, synthetic construct
  misc_feature 1..20: note = CRISPR gRNA sequence
  source 1..20: mol_type = other DNA
agaagggaaagaaggcaagt

SEQ ID NO: 34319 - DNA, 20 bp, synthetic construct
  misc_feature 1..20: note = CRISPR gRNA sequence
  source 1..20: mol_type = other DNA
tggcgtaaaatttaccaact

SEQ ID NO: 34320 - DNA, 20 bp, synthetic construct
  misc_feature 1..20: note = CRISPR gRNA sequence
  source 1..20: mol_type = other DNA
ggcgtaaaatttaccaactt

SEQ ID NO: 34321 - DNA, 20 bp, synthetic construct
  misc_feature 1..20: note = CRISPR gRNA sequence
  source 1..20: mol_type = other DNA
gcgtaaaatttaccaacttt

SEQ ID NO: 34322 - DNA, 20 bp, synthetic construct
  misc_feature 1..20: note = CRISPR gRNA sequence
  source 1..20: mol_type = other DNA
accaactttgagactacccc

SEQ ID NO: 34323 - DNA, 20 bp, synthetic construct
  misc_feature 1..20: note = CRISPR gRNA sequence
  source 1..20: mol_type = other DNA
ccaactttgagactacccct

SEQ ID NO: 34324 - DNA, 20 bp, synthetic construct
  misc_feature 1..20: note = CRISPR gRNA sequence
  source 1..20: mol_type = other DNA
tgagactacccctacctacc

SEQ ID NO: 34325 - DNA, 20 bp, synthetic construct
  misc_feature 1..20: note = CRISPR gRNA sequence
  source 1..20: mol_type = other DNA
gagactacccctacctacca

SEQ ID NO: 34326 - DNA, 20 bp, synthetic construct
  misc_feature 1..20: note = CRISPR gRNA sequence
  source 1..20: mol_type = other DNA
agactacccctacctaccaa

SEQ ID NO: 34327 - DNA, 20 bp, synthetic construct
  misc_feature 1..20: note = CRISPR gRNA sequence
  source 1..20: mol_type = other DNA
cccctacctaccaacacact

SEQ ID NO: 34328 - DNA, 20 bp, synthetic construct
  misc_feature 1..20: note = CRISPR gRNA sequence
  source 1..20: mol_type = other DNA
cctaccaacacactgtaacc

SEQ ID NO: 34329 - DNA, 20 bp, synthetic construct
  misc_feature 1..20: note = CRISPR gRNA sequence
  source 1..20: mol_type = other DNA
ccaacacactgtaacctggg

SEQ ID NO: 34330 - DNA, 20 bp, synthetic construct
  misc_feature 1..20: note = CRISPR gRNA sequence
  source 1..20: mol_type = other DNA
taacctgggcaagttcattt

SEQ ID NO: 34331 - DNA, 20 bp, synthetic construct
  misc_feature 1..20: note = CRISPR gRNA sequence
  source 1..20: mol_type = other DNA
ggcaagttcattttttaaac

SEQ ID NO: 34332 - DNA, 20 bp, synthetic construct
  misc_feature 1..20: note = CRISPR gRNA sequence
  source 1..20: mol_type = other DNA
attttttaaaccacttggag

SEQ ID NO: 34333 - DNA, 20 bp, synthetic construct
  misc_feature 1..20: note = CRISPR gRNA sequence
  source 1..20: mol_type = other DNA
tttaaaccacttggagcctc

SEQ ID NO: 34334 - DNA, 20 bp, synthetic construct
  misc_feature 1..20: note = CRISPR gRNA sequence
  source 1..20: mol_type = other DNA
ttaaaccacttggagcctca

SEQ ID NO: 34335 - DNA, 20 bp, synthetic construct
  misc_feature 1..20: note = CRISPR gRNA sequence
  source 1..20: mol_type = other DNA
taaaccacttggagcctcag

SEQ ID NO: 34336 - DNA, 20 bp, synthetic construct
  misc_feature 1..20: note = CRISPR gRNA sequence
  source 1..20: mol_type = other DNA
aaaccacttggagcctcagt

SEQ ID NO: 34337 - DNA, 20 bp, synthetic construct
  misc_feature 1..20: note = CRISPR gRNA sequence
  source 1..20: mol_type = other DNA
aaccacttggagcctcagtt

SEQ ID NO: 34338 - DNA, 20 bp, synthetic construct
  misc_feature 1..20: note = CRISPR gRNA sequence
  source 1..20: mol_type = other DNA
ggagcctcagtttccatatc

SEQ ID NO: 34339 - DNA, 20 bp, synthetic construct
  misc_feature 1..20: note = CRISPR gRNA sequence
  source 1..20: mol_type = other DNA
gagcctcagtttccatatct

SEQ ID NO: 34340 - DNA, 20 bp, synthetic construct
  misc_feature 1..20: note = CRISPR gRNA sequence
  source 1..20: mol_type = other DNA
agtttccatatctataaaat

SEQ ID NO: 34341 - DNA, 20 bp, synthetic construct
  misc_feature 1..20: note = CRISPR gRNA sequence
  source 1..20: mol_type = other DNA
ccatatctataaaatgcgaa

SEQ ID NO: 34342 - DNA, 20 bp, synthetic construct
  misc_feature 1..20: note = CRISPR gRNA sequence
  source 1..20: mol_type = other DNA
catatctataaaatgcgaat

SEQ ID NO: 34343 - DNA, 20 bp, synthetic construct
  misc_feature 1..20: note = CRISPR gRNA sequence
  source 1..20: mol_type = other DNA
taaaatgcgaataataattg

SEQ ID NO: 34344 - DNA, 20 bp, synthetic construct
  misc_feature 1..20: note = CRISPR gRNA sequence
  source 1..20: mol_type = other DNA
gcaactcacaaggattaggg

SEQ ID NO: 34345 - DNA, 20 bp, synthetic construct
  misc_feature 1..20: note = CRISPR gRNA sequence
  source 1..20: mol_type = other DNA
acaaggattaggggagttaa

SEQ ID NO: 34346 - DNA, 20 bp, synthetic construct
  misc_feature 1..20: note = CRISPR gRNA sequence
  source 1..20: mol_type = other DNA
ggggagttaagtcacgcgga

SEQ ID NO: 34347 - DNA, 20 bp, synthetic construct
  misc_feature 1..20: note = CRISPR gRNA sequence
  source 1..20: mol_type = other DNA
agtcacgcggagcccttagc

SEQ ID NO: 34348 - DNA, 20 bp, synthetic construct
  misc_feature 1..20: note = CRISPR gRNA sequence
  source 1..20: mol_type = other DNA
agcaatgggactggcaatca

SEQ ID NO: 34349 - DNA, 20 bp, synthetic construct
  misc_feature 1..20: note = CRISPR gRNA sequence
  source 1..20: mol_type = other DNA
gcaatgggactggcaatcag

SEQ ID NO: 34350 - DNA, 20 bp, synthetic construct
  misc_feature 1..20: note = CRISPR gRNA sequence
  source 1..20: mol_type = other DNA
gcaatcagtaagtgctgaat

SEQ ID NO: 34351 - DNA, 20 bp, synthetic construct
  misc_feature 1..20: note = CRISPR gRNA sequence
  source 1..20: mol_type = other DNA
aatgaacagaagtttaaggc

SEQ ID NO: 34352 - DNA, 20 bp, synthetic construct
  misc_feature 1..20: note = CRISPR gRNA sequence
  source 1..20: mol_type = other DNA
aaggcagcacagcttctaca

SEQ ID NO: 34353 - DNA, 20 bp, synthetic construct
  misc_feature 1..20: note = CRISPR gRNA sequence
  source 1..20: mol_type = other DNA
aggcagcacagcttctacat

SEQ ID NO: 34354 - DNA, 20 bp, synthetic construct
  misc_feature 1..20: note = CRISPR gRNA sequence
  source 1..20: mol_type = other DNA
ctacatggtgagtataatat

SEQ ID NO: 34355 - DNA, 20 bp, synthetic construct
  misc_feature 1..20: note = CRISPR gRNA sequence
  source 1..20: mol_type = other DNA
tacatggtgagtataatatg

SEQ ID NO: 34356 - DNA, 20 bp, synthetic construct
  misc_feature 1..20: note = CRISPR gRNA sequence
  source 1..20: mol_type = other DNA
catggtgagtataatatgtg

SEQ ID NO: 34357 - DNA, 20 bp, synthetic construct
  misc_feature 1..20: note = CRISPR gRNA sequence
  source 1..20: mol_type = other DNA
ttagtttgcttcttacgttt

SEQ ID NO: 34358 - DNA, 20 bp, synthetic construct
  misc_feature 1..20: note = CRISPR gRNA sequence
  source 1..20: mol_type = other DNA
gtttgcttcttacgtttgtg

SEQ ID NO: 34359 - DNA, 20 bp, synthetic construct
  misc_feature 1..20: note = CRISPR gRNA sequence
  source 1..20: mol_type = other DNA
gcttcttacgtttgtgagag

SEQ ID NO: 34360 - DNA, 20 bp, synthetic construct
  misc_feature 1..20: note = CRISPR gRNA sequence
  source 1..20: mol_type = other DNA
cttcttacgtttgtgagagt

SEQ ID NO: 34361 - DNA, 20 bp, synthetic construct
  misc_feature 1..20: note = CRISPR gRNA sequence
  source 1..20: mol_type = other DNA
cttacgtttgtgagagtgac

SEQ ID NO: 34362 - DNA, 20 bp, synthetic construct
  misc_feature 1..20: note = CRISPR gRNA sequence
  source 1..20: mol_type = other DNA
ttacgtttgtgagagtgaca

SEQ ID NO: 34363 - DNA, 20 bp, synthetic construct
  misc_feature 1..20: note = CRISPR gRNA sequence
  source 1..20: mol_type = other DNA
acgtttgtgagagtgacaaa

SEQ ID NO: 34364 - DNA, 20 bp, synthetic construct
  misc_feature 1..20: note = CRISPR gRNA sequence
  source 1..20: mol_type = other DNA
cgtttgtgagagtgacaaag

SEQ ID NO: 34365 - DNA, 20 bp, synthetic construct
  misc_feature 1..20: note = CRISPR gRNA sequence
  source 1..20: mol_type = other DNA
gtgagagtgacaaagggacc

SEQ ID NO: 34366 - DNA, 20 bp, synthetic construct
  misc_feature 1..20: note = CRISPR gRNA sequence
  source 1..20: mol_type = other DNA
tgagagtgacaaagggaccc

SEQ ID NO: 34367 - DNA, 20 bp, synthetic construct
  misc_feature 1..20: note = CRISPR gRNA sequence
  source 1..20: mol_type = other DNA
tcccttccatttcttccgag

SEQ ID NO: 34368 - DNA, 20 bp, synthetic construct
  misc_feature 1..20: note = CRISPR gRNA sequence
  source 1..20: mol_type = other DNA
cccttccatttcttccgagg

SEQ ID NO: 34369 - DNA, 20 bp, synthetic construct
  misc_feature 1..20: note = CRISPR gRNA sequence
  source 1..20: mol_type = other DNA
ccttccatttcttccgaggt

SEQ ID NO: 34370 - DNA, 20 bp, synthetic construct
  misc_feature 1..20: note = CRISPR gRNA sequence
  source 1..20: mol_type = other DNA
ccatttcttccgaggtcaaa

SEQ ID NO: 34371 - DNA, 20 bp, synthetic construct
  misc_feature 1..20: note = CRISPR gRNA sequence
  source 1..20: mol_type = other DNA
catttcttccgaggtcaaac

SEQ ID NO: 34372 - DNA, 20 bp, synthetic construct
  misc_feature 1..20: note = CRISPR gRNA sequence
  source 1..20: mol_type = other DNA
cttccgaggtcaaactttgt

SEQ ID NO: 34373 - DNA, 20 bp, synthetic construct
  misc_feature 1..20: note = CRISPR gRNA sequence
  source 1..20: mol_type = other DNA
ttccgaggtcaaactttgtg

SEQ ID NO: 34374 - DNA, 20 bp, synthetic construct
  misc_feature 1..20: note = CRISPR gRNA sequence
  source 1..20: mol_type = other DNA
ccgaggtcaaactttgtgaa

SEQ ID NO: 34375 - DNA, 20 bp, synthetic construct
  misc_feature 1..20: note = CRISPR gRNA sequence
  source 1..20: mol_type = other DNA
cgaggtcaaactttgtgaag

SEQ ID NO: 34376 - DNA, 20 bp, synthetic construct
  misc_feature 1..20: note = CRISPR gRNA sequence
  source 1..20: mol_type = other DNA
tgtgaagccgagctttctgt

SEQ ID NO: 34377 - DNA, 20 bp, synthetic construct
  misc_feature 1..20: note = CRISPR gRNA sequence
  source 1..20: mol_type = other DNA
gtgaagccgagctttctgtt

SEQ ID NO: 34378 - DNA, 20 bp, synthetic construct
  misc_feature 1..20: note = CRISPR gRNA sequence
  source 1..20: mol_type = other DNA
tgaagccgagctttctgttc

SEQ ID NO: 34379 - DNA, 20 bp, synthetic construct
  misc_feature 1..20: note = CRISPR gRNA sequence
  source 1..20: mol_type = other DNA
tctgttcttttgcataaggg

SEQ ID NO: 34380 - DNA, 20 bp, synthetic construct
  misc_feature 1..20: note = CRISPR gRNA sequence
  source 1..20: mol_type = other DNA
ctgttcttttgcataagggg

SEQ ID NO: 34381 - DNA, 20 bp, synthetic construct
  misc_feature 1..20: note = CRISPR gRNA sequence
  source 1..20: mol_type = other DNA
tgttcttttgcataagggga

SEQ ID NO: 34382 - DNA, 20 bp, synthetic construct
  misc_feature 1..20: note = CRISPR gRNA sequence
  source 1..20: mol_type = other DNA
ttcttttgcataaggggacc

SEQ ID NO: 34383 - DNA, 20 bp, synthetic construct
  misc_feature 1..20: note = CRISPR gRNA sequence
  source 1..20: mol_type = other DNA
ttttgcataaggggaccctg

SEQ ID NO: 34384 - DNA, 20 bp, synthetic construct
  misc_feature 1..20: note = CRISPR gRNA sequence
  source 1..20: mol_type = other DNA
ttgcataaggggaccctgca

SEQ ID NO: 34385 - DNA, 20 bp, synthetic construct
  misc_feature 1..20: note = CRISPR gRNA sequence
  source 1..20: mol_type = other DNA
tgcataaggggaccctgcag

SEQ ID NO: 34386 - DNA, 20 bp, synthetic construct
  misc_feature 1..20: note = CRISPR gRNA sequence
  source 1..20: mol_type = other DNA
gcataaggggaccctgcaga

SEQ ID NO: 34387 - DNA, 20 bp, synthetic construct
  misc_feature 1..20: note = CRISPR gRNA sequence
  source 1..20: mol_type = other DNA
cataaggggaccctgcagac

SEQ ID NO: 34388 - DNA, 20 bp, synthetic construct
  misc_feature 1..20: note = CRISPR gRNA sequence
  source 1..20: mol_type = other DNA
cagacttcataggaacaaga

SEQ ID NO: 34389 - DNA, 20 bp, synthetic construct
  misc_feature 1..20: note = CRISPR gRNA sequence
  source 1..20: mol_type = other DNA
cataggaacaagaagggccc

SEQ ID NO: 34390 - DNA, 20 bp, synthetic construct
  misc_feature 1..20: note = CRISPR gRNA sequence
  source 1..20: mol_type = other DNA
ataggaacaagaagggcccc

SEQ ID NO: 34391 - DNA, 20 bp, synthetic construct
  misc_feature 1..20: note = CRISPR gRNA sequence
  source 1..20: mol_type = other DNA
acatctgtagaaattccagc

SEQ ID NO: 34392 - DNA, 20 bp, synthetic construct
  misc_feature 1..20: note = CRISPR gRNA sequence
  source 1..20: mol_type = other DNA
tagaaattccagcactttgg

SEQ ID NO: 34393 - DNA, 20 bp, synthetic construct
  misc_feature 1..20: note = CRISPR gRNA sequence
  source 1..20: mol_type = other DNA
cagcactttgggagtccaag

SEQ ID NO: 34394 - DNA, 20 bp, synthetic construct
  misc_feature 1..20: note = CRISPR gRNA sequence
  source 1..20: mol_type = other DNA
tgggagtccaaggcaggagt

SEQ ID NO: 34395 - DNA, 20 bp, synthetic construct
  misc_feature 1..20: note = CRISPR gRNA sequence
  source 1..20: mol_type = other DNA
gggagtccaaggcaggagta

SEQ ID NO: 34396 - DNA, 20 bp, synthetic construct
  misc_feature 1..20: note = CRISPR gRNA sequence
  source 1..20: mol_type = other DNA
ggagtccaaggcaggagtat

SEQ ID NO: 34397 - DNA, 20 bp, synthetic construct
  misc_feature 1..20: note = CRISPR gRNA sequence
  source 1..20: mol_type = other DNA
agtccaggagtttgagacca

SEQ ID NO: 34398 - DNA, 20 bp, synthetic construct
  misc_feature 1..20: note = CRISPR gRNA sequence
  source 1..20: mol_type = other DNA
gagaccagcctgggcaacat

SEQ ID NO: 34399 - DNA, 20 bp, synthetic construct
  misc_feature 1..20: note = CRISPR gRNA sequence
  source 1..20: mol_type = other DNA
agaccagcctgggcaacatg

SEQ ID NO: 34400 - DNA, 20 bp, synthetic construct
  misc_feature 1..20: note = CRISPR gRNA sequence
  source 1..20: mol_type = other DNA
ggcaacatggtgaagcccta

SEQ ID NO: 34401 - DNA, 20 bp, synthetic construct
  misc_feature 1..20: note = CRISPR gRNA sequence
  source 1..20: mol_type = other DNA
tctctacaaataacacaaaa

SEQ ID NO: 34402 - DNA, 20 bp, synthetic construct
  misc_feature 1..20: note = CRISPR gRNA sequence
  source 1..20: mol_type = other DNA
tacaaataacacaaaactta

SEQ ID NO: 34403 - DNA, 20 bp, synthetic construct
  misc_feature 1..20: note = CRISPR gRNA sequence
  source 1..20: mol_type = other DNA
caaataacacaaaacttagc

SEQ ID NO: 34404 - DNA, 20 bp, synthetic construct
  misc_feature 1..20: note = CRISPR gRNA sequence
  source 1..20: mol_type = other DNA
agctgggcgtggtgatgtgc

SEQ ID NO: 34405 - DNA, 20 bp, synthetic construct
  misc_feature 1..20: note = CRISPR gRNA sequence
  source 1..20: mol_type = other DNA
gctgggcgtggtgatgtgca

SEQ ID NO: 34406 - DNA, 20 bp, synthetic construct
  misc_feature 1..20: note = CRISPR gRNA sequence
  source 1..20: mol_type = other DNA
ggcgtggtgatgtgcatctg

SEQ ID NO: 34407 - DNA, 20 bp, synthetic construct
  misc_feature 1..20: note = CRISPR gRNA sequence
  source 1..20: mol_type = other DNA
tagaaccagctactcaggag

SEQ ID NO: 34408 - DNA, 20 bp, synthetic construct
  misc_feature 1..20: note = CRISPR gRNA sequence
  source 1..20: mol_type = other DNA
ctcaggaggctgaggtggga

SEQ ID NO: 34409 - DNA, 20 bp, synthetic construct
  misc_feature 1..20: note = CRISPR gRNA sequence
  source 1..20: mol_type = other DNA
aggaggctgaggtgggagga

SEQ ID NO: 34410 - DNA, 20 bp, synthetic construct
  misc_feature 1..20: note = CRISPR gRNA sequence
  source 1..20: mol_type = other DNA
aggtgggaggatagcttgag

SEQ ID NO: 34411 - DNA, 20 bp, synthetic construct
  misc_feature 1..20: note = CRISPR gRNA sequence
  source 1..20: mol_type = other DNA
gagcctggggaggtgtcaag

SEQ ID NO: 34412 - DNA, 20 bp, synthetic construct
  misc_feature 1..20: note = CRISPR gRNA sequence
  source 1..20: mol_type = other DNA
agcctggggaggtgtcaagg

SEQ ID NO: 34413 - DNA, 20 bp, synthetic construct
  misc_feature 1..20: note = CRISPR gRNA sequence
  source 1..20: mol_type = other DNA
gggaggtgtcaaggctgcag

SEQ ID NO: 34414 - DNA, 20 bp, synthetic construct
  misc_feature 1..20: note = CRISPR gRNA sequence
  source 1..20: mol_type = other DNA
cagtgaactgagattgcacc

SEQ ID NO: 34415 - DNA, 20 bp, synthetic construct
  misc_feature 1..20: note = CRISPR gRNA sequence
  source 1..20: mol_type = other DNA
agattgcaccactgcactcc

SEQ ID NO: 34416 - DNA, 20 bp, synthetic construct
  misc_feature 1..20: note = CRISPR gRNA sequence
  source 1..20: mol_type = other DNA
caccactgcactccagcctg

SEQ ID NO: 34417 - DNA, 20 bp, synthetic construct
  misc_feature 1..20: note = CRISPR gRNA sequence
  source 1..20: mol_type = other DNA
cactccagcctgggtgatag

SEQ ID NO: 34418 - DNA, 20 bp, synthetic construct
  misc_feature 1..20: note = CRISPR gRNA sequence
  source 1..20: mol_type = other DNA
cagcctgggtgatagagcca

SEQ ID NO: 34419 - DNA, 20 bp, synthetic construct
  misc_feature 1..20: note = CRISPR gRNA sequence
  source 1..20: mol_type = other DNA
ggtgatagagccagactgtg

SEQ ID NO: 34420 - DNA, 20 bp, synthetic construct
  misc_feature 1..20: note = CRISPR gRNA sequence
  source 1..20: mol_type = other DNA
tgtctcagaaaaaaaaaaaa

SEQ ID NO: 34421 - DNA, 20 bp, synthetic construct
  misc_feature 1..20: note = CRISPR gRNA sequence
  source 1..20: mol_type = other DNA
agaaaaaaaaaaaaggcccc

SEQ ID NO: 34422 - DNA, 20 bp, synthetic construct
  misc_feature 1..20: note = CRISPR gRNA sequence
  source 1..20: mol_type = other DNA
ggatggtctggccacgctcc

SEQ ID NO: 34423 - DNA, 20 bp, synthetic construct
  misc_feature 1..20: note = CRISPR gRNA sequence
  source 1..20: mol_type = other DNA
gatggtctggccacgctccc

SEQ ID NO: 34424 - DNA, 20 bp, synthetic construct
  misc_feature 1..20: note = CRISPR gRNA sequence
  source 1..20: mol_type = other DNA
gccacgctccccatcaccac

SEQ ID NO: 34425 - DNA, 20 bp, synthetic construct
  misc_feature 1..20: note = CRISPR gRNA sequence
  source 1..20: mol_type = other DNA
cccatcaccaccactgagaa

SEQ ID NO: 34426 - DNA, 20 bp, synthetic construct
  misc_feature 1..20: note = CRISPR gRNA sequence
  source 1..20: mol_type = other DNA
agaagttgcctgggcaaaaa

SEQ ID NO: 34427 - DNA, 20 bp, synthetic construct
  misc_feature 1..20: note = CRISPR gRNA sequence
  source 1..20: mol_type = other DNA
cctgggcaaaaagtcaccag

SEQ ID NO: 34428 - DNA, 20 bp, synthetic construct
  misc_feature 1..20: note = CRISPR gRNA sequence
  source 1..20: mol_type = other DNA
ggcaaaaagtcaccagaggg

SEQ ID NO: 34429 - DNA, 20 bp, synthetic construct
  misc_feature 1..20: note = CRISPR gRNA sequence
  source 1..20: mol_type = other DNA
agatctgcgtcattggctca

SEQ ID NO: 34430 - DNA, 20 bp, synthetic construct
  misc_feature 1..20: note = CRISPR gRNA sequence
  source 1..20: mol_type = other DNA
cgtcattggctcaacctgga

SEQ ID NO: 34431 - DNA, 20 bp, synthetic construct
  misc_feature 1..20: note = CRISPR gRNA sequence
  source 1..20: mol_type = other DNA
gctcaacctggacaagaaga

SEQ ID NO: 34432 - DNA, 20 bp, synthetic construct
  misc_feature 1..20: note = CRISPR gRNA sequence
  source 1..20: mol_type = other DNA
aacctggacaagaagaaacc

SEQ ID NO: 34433 - DNA, 20 bp, synthetic construct
  misc_feature 1..20: note = CRISPR gRNA sequence
  source 1..20: mol_type = other DNA
gacaagaagaaaccccctcc

SEQ ID NO: 34434 - DNA, 20 bp, synthetic construct
  misc_feature 1..20: note = CRISPR gRNA sequence
  source 1..20: mol_type = other DNA
ccagaagcccccaatacaca

SEQ ID NO: 34435 - DNA, 20 bp, synthetic construct
  misc_feature 1..20: note = CRISPR gRNA sequence
  source 1..20: mol_type = other DNA
cagcgccccacttcctgctt

SEQ ID NO: 34436 - DNA, 20 bp, synthetic construct
  misc_feature 1..20: note = CRISPR gRNA sequence
  source 1..20: mol_type = other DNA
agcgccccacttcctgcttc

SEQ ID NO: 34437 - DNA, 20 bp, synthetic construct
  misc_feature 1..20: note = CRISPR gRNA sequence
  source 1..20: mol_type = other DNA
cctgcttccctaagactgaa

SEQ ID NO: 34438 - DNA, 20 bp, synthetic construct
  misc_feature 1..20: note = CRISPR gRNA sequence
  source 1..20: mol_type = other DNA
ctgcttccctaagactgaag

SEQ ID NO: 34439 - DNA, 20 bp, synthetic construct
  misc_feature 1..20: note = CRISPR gRNA sequence
  source 1..20: mol_type = other DNA
cttccctaagactgaagcct

SEQ ID NO: 34440 - DNA, 20 bp, synthetic construct
  misc_feature 1..20: note = CRISPR gRNA sequence
  source 1..20: mol_type = other DNA
ccctaagactgaagcctgca

SEQ ID NO: 34441 - DNA, 20 bp, synthetic construct
  misc_feature 1..20: note = CRISPR gRNA sequence
  source 1..20: mol_type = other DNA
cctaagactgaagcctgcac

SEQ ID NO: 34442 - DNA, 20 bp, synthetic construct
  misc_feature 1..20: note = CRISPR gRNA sequence
  source 1..20: mol_type = other DNA
agactgaagcctgcacctta

SEQ ID NO: 34443 - DNA, 20 bp, synthetic construct
  misc_feature 1..20: note = CRISPR gRNA sequence
  source 1..20: mol_type = other DNA
aagcctgcaccttaagcact

SEQ ID NO: 34444 - DNA, 20 bp, synthetic construct
  misc_feature 1..20: note = CRISPR gRNA sequence
  source 1..20: mol_type = other DNA
caccttaagcacttcctctt

SEQ ID NO: 34445 - DNA, 20 bp, synthetic construct
  misc_feature 1..20: note = CRISPR gRNA sequence
  source 1..20: mol_type = other DNA
aagcacttcctcttgggtga

SEQ ID NO: 34446 - DNA, 20 bp, synthetic construct
  misc_feature 1..20: note = CRISPR gRNA sequence
  source 1..20: mol_type = other DNA
agcacttcctcttgggtgat

SEQ ID NO: 34447 - DNA, 20 bp, synthetic construct
  misc_feature 1..20: note = CRISPR gRNA sequence
  source 1..20: mol_type = other DNA
cctcttgggtgatcaaggat

SEQ ID NO: 34448 - DNA, 20 bp, synthetic construct
  misc_feature 1..20: note = CRISPR gRNA sequence
  source 1..20: mol_type = other DNA
ctcttgggtgatcaaggatt

SEQ ID NO: 34449 - DNA, 20 bp, synthetic construct
  misc_feature 1..20: note = CRISPR gRNA sequence
  source 1..20: mol_type = other DNA
ttgggtgatcaaggatttgc

SEQ ID NO: 34450 - DNA, 20 bp, synthetic construct
  misc_feature 1..20: note = CRISPR gRNA sequence
  source 1..20: mol_type = other DNA
gggtgatcaaggatttgcag

SEQ ID NO: 34451 - DNA, 20 bp, synthetic construct
  misc_feature 1..20: note = CRISPR gRNA sequence
  source 1..20: mol_type = other DNA
ggtgatcaaggatttgcagc

SEQ ID NO: 34452 - DNA, 20 bp, synthetic construct
  misc_feature 1..20: note = CRISPR gRNA sequence
  source 1..20: mol_type = other DNA
gcagctcacagtggacttct

SEQ ID NO: 34453 - DNA, 20 bp, synthetic construct
  misc_feature 1..20: note = CRISPR gRNA sequence
  source 1..20: mol_type = other DNA
cagctcacagtggacttctg

SEQ ID NO: 34454 - DNA, 20 bp, synthetic construct
  misc_feature 1..20: note = CRISPR gRNA sequence
  source 1..20: mol_type = other DNA
acagtggacttctgcctcca

SEQ ID NO: 34455 - DNA, 20 bp, synthetic construct
  misc_feature 1..20: note = CRISPR gRNA sequence
  source 1..20: mol_type = other DNA
ctgcctccatcctccacacc

SEQ ID NO: 34456 - DNA, 20 bp, synthetic construct
  misc_feature 1..20: note = CRISPR gRNA sequence
  source 1..20: mol_type = other DNA
tgcctccatcctccacacca

SEQ ID NO: 34457 - DNA, 20 bp, synthetic construct
  misc_feature 1..20: note = CRISPR gRNA sequence
  source 1..20: mol_type = other DNA
cctccatcctccacaccatc

SEQ ID NO: 34458 - DNA, 20 bp, synthetic construct
  misc_feature 1..20: note = CRISPR gRNA sequence
  source 1..20: mol_type = other DNA
catcctccacaccatctgag

SEQ ID NO: 34459 - DNA, 20 bp, synthetic construct
  misc_feature 1..20: note = CRISPR gRNA sequence
  source 1..20: mol_type = other DNA
cacaccatctgagttcccaa

SEQ ID NO: 34460 - DNA, 20 bp, synthetic construct
  misc_feature 1..20: note = CRISPR gRNA sequence
  source 1..20: mol_type = other DNA
agttcccaaaaagctctggg

SEQ ID NO: 34461 - DNA, 20 bp, synthetic construct
  misc_feature 1..20: note = CRISPR gRNA sequence
  source 1..20: mol_type = other DNA
ccaaaaagctctggggaaaa

SEQ ID NO: 34462 - DNA, 20 bp, synthetic construct
  misc_feature 1..20: note = CRISPR gRNA sequence
  source 1..20: mol_type = other DNA
tggggaaaaggcagggtaga

SEQ ID NO: 34463 - DNA, 20 bp, synthetic construct
  misc_feature 1..20: note = CRISPR gRNA sequence
  source 1..20: mol_type = other DNA
gggaaaaggcagggtagagt

SEQ ID NO: 34464 - DNA, 20 bp, synthetic construct
  misc_feature 1..20: note = CRISPR gRNA sequence
  source 1..20: mol_type = other DNA
tgcccatttgagcttagagg

SEQ ID NO: 34465 - DNA, 20 bp, synthetic construct
  misc_feature 1..20: note = CRISPR gRNA sequence
  source 1..20: mol_type = other DNA
gagcttagaggaggttcaca

SEQ ID NO: 34466 - DNA, 20 bp, synthetic construct
  misc_feature 1..20: note = CRISPR gRNA sequence
  source 1..20: mol_type = other DNA
agcttagaggaggttcacac

SEQ ID NO: 34467 - DNA, 20 bp, synthetic construct
  misc_feature 1..20: note = CRISPR gRNA sequence
  source 1..20: mol_type = other DNA
agaggaggttcacacgcctc

SEQ ID NO: 34468 - DNA, 20 bp, synthetic construct
  misc_feature 1..20: note = CRISPR gRNA sequence
  source 1..20: mol_type = other DNA
gaggaggttcacacgcctca

SEQ ID NO: 34469 - DNA, 20 bp, synthetic construct
  misc_feature 1..20: note = CRISPR gRNA sequence
  source 1..20: mol_type = other DNA
acacgcctcagtgaaatggc

SEQ ID NO: 34470 - DNA, 20 bp, synthetic construct
  misc_feature 1..20: note = CRISPR gRNA sequence
  source 1..20: mol_type = other DNA
agtgaaatggcttgtccaag

SEQ ID NO: 34471 - DNA, 20 bp, synthetic construct
  misc_feature 1..20: note = CRISPR gRNA sequence
  source 1..20: mol_type = other DNA
gtccaaggtcatgtggttta

SEQ ID NO: 34472 - DNA, 20 bp, synthetic construct
  misc_feature 1..20: note = CRISPR gRNA sequence
  source 1..20: mol_type = other DNA
tccaaggtcatgtggtttag

SEQ ID NO: 34473 - DNA, 20 bp, synthetic construct
  misc_feature 1..20: note = CRISPR gRNA sequence
  source 1..20: mol_type = other DNA
aggagcttgcatctgaattc

SEQ ID NO: 34474 - DNA, 20 bp, synthetic construct
  misc_feature 1..20: note = CRISPR gRNA sequence
  source 1..20: mol_type = other DNA
ggagcttgcatctgaattct

SEQ ID NO: 34475 - DNA, 20 bp, synthetic construct
  misc_feature 1..20: note = CRISPR gRNA sequence
  source 1..20: mol_type = other DNA
gcatctgaattctggctgtg

SEQ ID NO: 34476 - DNA, 20 bp, synthetic construct
  misc_feature 1..20: note = CRISPR gRNA sequence
  source 1..20: mol_type = other DNA
catctgaattctggctgtga

SEQ ID NO: 34477 - DNA, 20 bp, synthetic construct
  misc_feature 1..20: note = CRISPR gRNA sequence
  source 1..20: mol_type = other DNA
aattctggctgtgatgcctt

SEQ ID NO: 34478 - DNA, 20 bp, synthetic construct
  misc_feature 1..20: note = CRISPR gRNA sequence
  source 1..20: mol_type = other DNA
tggctgtgatgccttagcca

SEQ ID NO: 34479 - DNA, 20 bp, synthetic construct
  misc_feature 1..20: note = CRISPR gRNA sequence
  source 1..20: mol_type = other DNA
gctgtgatgccttagccaag

SEQ ID NO: 34480 - DNA, 20 bp, synthetic construct
  misc_feature 1..20: note = CRISPR gRNA sequence
  source 1..20: mol_type = other DNA
tgatgccttagccaagtcac

SEQ ID NO: 34481 - DNA, 20 bp, synthetic construct
  misc_feature 1..20: note = CRISPR gRNA sequence
  source 1..20: mol_type = other DNA
agccaagtcacttgacctct

SEQ ID NO: 34482 - DNA, 20 bp, synthetic construct
  misc_feature 1..20: note = CRISPR gRNA sequence
  source 1..20: mol_type = other DNA
gccaagtcacttgacctctc

SEQ ID NO: 34483 - DNA, 20 bp, synthetic construct
  misc_feature 1..20: note = CRISPR gRNA sequence
  source 1..20: mol_type = other DNA
gacctctctgaacatcagtt

SEQ ID NO: 34484 - DNA, 20 bp, synthetic construct
  misc_feature 1..20: note = CRISPR gRNA sequence
  source 1..20: mol_type = other DNA
acctctctgaacatcagttt

SEQ ID NO: 34485 - DNA, 20 bp, synthetic construct
  misc_feature 1..20: note = CRISPR gRNA sequence
  source 1..20: mol_type = other DNA
tctgaacatcagttttccca

SEQ ID NO: 34486 - DNA, 20 bp, synthetic construct
  misc_feature 1..20: note = CRISPR gRNA sequence
  source 1..20: mol_type = other DNA
tgaacatcagttttcccaat

SEQ ID NO: 34487 - DNA, 20 bp, synthetic construct
  misc_feature 1..20: note = CRISPR gRNA sequence
  source 1..20: mol_type = other DNA
aacatcagttttcccaatat

SEQ ID NO: 34488 - DNA, 20 bp, synthetic construct
  misc_feature 1..20: note = CRISPR gRNA sequence
  source 1..20: mol_type = other DNA
tcccaatattagttctggag

SEQ ID NO: 34489 - DNA, 20 bp, synthetic construct
  misc_feature 1..20: note = CRISPR gRNA sequence
  source 1..20: mol_type = other DNA
cccaatattagttctggaga

SEQ ID NO: 34490 - DNA, 20 bp, synthetic construct
  misc_feature 1..20: note = CRISPR gRNA sequence
  source 1..20: mol_type = other DNA
ccaatattagttctggagaa

SEQ ID NO: 34491 - DNA, 20 bp, synthetic construct
  misc_feature 1..20: note = CRISPR gRNA sequence
  source 1..20: mol_type = other DNA
gttctggagaatgaagattg

SEQ ID NO: 34492 - DNA, 20 bp, synthetic construct
  misc_feature 1..20: note = CRISPR gRNA sequence
  source 1..20: mol_type = other DNA
tggagaatgaagattgcctt

SEQ ID NO: 34493 - DNA, 20 bp, synthetic construct
  misc_feature 1..20: note = CRISPR gRNA sequence
  source 1..20: mol_type = other DNA
gagaatgaagattgccttgc

SEQ ID NO: 34494 - DNA, 20 bp, synthetic construct
  misc_feature 1..20: note = CRISPR gRNA sequence
  source 1..20: mol_type = other DNA
ccttgcagcccaccactgtg

SEQ ID NO: 34495 - DNA, 20 bp, synthetic construct
  misc_feature 1..20: note = CRISPR gRNA sequence
  source 1..20: mol_type = other DNA
gcagcccaccactgtgggag

SEQ ID NO: 34496 - DNA, 20 bp, synthetic construct
  misc_feature 1..20: note = CRISPR gRNA sequence
  source 1..20: mol_type = other DNA
cagcccaccactgtgggagg

SEQ ID NO: 34497 - DNA, 20 bp, synthetic construct
  misc_feature 1..20: note = CRISPR gRNA sequence
  source 1..20: mol_type = other DNA
tgggaggccgaggcaggcag

SEQ ID NO: 34498 - DNA, 20 bp, synthetic construct
  misc_feature 1..20: note = CRISPR gRNA sequence
  source 1..20: mol_type = other DNA
gaggtcaggagtttgagacc

SEQ ID NO: 34499 - DNA, 20 bp, synthetic construct
  misc_feature 1..20: note = CRISPR gRNA sequence
  source 1..20: mol_type = other DNA
aggtcaggagtttgagacca

SEQ ID NO: 34500 - DNA, 20 bp, synthetic construct
  misc_feature 1..20: note = CRISPR gRNA sequence
  source 1..20: mol_type = other DNA
gagaccagcccgggcaacat

SEQ ID NO: 34501 - DNA, 20 bp, synthetic construct
  misc_feature 1..20: note = CRISPR gRNA sequence
  source 1..20: mol_type = other DNA
agaccagcccgggcaacatg

SEQ ID NO: 34502 - DNA, 20 bp, synthetic construct
  misc_feature 1..20: note = CRISPR gRNA sequence
  source 1..20: mol_type = other DNA
tactaaaaatacaaaattag

SEQ ID NO: 34503 - DNA, 20 bp, synthetic construct
  misc_feature 1..20: note = CRISPR gRNA sequence
  source 1..20: mol_type = other DNA
ctaaaaatacaaaattagcc

SEQ ID NO: 34504 - DNA, 20 bp, synthetic construct
  misc_feature 1..20: note = CRISPR gRNA sequence
  source 1..20: mol_type = other DNA
aaaatacaaaattagccagg

SEQ ID NO: 34505 - DNA, 20 bp, synthetic construct
  misc_feature 1..20: note = CRISPR gRNA sequence
  source 1..20: mol_type = other DNA
gccaggcatggtggcgtgct

SEQ ID NO: 34506 - DNA, 20 bp, synthetic construct
  misc_feature 1..20: note = CRISPR gRNA sequence
  source 1..20: mol_type = other DNA
ctgtaatcccagctacttgg

SEQ ID NO: 34507 - DNA, 20 bp, synthetic construct
  misc_feature 1..20: note = CRISPR gRNA sequence
  source 1..20: mol_type = other DNA
tgtaatcccagctacttggg

SEQ ID NO: 34508 - DNA, 20 bp, synthetic construct
  misc_feature 1..20: note = CRISPR gRNA sequence
  source 1..20: mol_type = other DNA
taatcccagctacttgggag

SEQ ID NO: 34509 - DNA, 20 bp, synthetic construct
  misc_feature 1..20: note = CRISPR gRNA sequence
  source 1..20: mol_type = other DNA
cttgggaggctgaggcagga

SEQ ID NO: 34510 - DNA, 20 bp, synthetic construct
  misc_feature 1..20: note = CRISPR gRNA sequence
  source 1..20: mol_type = other DNA
gggaggctgaggcaggagaa

SEQ ID NO: 34511 - DNA, 20 bp, synthetic construct
  misc_feature 1..20: note = CRISPR gRNA sequence
  source 1..20: mol_type = other DNA
ggaggctgaggcaggagaat

SEQ ID NO: 34512 - DNA, 20 bp, synthetic construct
  misc_feature 1..20: note = CRISPR gRNA sequence
  source 1..20: mol_type = other DNA
aggcaggagaatcgcttgaa

SEQ ID NO: 34513 - DNA, 20 bp, synthetic construct
  misc_feature 1..20: note = CRISPR gRNA sequence
  source 1..20: mol_type = other DNA
gaacctgggaggcagaggct

SEQ ID NO: 34514 - DNA, 20 bp, synthetic construct
  misc_feature 1..20: note = CRISPR gRNA sequence
  source 1..20: mol_type = other DNA
aacctgggaggcagaggctg

SEQ ID NO: 34515 - DNA, 20 bp, synthetic construct
  misc_feature 1..20: note = CRISPR gRNA sequence
  source 1..20: mol_type = other DNA
ggaggcagaggctgcagtga

SEQ ID NO: 34516 - DNA, 20 bp, synthetic construct
  misc_feature 1..20: note = CRISPR gRNA sequence
  source 1..20: mol_type = other DNA
cagtgaaccaagactgcgcc

SEQ ID NO: 34517 - DNA, 20 bp, synthetic construct
  misc_feature 1..20: note = CRISPR gRNA sequence
  source 1..20: mol_type = other DNA
cgccactgcactccagcctg

SEQ ID NO: 34518 - DNA, 20 bp, synthetic construct
  misc_feature 1..20: note = CRISPR gRNA sequence
  source 1..20: mol_type = other DNA
cactccagcctgggcgacaa

SEQ ID NO: 34519 - DNA, 20 bp, synthetic construct
  misc_feature 1..20: note = CRISPR gRNA sequence
  source 1..20: mol_type = other DNA
cagcctgggcgacaaagtga

SEQ ID NO: 34520 - DNA, 20 bp, synthetic construct
  misc_feature 1..20: note = CRISPR gRNA sequence
  source 1..20: mol_type = other DNA
ggcgacaaagtgagatacca

SEQ ID NO: 34521 - DNA, 20 bp, synthetic construct
  misc_feature 1..20: note = CRISPR gRNA sequence
  source 1..20: mol_type = other DNA
aaaaaaaaaacaaaaaacaa

SEQ ID NO: 34522 - DNA, 20 bp, synthetic construct
  misc_feature 1..20: note = CRISPR gRNA sequence
  source 1..20: mol_type = other DNA
tcctgcaggatcatcagaag

SEQ ID NO: 34523 - DNA, 20 bp, synthetic construct
  misc_feature 1..20: note = CRISPR gRNA sequence
  source 1..20: mol_type = other DNA
caggatcatcagaaggccaa

SEQ ID NO: 34524 - DNA, 20 bp, synthetic construct
  misc_feature 1..20: note = CRISPR gRNA sequence
  source 1..20: mol_type = other DNA
tgtgtggggtgccagctatg

SEQ ID NO: 34525 - DNA, 20 bp, synthetic construct
  misc_feature 1..20: note = CRISPR gRNA sequence
  source 1..20: mol_type = other DNA
tgtggggtgccagctatgtg

SEQ ID NO: 34526 - DNA, 20 bp, synthetic construct
  misc_feature 1..20: note = CRISPR gRNA sequence
  source 1..20: mol_type = other DNA
tgtgggaagcctacagtcaa

SEQ ID NO: 34527 - DNA, 20 bp, synthetic construct
  misc_feature 1..20: note = CRISPR gRNA sequence
  source 1..20: mol_type = other DNA
cagtcaaaggaagcccatta

SEQ ID NO: 34528 - DNA, 20 bp, synthetic construct
  misc_feature 1..20: note = CRISPR gRNA sequence
  source 1..20: mol_type = other DNA
cattagagggtgtcaaagct

SEQ ID NO: 34529 - DNA, 20 bp, synthetic construct
  misc_feature 1..20: note = CRISPR gRNA sequence
  source 1..20: mol_type = other DNA
gagggtgtcaaagctgaaat

SEQ ID NO: 34530 - DNA, 20 bp, synthetic construct
  misc_feature 1..20: note = CRISPR gRNA sequence
  source 1..20: mol_type = other DNA
aaattcaggcccaagactct

SEQ ID NO: 34531 - DNA, 20 bp, synthetic construct
  misc_feature 1..20: note = CRISPR gRNA sequence
  source 1..20: mol_type = other DNA
aggcccaagactctaggttt

SEQ ID NO: 34532 - DNA, 20 bp, synthetic construct
  misc_feature 1..20: note = CRISPR gRNA sequence
  source 1..20: mol_type = other DNA
taggtttccccacaacgcca

SEQ ID NO: 34533 - DNA, 20 bp, synthetic construct
  misc_feature 1..20: note = CRISPR gRNA sequence
  source 1..20: mol_type = other DNA
ggtttccccacaacgccaca

SEQ ID NO: 34534 - DNA, 20 bp, synthetic construct
  misc_feature 1..20: note = CRISPR gRNA sequence
  source 1..20: mol_type = other DNA
ccccacaacgccacagctgc

SEQ ID NO: 34535 - DNA, 20 bp, synthetic construct
  misc_feature 1..20: note = CRISPR gRNA sequence
  source 1..20: mol_type = other DNA
cccacaacgccacagctgcc

SEQ ID NO: 34536 - DNA, 20 bp, synthetic construct
  misc_feature 1..20: note = CRISPR gRNA sequence
  source 1..20: mol_type = other DNA
cctcccagtcacaccaagat

SEQ ID NO: 34537 - DNA, 20 bp, synthetic construct
  misc_feature 1..20: note = CRISPR gRNA sequence
  source 1..20: mol_type = other DNA
ccagtcacaccaagatctac

SEQ ID NO: 34538 - DNA, 20 bp, synthetic construct
  misc_feature 1..20: note = CRISPR gRNA sequence
  source 1..20: mol_type = other DNA
cttgaatcttggcatgggac

SEQ ID NO: 34539 - DNA, 20 bp, synthetic construct
  misc_feature 1..20: note = CRISPR gRNA sequence
  source 1..20: mol_type = other DNA
gaatcttggcatgggacctt

SEQ ID NO: 34540 - DNA, 20 bp, synthetic construct
  misc_feature 1..20: note = CRISPR gRNA sequence
  source 1..20: mol_type = other DNA
aatcttggcatgggaccttc

SEQ ID NO: 34541 - DNA, 20 bp, synthetic construct
  misc_feature 1..20: note = CRISPR gRNA sequence
  source 1..20: mol_type = other DNA
ggcatgggaccttcctctat

SEQ ID NO: 34542 - DNA, 20 bp, synthetic construct
  misc_feature 1..20: note = CRISPR gRNA sequence
  source 1..20: mol_type = other DNA
gcatgggaccttcctctatc

SEQ ID NO: 34543 - DNA, 20 bp, synthetic construct
  misc_feature 1..20: note = CRISPR gRNA sequence
  source 1..20: mol_type = other DNA
cctctatccccagagccaag

SEQ ID NO: 34544 - DNA, 20 bp, synthetic construct
  misc_feature 1..20: note = CRISPR gRNA sequence
  source 1..20: mol_type = other DNA
ctctatccccagagccaagt

SEQ ID NO: 34545 - DNA, 20 bp, synthetic construct
  misc_feature 1..20: note = CRISPR gRNA sequence
  source 1..20: mol_type = other DNA
tatccccagagccaagtttc

SEQ ID NO: 34546 - DNA, 20 bp, synthetic construct
  misc_feature 1..20: note = CRISPR gRNA sequence
  source 1..20: mol_type = other DNA
tccccagagccaagtttcct

SEQ ID NO: 34547 - DNA, 20 bp, synthetic construct
  misc_feature 1..20: note = CRISPR gRNA sequence
  source 1..20: mol_type = other DNA
cctatgtctatagatgctta

SEQ ID NO: 34548 - DNA, 20 bp, synthetic construct
  misc_feature 1..20: note = CRISPR gRNA sequence
  source 1..20: mol_type = other DNA
ctatgtctatagatgcttag

SEQ ID NO: 34549 - DNA, 20 bp, synthetic construct
  misc_feature 1..20: note = CRISPR gRNA sequence
  source 1..20: mol_type = other DNA
tgtctatagatgcttaggaa

SEQ ID NO: 34550 - DNA, 20 bp, synthetic construct
  misc_feature 1..20: note = CRISPR gRNA sequence
  source 1..20: mol_type = other DNA
tagatgcttaggaagtgctt

SEQ ID NO: 34551 - DNA, 20 bp, synthetic construct
  misc_feature 1..20: note = CRISPR gRNA sequence
  source 1..20: mol_type = other DNA
aggaagtgcttcaaaggccc

SEQ ID NO: 34552 - DNA, 20 bp, synthetic construct
  misc_feature 1..20: note = CRISPR gRNA sequence
  source 1..20: mol_type = other DNA
ggaagtgcttcaaaggcccc

SEQ ID NO: 34553 - DNA, 20 bp, synthetic construct
  misc_feature 1..20: note = CRISPR gRNA sequence
  source 1..20: mol_type = other DNA
caaaggccccttcattggac

SEQ ID NO: 34554 - DNA, 20 bp, synthetic construct
  misc_feature 1..20: note = CRISPR gRNA sequence
  source 1..20: mol_type = other DNA
aaaggccccttcattggact

SEQ ID NO: 34555 - DNA, 20 bp, synthetic construct
  misc_feature 1..20: note = CRISPR gRNA sequence
  source 1..20: mol_type = other DNA
cattggactgtttctccaaa

SEQ ID NO: 34556 - DNA, 20 bp, synthetic construct
  misc_feature 1..20: note = CRISPR gRNA sequence
  source 1..20: mol_type = other DNA
attggactgtttctccaaac

SEQ ID NO: 34557 - DNA, 20 bp, synthetic construct
  misc_feature 1..20: note = CRISPR gRNA sequence
  source 1..20: mol_type = other DNA
gactgtttctccaaaccaca

SEQ ID NO: 34558 - DNA, 20 bp, synthetic construct
  misc_feature 1..20: note = CRISPR gRNA sequence
  source 1..20: mol_type = other DNA
tttctccaaaccacattgcc

SEQ ID NO: 34559 - DNA, 20 bp, synthetic construct
  misc_feature 1..20: note = CRISPR gRNA sequence
  source 1..20: mol_type = other DNA
ctccaaaccacattgccaga

SEQ ID NO: 34560 - DNA, 20 bp, synthetic construct
  misc_feature 1..20: note = CRISPR gRNA sequence
  source 1..20: mol_type = other DNA
tccaaaccacattgccagag

SEQ ID NO: 34561 - DNA, 20 bp, synthetic construct
  misc_feature 1..20: note = CRISPR gRNA sequence
  source 1..20: mol_type = other DNA
caaaccacattgccagagcg

SEQ ID NO: 34562 - DNA, 20 bp, synthetic construct
  misc_feature 1..20: note = CRISPR gRNA sequence
  source 1..20: mol_type = other DNA
ccagagcgggatggagggaa

SEQ ID NO: 34563 - DNA, 20 bp, synthetic construct
  misc_feature 1..20: note = CRISPR gRNA sequence
  source 1..20: mol_type = other DNA
atcatcccgtggcaggagag

SEQ ID NO: 34564 - DNA, 20 bp, synthetic construct
  misc_feature 1..20: note = CRISPR gRNA sequence
  source 1..20: mol_type = other DNA
cagctctccctgagggcagg

SEQ ID NO: 34565 - DNA, 20 bp, synthetic construct
  misc_feature 1..20: note = CRISPR gRNA sequence
  source 1..20: mol_type = other DNA
agctctccctgagggcaggg

SEQ ID NO: 34566 - DNA, 20 bp, synthetic construct
  misc_feature 1..20: note = CRISPR gRNA sequence
  source 1..20: mol_type = other DNA
tccctgagggcagggactgt

SEQ ID NO: 34567 - DNA, 20 bp, synthetic construct
  misc_feature 1..20: note = CRISPR gRNA sequence
  source 1..20: mol_type = other DNA
cctgagggcagggactgtat

SEQ ID NO: 34568 - DNA, 20 bp, synthetic construct
  misc_feature 1..20: note = CRISPR gRNA sequence
  source 1..20: mol_type = other DNA
agggcagggactgtatccct

SEQ ID NO: 34569 - DNA, 20 bp, synthetic construct
  misc_feature 1..20: note = CRISPR gRNA sequence
  source 1..20: mol_type = other DNA
tatccctctagctcaccttc

SEQ ID NO: 34570 - DNA, 20 bp, synthetic construct
  misc_feature 1..20: note = CRISPR gRNA sequence
  source 1..20: mol_type = other DNA
tagctcaccttctcccagct

SEQ ID NO: 34571 - DNA, 20 bp, synthetic construct
  misc_feature 1..20: note = CRISPR gRNA sequence
  source 1..20: mol_type = other DNA
gctcaccttctcccagctct

SEQ ID NO: 34572 - DNA, 20 bp, synthetic construct
  misc_feature 1..20: note = CRISPR gRNA sequence
  source 1..20: mol_type = other DNA
accttctcccagctctcagc

SEQ ID NO: 34573 - DNA, 20 bp, synthetic construct
  misc_feature 1..20: note = CRISPR gRNA sequence
  source 1..20: mol_type = other DNA
ctcccagctctcagcatgtt

SEQ ID NO: 34574 - DNA, 20 bp, synthetic construct
  misc_feature 1..20: note = CRISPR gRNA sequence
  source 1..20: mol_type = other DNA
tcccagctctcagcatgttt

SEQ ID NO: 34575 - DNA, 20 bp, synthetic construct
  misc_feature 1..20: note = CRISPR gRNA sequence
  source 1..20: mol_type = other DNA
ccagctctcagcatgtttct

SEQ ID NO: 34576 - DNA, 20 bp, synthetic construct
  misc_feature 1..20: note = CRISPR gRNA sequence
  source 1..20: mol_type = other DNA
tcagcatgtttctgcgcatg

SEQ ID NO: 34577 - DNA, 20 bp, synthetic construct
  misc_feature 1..20: note = CRISPR gRNA sequence
  source 1..20: mol_type = other DNA
agcatgtttctgcgcatggc

SEQ ID NO: 34578 - DNA, 20 bp, synthetic construct
  misc_feature 1..20: note = CRISPR gRNA sequence
  source 1..20: mol_type = other DNA
ctgcgcatggcagcctctct

SEQ ID NO: 34579 - DNA, 20 bp, synthetic construct
  misc_feature 1..20: note = CRISPR gRNA sequence
  source 1..20: mol_type = other DNA
tgcgcatggcagcctctctt

SEQ ID NO: 34580 - DNA, 20 bp, synthetic construct
  misc_feature 1..20: note = CRISPR gRNA sequence
  source 1..20: mol_type = other DNA
cgcatggcagcctctcttca

SEQ ID NO: 34581 - DNA, 20 bp, synthetic construct
  misc_feature 1..20: note = CRISPR gRNA sequence
  source 1..20: mol_type = other DNA
tcttcatccgtggcaatgat

SEQ ID NO: 34582 - DNA, 20 bp, synthetic construct
  misc_feature 1..20: note = CRISPR gRNA sequence
  source 1..20: mol_type = other DNA
ttcatccgtggcaatgatat

SEQ ID NO: 34583 - DNA, 20 bp, synthetic construct
  misc_feature 1..20: note = CRISPR gRNA sequence
  source 1..20: mol_type = other DNA
catccgtggcaatgatatag

SEQ ID NO: 34584 - DNA, 20 bp, synthetic construct
  misc_feature 1..20: note = CRISPR gRNA sequence
  source 1..20: mol_type = other DNA
atccgtggcaatgatataga

SEQ ID NO: 34585 - DNA, 20 bp, synthetic construct
  misc_feature 1..20: note = CRISPR gRNA sequence
  source 1..20: mol_type = other DNA
gaattcacagtgtccagcaa

SEQ ID NO: 34586 - DNA, 20 bp, synthetic construct
  misc_feature 1..20: note = CRISPR gRNA sequence
  source 1..20: mol_type = other DNA
acagtgtccagcaagtgcca

SEQ ID NO: 34587 - DNA, 20 bp, synthetic construct
  misc_feature 1..20: note = CRISPR gRNA sequence
  source 1..20: mol_type = other DNA
gtaggcattaccccatttgg

SEQ ID NO: 34588 - DNA, 20 bp, synthetic construct
  misc_feature 1..20: note = CRISPR gRNA sequence
  source 1..20: mol_type = other DNA
ccccatttggtctaacttac

SEQ ID NO: 34589 - DNA, 20 bp, synthetic construct
  misc_feature 1..20: note = CRISPR gRNA sequence
  source 1..20: mol_type = other DNA
ggtctaacttacacatcagc

SEQ ID NO: 34590 - DNA, 20 bp, synthetic construct
  misc_feature 1..20: note = CRISPR gRNA sequence
  source 1..20: mol_type = other DNA
gtctaacttacacatcagct

SEQ ID NO: 34591 - DNA, 20 bp, synthetic construct
  misc_feature 1..20: note = CRISPR gRNA sequence
  source 1..20: mol_type = other DNA
acttacacatcagctatttg

SEQ ID NO: 34592 - DNA, 20 bp, synthetic construct
  misc_feature 1..20: note = CRISPR gRNA sequence
  source 1..20: mol_type = other DNA
acacatcagctatttgtatt

SEQ ID NO: 34593 - DNA, 20 bp, synthetic construct
  misc_feature 1..20: note = CRISPR gRNA sequence
  source 1..20: mol_type = other DNA
cacatcagctatttgtattc

SEQ ID NO: 34594 - DNA, 20 bp, synthetic construct
  misc_feature 1..20: note = CRISPR gRNA sequence
  source 1..20: mol_type = other DNA
tttgtattcctgtttttcag

SEQ ID NO: 34595 - DNA, 20 bp, synthetic construct
  misc_feature 1..20: note = CRISPR gRNA sequence
  source 1..20: mol_type = other DNA
gtattcctgtttttcagatg

SEQ ID NO: 34596 - DNA, 20 bp, synthetic construct
  misc_feature 1..20: note = CRISPR gRNA sequence
  source 1..20: mol_type = other DNA
tattcctgtttttcagatga

SEQ ID NO: 34597 - DNA, 20 bp, synthetic construct
  misc_feature 1..20: note = CRISPR gRNA sequence
  source 1..20: mol_type = other DNA
ctgtttttcagatgaagaga

SEQ ID NO: 34598 - DNA, 20 bp, synthetic construct
  misc_feature 1..20: note = CRISPR gRNA sequence
  source 1..20: mol_type = other DNA
tttttcagatgaagagacag

SEQ ID NO: 34599 - DNA, 20 bp, synthetic construct
  misc_feature 1..20: note = CRISPR gRNA sequence
  source 1..20: mol_type = other DNA
ttcagatgaagagacaggct

SEQ ID NO: 34600 - DNA, 20 bp, synthetic construct
  misc_feature 1..20: note = CRISPR gRNA sequence
  source 1..20: mol_type = other DNA
tcagatgaagagacaggctc

SEQ ID NO: 34601 - DNA, 20 bp, synthetic construct
  misc_feature 1..20: note = CRISPR gRNA sequence
  source 1..20: mol_type = other DNA
cagatgaagagacaggctca

SEQ ID NO: 34602 - DNA, 20 bp, synthetic construct
  misc_feature 1..20: note = CRISPR gRNA sequence
  source 1..20: mol_type = other DNA
agatgaagagacaggctcag

SEQ ID NO: 34603 - DNA, 20 bp, synthetic construct
  misc_feature 1..20: note = CRISPR gRNA sequence
  source 1..20: mol_type = other DNA
agagggattagtgggctgag

SEQ ID NO: 34604 - DNA, 20 bp, synthetic construct
  misc_feature 1..20: note = CRISPR gRNA sequence
  source 1..20: mol_type = other DNA
gtgggctgagatttgaacca

SEQ ID NO: 34605 - DNA, 20 bp, synthetic construct
  misc_feature 1..20: note = CRISPR gRNA sequence
  source 1..20: mol_type = other DNA
agatttgaaccaaactaccc

SEQ ID NO: 34606 - DNA, 20 bp, synthetic construct
  misc_feature 1..20: note = CRISPR gRNA sequence
  source 1..20: mol_type = other DNA
gaaccaaactacccatctcc

SEQ ID NO: 34607 - DNA, 20 bp, synthetic construct
  misc_feature 1..20: note = CRISPR gRNA sequence
  source 1..20: mol_type = other DNA
aaccaaactacccatctcca

SEQ ID NO: 34608 - DNA, 20 bp, synthetic construct
  misc_feature 1..20: note = CRISPR gRNA sequence
  source 1..20: mol_type = other DNA
cccatctccaaagtctcagc

SEQ ID NO: 34609 - DNA, 20 bp, synthetic construct
  misc_feature 1..20: note = CRISPR gRNA sequence
  source 1..20: mol_type = other DNA
caaagtctcagcccactcta

SEQ ID NO: 34610 - DNA, 20 bp, synthetic construct
  misc_feature 1..20: note = CRISPR gRNA sequence
  source 1..20: mol_type = other DNA
agcccactctatagcctttt

SEQ ID NO: 34611 - DNA, 20 bp, synthetic construct
  misc_feature 1..20: note = CRISPR gRNA sequence
  source 1..20: mol_type = other DNA
tatagcctttttgaattgct

SEQ ID NO: 34612 - DNA, 20 bp, synthetic construct
  misc_feature 1..20: note = CRISPR gRNA sequence
  source 1..20: mol_type = other DNA
tagcctttttgaattgctgt

SEQ ID NO: 34613 - DNA, 20 bp, synthetic construct
  misc_feature 1..20: note = CRISPR gRNA sequence
  source 1..20: mol_type = other DNA
tttgaattgctgttggcccc

SEQ ID NO: 34614 - DNA, 20 bp, synthetic construct
  misc_feature 1..20: note = CRISPR gRNA sequence
  source 1..20: mol_type = other DNA
ttgaattgctgttggccccc

SEQ ID NO: 34615 - DNA, 20 bp, synthetic construct
  misc_feature 1..20: note = CRISPR gRNA sequence
  source 1..20: mol_type = other DNA
tgaattgctgttggcccccc

SEQ ID NO: 34616 - DNA, 20 bp, synthetic construct
  misc_feature 1..20: note = CRISPR gRNA sequence
  source 1..20: mol_type = other DNA
gaattgctgttggcccccca

SEQ ID NO: 34617 - DNA, 20 bp, synthetic construct
  misc_feature 1..20: note = CRISPR gRNA sequence
  source 1..20: mol_type = other DNA
aattgctgttggccccccag

SEQ ID NO: 34618 - DNA, 20 bp, synthetic construct
  misc_feature 1..20: note = CRISPR gRNA sequence
  source 1..20: mol_type = other DNA
ctgttggccccccagcaccc

SEQ ID NO: 34619 - DNA, 20 bp, synthetic construct
  misc_feature 1..20: note = CRISPR gRNA sequence
  source 1..20: mol_type = other DNA
ttggccccccagcaccccgg

SEQ ID NO: 34620 - DNA, 20 bp, synthetic construct
  misc_feature 1..20: note = CRISPR gRNA sequence
  source 1..20: mol_type = other DNA
gccccccagcaccccggcga

SEQ ID NO: 34621 - DNA, 20 bp, synthetic construct
  misc_feature 1..20: note = CRISPR gRNA sequence
  source 1..20: mol_type = other DNA
ctccttttgaggagccatgt

SEQ ID NO: 34622 - DNA, 20 bp, synthetic construct
  misc_feature 1..20: note = CRISPR gRNA sequence
  source 1..20: mol_type = other DNA
tccttttgaggagccatgtg

SEQ ID NO: 34623 - DNA, 20 bp, synthetic construct
  misc_feature 1..20: note = CRISPR gRNA sequence
  source 1..20: mol_type = other DNA
cttttgaggagccatgtggg

SEQ ID NO: 34624 - DNA, 20 bp, synthetic construct
  misc_feature 1..20: note = CRISPR gRNA sequence
  source 1..20: mol_type = other DNA
ttgaggagccatgtgggggc

SEQ ID NO: 34625 - DNA, 20 bp, synthetic construct
  misc_feature 1..20: note = CRISPR gRNA sequence
  source 1..20: mol_type = other DNA
tgaggagccatgtgggggca

SEQ ID NO: 34626 - DNA, 20 bp, synthetic construct
  misc_feature 1..20: note = CRISPR gRNA sequence
  source 1..20: mol_type = other DNA
gaggagccatgtgggggcag

SEQ ID NO: 34627 - DNA, 20 bp, synthetic construct
  misc_feature 1..20: note = CRISPR gRNA sequence
  source 1..20: mol_type = other DNA
aggagccatgtgggggcagg

SEQ ID NO: 34628 - DNA, 20 bp, synthetic construct
  misc_feature 1..20: note = CRISPR gRNA sequence
  source 1..20: mol_type = other DNA
tgtctttttggtaaatgggc

SEQ ID NO: 34629 - DNA, 20 bp, synthetic construct
  misc_feature 1..20: note = CRISPR gRNA sequence
  source 1..20: mol_type = other DNA
tttggtaaatgggcagtatt

SEQ ID NO: 34630 - DNA, 20 bp, synthetic construct
  misc_feature 1..20: note = CRISPR gRNA sequence
  source 1..20: mol_type = other DNA
ttggtaaatgggcagtattt

SEQ ID NO: 34631 - DNA, 20 bp, synthetic construct
  misc_feature 1..20: note = CRISPR gRNA sequence
  source 1..20: mol_type = other DNA
tggtaaatgggcagtatttt

SEQ ID NO: 34632 - DNA, 20 bp, synthetic construct
  misc_feature 1..20: note = CRISPR gRNA sequence
  source 1..20: mol_type = other DNA
ggtaaatgggcagtattttt

SEQ ID NO: 34633 - DNA, 20 bp, synthetic construct
  misc_feature 1..20: note = CRISPR gRNA sequence
  source 1..20: mol_type = other DNA
gtaaatgggcagtattttta

SEQ ID NO: 34634 - DNA, 20 bp, synthetic construct
  misc_feature 1..20: note = CRISPR gRNA sequence
  source 1..20: mol_type = other DNA
ttagaaggtcctctttgaaa

SEQ ID NO: 34635 - DNA, 20 bp, synthetic construct
  misc_feature 1..20: note = CRISPR gRNA sequence
  source 1..20: mol_type = other DNA
tagaaggtcctctttgaaac

SEQ ID NO: 34636 - DNA, 20 bp, synthetic construct
  misc_feature 1..20: note = CRISPR gRNA sequence
  source 1..20: mol_type = other DNA
agaaggtcctctttgaaact

SEQ ID NO: 34637 - DNA, 20 bp, synthetic construct
  misc_feature 1..20: note = CRISPR gRNA sequence
  source 1..20: mol_type = other DNA
gaaggtcctctttgaaactg

SEQ ID NO: 34638 - DNA, 20 bp, synthetic construct
  misc_feature 1..20: note = CRISPR gRNA sequence
  source 1..20: mol_type = other DNA
tttgaaactgtgcttccccc

SEQ ID NO: 34639 - DNA, 20 bp, synthetic construct
  misc_feature 1..20: note = CRISPR gRNA sequence
  source 1..20: mol_type = other DNA
tgaaactgtgcttccccctg

SEQ ID NO: 34640 - DNA, 20 bp, synthetic construct
  misc_feature 1..20: note = CRISPR gRNA sequence
  source 1..20: mol_type = other DNA
gaaactgtgcttccccctgg

SEQ ID NO: 34641 - DNA, 20 bp, synthetic construct
  misc_feature 1..20: note = CRISPR gRNA sequence
  source 1..20: mol_type = other DNA
aaactgtgcttccccctggg

SEQ ID NO: 34642 - DNA, 20 bp, synthetic construct
  misc_feature 1..20: note = CRISPR gRNA sequence
  source 1..20: mol_type = other DNA
tgcttccccctgggccacca

SEQ ID NO: 34643 - DNA, 20 bp, synthetic construct
  misc_feature 1..20: note = CRISPR gRNA sequence
  source 1..20: mol_type = other DNA
ccccctgggccaccaccttc

SEQ ID NO: 34644 - DNA, 20 bp, synthetic construct
  misc_feature 1..20: note = CRISPR gRNA sequence
  source 1..20: mol_type = other DNA
cccctgggccaccaccttcc

SEQ ID NO: 34645 - DNA, 20 bp, synthetic construct
  misc_feature 1..20: note = CRISPR gRNA sequence
  source 1..20: mol_type = other DNA
ggccaccaccttccacatcc

SEQ ID NO: 34646 - DNA, 20 bp, synthetic construct
  misc_feature 1..20: note = CRISPR gRNA sequence
  source 1..20: mol_type = other DNA
ccacatccaactcgagaaaa

SEQ ID NO: 34647 - DNA, 20 bp, synthetic construct
  misc_feature 1..20: note = CRISPR gRNA sequence
  source 1..20: mol_type = other DNA
cacatccaactcgagaaaat

SEQ ID NO: 34648 - DNA, 20 bp, synthetic construct
  misc_feature 1..20: note = CRISPR gRNA sequence
  source 1..20: mol_type = other DNA
gagaaaatattcctgatctt

SEQ ID NO: 34649 - DNA, 20 bp, synthetic construct
  misc_feature 1..20: note = CRISPR gRNA sequence
  source 1..20: mol_type = other DNA
ctgatctttttgccatcaaa

SEQ ID NO: 34650 - DNA, 20 bp, synthetic construct
  misc_feature 1..20: note = CRISPR gRNA sequence
  source 1..20: mol_type = other DNA
atctttttgccatcaaaagt

SEQ ID NO: 34651 - DNA, 20 bp, synthetic construct
  misc_feature 1..20: note = CRISPR gRNA sequence
  source 1..20: mol_type = other DNA
tttgccatcaaaagtccttt

SEQ ID NO: 34652 - DNA, 20 bp, synthetic construct
  misc_feature 1..20: note = CRISPR gRNA sequence
  source 1..20: mol_type = other DNA
ttgccatcaaaagtcctttt

SEQ ID NO: 34653 - DNA, 20 bp, synthetic construct
  misc_feature 1..20: note = CRISPR gRNA sequence
  source 1..20: mol_type = other DNA
tgccatcaaaagtccttttt

SEQ ID NO: 34654 - DNA, 20 bp, synthetic construct
  misc_feature 1..20: note = CRISPR gRNA sequence
  source 1..20: mol_type = other DNA
gccatcaaaagtcctttttg

SEQ ID NO: 34655 - DNA, 20 bp, synthetic construct
  misc_feature 1..20: note = CRISPR gRNA sequence
  source 1..20: mol_type = other DNA
ccatcaaaagtcctttttgg

SEQ ID NO: 34656 - DNA, 20 bp, synthetic construct
  misc_feature 1..20: note = CRISPR gRNA sequence
  source 1..20: mol_type = other DNA
tttggggtttattttcatcc

SEQ ID NO: 34657 - DNA, 20 bp, synthetic construct
  misc_feature 1..20: note = CRISPR gRNA sequence
  source 1..20: mol_type = other DNA
ttggggtttattttcatccc

SEQ ID NO: 34658 - DNA, 20 bp, synthetic construct
  misc_feature 1..20: note = CRISPR gRNA sequence
  source 1..20: mol_type = other DNA
tggggtttattttcatcccc

SEQ ID NO: 34659 - DNA, 20 bp, synthetic construct
  misc_feature 1..20: note = CRISPR gRNA sequence
  source 1..20: mol_type = other DNA
ggggtttattttcatcccca

SEQ ID NO: 34660 - DNA, 20 bp, synthetic construct
  misc_feature 1..20: note = CRISPR gRNA sequence
  source 1..20: mol_type = other DNA
gggtttattttcatccccac

SEQ ID NO: 34661 - DNA, 20 bp, synthetic construct
  misc_feature 1..20: note = CRISPR gRNA sequence
  source 1..20: mol_type = other DNA
attttcatccccacttcaca

SEQ ID NO: 34662 - DNA, 20 bp, synthetic construct
  misc_feature 1..20: note = CRISPR gRNA sequence
  source 1..20: mol_type = other DNA
ttttcatccccacttcacac

SEQ ID NO: 34663 - DNA, 20 bp, synthetic construct
  misc_feature 1..20: note = CRISPR gRNA sequence
  source 1..20: mol_type = other DNA
tcatccccacttcacactgc

SEQ ID NO: 34664 - DNA, 20 bp, synthetic construct
  misc_feature 1..20: note = CRISPR gRNA sequence
  source 1..20: mol_type = other DNA
catccccacttcacactgca

SEQ ID NO: 34665 - DNA, 20 bp, synthetic construct
  misc_feature 1..20: note = CRISPR gRNA sequence
  source 1..20: mol_type = other DNA
atccccacttcacactgcat

SEQ ID NO: 34666 - DNA, 20 bp, synthetic construct
  misc_feature 1..20: note = CRISPR gRNA sequence
  source 1..20: mol_type = other DNA
cacactgcatgcaggatttg

SEQ ID NO: 34667 - DNA, 20 bp, synthetic construct
  misc_feature 1..20: note = CRISPR gRNA sequence
  source 1..20: mol_type = other DNA
acactgcatgcaggatttga

SEQ ID NO: 34668 - DNA, 20 bp, synthetic construct
  misc_feature 1..20: note = CRISPR gRNA sequence
  source 1..20: mol_type = other DNA
catgcaggatttgaaaggct

SEQ ID NO: 34669 - DNA, 20 bp, synthetic construct
  misc_feature 1..20: note = CRISPR gRNA sequence
  source 1..20: mol_type = other DNA
gaaaggctaagtgtagacac

SEQ ID NO: 34670 - DNA, 20 bp, synthetic construct
  misc_feature 1..20: note = CRISPR gRNA sequence
  source 1..20: mol_type = other DNA
aaaggctaagtgtagacact

SEQ ID NO: 34671 - DNA, 20 bp, synthetic construct
  misc_feature 1..20: note = CRISPR gRNA sequence
  source 1..20: mol_type = other DNA
agtgtagacactaaacaggt

SEQ ID NO: 34672 - DNA, 20 bp, synthetic construct
  misc_feature 1..20: note = CRISPR gRNA sequence
  source 1..20: mol_type = other DNA
aacaggtgtctgaaataaca

SEQ ID NO: 34673 - DNA, 20 bp, synthetic construct
  misc_feature 1..20: note = CRISPR gRNA sequence
  source 1..20: mol_type = other DNA
aaataacaattcacctctct

SEQ ID NO: 34674 - DNA, 20 bp, synthetic construct
  misc_feature 1..20: note = CRISPR gRNA sequence
  source 1..20: mol_type = other DNA
acctctctctcccccgaggg

SEQ ID NO: 34675 - DNA, 20 bp, synthetic construct
  misc_feature 1..20: note = CRISPR gRNA sequence
  source 1..20: mol_type = other DNA
tctctcccccgagggaaatc

SEQ ID NO: 34676 - DNA, 20 bp, synthetic construct
  misc_feature 1..20: note = CRISPR gRNA sequence
  source 1..20: mol_type = other DNA
tctcccccgagggaaatcag

SEQ ID NO: 34677 - DNA, 20 bp, synthetic construct
  misc_feature 1..20: note = CRISPR gRNA sequence
  source 1..20: mol_type = other DNA
tcccccgagggaaatcaggt

SEQ ID NO: 34678 - DNA, 20 bp, synthetic construct
  misc_feature 1..20: note = CRISPR gRNA sequence
  source 1..20: mol_type = other DNA
ccccgagggaaatcaggtgt

SEQ ID NO: 34679 - DNA, 20 bp, synthetic construct
  misc_feature 1..20: note = CRISPR gRNA sequence
  source 1..20: mol_type = other DNA
taactcagacttaaactatc

SEQ ID NO: 34680 - DNA, 20 bp, synthetic construct
  misc_feature 1..20: note = CRISPR gRNA sequence
  source 1..20: mol_type = other DNA
actcagacttaaactatctg

SEQ ID NO: 34681 - DNA, 20 bp, synthetic construct
  misc_feature 1..20: note = CRISPR gRNA sequence
  source 1..20: mol_type = other DNA
agacttaaactatctgaaga

SEQ ID NO: 34682 - DNA, 20 bp, synthetic construct
  misc_feature 1..20: note = CRISPR gRNA sequence
  source 1..20: mol_type = other DNA
aaactatctgaagatcagtg

SEQ ID NO: 34683 - DNA, 20 bp, synthetic construct
  misc_feature 1..20: note = CRISPR gRNA sequence
  source 1..20: mol_type = other DNA
aactatctgaagatcagtgc

SEQ ID NO: 34684 - DNA, 20 bp, synthetic construct
  misc_feature 1..20: note = CRISPR gRNA sequence
  source 1..20: mol_type = other DNA
tctgaagatcagtgcatgca

SEQ ID NO: 34685 - DNA, 20 bp, synthetic construct
  misc_feature 1..20: note = CRISPR gRNA sequence
  source 1..20: mol_type = other DNA
aagatcagtgcatgcatctc

SEQ ID NO: 34686 - DNA, 20 bp, synthetic construct
  misc_feature 1..20: note = CRISPR gRNA sequence
  source 1..20: mol_type = other DNA
ttctgggaacagcataacgt

SEQ ID NO: 34687 - DNA, 20 bp, synthetic construct
  misc_feature 1..20: note = CRISPR gRNA sequence
  source 1..20: mol_type = other DNA
ctgggaacagcataacgttc

SEQ ID NO: 34688 - DNA, 20 bp, synthetic construct
  misc_feature 1..20: note = CRISPR gRNA sequence
  source 1..20: mol_type = other DNA
tgggaacagcataacgttcc

SEQ ID NO: 34689 - DNA, 20 bp, synthetic construct
  misc_feature 1..20: note = CRISPR gRNA sequence
  source 1..20: mol_type = other DNA
ggaacagcataacgttccat

SEQ ID NO: 34690 - DNA, 20 bp, synthetic construct
  misc_feature 1..20: note = CRISPR gRNA sequence
  source 1..20: mol_type = other DNA
catctcagctggtgggagat

SEQ ID NO: 34691 - DNA, 20 bp, synthetic construct
  misc_feature 1..20: note = CRISPR gRNA sequence
  source 1..20: mol_type = other DNA
agctggtgggagatgaatgg

SEQ ID NO: 34692 - DNA, 20 bp, synthetic construct
  misc_feature 1..20: note = CRISPR gRNA sequence
  source 1..20: mol_type = other DNA
gtgggagatgaatggagctc

SEQ ID NO: 34693 - DNA, 20 bp, synthetic construct
  misc_feature 1..20: note = CRISPR gRNA sequence
  source 1..20: mol_type = other DNA
agatggtgagctttggggtg

SEQ ID NO: 34694 - DNA, 20 bp, synthetic construct
  misc_feature 1..20: note = CRISPR gRNA sequence
  source 1..20: mol_type = other DNA
tggggtgaaatttcccaact

SEQ ID NO: 34695 - DNA, 20 bp, synthetic construct
  misc_feature 1..20: note = CRISPR gRNA sequence
  source 1..20: mol_type = other DNA
ggggtgaaatttcccaactt

SEQ ID NO: 34696 - DNA, 20 bp, synthetic construct
  misc_feature 1..20: note = CRISPR gRNA sequence
  source 1..20: mol_type = other DNA
gggtgaaatttcccaacttt

SEQ ID NO: 34697 - DNA, 20 bp, synthetic construct
  misc_feature 1..20: note = CRISPR gRNA sequence
  source 1..20: mol_type = other DNA
cccaactttcaggttatccc

SEQ ID NO: 34698 - DNA, 20 bp, synthetic construct
  misc_feature 1..20: note = CRISPR gRNA sequence
  source 1..20: mol_type = other DNA
ccaactttcaggttatccct

SEQ ID NO: 34699 - DNA, 20 bp, synthetic construct
  misc_feature 1..20: note = CRISPR gRNA sequence
  source 1..20: mol_type = other DNA
tcaggttatccctacctacc

SEQ ID NO: 34700 - DNA, 20 bp, synthetic construct
  misc_feature 1..20: note = CRISPR gRNA sequence
  source 1..20: mol_type = other DNA
caggttatccctacctacca

SEQ ID NO: 34701 - DNA, 20 bp, synthetic construct
  misc_feature 1..20: note = CRISPR gRNA sequence
  source 1..20: mol_type = other DNA
aggttatccctacctaccaa

SEQ ID NO: 34702 - DNA, 20 bp, synthetic construct
  misc_feature 1..20: note = CRISPR gRNA sequence
  source 1..20: mol_type = other DNA
tccctacctaccaacgcact

SEQ ID NO: 34703 - DNA, 20 bp, synthetic construct
  misc_feature 1..20: note = CRISPR gRNA sequence
  source 1..20: mol_type = other DNA
cctaccaacgcactacaatc

SEQ ID NO: 34704 - DNA, 20 bp, synthetic construct
  misc_feature 1..20: note = CRISPR gRNA sequence
  source 1..20: mol_type = other DNA
ccaacgcactacaatctggg

SEQ ID NO: 34705 - DNA, 20 bp, synthetic construct
  misc_feature 1..20: note = CRISPR gRNA sequence
  source 1..20: mol_type = other DNA
caatctgggtaagttcattt

SEQ ID NO: 34706 - DNA, 20 bp, synthetic construct
  misc_feature 1..20: note = CRISPR gRNA sequence
  source 1..20: mol_type = other DNA
ggtaagttcattttttaaac

SEQ ID NO: 34707 - DNA, 20 bp, synthetic construct
  misc_feature 1..20: note = CRISPR gRNA sequence
  source 1..20: mol_type = other DNA
attttttaaaccacttggag

SEQ ID NO: 34708 - DNA, 20 bp, synthetic construct
  misc_feature 1..20: note = CRISPR gRNA sequence
  source 1..20: mol_type = other DNA
tttaaaccacttggagcctc

SEQ ID NO: 34709 - DNA, 20 bp, synthetic construct
  misc_feature 1..20: note = CRISPR gRNA sequence
  source 1..20: mol_type = other DNA
ttaaaccacttggagcctca

SEQ ID NO: 34710 - DNA, 20 bp, synthetic construct
  misc_feature 1..20: note = CRISPR gRNA sequence
  source 1..20: mol_type = other DNA
taaaccacttggagcctcag

SEQ ID NO: 34711 - DNA, 20 bp, synthetic construct
  misc_feature 1..20: note = CRISPR gRNA sequence
  source 1..20: mol_type = other DNA
aaaccacttggagcctcagt

SEQ ID NO: 34712 - DNA, 20 bp, synthetic construct
  misc_feature 1..20: note = CRISPR gRNA sequence
  source 1..20: mol_type = other DNA
aaccacttggagcctcagtt

SEQ ID NO: 34713 - DNA, 20 bp, synthetic construct
  misc_feature 1..20: note = CRISPR gRNA sequence
  source 1..20: mol_type = other DNA
ggagcctcagtttccttatc

SEQ ID NO: 34714 - DNA, 20 bp, synthetic construct
  misc_feature 1..20: note = CRISPR gRNA sequence
  source 1..20: mol_type = other DNA
gagcctcagtttccttatct

SEQ ID NO: 34715 - DNA, 20 bp, synthetic construct
  misc_feature 1..20: note = CRISPR gRNA sequence
  source 1..20: mol_type = other DNA
agtttccttatctgtaaagt

SEQ ID NO: 34716 - DNA, 20 bp, synthetic construct
  misc_feature 1..20: note = CRISPR gRNA sequence
  source 1..20: mol_type = other DNA
ccttatctgtaaagtggggg

SEQ ID NO: 34717 - DNA, 20 bp, synthetic construct
  misc_feature 1..20: note = CRISPR gRNA sequence
  source 1..20: mol_type = other DNA
cttatctgtaaagtggggga

SEQ ID NO: 34718 - DNA, 20 bp, synthetic construct
  misc_feature 1..20: note = CRISPR gRNA sequence
  source 1..20: mol_type = other DNA
atctgtaaagtgggggataa

SEQ ID NO: 34719 - DNA, 20 bp, synthetic construct
  misc_feature 1..20: note = CRISPR gRNA sequence
  source 1..20: mol_type = other DNA
tctgtaaagtgggggataat

SEQ ID NO: 34720 - DNA, 20 bp, synthetic construct
  misc_feature 1..20: note = CRISPR gRNA sequence
  source 1..20: mol_type = other DNA
taaagtgggggataataatt

SEQ ID NO: 34721 - DNA, 20 bp, synthetic construct
  misc_feature 1..20: note = CRISPR gRNA sequence
  source 1..20: mol_type = other DNA
gcaactcataggattagggg

SEQ ID NO: 34722 - DNA, 20 bp, synthetic construct
  misc_feature 1..20: note = CRISPR gRNA sequence
  source 1..20: mol_type = other DNA
ataggattaggggagttaag

SEQ ID NO: 34723 - DNA, 20 bp, synthetic construct
  misc_feature 1..20: note = CRISPR gRNA sequence
  source 1..20: mol_type = other DNA
ggggagttaagttgcatgga

SEQ ID NO: 34724 - DNA, 20 bp, synthetic construct
  misc_feature 1..20: note = CRISPR gRNA sequence
  source 1..20: mol_type = other DNA
agttgcatggagcccttaga

SEQ ID NO: 34725 - DNA, 20 bp, synthetic construct
  misc_feature 1..20: note = CRISPR gRNA sequence
  source 1..20: mol_type = other DNA
catggagcccttagaaaggg

SEQ ID NO: 34726 - DNA, 20 bp, synthetic construct
  misc_feature 1..20: note = CRISPR gRNA sequence
  source 1..20: mol_type = other DNA
agaaaggggactggcgacca

SEQ ID NO: 34727 - DNA, 20 bp, synthetic construct
  misc_feature 1..20: note = CRISPR gRNA sequence
  source 1..20: mol_type = other DNA
gaaaggggactggcgaccag

SEQ ID NO: 34728 - DNA, 20 bp, synthetic construct
  misc_feature 1..20: note = CRISPR gRNA sequence
  source 1..20: mol_type = other DNA
gcgaccagtaagtgctcaat

SEQ ID NO: 34729 - DNA, 20 bp, synthetic construct
  misc_feature 1..20: note = CRISPR gRNA sequence
  source 1..20: mol_type = other DNA
aatgaacagtagcttaaggc

SEQ ID NO: 34730 - DNA, 20 bp, synthetic construct
  misc_feature 1..20: note = CRISPR gRNA sequence
  source 1..20: mol_type = other DNA
aaggcagcacaacttctgca

SEQ ID NO: 34731 - DNA, 20 bp, synthetic construct
  misc_feature 1..20: note = CRISPR gRNA sequence
  source 1..20: mol_type = other DNA
aggcagcacaacttctgcat

SEQ ID NO: 34732 - DNA, 20 bp, synthetic construct
  misc_feature 1..20: note = CRISPR gRNA sequence
  source 1..20: mol_type = other DNA
ctgcatggtgagtacaatat

SEQ ID NO: 34733 - DNA, 20 bp, synthetic construct
  misc_feature 1..20: note = CRISPR gRNA sequence
  source 1..20: mol_type = other DNA
tgcatggtgagtacaatatg

SEQ ID NO: 34734 - DNA, 20 bp, synthetic construct
  misc_feature 1..20: note = CRISPR gRNA sequence
  source 1..20: mol_type = other DNA
catggtgagtacaatatgcg

SEQ ID NO: 34735 - DNA, 20 bp, synthetic construct
  misc_feature 1..20: note = CRISPR gRNA sequence
  source 1..20: mol_type = other DNA
ttattattaatgtgcttctt

SEQ ID NO: 34736 - DNA, 20 bp, synthetic construct
  misc_feature 1..20: note = CRISPR gRNA sequence
  source 1..20: mol_type = other DNA
tattattaatgtgcttctta

SEQ ID NO: 34737 - DNA, 20 bp, synthetic construct
  misc_feature 1..20: note = CRISPR gRNA sequence
  source 1..20: mol_type = other DNA
attattaatgtgcttcttac

SEQ ID NO: 34738 - DNA, 20 bp, synthetic construct
  misc_feature 1..20: note = CRISPR gRNA sequence
  source 1..20: mol_type = other DNA
ttattaatgtgcttcttacc

SEQ ID NO: 34739 - DNA, 20 bp, synthetic construct
  misc_feature 1..20: note = CRISPR gRNA sequence
  source 1..20: mol_type = other DNA
ttaatgtgcttcttacctct

SEQ ID NO: 34740 - DNA, 20 bp, synthetic construct
  misc_feature 1..20: note = CRISPR gRNA sequence
  source 1..20: mol_type = other DNA
atgtgcttcttacctctgtg

SEQ ID NO: 34741 - DNA, 20 bp, synthetic construct
  misc_feature 1..20: note = CRISPR gRNA sequence
  source 1..20: mol_type = other DNA
cttacctctgtgagagtgac

SEQ ID NO: 34742 - DNA, 20 bp, synthetic construct
  misc_feature 1..20: note = CRISPR gRNA sequence
  source 1..20: mol_type = other DNA
ttacctctgtgagagtgacc

SEQ ID NO: 34743 - DNA, 20 bp, synthetic construct
  misc_feature 1..20: note = CRISPR gRNA sequence
  source 1..20: mol_type = other DNA
acctctgtgagagtgaccag

SEQ ID NO: 34744 - DNA, 20 bp, synthetic construct
  misc_feature 1..20: note = CRISPR gRNA sequence
  source 1..20: mol_type = other DNA
cctctgtgagagtgaccagg

SEQ ID NO: 34745 - DNA, 20 bp, synthetic construct
  misc_feature 1..20: note = CRISPR gRNA sequence
  source 1..20: mol_type = other DNA
tgtgagagtgaccaggggag

SEQ ID NO: 34746 - DNA, 20 bp, synthetic construct
  misc_feature 1..20: note = CRISPR gRNA sequence
  source 1..20: mol_type = other DNA
tgagagtgaccaggggagat

SEQ ID NO: 34747 - DNA, 20 bp, synthetic construct
  misc_feature 1..20: note = CRISPR gRNA sequence
  source 1..20: mol_type = other DNA
ctctgtgtctggggctgtgc

SEQ ID NO: 34748 - DNA, 20 bp, synthetic construct
  misc_feature 1..20: note = CRISPR gRNA sequence
  source 1..20: mol_type = other DNA
tctgtgtctggggctgtgct

SEQ ID NO: 34749 - DNA, 20 bp, synthetic construct
  misc_feature 1..20: note = CRISPR gRNA sequence
  source 1..20: mol_type = other DNA
tgtgtctggggctgtgctag

SEQ ID NO: 34750 - DNA, 20 bp, synthetic construct
  misc_feature 1..20: note = CRISPR gRNA sequence
  source 1..20: mol_type = other DNA
tgtctggggctgtgctagat

SEQ ID NO: 34751 - DNA, 20 bp, synthetic construct
  misc_feature 1..20: note = CRISPR gRNA sequence
  source 1..20: mol_type = other DNA
gggctgtgctagatgccttg

SEQ ID NO: 34752 - DNA, 20 bp, synthetic construct
  misc_feature 1..20: note = CRISPR gRNA sequence
  source 1..20: mol_type = other DNA
tgctagatgccttgcattta

SEQ ID NO: 34753 - DNA, 20 bp, synthetic construct
  misc_feature 1..20: note = CRISPR gRNA sequence
  source 1..20: mol_type = other DNA
gatgccttgcatttactatt

SEQ ID NO: 34754 - DNA, 20 bp, synthetic construct
  misc_feature 1..20: note = CRISPR gRNA sequence
  source 1..20: mol_type = other DNA
gcatttactattctgtttca

SEQ ID NO: 34755 - DNA, 20 bp, synthetic construct
  misc_feature 1..20: note = CRISPR gRNA sequence
  source 1..20: mol_type = other DNA
catttactattctgtttcaa

SEQ ID NO: 34756 - DNA, 20 bp, synthetic construct
  misc_feature 1..20: note = CRISPR gRNA sequence
  source 1..20: mol_type = other DNA
actattctgtttcaactgtt

SEQ ID NO: 34757 - DNA, 20 bp, synthetic construct
  misc_feature 1..20: note = CRISPR gRNA sequence
  source 1..20: mol_type = other DNA
ctattctgtttcaactgtta

SEQ ID NO: 34758 - DNA, 20 bp, synthetic construct
  misc_feature 1..20: note = CRISPR gRNA sequence
  source 1..20: mol_type = other DNA
ttctgtttcaactgttaacg

SEQ ID NO: 34759 - DNA, 20 bp, synthetic construct
  misc_feature 1..20: note = CRISPR gRNA sequence
  source 1..20: mol_type = other DNA
tgtttcaactgttaacggca

SEQ ID NO: 34760 - DNA, 20 bp, synthetic construct
  misc_feature 1..20: note = CRISPR gRNA sequence
  source 1..20: mol_type = other DNA
tttcaactgttaacggcaac

SEQ ID NO: 34761 - DNA, 20 bp, synthetic construct
  misc_feature 1..20: note = CRISPR gRNA sequence
  source 1..20: mol_type = other DNA
caactgttaacggcaactct

SEQ ID NO: 34762 - DNA, 20 bp, synthetic construct
  misc_feature 1..20: note = CRISPR gRNA sequence
  source 1..20: mol_type = other DNA
aactgttaacggcaactctg

SEQ ID NO: 34763 - DNA, 20 bp, synthetic construct
  misc_feature 1..20: note = CRISPR gRNA sequence
  source 1..20: mol_type = other DNA
ttaacggcaactctgggaga

SEQ ID NO: 34764 - DNA, 20 bp, synthetic construct
  misc_feature 1..20: note = CRISPR gRNA sequence
  source 1..20: mol_type = other DNA
acggcaactctgggagattg

SEQ ID NO: 34765 - DNA, 20 bp, synthetic construct
  misc_feature 1..20: note = CRISPR gRNA sequence
  source 1..20: mol_type = other DNA
tgggagattgttgttattat

SEQ ID NO: 34766 - DNA, 20 bp, synthetic construct
  misc_feature 1..20: note = CRISPR gRNA sequence
  source 1..20: mol_type = other DNA
ggagattgttgttattatag

SEQ ID NO: 34767 - DNA, 20 bp, synthetic construct
  misc_feature 1..20: note = CRISPR gRNA sequence
  source 1..20: mol_type = other DNA
ttgttattatagccatttta

SEQ ID NO: 34768 - DNA, 20 bp, synthetic construct
  misc_feature 1..20: note = CRISPR gRNA sequence
  source 1..20: mol_type = other DNA
ttattatagccattttacag

SEQ ID NO: 34769 - DNA, 20 bp, synthetic construct
  misc_feature 1..20: note = CRISPR gRNA sequence
  source 1..20: mol_type = other DNA
ttatagccattttacagacg

SEQ ID NO: 34770 - DNA, 20 bp, synthetic construct
  misc_feature 1..20: note = CRISPR gRNA sequence
  source 1..20: mol_type = other DNA
tagccattttacagacgcag

SEQ ID NO: 34771 - DNA, 20 bp, synthetic construct
  misc_feature 1..20: note = CRISPR gRNA sequence
  source 1..20: mol_type = other DNA
tacagacgcaggcgctgaga

SEQ ID NO: 34772 - DNA, 20 bp, synthetic construct
  misc_feature 1..20: note = CRISPR gRNA sequence
  source 1..20: mol_type = other DNA
acagacgcaggcgctgagat

SEQ ID NO: 34773 - DNA, 20 bp, synthetic construct
  misc_feature 1..20: note = CRISPR gRNA sequence
  source 1..20: mol_type = other DNA
cagacgcaggcgctgagatt

SEQ ID NO: 34774 - DNA, 20 bp, synthetic construct
  misc_feature 1..20: note = CRISPR gRNA sequence
  source 1..20: mol_type = other DNA
agattacgtccagttcatta

SEQ ID NO: 34775 - DNA, 20 bp, synthetic construct
  misc_feature 1..20: note = CRISPR gRNA sequence
  source 1..20: mol_type = other DNA
cgtccagttcattagatgtt

SEQ ID NO: 34776 - DNA, 20 bp, synthetic construct
  misc_feature 1..20: note = CRISPR gRNA sequence
  source 1..20: mol_type = other DNA
attagatgttttcttcccag

SEQ ID NO: 34777 - DNA, 20 bp, synthetic construct
  misc_feature 1..20: note = CRISPR gRNA sequence
  source 1..20: mol_type = other DNA
gatgttttcttcccagaggc

SEQ ID NO: 34778 - DNA, 20 bp, synthetic construct
  misc_feature 1..20: note = CRISPR gRNA sequence
  source 1..20: mol_type = other DNA
tcttcccagaggcggggagt

SEQ ID NO: 34779 - DNA, 20 bp, synthetic construct
  misc_feature 1..20: note = CRISPR gRNA sequence
  source 1..20: mol_type = other DNA
cttcccagaggcggggagtc

SEQ ID NO: 34780 - DNA, 20 bp, synthetic construct
  misc_feature 1..20: note = CRISPR gRNA sequence
  source 1..20: mol_type = other DNA
ttcccagaggcggggagtct

SEQ ID NO: 34781 - DNA, 20 bp, synthetic construct
  misc_feature 1..20: note = CRISPR gRNA sequence
  source 1..20: mol_type = other DNA
cccagaggcggggagtctat

SEQ ID NO: 34782 - DNA, 20 bp, synthetic construct
  misc_feature 1..20: note = CRISPR gRNA sequence
  source 1..20: mol_type = other DNA
ccagaggcggggagtctatc

SEQ ID NO: 34783 - DNA, 20 bp, synthetic construct
  misc_feature 1..20: note = CRISPR gRNA sequence
  source 1..20: mol_type = other DNA
tctttgagggtctaaggagg

SEQ ID NO: 34784 - DNA, 20 bp, synthetic construct
  misc_feature 1..20: note = CRISPR gRNA sequence
  source 1..20: mol_type = other DNA
tgagggtctaaggaggcact

SEQ ID NO: 34785 - DNA, 20 bp, synthetic construct
  misc_feature 1..20: note = CRISPR gRNA sequence
  source 1..20: mol_type = other DNA
gagggtctaaggaggcactg

SEQ ID NO: 34786 - DNA, 20 bp, synthetic construct
  misc_feature 1..20: note = CRISPR gRNA sequence
  source 1..20: mol_type = other DNA
agggtctaaggaggcactga

SEQ ID NO: 34787 - DNA, 20 bp, synthetic construct
  misc_feature 1..20: note = CRISPR gRNA sequence
  source 1..20: mol_type = other DNA
aggaggcactgaaagggaga

SEQ ID NO: 34788 - DNA, 20 bp, synthetic construct
  misc_feature 1..20: note = CRISPR gRNA sequence
  source 1..20: mol_type = other DNA
aaagggagaagaaggctctt

SEQ ID NO: 34789 - DNA, 20 bp, synthetic construct
  misc_feature 1..20: note = CRISPR gRNA sequence
  source 1..20: mol_type = other DNA
ttttgctacccctaaaagcc

SEQ ID NO: 34790 - DNA, 20 bp, synthetic construct
  misc_feature 1..20: note = CRISPR gRNA sequence
  source 1..20: mol_type = other DNA
ttgctacccctaaaagcctc

SEQ ID NO: 34791 - DNA, 20 bp, synthetic construct
  misc_feature 1..20: note = CRISPR gRNA sequence
  source 1..20: mol_type = other DNA
tgctacccctaaaagcctcc

SEQ ID NO: 34792 - DNA, 20 bp, synthetic construct
  misc_feature 1..20: note = CRISPR gRNA sequence
  source 1..20: mol_type = other DNA
gctacccctaaaagcctcca

SEQ ID NO: 34793 - DNA, 20 bp, synthetic construct
  misc_feature 1..20: note = CRISPR gRNA sequence
  source 1..20: mol_type = other DNA
ctacccctaaaagcctccag

SEQ ID NO: 34794 - DNA, 20 bp, synthetic construct
  misc_feature 1..20: note = CRISPR gRNA sequence
  source 1..20: mol_type = other DNA
cccctaaaagcctccagcac

SEQ ID NO: 34795 - DNA, 20 bp, synthetic construct
  misc_feature 1..20: note = CRISPR gRNA sequence
  source 1..20: mol_type = other DNA
aaagcctccagcactgctct

SEQ ID NO: 34796 - DNA, 20 bp, synthetic construct
  misc_feature 1..20: note = CRISPR gRNA sequence
  source 1..20: mol_type = other DNA
cagcactgctctgaactgtg

SEQ ID NO: 34797 - DNA, 20 bp, synthetic construct
  misc_feature 1..20: note = CRISPR gRNA sequence
  source 1..20: mol_type = other DNA
ctctgaactgtgattaaaga

SEQ ID NO: 34798 - DNA, 20 bp, synthetic construct
  misc_feature 1..20: note = CRISPR gRNA sequence
  source 1..20: mol_type = other DNA
tgaactgtgattaaagagca

SEQ ID NO: 34799 - DNA, 20 bp, synthetic construct
  misc_feature 1..20: note = CRISPR gRNA sequence
  source 1..20: mol_type = other DNA
aactgtgattaaagagcatg

SEQ ID NO: 34800 - DNA, 20 bp, synthetic construct
  misc_feature 1..20: note = CRISPR gRNA sequence
  source 1..20: mol_type = other DNA
tgattaaagagcatgagaag

SEQ ID NO: 34801 - DNA, 20 bp, synthetic construct
  misc_feature 1..20: note = CRISPR gRNA sequence
  source 1..20: mol_type = other DNA
aagagcatgagaaggaggcc

SEQ ID NO: 34802 - DNA, 20 bp, synthetic construct
  misc_feature 1..20: note = CRISPR gRNA sequence
  source 1..20: mol_type = other DNA
acgcctataatcctagcact

SEQ ID NO: 34803 - DNA, 20 bp, synthetic construct
  misc_feature 1..20: note = CRISPR gRNA sequence
  source 1..20: mol_type = other DNA
taatcctagcactttgagag

SEQ ID NO: 34804 - DNA, 20 bp, synthetic construct
  misc_feature 1..20: note = CRISPR gRNA sequence
  source 1..20: mol_type = other DNA
gcactttgagaggccgaggc

SEQ ID NO: 34805 - DNA, 20 bp, synthetic construct
  misc_feature 1..20: note = CRISPR gRNA sequence
  source 1..20: mol_type = other DNA
tgagaggccgaggctggcgg

SEQ ID NO: 34806 - DNA, 20 bp, synthetic construct
  misc_feature 1..20: note = CRISPR gRNA sequence
  source 1..20: mol_type = other DNA
gagaggccgaggctggcgga

SEQ ID NO: 34807 - DNA, 20 bp, synthetic construct
  misc_feature 1..20: note = CRISPR gRNA sequence
  source 1..20: mol_type = other DNA
agaggccgaggctggcggat

SEQ ID NO: 34808 - DNA, 20 bp, synthetic construct
  misc_feature 1..20: note = CRISPR gRNA sequence
  source 1..20: mol_type = other DNA
gcggattacttgaggtcagg

SEQ ID NO: 34809 - DNA, 20 bp, synthetic construct
  misc_feature 1..20: note = CRISPR gRNA sequence
  source 1..20: mol_type = other DNA
cttgaggtcaggagttcaag

SEQ ID NO: 34810 - DNA, 20 bp, synthetic construct
  misc_feature 1..20: note = CRISPR gRNA sequence
  source 1..20: mol_type = other DNA
gaggtcaggagttcaagacc

SEQ ID NO: 34811 - DNA, 20 bp, synthetic construct
  misc_feature 1..20: note = CRISPR gRNA sequence
  source 1..20: mol_type = other DNA
aggtcaggagttcaagacca

SEQ ID NO: 34812 - DNA, 20 bp, synthetic construct
  misc_feature 1..20: note = CRISPR gRNA sequence
  source 1..20: mol_type = other DNA
aagaccagcctgaccagcat

SEQ ID NO: 34813 - DNA, 20 bp, synthetic construct
  misc_feature 1..20: note = CRISPR gRNA sequence
  source 1..20: mol_type = other DNA
accagcatggtgaaaccccg

SEQ ID NO: 34814 - DNA, 20 bp, synthetic construct
  misc_feature 1..20: note = CRISPR gRNA sequence
  source 1..20: mol_type = other DNA
tgcaaaaatacaaaaatgag

SEQ ID NO: 34815 - DNA, 20 bp, synthetic construct
  misc_feature 1..20: note = CRISPR gRNA sequence
  source 1..20: mol_type = other DNA
caaaaatacaaaaatgagct

SEQ ID NO: 34816 - DNA, 20 bp, synthetic construct
  misc_feature 1..20: note = CRISPR gRNA sequence
  source 1..20: mol_type = other DNA
ggcgtggtggtgggtgccta

SEQ ID NO: 34817 - DNA, 20 bp, synthetic construct
  misc_feature 1..20: note = CRISPR gRNA sequence
  source 1..20: mol_type = other DNA
taatcccagctacttgggag

SEQ ID NO: 34818 - DNA, 20 bp, synthetic construct
  misc_feature 1..20: note = CRISPR gRNA sequence
  source 1..20: mol_type = other DNA
cttgggaggctgaggcagga

SEQ ID NO: 34819 - DNA, 20 bp, synthetic construct
  misc_feature 1..20: note = CRISPR gRNA sequence
  source 1..20: mol_type = other DNA
gggaggctgaggcaggaaaa

SEQ ID NO: 34820 - DNA, 20 bp, synthetic construct
  misc_feature 1..20: note = CRISPR gRNA sequence
  source 1..20: mol_type = other DNA
ggaggctgaggcaggaaaat

SEQ ID NO: 34821 - DNA, 20 bp, synthetic construct
  misc_feature 1..20: note = CRISPR gRNA sequence
  source 1..20: mol_type = other DNA
aggcaggaaaattgcttgaa

SEQ ID NO: 34822 - DNA, 20 bp, synthetic construct
  misc_feature 1..20: note = CRISPR gRNA sequence
  source 1..20: mol_type = other DNA
cttgaacctgggaggcggag

SEQ ID NO: 34823 - DNA, 20 bp, synthetic construct
  misc_feature 1..20: note = CRISPR gRNA sequence
  source 1..20: mol_type = other DNA
gaacctgggaggcggaggtt

SEQ ID NO: 34824 - DNA, 20 bp, synthetic construct
  misc_feature 1..20: note = CRISPR gRNA sequence
  source 1..20: mol_type = other DNA
aacctgggaggcggaggttg

SEQ ID NO: 34825 - DNA, 20 bp, synthetic construct
  misc_feature 1..20: note = CRISPR gRNA sequence
  source 1..20: mol_type = other DNA
ggaggcggaggttgcagtga

SEQ ID NO: 34826 - DNA, 20 bp, synthetic construct
  misc_feature 1..20: note = CRISPR gRNA sequence
  source 1..20: mol_type = other DNA
cagtgagccgagatcacgcc

SEQ ID NO: 34827 - DNA, 20 bp, synthetic construct
  misc_feature 1..20: note = CRISPR gRNA sequence
  source 1..20: mol_type = other DNA
cactccagcctcggtgacag

SEQ ID NO: 34828 - DNA, 20 bp, synthetic construct
  misc_feature 1..20: note = CRISPR gRNA sequence
  source 1..20: mol_type = other DNA
cagcctcggtgacagagcaa

SEQ ID NO: 34829 - DNA, 20 bp, synthetic construct
  misc_feature 1..20: note = CRISPR gRNA sequence
  source 1..20: mol_type = other DNA
ggtgacagagcaagactctg

SEQ ID NO: 34830 - DNA, 20 bp, synthetic construct
  misc_feature 1..20: note = CRISPR gRNA sequence
  source 1..20: mol_type = other DNA
tgtctcagacaaaaaaaaaa

SEQ ID NO: 34831 - DNA, 20 bp, synthetic construct
  misc_feature 1..20: note = CRISPR gRNA sequence
  source 1..20: mol_type = other DNA
tctcagacaaaaaaaaaaaa

SEQ ID NO: 34832 - DNA, 20 bp, synthetic construct
  misc_feature 1..20: note = CRISPR gRNA sequence
  source 1..20: mol_type = other DNA
agacaaaaaaaaaaaaagct

SEQ ID NO: 34833 - DNA, 20 bp, synthetic construct
  misc_feature 1..20: note = CRISPR gRNA sequence
  source 1..20: mol_type = other DNA
gagaaggaatacttccctac

SEQ ID NO: 34834 - DNA, 20 bp, synthetic construct
  misc_feature 1..20: note = CRISPR gRNA sequence
  source 1..20: mol_type = other DNA
agaaggaatacttccctact

SEQ ID NO: 34835 - DNA, 20 bp, synthetic construct
  misc_feature 1..20: note = CRISPR gRNA sequence
  source 1..20: mol_type = other DNA
ccctactcttgaccatgaac

SEQ ID NO: 34836 - DNA, 20 bp, synthetic construct
  misc_feature 1..20: note = CRISPR gRNA sequence
  source 1..20: mol_type = other DNA
cctactcttgaccatgaact

SEQ ID NO: 34837 - DNA, 20 bp, synthetic construct
  misc_feature 1..20: note = CRISPR gRNA sequence
  source 1..20: mol_type = other DNA
ctcttgaccatgaacttctc

SEQ ID NO: 34838 - DNA, 20 bp, synthetic construct
  misc_feature 1..20: note = CRISPR gRNA sequence
  source 1..20: mol_type = other DNA
ttgaccatgaacttctcctc

SEQ ID NO: 34839 - DNA, 20 bp, synthetic construct
  misc_feature 1..20: note = CRISPR gRNA sequence
  source 1..20: mol_type = other DNA
gaccatgaacttctcctcct

SEQ ID NO: 34840 - DNA, 20 bp, synthetic construct
  misc_feature 1..20: note = CRISPR gRNA sequence
  source 1..20: mol_type = other DNA
accatgaacttctcctcctg

SEQ ID NO: 34841 - DNA, 20 bp, synthetic construct
  misc_feature 1..20: note = CRISPR gRNA sequence
  source 1..20: mol_type = other DNA
ctcctcctgaggaataatgg

SEQ ID NO: 34842 - DNA, 20 bp, synthetic construct
  misc_feature 1..20: note = CRISPR gRNA sequence
  source 1..20: mol_type = other DNA
tcctcctgaggaataatggg

SEQ ID NO: 34843 - DNA, 20 bp, synthetic construct
  misc_feature 1..20: note = CRISPR gRNA sequence
  source 1..20: mol_type = other DNA
ctcctgaggaataatgggaa

SEQ ID NO: 34844 - DNA, 20 bp, synthetic construct
  misc_feature 1..20: note = CRISPR gRNA sequence
  source 1..20: mol_type = other DNA
ctgaggaataatgggaagac

SEQ ID NO: 34845 - DNA, 20 bp, synthetic construct
  misc_feature 1..20: note = CRISPR gRNA sequence
  source 1..20: mol_type = other DNA
aggaataatgggaagacctc

SEQ ID NO: 34846 - DNA, 20 bp, synthetic construct
  misc_feature 1..20: note = CRISPR gRNA sequence
  source 1..20: mol_type = other DNA
tgaactgtgtgcctagagac

SEQ ID NO: 34847 - DNA, 20 bp, synthetic construct
  misc_feature 1..20: note = CRISPR gRNA sequence
  source 1..20: mol_type = other DNA
aactgtgtgcctagagacat

SEQ ID NO: 34848 - DNA, 20 bp, synthetic construct
  misc_feature 1..20: note = CRISPR gRNA sequence
  source 1..20: mol_type = other DNA
tgtgcctagagacatggttt

SEQ ID NO: 34849 - DNA, 20 bp, synthetic construct
  misc_feature 1..20: note = CRISPR gRNA sequence
  source 1..20: mol_type = other DNA
gagacatggtttgagtttct

SEQ ID NO: 34850 - DNA, 20 bp, synthetic construct
  misc_feature 1..20: note = CRISPR gRNA sequence
  source 1..20: mol_type = other DNA
gagtttctgctctgcctttg

SEQ ID NO: 34851 - DNA, 20 bp, synthetic construct
  misc_feature 1..20: note = CRISPR gRNA sequence
  source 1..20: mol_type = other DNA
agtttctgctctgcctttga

SEQ ID NO: 34852 - DNA, 20 bp, synthetic construct
  misc_feature 1..20: note = CRISPR gRNA sequence
  source 1..20: mol_type = other DNA
ctgctctgcctttgatcctg

SEQ ID NO: 34853 - DNA, 20 bp, synthetic construct
  misc_feature 1..20: note = CRISPR gRNA sequence
  source 1..20: mol_type = other DNA
tgctctgcctttgatcctga

SEQ ID NO: 34854 - DNA, 20 bp, synthetic construct
  misc_feature 1..20: note = CRISPR gRNA sequence
  source 1..20: mol_type = other DNA
ctctgcctttgatcctgagt

SEQ ID NO: 34855 - DNA, 20 bp, synthetic construct
  misc_feature 1..20: note = CRISPR gRNA sequence
  source 1..20: mol_type = other DNA
tgcctttgatcctgagtaca

SEQ ID NO: 34856 - DNA, 20 bp, synthetic construct
  misc_feature 1..20: note = CRISPR gRNA sequence
  source 1..20: mol_type = other DNA
cctttgatcctgagtacatt

SEQ ID NO: 34857 - DNA, 20 bp, synthetic construct
  misc_feature 1..20: note = CRISPR gRNA sequence
  source 1..20: mol_type = other DNA
tgatcctgagtacattacct

SEQ ID NO: 34858 - DNA, 20 bp, synthetic construct
  misc_feature 1..20: note = CRISPR gRNA sequence
  source 1..20: mol_type = other DNA
gatcctgagtacattacctt

SEQ ID NO: 34859 - DNA, 20 bp, synthetic construct
  misc_feature 1..20: note = CRISPR gRNA sequence
  source 1..20: mol_type = other DNA
atcctgagtacattacctta

SEQ ID NO: 34860 - DNA, 20 bp, synthetic construct
  misc_feature 1..20: note = CRISPR gRNA sequence
  source 1..20: mol_type = other DNA
agtacattaccttagccctc

SEQ ID NO: 34861 - DNA, 20 bp, synthetic construct
  misc_feature 1..20: note = CRISPR gRNA sequence
  source 1..20: mol_type = other DNA
ccttagccctctgagcctcc

SEQ ID NO: 34862 - DNA, 20 bp, synthetic construct
  misc_feature 1..20: note = CRISPR gRNA sequence
  source 1..20: mol_type = other DNA
agccctctgagcctccgttt

SEQ ID NO: 34863 - DNA, 20 bp, synthetic construct
  misc_feature 1..20: note = CRISPR gRNA sequence
  source 1..20: mol_type = other DNA
gccctctgagcctccgtttc

SEQ ID NO: 34864 - DNA, 20 bp, synthetic construct
  misc_feature 1..20: note = CRISPR gRNA sequence
  source 1..20: mol_type = other DNA
tgagcctccgtttcaacgag

SEQ ID NO: 34865 - DNA, 20 bp, synthetic construct
  misc_feature 1..20: note = CRISPR gRNA sequence
  source 1..20: mol_type = other DNA
agcctccgtttcaacgagtg

SEQ ID NO: 34866 - DNA, 20 bp, synthetic construct
  misc_feature 1..20: note = CRISPR gRNA sequence
  source 1..20: mol_type = other DNA
cgtttcaacgagtgttggag

SEQ ID NO: 34867 - DNA, 20 bp, synthetic construct
  misc_feature 1..20: note = CRISPR gRNA sequence
  source 1..20: mol_type = other DNA
caacgagtgttggagcccct

SEQ ID NO: 34868 - DNA, 20 bp, synthetic construct
  misc_feature 1..20: note = CRISPR gRNA sequence
  source 1..20: mol_type = other DNA
aacgagtgttggagcccctt

SEQ ID NO: 34869 - DNA, 20 bp, synthetic construct
  misc_feature 1..20: note = CRISPR gRNA sequence
  source 1..20: mol_type = other DNA
gagccccttcaattgagtct

SEQ ID NO: 34870 - DNA, 20 bp, synthetic construct
  misc_feature 1..20: note = CRISPR gRNA sequence
  source 1..20: mol_type = other DNA
caattgagtctttttgagat

SEQ ID NO: 34871 - DNA, 20 bp, synthetic construct
  misc_feature 1..20: note = CRISPR gRNA sequence
  source 1..20: mol_type = other DNA
aattgagtctttttgagatt

SEQ ID NO: 34872 - DNA, 20 bp, synthetic construct
  misc_feature 1..20: note = CRISPR gRNA sequence
  source 1..20: mol_type = other DNA
agtctttttgagattctgat

SEQ ID NO: 34873 - DNA, 20 bp, synthetic construct
  misc_feature 1..20: note = CRISPR gRNA sequence
  source 1..20: mol_type = other DNA
tttgagattctgattcctcg

SEQ ID NO: 34874 - DNA, 20 bp, synthetic construct
  misc_feature 1..20: note = CRISPR gRNA sequence
  source 1..20: mol_type = other DNA
ttgagattctgattcctcgt

SEQ ID NO: 34875 - DNA, 20 bp, synthetic construct
  misc_feature 1..20: note = CRISPR gRNA sequence
  source 1..20: mol_type = other DNA
tgagattctgattcctcgtt

SEQ ID NO: 34876 - DNA, 20 bp, synthetic construct
  misc_feature 1..20: note = CRISPR gRNA sequence
  source 1..20: mol_type = other DNA
gagattctgattcctcgttg

SEQ ID NO: 34877 - DNA, 20 bp, synthetic construct
  misc_feature 1..20: note = CRISPR gRNA sequence
  source 1..20: mol_type = other DNA
agattctgattcctcgttgc

SEQ ID NO: 34878 - DNA, 20 bp, synthetic construct
  misc_feature 1..20: note = CRISPR gRNA sequence
  source 1..20: mol_type = other DNA
tgattcctcgttgcctggca

SEQ ID NO: 34879 - DNA, 20 bp, synthetic construct
  misc_feature 1..20: note = CRISPR gRNA sequence
  source 1..20: mol_type = other DNA
attcctcgttgcctggcagt

SEQ ID NO: 34880 - DNA, 20 bp, synthetic construct
  misc_feature 1..20: note = CRISPR gRNA sequence
  source 1..20: mol_type = other DNA
ctcgttgcctggcagtcttc

SEQ ID NO: 34881 - DNA, 20 bp, synthetic construct
  misc_feature 1..20: note = CRISPR gRNA sequence
  source 1..20: mol_type = other DNA
gttgcctggcagtcttctcc

SEQ ID NO: 34882 - DNA, 20 bp, synthetic construct
  misc_feature 1..20: note = CRISPR gRNA sequence
  source 1..20: mol_type = other DNA
cctggcagtcttctcctttt

SEQ ID NO: 34883 - DNA, 20 bp, synthetic construct
  misc_feature 1..20: note = CRISPR gRNA sequence
  source 1..20: mol_type = other DNA
gcagtcttctccttttcctt

SEQ ID NO: 34884 - DNA, 20 bp, synthetic construct
  misc_feature 1..20: note = CRISPR gRNA sequence
  source 1..20: mol_type = other DNA
ctccttttcctttcccccaa

SEQ ID NO: 34885 - DNA, 20 bp, synthetic construct
  misc_feature 1..20: note = CRISPR gRNA sequence
  source 1..20: mol_type = other DNA
tccttttcctttcccccaag

SEQ ID NO: 34886 - DNA, 20 bp, synthetic construct
  misc_feature 1..20: note = CRISPR gRNA sequence
  source 1..20: mol_type = other DNA
cttttcctttcccccaaggc

SEQ ID NO: 34887 - DNA, 20 bp, synthetic construct
  misc_feature 1..20: note = CRISPR gRNA sequence
  source 1..20: mol_type = other DNA
ttcctttcccccaaggcccc

SEQ ID NO: 34888 - DNA, 20 bp, synthetic construct
  misc_feature 1..20: note = CRISPR gRNA sequence
  source 1..20: mol_type = other DNA
tcctttcccccaaggccccc

SEQ ID NO: 34889 - DNA, 20 bp, synthetic construct
  misc_feature 1..20: note = CRISPR gRNA sequence
  source 1..20: mol_type = other DNA
cctttcccccaaggcccccc

SEQ ID NO: 34890 - DNA, 20 bp, synthetic construct
  misc_feature 1..20: note = CRISPR gRNA sequence
  source 1..20: mol_type = other DNA
ctttcccccaaggccccccc

SEQ ID NO: 34891 - DNA, 20 bp, synthetic construct
  misc_feature 1..20: note = CRISPR gRNA sequence
  source 1..20: mol_type = other DNA
tcccccaaggccccccccaa

SEQ ID NO: 34892 - DNA, 20 bp, synthetic construct
  misc_feature 1..20: note = CRISPR gRNA sequence
  source 1..20: mol_type = other DNA
cccccaaggccccccccaac

SEQ ID NO: 34893 - DNA, 20 bp, synthetic construct
  misc_feature 1..20: note = CRISPR gRNA sequence
  source 1..20: mol_type = other DNA
ccccaaggccccccccaaca

SEQ ID NO: 34894 - DNA, 20 bp, synthetic construct
  misc_feature 1..20: note = CRISPR gRNA sequence
  source 1..20: mol_type = other DNA
ctccccaacctcatgacaag

SEQ ID NO: 34895 - DNA, 20 bp, synthetic construct
  misc_feature 1..20: note = CRISPR gRNA sequence
  source 1..20: mol_type = other DNA
cccaacctcatgacaagctg

SEQ ID NO: 34896 - DNA, 20 bp, synthetic construct
  misc_feature 1..20: note = CRISPR gRNA sequence
  source 1..20: mol_type = other DNA
atgacaagctgcttccgggg

SEQ ID NO: 34897 - DNA, 20 bp, synthetic construct
  misc_feature 1..20: note = CRISPR gRNA sequence
  source 1..20: mol_type = other DNA
cttccgggggccaaatggtg

SEQ ID NO: 34898 - DNA, 20 bp, synthetic construct
  misc_feature 1..20: note = CRISPR gRNA sequence
  source 1..20: mol_type = other DNA
ccgggggccaaatggtgttg

SEQ ID NO: 34899 - DNA, 20 bp, synthetic construct
  misc_feature 1..20: note = CRISPR gRNA sequence
  source 1..20: mol_type = other DNA
cgggggccaaatggtgttgg

SEQ ID NO: 34900 - DNA, 20 bp, synthetic construct
  misc_feature 1..20: note = CRISPR gRNA sequence
  source 1..20: mol_type = other DNA
ggaagccaggggcctaggaa

SEQ ID NO: 34901 - DNA, 20 bp, synthetic construct
  misc_feature 1..20: note = CRISPR gRNA sequence
  source 1..20: mol_type = other DNA
ggaatgcctatctaccatga

SEQ ID NO: 34902 - DNA, 20 bp, synthetic construct
  misc_feature 1..20: note = CRISPR gRNA sequence
  source 1..20: mol_type = other DNA
tctaccatgaccagacccca

SEQ ID NO: 34903 - DNA, 20 bp, synthetic construct
  misc_feature 1..20: note = CRISPR gRNA sequence
  source 1..20: mol_type = other DNA
ccatgaccagaccccaaaca

SEQ ID NO: 34904 - DNA, 20 bp, synthetic construct
  misc_feature 1..20: note = CRISPR gRNA sequence
  source 1..20: mol_type = other DNA
ctttgtgggggtagtagctc

SEQ ID NO: 34905 - DNA, 20 bp, synthetic construct
  misc_feature 1..20: note = CRISPR gRNA sequence
  source 1..20: mol_type = other DNA
tttgtgggggtagtagctca

SEQ ID NO: 34906 - DNA, 20 bp, synthetic construct
  misc_feature 1..20: note = CRISPR gRNA sequence
  source 1..20: mol_type = other DNA
tgtgggggtagtagctcaaa

SEQ ID NO: 34907 - DNA, 20 bp, synthetic construct
  misc_feature 1..20: note = CRISPR gRNA sequence
  source 1..20: mol_type = other DNA
gtgggggtagtagctcaaat

SEQ ID NO: 34908 - DNA, 20 bp, synthetic construct
  misc_feature 1..20: note = CRISPR gRNA sequence
  source 1..20: mol_type = other DNA
tgggggtagtagctcaaatg

SEQ ID NO: 34909 - DNA, 20 bp, synthetic construct
  misc_feature 1..20: note = CRISPR gRNA sequence
  source 1..20: mol_type = other DNA
aaatgagttccgcttttgct

SEQ ID NO: 34910 - DNA, 20 bp, synthetic construct
  misc_feature 1..20: note = CRISPR gRNA sequence
  source 1..20: mol_type = other DNA
cgcttttgctcatgcaccct

SEQ ID NO: 34911 - DNA, 20 bp, synthetic construct
  misc_feature 1..20: note = CRISPR gRNA sequence
  source 1..20: mol_type = other DNA
ttgctcatgcaccctgtagt

SEQ ID NO: 34912 - DNA, 20 bp, synthetic construct
  misc_feature 1..20: note = CRISPR gRNA sequence
  source 1..20: mol_type = other DNA
tgctcatgcaccctgtagtc

SEQ ID NO: 34913 - DNA, 20 bp, synthetic construct
  misc_feature 1..20: note = CRISPR gRNA sequence
  source 1..20: mol_type = other DNA
gctcatgcaccctgtagtcc

SEQ ID NO: 34914 - DNA, 20 bp, synthetic construct
  misc_feature 1..20: note = CRISPR gRNA sequence
  source 1..20: mol_type = other DNA
ctcatgcaccctgtagtcct

SEQ ID NO: 34915 - DNA, 20 bp, synthetic construct
  misc_feature 1..20: note = CRISPR gRNA sequence
  source 1..20: mol_type = other DNA
atgcaccctgtagtcctcca

SEQ ID NO: 34916 - DNA, 20 bp, synthetic construct
  misc_feature 1..20: note = CRISPR gRNA sequence
  source 1..20: mol_type = other DNA
tagtcctccagataaactct

SEQ ID NO: 34917 - DNA, 20 bp, synthetic construct
  misc_feature 1..20: note = CRISPR gRNA sequence
  source 1..20: mol_type = other DNA
cagataaactctaagaaaca

SEQ ID NO: 34918 - DNA, 20 bp, synthetic construct
  misc_feature 1..20: note = CRISPR gRNA sequence
  source 1..20: mol_type = other DNA
taagaaacatctctcacttt

SEQ ID NO: 34919 - DNA, 20 bp, synthetic construct
  misc_feature 1..20: note = CRISPR gRNA sequence
  source 1..20: mol_type = other DNA
agaaacatctctcacttttc

SEQ ID NO: 34920 - DNA, 20 bp, synthetic construct
  misc_feature 1..20: note = CRISPR gRNA sequence
  source 1..20: mol_type = other DNA
tcacttttcccctctaaagc

SEQ ID NO: 34921 - DNA, 20 bp, synthetic construct
  misc_feature 1..20: note = CRISPR gRNA sequence
  source 1..20: mol_type = other DNA
acttttcccctctaaagctg

SEQ ID NO: 34922 - DNA, 20 bp, synthetic construct
  misc_feature 1..20: note = CRISPR gRNA sequence
  source 1..20: mol_type = other DNA
ttcccctctaaagctgtaaa

SEQ ID NO: 34923 - DNA, 20 bp, synthetic construct
  misc_feature 1..20: note = CRISPR gRNA sequence
  source 1..20: mol_type = other DNA
tcccctctaaagctgtaaaa

SEQ ID NO: 34924 - DNA, 20 bp, synthetic construct
  misc_feature 1..20: note = CRISPR gRNA sequence
  source 1..20: mol_type = other DNA
cccctctaaagctgtaaaac

SEQ ID NO: 34925 - DNA, 20 bp, synthetic construct
  misc_feature 1..20: note = CRISPR gRNA sequence
  source 1..20: mol_type = other DNA
ccctctaaagctgtaaaaca

SEQ ID NO: 34926 - DNA, 20 bp, synthetic construct
  misc_feature 1..20: note = CRISPR gRNA sequence
  source 1..20: mol_type = other DNA
taaagctgtaaaacaatgat

SEQ ID NO: 34927 - DNA, 20 bp, synthetic construct
  misc_feature 1..20: note = CRISPR gRNA sequence
  source 1..20: mol_type = other DNA
aagctgtaaaacaatgattc

SEQ ID NO: 34928 - DNA, 20 bp, synthetic construct
  misc_feature 1..20: note = CRISPR gRNA sequence
  source 1..20: mol_type = other DNA
taaaacaatgattcactgag

SEQ ID NO: 34929 - DNA, 20 bp, synthetic construct
  misc_feature 1..20: note = CRISPR gRNA sequence
  source 1..20: mol_type = other DNA
actgagcaccccgtaagaaa

SEQ ID NO: 34930 - DNA, 20 bp, synthetic construct
  misc_feature 1..20: note = CRISPR gRNA sequence
  source 1..20: mol_type = other DNA
agcaccccgtaagaaagtca

SEQ ID NO: 34931 - DNA, 20 bp, synthetic construct
  misc_feature 1..20: note = CRISPR gRNA sequence
  source 1..20: mol_type = other DNA
agctcagttccttactggcc

SEQ ID NO: 34932 - DNA, 20 bp, synthetic construct
  misc_feature 1..20: note = CRISPR gRNA sequence
  source 1..20: mol_type = other DNA
agttccttactggccccaaa

SEQ ID NO: 34933 - DNA, 20 bp, synthetic construct
  misc_feature 1..20: note = CRISPR gRNA sequence
  source 1..20: mol_type = other DNA
cttactggccccaaagaggt

SEQ ID NO: 34934 - DNA, 20 bp, synthetic construct
  misc_feature 1..20: note = CRISPR gRNA sequence
  source 1..20: mol_type = other DNA
actggccccaaagaggttta

SEQ ID NO: 34935 - DNA, 20 bp, synthetic construct
  misc_feature 1..20: note = CRISPR gRNA sequence
  source 1..20: mol_type = other DNA
ctggccccaaagaggtttac

SEQ ID NO: 34936 - DNA, 20 bp, synthetic construct
  misc_feature 1..20: note = CRISPR gRNA sequence
  source 1..20: mol_type = other DNA
gccccaaagaggtttaccac

SEQ ID NO: 34937 - DNA, 20 bp, synthetic construct
  misc_feature 1..20: note = CRISPR gRNA sequence
  source 1..20: mol_type = other DNA
accacacagtccctgccaaa

SEQ ID NO: 34938 - DNA, 20 bp, synthetic construct
  misc_feature 1..20: note = CRISPR gRNA sequence
  source 1..20: mol_type = other DNA
ccacacagtccctgccaaag

SEQ ID NO: 34939 - DNA, 20 bp, synthetic construct
  misc_feature 1..20: note = CRISPR gRNA sequence
  source 1..20: mol_type = other DNA
ccaaagaggcttgcaatgta

SEQ ID NO: 34940 - DNA, 20 bp, synthetic construct
  misc_feature 1..20: note = CRISPR gRNA sequence
  source 1..20: mol_type = other DNA
gcaatgtagacccagatgat

SEQ ID NO: 34941 - DNA, 20 bp, synthetic construct
  misc_feature 1..20: note = CRISPR gRNA sequence
  source 1..20: mol_type = other DNA
caatgtagacccagatgata

SEQ ID NO: 34942 - DNA, 20 bp, synthetic construct
  misc_feature 1..20: note = CRISPR gRNA sequence
  source 1..20: mol_type = other DNA
taggagagagacaaaacata

SEQ ID NO: 34943 - DNA, 20 bp, synthetic construct
  misc_feature 1..20: note = CRISPR gRNA sequence
  source 1..20: mol_type = other DNA
aggagagagacaaaacataa

SEQ ID NO: 34944 - DNA, 20 bp, synthetic construct
  misc_feature 1..20: note = CRISPR gRNA sequence
  source 1..20: mol_type = other DNA
ggagagagacaaaacataat

SEQ ID NO: 34945 - DNA, 20 bp, synthetic construct
  misc_feature 1..20: note = CRISPR gRNA sequence
  source 1..20: mol_type = other DNA
agggtgcaggctctgggttc

SEQ ID NO: 34946 - DNA, 20 bp, synthetic construct
  misc_feature 1..20: note = CRISPR gRNA sequence
  source 1..20: mol_type = other DNA
tgggttcaaatcttagttcc

SEQ ID NO: 34947 - DNA, 20 bp, synthetic construct
  misc_feature 1..20: note = CRISPR gRNA sequence
  source 1..20: mol_type = other DNA
ggttcaaatcttagttccac

SEQ ID NO: 34948 - DNA, 20 bp, synthetic construct
  misc_feature 1..20: note = CRISPR gRNA sequence
  source 1..20: mol_type = other DNA
aaatcttagttccacacttg

SEQ ID NO: 34949 - DNA, 20 bp, synthetic construct
  misc_feature 1..20: note = CRISPR gRNA sequence
  source 1..20: mol_type = other DNA
agttccacacttgctgtgtg

SEQ ID NO: 34950 - DNA, 20 bp, synthetic construct
  misc_feature 1..20: note = CRISPR gRNA sequence
  source 1..20: mol_type = other DNA
gttccacacttgctgtgtga

SEQ ID NO: 34951 - DNA, 20 bp, synthetic construct
  misc_feature 1..20: note = CRISPR gRNA sequence
  source 1..20: mol_type = other DNA
cacacttgctgtgtgacttt

SEQ ID NO: 34952 - DNA, 20 bp, synthetic construct
  misc_feature 1..20: note = CRISPR gRNA sequence
  source 1..20: mol_type = other DNA
gctgtgtgactttgcaaatg

SEQ ID NO: 34953 - DNA, 20 bp, synthetic construct
  misc_feature 1..20: note = CRISPR gRNA sequence
  source 1..20: mol_type = other DNA
ctgtgtgactttgcaaatgt

SEQ ID NO: 34954 - DNA, 20 bp, synthetic construct
  misc_feature 1..20: note = CRISPR gRNA sequence
  source 1..20: mol_type = other DNA
tgtgactttgcaaatgttac

SEQ ID NO: 34955 - DNA, 20 bp, synthetic construct
  misc_feature 1..20: note = CRISPR gRNA sequence
  source 1..20: mol_type = other DNA
tgcaaatgttactcaacctc

SEQ ID NO: 34956 - DNA, 20 bp, synthetic construct
  misc_feature 1..20: note = CRISPR gRNA sequence
  source 1..20: mol_type = other DNA
gcaaatgttactcaacctct

SEQ ID NO: 34957 - DNA, 20 bp, synthetic construct
  misc_feature 1..20: note = CRISPR gRNA sequence
  source 1..20: mol_type = other DNA
caaatgttactcaacctctc

SEQ ID NO: 34958 - DNA, 20 bp, synthetic construct
  misc_feature 1..20: note = CRISPR gRNA sequence
  source 1..20: mol_type = other DNA
ctcaacctctctgagtcaca

SEQ ID NO: 34959 - DNA, 20 bp, synthetic construct
  misc_feature 1..20: note = CRISPR gRNA sequence
  source 1..20: mol_type = other DNA
aacctctctgagtcacagaa

SEQ ID NO: 34960 - DNA, 20 bp, synthetic construct
  misc_feature 1..20: note = CRISPR gRNA sequence
  source 1..20: mol_type = other DNA
tctgagtcacagaatcgact

SEQ ID NO: 34961 - DNA, 20 bp, synthetic construct
  misc_feature 1..20: note = CRISPR gRNA sequence
  source 1..20: mol_type = other DNA
tgagtcacagaatcgactgc

SEQ ID NO: 34962 - DNA, 20 bp, synthetic construct
  misc_feature 1..20: note = CRISPR gRNA sequence
  source 1..20: mol_type = other DNA
agtcacagaatcgactgcat

SEQ ID NO: 34963 - DNA, 20 bp, synthetic construct
  misc_feature 1..20: note = CRISPR gRNA sequence
  source 1..20: mol_type = other DNA
cattttgttggcacagtgct

SEQ ID NO: 34964 - DNA, 20 bp, synthetic construct
  misc_feature 1..20: note = CRISPR gRNA sequence
  source 1..20: mol_type = other DNA
tgttggcacagtgcttatgt

SEQ ID NO: 34965 - DNA, 20 bp, synthetic construct
  misc_feature 1..20: note = CRISPR gRNA sequence
  source 1..20: mol_type = other DNA
gttggcacagtgcttatgtc

SEQ ID NO: 34966 - DNA, 20 bp, synthetic construct
  misc_feature 1..20: note = CRISPR gRNA sequence
  source 1..20: mol_type = other DNA
ttggcacagtgcttatgtca

SEQ ID NO: 34967 - DNA, 20 bp, synthetic construct
  misc_feature 1..20: note = CRISPR gRNA sequence
  source 1..20: mol_type = other DNA
gcacagtgcttatgtcactg

SEQ ID NO: 34968 - DNA, 20 bp, synthetic construct
  misc_feature 1..20: note = CRISPR gRNA sequence
  source 1..20: mol_type = other DNA
atgtcactgggttgttgtga

SEQ ID NO: 34969 - DNA, 20 bp, synthetic construct
  misc_feature 1..20: note = CRISPR gRNA sequence
  source 1..20: mol_type = other DNA
tgtcactgggttgttgtgac

SEQ ID NO: 34970 - DNA, 20 bp, synthetic construct
  misc_feature 1..20: note = CRISPR gRNA sequence
  source 1..20: mol_type = other DNA
ggttgttgtgacttacctaa

SEQ ID NO: 34971 - DNA, 20 bp, synthetic construct
  misc_feature 1..20: note = CRISPR gRNA sequence
  source 1..20: mol_type = other DNA
ttgtgacttacctaaagtga

SEQ ID NO: 34972 - DNA, 20 bp, synthetic construct
  misc_feature 1..20: note = CRISPR gRNA sequence
  source 1..20: mol_type = other DNA
tgacttacctaaagtgactt

SEQ ID NO: 34973 - DNA, 20 bp, synthetic construct
  misc_feature 1..20: note = CRISPR gRNA sequence
  source 1..20: mol_type = other DNA
acctaaagtgacttagcgag

SEQ ID NO: 34974 - DNA, 20 bp, synthetic construct
  misc_feature 1..20: note = CRISPR gRNA sequence
  source 1..20: mol_type = other DNA
cctaaagtgacttagcgagt

SEQ ID NO: 34975 - DNA, 20 bp, synthetic construct
  misc_feature 1..20: note = CRISPR gRNA sequence
  source 1..20: mol_type = other DNA
aagtgacttagcgagtaagt

SEQ ID NO: 34976 - DNA, 20 bp, synthetic construct
  misc_feature 1..20: note = CRISPR gRNA sequence
  source 1..20: mol_type = other DNA
agcgagtaagtggtactaag

SEQ ID NO: 34977 - DNA, 20 bp, synthetic construct
  misc_feature 1..20: note = CRISPR gRNA sequence
  source 1..20: mol_type = other DNA
gcgagtaagtggtactaaga

SEQ ID NO: 34978 - DNA, 20 bp, synthetic construct
  misc_feature 1..20: note = CRISPR gRNA sequence
  source 1..20: mol_type = other DNA
agatgtaaactccaaaaata

SEQ ID NO: 34979 - DNA, 20 bp, synthetic construct
  misc_feature 1..20: note = CRISPR gRNA sequence
  source 1..20: mol_type = other DNA
caaaaataaaacagcaaagt

SEQ ID NO: 34980 - DNA, 20 bp, synthetic construct
  misc_feature 1..20: note = CRISPR gRNA sequence
  source 1..20: mol_type = other DNA
gatactgtacaactggcaaa

SEQ ID NO: 34981 - DNA, 20 bp, synthetic construct
  misc_feature 1..20: note = CRISPR gRNA sequence
  source 1..20: mol_type = other DNA
atactgtacaactggcaaaa

SEQ ID NO: 34982 - DNA, 20 bp, synthetic construct
  misc_feature 1..20: note = CRISPR gRNA sequence
  source 1..20: mol_type = other DNA
tacaactggcaaaagttaga

SEQ ID NO: 34983 - DNA, 20 bp, synthetic construct
  misc_feature 1..20: note = CRISPR gRNA sequence
  source 1..20: mol_type = other DNA
gcaaaagttagacatctggg

SEQ ID NO: 34984 - DNA, 20 bp, synthetic construct
  misc_feature 1..20: note = CRISPR gRNA sequence
  source 1..20: mol_type = other DNA
gacatctgggaaatgccaag

SEQ ID NO: 34985 - DNA, 20 bp, synthetic construct
  misc_feature 1..20: note = CRISPR gRNA sequence
  source 1..20: mol_type = other DNA
ggaaatgccaagtgttggtt

SEQ ID NO: 34986 - DNA, 20 bp, synthetic construct
  misc_feature 1..20: note = CRISPR gRNA sequence
  source 1..20: mol_type = other DNA
gttacacgggtttgtgggaa

SEQ ID NO: 34987 - DNA, 20 bp, synthetic construct
  misc_feature 1..20: note = CRISPR gRNA sequence
  source 1..20: mol_type = other DNA
cacgggtttgtgggaatgta

SEQ ID NO: 34988 - DNA, 20 bp, synthetic construct
  misc_feature 1..20: note = CRISPR gRNA sequence
  source 1..20: mol_type = other DNA
gtgggaatgtagatggatgg

SEQ ID NO: 34989 - DNA, 20 bp, synthetic construct
  misc_feature 1..20: note = CRISPR gRNA sequence
  source 1..20: mol_type = other DNA
tgggaatgtagatggatggg

SEQ ID NO: 34990 - DNA, 20 bp, synthetic construct
  misc_feature 1..20: note = CRISPR gRNA sequence
  source 1..20: mol_type = other DNA
tggagaacgacctggcatca

SEQ ID NO: 34991 - DNA, 20 bp, synthetic construct
  misc_feature 1..20: note = CRISPR gRNA sequence
  source 1..20: mol_type = other DNA
gagaacgacctggcatcatg

SEQ ID NO: 34992 - DNA, 20 bp, synthetic construct
  misc_feature 1..20: note = CRISPR gRNA sequence
  source 1..20: mol_type = other DNA
gcatcatgtagaatatctaa

SEQ ID NO: 34993 - DNA, 20 bp, synthetic construct
  misc_feature 1..20: note = CRISPR gRNA sequence
  source 1..20: mol_type = other DNA
aggatatgtagatcctacca

SEQ ID NO: 34994 - DNA, 20 bp, synthetic construct
  misc_feature 1..20: note = CRISPR gRNA sequence
  source 1..20: mol_type = other DNA
ccacctggcaattcagctct

SEQ ID NO: 34995 - DNA, 20 bp, synthetic construct
  misc_feature 1..20: note = CRISPR gRNA sequence
  source 1..20: mol_type = other DNA
gcaattcagctcttgggtct

SEQ ID NO: 34996 - DNA, 20 bp, synthetic construct
  misc_feature 1..20: note = CRISPR gRNA sequence
  source 1..20: mol_type = other DNA
agctcttgggtctatatatc

SEQ ID NO: 34997 - DNA, 20 bp, synthetic construct
  misc_feature 1..20: note = CRISPR gRNA sequence
  source 1..20: mol_type = other DNA
ttgggtctatatatcctgaa

SEQ ID NO: 34998 - DNA, 20 bp, synthetic construct
  misc_feature 1..20: note = CRISPR gRNA sequence
  source 1..20: mol_type = other DNA
gggtctatatatcctgaaga

SEQ ID NO: 34999 - DNA, 20 bp, synthetic construct
  misc_feature 1..20: note = CRISPR gRNA sequence
  source 1..20: mol_type = other DNA
ggtctatatatcctgaagaa

SEQ ID NO: 35000 - DNA, 20 bp, synthetic construct
  misc_feature 1..20: note = CRISPR gRNA sequence
  source 1..20: mol_type = other DNA
tatatcctgaagaaatgttc

SEQ ID NO: 35001 - DNA, 20 bp, synthetic construct
  misc_feature 1..20: note = CRISPR gRNA sequence
  source 1..20: mol_type = other DNA
aagaaatgttcccacaactc

SEQ ID NO: 35002 - DNA, 20 bp, synthetic construct
  misc_feature 1..20: note = CRISPR gRNA sequence
  source 1..20: mol_type = other DNA
ccacaactccccaggagaac

SEQ ID NO: 35003 - DNA, 20 bp, synthetic construct
  misc_feature 1..20: note = CRISPR gRNA sequence
  source 1..20: mol_type = other DNA
cccaggagaacccatctgag

SEQ ID NO: 35004 - DNA, 20 bp, synthetic construct
  misc_feature 1..20: note = CRISPR gRNA sequence
  source 1..20: mol_type = other DNA
aggatggttactgctgtgtt

SEQ ID NO: 35005 - DNA, 20 bp, synthetic construct
  misc_feature 1..20: note = CRISPR gRNA sequence
  source 1..20: mol_type = other DNA
ctgctgtgttatttgtggtg

SEQ ID NO: 35006 - DNA, 20 bp, synthetic construct
  misc_feature 1..20: note = CRISPR gRNA sequence
  source 1..20: mol_type = other DNA
ctgtgttatttgtggtgaca

SEQ ID NO: 35007 - DNA, 20 bp, synthetic construct
  misc_feature 1..20: note = CRISPR gRNA sequence
  source 1..20: mol_type = other DNA
tgttatttgtggtgacagag

SEQ ID NO: 35008 - DNA, 20 bp, synthetic construct
  misc_feature 1..20: note = CRISPR gRNA sequence
  source 1..20: mol_type = other DNA
tttgtggtgacagagagttg

SEQ ID NO: 35009 - DNA, 20 bp, synthetic construct
  misc_feature 1..20: note = CRISPR gRNA sequence
  source 1..20: mol_type = other DNA
gtggtgacagagagttggag

SEQ ID NO: 35010 - DNA, 20 bp, synthetic construct
  misc_feature 1..20: note = CRISPR gRNA sequence
  source 1..20: mol_type = other DNA
tggtgacagagagttggagg

SEQ ID NO: 35011 - DNA, 20 bp, synthetic construct
  misc_feature 1..20: note = CRISPR gRNA sequence
  source 1..20: mol_type = other DNA
gaggtcacctaggtgtccat

SEQ ID NO: 35012 - DNA, 20 bp, synthetic construct
  misc_feature 1..20: note = CRISPR gRNA sequence
  source 1..20: mol_type = other DNA
ggtgtccatcactgggggtg

SEQ ID NO: 35013 - DNA, 20 bp, synthetic construct
  misc_feature 1..20: note = CRISPR gRNA sequence
  source 1..20: mol_type = other DNA
ggggtgtggacaggtgaaaa

SEQ ID NO: 35014 - DNA, 20 bp, synthetic construct
  misc_feature 1..20: note = CRISPR gRNA sequence
  source 1..20: mol_type = other DNA
cactccatagagaacaatgt

SEQ ID NO: 35015 - DNA, 20 bp, synthetic construct
  misc_feature 1..20: note = CRISPR gRNA sequence
  source 1..20: mol_type = other DNA
catagagaacaatgtccgtg

SEQ ID NO: 35016 - DNA, 20 bp, synthetic construct
  misc_feature 1..20: note = CRISPR gRNA sequence
  source 1..20: mol_type = other DNA
gaagcaaagatcaaatgcat

SEQ ID NO: 35017 - DNA, 20 bp, synthetic construct
  misc_feature 1..20: note = CRISPR gRNA sequence
  source 1..20: mol_type = other DNA
aaaacatagtacagaatgca

SEQ ID NO: 35018 - DNA, 20 bp, synthetic construct
  misc_feature 1..20: note = CRISPR gRNA sequence
  source 1..20: mol_type = other DNA
tggccaggcgtggtgactcg

SEQ ID NO: 35019 - DNA, 20 bp, synthetic construct
  misc_feature 1..20: note = CRISPR gRNA sequence
  source 1..20: mol_type = other DNA
gcacctgtaattccagcact

SEQ ID NO: 35020 - DNA, 20 bp, synthetic construct
  misc_feature 1..20: note = CRISPR gRNA sequence
  source 1..20: mol_type = other DNA
taattccagcactttgggag

SEQ ID NO: 35021 - DNA, 20 bp, synthetic construct
  misc_feature 1..20: note = CRISPR gRNA sequence
  source 1..20: mol_type = other DNA
cagcactttgggaggccgag

SEQ ID NO: 35022 - DNA, 20 bp, synthetic construct
  misc_feature 1..20: note = CRISPR gRNA sequence
  source 1..20: mol_type = other DNA
tgggaggccgaggcgggtgg

SEQ ID NO: 35023 - DNA, 20 bp, synthetic construct
  misc_feature 1..20: note = CRISPR gRNA sequence
  source 1..20: mol_type = other DNA
gggaggccgaggcgggtgga

SEQ ID NO: 35024 - DNA, 20 bp, synthetic construct
  misc_feature 1..20: note = CRISPR gRNA sequence
  source 1..20: mol_type = other DNA
ggaggccgaggcgggtggat

SEQ ID NO: 35025 - DNA, 20 bp, synthetic construct
  misc_feature 1..20: note = CRISPR gRNA sequence
  source 1..20: mol_type = other DNA
aggtcaggagtttgagacca

SEQ ID NO: 35026 - DNA, 20 bp, synthetic construct
  misc_feature 1..20: note = CRISPR gRNA sequence
  source 1..20: mol_type = other DNA
gagaccagcctggccaaggt

SEQ ID NO: 35027 - DNA, 20 bp, synthetic construct
  misc_feature 1..20: note = CRISPR gRNA sequence
  source 1..20: mol_type = other DNA
agaccagcctggccaaggtg

SEQ ID NO: 35028 - DNA, 20 bp, synthetic construct
  misc_feature 1..20: note = CRISPR gRNA sequence
  source 1..20: mol_type = other DNA
gccaaggtggtaaaacccca

SEQ ID NO: 35029 - DNA, 20 bp, synthetic construct
  misc_feature 1..20: note = CRISPR gRNA sequence
  source 1..20: mol_type = other DNA
tactaaaaatagaaaactca

SEQ ID NO: 35030 - DNA, 20 bp, synthetic construct
  misc_feature 1..20: note = CRISPR gRNA sequence
  source 1..20: mol_type = other DNA
ctaaaaatagaaaactcagc

SEQ ID NO: 35031 - DNA, 20 bp, synthetic construct
  misc_feature 1..20: note = CRISPR gRNA sequence
  source 1..20: mol_type = other DNA
aaaatagaaaactcagcctg

SEQ ID NO: 35032 - DNA, 20 bp, synthetic construct
  misc_feature 1..20: note = CRISPR gRNA sequence
  source 1..20: mol_type = other DNA
agcctgggtgacagagtgag

SEQ ID NO: 35033 - DNA, 20 bp, synthetic construct
  misc_feature 1..20: note = CRISPR gRNA sequence
  source 1..20: mol_type = other DNA
ggtgacagagtgagactcca

SEQ ID NO: 35034 - DNA, 20 bp, synthetic construct
  misc_feature 1..20: note = CRISPR gRNA sequence
  source 1..20: mol_type = other DNA
catctaaaaaaaaaaaaaaa

SEQ ID NO: 35035 - DNA, 20 bp, synthetic construct
  misc_feature 1..20: note = CRISPR gRNA sequence
  source 1..20: mol_type = other DNA
aaaaaaaaaaaaaaaggcaa

SEQ ID NO: 35036 - DNA, 20 bp, synthetic construct
  misc_feature 1..20: note = CRISPR gRNA sequence
  source 1..20: mol_type = other DNA
tataagagcacatacaaaca

SEQ ID NO: 35037 - DNA, 20 bp, synthetic construct
  misc_feature 1..20: note = CRISPR gRNA sequence
  source 1..20: mol_type = other DNA
ataagagcacatacaaacag

SEQ ID NO: 35038 - DNA, 20 bp, synthetic construct
  misc_feature 1..20: note = CRISPR gRNA sequence
  source 1..20: mol_type = other DNA
taagagcacatacaaacaga

SEQ ID NO: 35039 - DNA, 20 bp, synthetic construct
  misc_feature 1..20: note = CRISPR gRNA sequence
  source 1..20: mol_type = other DNA
aaatgcattagaatgggcac

SEQ ID NO: 35040 - DNA, 20 bp, synthetic construct
  misc_feature 1..20: note = CRISPR gRNA sequence
  source 1..20: mol_type = other DNA
gaatgggcacccagtatggg

SEQ ID NO: 35041 - DNA, 20 bp, synthetic construct
  misc_feature 1..20: note = CRISPR gRNA sequence
  source 1..20: mol_type = other DNA
atgaagagaaaaccctcatg

SEQ ID NO: 35042 - DNA, 20 bp, synthetic construct
  misc_feature 1..20: note = CRISPR gRNA sequence
  source 1..20: mol_type = other DNA
atgtgaaccaaagatcatag

SEQ ID NO: 35043 - DNA, 20 bp, synthetic construct
  misc_feature 1..20: note = CRISPR gRNA sequence
  source 1..20: mol_type = other DNA
ggctgcactgggcagttaat

SEQ ID NO: 35044 - DNA, 20 bp, synthetic construct
  misc_feature 1..20: note = CRISPR gRNA sequence
  source 1..20: mol_type = other DNA
cactgggcagttaatcgaag

SEQ ID NO: 35045 - DNA, 20 bp, synthetic construct
  misc_feature 1..20: note = CRISPR gRNA sequence
  source 1..20: mol_type = other DNA
ggcagttaatcgaaggttta

SEQ ID NO: 35046 - DNA, 20 bp, synthetic construct
  misc_feature 1..20: note = CRISPR gRNA sequence
  source 1..20: mol_type = other DNA
atcgaaggtttaaaggccca

SEQ ID NO: 35047 - DNA, 20 bp, synthetic construct
  misc_feature 1..20: note = CRISPR gRNA sequence
  source 1..20: mol_type = other DNA
aaaggcccaggggttgaaaa

SEQ ID NO: 35048 - DNA, 20 bp, synthetic construct
  misc_feature 1..20: note = CRISPR gRNA sequence
  source 1..20: mol_type = other DNA
aaggcccaggggttgaaaag

SEQ ID NO: 35049 - DNA, 20 bp, synthetic construct
  misc_feature 1..20: note = CRISPR gRNA sequence
  source 1..20: mol_type = other DNA
aaaagaaaagaaacaaagga

SEQ ID NO: 35050 - DNA, 20 bp, synthetic construct
  misc_feature 1..20: note = CRISPR gRNA sequence
  source 1..20: mol_type = other DNA
atggggtgaggttggtacct

SEQ ID NO: 35051 - DNA, 20 bp, synthetic construct
  misc_feature 1..20: note = CRISPR gRNA sequence
  source 1..20: mol_type = other DNA
gtacctctatggctcaccaa

SEQ ID NO: 35052 - DNA, 20 bp, synthetic construct
  misc_feature 1..20: note = CRISPR gRNA sequence
  source 1..20: mol_type = other DNA
tatggctcaccaacaatagg

SEQ ID NO: 35053 - DNA, 20 bp, synthetic construct
  misc_feature 1..20: note = CRISPR gRNA sequence
  source 1..20: mol_type = other DNA
tggctcaccaacaatagggc

SEQ ID NO: 35054 - DNA, 20 bp, synthetic construct
  misc_feature 1..20: note = CRISPR gRNA sequence
  source 1..20: mol_type = other DNA
accaacaatagggcctgcac

SEQ ID NO: 35055 - DNA, 20 bp, synthetic construct
  misc_feature 1..20: note = CRISPR gRNA sequence
  source 1..20: mol_type = other DNA
cacagagcctggtacctata

SEQ ID NO: 35056 - DNA, 20 bp, synthetic construct
  misc_feature 1..20: note = CRISPR gRNA sequence
  source 1..20: mol_type = other DNA
gtacctatagatgttcacaa

SEQ ID NO: 35057 - DNA, 20 bp, synthetic construct
  misc_feature 1..20: note = CRISPR gRNA sequence
  source 1..20: mol_type = other DNA
tagatgttcacaaagaaaca

SEQ ID NO: 35058 - DNA, 20 bp, synthetic construct
  misc_feature 1..20: note = CRISPR gRNA sequence
  source 1..20: mol_type = other DNA
acaaagaaacaaacctctgc

SEQ ID NO: 35059 - DNA, 20 bp, synthetic construct
  misc_feature 1..20: note = CRISPR gRNA sequence
  source 1..20: mol_type = other DNA
tgctcttgccaccccacagg

SEQ ID NO: 35060 - DNA, 20 bp, synthetic construct
  misc_feature 1..20: note = CRISPR gRNA sequence
  source 1..20: mol_type = other DNA
ctcttgccaccccacaggct

SEQ ID NO: 35061 - DNA, 20 bp, synthetic construct
  misc_feature 1..20: note = CRISPR gRNA sequence
  source 1..20: mol_type = other DNA
ttgccaccccacaggctgtc

SEQ ID NO: 35062 - DNA, 20 bp, synthetic construct
  misc_feature 1..20: note = CRISPR gRNA sequence
  source 1..20: mol_type = other DNA
gccaccccacaggctgtctg

SEQ ID NO: 35063 - DNA, 20 bp, synthetic construct
  misc_feature 1..20: note = CRISPR gRNA sequence
  source 1..20: mol_type = other DNA
ccaccccacaggctgtctgg

SEQ ID NO: 35064 - DNA, 20 bp, synthetic construct
  misc_feature 1..20: note = CRISPR gRNA sequence
  source 1..20: mol_type = other DNA
tctggtgatggcttgatttg

SEQ ID NO: 35065 - DNA, 20 bp, synthetic construct
  misc_feature 1..20: note = CRISPR gRNA sequence
  source 1..20: mol_type = other DNA
gtgatggcttgatttgtgcc

SEQ ID NO: 35066 - DNA, 20 bp, synthetic construct
  misc_feature 1..20: note = CRISPR gRNA sequence
  source 1..20: mol_type = other DNA
gatttgtgcccaagagccca

SEQ ID NO: 35067 - DNA, 20 bp, synthetic construct
  misc_feature 1..20: note = CRISPR gRNA sequence
  source 1..20: mol_type = other DNA
atttgtgcccaagagcccag

SEQ ID NO: 35068 - DNA, 20 bp, synthetic construct
  misc_feature 1..20: note = CRISPR gRNA sequence
  source 1..20: mol_type = other DNA
gtgcccaagagcccagggtc

SEQ ID NO: 35069 - DNA, 20 bp, synthetic construct
  misc_feature 1..20: note = CRISPR gRNA sequence
  source 1..20: mol_type = other DNA
tgcccaagagcccagggtcc

SEQ ID NO: 35070 - DNA, 20 bp, synthetic construct
  misc_feature 1..20: note = CRISPR gRNA sequence
  source 1..20: mol_type = other DNA
gggaagagataggaacatgc

SEQ ID NO: 35071 - DNA, 20 bp, synthetic construct
  misc_feature 1..20: note = CRISPR gRNA sequence
  source 1..20: mol_type = other DNA
gacttggagcaggatggggg

SEQ ID NO: 35072 - DNA, 20 bp, synthetic construct
  misc_feature 1..20: note = CRISPR gRNA sequence
  source 1..20: mol_type = other DNA
ggagcaggatgggggaggag

SEQ ID NO: 35073 - DNA, 20 bp, synthetic construct
  misc_feature 1..20: note = CRISPR gRNA sequence
  source 1..20: mol_type = other DNA
gagcaggatgggggaggagc

SEQ ID NO: 35074 - DNA, 20 bp, synthetic construct
  misc_feature 1..20: note = CRISPR gRNA sequence
  source 1..20: mol_type = other DNA
gatgtagaggaagaagcccc

SEQ ID NO: 35075 - DNA, 20 bp, synthetic construct
  misc_feature 1..20: note = CRISPR gRNA sequence
  source 1..20: mol_type = other DNA
actctccagcctgctgtttg

SEQ ID NO: 35076 - DNA, 20 bp, synthetic construct
  misc_feature 1..20: note = CRISPR gRNA sequence
  source 1..20: mol_type = other DNA
tccagcctgctgtttgcaaa

SEQ ID NO: 35077 - DNA, 20 bp, synthetic construct
  misc_feature 1..20: note = CRISPR gRNA sequence
  source 1..20: mol_type = other DNA
cagcctgctgtttgcaaacc

SEQ ID NO: 35078 - DNA, 20 bp, synthetic construct
  misc_feature 1..20: note = CRISPR gRNA sequence
  source 1..20: mol_type = other DNA
ctgtttgcaaaccaagtgta

SEQ ID NO: 35079 - DNA, 20 bp, synthetic construct
  misc_feature 1..20: note = CRISPR gRNA sequence
  source 1..20: mol_type = other DNA
tttgcaaaccaagtgtagat

SEQ ID NO: 35080 - DNA, 20 bp, synthetic construct
  misc_feature 1..20: note = CRISPR gRNA sequence
  source 1..20: mol_type = other DNA
gcaaaccaagtgtagatatc

SEQ ID NO: 35081 - DNA, 20 bp, synthetic construct
  misc_feature 1..20: note = CRISPR gRNA sequence
  source 1..20: mol_type = other DNA
caaaccaagtgtagatatcc

SEQ ID NO: 35082 - DNA, 20 bp, synthetic construct
  misc_feature 1..20: note = CRISPR gRNA sequence
  source 1..20: mol_type = other DNA
aagagaaactactggtctca

SEQ ID NO: 35083 - DNA, 20 bp, synthetic construct
  misc_feature 1..20: note = CRISPR gRNA sequence
  source 1..20: mol_type = other DNA
agagaaactactggtctcac

SEQ ID NO: 35084 - DNA, 20 bp, synthetic construct
  misc_feature 1..20: note = CRISPR gRNA sequence
  source 1..20: mol_type = other DNA
ctggtctcactcaagacttt

SEQ ID NO: 35085 - DNA, 20 bp, synthetic construct
  misc_feature 1..20: note = CRISPR gRNA sequence
  source 1..20: mol_type = other DNA
gtctcactcaagactttcac

SEQ ID NO: 35086 - DNA, 20 bp, synthetic construct
  misc_feature 1..20: note = CRISPR gRNA sequence
  source 1..20: mol_type = other DNA
actcaagactttcacttcct

SEQ ID NO: 35087 - DNA, 20 bp, synthetic construct
  misc_feature 1..20: note = CRISPR gRNA sequence
  source 1..20: mol_type = other DNA
aagactttcacttcctggag

SEQ ID NO: 35088 - DNA, 20 bp, synthetic construct
  misc_feature 1..20: note = CRISPR gRNA sequence
  source 1..20: mol_type = other DNA
tcacttcctggagtggcacg

SEQ ID NO: 35089 - DNA, 20 bp, synthetic construct
  misc_feature 1..20: note = CRISPR gRNA sequence
  source 1..20: mol_type = other DNA
cacttcctggagtggcacga

SEQ ID NO: 35090 - DNA, 20 bp, synthetic construct
  misc_feature 1..20: note = CRISPR gRNA sequence
  source 1..20: mol_type = other DNA
acttcctggagtggcacgag

SEQ ID NO: 35091 - DNA, 20 bp, synthetic construct
  misc_feature 1..20: note = CRISPR gRNA sequence
  source 1..20: mol_type = other DNA
cctggagtggcacgaggagg

SEQ ID NO: 35092 - DNA, 20 bp, synthetic construct
  misc_feature 1..20: note = CRISPR gRNA sequence
  source 1..20: mol_type = other DNA
ctggagtggcacgaggaggt

SEQ ID NO: 35093 - DNA, 20 bp, synthetic construct
  misc_feature 1..20: note = CRISPR gRNA sequence
  source 1..20: mol_type = other DNA
gagtggcacgaggaggtcac

SEQ ID NO: 35094 - DNA, 20 bp, synthetic construct
  misc_feature 1..20: note = CRISPR gRNA sequence
  source 1..20: mol_type = other DNA
aggcatgtagcaacactgca

SEQ ID NO: 35095 - DNA, 20 bp, synthetic construct
  misc_feature 1..20: note = CRISPR gRNA sequence
  source 1..20: mol_type = other DNA
caatgctcaggggcttatgg

SEQ ID NO: 35096 - DNA, 20 bp, synthetic construct
  misc_feature 1..20: note = CRISPR gRNA sequence
  source 1..20: mol_type = other DNA
aggggcttatgggcctggaa

SEQ ID NO: 35097 - DNA, 20 bp, synthetic construct
  misc_feature 1..20: note = CRISPR gRNA sequence
  source 1..20: mol_type = other DNA
atgggcctggaaacagttgc

SEQ ID NO: 35098 - DNA, 20 bp, synthetic construct
  misc_feature 1..20: note = CRISPR gRNA sequence
  source 1..20: mol_type = other DNA
tgggcctggaaacagttgca

SEQ ID NO: 35099 - DNA, 20 bp, synthetic construct
  misc_feature 1..20: note = CRISPR gRNA sequence
  source 1..20: mol_type = other DNA
gaaacagttgcaggatctga

SEQ ID NO: 35100 - DNA, 20 bp, synthetic construct
  misc_feature 1..20: note = CRISPR gRNA sequence
  source 1..20: mol_type = other DNA
caggatctgatcatttgtcc

SEQ ID NO: 35101 - DNA, 20 bp, synthetic construct
  misc_feature 1..20: note = CRISPR gRNA sequence
  source 1..20: mol_type = other DNA
atcatttgtcctcaaggcag

SEQ ID NO: 35102 - DNA, 20 bp, synthetic construct
  misc_feature 1..20: note = CRISPR gRNA sequence
  source 1..20: mol_type = other DNA
gtcctcaaggcagggagact

SEQ ID NO: 35103 - DNA, 20 bp, synthetic construct
  misc_feature 1..20: note = CRISPR gRNA sequence
  source 1..20: mol_type = other DNA
tcctcaaggcagggagacta

SEQ ID NO: 35104 - DNA, 20 bp, synthetic construct
  misc_feature 1..20: note = CRISPR gRNA sequence
  source 1..20: mol_type = other DNA
aaggcagggagactagaaga

SEQ ID NO: 35105 - DNA, 20 bp, synthetic construct
  misc_feature 1..20: note = CRISPR gRNA sequence
  source 1..20: mol_type = other DNA
gaagacgtgcgtgcatgtgc

SEQ ID NO: 35106 - DNA, 20 bp, synthetic construct
  misc_feature 1..20: note = CRISPR gRNA sequence
  source 1..20: mol_type = other DNA
catgcatgtgtgtgcatgtg

SEQ ID NO: 35107 - DNA, 20 bp, synthetic construct
  misc_feature 1..20: note = CRISPR gRNA sequence
  source 1..20: mol_type = other DNA
cgtgtcaggagaggtctgga

SEQ ID NO: 35108 - DNA, 20 bp, synthetic construct
  misc_feature 1..20: note = CRISPR gRNA sequence
  source 1..20: mol_type = other DNA
gtgtcaggagaggtctggag

SEQ ID NO: 35109 - DNA, 20 bp, synthetic construct
  misc_feature 1..20: note = CRISPR gRNA sequence
  source 1..20: mol_type = other DNA
gagatattgctattggttgg

SEQ ID NO: 35110 - DNA, 20 bp, synthetic construct
  misc_feature 1..20: note = CRISPR gRNA sequence
  source 1..20: mol_type = other DNA
ctattggttggctctaaatc

SEQ ID NO: 35111 - DNA, 20 bp, synthetic construct
  misc_feature 1..20: note = CRISPR gRNA sequence
  source 1..20: mol_type = other DNA
ttggttggctctaaatcccc

SEQ ID NO: 35112 - DNA, 20 bp, synthetic construct
  misc_feature 1..20: note = CRISPR gRNA sequence
  source 1..20: mol_type = other DNA
gttggctctaaatccccttt

SEQ ID NO: 35113 - DNA, 20 bp, synthetic construct
  misc_feature 1..20: note = CRISPR gRNA sequence
  source 1..20: mol_type = other DNA
gctctaaatcccctttctga

SEQ ID NO: 35114 - DNA, 20 bp, synthetic construct
  misc_feature 1..20: note = CRISPR gRNA sequence
  source 1..20: mol_type = other DNA
taaatcccctttctgacctg

SEQ ID NO: 35115 - DNA, 20 bp, synthetic construct
  misc_feature 1..20: note = CRISPR gRNA sequence
  source 1..20: mol_type = other DNA
aatcccctttctgacctgca

SEQ ID NO: 35116 - DNA, 20 bp, synthetic construct
  misc_feature 1..20: note = CRISPR gRNA sequence
  source 1..20: mol_type = other DNA
tctgacctgcaagctcctca

SEQ ID NO: 35117 - DNA, 20 bp, synthetic construct
  misc_feature 1..20: note = CRISPR gRNA sequence
  source 1..20: mol_type = other DNA
ctgacctgcaagctcctcag

SEQ ID NO: 35118 - DNA, 20 bp, synthetic construct
  misc_feature 1..20: note = CRISPR gRNA sequence
  source 1..20: mol_type = other DNA
tgacctgcaagctcctcagc

SEQ ID NO: 35119 - DNA, 20 bp, synthetic construct
  misc_feature 1..20: note = CRISPR gRNA sequence
  source 1..20: mol_type = other DNA
acctgcaagctcctcagctg

SEQ ID NO: 35120 - DNA, 20 bp, synthetic construct
  misc_feature 1..20: note = CRISPR gRNA sequence
  source 1..20: mol_type = other DNA
caagctcctcagctgtgcca

SEQ ID NO: 35121 - DNA, 20 bp, synthetic construct
  misc_feature 1..20: note = CRISPR gRNA sequence
  source 1..20: mol_type = other DNA
ctcagctgtgccacaggggc

SEQ ID NO: 35122 - DNA, 20 bp, synthetic construct
  misc_feature 1..20: note = CRISPR gRNA sequence
  source 1..20: mol_type = other DNA
agctgtgccacaggggcttg

SEQ ID NO: 35123 - DNA, 20 bp, synthetic construct
  misc_feature 1..20: note = CRISPR gRNA sequence
  source 1..20: mol_type = other DNA
tgccacaggggcttggctgc

SEQ ID NO: 35124 - DNA, 20 bp, synthetic construct
  misc_feature 1..20: note = CRISPR gRNA sequence
  source 1..20: mol_type = other DNA
ggctgcaaaatcaaaagttg

SEQ ID NO: 35125 - DNA, 20 bp, synthetic construct
  misc_feature 1..20: note = CRISPR gRNA sequence
  source 1..20: mol_type = other DNA
gctgcaaaatcaaaagttga

SEQ ID NO: 35126 - DNA, 20 bp, synthetic construct
  misc_feature 1..20: note = CRISPR gRNA sequence
  source 1..20: mol_type = other DNA
caaaatcaaaagttgaatcc

SEQ ID NO: 35127 - DNA, 20 bp, synthetic construct
  misc_feature 1..20: note = CRISPR gRNA sequence
  source 1..20: mol_type = other DNA
aatccagtcgataggcctat

SEQ ID NO: 35128 - DNA, 20 bp, synthetic construct
  misc_feature 1..20: note = CRISPR gRNA sequence
  source 1..20: mol_type = other DNA
tttgttttgtttcccaagcc

SEQ ID NO: 35129 - DNA, 20 bp, synthetic construct
  misc_feature 1..20: note = CRISPR gRNA sequence
  source 1..20: mol_type = other DNA
gttttgtttcccaagccaat

SEQ ID NO: 35130 - DNA, 20 bp, synthetic construct
  misc_feature 1..20: note = CRISPR gRNA sequence
  source 1..20: mol_type = other DNA
ttttgtttcccaagccaata

SEQ ID NO: 35131 - DNA, 20 bp, synthetic construct
  misc_feature 1..20: note = CRISPR gRNA sequence
  source 1..20: mol_type = other DNA
tgtttcccaagccaatataa

SEQ ID NO: 35132 - DNA, 20 bp, synthetic construct
  misc_feature 1..20: note = CRISPR gRNA sequence
  source 1..20: mol_type = other DNA
gtttcccaagccaatataag

SEQ ID NO: 35133 - DNA, 20 bp, synthetic construct
  misc_feature 1..20: note = CRISPR gRNA sequence
  source 1..20: mol_type = other DNA
tttcccaagccaatataagt

SEQ ID NO: 35134 - DNA, 20 bp, synthetic construct
  misc_feature 1..20: note = CRISPR gRNA sequence
  source 1..20: mol_type = other DNA
cccaagccaatataagtgtg

SEQ ID NO: 35135 - DNA, 20 bp, synthetic construct
  misc_feature 1..20: note = CRISPR gRNA sequence
  source 1..20: mol_type = other DNA
ccaagccaatataagtgtgt

SEQ ID NO: 35136 - DNA, 20 bp, synthetic construct
  misc_feature 1..20: note = CRISPR gRNA sequence
  source 1..20: mol_type = other DNA
aatcaccatcacaatgtctc

SEQ ID NO: 35137 - DNA, 20 bp, synthetic construct
  misc_feature 1..20: note = CRISPR gRNA sequence
  source 1..20: mol_type = other DNA
tatatagagtacacacaatt

SEQ ID NO: 35138 - DNA, 20 bp, synthetic construct
  misc_feature 1..20: note = CRISPR gRNA sequence
  source 1..20: mol_type = other DNA
tatagagtacacacaattgt

SEQ ID NO: 35139 - DNA, 20 bp, synthetic construct
  misc_feature 1..20: note = CRISPR gRNA sequence
  source 1..20: mol_type = other DNA
ttaccagaggccccactact

SEQ ID NO: 35140 - DNA, 20 bp, synthetic construct
  misc_feature 1..20: note = CRISPR gRNA sequence
  source 1..20: mol_type = other DNA
ccagaggccccactactccc

SEQ ID NO: 35141 - DNA, 20 bp, synthetic construct
  misc_feature 1..20: note = CRISPR gRNA sequence
  source 1..20: mol_type = other DNA
ctccctattgccttctgcct

SEQ ID NO: 35142 - DNA, 20 bp, synthetic construct
  misc_feature 1..20: note = CRISPR gRNA sequence
  source 1..20: mol_type = other DNA
cctattgccttctgcctgga

SEQ ID NO: 35143 - DNA, 20 bp, synthetic construct
  misc_feature 1..20: note = CRISPR gRNA sequence
  source 1..20: mol_type = other DNA
ttgccttctgcctggacaca

SEQ ID NO: 35144 - DNA, 20 bp, synthetic construct
  misc_feature 1..20: note = CRISPR gRNA sequence
  source 1..20: mol_type = other DNA
ccttctgcctggacacattt

SEQ ID NO: 35145 - DNA, 20 bp, synthetic construct
  misc_feature 1..20: note = CRISPR gRNA sequence
  source 1..20: mol_type = other DNA
ctgcctggacacattttaca

SEQ ID NO: 35146 - DNA, 20 bp, synthetic construct
  misc_feature 1..20: note = CRISPR gRNA sequence
  source 1..20: mol_type = other DNA
tgcctggacacattttacat

SEQ ID NO: 35147 - DNA, 20 bp, synthetic construct
  misc_feature 1..20: note = CRISPR gRNA sequence
  source 1..20: mol_type = other DNA
cctggacacattttacatca

SEQ ID NO: 35148 - DNA, 20 bp, synthetic construct
  misc_feature 1..20: note = CRISPR gRNA sequence
  source 1..20: mol_type = other DNA
gacacattttacatcattat

SEQ ID NO: 35149 - DNA, 20 bp, synthetic construct
  misc_feature 1..20: note = CRISPR gRNA sequence
  source 1..20: mol_type = other DNA
tacatcattatggccccttt

SEQ ID NO: 35150 - DNA, 20 bp, synthetic construct
  misc_feature 1..20: note = CRISPR gRNA sequence
  source 1..20: mol_type = other DNA
acatcattatggcccctttg

SEQ ID NO: 35151 - DNA, 20 bp, synthetic construct
  misc_feature 1..20: note = CRISPR gRNA sequence
  source 1..20: mol_type = other DNA
catcattatggcccctttgg

SEQ ID NO: 35152 - DNA, 20 bp, synthetic construct
  misc_feature 1..20: note = CRISPR gRNA sequence
  source 1..20: mol_type = other DNA
tggcccctttggtatttgga

SEQ ID NO: 35153 - DNA, 20 bp, synthetic construct
  misc_feature 1..20: note = CRISPR gRNA sequence
  source 1..20: mol_type = other DNA
tggtatttggatttgccacc

SEQ ID NO: 35154 - DNA, 20 bp, synthetic construct
  misc_feature 1..20: note = CRISPR gRNA sequence
  source 1..20: mol_type = other DNA
ggtatttggatttgccaccc

SEQ ID NO: 35155 - DNA, 20 bp, synthetic construct
  misc_feature 1..20: note = CRISPR gRNA sequence
  source 1..20: mol_type = other DNA
gtatttggatttgccaccct

SEQ ID NO: 35156 - DNA, 20 bp, synthetic construct
  misc_feature 1..20: note = CRISPR gRNA sequence
  source 1..20: mol_type = other DNA
ggatttgccacccttggctt

SEQ ID NO: 35157 - DNA, 20 bp, synthetic construct
  misc_feature 1..20: note = CRISPR gRNA sequence
  source 1..20: mol_type = other DNA
gatttgccacccttggcttg

SEQ ID NO: 35158 - DNA, 20 bp, synthetic construct
  misc_feature 1..20: note = CRISPR gRNA sequence
  source 1..20: mol_type = other DNA
gccacccttggcttggaggc

SEQ ID NO: 35159 - DNA, 20 bp, synthetic construct
  misc_feature 1..20: note = CRISPR gRNA sequence
  source 1..20: mol_type = other DNA
ccacccttggcttggaggcc

SEQ ID NO: 35160 - DNA, 20 bp, synthetic construct
  misc_feature 1..20: note = CRISPR gRNA sequence
  source 1..20: mol_type = other DNA
ggcttggaggcccttgcagg

SEQ ID NO: 35161 - DNA, 20 bp, synthetic construct
  misc_feature 1..20: note = CRISPR gRNA sequence
  source 1..20: mol_type = other DNA
gcttggaggcccttgcaggt

SEQ ID NO: 35162 - DNA, 20 bp, synthetic construct
  misc_feature 1..20: note = CRISPR gRNA sequence
  source 1..20: mol_type = other DNA
ggaggcccttgcaggtccca

SEQ ID NO: 35163 - DNA, 20 bp, synthetic construct
  misc_feature 1..20: note = CRISPR gRNA sequence
  source 1..20: mol_type = other DNA
gaggcccttgcaggtcccaa

SEQ ID NO: 35164 - DNA, 20 bp, synthetic construct
  misc_feature 1..20: note = CRISPR gRNA sequence
  source 1..20: mol_type = other DNA
gcaggtcccaagataatggc

SEQ ID NO: 35165 - DNA, 20 bp, synthetic construct
  misc_feature 1..20: note = CRISPR gRNA sequence
  source 1..20: mol_type = other DNA
caggtcccaagataatggct

SEQ ID NO: 35166 - DNA, 20 bp, synthetic construct
  misc_feature 1..20: note = CRISPR gRNA sequence
  source 1..20: mol_type = other DNA
gggagggatgggtgactggg

SEQ ID NO: 35167 - DNA, 20 bp, synthetic construct
  misc_feature 1..20: note = CRISPR gRNA sequence
  source 1..20: mol_type = other DNA
ggagggatgggtgactgggg

SEQ ID NO: 35168 - DNA, 20 bp, synthetic construct
  misc_feature 1..20: note = CRISPR gRNA sequence
  source 1..20: mol_type = other DNA
gggcagggagaggcaggatt

SEQ ID NO: 35169 - DNA, 20 bp, synthetic construct
  misc_feature 1..20: note = CRISPR gRNA sequence
  source 1..20: mol_type = other DNA
aattatgtcctgtcctgcaa

SEQ ID NO: 35170 - DNA, 20 bp, synthetic construct
  misc_feature 1..20: note = CRISPR gRNA sequence
  source 1..20: mol_type = other DNA
tgtcctgtcctgcaatggaa

SEQ ID NO: 35171 - DNA, 20 bp, synthetic construct
  misc_feature 1..20: note = CRISPR gRNA sequence
  source 1..20: mol_type = other DNA
tcctgcaatggaattgaggt

SEQ ID NO: 35172 - DNA, 20 bp, synthetic construct
  misc_feature 1..20: note = CRISPR gRNA sequence
  source 1..20: mol_type = other DNA
caatggaattgaggtgtaca

SEQ ID NO: 35173 - DNA, 20 bp, synthetic construct
  misc_feature 1..20: note = CRISPR gRNA sequence
  source 1..20: mol_type = other DNA
aggtgtacagtagggtcttt

SEQ ID NO: 35174 - DNA, 20 bp, synthetic construct
  misc_feature 1..20: note = CRISPR gRNA sequence
  source 1..20: mol_type = other DNA
tttctacagagggtcttgga

SEQ ID NO: 35175 - DNA, 20 bp, synthetic construct
  misc_feature 1..20: note = CRISPR gRNA sequence
  source 1..20: mol_type = other DNA
ttctacagagggtcttggag

SEQ ID NO: 35176 - DNA, 20 bp, synthetic construct
  misc_feature 1..20: note = CRISPR gRNA sequence
  source 1..20: mol_type = other DNA
tctacagagggtcttggagg

SEQ ID NO: 35177 - DNA, 20 bp, synthetic construct
  misc_feature 1..20: note = CRISPR gRNA sequence
  source 1..20: mol_type = other DNA
ctacagagggtcttggaggg

SEQ ID NO: 35178 - DNA, 20 bp, synthetic construct
  misc_feature 1..20: note = CRISPR gRNA sequence
  source 1..20: mol_type = other DNA
tacagagggtcttggagggg

SEQ ID NO: 35179 - DNA, 20 bp, synthetic construct
  misc_feature 1..20: note = CRISPR gRNA sequence
  source 1..20: mol_type = other DNA
cagagggtcttggaggggac

SEQ ID NO: 35180 - DNA, 20 bp, synthetic construct
  misc_feature 1..20: note = CRISPR gRNA sequence
  source 1..20: mol_type = other DNA
ggaggggactggccctgggt

SEQ ID NO: 35181 - DNA, 20 bp, synthetic construct
  misc_feature 1..20: note = CRISPR gRNA sequence
  source 1..20: mol_type = other DNA
gaggggactggccctgggta

SEQ ID NO: 35182 - DNA, 20 bp, synthetic construct
  misc_feature 1..20: note = CRISPR gRNA sequence
  source 1..20: mol_type = other DNA
gccctgggtacccaaacagg

SEQ ID NO: 35183 - DNA, 20 bp, synthetic construct
  misc_feature 1..20: note = CRISPR gRNA sequence
  source 1..20: mol_type = other DNA
ggtacccaaacaggccagtt

SEQ ID NO: 35184 - DNA, 20 bp, synthetic construct
  misc_feature 1..20: note = CRISPR gRNA sequence
  source 1..20: mol_type = other DNA
cacacagagaaggagcagga

SEQ ID NO: 35185 - DNA, 20 bp, synthetic construct
  misc_feature 1..20: note = CRISPR gRNA sequence
  source 1..20: mol_type = other DNA
aagttgcagcatctggggtg

SEQ ID NO: 35186 - DNA, 20 bp, synthetic construct
  misc_feature 1..20: note = CRISPR gRNA sequence
  source 1..20: mol_type = other DNA
cagcatctggggtgttgggt

SEQ ID NO: 35187 - DNA, 20 bp, synthetic construct
  misc_feature 1..20: note = CRISPR gRNA sequence
  source 1..20: mol_type = other DNA
gggtgttgggtgcactttcc

SEQ ID NO: 35188 - DNA, 20 bp, synthetic construct
  misc_feature 1..20: note = CRISPR gRNA sequence
  source 1..20: mol_type = other DNA
ggtgcactttcccagctctg

SEQ ID NO: 35189 - DNA, 20 bp, synthetic construct
  misc_feature 1..20: note = CRISPR gRNA sequence
  source 1..20: mol_type = other DNA
tcccagctctgctgccagct

SEQ ID NO: 35190 - DNA, 20 bp, synthetic construct
  misc_feature 1..20: note = CRISPR gRNA sequence
  source 1..20: mol_type = other DNA
cccagctctgctgccagctc

SEQ ID NO: 35191 - DNA, 20 bp, synthetic construct
  misc_feature 1..20: note = CRISPR gRNA sequence
  source 1..20: mol_type = other DNA
ccagctctgctgccagctca

SEQ ID NO: 35192 - DNA, 20 bp, synthetic construct
  misc_feature 1..20: note = CRISPR gRNA sequence
  source 1..20: mol_type = other DNA
tgctgccagctcagatggaa

SEQ ID NO: 35193 - DNA, 20 bp, synthetic construct
  misc_feature 1..20: note = CRISPR gRNA sequence
  source 1..20: mol_type = other DNA
ctgccagctcagatggaaag

SEQ ID NO: 35194 - DNA, 20 bp, synthetic construct
  misc_feature 1..20: note = CRISPR gRNA sequence
  source 1..20: mol_type = other DNA
ccagctcagatggaaaggtg

SEQ ID NO: 35195 - DNA, 20 bp, synthetic construct
  misc_feature 1..20: note = CRISPR gRNA sequence
  source 1..20: mol_type = other DNA
agatggaaaggtgattaaga

SEQ ID NO: 35196 - DNA, 20 bp, synthetic construct
  misc_feature 1..20: note = CRISPR gRNA sequence
  source 1..20: mol_type = other DNA
agaggtaagctgtctgagat

SEQ ID NO: 35197 - DNA, 20 bp, synthetic construct
  misc_feature 1..20: note = CRISPR gRNA sequence
  source 1..20: mol_type = other DNA
tctgagatcacacctgtaat

SEQ ID NO: 35198 - DNA, 20 bp, synthetic construct
  misc_feature 1..20: note = CRISPR gRNA sequence
  source 1..20: mol_type = other DNA
agatcacacctgtaatccca

SEQ ID NO: 35199 - DNA, 20 bp, synthetic construct
  misc_feature 1..20: note = CRISPR gRNA sequence
  source 1..20: mol_type = other DNA
taatcccagcactttgggag

SEQ ID NO: 35200 - DNA, 20 bp, synthetic construct
  misc_feature 1..20: note = CRISPR gRNA sequence
  source 1..20: mol_type = other DNA
tgggaggctgaggagggagg

SEQ ID NO: 35201 - DNA, 20 bp, synthetic construct
  misc_feature 1..20: note = CRISPR gRNA sequence
  source 1..20: mol_type = other DNA
gggaggctgaggagggagga

SEQ ID NO: 35202 - DNA, 20 bp, synthetic construct
  misc_feature 1..20: note = CRISPR gRNA sequence
  source 1..20: mol_type = other DNA
ggaggctgaggagggaggat

SEQ ID NO: 35203 - DNA, 20 bp, synthetic construct
  misc_feature 1..20: note = CRISPR gRNA sequence
  source 1..20: mol_type = other DNA
aggagggaggatgacttgag

SEQ ID NO: 35204 - DNA, 20 bp, synthetic construct
  misc_feature 1..20: note = CRISPR gRNA sequence
  source 1..20: mol_type = other DNA
gaggccaggagtttgagacc

SEQ ID NO: 35205 - DNA, 20 bp, synthetic construct
  misc_feature 1..20: note = CRISPR gRNA sequence
  source 1..20: mol_type = other DNA
aggccaggagtttgagacca

SEQ ID NO: 35206 - DNA, 20 bp, synthetic construct
  misc_feature 1..20: note = CRISPR gRNA sequence
  source 1..20: mol_type = other DNA
gagaccagcctgggcaacat

SEQ ID NO: 35207 - DNA, 20 bp, synthetic construct
  misc_feature 1..20: note = CRISPR gRNA sequence
  source 1..20: mol_type = other DNA
agaccagcctgggcaacata

SEQ ID NO: 35208 - DNA, 20 bp, synthetic construct
  misc_feature 1..20: note = CRISPR gRNA sequence
  source 1..20: mol_type = other DNA
ggcaacatagtgaaacccca

SEQ ID NO: 35209 - DNA, 20 bp, synthetic construct
  misc_feature 1..20: note = CRISPR gRNA sequence
  source 1..20: mol_type = other DNA
ttcagaaataaaagatacaa

SEQ ID NO: 35210 - DNA, 20 bp, synthetic construct
  misc_feature 1..20: note = CRISPR gRNA sequence
  source 1..20: mol_type = other DNA
cagaaataaaagatacaaaa

SEQ ID NO: 35211 - DNA, 20 bp, synthetic construct
  misc_feature 1..20: note = CRISPR gRNA sequence
  source 1..20: mol_type = other DNA
agaaataaaagatacaaaaa

SEQ ID NO: 35212 - DNA, 20 bp, synthetic construct
  misc_feature 1..20: note = CRISPR gRNA sequence
  source 1..20: mol_type = other DNA
gctgggtgtggtggagtgcc

SEQ ID NO: 35213 - DNA, 20 bp, synthetic construct
  misc_feature 1..20: note = CRISPR gRNA sequence
  source 1..20: mol_type = other DNA
ggtgtggtggagtgcccttg

SEQ ID NO: 35214 - DNA, 20 bp, synthetic construct
  misc_feature 1..20: note = CRISPR gRNA sequence
  source 1..20: mol_type = other DNA
gtagtctcggctacttggga

SEQ ID NO: 35215 - DNA, 20 bp, synthetic construct
  misc_feature 1..20: note = CRISPR gRNA sequence
  source 1..20: mol_type = other DNA
tagtctcggctacttgggag

SEQ ID NO: 35216 - DNA, 20 bp, synthetic construct
  misc_feature 1..20: note = CRISPR gRNA sequence
  source 1..20: mol_type = other DNA
ggctacttgggaggctgagg

SEQ ID NO: 35217 - DNA, 20 bp, synthetic construct
  misc_feature 1..20: note = CRISPR gRNA sequence
  source 1..20: mol_type = other DNA
cttgggaggctgaggcagga

SEQ ID NO: 35218 - DNA, 20 bp, synthetic construct
  misc_feature 1..20: note = CRISPR gRNA sequence
  source 1..20: mol_type = other DNA
gggaggctgaggcaggagga

SEQ ID NO: 35219 - DNA, 20 bp, synthetic construct
  misc_feature 1..20: note = CRISPR gRNA sequence
  source 1..20: mol_type = other DNA
ggaggctgaggcaggaggat

SEQ ID NO: 35220 - DNA, 20 bp, synthetic construct
  misc_feature 1..20: note = CRISPR gRNA sequence
  source 1..20: mol_type = other DNA
aggcaggaggatggcttgag

SEQ ID NO: 35221 - DNA, 20 bp, synthetic construct
  misc_feature 1..20: note = CRISPR gRNA sequence
  source 1..20: mol_type = other DNA
gagctcaggagcttgaggct

SEQ ID NO: 35222 - DNA, 20 bp, synthetic construct
  misc_feature 1..20: note = CRISPR gRNA sequence
  source 1..20: mol_type = other DNA
agctcaggagcttgaggctg

SEQ ID NO: 35223 - DNA, 20 bp, synthetic construct
  misc_feature 1..20: note = CRISPR gRNA sequence
  source 1..20: mol_type = other DNA
aggagcttgaggctgcagtg

SEQ ID NO: 35224 - DNA, 20 bp, synthetic construct
  misc_feature 1..20: note = CRISPR gRNA sequence
  source 1..20: mol_type = other DNA
gaggctgcagtgagcaatga

SEQ ID NO: 35225 - DNA, 20 bp, synthetic construct
  misc_feature 1..20: note = CRISPR gRNA sequence
  source 1..20: mol_type = other DNA
aggctgcagtgagcaatgac

SEQ ID NO: 35226 - DNA, 20 bp, synthetic construct
  misc_feature 1..20: note = CRISPR gRNA sequence
  source 1..20: mol_type = other DNA
cagtgagcaatgactgtgcc

SEQ ID NO: 35227 - DNA, 20 bp, synthetic construct
  misc_feature 1..20: note = CRISPR gRNA sequence
  source 1..20: mol_type = other DNA
tgccactgcactccaacctg

SEQ ID NO: 35228 - DNA, 20 bp, synthetic construct
  misc_feature 1..20: note = CRISPR gRNA sequence
  source 1..20: mol_type = other DNA
cactccaacctgggcaacag

SEQ ID NO: 35229 - DNA, 20 bp, synthetic construct
  misc_feature 1..20: note = CRISPR gRNA sequence
  source 1..20: mol_type = other DNA
caacctgggcaacagagtga

SEQ ID NO: 35230 - DNA, 20 bp, synthetic construct
  misc_feature 1..20: note = CRISPR gRNA sequence
  source 1..20: mol_type = other DNA
ggcaacagagtgagactttg

SEQ ID NO: 35231 - DNA, 20 bp, synthetic construct
  misc_feature 1..20: note = CRISPR gRNA sequence
  source 1..20: mol_type = other DNA
tgtctcataaatgaaaggat

SEQ ID NO: 35232 - DNA, 20 bp, synthetic construct
  misc_feature 1..20: note = CRISPR gRNA sequence
  source 1..20: mol_type = other DNA
gtctcataaatgaaaggatg

SEQ ID NO: 35233 - DNA, 20 bp, synthetic construct
  misc_feature 1..20: note = CRISPR gRNA sequence
  source 1..20: mol_type = other DNA
tctcataaatgaaaggatga

SEQ ID NO: 35234 - DNA, 20 bp, synthetic construct
  misc_feature 1..20: note = CRISPR gRNA sequence
  source 1..20: mol_type = other DNA
ataaatgaaaggatgaatga

SEQ ID NO: 35235 - DNA, 20 bp, synthetic construct
  misc_feature 1..20: note = CRISPR gRNA sequence
  source 1..20: mol_type = other DNA
cctgggaactgtgggatgca

SEQ ID NO: 35236 - DNA, 20 bp, synthetic construct
  misc_feature 1..20: note = CRISPR gRNA sequence
  source 1..20: mol_type = other DNA
ggaactgtgggatgcaaaga

SEQ ID NO: 35237 - DNA, 20 bp, synthetic construct
  misc_feature 1..20: note = CRISPR gRNA sequence
  source 1..20: mol_type = other DNA
tgggatgcaaagagctgctc

SEQ ID NO: 35238 - DNA, 20 bp, synthetic construct
  misc_feature 1..20: note = CRISPR gRNA sequence
  source 1..20: mol_type = other DNA
ctccctgctgacacctgcct

SEQ ID NO: 35239 - DNA, 20 bp, synthetic construct
  misc_feature 1..20: note = CRISPR gRNA sequence
  source 1..20: mol_type = other DNA
cctgctgacacctgcctgct

SEQ ID NO: 35240 - DNA, 20 bp, synthetic construct
  misc_feature 1..20: note = CRISPR gRNA sequence
  source 1..20: mol_type = other DNA
ctgacacctgcctgctgctc

SEQ ID NO: 35241 - DNA, 20 bp, synthetic construct
  misc_feature 1..20: note = CRISPR gRNA sequence
  source 1..20: mol_type = other DNA
acacctgcctgctgctcctt

SEQ ID NO: 35242 - DNA, 20 bp, synthetic construct
  misc_feature 1..20: note = CRISPR gRNA sequence
  source 1..20: mol_type = other DNA
cctgctgctcctttttgcca

SEQ ID NO: 35243 - DNA, 20 bp, synthetic construct
  misc_feature 1..20: note = CRISPR gRNA sequence
  source 1..20: mol_type = other DNA
ctgctcctttttgccatccc

SEQ ID NO: 35244 - DNA, 20 bp, synthetic construct
  misc_feature 1..20: note = CRISPR gRNA sequence
  source 1..20: mol_type = other DNA
ctcctttttgccatcccaat

SEQ ID NO: 35245 - DNA, 20 bp, synthetic construct
  misc_feature 1..20: note = CRISPR gRNA sequence
  source 1..20: mol_type = other DNA
ctttttgccatcccaattcc

SEQ ID NO: 35246 - DNA, 20 bp, synthetic construct
  misc_feature 1..20: note = CRISPR gRNA sequence
  source 1..20: mol_type = other DNA
tttgccatcccaattccagc

SEQ ID NO: 35247 - DNA, 20 bp, synthetic construct
  misc_feature 1..20: note = CRISPR gRNA sequence
  source 1..20: mol_type = other DNA
ttgccatcccaattccagca

SEQ ID NO: 35248 - DNA, 20 bp, synthetic construct
  misc_feature 1..20: note = CRISPR gRNA sequence
  source 1..20: mol_type = other DNA
tgccatcccaattccagcac

SEQ ID NO: 35249 - DNA, 20 bp, synthetic construct
  misc_feature 1..20: note = CRISPR gRNA sequence
  source 1..20: mol_type = other DNA
gccatcccaattccagcacc

SEQ ID NO: 35250 - DNA, 20 bp, synthetic construct
  misc_feature 1..20: note = CRISPR gRNA sequence
  source 1..20: mol_type = other DNA
ccatcccaattccagcaccg

SEQ ID NO: 35251 - DNA, 20 bp, synthetic construct
  misc_feature 1..20: note = CRISPR gRNA sequence
  source 1..20: mol_type = other DNA
cagcaccgttgaatggattt

SEQ ID NO: 35252 - DNA, 20 bp, synthetic construct
  misc_feature 1..20: note = CRISPR gRNA sequence
  source 1..20: mol_type = other DNA
aatggatttccattgcagct

SEQ ID NO: 35253 - DNA, 20 bp, synthetic construct
  misc_feature 1..20: note = CRISPR gRNA sequence
  source 1..20: mol_type = other DNA
ccattgcagctccctgccct

SEQ ID NO: 35254 - DNA, 20 bp, synthetic construct
  misc_feature 1..20: note = CRISPR gRNA sequence
  source 1..20: mol_type = other DNA
cattgcagctccctgccctt

SEQ ID NO: 35255 - DNA, 20 bp, synthetic construct
  misc_feature 1..20: note = CRISPR gRNA sequence
  source 1..20: mol_type = other DNA
cagctccctgccctttgggt

SEQ ID NO: 35256 - DNA, 20 bp, synthetic construct
  misc_feature 1..20: note = CRISPR gRNA sequence
  source 1..20: mol_type = other DNA
cctgccctttgggtttgaac

SEQ ID NO: 35257 - DNA, 20 bp, synthetic construct
  misc_feature 1..20: note = CRISPR gRNA sequence
  source 1..20: mol_type = other DNA
ccctttgggtttgaaccaac

SEQ ID NO: 35258 - DNA, 20 bp, synthetic construct
  misc_feature 1..20: note = CRISPR gRNA sequence
  source 1..20: mol_type = other DNA
tgggtttgaaccaaccagcc

SEQ ID NO: 35259 - DNA, 20 bp, synthetic construct
  misc_feature 1..20: note = CRISPR gRNA sequence
  source 1..20: mol_type = other DNA
gggtttgaaccaaccagcct

SEQ ID NO: 35260 - DNA, 20 bp, synthetic construct
  misc_feature 1..20: note = CRISPR gRNA sequence
  source 1..20: mol_type = other DNA
ggtttgaaccaaccagcctc

SEQ ID NO: 35261 - DNA, 20 bp, synthetic construct
  misc_feature 1..20: note = CRISPR gRNA sequence
  source 1..20: mol_type = other DNA
gaaccaaccagcctctggca

SEQ ID NO: 35262 - DNA, 20 bp, synthetic construct
  misc_feature 1..20: note = CRISPR gRNA sequence
  source 1..20: mol_type = other DNA
aaccaaccagcctctggcaa

SEQ ID NO: 35263 - DNA, 20 bp, synthetic construct
  misc_feature 1..20: note = CRISPR gRNA sequence
  source 1..20: mol_type = other DNA
tggcaaacaaagtaacttca

SEQ ID NO: 35264 - DNA, 20 bp, synthetic construct
  misc_feature 1..20: note = CRISPR gRNA sequence
  source 1..20: mol_type = other DNA
gcaaacaaagtaacttcaga

SEQ ID NO: 35265 - DNA, 20 bp, synthetic construct
  misc_feature 1..20: note = CRISPR gRNA sequence
  source 1..20: mol_type = other DNA
cagagcaggaaagtggaaaa

SEQ ID NO: 35266 - DNA, 20 bp, synthetic construct
  misc_feature 1..20: note = CRISPR gRNA sequence
  source 1..20: mol_type = other DNA
agagcaggaaagtggaaaac

SEQ ID NO: 35267 - DNA, 20 bp, synthetic construct
  misc_feature 1..20: note = CRISPR gRNA sequence
  source 1..20: mol_type = other DNA
aaattggctgcaatccctag

SEQ ID NO: 35268 - DNA, 20 bp, synthetic construct
  misc_feature 1..20: note = CRISPR gRNA sequence
  source 1..20: mol_type = other DNA
gctgcaatccctagccaaag

SEQ ID NO: 35269 - DNA, 20 bp, synthetic construct
  misc_feature 1..20: note = CRISPR gRNA sequence
  source 1..20: mol_type = other DNA
caatccctagccaaagggct

SEQ ID NO: 35270 - DNA, 20 bp, synthetic construct
  misc_feature 1..20: note = CRISPR gRNA sequence
  source 1..20: mol_type = other DNA
gccaaagggcttctcagcag

SEQ ID NO: 35271 - DNA, 20 bp, synthetic construct
  misc_feature 1..20: note = CRISPR gRNA sequence
  source 1..20: mol_type = other DNA
ctcagcagttggaggcaggt

SEQ ID NO: 35272 - DNA, 20 bp, synthetic construct
  misc_feature 1..20: note = CRISPR gRNA sequence
  source 1..20: mol_type = other DNA
tcagcagttggaggcaggtt

SEQ ID NO: 35273 - DNA, 20 bp, synthetic construct
  misc_feature 1..20: note = CRISPR gRNA sequence
  source 1..20: mol_type = other DNA
agcagttggaggcaggttaa

SEQ ID NO: 35274 - DNA, 20 bp, synthetic construct
  misc_feature 1..20: note = CRISPR gRNA sequence
  source 1..20: mol_type = other DNA
gaggcaggttaaagaaagaa

SEQ ID NO: 35275 - DNA, 20 bp, synthetic construct
  misc_feature 1..20: note = CRISPR gRNA sequence
  source 1..20: mol_type = other DNA
aagaaagaaggacaagctca

SEQ ID NO: 35276 - DNA, 20 bp, synthetic construct
  misc_feature 1..20: note = CRISPR gRNA sequence
  source 1..20: mol_type = other DNA
agtcacaagtgaaatgagtc

SEQ ID NO: 35277 - DNA, 20 bp, synthetic construct
  misc_feature 1..20: note = CRISPR gRNA sequence
  source 1..20: mol_type = other DNA
tgtgatactataatgtcata

SEQ ID NO: 35278 - DNA, 20 bp, synthetic construct
  misc_feature 1..20: note = CRISPR gRNA sequence
  source 1..20: mol_type = other DNA
taatgtcatatacattacat

SEQ ID NO: 35279 - DNA, 20 bp, synthetic construct
  misc_feature 1..20: note = CRISPR gRNA sequence
  source 1..20: mol_type = other DNA
catcatgtatctgtccaaac

SEQ ID NO: 35280 - DNA, 20 bp, synthetic construct
  misc_feature 1..20: note = CRISPR gRNA sequence
  source 1..20: mol_type = other DNA
tccaaacccacagaatgtac

SEQ ID NO: 35281 - DNA, 20 bp, synthetic construct
  misc_feature 1..20: note = CRISPR gRNA sequence
  source 1..20: mol_type = other DNA
atgtaaacaaaccatggacc

SEQ ID NO: 35282 - DNA, 20 bp, synthetic construct
  misc_feature 1..20: note = CRISPR gRNA sequence
  source 1..20: mol_type = other DNA
gggtaataatgatgcatcaa

SEQ ID NO: 35283 - DNA, 20 bp, synthetic construct
  misc_feature 1..20: note = CRISPR gRNA sequence
  source 1..20: mol_type = other DNA
ggtaataatgatgcatcaat

SEQ ID NO: 35284 - DNA, 20 bp, synthetic construct
  misc_feature 1..20: note = CRISPR gRNA sequence
  source 1..20: mol_type = other DNA
attgattataacaaatgtat

SEQ ID NO: 35285 - DNA, 20 bp, synthetic construct
  misc_feature 1..20: note = CRISPR gRNA sequence
  source 1..20: mol_type = other DNA
attataacaaatgtatcagt

SEQ ID NO: 35286 - DNA, 20 bp, synthetic construct
  misc_feature 1..20: note = CRISPR gRNA sequence
  source 1..20: mol_type = other DNA
taacaaatgtatcagtctgg

SEQ ID NO: 35287 - DNA, 20 bp, synthetic construct
  misc_feature 1..20: note = CRISPR gRNA sequence
  source 1..20: mol_type = other DNA
gtgctgagtgttcatcatgg

SEQ ID NO: 35288 - DNA, 20 bp, synthetic construct
  misc_feature 1..20: note = CRISPR gRNA sequence
  source 1..20: mol_type = other DNA
agtgttcatcatgggggagg

SEQ ID NO: 35289 - DNA, 20 bp, synthetic construct
  misc_feature 1..20: note = CRISPR gRNA sequence
  source 1..20: mol_type = other DNA
atcatgggggaggctatgcc

SEQ ID NO: 35290 - DNA, 20 bp, synthetic construct
  misc_feature 1..20: note = CRISPR gRNA sequence
  source 1..20: mol_type = other DNA
tgcctgtatgggaggacgga

SEQ ID NO: 35291 - DNA, 20 bp, synthetic construct
  misc_feature 1..20: note = CRISPR gRNA sequence
  source 1..20: mol_type = other DNA
tatgggaggacggaggtaga

SEQ ID NO: 35292 - DNA, 20 bp, synthetic construct
  misc_feature 1..20: note = CRISPR gRNA sequence
  source 1..20: mol_type = other DNA
gcttccttgctgtcccagct

SEQ ID NO: 35293 - DNA, 20 bp, synthetic construct
  misc_feature 1..20: note = CRISPR gRNA sequence
  source 1..20: mol_type = other DNA
ccttgctgtcccagcttgag

SEQ ID NO: 35294 - DNA, 20 bp, synthetic construct
  misc_feature 1..20: note = CRISPR gRNA sequence
  source 1..20: mol_type = other DNA
cttgctgtcccagcttgagt

SEQ ID NO: 35295 - DNA, 20 bp, synthetic construct
  misc_feature 1..20: note = CRISPR gRNA sequence
  source 1..20: mol_type = other DNA
gctgtcccagcttgagtgct

SEQ ID NO: 35296 - DNA, 20 bp, synthetic construct
  misc_feature 1..20: note = CRISPR gRNA sequence
  source 1..20: mol_type = other DNA
ctgtcccagcttgagtgctc

SEQ ID NO: 35297 - DNA, 20 bp, synthetic construct
  misc_feature 1..20: note = CRISPR gRNA sequence
  source 1..20: mol_type = other DNA
tcccagcttgagtgctccct

SEQ ID NO: 35298 - DNA, 20 bp, synthetic construct
  misc_feature 1..20: note = CRISPR gRNA sequence
  source 1..20: mol_type = other DNA
gagtgctccctatgggattg

SEQ ID NO: 35299 - DNA, 20 bp, synthetic construct
  misc_feature 1..20: note = CRISPR gRNA sequence
  source 1..20: mol_type = other DNA
agtgctccctatgggattgg

SEQ ID NO: 35300 - DNA, 20 bp, synthetic construct
  misc_feature 1..20: note = CRISPR gRNA sequence
  source 1..20: mol_type = other DNA
cctatgggattggctaagac

SEQ ID NO: 35301 - DNA, 20 bp, synthetic construct
  misc_feature 1..20: note = CRISPR gRNA sequence
  source 1..20: mol_type = other DNA
tgggattggctaagacctct

SEQ ID NO: 35302 - DNA, 20 bp, synthetic construct
  misc_feature 1..20: note = CRISPR gRNA sequence
  source 1..20: mol_type = other DNA
gctaagacctctgttgtgac

SEQ ID NO: 35303 - DNA, 20 bp, synthetic construct
  misc_feature 1..20: note = CRISPR gRNA sequence
  source 1..20: mol_type = other DNA
agacctctgttgtgactgca

SEQ ID NO: 35304 - DNA, 20 bp, synthetic construct
  misc_feature 1..20: note = CRISPR gRNA sequence
  source 1..20: mol_type = other DNA
tgttgtgactgcattgcacc

SEQ ID NO: 35305 - DNA, 20 bp, synthetic construct
  misc_feature 1..20: note = CRISPR gRNA sequence
  source 1..20: mol_type = other DNA
ttgtgactgcattgcacctc

SEQ ID NO: 35306 - DNA, 20 bp, synthetic construct
  misc_feature 1..20: note = CRISPR gRNA sequence
  source 1..20: mol_type = other DNA
tgactgcattgcacctcaac

SEQ ID NO: 35307 - DNA, 20 bp, synthetic construct
  misc_feature 1..20: note = CRISPR gRNA sequence
  source 1..20: mol_type = other DNA
cattgcacctcaactcctgc

SEQ ID NO: 35308 - DNA, 20 bp, synthetic construct
  misc_feature 1..20: note = CRISPR gRNA sequence
  source 1..20: mol_type = other DNA
cacctcaactcctgctgctt

SEQ ID NO: 35309 - DNA, 20 bp, synthetic construct
  misc_feature 1..20: note = CRISPR gRNA sequence
  source 1..20: mol_type = other DNA
aactcctgctgcttcccaac

SEQ ID NO: 35310 - DNA, 20 bp, synthetic construct
  misc_feature 1..20: note = CRISPR gRNA sequence
  source 1..20: mol_type = other DNA
ctgctgcttcccaaccctgc

SEQ ID NO: 35311 - DNA, 20 bp, synthetic construct
  misc_feature 1..20: note = CRISPR gRNA sequence
  source 1..20: mol_type = other DNA
ctgcttcccaaccctgcttt

SEQ ID NO: 35312 - DNA, 20 bp, synthetic construct
  misc_feature 1..20: note = CRISPR gRNA sequence
  source 1..20: mol_type = other DNA
cttcccaaccctgctttctt

SEQ ID NO: 35313 - DNA, 20 bp, synthetic construct
  misc_feature 1..20: note = CRISPR gRNA sequence
  source 1..20: mol_type = other DNA
cccaaccctgctttcttccc

SEQ ID NO: 35314 - DNA, 20 bp, synthetic construct
  misc_feature 1..20: note = CRISPR gRNA sequence
  source 1..20: mol_type = other DNA
ccaaccctgctttcttccct

SEQ ID NO: 35315 - DNA, 20 bp, synthetic construct
  misc_feature 1..20: note = CRISPR gRNA sequence
  source 1..20: mol_type = other DNA
ctttcttcccttttccttcg

SEQ ID NO: 35316 - DNA, 20 bp, synthetic construct
  misc_feature 1..20: note = CRISPR gRNA sequence
  source 1..20: mol_type = other DNA
tcttcccttttccttcgggt

SEQ ID NO: 35317 - DNA, 20 bp, synthetic construct
  misc_feature 1..20: note = CRISPR gRNA sequence
  source 1..20: mol_type = other DNA
cttcccttttccttcgggtg

SEQ ID NO: 35318 - DNA, 20 bp, synthetic construct
  misc_feature 1..20: note = CRISPR gRNA sequence
  source 1..20: mol_type = other DNA
ttcccttttccttcgggtgt

SEQ ID NO: 35319 - DNA, 20 bp, synthetic construct
  misc_feature 1..20: note = CRISPR gRNA sequence
  source 1..20: mol_type = other DNA
cccttttccttcgggtgttc

SEQ ID NO: 35320 - DNA, 20 bp, synthetic construct
  misc_feature 1..20: note = CRISPR gRNA sequence
  source 1..20: mol_type = other DNA
ccttttccttcgggtgttcc

SEQ ID NO: 35321 - DNA, 20 bp, synthetic construct
  misc_feature 1..20: note = CRISPR gRNA sequence
  source 1..20: mol_type = other DNA
ttccttcgggtgttccctcc

SEQ ID NO: 35322 - DNA, 20 bp, synthetic construct
  misc_feature 1..20: note = CRISPR gRNA sequence
  source 1..20: mol_type = other DNA
tccttcgggtgttccctcct

SEQ ID NO: 35323 - DNA, 20 bp, synthetic construct
  misc_feature 1..20: note = CRISPR gRNA sequence
  source 1..20: mol_type = other DNA
ccttcgggtgttccctcctg

SEQ ID NO: 35324 - DNA, 20 bp, synthetic construct
  misc_feature 1..20: note = CRISPR gRNA sequence
  source 1..20: mol_type = other DNA
cttcgggtgttccctcctgt

SEQ ID NO: 35325 - DNA, 20 bp, synthetic construct
  misc_feature 1..20: note = CRISPR gRNA sequence
  source 1..20: mol_type = other DNA
cgggtgttccctcctgtgaa

SEQ ID NO: 35326 - DNA, 20 bp, synthetic construct
  misc_feature 1..20: note = CRISPR gRNA sequence
  source 1..20: mol_type = other DNA
gggtgttccctcctgtgaat

SEQ ID NO: 35327 - DNA, 20 bp, synthetic construct
  misc_feature 1..20: note = CRISPR gRNA sequence
  source 1..20: mol_type = other DNA
cctcctgtgaatgtccccag

SEQ ID NO: 35328 - DNA, 20 bp, synthetic construct
  misc_feature 1..20: note = CRISPR gRNA sequence
  source 1..20: mol_type = other DNA
ctgtgaatgtccccagtaaa

SEQ ID NO: 35329 - DNA, 20 bp, synthetic construct
  misc_feature 1..20: note = CRISPR gRNA sequence
  source 1..20: mol_type = other DNA
tgaatgtccccagtaaacct

SEQ ID NO: 35330 - DNA, 20 bp, synthetic construct
  misc_feature 1..20: note = CRISPR gRNA sequence
  source 1..20: mol_type = other DNA
ctatatgcaaatctccatct

SEQ ID NO: 35331 - DNA, 20 bp, synthetic construct
  misc_feature 1..20: note = CRISPR gRNA sequence
  source 1..20: mol_type = other DNA
tatgcaaatctccatctcct

SEQ ID NO: 35332 - DNA, 20 bp, synthetic construct
  misc_feature 1..20: note = CRISPR gRNA sequence
  source 1..20: mol_type = other DNA
catctcctacttggcttccc

SEQ ID NO: 35333 - DNA, 20 bp, synthetic construct
  misc_feature 1..20: note = CRISPR gRNA sequence
  source 1..20: mol_type = other DNA
ctacttggcttcccagacaa

SEQ ID NO: 35334 - DNA, 20 bp, synthetic construct
  misc_feature 1..20: note = CRISPR gRNA sequence
  source 1..20: mol_type = other DNA
cttggcttcccagacaatct

SEQ ID NO: 35335 - DNA, 20 bp, synthetic construct
  misc_feature 1..20: note = CRISPR gRNA sequence
  source 1..20: mol_type = other DNA
ggcttcccagacaatctgac

SEQ ID NO: 35336 - DNA, 20 bp, synthetic construct
  misc_feature 1..20: note = CRISPR gRNA sequence
  source 1..20: mol_type = other DNA
gcttcccagacaatctgacc

SEQ ID NO: 35337 - DNA, 20 bp, synthetic construct
  misc_feature 1..20: note = CRISPR gRNA sequence
  source 1..20: mol_type = other DNA
cccagacaatctgacctgag

SEQ ID NO: 35338 - DNA, 20 bp, synthetic construct
  misc_feature 1..20: note = CRISPR gRNA sequence
  source 1..20: mol_type = other DNA
ccagacaatctgacctgaga

SEQ ID NO: 35339 - DNA, 20 bp, synthetic construct
  misc_feature 1..20: note = CRISPR gRNA sequence
  source 1..20: mol_type = other DNA
acctgagacaacttacttct

SEQ ID NO: 35340 - DNA, 20 bp, synthetic construct
  misc_feature 1..20: note = CRISPR gRNA sequence
  source 1..20: mol_type = other DNA
agacaacttacttctatttt

SEQ ID NO: 35341 - DNA, 20 bp, synthetic construct
  misc_feature 1..20: note = CRISPR gRNA sequence
  source 1..20: mol_type = other DNA
acttctatttttcctccaag

SEQ ID NO: 35342 - DNA, 20 bp, synthetic construct
  misc_feature 1..20: note = CRISPR gRNA sequence
  source 1..20: mol_type = other DNA
cttctatttttcctccaaga

SEQ ID NO: 35343 - DNA, 20 bp, synthetic construct
  misc_feature 1..20: note = CRISPR gRNA sequence
  source 1..20: mol_type = other DNA
ctatttttcctccaagaggg

SEQ ID NO: 35344 - DNA, 20 bp, synthetic construct
  misc_feature 1..20: note = CRISPR gRNA sequence
  source 1..20: mol_type = other DNA
tatttttcctccaagaggga

SEQ ID NO: 35345 - DNA, 20 bp, synthetic construct
  misc_feature 1..20: note = CRISPR gRNA sequence
  source 1..20: mol_type = other DNA
tttttcctccaagagggacg

SEQ ID NO: 35346 - DNA, 20 bp, synthetic construct
  misc_feature 1..20: note = CRISPR gRNA sequence
  source 1..20: mol_type = other DNA
ttcctccaagagggacgtgg

SEQ ID NO: 35347 - DNA, 20 bp, synthetic construct
  misc_feature 1..20: note = CRISPR gRNA sequence
  source 1..20: mol_type = other DNA
tcctccaagagggacgtgga

SEQ ID NO: 35348 - DNA, 20 bp, synthetic construct
  misc_feature 1..20: note = CRISPR gRNA sequence
  source 1..20: mol_type = other DNA
cctccaagagggacgtggaa

SEQ ID NO: 35349 - DNA, 20 bp, synthetic construct
  misc_feature 1..20: note = CRISPR gRNA sequence
  source 1..20: mol_type = other DNA
ctccaagagggacgtggaaa

SEQ ID NO: 35350 - DNA, 20 bp, synthetic construct
  misc_feature 1..20: note = CRISPR gRNA sequence
  source 1..20: mol_type = other DNA
caagagggacgtggaaatcc

SEQ ID NO: 35351 - DNA, 20 bp, synthetic construct
  misc_feature 1..20: note = CRISPR gRNA sequence
  source 1..20: mol_type = other DNA
caggaccccacaaaagacac

SEQ ID NO: 35352 - DNA, 20 bp, synthetic construct
  misc_feature 1..20: note = CRISPR gRNA sequence
  source 1..20: mol_type = other DNA
tgaaagttcaggcaagccac

SEQ ID NO: 35353 - DNA, 20 bp, synthetic construct
  misc_feature 1..20: note = CRISPR gRNA sequence
  source 1..20: mol_type = other DNA
aaagttcaggcaagccacct

SEQ ID NO: 35354 - DNA, 20 bp, synthetic construct
  misc_feature 1..20: note = CRISPR gRNA sequence
  source 1..20: mol_type = other DNA
aggcaagccacctatcttct

SEQ ID NO: 35355 - DNA, 20 bp, synthetic construct
  misc_feature 1..20: note = CRISPR gRNA sequence
  source 1..20: mol_type = other DNA
tcttctctgggtcccgattg

SEQ ID NO: 35356 - DNA, 20 bp, synthetic construct
  misc_feature 1..20: note = CRISPR gRNA sequence
  source 1..20: mol_type = other DNA
ctctgggtcccgattgagga

SEQ ID NO: 35357 - DNA, 20 bp, synthetic construct
  misc_feature 1..20: note = CRISPR gRNA sequence
  source 1..20: mol_type = other DNA
tctgggtcccgattgaggac

SEQ ID NO: 35358 - DNA, 20 bp, synthetic construct
  misc_feature 1..20: note = CRISPR gRNA sequence
  source 1..20: mol_type = other DNA
tgggtcccgattgaggacac

SEQ ID NO: 35359 - DNA, 20 bp, synthetic construct
  misc_feature 1..20: note = CRISPR gRNA sequence
  source 1..20: mol_type = other DNA
ggtcccgattgaggacactg

SEQ ID NO: 35360 - DNA, 20 bp, synthetic construct
  misc_feature 1..20: note = CRISPR gRNA sequence
  source 1..20: mol_type = other DNA
aggacactgacctcataaca

SEQ ID NO: 35361 - DNA, 20 bp, synthetic construct
  misc_feature 1..20: note = CRISPR gRNA sequence
  source 1..20: mol_type = other DNA
acctcataacaacttggaaa

SEQ ID NO: 35362 - DNA, 20 bp, synthetic construct
  misc_feature 1..20: note = CRISPR gRNA sequence
  source 1..20: mol_type = other DNA
ataacaacttggaaaatctt

SEQ ID NO: 35363 - DNA, 20 bp, synthetic construct
  misc_feature 1..20: note = CRISPR gRNA sequence
  source 1..20: mol_type = other DNA
ggaaaatcttaaaactcgaa

SEQ ID NO: 35364 - DNA, 20 bp, synthetic construct
  misc_feature 1..20: note = CRISPR gRNA sequence
  source 1..20: mol_type = other DNA
gaaaatcttaaaactcgaat

SEQ ID NO: 35365 - DNA, 20 bp, synthetic construct
  misc_feature 1..20: note = CRISPR gRNA sequence
  source 1..20: mol_type = other DNA
aaaactcgaatgggccatca

SEQ ID NO: 35366 - DNA, 20 bp, synthetic construct
  misc_feature 1..20: note = CRISPR gRNA sequence
  source 1..20: mol_type = other DNA
aaactcgaatgggccatcat

SEQ ID NO: 35367 - DNA, 20 bp, synthetic construct
  misc_feature 1..20: note = CRISPR gRNA sequence
  source 1..20: mol_type = other DNA
gaatgggccatcatctccag

SEQ ID NO: 35368 - DNA, 20 bp, synthetic construct
  misc_feature 1..20: note = CRISPR gRNA sequence
  source 1..20: mol_type = other DNA
cagcttgtgcatttgccagt

SEQ ID NO: 35369 - DNA, 20 bp, synthetic construct
  misc_feature 1..20: note = CRISPR gRNA sequence
  source 1..20: mol_type = other DNA
gtgcatttgccagtaaaggg

SEQ ID NO: 35370 - DNA, 20 bp, synthetic construct
  misc_feature 1..20: note = CRISPR gRNA sequence
  source 1..20: mol_type = other DNA
tgcatttgccagtaaagggt

SEQ ID NO: 35371 - DNA, 20 bp, synthetic construct
  misc_feature 1..20: note = CRISPR gRNA sequence
  source 1..20: mol_type = other DNA
gccagtaaagggtaaagtta

SEQ ID NO: 35372 - DNA, 20 bp, synthetic construct
  misc_feature 1..20: note = CRISPR gRNA sequence
  source 1..20: mol_type = other DNA
ccagtaaagggtaaagttat

SEQ ID NO: 35373 - DNA, 20 bp, synthetic construct
  misc_feature 1..20: note = CRISPR gRNA sequence
  source 1..20: mol_type = other DNA
ttgtgggtgaggggcctggt

SEQ ID NO: 35374 - DNA, 20 bp, synthetic construct
  misc_feature 1..20: note = CRISPR gRNA sequence
  source 1..20: mol_type = other DNA
tgggtgaggggcctggtggt

SEQ ID NO: 35375 - DNA, 20 bp, synthetic construct
  misc_feature 1..20: note = CRISPR gRNA sequence
  source 1..20: mol_type = other DNA
gtggtcccaggatgagaatg

SEQ ID NO: 35376 - DNA, 20 bp, synthetic construct
  misc_feature 1..20: note = CRISPR gRNA sequence
  source 1..20: mol_type = other DNA
tatgagctgcagccaggaga

SEQ ID NO: 35377 - DNA, 20 bp, synthetic construct
  misc_feature 1..20: note = CRISPR gRNA sequence
  source 1..20: mol_type = other DNA
cagccaggagaccttcggtc

SEQ ID NO: 35378 - DNA, 20 bp, synthetic construct
  misc_feature 1..20: note = CRISPR gRNA sequence
  source 1..20: mol_type = other DNA
cggtccctgtccagaatgca

SEQ ID NO: 35379 - DNA, 20 bp, synthetic construct
  misc_feature 1..20: note = CRISPR gRNA sequence
  source 1..20: mol_type = other DNA
ggtccctgtccagaatgcag

SEQ ID NO: 35380 - DNA, 20 bp, synthetic construct
  misc_feature 1..20: note = CRISPR gRNA sequence
  source 1..20: mol_type = other DNA
tccagaatgcagggttggga

SEQ ID NO: 35381 - DNA, 20 bp, synthetic construct
  misc_feature 1..20: note = CRISPR gRNA sequence
  source 1..20: mol_type = other DNA
ggataagagttcccttcccc

SEQ ID NO: 35382 - DNA, 20 bp, synthetic construct
  misc_feature 1..20: note = CRISPR gRNA sequence
  source 1..20: mol_type = other DNA
ccttccccgcttgcctggtc

SEQ ID NO: 35383 - DNA, 20 bp, synthetic construct
  misc_feature 1..20: note = CRISPR gRNA sequence
  source 1..20: mol_type = other DNA
ccccgcttgcctggtctgtc

SEQ ID NO: 35384 - DNA, 20 bp, synthetic construct
  misc_feature 1..20: note = CRISPR gRNA sequence
  source 1..20: mol_type = other DNA
cccgcttgcctggtctgtcc

SEQ ID NO: 35385 - DNA, 20 bp, synthetic construct
  misc_feature 1..20: note = CRISPR gRNA sequence
  source 1..20: mol_type = other DNA
gcctggtctgtcccagctcc

SEQ ID NO: 35386 - DNA, 20 bp, synthetic construct
  misc_feature 1..20: note = CRISPR gRNA sequence
  source 1..20: mol_type = other DNA
cctggtctgtcccagctcca

SEQ ID NO: 35387 - DNA, 20 bp, synthetic construct
  misc_feature 1..20: note = CRISPR gRNA sequence
  source 1..20: mol_type = other DNA
gtctgtcccagctccagata

SEQ ID NO: 35388 - DNA, 20 bp, synthetic construct
  misc_feature 1..20: note = CRISPR gRNA sequence
  source 1..20: mol_type = other DNA
tcccagctccagatagcctc

SEQ ID NO: 35389 - DNA, 20 bp, synthetic construct
  misc_feature 1..20: note = CRISPR gRNA sequence
  source 1..20: mol_type = other DNA
cagatagcctcccttctgca

SEQ ID NO: 35390 - DNA, 20 bp, synthetic construct
  misc_feature 1..20: note = CRISPR gRNA sequence
  source 1..20: mol_type = other DNA
ccttctgcatgccactccta

SEQ ID NO: 35391 - DNA, 20 bp, synthetic construct
  misc_feature 1..20: note = CRISPR gRNA sequence
  source 1..20: mol_type = other DNA
ctgcatgccactcctaactg

SEQ ID NO: 35392 - DNA, 20 bp, synthetic construct
  misc_feature 1..20: note = CRISPR gRNA sequence
  source 1..20: mol_type = other DNA
tgcatgccactcctaactgc

SEQ ID NO: 35393 - DNA, 20 bp, synthetic construct
  misc_feature 1..20: note = CRISPR gRNA sequence
  source 1..20: mol_type = other DNA
catgccactcctaactgcag

SEQ ID NO: 35394 - DNA, 20 bp, synthetic construct
  misc_feature 1..20: note = CRISPR gRNA sequence
  source 1..20: mol_type = other DNA
ctaactgcagtcaatgacct

SEQ ID NO: 35395 - DNA, 20 bp, synthetic construct
  misc_feature 1..20: note = CRISPR gRNA sequence
  source 1..20: mol_type = other DNA
actgcagtcaatgacctgga

SEQ ID NO: 35396 - DNA, 20 bp, synthetic construct
  misc_feature 1..20: note = CRISPR gRNA sequence
  source 1..20: mol_type = other DNA
cagtcaatgacctggaaagg

SEQ ID NO: 35397 - DNA, 20 bp, synthetic construct
  misc_feature 1..20: note = CRISPR gRNA sequence
  source 1..20: mol_type = other DNA
gaaaggagtccaacaagttt

SEQ ID NO: 35398 - DNA, 20 bp, synthetic construct
  misc_feature 1..20: note = CRISPR gRNA sequence
  source 1..20: mol_type = other DNA
ttcctggaagggaacctgac

SEQ ID NO: 35399 - DNA, 20 bp, synthetic construct
  misc_feature 1..20: note = CRISPR gRNA sequence
  source 1..20: mol_type = other DNA
tcctggaagggaacctgacc

SEQ ID NO: 35400 - DNA, 20 bp, synthetic construct
  misc_feature 1..20: note = CRISPR gRNA sequence
  source 1..20: mol_type = other DNA
cctggaagggaacctgaccc

SEQ ID NO: 35401 - DNA, 20 bp, synthetic construct
  misc_feature 1..20: note = CRISPR gRNA sequence
  source 1..20: mol_type = other DNA
ctggaagggaacctgaccct

SEQ ID NO: 35402 - DNA, 20 bp, synthetic construct
  misc_feature 1..20: note = CRISPR gRNA sequence
  source 1..20: mol_type = other DNA
gaagggaacctgaccctggt

SEQ ID NO: 35403 - DNA, 20 bp, synthetic construct
  misc_feature 1..20: note = CRISPR gRNA sequence
  source 1..20: mol_type = other DNA
accctggtgctggggtaggg

SEQ ID NO: 35404 - DNA, 20 bp, synthetic construct
  misc_feature 1..20: note = CRISPR gRNA sequence
  source 1..20: mol_type = other DNA
gtgctggggtagggggtgga

SEQ ID NO: 35405 - DNA, 20 bp, synthetic construct
  misc_feature 1..20: note = CRISPR gRNA sequence
  source 1..20: mol_type = other DNA
gggtagggggtggagtgatg

SEQ ID NO: 35406 - DNA, 20 bp, synthetic construct
  misc_feature 1..20: note = CRISPR gRNA sequence
  source 1..20: mol_type = other DNA
gtgactgcagttagcaaagc

SEQ ID NO: 35407 - DNA, 20 bp, synthetic construct
  misc_feature 1..20: note = CRISPR gRNA sequence
  source 1..20: mol_type = other DNA
tgactgcagttagcaaagcc

SEQ ID NO: 35408 - DNA, 20 bp, synthetic construct
  misc_feature 1..20: note = CRISPR gRNA sequence
  source 1..20: mol_type = other DNA
cagttagcaaagccaggccc

SEQ ID NO: 35409 - DNA, 20 bp, synthetic construct
  misc_feature 1..20: note = CRISPR gRNA sequence
  source 1..20: mol_type = other DNA
gcaaagccaggccccacact

SEQ ID NO: 35410 - DNA, 20 bp, synthetic construct
  misc_feature 1..20: note = CRISPR gRNA sequence
  source 1..20: mol_type = other DNA
cagtcctgacccatccggct

SEQ ID NO: 35411 - DNA, 20 bp, synthetic construct
  misc_feature 1..20: note = CRISPR gRNA sequence
  source 1..20: mol_type = other DNA
acccatccggctctacttaa

SEQ ID NO: 35412 - DNA, 20 bp, synthetic construct
  misc_feature 1..20: note = CRISPR gRNA sequence
  source 1..20: mol_type = other DNA
tacttaacacagtccccccg

SEQ ID NO: 35413 - DNA, 20 bp, synthetic construct
  misc_feature 1..20: note = CRISPR gRNA sequence
  source 1..20: mol_type = other DNA
cttaacacagtccccccgcc

SEQ ID NO: 35414 - DNA, 20 bp, synthetic construct
  misc_feature 1..20: note = CRISPR gRNA sequence
  source 1..20: mol_type = other DNA
aacacagtccccccgccagc

SEQ ID NO: 35415 - DNA, 20 bp, synthetic construct
  misc_feature 1..20: note = CRISPR gRNA sequence
  source 1..20: mol_type = other DNA
acacagtccccccgccagca

SEQ ID NO: 35416 - DNA, 20 bp, synthetic construct
  misc_feature 1..20: note = CRISPR gRNA sequence
  source 1..20: mol_type = other DNA
tgctgggtgctggagacccc

SEQ ID NO: 35417 - DNA, 20 bp, synthetic construct
  misc_feature 1..20: note = CRISPR gRNA sequence
  source 1..20: mol_type = other DNA
ctgggtgctggagaccccaa

SEQ ID NO: 35418 - DNA, 20 bp, synthetic construct
  misc_feature 1..20: note = CRISPR gRNA sequence
  source 1..20: mol_type = other DNA
ggtgctggagaccccaagat

SEQ ID NO: 35419 - DNA, 20 bp, synthetic construct
  misc_feature 1..20: note = CRISPR gRNA sequence
  source 1..20: mol_type = other DNA
gagaccccaagatgaaccac

SEQ ID NO: 35420 - DNA, 20 bp, synthetic construct
  misc_feature 1..20: note = CRISPR gRNA sequence
  source 1..20: mol_type = other DNA
cttgctgagatctgactacg

SEQ ID NO: 35421 - DNA, 20 bp, synthetic construct
  misc_feature 1..20: note = CRISPR gRNA sequence
  source 1..20: mol_type = other DNA
gctgagatctgactacggag

SEQ ID NO: 35422 - DNA, 20 bp, synthetic construct
  misc_feature 1..20: note = CRISPR gRNA sequence
  source 1..20: mol_type = other DNA
ctgagatctgactacggagt

SEQ ID NO: 35423 - DNA, 20 bp, synthetic construct
  misc_feature 1..20: note = CRISPR gRNA sequence
  source 1..20: mol_type = other DNA
agatctgactacggagtcca

SEQ ID NO: 35424 - DNA, 20 bp, synthetic construct
  misc_feature 1..20: note = CRISPR gRNA sequence
  source 1..20: mol_type = other DNA
actacggagtccagccatcg

SEQ ID NO: 35425 - DNA, 20 bp, synthetic construct
  misc_feature 1..20: note = CRISPR gRNA sequence
  source 1..20: mol_type = other DNA
cggagtccagccatcggcag

SEQ ID NO: 35426 - DNA, 20 bp, synthetic construct
  misc_feature 1..20: note = CRISPR gRNA sequence
  source 1..20: mol_type = other DNA
ggctgtgagtgagaattacc

SEQ ID NO: 35427 - DNA, 20 bp, synthetic construct
  misc_feature 1..20: note = CRISPR gRNA sequence
  source 1..20: mol_type = other DNA
gctgtgagtgagaattacct

SEQ ID NO: 35428 - DNA, 20 bp, synthetic construct
  misc_feature 1..20: note = CRISPR gRNA sequence
  source 1..20: mol_type = other DNA
tgagtgagaattacctggga

SEQ ID NO: 35429 - DNA, 20 bp, synthetic construct
  misc_feature 1..20: note = CRISPR gRNA sequence
  source 1..20: mol_type = other DNA
cctgggaagggtgttaaaaa

SEQ ID NO: 35430 - DNA, 20 bp, synthetic construct
  misc_feature 1..20: note = CRISPR gRNA sequence
  source 1..20: mol_type = other DNA
ggaagggtgttaaaaacaca

SEQ ID NO: 35431 - DNA, 20 bp, synthetic construct
  misc_feature 1..20: note = CRISPR gRNA sequence
  source 1..20: mol_type = other DNA
aaaacacagcgtcctgggcc

SEQ ID NO: 35432 - DNA, 20 bp, synthetic construct
  misc_feature 1..20: note = CRISPR gRNA sequence
  source 1..20: mol_type = other DNA
ggcctcacccccagtgattc

SEQ ID NO: 35433 - DNA, 20 bp, synthetic construct
  misc_feature 1..20: note = CRISPR gRNA sequence
  source 1..20: mol_type = other DNA
acccccagtgattctattca

SEQ ID NO: 35434 - DNA, 20 bp, synthetic construct
  misc_feature 1..20: note = CRISPR gRNA sequence
  source 1..20: mol_type = other DNA
tattcagggagtctgcagcc

SEQ ID NO: 35435 - DNA, 20 bp, synthetic construct
  misc_feature 1..20: note = CRISPR gRNA sequence
  source 1..20: mol_type = other DNA
ttcagggagtctgcagccgg

SEQ ID NO: 35436 - DNA, 20 bp, synthetic construct
  misc_feature 1..20: note = CRISPR gRNA sequence
  source 1..20: mol_type = other DNA
agggagtctgcagccgggcc

SEQ ID NO: 35437 - DNA, 20 bp, synthetic construct
  misc_feature 1..20: note = CRISPR gRNA sequence
  source 1..20: mol_type = other DNA
cagccgggcccaggaatctg

SEQ ID NO: 35438 - DNA, 20 bp, synthetic construct
  misc_feature 1..20: note = CRISPR gRNA sequence
  source 1..20: mol_type = other DNA
tattttctttcatttttttt

SEQ ID NO: 35439 - DNA, 20 bp, synthetic construct
  misc_feature 1..20: note = CRISPR gRNA sequence
  source 1..20: mol_type = other DNA
tctttcattttttttgagac

SEQ ID NO: 35440 - DNA, 20 bp, synthetic construct
  misc_feature 1..20: note = CRISPR gRNA sequence
  source 1..20: mol_type = other DNA
ctttcattttttttgagacg

SEQ ID NO: 35441 - DNA, 20 bp, synthetic construct
  misc_feature 1..20: note = CRISPR gRNA sequence
  source 1..20: mol_type = other DNA
tttcattttttttgagacgg

SEQ ID NO: 35442 - DNA, 20 bp, synthetic construct
  misc_feature 1..20: note = CRISPR gRNA sequence
  source 1..20: mol_type = other DNA
tcattttttttgagacggag

SEQ ID NO: 35443 - DNA, 20 bp, synthetic construct
  misc_feature 1..20: note = CRISPR gRNA sequence
  source 1..20: mol_type = other DNA
cattttttttgagacggagt

SEQ ID NO: 35444 - DNA, 20 bp, synthetic construct
  misc_feature 1..20: note = CRISPR gRNA sequence
  source 1..20: mol_type = other DNA
attttttttgagacggagtt

SEQ ID NO: 35445 - DNA, 20 bp, synthetic construct
  misc_feature 1..20: note = CRISPR gRNA sequence
  source 1..20: mol_type = other DNA
tttttgagacggagtttcac

SEQ ID NO: 35446 - DNA, 20 bp, synthetic construct
  misc_feature 1..20: note = CRISPR gRNA sequence
  source 1..20: mol_type = other DNA
ttttgagacggagtttcact

SEQ ID NO: 35447 - DNA, 20 bp, synthetic construct
  misc_feature 1..20: note = CRISPR gRNA sequence
  source 1..20: mol_type = other DNA
tttgagacggagtttcactc

SEQ ID NO: 35448 - DNA, 20 bp, synthetic construct
  misc_feature 1..20: note = CRISPR gRNA sequence
  source 1..20: mol_type = other DNA
ttgagacggagtttcactct

SEQ ID NO: 35449 - DNA, 20 bp, synthetic construct
  misc_feature 1..20: note = CRISPR gRNA sequence
  source 1..20: mol_type = other DNA
tgagacggagtttcactctt

SEQ ID NO: 35450 - DNA, 20 bp, synthetic construct
  misc_feature 1..20: note = CRISPR gRNA sequence
  source 1..20: mol_type = other DNA
gagacggagtttcactcttg

SEQ ID NO: 35451 - DNA, 20 bp, synthetic construct
  misc_feature 1..20: note = CRISPR gRNA sequence
  source 1..20: mol_type = other DNA
agacggagtttcactcttgt

SEQ ID NO: 35452 - DNA, 20 bp, synthetic construct
  misc_feature 1..20: note = CRISPR gRNA sequence
  source 1..20: mol_type = other DNA
cactcttgttgcccaggctg

SEQ ID NO: 35453 - DNA, 20 bp, synthetic construct
  misc_feature 1..20: note = CRISPR gRNA sequence
  source 1..20: mol_type = other DNA
actcttgttgcccaggctgg

SEQ ID NO: 35454 - DNA, 20 bp, synthetic construct
  misc_feature 1..20: note = CRISPR gRNA sequence
  source 1..20: mol_type = other DNA
ttgttgcccaggctggagtg

SEQ ID NO: 35455 - DNA, 20 bp, synthetic construct
  misc_feature 1..20: note = CRISPR gRNA sequence
  source 1..20: mol_type = other DNA
gttgcccaggctggagtgca

SEQ ID NO: 35456 - DNA, 20 bp, synthetic construct
  misc_feature 1..20: note = CRISPR gRNA sequence
  source 1..20: mol_type = other DNA
ttgcccaggctggagtgcaa

SEQ ID NO: 35457 - DNA, 20 bp, synthetic construct
  misc_feature 1..20: note = CRISPR gRNA sequence
  source 1..20: mol_type = other DNA
cccaggctggagtgcaatgg

SEQ ID NO: 35458 - DNA, 20 bp, synthetic construct
  misc_feature 1..20: note = CRISPR gRNA sequence
  source 1..20: mol_type = other DNA
gagtgcaatggtgtgatctc

SEQ ID NO: 35459 - DNA, 20 bp, synthetic construct
  misc_feature 1..20: note = CRISPR gRNA sequence
  source 1..20: mol_type = other DNA
ggctcaccgcaatctccgcc

SEQ ID NO: 35460 - DNA, 20 bp, synthetic construct
  misc_feature 1..20: note = CRISPR gRNA sequence
  source 1..20: mol_type = other DNA
accgcaatctccgcctcctg

SEQ ID NO: 35461 - DNA, 20 bp, synthetic construct
  misc_feature 1..20: note = CRISPR gRNA sequence
  source 1..20: mol_type = other DNA
cgcctcctgggttcaggcga

SEQ ID NO: 35462 - DNA, 20 bp, synthetic construct
  misc_feature 1..20: note = CRISPR gRNA sequence
  source 1..20: mol_type = other DNA
ctgggttcaggcgattctcc

SEQ ID NO: 35463 - DNA, 20 bp, synthetic construct
  misc_feature 1..20: note = CRISPR gRNA sequence
  source 1..20: mol_type = other DNA
ggttcaggcgattctcctcc

SEQ ID NO: 35464 - DNA, 20 bp, synthetic construct
  misc_feature 1..20: note = CRISPR gRNA sequence
  source 1..20: mol_type = other DNA
aggcgattctcctccaccag

SEQ ID NO: 35465 - DNA, 20 bp, synthetic construct
  misc_feature 1..20: note = CRISPR gRNA sequence
  source 1..20: mol_type = other DNA
tcctccaccagcctaccgag

SEQ ID NO: 35466 - DNA, 20 bp, synthetic construct
  misc_feature 1..20: note = CRISPR gRNA sequence
  source 1..20: mol_type = other DNA
ctccaccagcctaccgagta

SEQ ID NO: 35467 - DNA, 20 bp, synthetic construct
  misc_feature 1..20: note = CRISPR gRNA sequence
  source 1..20: mol_type = other DNA
caccagcctaccgagtagct

SEQ ID NO: 35468 - DNA, 20 bp, synthetic construct
  misc_feature 1..20: note = CRISPR gRNA sequence
  source 1..20: mol_type = other DNA
ccgagtagctgggattacag

SEQ ID NO: 35469 - DNA, 20 bp, synthetic construct
  misc_feature 1..20: note = CRISPR gRNA sequence
  source 1..20: mol_type = other DNA
ggattacaggcatgcaccac

SEQ ID NO: 35470 - DNA, 20 bp, synthetic construct
  misc_feature 1..20: note = CRISPR gRNA sequence
  source 1..20: mol_type = other DNA
caggcatgcaccactacacc

SEQ ID NO: 35471 - DNA, 20 bp, synthetic construct
  misc_feature 1..20: note = CRISPR gRNA sequence
  source 1..20: mol_type = other DNA
cacccggctaattttgtatt

SEQ ID NO: 35472 - DNA, 20 bp, synthetic construct
  misc_feature 1..20: note = CRISPR gRNA sequence
  source 1..20: mol_type = other DNA
attttgtatttttaggagag

SEQ ID NO: 35473 - DNA, 20 bp, synthetic construct
  misc_feature 1..20: note = CRISPR gRNA sequence
  source 1..20: mol_type = other DNA
tgtatttttaggagagacgg

SEQ ID NO: 35474 - DNA, 20 bp, synthetic construct
  misc_feature 1..20: note = CRISPR gRNA sequence
  source 1..20: mol_type = other DNA
gtatttttaggagagacggt

SEQ ID NO: 35475 - DNA, 20 bp, synthetic construct
  misc_feature 1..20: note = CRISPR gRNA sequence
  source 1..20: mol_type = other DNA
tatttttaggagagacggtg

SEQ ID NO: 35476 - DNA, 20 bp, synthetic construct
  misc_feature 1..20: note = CRISPR gRNA sequence
  source 1..20: mol_type = other DNA
ttaggagagacggtgtttca

SEQ ID NO: 35477 - DNA, 20 bp, synthetic construct
  misc_feature 1..20: note = CRISPR gRNA sequence
  source 1..20: mol_type = other DNA
taggagagacggtgtttcac

SEQ ID NO: 35478 - DNA, 20 bp, synthetic construct
  misc_feature 1..20: note = CRISPR gRNA sequence
  source 1..20: mol_type = other DNA
aggagagacggtgtttcacc

SEQ ID NO: 35479 - DNA, 20 bp, synthetic construct
  misc_feature 1..20: note = CRISPR gRNA sequence
  source 1..20: mol_type = other DNA
ggagagacggtgtttcacca

SEQ ID NO: 35480 - DNA, 20 bp, synthetic construct
  misc_feature 1..20: note = CRISPR gRNA sequence
  source 1..20: mol_type = other DNA
caccatgttgcccaggctgg

SEQ ID NO: 35481 - DNA, 20 bp, synthetic construct
  misc_feature 1..20: note = CRISPR gRNA sequence
  source 1..20: mol_type = other DNA
accatgttgcccaggctggt

SEQ ID NO: 35482 - DNA, 20 bp, synthetic construct
  misc_feature 1..20: note = CRISPR gRNA sequence
  source 1..20: mol_type = other DNA
cccaggctggtctcgaactc

SEQ ID NO: 35483 - DNA, 20 bp, synthetic construct
  misc_feature 1..20: note = CRISPR gRNA sequence
  source 1..20: mol_type = other DNA
gtctcgaactcctgatccca

SEQ ID NO: 35484 - DNA, 20 bp, synthetic construct
  misc_feature 1..20: note = CRISPR gRNA sequence
  source 1..20: mol_type = other DNA
gaactcctgatcccaggtga

SEQ ID NO: 35485 - DNA, 20 bp, synthetic construct
  misc_feature 1..20: note = CRISPR gRNA sequence
  source 1..20: mol_type = other DNA
ctgatcccaggtgatccacc

SEQ ID NO: 35486 - DNA, 20 bp, synthetic construct
  misc_feature 1..20: note = CRISPR gRNA sequence
  source 1..20: mol_type = other DNA
atcccaggtgatccaccggc

SEQ ID NO: 35487 - DNA, 20 bp, synthetic construct
  misc_feature 1..20: note = CRISPR gRNA sequence
  source 1..20: mol_type = other DNA
agcctcccaaagtgctgggg

SEQ ID NO: 35488 - DNA, 20 bp, synthetic construct
  misc_feature 1..20: note = CRISPR gRNA sequence
  source 1..20: mol_type = other DNA
ccaaagtgctggggttacag

SEQ ID NO: 35489 - DNA, 20 bp, synthetic construct
  misc_feature 1..20: note = CRISPR gRNA sequence
  source 1..20: mol_type = other DNA
gggttacaggtgtgagccac

SEQ ID NO: 35490 - DNA, 20 bp, synthetic construct
  misc_feature 1..20: note = CRISPR gRNA sequence
  source 1..20: mol_type = other DNA
caggtgtgagccaccatgcc

SEQ ID NO: 35491 - DNA, 20 bp, synthetic construct
  misc_feature 1..20: note = CRISPR gRNA sequence
  source 1..20: mol_type = other DNA
gaatctgtattttcaaaaat

SEQ ID NO: 35492 - DNA, 20 bp, synthetic construct
  misc_feature 1..20: note = CRISPR gRNA sequence
  source 1..20: mol_type = other DNA
tattttcaaaaatttatttt

SEQ ID NO: 35493 - DNA, 20 bp, synthetic construct
  misc_feature 1..20: note = CRISPR gRNA sequence
  source 1..20: mol_type = other DNA
tcaaaaatttatttttatta

SEQ ID NO: 35494 - DNA, 20 bp, synthetic construct
  misc_feature 1..20: note = CRISPR gRNA sequence
  source 1..20: mol_type = other DNA
caaaaatttatttttattaa

SEQ ID NO: 35495 - DNA, 20 bp, synthetic construct
  misc_feature 1..20: note = CRISPR gRNA sequence
  source 1..20: mol_type = other DNA
aaaaatttatttttattaat

SEQ ID NO: 35496 - DNA, 20 bp, synthetic construct
  misc_feature 1..20: note = CRISPR gRNA sequence
  source 1..20: mol_type = other DNA
atttttattaatttatatat

SEQ ID NO: 35497 - DNA, 20 bp, synthetic construct
  misc_feature 1..20: note = CRISPR gRNA sequence
  source 1..20: mol_type = other DNA
tttttattaatttatatatt

SEQ ID NO: 35498 - DNA, 20 bp, synthetic construct
  misc_feature 1..20: note = CRISPR gRNA sequence
  source 1..20: mol_type = other DNA
ttattaatttatatattttt

SEQ ID NO: 35499 - DNA, 20 bp, synthetic construct
  misc_feature 1..20: note = CRISPR gRNA sequence
  source 1..20: mol_type = other DNA
tattaatttatatatttttt

SEQ ID NO: 35500 - DNA, 20 bp, synthetic construct
  misc_feature 1..20: note = CRISPR gRNA sequence
  source 1..20: mol_type = other DNA
attaatttatatattttttt

SEQ ID NO: 35501 - DNA, 20 bp, synthetic construct
  misc_feature 1..20: note = CRISPR gRNA sequence
  source 1..20: mol_type = other DNA
ttaatttatatatttttttc

SEQ ID NO: 35502 - DNA, 20 bp, synthetic construct
  misc_feature 1..20: note = CRISPR gRNA sequence
  source 1..20: mol_type = other DNA
atttatatatttttttccta

SEQ ID NO: 35503 - DNA, 20 bp, synthetic construct
  misc_feature 1..20: note = CRISPR gRNA sequence
  source 1..20: mol_type = other DNA
atatatttttttcctaaaaa

SEQ ID NO: 35504 - DNA, 20 bp, synthetic construct
  misc_feature 1..20: note = CRISPR gRNA sequence
  source 1..20: mol_type = other DNA
tatatttttttcctaaaaaa

SEQ ID NO: 35505 - DNA, 20 bp, synthetic construct
  misc_feature 1..20: note = CRISPR gRNA sequence
  source 1..20: mol_type = other DNA
ttttcctaaaaaaaggtctt

SEQ ID NO: 35506 - DNA, 20 bp, synthetic construct
  misc_feature 1..20: note = CRISPR gRNA sequence
  source 1..20: mol_type = other DNA
tttcctaaaaaaaggtcttg

SEQ ID NO: 35507 - DNA, 20 bp, synthetic construct
  misc_feature 1..20: note = CRISPR gRNA sequence
  source 1..20: mol_type = other DNA
ttcctaaaaaaaggtcttgc

SEQ ID NO: 35508 - DNA, 20 bp, synthetic construct
  misc_feature 1..20: note = CRISPR gRNA sequence
  source 1..20: mol_type = other DNA
tcctaaaaaaaggtcttgct

SEQ ID NO: 35509 - DNA, 20 bp, synthetic construct
  misc_feature 1..20: note = CRISPR gRNA sequence
  source 1..20: mol_type = other DNA
cctaaaaaaaggtcttgctc

SEQ ID NO: 35510 - DNA, 20 bp, synthetic construct
  misc_feature 1..20: note = CRISPR gRNA sequence
  source 1..20: mol_type = other DNA
ctaaaaaaaggtcttgctct

SEQ ID NO: 35511 - DNA, 20 bp, synthetic construct
  misc_feature 1..20: note = CRISPR gRNA sequence
  source 1..20: mol_type = other DNA
aaaaaaggtcttgctctgtt

SEQ ID NO: 35512 - DNA, 20 bp, synthetic construct
  misc_feature 1..20: note = CRISPR gRNA sequence
  source 1..20: mol_type = other DNA
gctctgttgcccaggctggt

SEQ ID NO: 35513 - DNA, 20 bp, synthetic construct
  misc_feature 1..20: note = CRISPR gRNA sequence
  source 1..20: mol_type = other DNA
ctctgttgcccaggctggtc

SEQ ID NO: 35514 - DNA, 20 bp, synthetic construct
  misc_feature 1..20: note = CRISPR gRNA sequence
  source 1..20: mol_type = other DNA
tgttgcccaggctggtcttg

SEQ ID NO: 35515 - DNA, 20 bp, synthetic construct
  misc_feature 1..20: note = CRISPR gRNA sequence
  source 1..20: mol_type = other DNA
ttgcccaggctggtcttgaa

SEQ ID NO: 35516 - DNA, 20 bp, synthetic construct
  misc_feature 1..20: note = CRISPR gRNA sequence
  source 1..20: mol_type = other DNA
cccaggctggtcttgaactc

SEQ ID NO: 35517 - DNA, 20 bp, synthetic construct
  misc_feature 1..20: note = CRISPR gRNA sequence
  source 1..20: mol_type = other DNA
gtcttgaactcctggtctca

SEQ ID NO: 35518 - DNA, 20 bp, synthetic construct
  misc_feature 1..20: note = CRISPR gRNA sequence
  source 1..20: mol_type = other DNA
gaactcctggtctcaagcca

SEQ ID NO: 35519 - DNA, 20 bp, synthetic construct
  misc_feature 1..20: note = CRISPR gRNA sequence
  source 1..20: mol_type = other DNA
aactcctggtctcaagccat

SEQ ID NO: 35520 - DNA, 20 bp, synthetic construct
  misc_feature 1..20: note = CRISPR gRNA sequence
  source 1..20: mol_type = other DNA
ctggtctcaagccatcatcc

SEQ ID NO: 35521 - DNA, 20 bp, synthetic construct
  misc_feature 1..20: note = CRISPR gRNA sequence
  source 1..20: mol_type = other DNA
gtctcaagccatcatcctgc

SEQ ID NO: 35522 - DNA, 20 bp, synthetic construct
  misc_feature 1..20: note = CRISPR gRNA sequence
  source 1..20: mol_type = other DNA
aagccatcatcctgccttga

SEQ ID NO: 35523 - DNA, 20 bp, synthetic construct
  misc_feature 1..20: note = CRISPR gRNA sequence
  source 1..20: mol_type = other DNA
ccttgacctcccaaggtgat

SEQ ID NO: 35524 - DNA, 20 bp, synthetic construct
  misc_feature 1..20: note = CRISPR gRNA sequence
  source 1..20: mol_type = other DNA
gacctcccaaggtgatggaa

SEQ ID NO: 35525 - DNA, 20 bp, synthetic construct
  misc_feature 1..20: note = CRISPR gRNA sequence
  source 1..20: mol_type = other DNA
acctcccaaggtgatggaat

SEQ ID NO: 35526 - DNA, 20 bp, synthetic construct
  misc_feature 1..20: note = CRISPR gRNA sequence
  source 1..20: mol_type = other DNA
ccaaggtgatggaattacag

SEQ ID NO: 35527 - DNA, 20 bp, synthetic construct
  misc_feature 1..20: note = CRISPR gRNA sequence
  source 1..20: mol_type = other DNA
caggcatgagccactgcacc

SEQ ID NO: 35528 - DNA, 20 bp, synthetic construct
  misc_feature 1..20: note = CRISPR gRNA sequence
  source 1..20: mol_type = other DNA
caccaggcccctttcttaat

SEQ ID NO: 35529 - DNA, 20 bp, synthetic construct
  misc_feature 1..20: note = CRISPR gRNA sequence
  source 1..20: mol_type = other DNA
tcttaattcttatatctttc

SEQ ID NO: 35530 - DNA, 20 bp, synthetic construct
  misc_feature 1..20: note = CRISPR gRNA sequence
  source 1..20: mol_type = other DNA
cttaattcttatatctttcc

SEQ ID NO: 35531 - DNA, 20 bp, synthetic construct
  misc_feature 1..20: note = CRISPR gRNA sequence
  source 1..20: mol_type = other DNA
ttaattcttatatctttcct

SEQ ID NO: 35532 - DNA, 20 bp, synthetic construct
  misc_feature 1..20: note = CRISPR gRNA sequence
  source 1..20: mol_type = other DNA
aattcttatatctttccttc

SEQ ID NO: 35533 - DNA, 20 bp, synthetic construct
  misc_feature 1..20: note = CRISPR gRNA sequence
  source 1..20: mol_type = other DNA
attcttatatctttccttcc

SEQ ID NO: 35534 - DNA, 20 bp, synthetic construct
  misc_feature 1..20: note = CRISPR gRNA sequence
  source 1..20: mol_type = other DNA
ttatatctttccttcctgaa

SEQ ID NO: 35535 - DNA, 20 bp, synthetic construct
  misc_feature 1..20: note = CRISPR gRNA sequence
  source 1..20: mol_type = other DNA
atatctttccttcctgaagt

SEQ ID NO: 35536 - DNA, 20 bp, synthetic construct
  misc_feature 1..20: note = CRISPR gRNA sequence
  source 1..20: mol_type = other DNA
tatctttccttcctgaagtc

SEQ ID NO: 35537 - DNA, 20 bp, synthetic construct
  misc_feature 1..20: note = CRISPR gRNA sequence
  source 1..20: mol_type = other DNA
tccttcctgaagtctttcag

SEQ ID NO: 35538 - DNA, 20 bp, synthetic construct
  misc_feature 1..20: note = CRISPR gRNA sequence
  source 1..20: mol_type = other DNA
ccttcctgaagtctttcagc

SEQ ID NO: 35539 - DNA, 20 bp, synthetic construct
  misc_feature 1..20: note = CRISPR gRNA sequence
  source 1..20: mol_type = other DNA
cttcctgaagtctttcagct

SEQ ID NO: 35540 - DNA, 20 bp, synthetic construct
  misc_feature 1..20: note = CRISPR gRNA sequence
  source 1..20: mol_type = other DNA
cctgaagtctttcagctgcc

SEQ ID NO: 35541 - DNA, 20 bp, synthetic construct
  misc_feature 1..20: note = CRISPR gRNA sequence
  source 1..20: mol_type = other DNA
ctgaagtctttcagctgccc

SEQ ID NO: 35542 - DNA, 20 bp, synthetic construct
  misc_feature 1..20: note = CRISPR gRNA sequence
  source 1..20: mol_type = other DNA
aagtctttcagctgccctct

SEQ ID NO: 35543 - DNA, 20 bp, synthetic construct
  misc_feature 1..20: note = CRISPR gRNA sequence
  source 1..20: mol_type = other DNA
tcagctgccctctgctgcca

SEQ ID NO: 35544 - DNA, 20 bp, synthetic construct
  misc_feature 1..20: note = CRISPR gRNA sequence
  source 1..20: mol_type = other DNA
cagctgccctctgctgccat

SEQ ID NO: 35545 - DNA, 20 bp, synthetic construct
  misc_feature 1..20: note = CRISPR gRNA sequence
  source 1..20: mol_type = other DNA
agctgccctctgctgccatg

SEQ ID NO: 35546 - DNA, 20 bp, synthetic construct
  misc_feature 1..20: note = CRISPR gRNA sequence
  source 1..20: mol_type = other DNA
ccctctgctgccatgccctt

SEQ ID NO: 35547 - DNA, 20 bp, synthetic construct
  misc_feature 1..20: note = CRISPR gRNA sequence
  source 1..20: mol_type = other DNA
tgctgccatgcccttggtct

SEQ ID NO: 35548 - DNA, 20 bp, synthetic construct
  misc_feature 1..20: note = CRISPR gRNA sequence
  source 1..20: mol_type = other DNA
ctgccatgcccttggtctag

SEQ ID NO: 35549 - DNA, 20 bp, synthetic construct
  misc_feature 1..20: note = CRISPR gRNA sequence
  source 1..20: mol_type = other DNA
ccatgcccttggtctagtag

SEQ ID NO: 35550 - DNA, 20 bp, synthetic construct
  misc_feature 1..20: note = CRISPR gRNA sequence
  source 1..20: mol_type = other DNA
ggtctagtagtcaccagacc

SEQ ID NO: 35551 - DNA, 20 bp, synthetic construct
  misc_feature 1..20: note = CRISPR gRNA sequence
  source 1..20: mol_type = other DNA
gtctagtagtcaccagaccc

SEQ ID NO: 35552 - DNA, 20 bp, synthetic construct
  misc_feature 1..20: note = CRISPR gRNA sequence
  source 1..20: mol_type = other DNA
gtagtcaccagaccctcagc

SEQ ID NO: 35553 - DNA, 20 bp, synthetic construct
  misc_feature 1..20: note = CRISPR gRNA sequence
  source 1..20: mol_type = other DNA
agcatagattttacaatagc

SEQ ID NO: 35554 - DNA, 20 bp, synthetic construct
  misc_feature 1..20: note = CRISPR gRNA sequence
  source 1..20: mol_type = other DNA
tacaatagcttccaggtctt

SEQ ID NO: 35555 - DNA, 20 bp, synthetic construct
  misc_feature 1..20: note = CRISPR gRNA sequence
  source 1..20: mol_type = other DNA
acaatagcttccaggtcttt

SEQ ID NO: 35556 - DNA, 20 bp, synthetic construct
  misc_feature 1..20: note = CRISPR gRNA sequence
  source 1..20: mol_type = other DNA
caatagcttccaggtctttc

SEQ ID NO: 35557 - DNA, 20 bp, synthetic construct
  misc_feature 1..20: note = CRISPR gRNA sequence
  source 1..20: mol_type = other DNA
ccaggtctttcctctcatcc

SEQ ID NO: 35558 - DNA, 20 bp, synthetic construct
  misc_feature 1..20: note = CRISPR gRNA sequence
  source 1..20: mol_type = other DNA
caggtctttcctctcatccg

SEQ ID NO: 35559 - DNA, 20 bp, synthetic construct
  misc_feature 1..20: note = CRISPR gRNA sequence
  source 1..20: mol_type = other DNA
tcctctcatccggtttccca

SEQ ID NO: 35560 - DNA, 20 bp, synthetic construct
  misc_feature 1..20: note = CRISPR gRNA sequence
  source 1..20: mol_type = other DNA
cctctcatccggtttcccaa

SEQ ID NO: 35561 - DNA, 20 bp, synthetic construct
  misc_feature 1..20: note = CRISPR gRNA sequence
  source 1..20: mol_type = other DNA
ctctcatccggtttcccaaa

SEQ ID NO: 35562 - DNA, 20 bp, synthetic construct
  misc_feature 1..20: note = CRISPR gRNA sequence
  source 1..20: mol_type = other DNA
tcatccggtttcccaaactg

SEQ ID NO: 35563 - DNA, 20 bp, synthetic construct
  misc_feature 1..20: note = CRISPR gRNA sequence
  source 1..20: mol_type = other DNA
atccggtttcccaaactgca

SEQ ID NO: 35564 - DNA, 20 bp, synthetic construct
  misc_feature 1..20: note = CRISPR gRNA sequence
  source 1..20: mol_type = other DNA
cccaaactgcaggcattcgt

SEQ ID NO: 35565 - DNA, 20 bp, synthetic construct
  misc_feature 1..20: note = CRISPR gRNA sequence
  source 1..20: mol_type = other DNA
ccaaactgcaggcattcgtc

SEQ ID NO: 35566 - DNA, 20 bp, synthetic construct
  misc_feature 1..20: note = CRISPR gRNA sequence
  source 1..20: mol_type = other DNA
caggcattcgtcttccatct

SEQ ID NO: 35567 - DNA, 20 bp, synthetic construct
  misc_feature 1..20: note = CRISPR gRNA sequence
  source 1..20: mol_type = other DNA
gtcttccatctttacaattt

SEQ ID NO: 35568 - DNA, 20 bp, synthetic construct
  misc_feature 1..20: note = CRISPR gRNA sequence
  source 1..20: mol_type = other DNA
ccatctttacaatttttggg

SEQ ID NO: 35569 - DNA, 20 bp, synthetic construct
  misc_feature 1..20: note = CRISPR gRNA sequence
  source 1..20: mol_type = other DNA
catctttacaatttttgggg

SEQ ID NO: 35570 - DNA, 20 bp, synthetic construct
  misc_feature 1..20: note = CRISPR gRNA sequence
  source 1..20: mol_type = other DNA
tacaatttttggggtcatat

SEQ ID NO: 35571 - DNA, 20 bp, synthetic construct
  misc_feature 1..20: note = CRISPR gRNA sequence
  source 1..20: mol_type = other DNA
acaatttttggggtcatatt

SEQ ID NO: 35572 - DNA, 20 bp, synthetic construct
  misc_feature 1..20: note = CRISPR gRNA sequence
  source 1..20: mol_type = other DNA
caatttttggggtcatattg

SEQ ID NO: 35573 - DNA, 20 bp, synthetic construct
  misc_feature 1..20: note = CRISPR gRNA sequence
  source 1..20: mol_type = other DNA
ttggggtcatattgacatat

SEQ ID NO: 35574 - DNA, 20 bp, synthetic construct
  misc_feature 1..20: note = CRISPR gRNA sequence
  source 1..20: mol_type = other DNA
tggggtcatattgacatatc

SEQ ID NO: 35575 - DNA, 20 bp, synthetic construct
  misc_feature 1..20: note = CRISPR gRNA sequence
  source 1..20: mol_type = other DNA
ggggtcatattgacatatca

SEQ ID NO: 35576 - DNA, 20 bp, synthetic construct
  misc_feature 1..20: note = CRISPR gRNA sequence
  source 1..20: mol_type = other DNA
gggtcatattgacatatcac

SEQ ID NO: 35577 - DNA, 20 bp, synthetic construct
  misc_feature 1..20: note = CRISPR gRNA sequence
  source 1..20: mol_type = other DNA
acatatcacctgttctacaa

SEQ ID NO: 35578 - DNA, 20 bp, synthetic construct
  misc_feature 1..20: note = CRISPR gRNA sequence
  source 1..20: mol_type = other DNA
ttctacaatttaccttagta

SEQ ID NO: 35579 - DNA, 20 bp, synthetic construct
  misc_feature 1..20: note = CRISPR gRNA sequence
  source 1..20: mol_type = other DNA
tacaatttaccttagtattt

SEQ ID NO: 35580 - DNA, 20 bp, synthetic construct
  misc_feature 1..20: note = CRISPR gRNA sequence
  source 1..20: mol_type = other DNA
caatttaccttagtattttt

SEQ ID NO: 35581 - DNA, 20 bp, synthetic construct
  misc_feature 1..20: note = CRISPR gRNA sequence
  source 1..20: mol_type = other DNA
accttagtatttttcttaaa

SEQ ID NO: 35582 - DNA, 20 bp, synthetic construct
  misc_feature 1..20: note = CRISPR gRNA sequence
  source 1..20: mol_type = other DNA
ccttagtatttttcttaaat

SEQ ID NO: 35583 - DNA, 20 bp, synthetic construct
  misc_feature 1..20: note = CRISPR gRNA sequence
  source 1..20: mol_type = other DNA
agtatttttcttaaattaac

SEQ ID NO: 35584 - DNA, 20 bp, synthetic construct
  misc_feature 1..20: note = CRISPR gRNA sequence
  source 1..20: mol_type = other DNA
gtatttttcttaaattaact

SEQ ID NO: 35585 - DNA, 20 bp, synthetic construct
  misc_feature 1..20: note = CRISPR gRNA sequence
  source 1..20: mol_type = other DNA
ttcttaaattaactttttaa

SEQ ID NO: 35586 - DNA, 20 bp, synthetic construct
  misc_feature 1..20: note = CRISPR gRNA sequence
  source 1..20: mol_type = other DNA
tcttaaattaactttttaaa

SEQ ID NO: 35587 - DNA, 20 bp, synthetic construct
  misc_feature 1..20: note = CRISPR gRNA sequence
  source 1..20: mol_type = other DNA
cttaaattaactttttaaag

SEQ ID NO: 35588 - DNA, 20 bp, synthetic construct
  misc_feature 1..20: note = CRISPR gRNA sequence
  source 1..20: mol_type = other DNA
ttaaattaactttttaaaga

SEQ ID NO: 35589 - DNA, 20 bp, synthetic construct
  misc_feature 1..20: note = CRISPR gRNA sequence
  source 1..20: mol_type = other DNA
aaattaactttttaaagaaa

SEQ ID NO: 35590 - DNA, 20 bp, synthetic construct
  misc_feature 1..20: note = CRISPR gRNA sequence
  source 1..20: mol_type = other DNA
aattaactttttaaagaaac

SEQ ID NO: 35591 - DNA, 20 bp, synthetic construct
  misc_feature 1..20: note = CRISPR gRNA sequence
  source 1..20: mol_type = other DNA
actttttaaagaaacttaaa

SEQ ID NO: 35592 - DNA, 20 bp, synthetic construct
  misc_feature 1..20: note = CRISPR gRNA sequence
  source 1..20: mol_type = other DNA
tttaaagaaacttaaataga

SEQ ID NO: 35593 - DNA, 20 bp, synthetic construct
  misc_feature 1..20: note = CRISPR gRNA sequence
  source 1..20: mol_type = other DNA
ttaaagaaacttaaatagac

SEQ ID NO: 35594 - DNA, 20 bp, synthetic construct
  misc_feature 1..20: note = CRISPR gRNA sequence
  source 1..20: mol_type = other DNA
taaagaaacttaaatagacc

SEQ ID NO: 35595 - DNA, 20 bp, synthetic construct
  misc_feature 1..20: note = CRISPR gRNA sequence
  source 1..20: mol_type = other DNA
aaagaaacttaaatagaccg

SEQ ID NO: 35596 - DNA, 20 bp, synthetic construct
  misc_feature 1..20: note = CRISPR gRNA sequence
  source 1..20: mol_type = other DNA
aagaaacttaaatagaccga

SEQ ID NO: 35597 - DNA, 20 bp, synthetic construct
  misc_feature 1..20: note = CRISPR gRNA sequence
  source 1..20: mol_type = other DNA
aaatagaccgattttaaaag

SEQ ID NO: 35598 - DNA, 20 bp, synthetic construct
  misc_feature 1..20: note = CRISPR gRNA sequence
  source 1..20: mol_type = other DNA
aatagaccgattttaaaaga

SEQ ID NO: 35599 - DNA, 20 bp, synthetic construct
  misc_feature 1..20: note = CRISPR gRNA sequence
  source 1..20: mol_type = other DNA
taaaagaaagctttctagag

SEQ ID NO: 35600 - DNA, 20 bp, synthetic construct
  misc_feature 1..20: note = CRISPR gRNA sequence
  source 1..20: mol_type = other DNA
aaaagaaagctttctagagt

SEQ ID NO: 35601 - DNA, 20 bp, synthetic construct
  misc_feature 1..20: note = CRISPR gRNA sequence
  source 1..20: mol_type = other DNA
aaagaaagctttctagagtt

SEQ ID NO: 35602 - DNA, 20 bp, synthetic construct
  misc_feature 1..20: note = CRISPR gRNA sequence
  source 1..20: mol_type = other DNA
tctagagttgaaagcgggga

SEQ ID NO: 35603 - DNA, 20 bp, synthetic construct
  misc_feature 1..20: note = CRISPR gRNA sequence
  source 1..20: mol_type = other DNA
ctagagttgaaagcggggag

SEQ ID NO: 35604 - DNA, 20 bp, synthetic construct
  misc_feature 1..20: note = CRISPR gRNA sequence
  source 1..20: mol_type = other DNA
tagagttgaaagcggggagt

SEQ ID NO: 35605 - DNA, 20 bp, synthetic construct
  misc_feature 1..20: note = CRISPR gRNA sequence
  source 1..20: mol_type = other DNA
gagttgaaagcggggagtca

SEQ ID NO: 35606 - DNA, 20 bp, synthetic construct
  misc_feature 1..20: note = CRISPR gRNA sequence
  source 1..20: mol_type = other DNA
aaagcggggagtcagacaga

SEQ ID NO: 35607 - DNA, 20 bp, synthetic construct
  misc_feature 1..20: note = CRISPR gRNA sequence
  source 1..20: mol_type = other DNA
gtccacccatgtacctagca

SEQ ID NO: 35608 - DNA, 20 bp, synthetic construct
  misc_feature 1..20: note = CRISPR gRNA sequence
  source 1..20: mol_type = other DNA
tccacccatgtacctagcaa

SEQ ID NO: 35609 - DNA, 20 bp, synthetic construct
  misc_feature 1..20: note = CRISPR gRNA sequence
  source 1..20: mol_type = other DNA
gcaagattattcacaatagt

SEQ ID NO: 35610 - DNA, 20 bp, synthetic construct
  misc_feature 1..20: note = CRISPR gRNA sequence
  source 1..20: mol_type = other DNA
ttcacaatagtcaagaggta

SEQ ID NO: 35611 - DNA, 20 bp, synthetic construct
  misc_feature 1..20: note = CRISPR gRNA sequence
  source 1..20: mol_type = other DNA
acaatagtcaagaggtagga

SEQ ID NO: 35612 - DNA, 20 bp, synthetic construct
  misc_feature 1..20: note = CRISPR gRNA sequence
  source 1..20: mol_type = other DNA
tcaacaaatgaatggatgaa

SEQ ID NO: 35613 - DNA, 20 bp, synthetic construct
  misc_feature 1..20: note = CRISPR gRNA sequence
  source 1..20: mol_type = other DNA
gaatactattccgccataga

SEQ ID NO: 35614 - DNA, 20 bp, synthetic construct
  misc_feature 1..20: note = CRISPR gRNA sequence
  source 1..20: mol_type = other DNA
ttccgccatagaaaggaatt

SEQ ID NO: 35615 - DNA, 20 bp, synthetic construct
  misc_feature 1..20: note = CRISPR gRNA sequence
  source 1..20: mol_type = other DNA
cgccatagaaaggaattaca

SEQ ID NO: 35616 - DNA, 20 bp, synthetic construct
  misc_feature 1..20: note = CRISPR gRNA sequence
  source 1..20: mol_type = other DNA
cacatggcacgacatggatg

SEQ ID NO: 35617 - DNA, 20 bp, synthetic construct
  misc_feature 1..20: note = CRISPR gRNA sequence
  source 1..20: mol_type = other DNA
gaagacattatgctaagtga

SEQ ID NO: 35618 - DNA, 20 bp, synthetic construct
  misc_feature 1..20: note = CRISPR gRNA sequence
  source 1..20: mol_type = other DNA
tgctaagtgaaagaagccag

SEQ ID NO: 35619 - DNA, 20 bp, synthetic construct
  misc_feature 1..20: note = CRISPR gRNA sequence
  source 1..20: mol_type = other DNA
agtgaaagaagccaggcaca

SEQ ID NO: 35620 - DNA, 20 bp, synthetic construct
  misc_feature 1..20: note = CRISPR gRNA sequence
  source 1..20: mol_type = other DNA
tatttataggcggtgtctag

SEQ ID NO: 35621 - DNA, 20 bp, synthetic construct
  misc_feature 1..20: note = CRISPR gRNA sequence
  source 1..20: mol_type = other DNA
tttataggcggtgtctagag

SEQ ID NO: 35622 - DNA, 20 bp, synthetic construct
  misc_feature 1..20: note = CRISPR gRNA sequence
  source 1..20: mol_type = other DNA
ataggcggtgtctagagtag

SEQ ID NO: 35623 - DNA, 20 bp, synthetic construct
  misc_feature 1..20: note = CRISPR gRNA sequence
  source 1..20: mol_type = other DNA
taggcggtgtctagagtagc

SEQ ID NO: 35624 - DNA, 20 bp, synthetic construct
  misc_feature 1..20: note = CRISPR gRNA sequence
  source 1..20: mol_type = other DNA
gagtagcccaaaacatagag

SEQ ID NO: 35625 - DNA, 20 bp, synthetic construct
  misc_feature 1..20: note = CRISPR gRNA sequence
  source 1..20: mol_type = other DNA
gagttaccacgagctgggtg

SEQ ID NO: 35626 - DNA, 20 bp, synthetic construct
  misc_feature 1..20: note = CRISPR gRNA sequence
  source 1..20: mol_type = other DNA
ccacgagctgggtggaaggg

SEQ ID NO: 35627 - DNA, 20 bp, synthetic construct
  misc_feature 1..20: note = CRISPR gRNA sequence
  source 1..20: mol_type = other DNA
ggtggaaggggcagtgggga

SEQ ID NO: 35628 - DNA, 20 bp, synthetic construct
  misc_feature 1..20: note = CRISPR gRNA sequence
  source 1..20: mol_type = other DNA
ttgcttattgggtagagttt

SEQ ID NO: 35629 - DNA, 20 bp, synthetic construct
  misc_feature 1..20: note = CRISPR gRNA sequence
  source 1..20: mol_type = other DNA
cttattgggtagagtttcag

SEQ ID NO: 35630 - DNA, 20 bp, synthetic construct
  misc_feature 1..20: note = CRISPR gRNA sequence
  source 1..20: mol_type = other DNA
attgggtagagtttcagttt

SEQ ID NO: 35631 - DNA, 20 bp, synthetic construct
  misc_feature 1..20: note = CRISPR gRNA sequence
  source 1..20: mol_type = other DNA
ttgggtagagtttcagtttg

SEQ ID NO: 35632 - DNA, 20 bp, synthetic construct
  misc_feature 1..20: note = CRISPR gRNA sequence
  source 1..20: mol_type = other DNA
ggtagagtttcagtttggga

SEQ ID NO: 35633 - DNA, 20 bp, synthetic construct
  misc_feature 1..20: note = CRISPR gRNA sequence
  source 1..20: mol_type = other DNA
cagtttgggaggatgaaaaa

SEQ ID NO: 35634 - DNA, 20 bp, synthetic construct
  misc_feature 1..20: note = CRISPR gRNA sequence
  source 1..20: mol_type = other DNA
agtttgggaggatgaaaaag

SEQ ID NO: 35635 - DNA, 20 bp, synthetic construct
  misc_feature 1..20: note = CRISPR gRNA sequence
  source 1..20: mol_type = other DNA
gggaggatgaaaaagttctg

SEQ ID NO: 35636 - DNA, 20 bp, synthetic construct
  misc_feature 1..20: note = CRISPR gRNA sequence
  source 1..20: mol_type = other DNA
ggaggatgaaaaagttctgg

SEQ ID NO: 35637 - DNA, 20 bp, synthetic construct
  misc_feature 1..20: note = CRISPR gRNA sequence
  source 1..20: mol_type = other DNA
tggagatggatggtagcgga

SEQ ID NO: 35638 - DNA, 20 bp, synthetic construct
  misc_feature 1..20: note = CRISPR gRNA sequence
  source 1..20: mol_type = other DNA
gagatggatggtagcggagg

SEQ ID NO: 35639 - DNA, 20 bp, synthetic construct
  misc_feature 1..20: note = CRISPR gRNA sequence
  source 1..20: mol_type = other DNA
cacaacagtttgaaatattt

SEQ ID NO: 35640 - DNA, 20 bp, synthetic construct
  misc_feature 1..20: note = CRISPR gRNA sequence
  source 1..20: mol_type = other DNA
gaaatatttaatgccactga

SEQ ID NO: 35641 - DNA, 20 bp, synthetic construct
  misc_feature 1..20: note = CRISPR gRNA sequence
  source 1..20: mol_type = other DNA
aaatatttaatgccactgaa

SEQ ID NO: 35642 - DNA, 20 bp, synthetic construct
  misc_feature 1..20: note = CRISPR gRNA sequence
  source 1..20: mol_type = other DNA
aatgccactgaaatgtacat

SEQ ID NO: 35643 - DNA, 20 bp, synthetic construct
  misc_feature 1..20: note = CRISPR gRNA sequence
  source 1..20: mol_type = other DNA
atgccactgaaatgtacatt

SEQ ID NO: 35644 - DNA, 20 bp, synthetic construct
  misc_feature 1..20: note = CRISPR gRNA sequence
  source 1..20: mol_type = other DNA
aaatgtacatttgaaagtgg

SEQ ID NO: 35645 - DNA, 20 bp, synthetic construct
  misc_feature 1..20: note = CRISPR gRNA sequence
  source 1..20: mol_type = other DNA
gaaagtggttaaaatggtaa

SEQ ID NO: 35646 - DNA, 20 bp, synthetic construct
  misc_feature 1..20: note = CRISPR gRNA sequence
  source 1..20: mol_type = other DNA
aaagtggttaaaatggtaaa

SEQ ID NO: 35647 - DNA, 20 bp, synthetic construct
  misc_feature 1..20: note = CRISPR gRNA sequence
  source 1..20: mol_type = other DNA
aaatggtaaattttatgtta

SEQ ID NO: 35648 - DNA, 20 bp, synthetic construct
  misc_feature 1..20: note = CRISPR gRNA sequence
  source 1..20: mol_type = other DNA
tatgttatatgtattttacc

SEQ ID NO: 35649 - DNA, 20 bp, synthetic construct
  misc_feature 1..20: note = CRISPR gRNA sequence
  source 1..20: mol_type = other DNA
atgttatatgtattttacca

SEQ ID NO: 35650 - DNA, 20 bp, synthetic construct
  misc_feature 1..20: note = CRISPR gRNA sequence
  source 1..20: mol_type = other DNA
tgttatatgtattttaccat

SEQ ID NO: 35651 - DNA, 20 bp, synthetic construct
  misc_feature 1..20: note = CRISPR gRNA sequence
  source 1..20: mol_type = other DNA
tatgtattttaccatgattt

SEQ ID NO: 35652 - DNA, 20 bp, synthetic construct
  misc_feature 1..20: note = CRISPR gRNA sequence
  source 1..20: mol_type = other DNA
taccatgattttacaaaaag

SEQ ID NO: 35653 - DNA, 20 bp, synthetic construct
  misc_feature 1..20: note = CRISPR gRNA sequence
  source 1..20: mol_type = other DNA
accatgattttacaaaaaga

SEQ ID NO: 35654 - DNA, 20 bp, synthetic construct
  misc_feature 1..20: note = CRISPR gRNA sequence
  source 1..20: mol_type = other DNA
ccatgattttacaaaaagaa

SEQ ID NO: 35655 - DNA, 20 bp, synthetic construct
  misc_feature 1..20: note = CRISPR gRNA sequence
  source 1..20: mol_type = other DNA
tacaaaaagaaaactttttt

SEQ ID NO: 35656 - DNA, 20 bp, synthetic construct
  misc_feature 1..20: note = CRISPR gRNA sequence
  source 1..20: mol_type = other DNA
acaaaaagaaaacttttttt

SEQ ID NO: 35657 - DNA, 20 bp, synthetic construct
  misc_feature 1..20: note = CRISPR gRNA sequence
  source 1..20: mol_type = other DNA
caaaaagaaaactttttttt

SEQ ID NO: 35658 - DNA, 20 bp, synthetic construct
  misc_feature 1..20: note = CRISPR gRNA sequence
  source 1..20: mol_type = other DNA
ttttttccatgtataaacgg

SEQ ID NO: 35659 - DNA, 20 bp, synthetic construct
  misc_feature 1..20: note = CRISPR gRNA sequence
  source 1..20: mol_type = other DNA
tttttccatgtataaacgga

SEQ ID NO: 35660 - DNA, 20 bp, synthetic construct
  misc_feature 1..20: note = CRISPR gRNA sequence
  source 1..20: mol_type = other DNA
ttttccatgtataaacggaa

SEQ ID NO: 35661 - DNA, 20 bp, synthetic construct
  misc_feature 1..20: note = CRISPR gRNA sequence
  source 1..20: mol_type = other DNA
tttccatgtataaacggaaa

SEQ ID NO: 35662 - DNA, 20 bp, synthetic construct
  misc_feature 1..20: note = CRISPR gRNA sequence
  source 1..20: mol_type = other DNA
ttccatgtataaacggaaaa

SEQ ID NO: 35663 - DNA, 20 bp, synthetic construct
  misc_feature 1..20: note = CRISPR gRNA sequence
  source 1..20: mol_type = other DNA
tccatgtataaacggaaaag

SEQ ID NO: 35664 - DNA, 20 bp, synthetic construct
  misc_feature 1..20: note = CRISPR gRNA sequence
  source 1..20: mol_type = other DNA
ccatgtataaacggaaaagc

SEQ ID NO: 35665 - DNA, 20 bp, synthetic construct
  misc_feature 1..20: note = CRISPR gRNA sequence
  source 1..20: mol_type = other DNA
catgtataaacggaaaagca

SEQ ID NO: 35666 - DNA, 20 bp, synthetic construct
  misc_feature 1..20: note = CRISPR gRNA sequence
  source 1..20: mol_type = other DNA
gtggttgaaaaagaaacaat

SEQ ID NO: 35667 - DNA, 20 bp, synthetic construct
  misc_feature 1..20: note = CRISPR gRNA sequence
  source 1..20: mol_type = other DNA
tggttgaaaaagaaacaatg

SEQ ID NO: 35668 - DNA, 20 bp, synthetic construct
  misc_feature 1..20: note = CRISPR gRNA sequence
  source 1..20: mol_type = other DNA
aaaaagaaacaatgttacta

SEQ ID NO: 35669 - DNA, 20 bp, synthetic construct
  misc_feature 1..20: note = CRISPR gRNA sequence
  source 1..20: mol_type = other DNA
ctaaaataatctcagcttct

SEQ ID NO: 35670 - DNA, 20 bp, synthetic construct
  misc_feature 1..20: note = CRISPR gRNA sequence
  source 1..20: mol_type = other DNA
aaataatctcagcttcttta

SEQ ID NO: 35671 - DNA, 20 bp, synthetic construct
  misc_feature 1..20: note = CRISPR gRNA sequence
  source 1..20: mol_type = other DNA
agcttctttaccactttgtt

SEQ ID NO: 35672 - DNA, 20 bp, synthetic construct
  misc_feature 1..20: note = CRISPR gRNA sequence
  source 1..20: mol_type = other DNA
ctttaccactttgttaaaaa

SEQ ID NO: 35673 - DNA, 20 bp, synthetic construct
  misc_feature 1..20: note = CRISPR gRNA sequence
  source 1..20: mol_type = other DNA
tttaccactttgttaaaaag

SEQ ID NO: 35674 - DNA, 20 bp, synthetic construct
  misc_feature 1..20: note = CRISPR gRNA sequence
  source 1..20: mol_type = other DNA
taccactttgttaaaaagaa

SEQ ID NO: 35675 - DNA, 20 bp, synthetic construct
  misc_feature 1..20: note = CRISPR gRNA sequence
  source 1..20: mol_type = other DNA
accactttgttaaaaagaaa

SEQ ID NO: 35676 - DNA, 20 bp, synthetic construct
  misc_feature 1..20: note = CRISPR gRNA sequence
  source 1..20: mol_type = other DNA
ccactttgttaaaaagaaat

SEQ ID NO: 35677 - DNA, 20 bp, synthetic construct
  misc_feature 1..20: note = CRISPR gRNA sequence
  source 1..20: mol_type = other DNA
tgttaaaaagaaatcttagc

SEQ ID NO: 35678 - DNA, 20 bp, synthetic construct
  misc_feature 1..20: note = CRISPR gRNA sequence
  source 1..20: mol_type = other DNA
gttaaaaagaaatcttagca

SEQ ID NO: 35679 - DNA, 20 bp, synthetic construct
  misc_feature 1..20: note = CRISPR gRNA sequence
  source 1..20: mol_type = other DNA
ttaaaaagaaatcttagcaa

SEQ ID NO: 35680 - DNA, 20 bp, synthetic construct
  misc_feature 1..20: note = CRISPR gRNA sequence
  source 1..20: mol_type = other DNA
aaaagaaatcttagcaagca

SEQ ID NO: 35681 - DNA, 20 bp, synthetic construct
  misc_feature 1..20: note = CRISPR gRNA sequence
  source 1..20: mol_type = other DNA
agcaagcattagggcactgt

SEQ ID NO: 35682 - DNA, 20 bp, synthetic construct
  misc_feature 1..20: note = CRISPR gRNA sequence
  source 1..20: mol_type = other DNA
gcaagcattagggcactgtc

SEQ ID NO: 35683 - DNA, 20 bp, synthetic construct
  misc_feature 1..20: note = CRISPR gRNA sequence
  source 1..20: mol_type = other DNA
gggcactgtcaaacatcagg

SEQ ID NO: 35684 - DNA, 20 bp, synthetic construct
  misc_feature 1..20: note = CRISPR gRNA sequence
  source 1..20: mol_type = other DNA
tcaaacatcagggaaaatca

SEQ ID NO: 35685 - DNA, 20 bp, synthetic construct
  misc_feature 1..20: note = CRISPR gRNA sequence
  source 1..20: mol_type = other DNA
tgtccttgatgtcagaagga

SEQ ID NO: 35686 - DNA, 20 bp, synthetic construct
  misc_feature 1..20: note = CRISPR gRNA sequence
  source 1..20: mol_type = other DNA
gtccttgatgtcagaaggat

SEQ ID NO: 35687 - DNA, 20 bp, synthetic construct
  misc_feature 1..20: note = CRISPR gRNA sequence
  source 1..20: mol_type = other DNA
tccttgatgtcagaaggatt

SEQ ID NO: 35688 - DNA, 20 bp, synthetic construct
  misc_feature 1..20: note = CRISPR gRNA sequence
  source 1..20: mol_type = other DNA
gatgtcagaaggattgaagg

SEQ ID NO: 35689 - DNA, 20 bp, synthetic construct
  misc_feature 1..20: note = CRISPR gRNA sequence
  source 1..20: mol_type = other DNA
atgtcagaaggattgaagga

SEQ ID NO: 35690 - DNA, 20 bp, synthetic construct
  misc_feature 1..20: note = CRISPR gRNA sequence
  source 1..20: mol_type = other DNA
aaggaatctgaaaactatct

SEQ ID NO: 35691 - DNA, 20 bp, synthetic construct
  misc_feature 1..20: note = CRISPR gRNA sequence
  source 1..20: mol_type = other DNA
aaaactatctatgtccttcc

SEQ ID NO: 35692 - DNA, 20 bp, synthetic construct
  misc_feature 1..20: note = CRISPR gRNA sequence
  source 1..20: mol_type = other DNA
tctatgtccttcctatgaga

SEQ ID NO: 35693 - DNA, 20 bp, synthetic construct
  misc_feature 1..20: note = CRISPR gRNA sequence
  source 1..20: mol_type = other DNA
tgtccttcctatgagaatcg

SEQ ID NO: 35694 - DNA, 20 bp, synthetic construct
  misc_feature 1..20: note = CRISPR gRNA sequence
  source 1..20: mol_type = other DNA
cctatgagaatcggtggtaa

SEQ ID NO: 35695 - DNA, 20 bp, synthetic construct
  misc_feature 1..20: note = CRISPR gRNA sequence
  source 1..20: mol_type = other DNA
ctatgagaatcggtggtaac

SEQ ID NO: 35696 - DNA, 20 bp, synthetic construct
  misc_feature 1..20: note = CRISPR gRNA sequence
  source 1..20: mol_type = other DNA
tgagaatcggtggtaactaa

SEQ ID NO: 35697 - DNA, 20 bp, synthetic construct
  misc_feature 1..20: note = CRISPR gRNA sequence
  source 1..20: mol_type = other DNA
atgcccctttctgaactgtc

SEQ ID NO: 35698 - DNA, 20 bp, synthetic construct
  misc_feature 1..20: note = CRISPR gRNA sequence
  source 1..20: mol_type = other DNA
tctgaactgtcttttgactg

SEQ ID NO: 35699 - DNA, 20 bp, synthetic construct
  misc_feature 1..20: note = CRISPR gRNA sequence
  source 1..20: mol_type = other DNA
ctgaactgtcttttgactgt

SEQ ID NO: 35700 - DNA, 20 bp, synthetic construct
  misc_feature 1..20: note = CRISPR gRNA sequence
  source 1..20: mol_type = other DNA
tgaactgtcttttgactgtg

SEQ ID NO: 35701 - DNA, 20 bp, synthetic construct
  misc_feature 1..20: note = CRISPR gRNA sequence
  source 1..20: mol_type = other DNA
aactgtcttttgactgtgtg

SEQ ID NO: 35702 - DNA, 20 bp, synthetic construct
  misc_feature 1..20: note = CRISPR gRNA sequence
  source 1..20: mol_type = other DNA
tcttttgactgtgtgtgtct

SEQ ID NO: 35703 - DNA, 20 bp, synthetic construct
  misc_feature 1..20: note = CRISPR gRNA sequence
  source 1..20: mol_type = other DNA
ttgactgtgtgtgtcttggt

SEQ ID NO: 35704 - DNA, 20 bp, synthetic construct
  misc_feature 1..20: note = CRISPR gRNA sequence
  source 1..20: mol_type = other DNA
tgactgtgtgtgtcttggtc

SEQ ID NO: 35705 - DNA, 20 bp, synthetic construct
  misc_feature 1..20: note = CRISPR gRNA sequence
  source 1..20: mol_type = other DNA
gactgtgtgtgtcttggtct

SEQ ID NO: 35706 - DNA, 20 bp, synthetic construct
  misc_feature 1..20: note = CRISPR gRNA sequence
  source 1..20: mol_type = other DNA
actgtgtgtgtcttggtctt

SEQ ID NO: 35707 - DNA, 20 bp, synthetic construct
  misc_feature 1..20: note = CRISPR gRNA sequence
  source 1..20: mol_type = other DNA
tgtgtgtcttggtctttgga

SEQ ID NO: 35708 - DNA, 20 bp, synthetic construct
  misc_feature 1..20: note = CRISPR gRNA sequence
  source 1..20: mol_type = other DNA
ggtctttggaaacctcccat

SEQ ID NO: 35709 - DNA, 20 bp, synthetic construct
  misc_feature 1..20: note = CRISPR gRNA sequence
  source 1..20: mol_type = other DNA
gtctttggaaacctcccatc

SEQ ID NO: 35710 - DNA, 20 bp, synthetic construct
  misc_feature 1..20: note = CRISPR gRNA sequence
  source 1..20: mol_type = other DNA
tggaaacctcccatctgcct

SEQ ID NO: 35711 - DNA, 20 bp, synthetic construct
  misc_feature 1..20: note = CRISPR gRNA sequence
  source 1..20: mol_type = other DNA
ggaaacctcccatctgccta

SEQ ID NO: 35712 - DNA, 20 bp, synthetic construct
  misc_feature 1..20: note = CRISPR gRNA sequence
  source 1..20: mol_type = other DNA
gaaacctcccatctgcctat

SEQ ID NO: 35713 - DNA, 20 bp, synthetic construct
  misc_feature 1..20: note = CRISPR gRNA sequence
  source 1..20: mol_type = other DNA
ccatctgcctatgctttcct

SEQ ID NO: 35714 - DNA, 20 bp, synthetic construct
  misc_feature 1..20: note = CRISPR gRNA sequence
  source 1..20: mol_type = other DNA
cctatgctttcctctctgac

SEQ ID NO: 35715 - DNA, 20 bp, synthetic construct
  misc_feature 1..20: note = CRISPR gRNA sequence
  source 1..20: mol_type = other DNA
tgctttcctctctgactttt

SEQ ID NO: 35716 - DNA, 20 bp, synthetic construct
  misc_feature 1..20: note = CRISPR gRNA sequence
  source 1..20: mol_type = other DNA
tcctctctgacttttttctc

SEQ ID NO: 35717 - DNA, 20 bp, synthetic construct
  misc_feature 1..20: note = CRISPR gRNA sequence
  source 1..20: mol_type = other DNA
cctctctgacttttttctct

SEQ ID NO: 35718 - DNA, 20 bp, synthetic construct
  misc_feature 1..20: note = CRISPR gRNA sequence
  source 1..20: mol_type = other DNA
ctctctgacttttttctctc

SEQ ID NO: 35719 - DNA, 20 bp, synthetic construct
  misc_feature 1..20: note = CRISPR gRNA sequence
  source 1..20: mol_type = other DNA
tctgacttttttctctctct

SEQ ID NO: 35720 - DNA, 20 bp, synthetic construct
  misc_feature 1..20: note = CRISPR gRNA sequence
  source 1..20: mol_type = other DNA
tgacttttttctctctcttt

SEQ ID NO: 35721 - DNA, 20 bp, synthetic construct
  misc_feature 1..20: note = CRISPR gRNA sequence
  source 1..20: mol_type = other DNA
acttttttctctctcttttt

SEQ ID NO: 35722 - DNA, 20 bp, synthetic construct
  misc_feature 1..20: note = CRISPR gRNA sequence
  source 1..20: mol_type = other DNA
ttttctctctcttttttttt

SEQ ID NO: 35723 - DNA, 20 bp, synthetic construct
  misc_feature 1..20: note = CRISPR gRNA sequence
  source 1..20: mol_type = other DNA
tttctctctctttttttttt

SEQ ID NO: 35724 - DNA, 20 bp, synthetic construct
  misc_feature 1..20: note = CRISPR gRNA sequence
  source 1..20: mol_type = other DNA
ttctctctcttttttttttc

SEQ ID NO: 35725 - DNA, 20 bp, synthetic construct
  misc_feature 1..20: note = CRISPR gRNA sequence
  source 1..20: mol_type = other DNA
tctctctcttttttttttcc

SEQ ID NO: 35726 - DNA, 20 bp, synthetic construct
  misc_feature 1..20: note = CRISPR gRNA sequence
  source 1..20: mol_type = other DNA
ctctctcttttttttttcct

SEQ ID NO: 35727 - DNA, 20 bp, synthetic construct
  misc_feature 1..20: note = CRISPR gRNA sequence
  source 1..20: mol_type = other DNA
tctctcttttttttttcctg

SEQ ID NO: 35728 - DNA, 20 bp, synthetic construct
  misc_feature 1..20: note = CRISPR gRNA sequence
  source 1..20: mol_type = other DNA
tctcttttttttttcctgag

SEQ ID NO: 35729 - DNA, 20 bp, synthetic construct
  misc_feature 1..20: note = CRISPR gRNA sequence
  source 1..20: mol_type = other DNA
tcttttttttttcctgagac

SEQ ID NO: 35730 - DNA, 20 bp, synthetic construct
  misc_feature 1..20: note = CRISPR gRNA sequence
  source 1..20: mol_type = other DNA
ttttttttttcctgagacag

SEQ ID NO: 35731 - DNA, 20 bp, synthetic construct
  misc_feature 1..20: note = CRISPR gRNA sequence
  source 1..20: mol_type = other DNA
ttttttttcctgagacagtc

SEQ ID NO: 35732 - DNA, 20 bp, synthetic construct
  misc_feature 1..20: note = CRISPR gRNA sequence
  source 1..20: mol_type = other DNA
tttttttcctgagacagtct

SEQ ID NO: 35733 - DNA, 20 bp, synthetic construct
  misc_feature 1..20: note = CRISPR gRNA sequence
  source 1..20: mol_type = other DNA
ttttttcctgagacagtctt

SEQ ID NO: 35734 - DNA, 20 bp, synthetic construct
  misc_feature 1..20: note = CRISPR gRNA sequence
  source 1..20: mol_type = other DNA
tttttcctgagacagtcttg

SEQ ID NO: 35735 - DNA, 20 bp, synthetic construct
  misc_feature 1..20: note = CRISPR gRNA sequence
  source 1..20: mol_type = other DNA
ttttcctgagacagtcttgc

SEQ ID NO: 35736 - DNA, 20 bp, synthetic construct
  misc_feature 1..20: note = CRISPR gRNA sequence
  source 1..20: mol_type = other DNA
tttcctgagacagtcttgct

SEQ ID NO: 35737 - DNA, 20 bp, synthetic construct
  misc_feature 1..20: note = CRISPR gRNA sequence
  source 1..20: mol_type = other DNA
ttcctgagacagtcttgctc

SEQ ID NO: 35738 - DNA, 20 bp, synthetic construct
  misc_feature 1..20: note = CRISPR gRNA sequence
  source 1..20: mol_type = other DNA
tcctgagacagtcttgctct

SEQ ID NO: 35739 - DNA, 20 bp, synthetic construct
  misc_feature 1..20: note = CRISPR gRNA sequence
  source 1..20: mol_type = other DNA
cctgagacagtcttgctctg

SEQ ID NO: 35740 - DNA, 20 bp, synthetic construct
  misc_feature 1..20: note = CRISPR gRNA sequence
  source 1..20: mol_type = other DNA
ctgagacagtcttgctctgt

SEQ ID NO: 35741 - DNA, 20 bp, synthetic construct
  misc_feature 1..20: note = CRISPR gRNA sequence
  source 1..20: mol_type = other DNA
agacagtcttgctctgttgc

SEQ ID NO: 35742 - DNA, 20 bp, synthetic construct
  misc_feature 1..20: note = CRISPR gRNA sequence
  source 1..20: mol_type = other DNA
gctctgttgcccaggctggc

SEQ ID NO: 35743 - DNA, 20 bp, synthetic construct
  misc_feature 1..20: note = CRISPR gRNA sequence
  source 1..20: mol_type = other DNA
ctctgttgcccaggctggcg

SEQ ID NO: 35744 - DNA, 20 bp, synthetic construct
  misc_feature 1..20: note = CRISPR gRNA sequence
  source 1..20: mol_type = other DNA
tgttgcccaggctggcgtgc

SEQ ID NO: 35745 - DNA, 20 bp, synthetic construct
  misc_feature 1..20: note = CRISPR gRNA sequence
  source 1..20: mol_type = other DNA
ttgcccaggctggcgtgcag

SEQ ID NO: 35746 - DNA, 20 bp, synthetic construct
  misc_feature 1..20: note = CRISPR gRNA sequence
  source 1..20: mol_type = other DNA
cccaggctggcgtgcagtgg

SEQ ID NO: 35747 - DNA, 20 bp, synthetic construct
  misc_feature 1..20: note = CRISPR gRNA sequence
  source 1..20: mol_type = other DNA
gcgtgcagtggtgcaatctc

SEQ ID NO: 35748 - DNA, 20 bp, synthetic construct
  misc_feature 1..20: note = CRISPR gRNA sequence
  source 1..20: mol_type = other DNA
agctctcgggtaacctccac

SEQ ID NO: 35749 - DNA, 20 bp, synthetic construct
  misc_feature 1..20: note = CRISPR gRNA sequence
  source 1..20: mol_type = other DNA
tcgggtaacctccacctctc

SEQ ID NO: 35750 - DNA, 20 bp, synthetic construct
  misc_feature 1..20: note = CRISPR gRNA sequence
  source 1..20: mol_type = other DNA
gggtaacctccacctctcgg

SEQ ID NO: 35751 - DNA, 20 bp, synthetic construct
  misc_feature 1..20: note = CRISPR gRNA sequence
  source 1..20: mol_type = other DNA
cacctctcgggtaaactccg

SEQ ID NO: 35752 - DNA, 20 bp, synthetic construct
  misc_feature 1..20: note = CRISPR gRNA sequence
  source 1..20: mol_type = other DNA
tcgggtaaactccgcctctt

SEQ ID NO: 35753 - DNA, 20 bp, synthetic construct
  misc_feature 1..20: note = CRISPR gRNA sequence
  source 1..20: mol_type = other DNA
gggtaaactccgcctcttgg

SEQ ID NO: 35754 - DNA, 20 bp, synthetic construct
  misc_feature 1..20: note = CRISPR gRNA sequence
  source 1..20: mol_type = other DNA
cgcctcttgggttcaagtga

SEQ ID NO: 35755 - DNA, 20 bp, synthetic construct
  misc_feature 1..20: note = CRISPR gRNA sequence
  source 1..20: mol_type = other DNA
ttgggttcaagtgattctcg

SEQ ID NO: 35756 - DNA, 20 bp, synthetic construct
  misc_feature 1..20: note = CRISPR gRNA sequence
  source 1..20: mol_type = other DNA
gggttcaagtgattctcgtg

SEQ ID NO: 35757 - DNA, 20 bp, synthetic construct
  misc_feature 1..20: note = CRISPR gRNA sequence
  source 1..20: mol_type = other DNA
ggttcaagtgattctcgtgc

SEQ ID NO: 35758 - DNA, 20 bp, synthetic construct
  misc_feature 1..20: note = CRISPR gRNA sequence
  source 1..20: mol_type = other DNA
aagtgattctcgtgcctcag

SEQ ID NO: 35759 - DNA, 20 bp, synthetic construct
  misc_feature 1..20: note = CRISPR gRNA sequence
  source 1..20: mol_type = other DNA
tcgtgcctcagcctcccaag

SEQ ID NO: 35760 - DNA, 20 bp, synthetic construct
  misc_feature 1..20: note = CRISPR gRNA sequence
  source 1..20: mol_type = other DNA
gtgcctcagcctcccaagta

SEQ ID NO: 35761 - DNA, 20 bp, synthetic construct
  misc_feature 1..20: note = CRISPR gRNA sequence
  source 1..20: mol_type = other DNA
agcctcccaagtagttgaga

SEQ ID NO: 35762 - DNA, 20 bp, synthetic construct
  misc_feature 1..20: note = CRISPR gRNA sequence
  source 1..20: mol_type = other DNA
ccaagtagttgagattacag

SEQ ID NO: 35763 - DNA, 20 bp, synthetic construct
  misc_feature 1..20: note = CRISPR gRNA sequence
  source 1..20: mol_type = other DNA
agattacaggtgtgcaccac

SEQ ID NO: 35764 - DNA, 20 bp, synthetic construct
  misc_feature 1..20: note = CRISPR gRNA sequence
  source 1..20: mol_type = other DNA
caggtgtgcaccaccatgcc

SEQ ID NO: 35765 - DNA, 20 bp, synthetic construct
  misc_feature 1..20: note = CRISPR gRNA sequence
  source 1..20: mol_type = other DNA
aaacacaaaaaagtgtttta

SEQ ID NO: 35766 - DNA, 20 bp, synthetic construct
  misc_feature 1..20: note = CRISPR gRNA sequence
  source 1..20: mol_type = other DNA
tagtagagttggggtttctc

SEQ ID NO: 35767 - DNA, 20 bp, synthetic construct
  misc_feature 1..20: note = CRISPR gRNA sequence
  source 1..20: mol_type = other DNA
agtagagttggggtttctcc

SEQ ID NO: 35768 - DNA, 20 bp, synthetic construct
  misc_feature 1..20: note = CRISPR gRNA sequence
  source 1..20: mol_type = other DNA
gtagagttggggtttctcca

SEQ ID NO: 35769 - DNA, 20 bp, synthetic construct
  misc_feature 1..20: note = CRISPR gRNA sequence
  source 1..20: mol_type = other DNA
gggtttctccaggttgccca

SEQ ID NO: 35770 - DNA, 20 bp, synthetic construct
  misc_feature 1..20: note = CRISPR gRNA sequence
  source 1..20: mol_type = other DNA
ctccaggttgcccaggctgg

SEQ ID NO: 35771 - DNA, 20 bp, synthetic construct
  misc_feature 1..20: note = CRISPR gRNA sequence
  source 1..20: mol_type = other DNA
tccaggttgcccaggctggt

SEQ ID NO: 35772 - DNA, 20 bp, synthetic construct
  misc_feature 1..20: note = CRISPR gRNA sequence
  source 1..20: mol_type = other DNA
caggttgcccaggctggtct

SEQ ID NO: 35773 - DNA, 20 bp, synthetic construct
  misc_feature 1..20: note = CRISPR gRNA sequence
  source 1..20: mol_type = other DNA
cccaggctggtcttgaactc

SEQ ID NO: 35774 - DNA, 20 bp, synthetic construct
  misc_feature 1..20: note = CRISPR gRNA sequence
  source 1..20: mol_type = other DNA
gtcttgaactcctggcctca

SEQ ID NO: 35775 - DNA, 20 bp, synthetic construct
  misc_feature 1..20: note = CRISPR gRNA sequence
  source 1..20: mol_type = other DNA
gaactcctggcctcaagcaa

SEQ ID NO: 35776 - DNA, 20 bp, synthetic construct
  misc_feature 1..20: note = CRISPR gRNA sequence
  source 1..20: mol_type = other DNA
aactcctggcctcaagcaat

SEQ ID NO: 35777 - DNA, 20 bp, synthetic construct
  misc_feature 1..20: note = CRISPR gRNA sequence
  source 1..20: mol_type = other DNA
ctggcctcaagcaatccacc

SEQ ID NO: 35778 - DNA, 20 bp, synthetic construct
  misc_feature 1..20: note = CRISPR gRNA sequence
  source 1..20: mol_type = other DNA
gcctcaagcaatccacccgc

SEQ ID NO: 35779 - DNA, 20 bp, synthetic construct
  misc_feature 1..20: note = CRISPR gRNA sequence
  source 1..20: mol_type = other DNA
aagcaatccacccgcctcgg

SEQ ID NO: 35780 - DNA, 20 bp, synthetic construct
  misc_feature 1..20: note = CRISPR gRNA sequence
  source 1..20: mol_type = other DNA
ggcctcccaaagtgctagga

SEQ ID NO: 35781 - DNA, 20 bp, synthetic construct
  misc_feature 1..20: note = CRISPR gRNA sequence
  source 1..20: mol_type = other DNA
ccaaagtgctaggattacag

SEQ ID NO: 35782 - DNA, 20 bp, synthetic construct
  misc_feature 1..20: note = CRISPR gRNA sequence
  source 1..20: mol_type = other DNA
ggattacaggtgtgaaccac

SEQ ID NO: 35783 - DNA, 20 bp, synthetic construct
  misc_feature 1..20: note = CRISPR gRNA sequence
  source 1..20: mol_type = other DNA
caggtgtgaaccactgctcc

SEQ ID NO: 35784 - DNA, 20 bp, synthetic construct
  misc_feature 1..20: note = CRISPR gRNA sequence
  source 1..20: mol_type = other DNA
ctcccggcccctctctgatc

SEQ ID NO: 35785 - DNA, 20 bp, synthetic construct
  misc_feature 1..20: note = CRISPR gRNA sequence
  source 1..20: mol_type = other DNA
ccggcccctctctgatcttt

SEQ ID NO: 35786 - DNA, 20 bp, synthetic construct
  misc_feature 1..20: note = CRISPR gRNA sequence
  source 1..20: mol_type = other DNA
tctgatctttctaaacaatc

SEQ ID NO: 35787 - DNA, 20 bp, synthetic construct
  misc_feature 1..20: note = CRISPR gRNA sequence
  source 1..20: mol_type = other DNA
tgatctttctaaacaatccc

SEQ ID NO: 35788 - DNA, 20 bp, synthetic construct
  misc_feature 1..20: note = CRISPR gRNA sequence
  source 1..20: mol_type = other DNA
atctttctaaacaatccctt

SEQ ID NO: 35789 - DNA, 20 bp, synthetic construct
  misc_feature 1..20: note = CRISPR gRNA sequence
  source 1..20: mol_type = other DNA
tctaaacaatccctttagga

SEQ ID NO: 35790 - DNA, 20 bp, synthetic construct
  misc_feature 1..20: note = CRISPR gRNA sequence
  source 1..20: mol_type = other DNA
ctaaacaatccctttaggat

SEQ ID NO: 35791 - DNA, 20 bp, synthetic construct
  misc_feature 1..20: note = CRISPR gRNA sequence
  source 1..20: mol_type = other DNA
taaacaatccctttaggatc

SEQ ID NO: 35792 - DNA, 20 bp, synthetic construct
  misc_feature 1..20: note = CRISPR gRNA sequence
  source 1..20: mol_type = other DNA
aacaatccctttaggatcta

SEQ ID NO: 35793 - DNA, 20 bp, synthetic construct
  misc_feature 1..20: note = CRISPR gRNA sequence
  source 1..20: mol_type = other DNA
taggatctataataattatt

SEQ ID NO: 35794 - DNA, 20 bp, synthetic construct
  misc_feature 1..20: note = CRISPR gRNA sequence
  source 1..20: mol_type = other DNA
aggatctataataattattc

SEQ ID NO: 35795 - DNA, 20 bp, synthetic construct
  misc_feature 1..20: note = CRISPR gRNA sequence
  source 1..20: mol_type = other DNA
ggatctataataattattcc

SEQ ID NO: 35796 - DNA, 20 bp, synthetic construct
  misc_feature 1..20: note = CRISPR gRNA sequence
  source 1..20: mol_type = other DNA
taataattattcccaatgca

SEQ ID NO: 35797 - DNA, 20 bp, synthetic construct
  misc_feature 1..20: note = CRISPR gRNA sequence
  source 1..20: mol_type = other DNA
ttcccaatgcatgaatattc

SEQ ID NO: 35798 - DNA, 20 bp, synthetic construct
  misc_feature 1..20: note = CRISPR gRNA sequence
  source 1..20: mol_type = other DNA
ccaatgcatgaatattcttt

SEQ ID NO: 35799 - DNA, 20 bp, synthetic construct
  misc_feature 1..20: note = CRISPR gRNA sequence
  source 1..20: mol_type = other DNA
tttggtggttttctaaagtg

SEQ ID NO: 35800 - DNA, 20 bp, synthetic construct
  misc_feature 1..20: note = CRISPR gRNA sequence
  source 1..20: mol_type = other DNA
tggtggttttctaaagtgct

SEQ ID NO: 35801 - DNA, 20 bp, synthetic construct
  misc_feature 1..20: note = CRISPR gRNA sequence
  source 1..20: mol_type = other DNA
ggtggttttctaaagtgctt

SEQ ID NO: 35802 - DNA, 20 bp, synthetic construct
  misc_feature 1..20: note = CRISPR gRNA sequence
  source 1..20: mol_type = other DNA
gtggttttctaaagtgcttt

SEQ ID NO: 35803 - DNA, 20 bp, synthetic construct
  misc_feature 1..20: note = CRISPR gRNA sequence
  source 1..20: mol_type = other DNA
tctaaagtgctttttctgta

SEQ ID NO: 35804 - DNA, 20 bp, synthetic construct
  misc_feature 1..20: note = CRISPR gRNA sequence
  source 1..20: mol_type = other DNA
ctaaagtgctttttctgtac

SEQ ID NO: 35805 - DNA, 20 bp, synthetic construct
  misc_feature 1..20: note = CRISPR gRNA sequence
  source 1..20: mol_type = other DNA
taaagtgctttttctgtaca

SEQ ID NO: 35806 - DNA, 20 bp, synthetic construct
  misc_feature 1..20: note = CRISPR gRNA sequence
  source 1..20: mol_type = other DNA
aagtgctttttctgtacaca

SEQ ID NO: 35807 - DNA, 20 bp, synthetic construct
  misc_feature 1..20: note = CRISPR gRNA sequence
  source 1..20: mol_type = other DNA
tttctgtacacatcagacat

SEQ ID NO: 35808 - DNA, 20 bp, synthetic construct
  misc_feature 1..20: note = CRISPR gRNA sequence
  source 1..20: mol_type = other DNA
ttctgtacacatcagacatc

SEQ ID NO: 35809 - DNA, 20 bp, synthetic construct
  misc_feature 1..20: note = CRISPR gRNA sequence
  source 1..20: mol_type = other DNA
tctgtacacatcagacatca

SEQ ID NO: 35810 - DNA, 20 bp, synthetic construct
  misc_feature 1..20: note = CRISPR gRNA sequence
  source 1..20: mol_type = other DNA
ctgtacacatcagacatcat

SEQ ID NO: 35811 - DNA, 20 bp, synthetic construct
  misc_feature 1..20: note = CRISPR gRNA sequence
  source 1..20: mol_type = other DNA
tgtacacatcagacatcatc

SEQ ID NO: 35812 - DNA, 20 bp, synthetic construct
  misc_feature 1..20: note = CRISPR gRNA sequence
  source 1..20: mol_type = other DNA
tacacatcagacatcatcaa

SEQ ID NO: 35813 - DNA, 20 bp, synthetic construct
  misc_feature 1..20: note = CRISPR gRNA sequence
  source 1..20: mol_type = other DNA
tcatgttttatccattttac

SEQ ID NO: 35814 - DNA, 20 bp, synthetic construct
  misc_feature 1..20: note = CRISPR gRNA sequence
  source 1..20: mol_type = other DNA
atgttttatccattttacag

SEQ ID NO: 35815 - DNA, 20 bp, synthetic construct
  misc_feature 1..20: note = CRISPR gRNA sequence
  source 1..20: mol_type = other DNA
tatccattttacagatgaac

SEQ ID NO: 35816 - DNA, 20 bp, synthetic construct
  misc_feature 1..20: note = CRISPR gRNA sequence
  source 1..20: mol_type = other DNA
atccattttacagatgaacc

SEQ ID NO: 35817 - DNA, 20 bp, synthetic construct
  misc_feature 1..20: note = CRISPR gRNA sequence
  source 1..20: mol_type = other DNA
tccattttacagatgaacct

SEQ ID NO: 35818 - DNA, 20 bp, synthetic construct
  misc_feature 1..20: note = CRISPR gRNA sequence
  source 1..20: mol_type = other DNA
tacagatgaacctcagagag

SEQ ID NO: 35819 - DNA, 20 bp, synthetic construct
  misc_feature 1..20: note = CRISPR gRNA sequence
  source 1..20: mol_type = other DNA
acagatgaacctcagagagg

SEQ ID NO: 35820 - DNA, 20 bp, synthetic construct
  misc_feature 1..20: note = CRISPR gRNA sequence
  source 1..20: mol_type = other DNA
cagatgaacctcagagaggg

SEQ ID NO: 35821 - DNA, 20 bp, synthetic construct
  misc_feature 1..20: note = CRISPR gRNA sequence
  source 1..20: mol_type = other DNA
agagaggggaagtcacttgt

SEQ ID NO: 35822 - DNA, 20 bp, synthetic construct
  misc_feature 1..20: note = CRISPR gRNA sequence
  source 1..20: mol_type = other DNA
gtcagtgtgactcaaggcaa

SEQ ID NO: 35823 - DNA, 20 bp, synthetic construct
  misc_feature 1..20: note = CRISPR gRNA sequence
  source 1..20: mol_type = other DNA
tcagtgtgactcaaggcaaa

SEQ ID NO: 35824 - DNA, 20 bp, synthetic construct
  misc_feature 1..20: note = CRISPR gRNA sequence
  source 1..20: mol_type = other DNA
aaggcaaatctgaggctaag

SEQ ID NO: 35825 - DNA, 20 bp, synthetic construct
  misc_feature 1..20: note = CRISPR gRNA sequence
  source 1..20: mol_type = other DNA
aggctaagtccagaagtttc

SEQ ID NO: 35826 - DNA, 20 bp, synthetic construct
  misc_feature 1..20: note = CRISPR gRNA sequence
  source 1..20: mol_type = other DNA
agtccagaagtttcctacct

SEQ ID NO: 35827 - DNA, 20 bp, synthetic construct
  misc_feature 1..20: note = CRISPR gRNA sequence
  source 1..20: mol_type = other DNA
cctacctccctccagccact

SEQ ID NO: 35828 - DNA, 20 bp, synthetic construct
  misc_feature 1..20: note = CRISPR gRNA sequence
  source 1..20: mol_type = other DNA
ctacctccctccagccactt

SEQ ID NO: 35829 - DNA, 20 bp, synthetic construct
  misc_feature 1..20: note = CRISPR gRNA sequence
  source 1..20: mol_type = other DNA
cctccctccagccacttccc

SEQ ID NO: 35830 - DNA, 20 bp, synthetic construct
  misc_feature 1..20: note = CRISPR gRNA sequence
  source 1..20: mol_type = other DNA
cctccagccacttccctgat

SEQ ID NO: 35831 - DNA, 20 bp, synthetic construct
  misc_feature 1..20: note = CRISPR gRNA sequence
  source 1..20: mol_type = other DNA
cagccacttccctgattgcc

SEQ ID NO: 35832 - DNA, 20 bp, synthetic construct
  misc_feature 1..20: note = CRISPR gRNA sequence
  source 1..20: mol_type = other DNA
ccctgattgcctggaactaa

SEQ ID NO: 35833 - DNA, 20 bp, synthetic construct
  misc_feature 1..20: note = CRISPR gRNA sequence
  source 1..20: mol_type = other DNA
cctgattgcctggaactaat

SEQ ID NO: 35834 - DNA, 20 bp, synthetic construct
  misc_feature 1..20: note = CRISPR gRNA sequence
  source 1..20: mol_type = other DNA
attgcctggaactaatccag

SEQ ID NO: 35835 - DNA, 20 bp, synthetic construct
  misc_feature 1..20: note = CRISPR gRNA sequence
  source 1..20: mol_type = other DNA
cctggaactaatccagagtt

SEQ ID NO: 35836 - DNA, 20 bp, synthetic construct
  misc_feature 1..20: note = CRISPR gRNA sequence
  source 1..20: mol_type = other DNA
gaactaatccagagtttcct

SEQ ID NO: 35837 - DNA, 20 bp, synthetic construct
  misc_feature 1..20: note = CRISPR gRNA sequence
  source 1..20: mol_type = other DNA
atccagagtttccttgggtt

SEQ ID NO: 35838 - DNA, 20 bp, synthetic construct
  misc_feature 1..20: note = CRISPR gRNA sequence
  source 1..20: mol_type = other DNA
ccttgggttaatttctgatt

SEQ ID NO: 35839 - DNA, 20 bp, synthetic construct
  misc_feature 1..20: note = CRISPR gRNA sequence
  source 1..20: mol_type = other DNA
cttgggttaatttctgattc

SEQ ID NO: 35840 - DNA, 20 bp, synthetic construct
  misc_feature 1..20: note = CRISPR gRNA sequence
  source 1..20: mol_type = other DNA
gggttaatttctgattctgc

SEQ ID NO: 35841 - DNA, 20 bp, synthetic construct
  misc_feature 1..20: note = CRISPR gRNA sequence
  source 1..20: mol_type = other DNA
ggttaatttctgattctgct

SEQ ID NO: 35842 - DNA, 20 bp, synthetic construct
  misc_feature 1..20: note = CRISPR gRNA sequence
  source 1..20: mol_type = other DNA
atttctgattctgctcttct

SEQ ID NO: 35843 - DNA, 20 bp, synthetic construct
  misc_feature 1..20: note = CRISPR gRNA sequence
  source 1..20: mol_type = other DNA
ctgattctgctcttctcaag

SEQ ID NO: 35844 - DNA, 20 bp, synthetic construct
  misc_feature 1..20: note = CRISPR gRNA sequence
  source 1..20: mol_type = other DNA
tgattctgctcttctcaagg

SEQ ID NO: 35845 - DNA, 20 bp, synthetic construct
  misc_feature 1..20: note = CRISPR gRNA sequence
  source 1..20: mol_type = other DNA
attctgctcttctcaaggta

SEQ ID NO: 35846 - DNA, 20 bp, synthetic construct
  misc_feature 1..20: note = CRISPR gRNA sequence
  source 1..20: mol_type = other DNA
tgctcttctcaaggtatctg

SEQ ID NO: 35847 - DNA, 20 bp, synthetic construct
  misc_feature 1..20: note = CRISPR gRNA sequence
  source 1..20: mol_type = other DNA
ctcttctcaaggtatctgag

SEQ ID NO: 35848 - DNA, 20 bp, synthetic construct
  misc_feature 1..20: note = CRISPR gRNA sequence
  source 1..20: mol_type = other DNA
ttctcaaggtatctgaggct

SEQ ID NO: 35849 - DNA, 20 bp, synthetic construct
  misc_feature 1..20: note = CRISPR gRNA sequence
  source 1..20: mol_type = other DNA
ctcaaggtatctgaggctgg

SEQ ID NO: 35850 - DNA, 20 bp, synthetic construct
  misc_feature 1..20: note = CRISPR gRNA sequence
  source 1..20: mol_type = other DNA
tcaaggtatctgaggctggg

SEQ ID NO: 35851 - DNA, 20 bp, synthetic construct
  misc_feature 1..20: note = CRISPR gRNA sequence
  source 1..20: mol_type = other DNA
aaggtatctgaggctgggtc

SEQ ID NO: 35852 - DNA, 20 bp, synthetic construct
  misc_feature 1..20: note = CRISPR gRNA sequence
  source 1..20: mol_type = other DNA
aggctgggtcttaggacatg

SEQ ID NO: 35853 - DNA, 20 bp, synthetic construct
  misc_feature 1..20: note = CRISPR gRNA sequence
  source 1..20: mol_type = other DNA
ggtcttaggacatgaaacca

SEQ ID NO: 35854 - DNA, 20 bp, synthetic construct
  misc_feature 1..20: note = CRISPR gRNA sequence
  source 1..20: mol_type = other DNA
aggacatgaaaccaagcccc

SEQ ID NO: 35855 - DNA, 20 bp, synthetic construct
  misc_feature 1..20: note = CRISPR gRNA sequence
  source 1..20: mol_type = other DNA
ggacatgaaaccaagcccca

SEQ ID NO: 35856 - DNA, 20 bp, synthetic construct
  misc_feature 1..20: note = CRISPR gRNA sequence
  source 1..20: mol_type = other DNA
ggtatcaacaggtttctctc

SEQ ID NO: 35857 - DNA, 20 bp, synthetic construct
  misc_feature 1..20: note = CRISPR gRNA sequence
  source 1..20: mol_type = other DNA
ctctctgactgcctgggacc

SEQ ID NO: 35858 - DNA, 20 bp, synthetic construct
  misc_feature 1..20: note = CRISPR gRNA sequence
  source 1..20: mol_type = other DNA
tctctgactgcctgggacct

SEQ ID NO: 35859 - DNA, 20 bp, synthetic construct
  misc_feature 1..20: note = CRISPR gRNA sequence
  source 1..20: mol_type = other DNA
tctgactgcctgggacctgc

SEQ ID NO: 35860 - DNA, 20 bp, synthetic construct
  misc_feature 1..20: note = CRISPR gRNA sequence
  source 1..20: mol_type = other DNA
tgactgcctgggacctgccc

SEQ ID NO: 35861 - DNA, 20 bp, synthetic construct
  misc_feature 1..20: note = CRISPR gRNA sequence
  source 1..20: mol_type = other DNA
actgcctgggacctgccctg

SEQ ID NO: 35862 - DNA, 20 bp, synthetic construct
  misc_feature 1..20: note = CRISPR gRNA sequence
  source 1..20: mol_type = other DNA
cctgggacctgccctgcatt

SEQ ID NO: 35863 - DNA, 20 bp, synthetic construct
  misc_feature 1..20: note = CRISPR gRNA sequence
  source 1..20: mol_type = other DNA
ggacctgccctgcatttgtg

SEQ ID NO: 35864 - DNA, 20 bp, synthetic construct
  misc_feature 1..20: note = CRISPR gRNA sequence
  source 1..20: mol_type = other DNA
ccctgcatttgtggaggttc

SEQ ID NO: 35865 - DNA, 20 bp, synthetic construct
  misc_feature 1..20: note = CRISPR gRNA sequence
  source 1..20: mol_type = other DNA
catttgtggaggttcacatc

SEQ ID NO: 35866 - DNA, 20 bp, synthetic construct
  misc_feature 1..20: note = CRISPR gRNA sequence
  source 1..20: mol_type = other DNA
gtggaggttcacatctgctt

SEQ ID NO: 35867 - DNA, 20 bp, synthetic construct
  misc_feature 1..20: note = CRISPR gRNA sequence
  source 1..20: mol_type = other DNA
tggaggttcacatctgcttg

SEQ ID NO: 35868 - DNA, 20 bp, synthetic construct
  misc_feature 1..20: note = CRISPR gRNA sequence
  source 1..20: mol_type = other DNA
acatctgcttgctgcactgg

SEQ ID NO: 35869 - DNA, 20 bp, synthetic construct
  misc_feature 1..20: note = CRISPR gRNA sequence
  source 1..20: mol_type = other DNA
cttgctgcactgggctgggc

SEQ ID NO: 35870 - DNA, 20 bp, synthetic construct
  misc_feature 1..20: note = CRISPR gRNA sequence
  source 1..20: mol_type = other DNA
gctgcactgggctgggctct

SEQ ID NO: 35871 - DNA, 20 bp, synthetic construct
  misc_feature 1..20: note = CRISPR gRNA sequence
  source 1..20: mol_type = other DNA
ctgcactgggctgggctctc

SEQ ID NO: 35872 - DNA, 20 bp, synthetic construct
  misc_feature 1..20: note = CRISPR gRNA sequence
  source 1..20: mol_type = other DNA
cactgggctgggctctcagt

SEQ ID NO: 35873 - DNA, 20 bp, synthetic construct
  misc_feature 1..20: note = CRISPR gRNA sequence
  source 1..20: mol_type = other DNA
ggctgggctctcagtagacc

SEQ ID NO: 35874 - DNA, 20 bp, synthetic construct
  misc_feature 1..20: note = CRISPR gRNA sequence
  source 1..20: mol_type = other DNA
ggctctcagtagaccagggt

SEQ ID NO: 35875 - DNA, 20 bp, synthetic construct
  misc_feature 1..20: note = CRISPR gRNA sequence
  source 1..20: mol_type = other DNA
tcagtagaccagggttcaaa

SEQ ID NO: 35876 - DNA, 20 bp, synthetic construct
  misc_feature 1..20: note = CRISPR gRNA sequence
  source 1..20: mol_type = other DNA
agtagaccagggttcaaatc

SEQ ID NO: 35877 - DNA, 20 bp, synthetic construct
  misc_feature 1..20: note = CRISPR gRNA sequence
  source 1..20: mol_type = other DNA
aaatcctgcgtctgcaaact

SEQ ID NO: 35878 - DNA, 20 bp, synthetic construct
  misc_feature 1..20: note = CRISPR gRNA sequence
  source 1..20: mol_type = other DNA
cgtctgcaaactgcttgcta

SEQ ID NO: 35879 - DNA, 20 bp, synthetic construct
  misc_feature 1..20: note = CRISPR gRNA sequence
  source 1..20: mol_type = other DNA
caaactgcttgctatgtggc

SEQ ID NO: 35880 - DNA, 20 bp, synthetic construct
  misc_feature 1..20: note = CRISPR gRNA sequence
  source 1..20: mol_type = other DNA
cttgctatgtggcgttaagc

SEQ ID NO: 35881 - DNA, 20 bp, synthetic construct
  misc_feature 1..20: note = CRISPR gRNA sequence
  source 1..20: mol_type = other DNA
gctatgtggcgttaagcaaa

SEQ ID NO: 35882 - DNA, 20 bp, synthetic construct
  misc_feature 1..20: note = CRISPR gRNA sequence
  source 1..20: mol_type = other DNA
ctatgtggcgttaagcaaaa

SEQ ID NO: 35883 - DNA, 20 bp, synthetic construct
  misc_feature 1..20: note = CRISPR gRNA sequence
  source 1..20: mol_type = other DNA
tgtggcgttaagcaaaacaa

SEQ ID NO: 35884 - DNA, 20 bp, synthetic construct
  misc_feature 1..20: note = CRISPR gRNA sequence
  source 1..20: mol_type = other DNA
agcaaaacaaaacaaaacac

SEQ ID NO: 35885 - DNA, 20 bp, synthetic construct
  misc_feature 1..20: note = CRISPR gRNA sequence
  source 1..20: mol_type = other DNA
ctggtactccttttctgata

SEQ ID NO: 35886 - DNA, 20 bp, synthetic construct
  misc_feature 1..20: note = CRISPR gRNA sequence
  source 1..20: mol_type = other DNA
gtactccttttctgatagag

SEQ ID NO: 35887 - DNA, 20 bp, synthetic construct
  misc_feature 1..20: note = CRISPR gRNA sequence
  source 1..20: mol_type = other DNA
cttttctgatagaggttttg

SEQ ID NO: 35888 - DNA, 20 bp, synthetic construct
  misc_feature 1..20: note = CRISPR gRNA sequence
  source 1..20: mol_type = other DNA
ttctgatagaggttttgtaa

SEQ ID NO: 35889 - DNA, 20 bp, synthetic construct
  misc_feature 1..20: note = CRISPR gRNA sequence
  source 1..20: mol_type = other DNA
tctgatagaggttttgtaac

SEQ ID NO: 35890 - DNA, 20 bp, synthetic construct
  misc_feature 1..20: note = CRISPR gRNA sequence
  source 1..20: mol_type = other DNA
ctgatagaggttttgtaaca

SEQ ID NO: 35891 - DNA, 20 bp, synthetic construct
  misc_feature 1..20: note = CRISPR gRNA sequence
  source 1..20: mol_type = other DNA
tgatagaggttttgtaacag

SEQ ID NO: 35892 - DNA, 20 bp, synthetic construct
  misc_feature 1..20: note = CRISPR gRNA sequence
  source 1..20: mol_type = other DNA
atagaggttttgtaacaggg

SEQ ID NO: 35893 - DNA, 20 bp, synthetic construct
  misc_feature 1..20: note = CRISPR gRNA sequence
  source 1..20: mol_type = other DNA
tgtaacagggagagagtaaa

SEQ ID NO: 35894 - DNA, 20 bp, synthetic construct
  misc_feature 1..20: note = CRISPR gRNA sequence
  source 1..20: mol_type = other DNA
gtaacagggagagagtaaag

SEQ ID NO: 35895 - DNA, 20 bp, synthetic construct
  misc_feature 1..20: note = CRISPR gRNA sequence
  source 1..20: mol_type = other DNA
taacagggagagagtaaaga

SEQ ID NO: 35896 - DNA, 20 bp, synthetic construct
  misc_feature 1..20: note = CRISPR gRNA sequence
  source 1..20: mol_type = other DNA
ccagtgtctctgacttgagg

SEQ ID NO: 35897 - DNA, 20 bp, synthetic construct
  misc_feature 1..20: note = CRISPR gRNA sequence
  source 1..20: mol_type = other DNA
tgacttgagggacttttgcc

SEQ ID NO: 35898 - DNA, 20 bp, synthetic construct
  misc_feature 1..20: note = CRISPR gRNA sequence
  source 1..20: mol_type = other DNA
acttgagggacttttgcccc

SEQ ID NO: 35899 - DNA, 20 bp, synthetic construct
  misc_feature 1..20: note = CRISPR gRNA sequence
  source 1..20: mol_type = other DNA
gagggacttttgccccacaa

SEQ ID NO: 35900 - DNA, 20 bp, synthetic construct
  misc_feature 1..20: note = CRISPR gRNA sequence
  source 1..20: mol_type = other DNA
agggacttttgccccacaaa

SEQ ID NO: 35901 - DNA, 20 bp, synthetic construct
  misc_feature 1..20: note = CRISPR gRNA sequence
  source 1..20: mol_type = other DNA
ttgccccacaaacgaacatt

SEQ ID NO: 35902 - DNA, 20 bp, synthetic construct
  misc_feature 1..20: note = CRISPR gRNA sequence
  source 1..20: mol_type = other DNA
tgccccacaaacgaacattg

SEQ ID NO: 35903 - DNA, 20 bp, synthetic construct
  misc_feature 1..20: note = CRISPR gRNA sequence
  source 1..20: mol_type = other DNA
gccccacaaacgaacattgg

SEQ ID NO: 35904 - DNA, 20 bp, synthetic construct
  misc_feature 1..20: note = CRISPR gRNA sequence
  source 1..20: mol_type = other DNA
ccccacaaacgaacattgga

SEQ ID NO: 35905 - DNA, 20 bp, synthetic construct
  misc_feature 1..20: note = CRISPR gRNA sequence
  source 1..20: mol_type = other DNA
gagtcacctgggatagatgg

SEQ ID NO: 35906 - DNA, 20 bp, synthetic construct
  misc_feature 1..20: note = CRISPR gRNA sequence
  source 1..20: mol_type = other DNA
ggatagatggtttaacctgc

SEQ ID NO: 35907 - DNA, 20 bp, synthetic construct
  misc_feature 1..20: note = CRISPR gRNA sequence
  source 1..20: mol_type = other DNA
aacctgcaggatctcagcct

SEQ ID NO: 35908 - DNA, 20 bp, synthetic construct
  misc_feature 1..20: note = CRISPR gRNA sequence
  source 1..20: mol_type = other DNA
acctgcaggatctcagcctc

SEQ ID NO: 35909 - DNA, 20 bp, synthetic construct
  misc_feature 1..20: note = CRISPR gRNA sequence
  source 1..20: mol_type = other DNA
caggatctcagcctcacccc

SEQ ID NO: 35910 - DNA, 20 bp, synthetic construct
  misc_feature 1..20: note = CRISPR gRNA sequence
  source 1..20: mol_type = other DNA
agcctcaccccaggcctagc

SEQ ID NO: 35911 - DNA, 20 bp, synthetic construct
  misc_feature 1..20: note = CRISPR gRNA sequence
  source 1..20: mol_type = other DNA
accccaggcctagccaaccg

SEQ ID NO: 35912 - DNA, 20 bp, synthetic construct
  misc_feature 1..20: note = CRISPR gRNA sequence
  source 1..20: mol_type = other DNA
gccaaccgggcctgggggtg

SEQ ID NO: 35913 - DNA, 20 bp, synthetic construct
  misc_feature 1..20: note = CRISPR gRNA sequence
  source 1..20: mol_type = other DNA
ggggtgagcccgggaaccta

SEQ ID NO: 35914 - DNA, 20 bp, synthetic construct
  misc_feature 1..20: note = CRISPR gRNA sequence
  source 1..20: mol_type = other DNA
catcctgaacaggttgatca

SEQ ID NO: 35915 - DNA, 20 bp, synthetic construct
  misc_feature 1..20: note = CRISPR gRNA sequence
  source 1..20: mol_type = other DNA
aacaggttgatcatcccagg

SEQ ID NO: 35916 - DNA, 20 bp, synthetic construct
  misc_feature 1..20: note = CRISPR gRNA sequence
  source 1..20: mol_type = other DNA
atcatcccaggtgatgttca

SEQ ID NO: 35917 - DNA, 20 bp, synthetic construct
  misc_feature 1..20: note = CRISPR gRNA sequence
  source 1..20: mol_type = other DNA
atgtgtggggagcctgggat

SEQ ID NO: 35918 - DNA, 20 bp, synthetic construct
  misc_feature 1..20: note = CRISPR gRNA sequence
  source 1..20: mol_type = other DNA
ggattccccactcagtcatc

SEQ ID NO: 35919 - DNA, 20 bp, synthetic construct
  misc_feature 1..20: note = CRISPR gRNA sequence
  source 1..20: mol_type = other DNA
cccactcagtcatctccaaa

SEQ ID NO: 35920 - DNA, 20 bp, synthetic construct
  misc_feature 1..20: note = CRISPR gRNA sequence
  source 1..20: mol_type = other DNA
agtcatctccaaagaccctg

SEQ ID NO: 35921 - DNA, 20 bp, synthetic construct
  misc_feature 1..20: note = CRISPR gRNA sequence
  source 1..20: mol_type = other DNA
caaagaccctgcctccaaac

SEQ ID NO: 35922 - DNA, 20 bp, synthetic construct
  misc_feature 1..20: note = CRISPR gRNA sequence
  source 1..20: mol_type = other DNA
cctccaaacgctctgagatt

SEQ ID NO: 35923 - DNA, 20 bp, synthetic construct
  misc_feature 1..20: note = CRISPR gRNA sequence
  source 1..20: mol_type = other DNA
caaacgctctgagattgttg

SEQ ID NO: 35924 - DNA, 20 bp, synthetic construct
  misc_feature 1..20: note = CRISPR gRNA sequence
  source 1..20: mol_type = other DNA
tgagattgttggagaccagg

SEQ ID NO: 35925 - DNA, 20 bp, synthetic construct
  misc_feature 1..20: note = CRISPR gRNA sequence
  source 1..20: mol_type = other DNA
agattgttggagaccaggtc

SEQ ID NO: 35926 - DNA, 20 bp, synthetic construct
  misc_feature 1..20: note = CRISPR gRNA sequence
  source 1..20: mol_type = other DNA
ttggagaccaggtcatcccc

SEQ ID NO: 35927 - DNA, 20 bp, synthetic construct
  misc_feature 1..20: note = CRISPR gRNA sequence
  source 1..20: mol_type = other DNA
gagaccaggtcatcccctaa

SEQ ID NO: 35928 - DNA, 20 bp, synthetic construct
  misc_feature 1..20: note = CRISPR gRNA sequence
  source 1..20: mol_type = other DNA
agggagccgggggtttgcaa

SEQ ID NO: 35929 - DNA, 20 bp, synthetic construct
  misc_feature 1..20: note = CRISPR gRNA sequence
  source 1..20: mol_type = other DNA
gcaaggtgatcatttgttgg

SEQ ID NO: 35930 - DNA, 20 bp, synthetic construct
  misc_feature 1..20: note = CRISPR gRNA sequence
  source 1..20: mol_type = other DNA
caaggtgatcatttgttgga

SEQ ID NO: 35931 - DNA, 20 bp, synthetic construct
  misc_feature 1..20: note = CRISPR gRNA sequence
  source 1..20: mol_type = other DNA
gttggagtcaagttcctttg

SEQ ID NO: 35932 - DNA, 20 bp, synthetic construct
  misc_feature 1..20: note = CRISPR gRNA sequence
  source 1..20: mol_type = other DNA
ttggagtcaagttcctttgg

SEQ ID NO: 35933 - DNA, 20 bp, synthetic construct
  misc_feature 1..20: note = CRISPR gRNA sequence
  source 1..20: mol_type = other DNA
gagtcaagttcctttggctc

SEQ ID NO: 35934 - DNA, 20 bp, synthetic construct
  misc_feature 1..20: note = CRISPR gRNA sequence
  source 1..20: mol_type = other DNA
ctttggctcctctttctcca

SEQ ID NO: 35935 - DNA, 20 bp, synthetic construct
  misc_feature 1..20: note = CRISPR gRNA sequence
  source 1..20: mol_type = other DNA
tggctcctctttctccaaga

SEQ ID NO: 35936 - DNA, 20 bp, synthetic construct
  misc_feature 1..20: note = CRISPR gRNA sequence
  source 1..20: mol_type = other DNA
ggctcctctttctccaagag

SEQ ID NO: 35937 - DNA, 20 bp, synthetic construct
  misc_feature 1..20: note = CRISPR gRNA sequence
  source 1..20: mol_type = other DNA
gctcctctttctccaagagg

SEQ ID NO: 35938 - DNA, 20 bp, synthetic construct
  misc_feature 1..20: note = CRISPR gRNA sequence
  source 1..20: mol_type = other DNA
ctctttctccaagaggaaga

SEQ ID NO: 35939 - DNA, 20 bp, synthetic construct
  misc_feature 1..20: note = CRISPR gRNA sequence
  source 1..20: mol_type = other DNA
tttctccaagaggaagaagt

SEQ ID NO: 35940 - DNA, 20 bp, synthetic construct
  misc_feature 1..20: note = CRISPR gRNA sequence
  source 1..20: mol_type = other DNA
tctccaagaggaagaagtac

SEQ ID NO: 35941 - DNA, 20 bp, synthetic construct
  misc_feature 1..20: note = CRISPR gRNA sequence
  source 1..20: mol_type = other DNA
ctccaagaggaagaagtacc

SEQ ID NO: 35942 - DNA, 20 bp, synthetic construct
  misc_feature 1..20: note = CRISPR gRNA sequence
  source 1..20: mol_type = other DNA
tccaagaggaagaagtacct

SEQ ID NO: 35943 - DNA, 20 bp, synthetic construct
  misc_feature 1..20: note = CRISPR gRNA sequence
  source 1..20: mol_type = other DNA
caagaggaagaagtacctgt

SEQ ID NO: 35944 - DNA, 20 bp, synthetic construct
  misc_feature 1..20: note = CRISPR gRNA sequence
  source 1..20: mol_type = other DNA
tttccttaatctcactccgg

SEQ ID NO: 35945 - DNA, 20 bp, synthetic construct
  misc_feature 1..20: note = CRISPR gRNA sequence
  source 1..20: mol_type = other DNA
ccttaatctcactccggaga

SEQ ID NO: 35946 - DNA, 20 bp, synthetic construct
  misc_feature 1..20: note = CRISPR gRNA sequence
  source 1..20: mol_type = other DNA
cttaatctcactccggagaa

SEQ ID NO: 35947 - DNA, 20 bp, synthetic construct
  misc_feature 1..20: note = CRISPR gRNA sequence
  source 1..20: mol_type = other DNA
aatctcactccggagaagta

SEQ ID NO: 35948 - DNA, 20 bp, synthetic construct
  misc_feature 1..20: note = CRISPR gRNA sequence
  source 1..20: mol_type = other DNA
atctcactccggagaagtat

SEQ ID NO: 35949 - DNA, 20 bp, synthetic construct
  misc_feature 1..20: note = CRISPR gRNA sequence
  source 1..20: mol_type = other DNA
actccggagaagtatttatt

SEQ ID NO: 35950 - DNA, 20 bp, synthetic construct
  misc_feature 1..20: note = CRISPR gRNA sequence
  source 1..20: mol_type = other DNA
cggagaagtatttatttatt

SEQ ID NO: 35951 - DNA, 20 bp, synthetic construct
  misc_feature 1..20: note = CRISPR gRNA sequence
  source 1..20: mol_type = other DNA
atttattttttctctggagt

SEQ ID NO: 35952 - DNA, 20 bp, synthetic construct
  misc_feature 1..20: note = CRISPR gRNA sequence
  source 1..20: mol_type = other DNA
tttattttttctctggagtg

SEQ ID NO: 35953 - DNA, 20 bp, synthetic construct
  misc_feature 1..20: note = CRISPR gRNA sequence
  source 1..20: mol_type = other DNA
attttttctctggagtgggg

SEQ ID NO: 35954 - DNA, 20 bp, synthetic construct
  misc_feature 1..20: note = CRISPR gRNA sequence
  source 1..20: mol_type = other DNA
ttttttctctggagtgggga

SEQ ID NO: 35955 - DNA, 20 bp, synthetic construct
  misc_feature 1..20: note = CRISPR gRNA sequence
  source 1..20: mol_type = other DNA
tttctctggagtggggagca

SEQ ID NO: 35956 - DNA, 20 bp, synthetic construct
  misc_feature 1..20: note = CRISPR gRNA sequence
  source 1..20: mol_type = other DNA
ttctctggagtggggagcag

SEQ ID NO: 35957 - DNA, 20 bp, synthetic construct
  misc_feature 1..20: note = CRISPR gRNA sequence
  source 1..20: mol_type = other DNA
tctctggagtggggagcaga

SEQ ID NO: 35958 - DNA, 20 bp, synthetic construct
  misc_feature 1..20: note = CRISPR gRNA sequence
  source 1..20: mol_type = other DNA
ctctggagtggggagcagaa

SEQ ID NO: 35959 - DNA, 20 bp, synthetic construct
  misc_feature 1..20: note = CRISPR gRNA sequence
  source 1..20: mol_type = other DNA
tctggagtggggagcagaaa

SEQ ID NO: 35960 - DNA, 20 bp, synthetic construct
  misc_feature 1..20: note = CRISPR gRNA sequence
  source 1..20: mol_type = other DNA
tggagtggggagcagaaacg

SEQ ID NO: 35961 - DNA, 20 bp, synthetic construct
  misc_feature 1..20: note = CRISPR gRNA sequence
  source 1..20: mol_type = other DNA
gagtggggagcagaaacgga

SEQ ID NO: 35962 - DNA, 20 bp, synthetic construct
  misc_feature 1..20: note = CRISPR gRNA sequence
  source 1..20: mol_type = other DNA
cctgccaaagttagacactc

SEQ ID NO: 35963 - DNA, 20 bp, synthetic construct
  misc_feature 1..20: note = CRISPR gRNA sequence
  source 1..20: mol_type = other DNA
ctgccaaagttagacactcc

SEQ ID NO: 35964 - DNA, 20 bp, synthetic construct
  misc_feature 1..20: note = CRISPR gRNA sequence
  source 1..20: mol_type = other DNA
ccaaagttagacactccagg

SEQ ID NO: 35965 - DNA, 20 bp, synthetic construct
  misc_feature 1..20: note = CRISPR gRNA sequence
  source 1..20: mol_type = other DNA
gacactccaggctgcggctg

SEQ ID NO: 35966 - DNA, 20 bp, synthetic construct
  misc_feature 1..20: note = CRISPR gRNA sequence
  source 1..20: mol_type = other DNA
caggctgcggctggggaggg

SEQ ID NO: 35967 - DNA, 20 bp, synthetic construct
  misc_feature 1..20: note = CRISPR gRNA sequence
  source 1..20: mol_type = other DNA
cggctggggagggagccatg

SEQ ID NO: 35968 - DNA, 20 bp, synthetic construct
  misc_feature 1..20: note = CRISPR gRNA sequence
  source 1..20: mol_type = other DNA
gggagggagccatgccttga

SEQ ID NO: 35969 - DNA, 20 bp, synthetic construct
  misc_feature 1..20: note = CRISPR gRNA sequence
  source 1..20: mol_type = other DNA
gaacttctaggcttttgcca

SEQ ID NO: 35970 - DNA, 20 bp, synthetic construct
  misc_feature 1..20: note = CRISPR gRNA sequence
  source 1..20: mol_type = other DNA
aacttctaggcttttgccac

SEQ ID NO: 35971 - DNA, 20 bp, synthetic construct
  misc_feature 1..20: note = CRISPR gRNA sequence
  source 1..20: mol_type = other DNA
ctaggcttttgccacctctc

SEQ ID NO: 35972 - DNA, 20 bp, synthetic construct
  misc_feature 1..20: note = CRISPR gRNA sequence
  source 1..20: mol_type = other DNA
taggcttttgccacctctcc

SEQ ID NO: 35973 - DNA, 20 bp, synthetic construct
  misc_feature 1..20: note = CRISPR gRNA sequence
  source 1..20: mol_type = other DNA
ggcttttgccacctctcctg

SEQ ID NO: 35974 - DNA, 20 bp, synthetic construct
  misc_feature 1..20: note = CRISPR gRNA sequence
  source 1..20: mol_type = other DNA
ttgccacctctcctgtgcca

SEQ ID NO: 35975 - DNA, 20 bp, synthetic construct
  misc_feature 1..20: note = CRISPR gRNA sequence
  source 1..20: mol_type = other DNA
tgccacctctcctgtgccac

SEQ ID NO: 35976 - DNA, 20 bp, synthetic construct
  misc_feature 1..20: note = CRISPR gRNA sequence
  source 1..20: mol_type = other DNA
gccacctctcctgtgccacc

SEQ ID NO: 35977 - DNA, 20 bp, synthetic construct
  misc_feature 1..20: note = CRISPR gRNA sequence
  source 1..20: mol_type = other DNA
ccacctctcctgtgccacct

SEQ ID NO: 35978 - DNA, 20 bp, synthetic construct
  misc_feature 1..20: note = CRISPR gRNA sequence
  source 1..20: mol_type = other DNA
tcctgtgccacctagggtgg

SEQ ID NO: 35979 - DNA, 20 bp, synthetic construct
  misc_feature 1..20: note = CRISPR gRNA sequence
  source 1..20: mol_type = other DNA
ctgtgccacctagggtggag

SEQ ID NO: 35980 - DNA, 20 bp, synthetic construct
  misc_feature 1..20: note = CRISPR gRNA sequence
  source 1..20: mol_type = other DNA
tgccacctagggtggagagg

SEQ ID NO: 35981 - DNA, 20 bp, synthetic construct
  misc_feature 1..20: note = CRISPR gRNA sequence
  source 1..20: mol_type = other DNA
gggtggagaggggctgtggg

SEQ ID NO: 35982 - DNA, 20 bp, synthetic construct
  misc_feature 1..20: note = CRISPR gRNA sequence
  source 1..20: mol_type = other DNA
tgggactcaggaggaccgcg

SEQ ID NO: 35983 - DNA, 20 bp, synthetic construct
  misc_feature 1..20: note = CRISPR gRNA sequence
  source 1..20: mol_type = other DNA
aggaggaccgcggcttttaa

SEQ ID NO: 35984 - DNA, 20 bp, synthetic construct
  misc_feature 1..20: note = CRISPR gRNA sequence
  source 1..20: mol_type = other DNA
ttaagagttccagactaagc

SEQ ID NO: 35985 - DNA, 20 bp, synthetic construct
  misc_feature 1..20: note = CRISPR gRNA sequence
  source 1..20: mol_type = other DNA
taagagttccagactaagct

SEQ ID NO: 35986 - DNA, 20 bp, synthetic construct
  misc_feature 1..20: note = CRISPR gRNA sequence
  source 1..20: mol_type = other DNA
aagagttccagactaagcta

SEQ ID NO: 35987 - DNA, 20 bp, synthetic construct
  misc_feature 1..20: note = CRISPR gRNA sequence
  source 1..20: mol_type = other DNA
agagttccagactaagctaa

SEQ ID NO: 35988 - DNA, 20 bp, synthetic construct
  misc_feature 1..20: note = CRISPR gRNA sequence
  source 1..20: mol_type = other DNA
cagactaagctaagcatggt

SEQ ID NO: 35989 - DNA, 20 bp, synthetic construct
  misc_feature 1..20: note = CRISPR gRNA sequence
  source 1..20: mol_type = other DNA
agctaagcatggtggctccg

SEQ ID NO: 35990 - DNA, 20 bp, synthetic construct
  misc_feature 1..20: note = CRISPR gRNA sequence
  source 1..20: mol_type = other DNA
agcatggtggctccgattcc

SEQ ID NO: 35991 - DNA, 20 bp, synthetic construct
  misc_feature 1..20: note = CRISPR gRNA sequence
  source 1..20: mol_type = other DNA
cgattccggctttcctggac

SEQ ID NO: 35992 - DNA, 20 bp, synthetic construct
  misc_feature 1..20: note = CRISPR gRNA sequence
  source 1..20: mol_type = other DNA
cggctttcctggaccccagg

SEQ ID NO: 35993 - DNA, 20 bp, synthetic construct
  misc_feature 1..20: note = CRISPR gRNA sequence
  source 1..20: mol_type = other DNA
tcctggaccccagggagatc

SEQ ID NO: 35994 - DNA, 20 bp, synthetic construct
  misc_feature 1..20: note = CRISPR gRNA sequence
  source 1..20: mol_type = other DNA
cctggaccccagggagatcc

SEQ ID NO: 35995 - DNA, 20 bp, synthetic construct
  misc_feature 1..20: note = CRISPR gRNA sequence
  source 1..20: mol_type = other DNA
ctggaccccagggagatcca

SEQ ID NO: 35996 - DNA, 20 bp, synthetic construct
  misc_feature 1..20: note = CRISPR gRNA sequence
  source 1..20: mol_type = other DNA
gaccccagggagatccaatc

SEQ ID NO: 35997 - DNA, 20 bp, synthetic construct
  misc_feature 1..20: note = CRISPR gRNA sequence
  source 1..20: mol_type = other DNA
ccactcccaccccggcattc

SEQ ID NO: 35998 - DNA, 20 bp, synthetic construct
  misc_feature 1..20: note = CRISPR gRNA sequence
  source 1..20: mol_type = other DNA
ccaccccggcattcgcacgc

SEQ ID NO: 35999 - DNA, 20 bp, synthetic construct
  misc_feature 1..20: note = CRISPR gRNA sequence
  source 1..20: mol_type = other DNA
gcacgctggctttccggggc

SEQ ID NO: 36000 - DNA, 20 bp, synthetic construct
  misc_feature 1..20: note = CRISPR gRNA sequence
  source 1..20: mol_type = other DNA
gctttccggggcgctttagc

SEQ ID NO: 36001 - DNA, 20 bp, synthetic construct
  misc_feature 1..20: note = CRISPR gRNA sequence
  source 1..20: mol_type = other DNA
tccggggcgctttagcctct

SEQ ID NO: 36002 - DNA, 20 bp, synthetic construct
  misc_feature 1..20: note = CRISPR gRNA sequence
  source 1..20: mol_type = other DNA
ccggggcgctttagcctctc

SEQ ID NO: 36003 - DNA, 20 bp, synthetic construct
  misc_feature 1..20: note = CRISPR gRNA sequence
  source 1..20: mol_type = other DNA
cggggcgctttagcctctct

SEQ ID NO: 36004 - DNA, 20 bp, synthetic construct
  misc_feature 1..20: note = CRISPR gRNA sequence
  source 1..20: mol_type = other DNA
tagcctctctccttagaggg

SEQ ID NO: 36005 - DNA, 20 bp, synthetic construct
  misc_feature 1..20: note = CRISPR gRNA sequence
  source 1..20: mol_type = other DNA
agcctctctccttagagggt

SEQ ID NO: 36006 - DNA, 20 bp, synthetic construct
  misc_feature 1..20: note = CRISPR gRNA sequence
  source 1..20: mol_type = other DNA
gcctctctccttagagggtg

SEQ ID NO: 36007 - DNA, 20 bp, synthetic construct
  misc_feature 1..20: note = CRISPR gRNA sequence
  source 1..20: mol_type = other DNA
tctccttagagggtgtgact

SEQ ID NO: 36008 - DNA, 20 bp, synthetic construct
  misc_feature 1..20: note = CRISPR gRNA sequence
  source 1..20: mol_type = other DNA
tccttagagggtgtgactca

SEQ ID NO: 36009 - DNA, 20 bp, synthetic construct
  misc_feature 1..20: note = CRISPR gRNA sequence
  source 1..20: mol_type = other DNA
cttagagggtgtgactcagg

SEQ ID NO: 36010 - DNA, 20 bp, synthetic construct
  misc_feature 1..20: note = CRISPR gRNA sequence
  source 1..20: mol_type = other DNA
agagggtgtgactcagggcc

SEQ ID NO: 36011 - DNA, 20 bp, synthetic construct
  misc_feature 1..20: note = CRISPR gRNA sequence
  source 1..20: mol_type = other DNA
gagggtgtgactcagggccc

SEQ ID NO: 36012 - DNA, 20 bp, synthetic construct
  misc_feature 1..20: note = CRISPR gRNA sequence
  source 1..20: mol_type = other DNA
agggccccaaagcgaggtag

SEQ ID NO: 36013 - DNA, 20 bp, synthetic construct
  misc_feature 1..20: note = CRISPR gRNA sequence
  source 1..20: mol_type = other DNA
agtccggggggatccctccc

SEQ ID NO: 36014 - DNA, 20 bp, synthetic construct
  misc_feature 1..20: note = CRISPR gRNA sequence
  source 1..20: mol_type = other DNA
ccccacccctcccaacaaca

SEQ ID NO: 36015 - DNA, 20 bp, synthetic construct
  misc_feature 1..20: note = CRISPR gRNA sequence
  source 1..20: mol_type = other DNA
ccaacaacacacaccttcgc

SEQ ID NO: 36016 - DNA, 20 bp, synthetic construct
  misc_feature 1..20: note = CRISPR gRNA sequence
  source 1..20: mol_type = other DNA
cgccaagatgttcaacgaga

SEQ ID NO: 36017 - DNA, 20 bp, synthetic construct
  misc_feature 1..20: note = CRISPR gRNA sequence
  source 1..20: mol_type = other DNA
gccaagatgttcaacgagag

SEQ ID NO: 36018 - DNA, 20 bp, synthetic construct
  misc_feature 1..20: note = CRISPR gRNA sequence
  source 1..20: mol_type = other DNA
aacgagagttgaggacttat

SEQ ID NO: 36019 - DNA, 20 bp, synthetic construct
  misc_feature 1..20: note = CRISPR gRNA sequence
  source 1..20: mol_type = other DNA
aggacttatcccatcctctg

SEQ ID NO: 36020 - DNA, 20 bp, synthetic construct
  misc_feature 1..20: note = CRISPR gRNA sequence
  source 1..20: mol_type = other DNA
atcccatcctctggttaaag

SEQ ID NO: 36021 - DNA, 20 bp, synthetic construct
  misc_feature 1..20: note = CRISPR gRNA sequence
  source 1..20: mol_type = other DNA
tcccatcctctggttaaagg

SEQ ID NO: 36022 - DNA, 20 bp, synthetic construct
  misc_feature 1..20: note = CRISPR gRNA sequence
  source 1..20: mol_type = other DNA
tggttaaaggtttggctccc

SEQ ID NO: 36023 - DNA, 20 bp, synthetic construct
  misc_feature 1..20: note = CRISPR gRNA sequence
  source 1..20: mol_type = other DNA
gttaaaggtttggctcccta

SEQ ID NO: 36024 - DNA, 20 bp, synthetic construct
  misc_feature 1..20: note = CRISPR gRNA sequence
  source 1..20: mol_type = other DNA
aaggtttggctccctactgc

SEQ ID NO: 36025 - DNA, 20 bp, synthetic construct
  misc_feature 1..20: note = CRISPR gRNA sequence
  source 1..20: mol_type = other DNA
ggctccctactgcctccctg

SEQ ID NO: 36026 - DNA, 20 bp, synthetic construct
  misc_feature 1..20: note = CRISPR gRNA sequence
  source 1..20: mol_type = other DNA
gctccctactgcctccctga

SEQ ID NO: 36027 - DNA, 20 bp, synthetic construct
  misc_feature 1..20: note = CRISPR gRNA sequence
  source 1..20: mol_type = other DNA
cctactgcctccctgagcag

SEQ ID NO: 36028 - DNA, 20 bp, synthetic construct
  misc_feature 1..20: note = CRISPR gRNA sequence
  source 1..20: mol_type = other DNA
ctgcctccctgagcagggcc

SEQ ID NO: 36029 - DNA, 20 bp, synthetic construct
  misc_feature 1..20: note = CRISPR gRNA sequence
  source 1..20: mol_type = other DNA
cctccctgagcagggccccc

SEQ ID NO: 36030 - DNA, 20 bp, synthetic construct
  misc_feature 1..20: note = CRISPR gRNA sequence
  source 1..20: mol_type = other DNA
cctgagcagggccccccgcc

SEQ ID NO: 36031 - DNA, 20 bp, synthetic construct
  misc_feature 1..20: note = CRISPR gRNA sequence
  source 1..20: mol_type = other DNA
agcagggccccccgcctgga

SEQ ID NO: 36032 - DNA, 20 bp, synthetic construct
  misc_feature 1..20: note = CRISPR gRNA sequence
  source 1..20: mol_type = other DNA
gagagcccaatacccaagat

SEQ ID NO: 36033 - DNA, 20 bp, synthetic construct
  misc_feature 1..20: note = CRISPR gRNA sequence
  source 1..20: mol_type = other DNA
cagagttagagatggaatat

SEQ ID NO: 36034 - DNA, 20 bp, synthetic construct
  misc_feature 1..20: note = CRISPR gRNA sequence
  source 1..20: mol_type = other DNA
gagatggaatatgacccaac

SEQ ID NO: 36035 - DNA, 20 bp, synthetic construct
  misc_feature 1..20: note = CRISPR gRNA sequence
  source 1..20: mol_type = other DNA
agggaacggcggccctggtc

SEQ ID NO: 36036 - DNA, 20 bp, synthetic construct
  misc_feature 1..20: note = CRISPR gRNA sequence
  source 1..20: mol_type = other DNA
gtccaaagtctggcgtacaa

SEQ ID NO: 36037 - DNA, 20 bp, synthetic construct
  misc_feature 1..20: note = CRISPR gRNA sequence
  source 1..20: mol_type = other DNA
gcgtacaagaagggcgcgca

SEQ ID NO: 36038 - DNA, 20 bp, synthetic construct
  misc_feature 1..20: note = CRISPR gRNA sequence
  source 1..20: mol_type = other DNA
tgcaggatcccgggcgcgcg

SEQ ID NO: 36039 - DNA, 20 bp, synthetic construct
  misc_feature 1..20: note = CRISPR gRNA sequence
  source 1..20: mol_type = other DNA
caggatcccgggcgcgcgga

SEQ ID NO: 36040 - DNA, 20 bp, synthetic construct
  misc_feature 1..20: note = CRISPR gRNA sequence
  source 1..20: mol_type = other DNA
ctccgcgctcccagtctgcg

SEQ ID NO: 36041 - DNA, 20 bp, synthetic construct
  misc_feature 1..20: note = CRISPR gRNA sequence
  source 1..20: mol_type = other DNA
cgcgctcccagtctgcgctc

SEQ ID NO: 36042 - DNA, 20 bp, synthetic construct
  misc_feature 1..20: note = CRISPR gRNA sequence
  source 1..20: mol_type = other DNA
ccagtctgcgctccggcttc

SEQ ID NO: 36043 - DNA, 20 bp, synthetic construct
  misc_feature 1..20: note = CRISPR gRNA sequence
  source 1..20: mol_type = other DNA
cgctccggcttctctgcaga

SEQ ID NO: 36044 - DNA, 20 bp, synthetic construct
  misc_feature 1..20: note = CRISPR gRNA sequence
  source 1..20: mol_type = other DNA
cggcttctctgcagaagctg

SEQ ID NO: 36045 - DNA, 20 bp, synthetic construct
  misc_feature 1..20: note = CRISPR gRNA sequence
  source 1..20: mol_type = other DNA
ctctgcagaagctgccgcca

SEQ ID NO: 36046 - DNA, 20 bp, synthetic construct
  misc_feature 1..20: note = CRISPR gRNA sequence
  source 1..20: mol_type = other DNA
tctgcagaagctgccgccag

SEQ ID NO: 36047 - DNA, 20 bp, synthetic construct
  misc_feature 1..20: note = CRISPR gRNA sequence
  source 1..20: mol_type = other DNA
tgcagaagctgccgccaggc

SEQ ID NO: 36048 - DNA, 20 bp, synthetic construct
  misc_feature 1..20: note = CRISPR gRNA sequence
  source 1..20: mol_type = other DNA
cagaagctgccgccaggctt

SEQ ID NO: 36049 - DNA, 20 bp, synthetic construct
  misc_feature 1..20: note = CRISPR gRNA sequence
  source 1..20: mol_type = other DNA
ccgccaggctttcctgccac

SEQ ID NO: 36050 - DNA, 20 bp, synthetic construct
  misc_feature 1..20: note = CRISPR gRNA sequence
  source 1..20: mol_type = other DNA
tcctgccacccgcccacggc

SEQ ID NO: 36051 - DNA, 20 bp, synthetic construct
  misc_feature 1..20: note = CRISPR gRNA sequence
  source 1..20: mol_type = other DNA
cctgccacccgcccacggcc

SEQ ID NO: 36052 - DNA, 20 bp, synthetic construct
  misc_feature 1..20: note = CRISPR gRNA sequence
  source 1..20: mol_type = other DNA
ctgccacccgcccacggccc

SEQ ID NO: 36053 - DNA, 20 bp, synthetic construct
  misc_feature 1..20: note = CRISPR gRNA sequence
  source 1..20: mol_type = other DNA
ccacccgcccacggccccgg

SEQ ID NO: 36054 - DNA, 20 bp, synthetic construct
  misc_feature 1..20: note = CRISPR gRNA sequence
  source 1..20: mol_type = other DNA
tgggcacagcaagccaagct

SEQ ID NO: 36055 - DNA, 20 bp, synthetic construct
  misc_feature 1..20: note = CRISPR gRNA sequence
  source 1..20: mol_type = other DNA
ggcacagcaagccaagctcc

SEQ ID NO: 36056 - DNA, 20 bp, synthetic construct
  misc_feature 1..20: note = CRISPR gRNA sequence
  source 1..20: mol_type = other DNA
cgggttcccggctcctggtt

SEQ ID NO: 36057 - DNA, 20 bp, synthetic construct
  misc_feature 1..20: note = CRISPR gRNA sequence
  source 1..20: mol_type = other DNA
ccggctcctggttcccgcgc

SEQ ID NO: 36058 - DNA, 20 bp, synthetic construct
  misc_feature 1..20: note = CRISPR gRNA sequence
  source 1..20: mol_type = other DNA
ctggttcccgcgcagagtcg

SEQ ID NO: 36059 - DNA, 20 bp, synthetic construct
  misc_feature 1..20: note = CRISPR gRNA sequence
  source 1..20: mol_type = other DNA
gttcccgcgcagagtcgttg

SEQ ID NO: 36060 - DNA, 20 bp, synthetic construct
  misc_feature 1..20: note = CRISPR gRNA sequence
  source 1..20: mol_type = other DNA
ccgcgcagagtcgttgcggg

SEQ ID NO: 36061 - DNA, 20 bp, synthetic construct
  misc_feature 1..20: note = CRISPR gRNA sequence
  source 1..20: mol_type = other DNA
cggggatgctggaaacgagg

SEQ ID NO: 36062 - DNA, 20 bp, synthetic construct
  misc_feature 1..20: note = CRISPR gRNA sequence
  source 1..20: mol_type = other DNA
gaaacgaggtgtttcccggc

SEQ ID NO: 36063 - DNA, 20 bp, synthetic construct
  misc_feature 1..20: note = CRISPR gRNA sequence
  source 1..20: mol_type = other DNA
cccggccctacattttgcat

SEQ ID NO: 36064 - DNA, 20 bp, synthetic construct
  misc_feature 1..20: note = CRISPR gRNA sequence
  source 1..20: mol_type = other DNA
ccggccctacattttgcata

SEQ ID NO: 36065 - DNA, 20 bp, synthetic construct
  misc_feature 1..20: note = CRISPR gRNA sequence
  source 1..20: mol_type = other DNA
cattttgcatattccatccc

SEQ ID NO: 36066 - DNA, 20 bp, synthetic construct
  misc_feature 1..20: note = CRISPR gRNA sequence
  source 1..20: mol_type = other DNA
tgcatattccatccccccat

SEQ ID NO: 36067 - DNA, 20 bp, synthetic construct
  misc_feature 1..20: note = CRISPR gRNA sequence
  source 1..20: mol_type = other DNA
gcatattccatccccccatc

SEQ ID NO: 36068 - DNA, 20 bp, synthetic construct
  misc_feature 1..20: note = CRISPR gRNA sequence
  source 1..20: mol_type = other DNA
catattccatccccccatcc

SEQ ID NO: 36069 - DNA, 20 bp, synthetic construct
  misc_feature 1..20: note = CRISPR gRNA sequence
  source 1..20: mol_type = other DNA
catccccccatcctcccaga

SEQ ID NO: 36070 - DNA, 20 bp, synthetic construct
  misc_feature 1..20: note = CRISPR gRNA sequence
  source 1..20: mol_type = other DNA
ccagacttgctgtgtgacct

SEQ ID NO: 36071 - DNA, 20 bp, synthetic construct
  misc_feature 1..20: note = CRISPR gRNA sequence
  source 1..20: mol_type = other DNA
gctgtgtgaccttgagcaag

SEQ ID NO: 36072 - DNA, 20 bp, synthetic construct
  misc_feature 1..20: note = CRISPR gRNA sequence
  source 1..20: mol_type = other DNA
ctgtgtgaccttgagcaagt

SEQ ID NO: 36073 - DNA, 20 bp, synthetic construct
  misc_feature 1..20: note = CRISPR gRNA sequence
  source 1..20: mol_type = other DNA
tgtgaccttgagcaagtagc

SEQ ID NO: 36074 - DNA, 20 bp, synthetic construct
  misc_feature 1..20: note = CRISPR gRNA sequence
  source 1..20: mol_type = other DNA
gagcaagtagctgacagtct

SEQ ID NO: 36075 - DNA, 20 bp, synthetic construct
  misc_feature 1..20: note = CRISPR gRNA sequence
  source 1..20: mol_type = other DNA
agcaagtagctgacagtctc

SEQ ID NO: 36076 - DNA, 20 bp, synthetic construct
  misc_feature 1..20: note = CRISPR gRNA sequence
  source 1..20: mol_type = other DNA
acagtctcggagcctcgatt

SEQ ID NO: 36077 - DNA, 20 bp, synthetic construct
  misc_feature 1..20: note = CRISPR gRNA sequence
  source 1..20: mol_type = other DNA
ggagcctcgattctcagccc

SEQ ID NO: 36078 - DNA, 20 bp, synthetic construct
  misc_feature 1..20: note = CRISPR gRNA sequence
  source 1..20: mol_type = other DNA
gattctcagcccgaccttag

SEQ ID NO: 36079 - DNA, 20 bp, synthetic construct
  misc_feature 1..20: note = CRISPR gRNA sequence
  source 1..20: mol_type = other DNA
tcagcccgaccttaggggtt

SEQ ID NO: 36080 - DNA, 20 bp, synthetic construct
  misc_feature 1..20: note = CRISPR gRNA sequence
  source 1..20: mol_type = other DNA
agcccgaccttaggggttac

SEQ ID NO: 36081 - DNA, 20 bp, synthetic construct
  misc_feature 1..20: note = CRISPR gRNA sequence
  source 1..20: mol_type = other DNA
aggggttacagaggagactt

SEQ ID NO: 36082 - DNA, 20 bp, synthetic construct
  misc_feature 1..20: note = CRISPR gRNA sequence
  source 1..20: mol_type = other DNA
ggggttacagaggagacttt

SEQ ID NO: 36083 - DNA, 20 bp, synthetic construct
  misc_feature 1..20: note = CRISPR gRNA sequence
  source 1..20: mol_type = other DNA
cagaggagactttggtcacc

SEQ ID NO: 36084 - DNA, 20 bp, synthetic construct
  misc_feature 1..20: note = CRISPR gRNA sequence
  source 1..20: mol_type = other DNA
tggtcacctaccgctgttcc

SEQ ID NO: 36085 - DNA, 20 bp, synthetic construct
  misc_feature 1..20: note = CRISPR gRNA sequence
  source 1..20: mol_type = other DNA
ggtcacctaccgctgttccc

SEQ ID NO: 36086 - DNA, 20 bp, synthetic construct
  misc_feature 1..20: note = CRISPR gRNA sequence
  source 1..20: mol_type = other DNA
gtcacctaccgctgttcccc

SEQ ID NO: 36087 - DNA, 20 bp, synthetic construct
  misc_feature 1..20: note = CRISPR gRNA sequence
  source 1..20: mol_type = other DNA
ccgctgttccccgggctccc

SEQ ID NO: 36088 - DNA, 20 bp, synthetic construct
  misc_feature 1..20: note = CRISPR gRNA sequence
  source 1..20: mol_type = other DNA
ttccccgggctcccgcgcgc

SEQ ID NO: 36089 - DNA, 20 bp, synthetic construct
  misc_feature 1..20: note = CRISPR gRNA sequence
  source 1..20: mol_type = other DNA
cccgggctcccgcgcgcgct

SEQ ID NO: 36090 - DNA, 20 bp, synthetic construct
  misc_feature 1..20: note = CRISPR gRNA sequence
  source 1..20: mol_type = other DNA
ccgcgcgcgctgctggtggc

SEQ ID NO: 36091 - DNA, 20 bp, synthetic construct
  misc_feature 1..20: note = CRISPR gRNA sequence
  source 1..20: mol_type = other DNA
ctggtggcctctccctcccg

SEQ ID NO: 36092 - DNA, 20 bp, synthetic construct
  misc_feature 1..20: note = CRISPR gRNA sequence
  source 1..20: mol_type = other DNA
gtggcctctccctcccgcca

SEQ ID NO: 36093 - DNA, 20 bp, synthetic construct
  misc_feature 1..20: note = CRISPR gRNA sequence
  source 1..20: mol_type = other DNA
tccctcccgccagctctggg

SEQ ID NO: 36094 - DNA, 20 bp, synthetic construct
  misc_feature 1..20: note = CRISPR gRNA sequence
  source 1..20: mol_type = other DNA
cctcccgccagctctggggc

SEQ ID NO: 36095 - DNA, 20 bp, synthetic construct
  misc_feature 1..20: note = CRISPR gRNA sequence
  source 1..20: mol_type = other DNA
ccgccagctctggggccgcg

SEQ ID NO: 36096 - DNA, 20 bp, synthetic construct
  misc_feature 1..20: note = CRISPR gRNA sequence
  source 1..20: mol_type = other DNA
tggggccgcggcaagtctgt

SEQ ID NO: 36097 - DNA, 20 bp, synthetic construct
  misc_feature 1..20: note = CRISPR gRNA sequence
  source 1..20: mol_type = other DNA
gggccgcggcaagtctgtgg

SEQ ID NO: 36098 - DNA, 20 bp, synthetic construct
  misc_feature 1..20: note = CRISPR gRNA sequence
  source 1..20: mol_type = other DNA
tggcagctcgtccgctggtc

SEQ ID NO: 36099 - DNA, 20 bp, synthetic construct
  misc_feature 1..20: note = CRISPR gRNA sequence
  source 1..20: mol_type = other DNA
gtccgctggtcatcctacct

SEQ ID NO: 36100 - DNA, 20 bp, synthetic construct
  misc_feature 1..20: note = CRISPR gRNA sequence
  source 1..20: mol_type = other DNA
gtcatcctacctccccgcct

SEQ ID NO: 36101 - DNA, 20 bp, synthetic construct
  misc_feature 1..20: note = CRISPR gRNA sequence
  source 1..20: mol_type = other DNA
cctccccgcctccccgcagt

SEQ ID NO: 36102 - DNA, 20 bp, synthetic construct
  misc_feature 1..20: note = CRISPR gRNA sequence
  source 1..20: mol_type = other DNA
cccgcctccccgcagttctt

SEQ ID NO: 36103 - DNA, 20 bp, synthetic construct
  misc_feature 1..20: note = CRISPR gRNA sequence
  source 1..20: mol_type = other DNA
cccgcagttctttttccctt

SEQ ID NO: 36104 - DNA, 20 bp, synthetic construct
  misc_feature 1..20: note = CRISPR gRNA sequence
  source 1..20: mol_type = other DNA
tttttccctttcactttctt

SEQ ID NO: 36105 - DNA, 20 bp, synthetic construct
  misc_feature 1..20: note = CRISPR gRNA sequence
  source 1..20: mol_type = other DNA
tttccctttcactttctttc

SEQ ID NO: 36106 - DNA, 20 bp, synthetic construct
  misc_feature 1..20: note = CRISPR gRNA sequence
  source 1..20: mol_type = other DNA
ttccctttcactttctttct

SEQ ID NO: 36107 - DNA, 20 bp, synthetic construct
  misc_feature 1..20: note = CRISPR gRNA sequence
  source 1..20: mol_type = other DNA
tccctttcactttctttctg

SEQ ID NO: 36108 - DNA, 20 bp, synthetic construct
  misc_feature 1..20: note = CRISPR gRNA sequence
  source 1..20: mol_type = other DNA
ccctttcactttctttctgc

SEQ ID NO: 36109 - DNA, 20 bp, synthetic construct
  misc_feature 1..20: note = CRISPR gRNA sequence
  source 1..20: mol_type = other DNA
cctttcactttctttctgca

SEQ ID NO: 36110 - DNA, 20 bp, synthetic construct
  misc_feature 1..20: note = CRISPR gRNA sequence
  source 1..20: mol_type = other DNA
tcactttctttctgcagcgc

SEQ ID NO: 36111 - DNA, 20 bp, synthetic construct
  misc_feature 1..20: note = CRISPR gRNA sequence
  source 1..20: mol_type = other DNA
cactttctttctgcagcgct

SEQ ID NO: 36112 - DNA, 20 bp, synthetic construct
  misc_feature 1..20: note = CRISPR gRNA sequence
  source 1..20: mol_type = other DNA
actttctttctgcagcgctg

SEQ ID NO: 36113 - DNA, 20 bp, synthetic construct
  misc_feature 1..20: note = CRISPR gRNA sequence
  source 1..20: mol_type = other DNA
tctttctgcagcgctgagct

SEQ ID NO: 36114 - DNA, 20 bp, synthetic construct
  misc_feature 1..20: note = CRISPR gRNA sequence
  source 1..20: mol_type = other DNA
ctttctgcagcgctgagctc

SEQ ID NO: 36115 - DNA, 20 bp, synthetic construct
  misc_feature 1..20: note = CRISPR gRNA sequence
  source 1..20: mol_type = other DNA
tttctgcagcgctgagctcg

SEQ ID NO: 36116 - DNA, 20 bp, synthetic construct
  misc_feature 1..20: note = CRISPR gRNA sequence
  source 1..20: mol_type = other DNA
tctgcagcgctgagctcggg

SEQ ID NO: 36117 - DNA, 20 bp, synthetic construct
  misc_feature 1..20: note = CRISPR gRNA sequence
  source 1..20: mol_type = other DNA
ctgcagcgctgagctcgggc

SEQ ID NO: 36118 - DNA, 20 bp, synthetic construct
  misc_feature 1..20: note = CRISPR gRNA sequence
  source 1..20: mol_type = other DNA
tgcagcgctgagctcgggcc

SEQ ID NO: 36119 - DNA, 20 bp, synthetic construct
  misc_feature 1..20: note = CRISPR gRNA sequence
  source 1..20: mol_type = other DNA
cagcgctgagctcgggccag

SEQ ID NO: 36120 - DNA, 20 bp, synthetic construct
  misc_feature 1..20: note = CRISPR gRNA sequence
  source 1..20: mol_type = other DNA
agctcgggccaggctgtgga

SEQ ID NO: 36121 - DNA, 20 bp, synthetic construct
  misc_feature 1..20: note = CRISPR gRNA sequence
  source 1..20: mol_type = other DNA
gggccaggctgtggagcaac

SEQ ID NO: 36122 - DNA, 20 bp, synthetic construct
  misc_feature 1..20: note = CRISPR gRNA sequence
  source 1..20: mol_type = other DNA
tggagcaaccaagcacctac

SEQ ID NO: 36123 - DNA, 20 bp, synthetic construct
  misc_feature 1..20: note = CRISPR gRNA sequence
  source 1..20: mol_type = other DNA
ctgtggccaccacgtgcttt

SEQ ID NO: 36124 - DNA, 20 bp, synthetic construct
  misc_feature 1..20: note = CRISPR gRNA sequence
  source 1..20: mol_type = other DNA
tggccaccacgtgctttatc

SEQ ID NO: 36125 - DNA, 20 bp, synthetic construct
  misc_feature 1..20: note = CRISPR gRNA sequence
  source 1..20: mol_type = other DNA
tatcagaagtggcatcccaa

SEQ ID NO: 36126 - DNA, 20 bp, synthetic construct
  misc_feature 1..20: note = CRISPR gRNA sequence
  source 1..20: mol_type = other DNA
atcagaagtggcatcccaac

SEQ ID NO: 36127 - DNA, 20 bp, synthetic construct
  misc_feature 1..20: note = CRISPR gRNA sequence
  source 1..20: mol_type = other DNA
tcagaagtggcatcccaact

SEQ ID NO: 36128 - DNA, 20 bp, synthetic construct
  misc_feature 1..20: note = CRISPR gRNA sequence
  source 1..20: mol_type = other DNA
cctggggcatccaagaggtc

SEQ ID NO: 36129 - DNA, 20 bp, synthetic construct
  misc_feature 1..20: note = CRISPR gRNA sequence
  source 1..20: mol_type = other DNA
gggcatccaagaggtccctg

SEQ ID NO: 36130 - DNA, 20 bp, synthetic construct
  misc_feature 1..20: note = CRISPR gRNA sequence
  source 1..20: mol_type = other DNA
cctccagtcggttcctcaca

SEQ ID NO: 36131 - DNA, 20 bp, synthetic construct
  misc_feature 1..20: note = CRISPR gRNA sequence
  source 1..20: mol_type = other DNA
cagtcggttcctcacagtgg

SEQ ID NO: 36132 - DNA, 20 bp, synthetic construct
  misc_feature 1..20: note = CRISPR gRNA sequence
  source 1..20: mol_type = other DNA
ctcacagtggccagccccac

SEQ ID NO: 36133 - DNA, 20 bp, synthetic construct
  misc_feature 1..20: note = CRISPR gRNA sequence
  source 1..20: mol_type = other DNA
acagtggccagccccacttc

SEQ ID NO: 36134 - DNA, 20 bp, synthetic construct
  misc_feature 1..20: note = CRISPR gRNA sequence
  source 1..20: mol_type = other DNA
cggggagagtcccaggcccc

SEQ ID NO: 36135 - DNA, 20 bp, synthetic construct
  misc_feature 1..20: note = CRISPR gRNA sequence
  source 1..20: mol_type = other DNA
ggggagagtcccaggccccg

SEQ ID NO: 36136 - DNA, 20 bp, synthetic construct
  misc_feature 1..20: note = CRISPR gRNA sequence
  source 1..20: mol_type = other DNA
gggagccacttgggcaagtg

SEQ ID NO: 36137 - DNA, 20 bp, synthetic construct
  misc_feature 1..20: note = CRISPR gRNA sequence
  source 1..20: mol_type = other DNA
gggcaagtgatctgcaagtc

SEQ ID NO: 36138 - DNA, 20 bp, synthetic construct
  misc_feature 1..20: note = CRISPR gRNA sequence
  source 1..20: mol_type = other DNA
ggcaagtgatctgcaagtcc

SEQ ID NO: 36139 - DNA, 20 bp, synthetic construct
  misc_feature 1..20: note = CRISPR gRNA sequence
  source 1..20: mol_type = other DNA
caagtcctgagttgcaggga

SEQ ID NO: 36140 - DNA, 20 bp, synthetic construct
  misc_feature 1..20: note = CRISPR gRNA sequence
  source 1..20: mol_type = other DNA
agttgcagggagcttgtccc

SEQ ID NO: 36141 - DNA, 20 bp, synthetic construct
  misc_feature 1..20: note = CRISPR gRNA sequence
  source 1..20: mol_type = other DNA
cagggagcttgtccccaccc

SEQ ID NO: 36142 - DNA, 20 bp, synthetic construct
  misc_feature 1..20: note = CRISPR gRNA sequence
  source 1..20: mol_type = other DNA
gtccccacccctgggtgggt

SEQ ID NO: 36143 - DNA, 20 bp, synthetic construct
  misc_feature 1..20: note = CRISPR gRNA sequence
  source 1..20: mol_type = other DNA
tccccacccctgggtgggtc

SEQ ID NO: 36144 - DNA, 20 bp, synthetic construct
  misc_feature 1..20: note = CRISPR gRNA sequence
  source 1..20: mol_type = other DNA
ggtgggtctctgtttctctc

SEQ ID NO: 36145 - DNA, 20 bp, synthetic construct
  misc_feature 1..20: note = CRISPR gRNA sequence
  source 1..20: mol_type = other DNA
tgtttctctccaactcagtc

SEQ ID NO: 36146 - DNA, 20 bp, synthetic construct
  misc_feature 1..20: note = CRISPR gRNA sequence
  source 1..20: mol_type = other DNA
tttctctccaactcagtcca

SEQ ID NO: 36147 - DNA, 20 bp, synthetic construct
  misc_feature 1..20: note = CRISPR gRNA sequence
  source 1..20: mol_type = other DNA
ctctccaactcagtccaacc

SEQ ID NO: 36148 - DNA, 20 bp, synthetic construct
  misc_feature 1..20: note = CRISPR gRNA sequence
  source 1..20: mol_type = other DNA
tctccaactcagtccaaccg

SEQ ID NO: 36149 - DNA, 20 bp, synthetic construct
  misc_feature 1..20: note = CRISPR gRNA sequence
  source 1..20: mol_type = other DNA
tccaactcagtccaaccgtg

SEQ ID NO: 36150 - DNA, 20 bp, synthetic construct
  misc_feature 1..20: note = CRISPR gRNA sequence
  source 1..20: mol_type = other DNA
caactcagtccaaccgtgaa

SEQ ID NO: 36151 - DNA, 20 bp, synthetic construct
  misc_feature 1..20: note = CRISPR gRNA sequence
  source 1..20: mol_type = other DNA
agtccaaccgtgaaagtggc

SEQ ID NO: 36152 - DNA, 20 bp, synthetic construct
  misc_feature 1..20: note = CRISPR gRNA sequence
  source 1..20: mol_type = other DNA
cgagggcacatggcccctga

SEQ ID NO: 36153 - DNA, 20 bp, synthetic construct
  misc_feature 1..20: note = CRISPR gRNA sequence
  source 1..20: mol_type = other DNA
agatgagctaactgagctat

SEQ ID NO: 36154 - DNA, 20 bp, synthetic construct
  misc_feature 1..20: note = CRISPR gRNA sequence
  source 1..20: mol_type = other DNA
actgagctattcactcctct

SEQ ID NO: 36155 - DNA, 20 bp, synthetic construct
  misc_feature 1..20: note = CRISPR gRNA sequence
  source 1..20: mol_type = other DNA
agctattcactcctctgatg

SEQ ID NO: 36156 - DNA, 20 bp, synthetic construct
  misc_feature 1..20: note = CRISPR gRNA sequence
  source 1..20: mol_type = other DNA
ttcactcctctgatgctggc

SEQ ID NO: 36157 - DNA, 20 bp, synthetic construct
  misc_feature 1..20: note = CRISPR gRNA sequence
  source 1..20: mol_type = other DNA
actcctctgatgctggccct

SEQ ID NO: 36158 - DNA, 20 bp, synthetic construct
  misc_feature 1..20: note = CRISPR gRNA sequence
  source 1..20: mol_type = other DNA
ctctgatgctggccctaggg

SEQ ID NO: 36159 - DNA, 20 bp, synthetic construct
  misc_feature 1..20: note = CRISPR gRNA sequence
  source 1..20: mol_type = other DNA
tgatgctggccctagggagg

SEQ ID NO: 36160 - DNA, 20 bp, synthetic construct
  misc_feature 1..20: note = CRISPR gRNA sequence
  source 1..20: mol_type = other DNA
atgctggccctagggaggaa

SEQ ID NO: 36161 - DNA, 20 bp, synthetic construct
  misc_feature 1..20: note = CRISPR gRNA sequence
  source 1..20: mol_type = other DNA
gccctagggaggaagagaaa

SEQ ID NO: 36162 - DNA, 20 bp, synthetic construct
  misc_feature 1..20: note = CRISPR gRNA sequence
  source 1..20: mol_type = other DNA
gggaggaagagaaaatccct

SEQ ID NO: 36163 - DNA, 20 bp, synthetic construct
  misc_feature 1..20: note = CRISPR gRNA sequence
  source 1..20: mol_type = other DNA
aggtaccttccatggatgga

SEQ ID NO: 36164 - DNA, 20 bp, synthetic construct
  misc_feature 1..20: note = CRISPR gRNA sequence
  source 1..20: mol_type = other DNA
ccatggatggaaaacctgtg

SEQ ID NO: 36165 - DNA, 20 bp, synthetic construct
  misc_feature 1..20: note = CRISPR gRNA sequence
  source 1..20: mol_type = other DNA
catggatggaaaacctgtgt

SEQ ID NO: 36166 - DNA, 20 bp, synthetic construct
  misc_feature 1..20: note = CRISPR gRNA sequence
  source 1..20: mol_type = other DNA
tgttaccatgaccacacccc

SEQ ID NO: 36167 - DNA, 20 bp, synthetic construct
  misc_feature 1..20: note = CRISPR gRNA sequence
  source 1..20: mol_type = other DNA
ccatgaccacacccccagcc

SEQ ID NO: 36168 - DNA, 20 bp, synthetic construct
  misc_feature 1..20: note = CRISPR gRNA sequence
  source 1..20: mol_type = other DNA
ccggtccttttcagaggtct

SEQ ID NO: 36169 - DNA, 20 bp, synthetic construct
  misc_feature 1..20: note = CRISPR gRNA sequence
  source 1..20: mol_type = other DNA
ttcagaggtcttggattcct

SEQ ID NO: 36170 - DNA, 20 bp, synthetic construct
  misc_feature 1..20: note = CRISPR gRNA sequence
  source 1..20: mol_type = other DNA
tcagaggtcttggattcctg

SEQ ID NO: 36171 - DNA, 20 bp, synthetic construct
  misc_feature 1..20: note = CRISPR gRNA sequence
  source 1..20: mol_type = other DNA
cagaggtcttggattcctgc

SEQ ID NO: 36172 - DNA, 20 bp, synthetic construct
  misc_feature 1..20: note = CRISPR gRNA sequence
  source 1..20: mol_type = other DNA
agaggtcttggattcctgct

SEQ ID NO: 36173 - DNA, 20 bp, synthetic construct
  misc_feature 1..20: note = CRISPR gRNA sequence
  source 1..20: mol_type = other DNA
ggattcctgctgggtcctcc

SEQ ID NO: 36174 - DNA, 20 bp, synthetic construct
  misc_feature 1..20: note = CRISPR gRNA sequence
  source 1..20: mol_type = other DNA
gattcctgctgggtcctcca

SEQ ID NO: 36175 - DNA, 20 bp, synthetic construct
  misc_feature 1..20: note = CRISPR gRNA sequence
  source 1..20: mol_type = other DNA
ctgctgggtcctccaaggca

SEQ ID NO: 36176 - DNA, 20 bp, synthetic construct
  misc_feature 1..20: note = CRISPR gRNA sequence
  source 1..20: mol_type = other DNA
ctgggtcctccaaggcatga

SEQ ID NO: 36177 - DNA, 20 bp, synthetic construct
  misc_feature 1..20: note = CRISPR gRNA sequence
  source 1..20: mol_type = other DNA
ggtcctccaaggcatgagac

SEQ ID NO: 36178 - DNA, 20 bp, synthetic construct
  misc_feature 1..20: note = CRISPR gRNA sequence
  source 1..20: mol_type = other DNA
caaggcatgagactttgagg

SEQ ID NO: 36179 - DNA, 20 bp, synthetic construct
  misc_feature 1..20: note = CRISPR gRNA sequence
  source 1..20: mol_type = other DNA
tgaggtggtcactttccctt

SEQ ID NO: 36180 - DNA, 20 bp, synthetic construct
  misc_feature 1..20: note = CRISPR gRNA sequence
  source 1..20: mol_type = other DNA
gaggtggtcactttcccttt

SEQ ID NO: 36181 - DNA, 20 bp, synthetic construct
  misc_feature 1..20: note = CRISPR gRNA sequence
  source 1..20: mol_type = other DNA
aggtggtcactttccctttt

SEQ ID NO: 36182 - DNA, 20 bp, synthetic construct
  misc_feature 1..20: note = CRISPR gRNA sequence
  source 1..20: mol_type = other DNA
tcccttttcaggcctgaatt

SEQ ID NO: 36183 - DNA, 20 bp, synthetic construct
  misc_feature 1..20: note = CRISPR gRNA sequence
  source 1..20: mol_type = other DNA
cccttttcaggcctgaattt

SEQ ID NO: 36184 - DNA, 20 bp, synthetic construct
  misc_feature 1..20: note = CRISPR gRNA sequence
  source 1..20: mol_type = other DNA
ccttttcaggcctgaatttc

SEQ ID NO: 36185 - DNA, 20 bp, synthetic construct
  misc_feature 1..20: note = CRISPR gRNA sequence
  source 1..20: mol_type = other DNA
ttcaggcctgaatttcctca

SEQ ID NO: 36186 - DNA, 20 bp, synthetic construct
  misc_feature 1..20: note = CRISPR gRNA sequence
  source 1..20: mol_type = other DNA
tcaggcctgaatttcctcat

SEQ ID NO: 36187 - DNA, 20 bp, synthetic construct
  misc_feature 1..20: note = CRISPR gRNA sequence
  source 1..20: mol_type = other DNA
caggcctgaatttcctcatc

SEQ ID NO: 36188 - DNA, 20 bp, synthetic construct
  misc_feature 1..20: note = CRISPR gRNA sequence
  source 1..20: mol_type = other DNA
aggcctgaatttcctcatct

SEQ ID NO: 36189 - DNA, 20 bp, synthetic construct
  misc_feature 1..20: note = CRISPR gRNA sequence
  source 1..20: mol_type = other DNA
aatttcctcatctggaattg

SEQ ID NO: 36190 - DNA, 20 bp, synthetic construct
  misc_feature 1..20: note = CRISPR gRNA sequence
  source 1..20: mol_type = other DNA
cctcatctggaattgaggga

SEQ ID NO: 36191 - DNA, 20 bp, synthetic construct
  misc_feature 1..20: note = CRISPR gRNA sequence
  source 1..20: mol_type = other DNA
ctcatctggaattgagggag

SEQ ID NO: 36192 - DNA, 20 bp, synthetic construct
  misc_feature 1..20: note = CRISPR gRNA sequence
  source 1..20: mol_type = other DNA
atctggaattgagggagggg

SEQ ID NO: 36193 - DNA, 20 bp, synthetic construct
  misc_feature 1..20: note = CRISPR gRNA sequence
  source 1..20: mol_type = other DNA
gaattgagggagggggcaag

SEQ ID NO: 36194 - DNA, 20 bp, synthetic construct
  misc_feature 1..20: note = CRISPR gRNA sequence
  source 1..20: mol_type = other DNA
agggagggggcaaggttacc

SEQ ID NO: 36195 - DNA, 20 bp, synthetic construct
  misc_feature 1..20: note = CRISPR gRNA sequence
  source 1..20: mol_type = other DNA
cctctgacttctccccctcc

SEQ ID NO: 36196 - DNA, 20 bp, synthetic construct
  misc_feature 1..20: note = CRISPR gRNA sequence
  source 1..20: mol_type = other DNA
tgacttctccccctccaaca

SEQ ID NO: 36197 - DNA, 20 bp, synthetic construct
  misc_feature 1..20: note = CRISPR gRNA sequence
  source 1..20: mol_type = other DNA
acttctccccctccaacact

SEQ ID NO: 36198 - DNA, 20 bp, synthetic construct
  misc_feature 1..20: note = CRISPR gRNA sequence
  source 1..20: mol_type = other DNA
ctccccctccaacactttcc

SEQ ID NO: 36199 - DNA, 20 bp, synthetic construct
  misc_feature 1..20: note = CRISPR gRNA sequence
  source 1..20: mol_type = other DNA
tccccctccaacactttccc

SEQ ID NO: 36200 - DNA, 20 bp, synthetic construct
  misc_feature 1..20: note = CRISPR gRNA sequence
  source 1..20: mol_type = other DNA
cccctccaacactttcccgt

SEQ ID NO: 36201 - DNA, 20 bp, synthetic construct
  misc_feature 1..20: note = CRISPR gRNA sequence
  source 1..20: mol_type = other DNA
caacactttcccgtagcaac

SEQ ID NO: 36202 - DNA, 20 bp, synthetic construct
  misc_feature 1..20: note = CRISPR gRNA sequence
  source 1..20: mol_type = other DNA
tcccgtagcaacttaaggct

SEQ ID NO: 36203 - DNA, 20 bp, synthetic construct
  misc_feature 1..20: note = CRISPR gRNA sequence
  source 1..20: mol_type = other DNA
cccgtagcaacttaaggctg

SEQ ID NO: 36204 - DNA, 20 bp, synthetic construct
  misc_feature 1..20: note = CRISPR gRNA sequence
  source 1..20: mol_type = other DNA
ccgtagcaacttaaggctgc

SEQ ID NO: 36205 - DNA, 20 bp, synthetic construct
  misc_feature 1..20: note = CRISPR gRNA sequence
  source 1..20: mol_type = other DNA
aaggctgcacccaaccacac

SEQ ID NO: 36206 - DNA, 20 bp, synthetic construct
  misc_feature 1..20: note = CRISPR gRNA sequence
  source 1..20: mol_type = other DNA
aggctgcacccaaccacacc

SEQ ID NO: 36207 - DNA, 20 bp, synthetic construct
  misc_feature 1..20: note = CRISPR gRNA sequence
  source 1..20: mol_type = other DNA
cacccaaccacaccggcaga

SEQ ID NO: 36208 - DNA, 20 bp, synthetic construct
  misc_feature 1..20: note = CRISPR gRNA sequence
  source 1..20: mol_type = other DNA
tcatcagtctctgggttcaa

SEQ ID NO: 36209 - DNA, 20 bp, synthetic construct
  misc_feature 1..20: note = CRISPR gRNA sequence
  source 1..20: mol_type = other DNA
tgggttcaaagcaaaccata

SEQ ID NO: 36210 - DNA, 20 bp, synthetic construct
  misc_feature 1..20: note = CRISPR gRNA sequence
  source 1..20: mol_type = other DNA
ggttcaaagcaaaccataca

SEQ ID NO: 36211 - DNA, 20 bp, synthetic construct
  misc_feature 1..20: note = CRISPR gRNA sequence
  source 1..20: mol_type = other DNA
aaagcaaaccatacatttca

SEQ ID NO: 36212 - DNA, 20 bp, synthetic construct
  misc_feature 1..20: note = CRISPR gRNA sequence
  source 1..20: mol_type = other DNA
caggggagtctgagaaaagg

SEQ ID NO: 36213 - DNA, 20 bp, synthetic construct
  misc_feature 1..20: note = CRISPR gRNA sequence
  source 1..20: mol_type = other DNA
aggggagtctgagaaaaggg

SEQ ID NO: 36214 - DNA, 20 bp, synthetic construct
  misc_feature 1..20: note = CRISPR gRNA sequence
  source 1..20: mol_type = other DNA
agaaaagggataccacccct

SEQ ID NO: 36215 - DNA, 20 bp, synthetic construct
  misc_feature 1..20: note = CRISPR gRNA sequence
  source 1..20: mol_type = other DNA
taaccatccaacaacagcaa

SEQ ID NO: 36216 - DNA, 20 bp, synthetic construct
  misc_feature 1..20: note = CRISPR gRNA sequence
  source 1..20: mol_type = other DNA
aaccatccaacaacagcaat

SEQ ID NO: 36217 - DNA, 20 bp, synthetic construct
  misc_feature 1..20: note = CRISPR gRNA sequence
  source 1..20: mol_type = other DNA
accatccaacaacagcaatg

SEQ ID NO: 36218 - DNA, 20 bp, synthetic construct
  misc_feature 1..20: note = CRISPR gRNA sequence
  source 1..20: mol_type = other DNA
agctcctatgagctcaattc

SEQ ID NO: 36219 - DNA, 20 bp, synthetic construct
  misc_feature 1..20: note = CRISPR gRNA sequence
  source 1..20: mol_type = other DNA
ctatgagctcaattccagtt

SEQ ID NO: 36220 - DNA, 20 bp, synthetic construct
  misc_feature 1..20: note = CRISPR gRNA sequence
  source 1..20: mol_type = other DNA
tgagctcaattccagttcct

SEQ ID NO: 36221 - DNA, 20 bp, synthetic construct
  misc_feature 1..20: note = CRISPR gRNA sequence
  source 1..20: mol_type = other DNA
aattccagttcctataaaat

SEQ ID NO: 36222 - DNA, 20 bp, synthetic construct
  misc_feature 1..20: note = CRISPR gRNA sequence
  source 1..20: mol_type = other DNA
cagttcctataaaatattgg

SEQ ID NO: 36223 - DNA, 20 bp, synthetic construct
  misc_feature 1..20: note = CRISPR gRNA sequence
  source 1..20: mol_type = other DNA
ctataaaatattggacactg

SEQ ID NO: 36224 - DNA, 20 bp, synthetic construct
  misc_feature 1..20: note = CRISPR gRNA sequence
  source 1..20: mol_type = other DNA
taaaatattggacactgtgc

SEQ ID NO: 36225 - DNA, 20 bp, synthetic construct
  misc_feature 1..20: note = CRISPR gRNA sequence
  source 1..20: mol_type = other DNA
gacactgtgctaggtccctc

SEQ ID NO: 36226 - DNA, 20 bp, synthetic construct
  misc_feature 1..20: note = CRISPR gRNA sequence
  source 1..20: mol_type = other DNA
tgctaggtccctcatcatta

SEQ ID NO: 36227 - DNA, 20 bp, synthetic construct
  misc_feature 1..20: note = CRISPR gRNA sequence
  source 1..20: mol_type = other DNA
ggtccctcatcattaccctt

SEQ ID NO: 36228 - DNA, 20 bp, synthetic construct
  misc_feature 1..20: note = CRISPR gRNA sequence
  source 1..20: mol_type = other DNA
atcattaccctttcatacag

SEQ ID NO: 36229 - DNA, 20 bp, synthetic construct
  misc_feature 1..20: note = CRISPR gRNA sequence
  source 1..20: mol_type = other DNA
ccctttcatacaggctttcc

SEQ ID NO: 36230 - DNA, 20 bp, synthetic construct
  misc_feature 1..20: note = CRISPR gRNA sequence
  source 1..20: mol_type = other DNA
tcatacaggctttcccacag

SEQ ID NO: 36231 - DNA, 20 bp, synthetic construct
  misc_feature 1..20: note = CRISPR gRNA sequence
  source 1..20: mol_type = other DNA
catacaggctttcccacagg

SEQ ID NO: 36232 - DNA, 20 bp, synthetic construct
  misc_feature 1..20: note = CRISPR gRNA sequence
  source 1..20: mol_type = other DNA
atacaggctttcccacaggt

SEQ ID NO: 36233 - DNA, 20 bp, synthetic construct
  misc_feature 1..20: note = CRISPR gRNA sequence
  source 1..20: mol_type = other DNA
tcccacaggtccattgtaca

SEQ ID NO: 36234 - DNA, 20 bp, synthetic construct
  misc_feature 1..20: note = CRISPR gRNA sequence
  source 1..20: mol_type = other DNA
cccacaggtccattgtacac

SEQ ID NO: 36235 - DNA, 20 bp, synthetic construct
  misc_feature 1..20: note = CRISPR gRNA sequence
  source 1..20: mol_type = other DNA
ccacaggtccattgtacact

SEQ ID NO: 36236 - DNA, 20 bp, synthetic construct
  misc_feature 1..20: note = CRISPR gRNA sequence
  source 1..20: mol_type = other DNA
tacactccaggaaaattgac

SEQ ID NO: 36237 - DNA, 20 bp, synthetic construct
  misc_feature 1..20: note = CRISPR gRNA sequence
  source 1..20: mol_type = other DNA
caggaaaattgactcgagaa

SEQ ID NO: 36238 - DNA, 20 bp, synthetic construct
  misc_feature 1..20: note = CRISPR gRNA sequence
  source 1..20: mol_type = other DNA
actcgagaatgtaaacgact

SEQ ID NO: 36239 - DNA, 20 bp, synthetic construct
  misc_feature 1..20: note = CRISPR gRNA sequence
  source 1..20: mol_type = other DNA
gagaatgtaaacgacttctt

SEQ ID NO: 36240 - DNA, 20 bp, synthetic construct
  misc_feature 1..20: note = CRISPR gRNA sequence
  source 1..20: mol_type = other DNA
cttcaggggcacacccttcc

SEQ ID NO: 36241 - DNA, 20 bp, synthetic construct
  misc_feature 1..20: note = CRISPR gRNA sequence
  source 1..20: mol_type = other DNA
ttcaggggcacacccttccc

SEQ ID NO: 36242 - DNA, 20 bp, synthetic construct
  misc_feature 1..20: note = CRISPR gRNA sequence
  source 1..20: mol_type = other DNA
caggggcacacccttcccag

SEQ ID NO: 36243 - DNA, 20 bp, synthetic construct
  misc_feature 1..20: note = CRISPR gRNA sequence
  source 1..20: mol_type = other DNA
aggggcacacccttcccagc

SEQ ID NO: 36244 - DNA, 20 bp, synthetic construct
  misc_feature 1..20: note = CRISPR gRNA sequence
  source 1..20: mol_type = other DNA
cccagccaacggtgtagctg

SEQ ID NO: 36245 - DNA, 20 bp, synthetic construct
  misc_feature 1..20: note = CRISPR gRNA sequence
  source 1..20: mol_type = other DNA
ccagccaacggtgtagctgc

SEQ ID NO: 36246 - DNA, 20 bp, synthetic construct
  misc_feature 1..20: note = CRISPR gRNA sequence
  source 1..20: mol_type = other DNA
ccatgctgccttcagagccg

SEQ ID NO: 36247 - DNA, 20 bp, synthetic construct
  misc_feature 1..20: note = CRISPR gRNA sequence
  source 1..20: mol_type = other DNA
ccttcagagccggtgccagg

SEQ ID NO: 36248 - DNA, 20 bp, synthetic construct
  misc_feature 1..20: note = CRISPR gRNA sequence
  source 1..20: mol_type = other DNA
cagagccggtgccaggtgtc

SEQ ID NO: 36249 - DNA, 20 bp, synthetic construct
  misc_feature 1..20: note = CRISPR gRNA sequence
  source 1..20: mol_type = other DNA
agagccggtgccaggtgtct

SEQ ID NO: 36250 - DNA, 20 bp, synthetic construct
  misc_feature 1..20: note = CRISPR gRNA sequence
  source 1..20: mol_type = other DNA
cactgtgctcttcccaccat

SEQ ID NO: 36251 - DNA, 20 bp, synthetic construct
  misc_feature 1..20: note = CRISPR gRNA sequence
  source 1..20: mol_type = other DNA
tgctcttcccaccatctgtt

SEQ ID NO: 36252 - DNA, 20 bp, synthetic construct
  misc_feature 1..20: note = CRISPR gRNA sequence
  source 1..20: mol_type = other DNA
ttcccaccatctgttccccc

SEQ ID NO: 36253 - DNA, 20 bp, synthetic construct
  misc_feature 1..20: note = CRISPR gRNA sequence
  source 1..20: mol_type = other DNA
cccaccatctgttcccccgt

SEQ ID NO: 36254 - DNA, 20 bp, synthetic construct
  misc_feature 1..20: note = CRISPR gRNA sequence
  source 1..20: mol_type = other DNA
ccaccatctgttcccccgtc

SEQ ID NO: 36255 - DNA, 20 bp, synthetic construct
  misc_feature 1..20: note = CRISPR gRNA sequence
  source 1..20: mol_type = other DNA
ttcccccgtcccctgaccct

SEQ ID NO: 36256 - DNA, 20 bp, synthetic construct
  misc_feature 1..20: note = CRISPR gRNA sequence
  source 1..20: mol_type = other DNA
ccccgtcccctgaccctttt

SEQ ID NO: 36257 - DNA, 20 bp, synthetic construct
  misc_feature 1..20: note = CRISPR gRNA sequence
  source 1..20: mol_type = other DNA
accctttttaaacaacacca

SEQ ID NO: 36258 - DNA, 20 bp, synthetic construct
  misc_feature 1..20: note = CRISPR gRNA sequence
  source 1..20: mol_type = other DNA
tttaaacaacaccattagga

SEQ ID NO: 36259 - DNA, 20 bp, synthetic construct
  misc_feature 1..20: note = CRISPR gRNA sequence
  source 1..20: mol_type = other DNA
ttaaacaacaccattaggaa

SEQ ID NO: 36260 - DNA, 20 bp, synthetic construct
  misc_feature 1..20: note = CRISPR gRNA sequence
  source 1..20: mol_type = other DNA
taaacaacaccattaggaaa

SEQ ID NO: 36261 - DNA, 20 bp, synthetic construct
  misc_feature 1..20: note = CRISPR gRNA sequence
  source 1..20: mol_type = other DNA
aaacaacaccattaggaaac

SEQ ID NO: 36262 - DNA, 20 bp, synthetic construct
  misc_feature 1..20: note = CRISPR gRNA sequence
  source 1..20: mol_type = other DNA
aacaacaccattaggaaact

SEQ ID NO: 36263 - DNA, 20 bp, synthetic construct
  misc_feature 1..20: note = CRISPR gRNA sequence
  source 1..20: mol_type = other DNA
ggaaactggggggagggcag

SEQ ID NO: 36264 - DNA, 20 bp, synthetic construct
  misc_feature 1..20: note = CRISPR gRNA sequence
  source 1..20: mol_type = other DNA
gggggagggcagcatccgcc

SEQ ID NO: 36265 - DNA, 20 bp, synthetic construct
  misc_feature 1..20: note = CRISPR gRNA sequence
  source 1..20: mol_type = other DNA
tccccagctgctgagggctc

SEQ ID NO: 36266 - DNA, 20 bp, synthetic construct
  misc_feature 1..20: note = CRISPR gRNA sequence
  source 1..20: mol_type = other DNA
cccagctgctgagggctcaa

SEQ ID NO: 36267 - DNA, 20 bp, synthetic construct
  misc_feature 1..20: note = CRISPR gRNA sequence
  source 1..20: mol_type = other DNA
ctgagggctcaacagctaca

SEQ ID NO: 36268 - DNA, 20 bp, synthetic construct
  misc_feature 1..20: note = CRISPR gRNA sequence
  source 1..20: mol_type = other DNA
agggctcaacagctacacct

SEQ ID NO: 36269 - DNA, 20 bp, synthetic construct
  misc_feature 1..20: note = CRISPR gRNA sequence
  source 1..20: mol_type = other DNA
aacagctacacctcaaggct

SEQ ID NO: 36270 - DNA, 20 bp, synthetic construct
  misc_feature 1..20: note = CRISPR gRNA sequence
  source 1..20: mol_type = other DNA
cacctcaaggctgactccaa

SEQ ID NO: 36271 - DNA, 20 bp, synthetic construct
  misc_feature 1..20: note = CRISPR gRNA sequence
  source 1..20: mol_type = other DNA
aaggctgactccaattttgg

SEQ ID NO: 36272 - DNA, 20 bp, synthetic construct
  misc_feature 1..20: note = CRISPR gRNA sequence
  source 1..20: mol_type = other DNA
actccaattttggtttccct

SEQ ID NO: 36273 - DNA, 20 bp, synthetic construct
  misc_feature 1..20: note = CRISPR gRNA sequence
  source 1..20: mol_type = other DNA
caattttggtttccctgctt

SEQ ID NO: 36274 - DNA, 20 bp, synthetic construct
  misc_feature 1..20: note = CRISPR gRNA sequence
  source 1..20: mol_type = other DNA
tggtttccctgcttctctgg

SEQ ID NO: 36275 - DNA, 20 bp, synthetic construct
  misc_feature 1..20: note = CRISPR gRNA sequence
  source 1..20: mol_type = other DNA
ggtttccctgcttctctggg

SEQ ID NO: 36276 - DNA, 20 bp, synthetic construct
  misc_feature 1..20: note = CRISPR gRNA sequence
  source 1..20: mol_type = other DNA
gtttccctgcttctctgggt

SEQ ID NO: 36277 - DNA, 20 bp, synthetic construct
  misc_feature 1..20: note = CRISPR gRNA sequence
  source 1..20: mol_type = other DNA
ccctgcttctctgggtatgg

SEQ ID NO: 36278 - DNA, 20 bp, synthetic construct
  misc_feature 1..20: note = CRISPR gRNA sequence
  source 1..20: mol_type = other DNA
cctgcttctctgggtatgga

SEQ ID NO: 36279 - DNA, 20 bp, synthetic construct
  misc_feature 1..20: note = CRISPR gRNA sequence
  source 1..20: mol_type = other DNA
cttctctgggtatggagtgg

SEQ ID NO: 36280 - DNA, 20 bp, synthetic construct
  misc_feature 1..20: note = CRISPR gRNA sequence
  source 1..20: mol_type = other DNA
ctctgggtatggagtggagt

SEQ ID NO: 36281 - DNA, 20 bp, synthetic construct
  misc_feature 1..20: note = CRISPR gRNA sequence
  source 1..20: mol_type = other DNA
tctgggtatggagtggagtc

SEQ ID NO: 36282 - DNA, 20 bp, synthetic construct
  misc_feature 1..20: note = CRISPR gRNA sequence
  source 1..20: mol_type = other DNA
tgggtatggagtggagtctg

SEQ ID NO: 36283 - DNA, 20 bp, synthetic construct
  misc_feature 1..20: note = CRISPR gRNA sequence
  source 1..20: mol_type = other DNA
ggtatggagtggagtctggc

SEQ ID NO: 36284 - DNA, 20 bp, synthetic construct
  misc_feature 1..20: note = CRISPR gRNA sequence
  source 1..20: mol_type = other DNA
gcagaggtcccgtcctgcag

SEQ ID NO: 36285 - DNA, 20 bp, synthetic construct
  misc_feature 1..20: note = CRISPR gRNA sequence
  source 1..20: mol_type = other DNA
cagaggcacccctcagtatt

SEQ ID NO: 36286 - DNA, 20 bp, synthetic construct
  misc_feature 1..20: note = CRISPR gRNA sequence
  source 1..20: mol_type = other DNA
agtatttacccaaagggagg

SEQ ID NO: 36287 - DNA, 20 bp, synthetic construct
  misc_feature 1..20: note = CRISPR gRNA sequence
  source 1..20: mol_type = other DNA
acccaaagggaggcgagaag

SEQ ID NO: 36288 - DNA, 20 bp, synthetic construct
  misc_feature 1..20: note = CRISPR gRNA sequence
  source 1..20: mol_type = other DNA
cccaaagggaggcgagaaga

SEQ ID NO: 36289 - DNA, 20 bp, synthetic construct
  misc_feature 1..20: note = CRISPR gRNA sequence
  source 1..20: mol_type = other DNA
gctgtgggccgagccaggcc

SEQ ID NO: 36290 - DNA, 20 bp, synthetic construct
  misc_feature 1..20: note = CRISPR gRNA sequence
  source 1..20: mol_type = other DNA
ctgtgggccgagccaggcca

SEQ ID NO: 36291 - DNA, 20 bp, synthetic construct
  misc_feature 1..20: note = CRISPR gRNA sequence
  source 1..20: mol_type = other DNA
tgggccgagccaggccagca

SEQ ID NO: 36292 - DNA, 20 bp, synthetic construct
  misc_feature 1..20: note = CRISPR gRNA sequence
  source 1..20: mol_type = other DNA
agagttagtgacacactgcc

SEQ ID NO: 36293 - DNA, 20 bp, synthetic construct
  misc_feature 1..20: note = CRISPR gRNA sequence
  source 1..20: mol_type = other DNA
gtgacacactgcccgaaagt

SEQ ID NO: 36294 - DNA, 20 bp, synthetic construct
  misc_feature 1..20: note = CRISPR gRNA sequence
  source 1..20: mol_type = other DNA
cccgaaagtctgacttctag

SEQ ID NO: 36295 - DNA, 20 bp, synthetic construct
  misc_feature 1..20: note = CRISPR gRNA sequence
  source 1..20: mol_type = other DNA
acttctagaacctttcggtg

SEQ ID NO: 36296 - DNA, 20 bp, synthetic construct
  misc_feature 1..20: note = CRISPR gRNA sequence
  source 1..20: mol_type = other DNA
ctagaacctttcggtgctga

SEQ ID NO: 36297 - DNA, 20 bp, synthetic construct
  misc_feature 1..20: note = CRISPR gRNA sequence
  source 1..20: mol_type = other DNA
tagaacctttcggtgctgat

SEQ ID NO: 36298 - DNA, 20 bp, synthetic construct
  misc_feature 1..20: note = CRISPR gRNA sequence
  source 1..20: mol_type = other DNA
gaacctttcggtgctgatac

SEQ ID NO: 36299 - DNA, 20 bp, synthetic construct
  misc_feature 1..20: note = CRISPR gRNA sequence
  source 1..20: mol_type = other DNA
tcggtgctgatacatggttc

SEQ ID NO: 36300 - DNA, 20 bp, synthetic construct
  misc_feature 1..20: note = CRISPR gRNA sequence
  source 1..20: mol_type = other DNA
cggtgctgatacatggttca

SEQ ID NO: 36301 - DNA, 20 bp, synthetic construct
  misc_feature 1..20: note = CRISPR gRNA sequence
  source 1..20: mol_type = other DNA
ggtgctgatacatggttcat

SEQ ID NO: 36302 - DNA, 20 bp, synthetic construct
  misc_feature 1..20: note = CRISPR gRNA sequence
  source 1..20: mol_type = other DNA
atacatggttcatactccag

SEQ ID NO: 36303 - DNA, 20 bp, synthetic construct
  misc_feature 1..20: note = CRISPR gRNA sequence
  source 1..20: mol_type = other DNA
atactccagacacctggctg

SEQ ID NO: 36304 - DNA, 20 bp, synthetic construct
  misc_feature 1..20: note = CRISPR gRNA sequence
  source 1..20: mol_type = other DNA
cagacacctggctgacctga

SEQ ID NO: 36305 - DNA, 20 bp, synthetic construct
  misc_feature 1..20: note = CRISPR gRNA sequence
  source 1..20: mol_type = other DNA
gctgacctgaagtctccctc

SEQ ID NO: 36306 - DNA, 20 bp, synthetic construct
  misc_feature 1..20: note = CRISPR gRNA sequence
  source 1..20: mol_type = other DNA
acctgaagtctccctccggt

SEQ ID NO: 36307 - DNA, 20 bp, synthetic construct
  misc_feature 1..20: note = CRISPR gRNA sequence
  source 1..20: mol_type = other DNA
aagtctccctccggtggaag

SEQ ID NO: 36308 - DNA, 20 bp, synthetic construct
  misc_feature 1..20: note = CRISPR gRNA sequence
  source 1..20: mol_type = other DNA
cctccggtggaaggaaatag

SEQ ID NO: 36309 - DNA, 20 bp, synthetic construct
  misc_feature 1..20: note = CRISPR gRNA sequence
  source 1..20: mol_type = other DNA
cggtggaaggaaatagacaa

SEQ ID NO: 36310 - DNA, 20 bp, synthetic construct
  misc_feature 1..20: note = CRISPR gRNA sequence
  source 1..20: mol_type = other DNA
tttcacatcttccaatggcc

SEQ ID NO: 36311 - DNA, 20 bp, synthetic construct
  misc_feature 1..20: note = CRISPR gRNA sequence
  source 1..20: mol_type = other DNA
tcacatcttccaatggcctg

SEQ ID NO: 36312 - DNA, 20 bp, synthetic construct
  misc_feature 1..20: note = CRISPR gRNA sequence
  source 1..20: mol_type = other DNA
cacatcttccaatggcctgc

SEQ ID NO: 36313 - DNA, 20 bp, synthetic construct
  misc_feature 1..20: note = CRISPR gRNA sequence
  source 1..20: mol_type = other DNA
acatcttccaatggcctgcc

SEQ ID NO: 36314 - DNA, 20 bp, synthetic construct
  misc_feature 1..20: note = CRISPR gRNA sequence
  source 1..20: mol_type = other DNA
ccaatggcctgccccagcag

SEQ ID NO: 36315 - DNA, 20 bp, synthetic construct
  misc_feature 1..20: note = CRISPR gRNA sequence
  source 1..20: mol_type = other DNA
caatggcctgccccagcagg

SEQ ID NO: 36316 - DNA, 20 bp, synthetic construct
  misc_feature 1..20: note = CRISPR gRNA sequence
  source 1..20: mol_type = other DNA
ccccagcaggacacagactc

SEQ ID NO: 36317 - DNA, 20 bp, synthetic construct
  misc_feature 1..20: note = CRISPR gRNA sequence
  source 1..20: mol_type = other DNA
ctgttcccatcctcaccccc

SEQ ID NO: 36318 - DNA, 20 bp, synthetic construct
  misc_feature 1..20: note = CRISPR gRNA sequence
  source 1..20: mol_type = other DNA
ttcccatcctcacccccatc

SEQ ID NO: 36319 - DNA, 20 bp, synthetic construct
  misc_feature 1..20: note = CRISPR gRNA sequence
  source 1..20: mol_type = other DNA
ccatcctcacccccatcccc

SEQ ID NO: 36320 - DNA, 20 bp, synthetic construct
  misc_feature 1..20: note = CRISPR gRNA sequence
  source 1..20: mol_type = other DNA
acccccatccccaattcaga

SEQ ID NO: 36321 - DNA, 20 bp, synthetic construct
  misc_feature 1..20: note = CRISPR gRNA sequence
  source 1..20: mol_type = other DNA
agaatggtttctctgtttat

SEQ ID NO: 36322 - DNA, 20 bp, synthetic construct
  misc_feature 1..20: note = CRISPR gRNA sequence
  source 1..20: mol_type = other DNA
ctctgtttatctggaatggc

SEQ ID NO: 36323 - DNA, 20 bp, synthetic construct
  misc_feature 1..20: note = CRISPR gRNA sequence
  source 1..20: mol_type = other DNA
tctgtttatctggaatggca

SEQ ID NO: 36324 - DNA, 20 bp, synthetic construct
  misc_feature 1..20: note = CRISPR gRNA sequence
  source 1..20: mol_type = other DNA
tgtttatctggaatggcagg

SEQ ID NO: 36325 - DNA, 20 bp, synthetic construct
  misc_feature 1..20: note = CRISPR gRNA sequence
  source 1..20: mol_type = other DNA
tttatctggaatggcaggac

SEQ ID NO: 36326 - DNA, 20 bp, synthetic construct
  misc_feature 1..20: note = CRISPR gRNA sequence
  source 1..20: mol_type = other DNA
atctggaatggcaggaccag

SEQ ID NO: 36327 - DNA, 20 bp, synthetic construct
  misc_feature 1..20: note = CRISPR gRNA sequence
  source 1..20: mol_type = other DNA
tctggaatggcaggaccagc

SEQ ID NO: 36328 - DNA, 20 bp, synthetic construct
  misc_feature 1..20: note = CRISPR gRNA sequence
  source 1..20: mol_type = other DNA
gaatggcaggaccagctgag

SEQ ID NO: 36329 - DNA, 20 bp, synthetic construct
  misc_feature 1..20: note = CRISPR gRNA sequence
  source 1..20: mol_type = other DNA
agactgcacgctaaattaag

SEQ ID NO: 36330 - DNA, 20 bp, synthetic construct
  misc_feature 1..20: note = CRISPR gRNA sequence
  source 1..20: mol_type = other DNA
cacgctaaattaagatgctt

SEQ ID NO: 36331 - DNA, 20 bp, synthetic construct
  misc_feature 1..20: note = CRISPR gRNA sequence
  source 1..20: mol_type = other DNA
aattaagatgctttcccggc

SEQ ID NO: 36332 - DNA, 20 bp, synthetic construct
  misc_feature 1..20: note = CRISPR gRNA sequence
  source 1..20: mol_type = other DNA
agatgctttcccggcctttt

SEQ ID NO: 36333 - DNA, 20 bp, synthetic construct
  misc_feature 1..20: note = CRISPR gRNA sequence
  source 1..20: mol_type = other DNA
tcccggcctttttaccttgg

SEQ ID NO: 36334 - DNA, 20 bp, synthetic construct
  misc_feature 1..20: note = CRISPR gRNA sequence
  source 1..20: mol_type = other DNA
cccggcctttttaccttggg

SEQ ID NO: 36335 - DNA, 20 bp, synthetic construct
  misc_feature 1..20: note = CRISPR gRNA sequence
  source 1..20: mol_type = other DNA
ccggcctttttaccttgggg

SEQ ID NO: 36336 - DNA, 20 bp, synthetic construct
  misc_feature 1..20: note = CRISPR gRNA sequence
  source 1..20: mol_type = other DNA
tttaccttggggctctgaca

SEQ ID NO: 36337 - DNA, 20 bp, synthetic construct
  misc_feature 1..20: note = CRISPR gRNA sequence
  source 1..20: mol_type = other DNA
ttaccttggggctctgacag

SEQ ID NO: 36338 - DNA, 20 bp, synthetic construct
  misc_feature 1..20: note = CRISPR gRNA sequence
  source 1..20: mol_type = other DNA
taccttggggctctgacagg

SEQ ID NO: 36339 - DNA, 20 bp, synthetic construct
  misc_feature 1..20: note = CRISPR gRNA sequence
  source 1..20: mol_type = other DNA
accttggggctctgacaggt

SEQ ID NO: 36340 - DNA, 20 bp, synthetic construct
  misc_feature 1..20: note = CRISPR gRNA sequence
  source 1..20: mol_type = other DNA
ccttggggctctgacaggta

SEQ ID NO: 36341 - DNA, 20 bp, synthetic construct
  misc_feature 1..20: note = CRISPR gRNA sequence
  source 1..20: mol_type = other DNA
ggggctctgacaggtaggac

SEQ ID NO: 36342 - DNA, 20 bp, synthetic construct
  misc_feature 1..20: note = CRISPR gRNA sequence
  source 1..20: mol_type = other DNA
gggctctgacaggtaggacc

SEQ ID NO: 36343 - DNA, 20 bp, synthetic construct
  misc_feature 1..20: note = CRISPR gRNA sequence
  source 1..20: mol_type = other DNA
tgacaggtaggacccagcag

SEQ ID NO: 36344 - DNA, 20 bp, synthetic construct
  misc_feature 1..20: note = CRISPR gRNA sequence
  source 1..20: mol_type = other DNA
acaggtaggacccagcaggg

SEQ ID NO: 36345 - DNA, 20 bp, synthetic construct
  misc_feature 1..20: note = CRISPR gRNA sequence
  source 1..20: mol_type = other DNA
tgtaggaatcccagccaggc

SEQ ID NO: 36346 - DNA, 20 bp, synthetic construct
  misc_feature 1..20: note = CRISPR gRNA sequence
  source 1..20: mol_type = other DNA
ccggagtctggcagcccctc

SEQ ID NO: 36347 - DNA, 20 bp, synthetic construct
  misc_feature 1..20: note = CRISPR gRNA sequence
  source 1..20: mol_type = other DNA
gcagcccctcctcgtgccct

SEQ ID NO: 36348 - DNA, 20 bp, synthetic construct
  misc_feature 1..20: note = CRISPR gRNA sequence
  source 1..20: mol_type = other DNA
ctcgtgccctcagcttcccc

SEQ ID NO: 36349 - DNA, 20 bp, synthetic construct
  misc_feature 1..20: note = CRISPR gRNA sequence
  source 1..20: mol_type = other DNA
gtgccctcagcttccccaag

SEQ ID NO: 36350 - DNA, 20 bp, synthetic construct
  misc_feature 1..20: note = CRISPR gRNA sequence
  source 1..20: mol_type = other DNA
agcttccccaaggatgcctt

SEQ ID NO: 36351 - DNA, 20 bp, synthetic construct
  misc_feature 1..20: note = CRISPR gRNA sequence
  source 1..20: mol_type = other DNA
ccccaaggatgccttcggat

SEQ ID NO: 36352 - DNA, 20 bp, synthetic construct
  misc_feature 1..20: note = CRISPR gRNA sequence
  source 1..20: mol_type = other DNA
cccaaggatgccttcggatg

SEQ ID NO: 36353 - DNA, 20 bp, synthetic construct
  misc_feature 1..20: note = CRISPR gRNA sequence
  source 1..20: mol_type = other DNA
tgtctccggcaggcaggggc

SEQ ID NO: 36354 - DNA, 20 bp, synthetic construct
  misc_feature 1..20: note = CRISPR gRNA sequence
  source 1..20: mol_type = other DNA
gtctccggcaggcaggggca

SEQ ID NO: 36355 - DNA, 20 bp, synthetic construct
  misc_feature 1..20: note = CRISPR gRNA sequence
  source 1..20: mol_type = other DNA
tctccggcaggcaggggcaa

SEQ ID NO: 36356 - DNA, 20 bp, synthetic construct
  misc_feature 1..20: note = CRISPR gRNA sequence
  source 1..20: mol_type = other DNA
cggcaggcaggggcaagggc

SEQ ID NO: 36357 - DNA, 20 bp, synthetic construct
  misc_feature 1..20: note = CRISPR gRNA sequence
  source 1..20: mol_type = other DNA
caggggcaagggctggtgcc

SEQ ID NO: 36358 - DNA, 20 bp, synthetic construct
  misc_feature 1..20: note = CRISPR gRNA sequence
  source 1..20: mol_type = other DNA
aagggctggtgcctggttta

SEQ ID NO: 36359 - DNA, 20 bp, synthetic construct
  misc_feature 1..20: note = CRISPR gRNA sequence
  source 1..20: mol_type = other DNA
ctggtttacagcattccttt

SEQ ID NO: 36360 - DNA, 20 bp, synthetic construct
  misc_feature 1..20: note = CRISPR gRNA sequence
  source 1..20: mol_type = other DNA
ggtttacagcattccttttg

SEQ ID NO: 36361 - DNA, 20 bp, synthetic construct
  misc_feature 1..20: note = CRISPR gRNA sequence
  source 1..20: mol_type = other DNA
acagcattccttttggagtc

SEQ ID NO: 36362 - DNA, 20 bp, synthetic construct
  misc_feature 1..20: note = CRISPR gRNA sequence
  source 1..20: mol_type = other DNA
attccttttggagtctggaa

SEQ ID NO: 36363 - DNA, 20 bp, synthetic construct
  misc_feature 1..20: note = CRISPR gRNA sequence
  source 1..20: mol_type = other DNA
ccttttggagtctggaatag

SEQ ID NO: 36364 - DNA, 20 bp, synthetic construct
  misc_feature 1..20: note = CRISPR gRNA sequence
  source 1..20: mol_type = other DNA
cttttggagtctggaatagt

SEQ ID NO: 36365 - DNA, 20 bp, synthetic construct
  misc_feature 1..20: note = CRISPR gRNA sequence
  source 1..20: mol_type = other DNA
ttttggagtctggaatagtg

SEQ ID NO: 36366 - DNA, 20 bp, synthetic construct
  misc_feature 1..20: note = CRISPR gRNA sequence
  source 1..20: mol_type = other DNA
ctccctgtcttctctcccct

SEQ ID NO: 36367 - DNA, 20 bp, synthetic construct
  misc_feature 1..20: note = CRISPR gRNA sequence
  source 1..20: mol_type = other DNA
tccctgtcttctctcccctt

SEQ ID NO: 36368 - DNA, 20 bp, synthetic construct
  misc_feature 1..20: note = CRISPR gRNA sequence
  source 1..20: mol_type = other DNA
cctgtcttctctccccttag

SEQ ID NO: 36369 - DNA, 20 bp, synthetic construct
  misc_feature 1..20: note = CRISPR gRNA sequence
  source 1..20: mol_type = other DNA
ccccttaggagtctgcacta

SEQ ID NO: 36370 - DNA, 20 bp, synthetic construct
  misc_feature 1..20: note = CRISPR gRNA sequence
  source 1..20: mol_type = other DNA
atggaaacaacctgtcaatc

SEQ ID NO: 36371 - DNA, 20 bp, synthetic construct
  misc_feature 1..20: note = CRISPR gRNA sequence
  source 1..20: mol_type = other DNA
acaacctgtcaatccagctc

SEQ ID NO: 36372 - DNA, 20 bp, synthetic construct
  misc_feature 1..20: note = CRISPR gRNA sequence
  source 1..20: mol_type = other DNA
caacctgtcaatccagctca

SEQ ID NO: 36373 - DNA, 20 bp, synthetic construct
  misc_feature 1..20: note = CRISPR gRNA sequence
  source 1..20: mol_type = other DNA
aatccagctcaaggcacaca

SEQ ID NO: 36374 - DNA, 20 bp, synthetic construct
  misc_feature 1..20: note = CRISPR gRNA sequence
  source 1..20: mol_type = other DNA
agctcaaggcacacatagcc

SEQ ID NO: 36375 - DNA, 20 bp, synthetic construct
  misc_feature 1..20: note = CRISPR gRNA sequence
  source 1..20: mol_type = other DNA
cacatagcccagacacccat

SEQ ID NO: 36376 - DNA, 20 bp, synthetic construct
  misc_feature 1..20: note = CRISPR gRNA sequence
  source 1..20: mol_type = other DNA
cacccatgagaccctctccg

SEQ ID NO: 36377 - DNA, 20 bp, synthetic construct
  misc_feature 1..20: note = CRISPR gRNA sequence
  source 1..20: mol_type = other DNA
acccatgagaccctctccgt

SEQ ID NO: 36378 - DNA, 20 bp, synthetic construct
  misc_feature 1..20: note = CRISPR gRNA sequence
  source 1..20: mol_type = other DNA
cccatgagaccctctccgtg

SEQ ID NO: 36379 - DNA, 20 bp, synthetic construct
  misc_feature 1..20: note = CRISPR gRNA sequence
  source 1..20: mol_type = other DNA
gaccctctccgtggggaccc

SEQ ID NO: 36380 - DNA, 20 bp, synthetic construct
  misc_feature 1..20: note = CRISPR gRNA sequence
  source 1..20: mol_type = other DNA
ccctctccgtggggacccta

SEQ ID NO: 36381 - DNA, 20 bp, synthetic construct
  misc_feature 1..20: note = CRISPR gRNA sequence
  source 1..20: mol_type = other DNA
ctagagcacctatcatgaac

SEQ ID NO: 36382 - DNA, 20 bp, synthetic construct
  misc_feature 1..20: note = CRISPR gRNA sequence
  source 1..20: mol_type = other DNA
tagagcacctatcatgaacg

SEQ ID NO: 36383 - DNA, 20 bp, synthetic construct
  misc_feature 1..20: note = CRISPR gRNA sequence
  source 1..20: mol_type = other DNA
gagcacctatcatgaacgag

SEQ ID NO: 36384 - DNA, 20 bp, synthetic construct
  misc_feature 1..20: note = CRISPR gRNA sequence
  source 1..20: mol_type = other DNA
ctatcatgaacgaggagacc

SEQ ID NO: 36385 - DNA, 20 bp, synthetic construct
  misc_feature 1..20: note = CRISPR gRNA sequence
  source 1..20: mol_type = other DNA
tcatgaacgaggagaccaag

SEQ ID NO: 36386 - DNA, 20 bp, synthetic construct
  misc_feature 1..20: note = CRISPR gRNA sequence
  source 1..20: mol_type = other DNA
catgaacgaggagaccaagt

SEQ ID NO: 36387 - DNA, 20 bp, synthetic construct
  misc_feature 1..20: note = CRISPR gRNA sequence
  source 1..20: mol_type = other DNA
gtcacttttctcctactgcc

SEQ ID NO: 36388 - DNA, 20 bp, synthetic construct
  misc_feature 1..20: note = CRISPR gRNA sequence
  source 1..20: mol_type = other DNA
ttttctcctactgccaagac

SEQ ID NO: 36389 - DNA, 20 bp, synthetic construct
  misc_feature 1..20: note = CRISPR gRNA sequence
  source 1..20: mol_type = other DNA
cctacccaaatctgccttac

SEQ ID NO: 36390 - DNA, 20 bp, synthetic construct
  misc_feature 1..20: note = CRISPR gRNA sequence
  source 1..20: mol_type = other DNA
ctacccaaatctgccttact

SEQ ID NO: 36391 - DNA, 20 bp, synthetic construct
  misc_feature 1..20: note = CRISPR gRNA sequence
  source 1..20: mol_type = other DNA
acctgcccttgaccatcatt

SEQ ID NO: 36392 - DNA, 20 bp, synthetic construct
  misc_feature 1..20: note = CRISPR gRNA sequence
  source 1..20: mol_type = other DNA
ccttgaccatcattcagcat

SEQ ID NO: 36393 - DNA, 20 bp, synthetic construct
  misc_feature 1..20: note = CRISPR gRNA sequence
  source 1..20: mol_type = other DNA
cagcatgagaatgtaatgat

SEQ ID NO: 36394 - DNA, 20 bp, synthetic construct
  misc_feature 1..20: note = CRISPR gRNA sequence
  source 1..20: mol_type = other DNA
gagaatgtaatgatcagaca

SEQ ID NO: 36395 - DNA, 20 bp, synthetic construct
  misc_feature 1..20: note = CRISPR gRNA sequence
  source 1..20: mol_type = other DNA
aatgatcagacacagaaaat

SEQ ID NO: 36396 - DNA, 20 bp, synthetic construct
  misc_feature 1..20: note = CRISPR gRNA sequence
  source 1..20: mol_type = other DNA
atgatcagacacagaaaatc

SEQ ID NO: 36397 - DNA, 20 bp, synthetic construct
  misc_feature 1..20: note = CRISPR gRNA sequence
  source 1..20: mol_type = other DNA
atcagacacagaaaatcagg

SEQ ID NO: 36398 - DNA, 20 bp, synthetic construct
  misc_feature 1..20: note = CRISPR gRNA sequence
  source 1..20: mol_type = other DNA
cagacacagaaaatcaggaa

SEQ ID NO: 36399 - DNA, 20 bp, synthetic construct
  misc_feature 1..20: note = CRISPR gRNA sequence
  source 1..20: mol_type = other DNA
agaaaatcaggaagagtttt

SEQ ID NO: 36400 - DNA, 20 bp, synthetic construct
  misc_feature 1..20: note = CRISPR gRNA sequence
  source 1..20: mol_type = other DNA
aatcaggaagagttttgaga

SEQ ID NO: 36401 - DNA, 20 bp, synthetic construct
  misc_feature 1..20: note = CRISPR gRNA sequence
  source 1..20: mol_type = other DNA
agcatctaatctacccattt

SEQ ID NO: 36402 - DNA, 20 bp, synthetic construct
  misc_feature 1..20: note = CRISPR gRNA sequence
  source 1..20: mol_type = other DNA
catctaatctacccatttta

SEQ ID NO: 36403 - DNA, 20 bp, synthetic construct
  misc_feature 1..20: note = CRISPR gRNA sequence
  source 1..20: mol_type = other DNA
taatctacccattttagaga

SEQ ID NO: 36404 - DNA, 20 bp, synthetic construct
  misc_feature 1..20: note = CRISPR gRNA sequence
  source 1..20: mol_type = other DNA
attttagagatggtatgact

SEQ ID NO: 36405 - DNA, 20 bp, synthetic construct
  misc_feature 1..20: note = CRISPR gRNA sequence
  source 1..20: mol_type = other DNA
ttttagagatggtatgactg

SEQ ID NO: 36406 - DNA, 20 bp, synthetic construct
  misc_feature 1..20: note = CRISPR gRNA sequence
  source 1..20: mol_type = other DNA
tggtatgactgaggcttata

SEQ ID NO: 36407 - DNA, 20 bp, synthetic construct
  misc_feature 1..20: note = CRISPR gRNA sequence
  source 1..20: mol_type = other DNA
ggtatgactgaggcttatat

SEQ ID NO: 36408 - DNA, 20 bp, synthetic construct
  misc_feature 1..20: note = CRISPR gRNA sequence
  source 1..20: mol_type = other DNA
actgaggcttatataggaaa

SEQ ID NO: 36409 - DNA, 20 bp, synthetic construct
  misc_feature 1..20: note = CRISPR gRNA sequence
  source 1..20: mol_type = other DNA
ctgaggcttatataggaaaa

SEQ ID NO: 36410 - DNA, 20 bp, synthetic construct
  misc_feature 1..20: note = CRISPR gRNA sequence
  source 1..20: mol_type = other DNA
tataggaaaaaggcttgctc

SEQ ID NO: 36411 - DNA, 20 bp, synthetic construct
  misc_feature 1..20: note = CRISPR gRNA sequence
  source 1..20: mol_type = other DNA
ataggaaaaaggcttgctca

SEQ ID NO: 36412 - DNA, 20 bp, synthetic construct
  misc_feature 1..20: note = CRISPR gRNA sequence
  source 1..20: mol_type = other DNA
cttgctcaaggtcacactat

SEQ ID NO: 36413 - DNA, 20 bp, synthetic construct
  misc_feature 1..20: note = CRISPR gRNA sequence
  source 1..20: mol_type = other DNA
aggtcacactatgagtgtat

SEQ ID NO: 36414 - DNA, 20 bp, synthetic construct
  misc_feature 1..20: note = CRISPR gRNA sequence
  source 1..20: mol_type = other DNA
cacactatgagtgtatcagc

SEQ ID NO: 36415 - DNA, 20 bp, synthetic construct
  misc_feature 1..20: note = CRISPR gRNA sequence
  source 1..20: mol_type = other DNA
acactatgagtgtatcagct

SEQ ID NO: 36416 - DNA, 20 bp, synthetic construct
  misc_feature 1..20: note = CRISPR gRNA sequence
  source 1..20: mol_type = other DNA
tatgagtgtatcagctagga

SEQ ID NO: 36417 - DNA, 20 bp, synthetic construct
  misc_feature 1..20: note = CRISPR gRNA sequence
  source 1..20: mol_type = other DNA
atgagtgtatcagctaggat

SEQ ID NO: 36418 - DNA, 20 bp, synthetic construct
  misc_feature 1..20: note = CRISPR gRNA sequence
  source 1..20: mol_type = other DNA
gtgtatcagctaggataggc

SEQ ID NO: 36419 - DNA, 20 bp, synthetic construct
  misc_feature 1..20: note = CRISPR gRNA sequence
  source 1..20: mol_type = other DNA
tgtatcagctaggataggcc

SEQ ID NO: 36420 - DNA, 20 bp, synthetic construct
  misc_feature 1..20: note = CRISPR gRNA sequence
  source 1..20: mol_type = other DNA
ggataggccaggttacactg

SEQ ID NO: 36421 - DNA, 20 bp, synthetic construct
  misc_feature 1..20: note = CRISPR gRNA sequence
  source 1..20: mol_type = other DNA
tgtagtacatgcaccctcca

SEQ ID NO: 36422 - DNA, 20 bp, synthetic construct
  misc_feature 1..20: note = CRISPR gRNA sequence
  source 1..20: mol_type = other DNA
acatgcaccctccaaagtcc

SEQ ID NO: 36423 - DNA, 20 bp, synthetic construct
  misc_feature 1..20: note = CRISPR gRNA sequence
  source 1..20: mol_type = other DNA
tccaaagtcccagtgactca

SEQ ID NO: 36424 - DNA, 20 bp, synthetic construct
  misc_feature 1..20: note = CRISPR gRNA sequence
  source 1..20: mol_type = other DNA
ccagtgactcatggcaacaa

SEQ ID NO: 36425 - DNA, 20 bp, synthetic construct
  misc_feature 1..20: note = CRISPR gRNA sequence
  source 1..20: mol_type = other DNA
ctcttgcttcctgtctcgtg

SEQ ID NO: 36426 - DNA, 20 bp, synthetic construct
  misc_feature 1..20: note = CRISPR gRNA sequence
  source 1..20: mol_type = other DNA
cctgtctcgtgtggattgac

SEQ ID NO: 36427 - DNA, 20 bp, synthetic construct
  misc_feature 1..20: note = CRISPR gRNA sequence
  source 1..20: mol_type = other DNA
ctgtctcgtgtggattgact

SEQ ID NO: 36428 - DNA, 20 bp, synthetic construct
  misc_feature 1..20: note = CRISPR gRNA sequence
  source 1..20: mol_type = other DNA
atcatcctgtctcccacact

SEQ ID NO: 36429 - DNA, 20 bp, synthetic construct
  misc_feature 1..20: note = CRISPR gRNA sequence
  source 1..20: mol_type = other DNA
tcatcctgtctcccacactc

SEQ ID NO: 36430 - DNA, 20 bp, synthetic construct
  misc_feature 1..20: note = CRISPR gRNA sequence
  source 1..20: mol_type = other DNA
gtctcccacactcaggctaa

SEQ ID NO: 36431 - DNA, 20 bp, synthetic construct
  misc_feature 1..20: note = CRISPR gRNA sequence
  source 1..20: mol_type = other DNA
tctcccacactcaggctaac

SEQ ID NO: 36432 - DNA, 20 bp, synthetic construct
  misc_feature 1..20: note = CRISPR gRNA sequence
  source 1..20: mol_type = other DNA
ctcccacactcaggctaaca

SEQ ID NO: 36433 - DNA, 20 bp, synthetic construct
  misc_feature 1..20: note = CRISPR gRNA sequence
  source 1..20: mol_type = other DNA
ccacactcaggctaacaggg

SEQ ID NO: 36434 - DNA, 20 bp, synthetic construct
  misc_feature 1..20: note = CRISPR gRNA sequence
  source 1..20: mol_type = other DNA
gccatgatttgcaatatttc

SEQ ID NO: 36435 - DNA, 20 bp, synthetic construct
  misc_feature 1..20: note = CRISPR gRNA sequence
  source 1..20: mol_type = other DNA
tttgcaatatttctggtccc

SEQ ID NO: 36436 - DNA, 20 bp, synthetic construct
  misc_feature 1..20: note = CRISPR gRNA sequence
  source 1..20: mol_type = other DNA
tgcaatatttctggtccctg

SEQ ID NO: 36437 - DNA, 20 bp, synthetic construct
  misc_feature 1..20: note = CRISPR gRNA sequence
  source 1..20: mol_type = other DNA
aatatttctggtccctggag

SEQ ID NO: 36438 - DNA, 20 bp, synthetic construct
  misc_feature 1..20: note = CRISPR gRNA sequence
  source 1..20: mol_type = other DNA
tggtccctggagtagaaaaa

SEQ ID NO: 36439 - DNA, 20 bp, synthetic construct
  misc_feature 1..20: note = CRISPR gRNA sequence
  source 1..20: mol_type = other DNA
ctggagtagaaaaaaagaaa

SEQ ID NO: 36440 - DNA, 20 bp, synthetic construct
  misc_feature 1..20: note = CRISPR gRNA sequence
  source 1..20: mol_type = other DNA
aagtactgtcaattacacct

SEQ ID NO: 36441 - DNA, 20 bp, synthetic construct
  misc_feature 1..20: note = CRISPR gRNA sequence
  source 1..20: mol_type = other DNA
cttggttcttaaaacaacta

SEQ ID NO: 36442 - DNA, 20 bp, synthetic construct
  misc_feature 1..20: note = CRISPR gRNA sequence
  source 1..20: mol_type = other DNA
ttggttcttaaaacaactac

SEQ ID NO: 36443 - DNA, 20 bp, synthetic construct
  misc_feature 1..20: note = CRISPR gRNA sequence
  source 1..20: mol_type = other DNA
aacaactacaggcatgacat

SEQ ID NO: 36444 - DNA, 20 bp, synthetic construct
  misc_feature 1..20: note = CRISPR gRNA sequence
  source 1..20: mol_type = other DNA
ggcatgacatgagtcttttt

SEQ ID NO: 36445 - DNA, 20 bp, synthetic construct
  misc_feature 1..20: note = CRISPR gRNA sequence
  source 1..20: mol_type = other DNA
ttagcatgtttcattgacca

SEQ ID NO: 36446 - DNA, 20 bp, synthetic construct
  misc_feature 1..20: note = CRISPR gRNA sequence
  source 1..20: mol_type = other DNA
catgtttcattgaccaaagc

SEQ ID NO: 36447 - DNA, 20 bp, synthetic construct
  misc_feature 1..20: note = CRISPR gRNA sequence
  source 1..20: mol_type = other DNA
attgaccaaagcaagtttca

SEQ ID NO: 36448 - DNA, 20 bp, synthetic construct
  misc_feature 1..20: note = CRISPR gRNA sequence
  source 1..20: mol_type = other DNA
tcatggctgtgcccaatttc

SEQ ID NO: 36449 - DNA, 20 bp, synthetic construct
  misc_feature 1..20: note = CRISPR gRNA sequence
  source 1..20: mol_type = other DNA
catggctgtgcccaatttca

SEQ ID NO: 36450 - DNA, 20 bp, synthetic construct
  misc_feature 1..20: note = CRISPR gRNA sequence
  source 1..20: mol_type = other DNA
tggctgtgcccaatttcaag

SEQ ID NO: 36451 - DNA, 20 bp, synthetic construct
  misc_feature 1..20: note = CRISPR gRNA sequence
  source 1..20: mol_type = other DNA
ggctgtgcccaatttcaagg

SEQ ID NO: 36452 - DNA, 20 bp, synthetic construct
  misc_feature 1..20: note = CRISPR gRNA sequence
  source 1..20: mol_type = other DNA
tgtgcccaatttcaaggagg

SEQ ID NO: 36453 - DNA, 20 bp, synthetic construct
  misc_feature 1..20: note = CRISPR gRNA sequence
  source 1..20: mol_type = other DNA
tgcccaatttcaaggaggca

SEQ ID NO: 36454 - DNA, 20 bp, synthetic construct
  misc_feature 1..20: note = CRISPR gRNA sequence
  source 1..20: mol_type = other DNA
ccaatttcaaggaggcagag

SEQ ID NO: 36455 - DNA, 20 bp, synthetic construct
  misc_feature 1..20: note = CRISPR gRNA sequence
  source 1..20: mol_type = other DNA
agagaagtgtaatcccacca

SEQ ID NO: 36456 - DNA, 20 bp, synthetic construct
  misc_feature 1..20: note = CRISPR gRNA sequence
  source 1..20: mol_type = other DNA
gagaagtgtaatcccaccaa

SEQ ID NO: 36457 - DNA, 20 bp, synthetic construct
  misc_feature 1..20: note = CRISPR gRNA sequence
  source 1..20: mol_type = other DNA
gtgtaatcccaccaaaggcc

SEQ ID NO: 36458 - DNA, 20 bp, synthetic construct
  misc_feature 1..20: note = CRISPR gRNA sequence
  source 1..20: mol_type = other DNA
aatcccaccaaaggcctaga

SEQ ID NO: 36459 - DNA, 20 bp, synthetic construct
  misc_feature 1..20: note = CRISPR gRNA sequence
  source 1..20: mol_type = other DNA
tcccaccaaaggcctagaaa

SEQ ID NO: 36460 - DNA, 20 bp, synthetic construct
  misc_feature 1..20: note = CRISPR gRNA sequence
  source 1..20: mol_type = other DNA
cccaccaaaggcctagaaag

SEQ ID NO: 36461 - DNA, 20 bp, synthetic construct
  misc_feature 1..20: note = CRISPR gRNA sequence
  source 1..20: mol_type = other DNA
caccaaaggcctagaaagag

SEQ ID NO: 36462 - DNA, 20 bp, synthetic construct
  misc_feature 1..20: note = CRISPR gRNA sequence
  source 1..20: mol_type = other DNA
aaaggcctagaaagaggaga

SEQ ID NO: 36463 - DNA, 20 bp, synthetic construct
  misc_feature 1..20: note = CRISPR gRNA sequence
  source 1..20: mol_type = other DNA
aggcctagaaagaggagaaa

SEQ ID NO: 36464 - DNA, 20 bp, synthetic construct
  misc_feature 1..20: note = CRISPR gRNA sequence
  source 1..20: mol_type = other DNA
ggagaaagagtatctgtgaa

SEQ ID NO: 36465 - DNA, 20 bp, synthetic construct
  misc_feature 1..20: note = CRISPR gRNA sequence
  source 1..20: mol_type = other DNA
aacagccctaatgcctacca

SEQ ID NO: 36466 - DNA, 20 bp, synthetic construct
  misc_feature 1..20: note = CRISPR gRNA sequence
  source 1..20: mol_type = other DNA
cagccctaatgcctaccaca

SEQ ID NO: 36467 - DNA, 20 bp, synthetic construct
  misc_feature 1..20: note = CRISPR gRNA sequence
  source 1..20: mol_type = other DNA
taatgcctaccacagagaat

SEQ ID NO: 36468 - DNA, 20 bp, synthetic construct
  misc_feature 1..20: note = CRISPR gRNA sequence
  source 1..20: mol_type = other DNA
ctaccacagagaattagtaa

SEQ ID NO: 36469 - DNA, 20 bp, synthetic construct
  misc_feature 1..20: note = CRISPR gRNA sequence
  source 1..20: mol_type = other DNA
accacagagaattagtaaca

SEQ ID NO: 36470 - DNA, 20 bp, synthetic construct
  misc_feature 1..20: note = CRISPR gRNA sequence
  source 1..20: mol_type = other DNA
cagagaattagtaacagagc

SEQ ID NO: 36471 - DNA, 20 bp, synthetic construct
  misc_feature 1..20: note = CRISPR gRNA sequence
  source 1..20: mol_type = other DNA
agagaattagtaacagagct

SEQ ID NO: 36472 - DNA, 20 bp, synthetic construct
  misc_feature 1..20: note = CRISPR gRNA sequence
  source 1..20: mol_type = other DNA
ttagtaacagagctgggcca

SEQ ID NO: 36473 - DNA, 20 bp, synthetic construct
  misc_feature 1..20: note = CRISPR gRNA sequence
  source 1..20: mol_type = other DNA
aaccatcgtcctctgtctcc

SEQ ID NO: 36474 - DNA, 20 bp, synthetic construct
  misc_feature 1..20: note = CRISPR gRNA sequence
  source 1..20: mol_type = other DNA
gtctccaagattattcccca

SEQ ID NO: 36475 - DNA, 20 bp, synthetic construct
  misc_feature 1..20: note = CRISPR gRNA sequence
  source 1..20: mol_type = other DNA
tgccatgtgctttttctcct

SEQ ID NO: 36476 - DNA, 20 bp, synthetic construct
  misc_feature 1..20: note = CRISPR gRNA sequence
  source 1..20: mol_type = other DNA
gccatgtgctttttctcctg

SEQ ID NO: 36477 - DNA, 20 bp, synthetic construct
  misc_feature 1..20: note = CRISPR gRNA sequence
  source 1..20: mol_type = other DNA
tgtgctttttctcctgagga

SEQ ID NO: 36478 - DNA, 20 bp, synthetic construct
  misc_feature 1..20: note = CRISPR gRNA sequence
  source 1..20: mol_type = other DNA
ctttttctcctgaggatggt

SEQ ID NO: 36479 - DNA, 20 bp, synthetic construct
  misc_feature 1..20: note = CRISPR gRNA sequence
  source 1..20: mol_type = other DNA
cctgaggatggttagcctta

SEQ ID NO: 36480 - DNA, 20 bp, synthetic construct
  misc_feature 1..20: note = CRISPR gRNA sequence
  source 1..20: mol_type = other DNA
tgaggatggttagccttaaa

SEQ ID NO: 36481 - DNA, 20 bp, synthetic construct
  misc_feature 1..20: note = CRISPR gRNA sequence
  source 1..20: mol_type = other DNA
agagatttgtgtcatatcct

SEQ ID NO: 36482 - DNA, 20 bp, synthetic construct
  misc_feature 1..20: note = CRISPR gRNA sequence
  source 1..20: mol_type = other DNA
gagatttgtgtcatatccta

SEQ ID NO: 36483 - DNA, 20 bp, synthetic construct
  misc_feature 1..20: note = CRISPR gRNA sequence
  source 1..20: mol_type = other DNA
agatttgtgtcatatcctaa

SEQ ID NO: 36484 - DNA, 20 bp, synthetic construct
  misc_feature 1..20: note = CRISPR gRNA sequence
  source 1..20: mol_type = other DNA
gatttgtgtcatatcctaag

SEQ ID NO: 36485 - DNA, 20 bp, synthetic construct
  misc_feature 1..20: note = CRISPR gRNA sequence
  source 1..20: mol_type = other DNA
tgtgtcatatcctaagggga

SEQ ID NO: 36486 - DNA, 20 bp, synthetic construct
  misc_feature 1..20: note = CRISPR gRNA sequence
  source 1..20: mol_type = other DNA
aggggatagaacactaatga

SEQ ID NO: 36487 - DNA, 20 bp, synthetic construct
  misc_feature 1..20: note = CRISPR gRNA sequence
  source 1..20: mol_type = other DNA
gaacactaatgatggaaaca

SEQ ID NO: 36488 - DNA, 20 bp, synthetic construct
  misc_feature 1..20: note = CRISPR gRNA sequence
  source 1..20: mol_type = other DNA
aacactaatgatggaaacaa

SEQ ID NO: 36489 - DNA, 20 bp, synthetic construct
  misc_feature 1..20: note = CRISPR gRNA sequence
  source 1..20: mol_type = other DNA
tggaaacaaaggtattgtgt

SEQ ID NO: 36490 - DNA, 20 bp, synthetic construct
  misc_feature 1..20: note = CRISPR gRNA sequence
  source 1..20: mol_type = other DNA
acaaaggtattgtgttagac

SEQ ID NO: 36491 - DNA, 20 bp, synthetic construct
  misc_feature 1..20: note = CRISPR gRNA sequence
  source 1..20: mol_type = other DNA
aggtattgtgttagactggc

SEQ ID NO: 36492 - DNA, 20 bp, synthetic construct
  misc_feature 1..20: note = CRISPR gRNA sequence
  source 1..20: mol_type = other DNA
gtattgtgttagactggctg

SEQ ID NO: 36493 - DNA, 20 bp, synthetic construct
  misc_feature 1..20: note = CRISPR gRNA sequence
  source 1..20: mol_type = other DNA
tattgtgttagactggctgg

SEQ ID NO: 36494 - DNA, 20 bp, synthetic construct
  misc_feature 1..20: note = CRISPR gRNA sequence
  source 1..20: mol_type = other DNA
ttgtgttagactggctggag

SEQ ID NO: 36495 - DNA, 20 bp, synthetic construct
  misc_feature 1..20: note = CRISPR gRNA sequence
  source 1..20: mol_type = other DNA
actggctggaggagaaattt

SEQ ID NO: 36496 - DNA, 20 bp, synthetic construct
  misc_feature 1..20: note = CRISPR gRNA sequence
  source 1..20: mol_type = other DNA
ctggctggaggagaaatttg

SEQ ID NO: 36497 - DNA, 20 bp, synthetic construct
  misc_feature 1..20: note = CRISPR gRNA sequence
  source 1..20: mol_type = other DNA
tggaggagaaatttgaggat

SEQ ID NO: 36498 - DNA, 20 bp, synthetic construct
  misc_feature 1..20: note = CRISPR gRNA sequence
  source 1..20: mol_type = other DNA
ttgaggatgagaaacatcac

SEQ ID NO: 36499 - DNA, 20 bp, synthetic construct
  misc_feature 1..20: note = CRISPR gRNA sequence
  source 1..20: mol_type = other DNA
tcaccagaaatcacaccatc

SEQ ID NO: 36500 - DNA, 20 bp, synthetic construct
  misc_feature 1..20: note = CRISPR gRNA sequence
  source 1..20: mol_type = other DNA
caccagaaatcacaccatcc

SEQ ID NO: 36501 - DNA, 20 bp, synthetic construct
  misc_feature 1..20: note = CRISPR gRNA sequence
  source 1..20: mol_type = other DNA
aggcactacttacttccatc

SEQ ID NO: 36502 - DNA, 20 bp, synthetic construct
  misc_feature 1..20: note = CRISPR gRNA sequence
  source 1..20: mol_type = other DNA
catctggtgccatgctgccc

SEQ ID NO: 36503 - DNA, 20 bp, synthetic construct
  misc_feature 1..20: note = CRISPR gRNA sequence
  source 1..20: mol_type = other DNA
tgccctggaccatttcttca

SEQ ID NO: 36504 - DNA, 20 bp, synthetic construct
  misc_feature 1..20: note = CRISPR gRNA sequence
  source 1..20: mol_type = other DNA
gccctggaccatttcttcat

SEQ ID NO: 36505 - DNA, 20 bp, synthetic construct
  misc_feature 1..20: note = CRISPR gRNA sequence
  source 1..20: mol_type = other DNA
ctggaccatttcttcatggg

SEQ ID NO: 36506 - DNA, 20 bp, synthetic construct
  misc_feature 1..20: note = CRISPR gRNA sequence
  source 1..20: mol_type = other DNA
ccatttcttcatgggtagca

SEQ ID NO: 36507 - DNA, 20 bp, synthetic construct
  misc_feature 1..20: note = CRISPR gRNA sequence
  source 1..20: mol_type = other DNA
ttcatgggtagcatggatgc

SEQ ID NO: 36508 - DNA, 20 bp, synthetic construct
  misc_feature 1..20: note = CRISPR gRNA sequence
  source 1..20: mol_type = other DNA
agcatggatgctggacacca

SEQ ID NO: 36509 - DNA, 20 bp, synthetic construct
  misc_feature 1..20: note = CRISPR gRNA sequence
  source 1..20: mol_type = other DNA
ggatgctggacaccatagcc

SEQ ID NO: 36510 - DNA, 20 bp, synthetic construct
  misc_feature 1..20: note = CRISPR gRNA sequence
  source 1..20: mol_type = other DNA
ctggacaccatagcctggaa

SEQ ID NO: 36511 - DNA, 20 bp, synthetic construct
  misc_feature 1..20: note = CRISPR gRNA sequence
  source 1..20: mol_type = other DNA
gacaccatagcctggaaaag

SEQ ID NO: 36512 - DNA, 20 bp, synthetic construct
  misc_feature 1..20: note = CRISPR gRNA sequence
  source 1..20: mol_type = other DNA
ctggaaaagaagttatgccc

SEQ ID NO: 36513 - DNA, 20 bp, synthetic construct
  misc_feature 1..20: note = CRISPR gRNA sequence
  source 1..20: mol_type = other DNA
tggaaaagaagttatgccct

SEQ ID NO: 36514 - DNA, 20 bp, synthetic construct
  misc_feature 1..20: note = CRISPR gRNA sequence
  source 1..20: mol_type = other DNA
agaagttatgccctaggcta

SEQ ID NO: 36515 - DNA, 20 bp, synthetic construct
  misc_feature 1..20: note = CRISPR gRNA sequence
  source 1..20: mol_type = other DNA
tatggccacatccttttgcc

SEQ ID NO: 36516 - DNA, 20 bp, synthetic construct
  misc_feature 1..20: note = CRISPR gRNA sequence
  source 1..20: mol_type = other DNA
tgccgagatcacacaaaatc

SEQ ID NO: 36517 - DNA, 20 bp, synthetic construct
  misc_feature 1..20: note = CRISPR gRNA sequence
  source 1..20: mol_type = other DNA
gccgagatcacacaaaatcc

SEQ ID NO: 36518 - DNA, 20 bp, synthetic construct
  misc_feature 1..20: note = CRISPR gRNA sequence
  source 1..20: mol_type = other DNA
ccgagatcacacaaaatcca

SEQ ID NO: 36519 - DNA, 20 bp, synthetic construct
  misc_feature 1..20: note = CRISPR gRNA sequence
  source 1..20: mol_type = other DNA
tcacacaaaatccagggact

SEQ ID NO: 36520 - DNA, 20 bp, synthetic construct
  misc_feature 1..20: note = CRISPR gRNA sequence
  source 1..20: mol_type = other DNA
tccagggacttagccttgtc

SEQ ID NO: 36521 - DNA, 20 bp, synthetic construct
  misc_feature 1..20: note = CRISPR gRNA sequence
  source 1..20: mol_type = other DNA
tagccttgtctggtgccatc

SEQ ID NO: 36522 - DNA, 20 bp, synthetic construct
  misc_feature 1..20: note = CRISPR gRNA sequence
  source 1..20: mol_type = other DNA
agccttgtctggtgccatct

SEQ ID NO: 36523 - DNA, 20 bp, synthetic construct
  misc_feature 1..20: note = CRISPR gRNA sequence
  source 1..20: mol_type = other DNA
ctggtgccatctaggcctcc

SEQ ID NO: 36524 - DNA, 20 bp, synthetic construct
  misc_feature 1..20: note = CRISPR gRNA sequence
  source 1..20: mol_type = other DNA
tggtgccatctaggcctcca

SEQ ID NO: 36525 - DNA, 20 bp, synthetic construct
  misc_feature 1..20: note = CRISPR gRNA sequence
  source 1..20: mol_type = other DNA
catctaggcctccaaggcct

SEQ ID NO: 36526 - DNA, 20 bp, synthetic construct
  misc_feature 1..20: note = CRISPR gRNA sequence
  source 1..20: mol_type = other DNA
ccaaggccttggaaatttac

SEQ ID NO: 36527 - DNA, 20 bp, synthetic construct
  misc_feature 1..20: note = CRISPR gRNA sequence
  source 1..20: mol_type = other DNA
gccttggaaatttactggcc

SEQ ID NO: 36528 - DNA, 20 bp, synthetic construct
  misc_feature 1..20: note = CRISPR gRNA sequence
  source 1..20: mol_type = other DNA
ccttggaaatttactggcct

SEQ ID NO: 36529 - DNA, 20 bp, synthetic construct
  misc_feature 1..20: note = CRISPR gRNA sequence
  source 1..20: mol_type = other DNA
ttggaaatttactggcctgg

SEQ ID NO: 36530 - DNA, 20 bp, synthetic construct
  misc_feature 1..20: note = CRISPR gRNA sequence
  source 1..20: mol_type = other DNA
tggaaatttactggcctggg

SEQ ID NO: 36531 - DNA, 20 bp, synthetic construct
  misc_feature 1..20: note = CRISPR gRNA sequence
  source 1..20: mol_type = other DNA
aatttactggcctgggaggc

SEQ ID NO: 36532 - DNA, 20 bp, synthetic construct
  misc_feature 1..20: note = CRISPR gRNA sequence
  source 1..20: mol_type = other DNA
gcctgggaggcaagaaacct

SEQ ID NO: 36533 - DNA, 20 bp, synthetic construct
  misc_feature 1..20: note = CRISPR gRNA sequence
  source 1..20: mol_type = other DNA
ttctcctcctgcctctgtca

SEQ ID NO: 36534 - DNA, 20 bp, synthetic construct
  misc_feature 1..20: note = CRISPR gRNA sequence
  source 1..20: mol_type = other DNA
atggacttgctgtgtgactg

SEQ ID NO: 36535 - DNA, 20 bp, synthetic construct
  misc_feature 1..20: note = CRISPR gRNA sequence
  source 1..20: mol_type = other DNA
tggacttgctgtgtgactgt

SEQ ID NO: 36536 - DNA, 20 bp, synthetic construct
  misc_feature 1..20: note = CRISPR gRNA sequence
  source 1..20: mol_type = other DNA
gcacaccctttgcccttcct

SEQ ID NO: 36537 - DNA, 20 bp, synthetic construct
  misc_feature 1..20: note = CRISPR gRNA sequence
  source 1..20: mol_type = other DNA
cctttgcccttccttggcca

SEQ ID NO: 36538 - DNA, 20 bp, synthetic construct
  misc_feature 1..20: note = CRISPR gRNA sequence
  source 1..20: mol_type = other DNA
ccatggtctttccgtctgct

SEQ ID NO: 36539 - DNA, 20 bp, synthetic construct
  misc_feature 1..20: note = CRISPR gRNA sequence
  source 1..20: mol_type = other DNA
tggtctttccgtctgcttag

SEQ ID NO: 36540 - DNA, 20 bp, synthetic construct
  misc_feature 1..20: note = CRISPR gRNA sequence
  source 1..20: mol_type = other DNA
gtctttccgtctgcttagtg

SEQ ID NO: 36541 - DNA, 20 bp, synthetic construct
  misc_feature 1..20: note = CRISPR gRNA sequence
  source 1..20: mol_type = other DNA
tctttccgtctgcttagtgg

SEQ ID NO: 36542 - DNA, 20 bp, synthetic construct
  misc_feature 1..20: note = CRISPR gRNA sequence
  source 1..20: mol_type = other DNA
ttccgtctgcttagtggagg

SEQ ID NO: 36543 - DNA, 20 bp, synthetic construct
  misc_feature 1..20: note = CRISPR gRNA sequence
  source 1..20: mol_type = other DNA
ggaggtggtgatccctgcct

SEQ ID NO: 36544 - DNA, 20 bp, synthetic construct
  misc_feature 1..20: note = CRISPR gRNA sequence
  source 1..20: mol_type = other DNA
gaggtggtgatccctgcctg

SEQ ID NO: 36545 - DNA, 20 bp, synthetic construct
  misc_feature 1..20: note = CRISPR gRNA sequence
  source 1..20: mol_type = other DNA
tgatccctgcctgaggatca

SEQ ID NO: 36546 - DNA, 20 bp, synthetic construct
  misc_feature 1..20: note = CRISPR gRNA sequence
  source 1..20: mol_type = other DNA
ctgcctgaggatcatggtgt

SEQ ID NO: 36547 - DNA, 20 bp, synthetic construct
  misc_feature 1..20: note = CRISPR gRNA sequence
  source 1..20: mol_type = other DNA
gagcatgtttcataaattct

SEQ ID NO: 36548 - DNA, 20 bp, synthetic construct
  misc_feature 1..20: note = CRISPR gRNA sequence
  source 1..20: mol_type = other DNA
aattctaagactctctgcct

SEQ ID NO: 36549 - DNA, 20 bp, synthetic construct
  misc_feature 1..20: note = CRISPR gRNA sequence
  source 1..20: mol_type = other DNA
ctaagactctctgcctgagt

SEQ ID NO: 36550 - DNA, 20 bp, synthetic construct
  misc_feature 1..20: note = CRISPR gRNA sequence
  source 1..20: mol_type = other DNA
taagactctctgcctgagtg

SEQ ID NO: 36551 - DNA, 20 bp, synthetic construct
  misc_feature 1..20: note = CRISPR gRNA sequence
  source 1..20: mol_type = other DNA
gagtgaggacctattgctat

SEQ ID NO: 36552 - DNA, 20 bp, synthetic construct
  misc_feature 1..20: note = CRISPR gRNA sequence
  source 1..20: mol_type = other DNA
aggacctattgctattagcc

SEQ ID NO: 36553 - DNA, 20 bp, synthetic construct
  misc_feature 1..20: note = CRISPR gRNA sequence
  source 1..20: mol_type = other DNA
ctattgctattagcccagtt

SEQ ID NO: 36554 - DNA, 20 bp, synthetic construct
  misc_feature 1..20: note = CRISPR gRNA sequence
  source 1..20: mol_type = other DNA
tattgctattagcccagttg

SEQ ID NO: 36555 - DNA, 20 bp, synthetic construct
  misc_feature 1..20: note = CRISPR gRNA sequence
  source 1..20: mol_type = other DNA
ttgctattagcccagttgag

SEQ ID NO: 36556 - DNA, 20 bp, synthetic construct
  misc_feature 1..20: note = CRISPR gRNA sequence
  source 1..20: mol_type = other DNA
cccagttgaggagaaatgac

SEQ ID NO: 36557 - DNA, 20 bp, synthetic construct
  misc_feature 1..20: note = CRISPR gRNA sequence
  source 1..20: mol_type = other DNA
agttgaggagaaatgaccag

SEQ ID NO: 36558 - DNA, 20 bp, synthetic construct
  misc_feature 1..20: note = CRISPR gRNA sequence
  source 1..20: mol_type = other DNA
gttgaggagaaatgaccagt

SEQ ID NO: 36559 - DNA, 20 bp, synthetic construct
  misc_feature 1..20: note = CRISPR gRNA sequence
  source 1..20: mol_type = other DNA
ttgaggagaaatgaccagtg

SEQ ID NO: 36560 - DNA, 20 bp, synthetic construct
  misc_feature 1..20: note = CRISPR gRNA sequence
  source 1..20: mol_type = other DNA
gaaatgaccagtggggctga

SEQ ID NO: 36561 - DNA, 20 bp, synthetic construct
  misc_feature 1..20: note = CRISPR gRNA sequence
  source 1..20: mol_type = other DNA
gtggggctgacagtacatcc

SEQ ID NO: 36562 - DNA, 20 bp, synthetic construct
  misc_feature 1..20: note = CRISPR gRNA sequence
  source 1..20: mol_type = other DNA
gtatgtctctactgcatgcc

SEQ ID NO: 36563 - DNA, 20 bp, synthetic construct
  misc_feature 1..20: note = CRISPR gRNA sequence
  source 1..20: mol_type = other DNA
tatgtctctactgcatgccc

SEQ ID NO: 36564 - DNA, 20 bp, synthetic construct
  misc_feature 1..20: note = CRISPR gRNA sequence
  source 1..20: mol_type = other DNA
atgtctctactgcatgccca

SEQ ID NO: 36565 - DNA, 20 bp, synthetic construct
  misc_feature 1..20: note = CRISPR gRNA sequence
  source 1..20: mol_type = other DNA
gtctctactgcatgcccagg

SEQ ID NO: 36566 - DNA, 20 bp, synthetic construct
  misc_feature 1..20: note = CRISPR gRNA sequence
  source 1..20: mol_type = other DNA
tctactgcatgcccagggag

SEQ ID NO: 36567 - DNA, 20 bp, synthetic construct
  misc_feature 1..20: note = CRISPR gRNA sequence
  source 1..20: mol_type = other DNA
ctgcatgcccagggagcagc

SEQ ID NO: 36568 - DNA, 20 bp, synthetic construct
  misc_feature 1..20: note = CRISPR gRNA sequence
  source 1..20: mol_type = other DNA
tgcatgcccagggagcagct

SEQ ID NO: 36569 - DNA, 20 bp, synthetic construct
  misc_feature 1..20: note = CRISPR gRNA sequence
  source 1..20: mol_type = other DNA
agcagctgggctctaaaccc

SEQ ID NO: 36570 - DNA, 20 bp, synthetic construct
  misc_feature 1..20: note = CRISPR gRNA sequence
  source 1..20: mol_type = other DNA
gcagctgggctctaaacccc

SEQ ID NO: 36571 - DNA, 20 bp, synthetic construct
  misc_feature 1..20: note = CRISPR gRNA sequence
  source 1..20: mol_type = other DNA
gctctaaaccccaggacgca

SEQ ID NO: 36572 - DNA, 20 bp, synthetic construct
  misc_feature 1..20: note = CRISPR gRNA sequence
  source 1..20: mol_type = other DNA
aaccccaggacgcatagtac

SEQ ID NO: 36573 - DNA, 20 bp, synthetic construct
  misc_feature 1..20: note = CRISPR gRNA sequence
  source 1..20: mol_type = other DNA
aggacgcatagtactggcct

SEQ ID NO: 36574 - DNA, 20 bp, synthetic construct
  misc_feature 1..20: note = CRISPR gRNA sequence
  source 1..20: mol_type = other DNA
atagtactggcctcagcctc

SEQ ID NO: 36575 - DNA, 20 bp, synthetic construct
  misc_feature 1..20: note = CRISPR gRNA sequence
  source 1..20: mol_type = other DNA
tagtactggcctcagcctct

SEQ ID NO: 36576 - DNA, 20 bp, synthetic construct
  misc_feature 1..20: note = CRISPR gRNA sequence
  source 1..20: mol_type = other DNA
tggcctcagcctctgggaat

SEQ ID NO: 36577 - DNA, 20 bp, synthetic construct
  misc_feature 1..20: note = CRISPR gRNA sequence
  source 1..20: mol_type = other DNA
ggcctcagcctctgggaatt

SEQ ID NO: 36578 - DNA, 20 bp, synthetic construct
  misc_feature 1..20: note = CRISPR gRNA sequence
  source 1..20: mol_type = other DNA
ctcagcctctgggaattggg

SEQ ID NO: 36579 - DNA, 20 bp, synthetic construct
  misc_feature 1..20: note = CRISPR gRNA sequence
  source 1..20: mol_type = other DNA
tcagcctctgggaattggga

SEQ ID NO: 36580 - DNA, 20 bp, synthetic construct
  misc_feature 1..20: note = CRISPR gRNA sequence
  source 1..20: mol_type = other DNA
cctctgggaattgggaaggc

SEQ ID NO: 36581 - DNA, 20 bp, synthetic construct
  misc_feature 1..20: note = CRISPR gRNA sequence
  source 1..20: mol_type = other DNA
gaattgggaaggctggcttc

SEQ ID NO: 36582 - DNA, 20 bp, synthetic construct
  misc_feature 1..20: note = CRISPR gRNA sequence
  source 1..20: mol_type = other DNA
aattgggaaggctggcttct

SEQ ID NO: 36583 - DNA, 20 bp, synthetic construct
  misc_feature 1..20: note = CRISPR gRNA sequence
  source 1..20: mol_type = other DNA
tgggaaggctggcttctggg

SEQ ID NO: 36584 - DNA, 20 bp, synthetic construct
  misc_feature 1..20: note = CRISPR gRNA sequence
  source 1..20: mol_type = other DNA
ggtggacctcctactctttt

SEQ ID NO: 36585 - DNA, 20 bp, synthetic construct
  misc_feature 1..20: note = CRISPR gRNA sequence
  source 1..20: mol_type = other DNA
tggacctcctactcttttca

SEQ ID NO: 36586 - DNA, 20 bp, synthetic construct
  misc_feature 1..20: note = CRISPR gRNA sequence
  source 1..20: mol_type = other DNA
cctcctactcttttcagagt

SEQ ID NO: 36587 - DNA, 20 bp, synthetic construct
  misc_feature 1..20: note = CRISPR gRNA sequence
  source 1..20: mol_type = other DNA
tcctactcttttcagagtta

SEQ ID NO: 36588 - DNA, 20 bp, synthetic construct
  misc_feature 1..20: note = CRISPR gRNA sequence
  source 1..20: mol_type = other DNA
cctactcttttcagagttag

SEQ ID NO: 36589 - DNA, 20 bp, synthetic construct
  misc_feature 1..20: note = CRISPR gRNA sequence
  source 1..20: mol_type = other DNA
actcttttcagagttagagg

SEQ ID NO: 36590 - DNA, 20 bp, synthetic construct
  misc_feature 1..20: note = CRISPR gRNA sequence
  source 1..20: mol_type = other DNA
agagttagaggtggactctc

SEQ ID NO: 36591 - DNA, 20 bp, synthetic construct
  misc_feature 1..20: note = CRISPR gRNA sequence
  source 1..20: mol_type = other DNA
agttagaggtggactctctg

SEQ ID NO: 36592 - DNA, 20 bp, synthetic construct
  misc_feature 1..20: note = CRISPR gRNA sequence
  source 1..20: mol_type = other DNA
ggtggactctctggagttgt

SEQ ID NO: 36593 - DNA, 20 bp, synthetic construct
  misc_feature 1..20: note = CRISPR gRNA sequence
  source 1..20: mol_type = other DNA
gtggactctctggagttgtg

SEQ ID NO: 36594 - DNA, 20 bp, synthetic construct
  misc_feature 1..20: note = CRISPR gRNA sequence
  source 1..20: mol_type = other DNA
tggagttgtgaggataaaat

SEQ ID NO: 36595 - DNA, 20 bp, synthetic construct
  misc_feature 1..20: note = CRISPR gRNA sequence
  source 1..20: mol_type = other DNA
ggagttgtgaggataaaata

SEQ ID NO: 36596 - DNA, 20 bp, synthetic construct
  misc_feature 1..20: note = CRISPR gRNA sequence
  source 1..20: mol_type = other DNA
aggataaaataaggtatata

SEQ ID NO: 36597 - DNA, 20 bp, synthetic construct
  misc_feature 1..20: note = CRISPR gRNA sequence
  source 1..20: mol_type = other DNA
aataaggtatataaagcact

SEQ ID NO: 36598 - DNA, 20 bp, synthetic construct
  misc_feature 1..20: note = CRISPR gRNA sequence
  source 1..20: mol_type = other DNA
aggtatataaagcacttaga

SEQ ID NO: 36599 - DNA, 20 bp, synthetic construct
  misc_feature 1..20: note = CRISPR gRNA sequence
  source 1..20: mol_type = other DNA
cttagacagtgcctaataca

SEQ ID NO: 36600 - DNA, 20 bp, synthetic construct
  misc_feature 1..20: note = CRISPR gRNA sequence
  source 1..20: mol_type = other DNA
gacagtgcctaatacacagt

SEQ ID NO: 36601 - DNA, 20 bp, synthetic construct
  misc_feature 1..20: note = CRISPR gRNA sequence
  source 1..20: mol_type = other DNA
atacacagtgagtgctttcc

SEQ ID NO: 36602 - DNA, 20 bp, synthetic construct
  misc_feature 1..20: note = CRISPR gRNA sequence
  source 1..20: mol_type = other DNA
ttccaagtgtgtactgctat

SEQ ID NO: 36603 - DNA, 20 bp, synthetic construct
  misc_feature 1..20: note = CRISPR gRNA sequence
  source 1..20: mol_type = other DNA
tccaagtgtgtactgctatg

SEQ ID NO: 36604 - DNA, 20 bp, synthetic construct
  misc_feature 1..20: note = CRISPR gRNA sequence
  source 1..20: mol_type = other DNA
aagtgtgtactgctatgagg

SEQ ID NO: 36605 - DNA, 20 bp, synthetic construct
  misc_feature 1..20: note = CRISPR gRNA sequence
  source 1..20: mol_type = other DNA
agtgtgtactgctatgagga

SEQ ID NO: 36606 - DNA, 20 bp, synthetic construct
  misc_feature 1..20: note = CRISPR gRNA sequence
  source 1..20: mol_type = other DNA
tactgctatgaggaaggaca

SEQ ID NO: 36607 - DNA, 20 bp, synthetic construct
  misc_feature 1..20: note = CRISPR gRNA sequence
  source 1..20: mol_type = other DNA
tatgaggaaggacatagtac

SEQ ID NO: 36608 - DNA, 20 bp, synthetic construct
  misc_feature 1..20: note = CRISPR gRNA sequence
  source 1..20: mol_type = other DNA
aggaaggacatagtaccaga

SEQ ID NO: 36609 - DNA, 20 bp, synthetic construct
  misc_feature 1..20: note = CRISPR gRNA sequence
  source 1..20: mol_type = other DNA
atagtaccagaaagtacatc

SEQ ID NO: 36610 - DNA, 20 bp, synthetic construct
  misc_feature 1..20: note = CRISPR gRNA sequence
  source 1..20: mol_type = other DNA
aagtacatccggaaatgtga

SEQ ID NO: 36611 - DNA, 20 bp, synthetic construct
  misc_feature 1..20: note = CRISPR gRNA sequence
  source 1..20: mol_type = other DNA
catccggaaatgtgatagca

SEQ ID NO: 36612 - DNA, 20 bp, synthetic construct
  misc_feature 1..20: note = CRISPR gRNA sequence
  source 1..20: mol_type = other DNA
aatgtgatagcatagtccac

SEQ ID NO: 36613 - DNA, 20 bp, synthetic construct
  misc_feature 1..20: note = CRISPR gRNA sequence
  source 1..20: mol_type = other DNA
tagcatagtccactagatga

SEQ ID NO: 36614 - DNA, 20 bp, synthetic construct
  misc_feature 1..20: note = CRISPR gRNA sequence
  source 1..20: mol_type = other DNA
ctagatgatggaccaccatt

SEQ ID NO: 36615 - DNA, 20 bp, synthetic construct
  misc_feature 1..20: note = CRISPR gRNA sequence
  source 1..20: mol_type = other DNA
atgatggaccaccatttagt

SEQ ID NO: 36616 - DNA, 20 bp, synthetic construct
  misc_feature 1..20: note = CRISPR gRNA sequence
  source 1..20: mol_type = other DNA
gttggccaatccccaactgt

SEQ ID NO: 36617 - DNA, 20 bp, synthetic construct
  misc_feature 1..20: note = CRISPR gRNA sequence
  source 1..20: mol_type = other DNA
atccccaactgttggacatt

SEQ ID NO: 36618 - DNA, 20 bp, synthetic construct
  misc_feature 1..20: note = CRISPR gRNA sequence
  source 1..20: mol_type = other DNA
tccccaactgttggacattt

SEQ ID NO: 36619 - DNA, 20 bp, synthetic construct
  misc_feature 1..20: note = CRISPR gRNA sequence
  source 1..20: mol_type = other DNA
aataattataaataatcttg

SEQ ID NO: 36620 - DNA, 20 bp, synthetic construct
  misc_feature 1..20: note = CRISPR gRNA sequence
  source 1..20: mol_type = other DNA
attataaataatcttgcagt

SEQ ID NO: 36621 - DNA, 20 bp, synthetic construct
  misc_feature 1..20: note = CRISPR gRNA sequence
  source 1..20: mol_type = other DNA
tacgttcatgatcgtttgcc

SEQ ID NO: 36622 - DNA, 20 bp, synthetic construct
  misc_feature 1..20: note = CRISPR gRNA sequence
  source 1..20: mol_type = other DNA
acgttcatgatcgtttgcca

SEQ ID NO: 36623 - DNA, 20 bp, synthetic construct
  misc_feature 1..20: note = CRISPR gRNA sequence
  source 1..20: mol_type = other DNA
tcatgatcgtttgccaaggt

SEQ ID NO: 36624 - DNA, 20 bp, synthetic construct
  misc_feature 1..20: note = CRISPR gRNA sequence
  source 1..20: mol_type = other DNA
atgatcgtttgccaaggtta

SEQ ID NO: 36625 - DNA, 20 bp, synthetic construct
  misc_feature 1..20: note = CRISPR gRNA sequence
  source 1..20: mol_type = other DNA
gtttgccaaggttagagtcc

SEQ ID NO: 36626 - DNA, 20 bp, synthetic construct
  misc_feature 1..20: note = CRISPR gRNA sequence
  source 1..20: mol_type = other DNA
caaggttagagtcctagaaa

SEQ ID NO: 36627 - DNA, 20 bp, synthetic construct
  misc_feature 1..20: note = CRISPR gRNA sequence
  source 1..20: mol_type = other DNA
gaaatggaattactgaatca

SEQ ID NO: 36628 - DNA, 20 bp, synthetic construct
  misc_feature 1..20: note = CRISPR gRNA sequence
  source 1..20: mol_type = other DNA
aaatggaattactgaatcaa

SEQ ID NO: 36629 - DNA, 20 bp, synthetic construct
  misc_feature 1..20: note = CRISPR gRNA sequence
  source 1..20: mol_type = other DNA
caaaggaactgcacattatt

SEQ ID NO: 36630 - DNA, 20 bp, synthetic construct
  misc_feature 1..20: note = CRISPR gRNA sequence
  source 1..20: mol_type = other DNA
aaaggaactgcacattattt

SEQ ID NO: 36631 - DNA, 20 bp, synthetic construct
  misc_feature 1..20: note = CRISPR gRNA sequence
  source 1..20: mol_type = other DNA
aaatgccccgtgccctctat

SEQ ID NO: 36632 - DNA, 20 bp, synthetic construct
  misc_feature 1..20: note = CRISPR gRNA sequence
  source 1..20: mol_type = other DNA
gtgccctctattggtacttc

SEQ ID NO: 36633 - DNA, 20 bp, synthetic construct
  misc_feature 1..20: note = CRISPR gRNA sequence
  source 1..20: mol_type = other DNA
ccctctattggtacttctag

SEQ ID NO: 36634 - DNA, 20 bp, synthetic construct
  misc_feature 1..20: note = CRISPR gRNA sequence
  source 1..20: mol_type = other DNA
cctctattggtacttctaga

SEQ ID NO: 36635 - DNA, 20 bp, synthetic construct
  misc_feature 1..20: note = CRISPR gRNA sequence
  source 1..20: mol_type = other DNA
tctattggtacttctagaag

SEQ ID NO: 36636 - DNA, 20 bp, synthetic construct
  misc_feature 1..20: note = CRISPR gRNA sequence
  source 1..20: mol_type = other DNA
ctattggtacttctagaagg

SEQ ID NO: 36637 - DNA, 20 bp, synthetic construct
  misc_feature 1..20: note = CRISPR gRNA sequence
  source 1..20: mol_type = other DNA
ttggtacttctagaaggagg

SEQ ID NO: 36638 - DNA, 20 bp, synthetic construct
  misc_feature 1..20: note = CRISPR gRNA sequence
  source 1..20: mol_type = other DNA
cttctagaaggaggtggttt

SEQ ID NO: 36639 - DNA, 20 bp, synthetic construct
  misc_feature 1..20: note = CRISPR gRNA sequence
  source 1..20: mol_type = other DNA
tctagaaggaggtggtttaa

SEQ ID NO: 36640 - DNA, 20 bp, synthetic construct
  misc_feature 1..20: note = CRISPR gRNA sequence
  source 1..20: mol_type = other DNA
aggaggtggtttaagagttc

SEQ ID NO: 36641 - DNA, 20 bp, synthetic construct
  misc_feature 1..20: note = CRISPR gRNA sequence
  source 1..20: mol_type = other DNA
gtggtttaagagttccagtt

SEQ ID NO: 36642 - DNA, 20 bp, synthetic construct
  misc_feature 1..20: note = CRISPR gRNA sequence
  source 1..20: mol_type = other DNA
ttccagttcggccatcatga

SEQ ID NO: 36643 - DNA, 20 bp, synthetic construct
  misc_feature 1..20: note = CRISPR gRNA sequence
  source 1..20: mol_type = other DNA
atggctcacacctgtaatcc

SEQ ID NO: 36644 - DNA, 20 bp, synthetic construct
  misc_feature 1..20: note = CRISPR gRNA sequence
  source 1..20: mol_type = other DNA
cacctgtaatcccagcactt

SEQ ID NO: 36645 - DNA, 20 bp, synthetic construct
  misc_feature 1..20: note = CRISPR gRNA sequence
  source 1..20: mol_type = other DNA
acctgtaatcccagcacttt

SEQ ID NO: 36646 - DNA, 20 bp, synthetic construct
  misc_feature 1..20: note = CRISPR gRNA sequence
  source 1..20: mol_type = other DNA
ctgtaatcccagcactttgg

SEQ ID NO: 36647 - DNA, 20 bp, synthetic construct
  misc_feature 1..20: note = CRISPR gRNA sequence
  source 1..20: mol_type = other DNA
tgtaatcccagcactttggg

SEQ ID NO: 36648 - DNA, 20 bp, synthetic construct
  misc_feature 1..20: note = CRISPR gRNA sequence
  source 1..20: mol_type = other DNA
tcccagcactttgggaggcc

SEQ ID NO: 36649 - DNA, 20 bp, synthetic construct
  misc_feature 1..20: note = CRISPR gRNA sequence
  source 1..20: mol_type = other DNA
cccagcactttgggaggccg

SEQ ID NO: 36650 - DNA, 20 bp, synthetic construct
  misc_feature 1..20: note = CRISPR gRNA sequence
  source 1..20: mol_type = other DNA
agcactttgggaggccgagg

SEQ ID NO: 36651 - DNA, 20 bp, synthetic construct
  misc_feature 1..20: note = CRISPR gRNA sequence
  source 1..20: mol_type = other DNA
gcactttgggaggccgaggt

SEQ ID NO: 36652 - DNA, 20 bp, synthetic construct
  misc_feature 1..20: note = CRISPR gRNA sequence
  source 1..20: mol_type = other DNA
ctttgggaggccgaggtggg

SEQ ID NO: 36653 - DNA, 20 bp, synthetic construct
  misc_feature 1..20: note = CRISPR gRNA sequence
  source 1..20: mol_type = other DNA
cgaggtgggcagatcaccct

SEQ ID NO: 36654 - DNA, 20 bp, synthetic construct
  misc_feature 1..20: note = CRISPR gRNA sequence
  source 1..20: mol_type = other DNA
gaggtgggcagatcaccctg

SEQ ID NO: 36655 - DNA, 20 bp, synthetic construct
  misc_feature 1..20: note = CRISPR gRNA sequence
  source 1..20: mol_type = other DNA
tgggcagatcaccctgaggt

SEQ ID NO: 36656 - DNA, 20 bp, synthetic construct
  misc_feature 1..20: note = CRISPR gRNA sequence
  source 1..20: mol_type = other DNA
gggcagatcaccctgaggtc

SEQ ID NO: 36657 - DNA, 20 bp, synthetic construct
  misc_feature 1..20: note = CRISPR gRNA sequence
  source 1..20: mol_type = other DNA
gcagatcaccctgaggtcag

SEQ ID NO: 36658 - DNA, 20 bp, synthetic construct
  misc_feature 1..20: note = CRISPR gRNA sequence
  source 1..20: mol_type = other DNA
caccctgaggtcaggagttt

SEQ ID NO: 36659 - DNA, 20 bp, synthetic construct
  misc_feature 1..20: note = CRISPR gRNA sequence
  source 1..20: mol_type = other DNA
tgaggtcaggagtttgagcc

SEQ ID NO: 36660 - DNA, 20 bp, synthetic construct
  misc_feature 1..20: note = CRISPR gRNA sequence
  source 1..20: mol_type = other DNA
tcaggagtttgagcccagcc

SEQ ID NO: 36661 - DNA, 20 bp, synthetic construct
  misc_feature 1..20: note = CRISPR gRNA sequence
  source 1..20: mol_type = other DNA
tgagcccagcctggccaaca

SEQ ID NO: 36662 - DNA, 20 bp, synthetic construct
  misc_feature 1..20: note = CRISPR gRNA sequence
  source 1..20: mol_type = other DNA
gtactaaaaattacaaaaat

SEQ ID NO: 36663 - DNA, 20 bp, synthetic construct
  misc_feature 1..20: note = CRISPR gRNA sequence
  source 1..20: mol_type = other DNA
taaaaattacaaaaattagc

SEQ ID NO: 36664 - DNA, 20 bp, synthetic construct
  misc_feature 1..20: note = CRISPR gRNA sequence
  source 1..20: mol_type = other DNA
aaaaattacaaaaattagct

SEQ ID NO: 36665 - DNA, 20 bp, synthetic construct
  misc_feature 1..20: note = CRISPR gRNA sequence
  source 1..20: mol_type = other DNA
caaaaattagctgggcattg

SEQ ID NO: 36666 - DNA, 20 bp, synthetic construct
  misc_feature 1..20: note = CRISPR gRNA sequence
  source 1..20: mol_type = other DNA
gtggtgtgcacctgtaatcc

SEQ ID NO: 36667 - DNA, 20 bp, synthetic construct
  misc_feature 1..20: note = CRISPR gRNA sequence
  source 1..20: mol_type = other DNA
cacctgtaatcccagctact

SEQ ID NO: 36668 - DNA, 20 bp, synthetic construct
  misc_feature 1..20: note = CRISPR gRNA sequence
  source 1..20: mol_type = other DNA
acctgtaatcccagctactc

SEQ ID NO: 36669 - DNA, 20 bp, synthetic construct
  misc_feature 1..20: note = CRISPR gRNA sequence
  source 1..20: mol_type = other DNA
ctgtaatcccagctactcgg

SEQ ID NO: 36670 - DNA, 20 bp, synthetic construct
  misc_feature 1..20: note = CRISPR gRNA sequence
  source 1..20: mol_type = other DNA
tgtaatcccagctactcggg

SEQ ID NO: 36671 - DNA, 20 bp, synthetic construct
  misc_feature 1..20: note = CRISPR gRNA sequence
  source 1..20: mol_type = other DNA
tcccagctactcgggaggct

SEQ ID NO: 36672 - DNA, 20 bp, synthetic construct
  misc_feature 1..20: note = CRISPR gRNA sequence
  source 1..20: mol_type = other DNA
cccagctactcgggaggctg

SEQ ID NO: 36673 - DNA, 20 bp, synthetic construct
  misc_feature 1..20: note = CRISPR gRNA sequence
  source 1..20: mol_type = other DNA
agctactcgggaggctgagg

SEQ ID NO: 36674 - DNA, 20 bp, synthetic construct
  misc_feature 1..20: note = CRISPR gRNA sequence
  source 1..20: mol_type = other DNA
tactcgggaggctgaggcag

SEQ ID NO: 36675 - DNA, 20 bp, synthetic construct
  misc_feature 1..20: note = CRISPR gRNA sequence
  source 1..20: mol_type = other DNA
gcagaagaatcgcttgaacc

SEQ ID NO: 36676 - DNA, 20 bp, synthetic construct
  misc_feature 1..20: note = CRISPR gRNA sequence
  source 1..20: mol_type = other DNA
cagaagaatcgcttgaaccc

SEQ ID NO: 36677 - DNA, 20 bp, synthetic construct
  misc_feature 1..20: note = CRISPR gRNA sequence
  source 1..20: mol_type = other DNA
gaagaatcgcttgaacccgg

SEQ ID NO: 36678 - DNA, 20 bp, synthetic construct
  misc_feature 1..20: note = CRISPR gRNA sequence
  source 1..20: mol_type = other DNA
aagaatcgcttgaacccggg

SEQ ID NO: 36679 - DNA, 20 bp, synthetic construct
  misc_feature 1..20: note = CRISPR gRNA sequence
  source 1..20: mol_type = other DNA
aatcgcttgaacccgggagg

SEQ ID NO: 36680 - DNA, 20 bp, synthetic construct
  misc_feature 1..20: note = CRISPR gRNA sequence
  source 1..20: mol_type = other DNA
tcgcttgaacccgggaggcg

SEQ ID NO: 36681 - DNA, 20 bp, synthetic construct
  misc_feature 1..20: note = CRISPR gRNA sequence
  source 1..20: mol_type = other DNA
cgcttgaacccgggaggcgg

SEQ ID NO: 36682 - DNA, 20 bp, synthetic construct
  misc_feature 1..20: note = CRISPR gRNA sequence
  source 1..20: mol_type = other DNA
aacccgggaggcggaggctg

SEQ ID NO: 36683 - DNA, 20 bp, synthetic construct
  misc_feature 1..20: note = CRISPR gRNA sequence
  source 1..20: mol_type = other DNA
cgggaggcggaggctgcagt

SEQ ID NO: 36684 - DNA, 20 bp, synthetic construct
  misc_feature 1..20: note = CRISPR gRNA sequence
  source 1..20: mol_type = other DNA
ggcggaggctgcagtgagcc

SEQ ID NO: 36685 - DNA, 20 bp, synthetic construct
  misc_feature 1..20: note = CRISPR gRNA sequence
  source 1..20: mol_type = other DNA
gagattgcaccattgcactc

SEQ ID NO: 36686 - DNA, 20 bp, synthetic construct
  misc_feature 1..20: note = CRISPR gRNA sequence
  source 1..20: mol_type = other DNA
tgcaccattgcactccagcc

SEQ ID NO: 36687 - DNA, 20 bp, synthetic construct
  misc_feature 1..20: note = CRISPR gRNA sequence
  source 1..20: mol_type = other DNA
gcaccattgcactccagcct

SEQ ID NO: 36688 - DNA, 20 bp, synthetic construct
  misc_feature 1..20: note = CRISPR gRNA sequence
  source 1..20: mol_type = other DNA
ttgcactccagcctgggtga

SEQ ID NO: 36689 - DNA, 20 bp, synthetic construct
  misc_feature 1..20: note = CRISPR gRNA sequence
  source 1..20: mol_type = other DNA
gcactccagcctgggtgaca

SEQ ID NO: 36690 - DNA, 20 bp, synthetic construct
  misc_feature 1..20: note = CRISPR gRNA sequence
  source 1..20: mol_type = other DNA
tccagcctgggtgacagagc

SEQ ID NO: 36691 - DNA, 20 bp, synthetic construct
  misc_feature 1..20: note = CRISPR gRNA sequence
  source 1..20: mol_type = other DNA
agactctgtctcaaaaaaaa

SEQ ID NO: 36692 - DNA, 20 bp, synthetic construct
  misc_feature 1..20: note = CRISPR gRNA sequence
  source 1..20: mol_type = other DNA
actctgtctcaaaaaaaaaa

SEQ ID NO: 36693 - DNA, 20 bp, synthetic construct
  misc_feature 1..20: note = CRISPR gRNA sequence
  source 1..20: mol_type = other DNA
tctcaaaaaaaaaagagttc

SEQ ID NO: 36694 - DNA, 20 bp, synthetic construct
  misc_feature 1..20: note = CRISPR gRNA sequence
  source 1..20: mol_type = other DNA
aaaaaaaaagagttccagtt

SEQ ID NO: 36695 - DNA, 20 bp, synthetic construct
  misc_feature 1..20: note = CRISPR gRNA sequence
  source 1..20: mol_type = other DNA
aaaaaagagttccagttcag

SEQ ID NO: 36696 - DNA, 20 bp, synthetic construct
  misc_feature 1..20: note = CRISPR gRNA sequence
  source 1..20: mol_type = other DNA
aaaaagagttccagttcaga

SEQ ID NO: 36697 - DNA, 20 bp, synthetic construct
  misc_feature 1..20: note = CRISPR gRNA sequence
  source 1..20: mol_type = other DNA
aaaagagttccagttcagaa

SEQ ID NO: 36698 - DNA, 20 bp, synthetic construct
  misc_feature 1..20: note = CRISPR gRNA sequence
  source 1..20: mol_type = other DNA
agagttccagttcagaaggg

SEQ ID NO: 36699 - DNA, 20 bp, synthetic construct
  misc_feature 1..20: note = CRISPR gRNA sequence
  source 1..20: mol_type = other DNA
tcagaagggaagaatttgct

SEQ ID NO: 36700 - DNA, 20 bp, synthetic construct
  misc_feature 1..20: note = CRISPR gRNA sequence
  source 1..20: mol_type = other DNA
gggaagaatttgcttagcaa

SEQ ID NO: 36701 - DNA, 20 bp, synthetic construct
  misc_feature 1..20: note = CRISPR gRNA sequence
  source 1..20: mol_type = other DNA
gaagaatttgcttagcaaaa

SEQ ID NO: 36702 - DNA, 20 bp, synthetic construct
  misc_feature 1..20: note = CRISPR gRNA sequence
  source 1..20: mol_type = other DNA
aagaatttgcttagcaaaag

SEQ ID NO: 36703 - DNA, 20 bp, synthetic construct
  misc_feature 1..20: note = CRISPR gRNA sequence
  source 1..20: mol_type = other DNA
ttgcttagcaaaagaggtga

SEQ ID NO: 36704 - DNA, 20 bp, synthetic construct
  misc_feature 1..20: note = CRISPR gRNA sequence
  source 1..20: mol_type = other DNA
aaagaggtgatggtctgtgt

SEQ ID NO: 36705 - DNA, 20 bp, synthetic construct
  misc_feature 1..20: note = CRISPR gRNA sequence
  source 1..20: mol_type = other DNA
aggtgatggtctgtgttagc

SEQ ID NO: 36706 - DNA, 20 bp, synthetic construct
  misc_feature 1..20: note = CRISPR gRNA sequence
  source 1..20: mol_type = other DNA
ggtgatggtctgtgttagct

SEQ ID NO: 36707 - DNA, 20 bp, synthetic construct
  misc_feature 1..20: note = CRISPR gRNA sequence
  source 1..20: mol_type = other DNA
tggtctgtgttagctaggat

SEQ ID NO: 36708 - DNA, 20 bp, synthetic construct
  misc_feature 1..20: note = CRISPR gRNA sequence
  source 1..20: mol_type = other DNA
gtctgtgttagctaggatta

SEQ ID NO: 36709 - DNA, 20 bp, synthetic construct
  misc_feature 1..20: note = CRISPR gRNA sequence
  source 1..20: mol_type = other DNA
ctaggattagagttcactgt

SEQ ID NO: 36710 - DNA, 20 bp, synthetic construct
  misc_feature 1..20: note = CRISPR gRNA sequence
  source 1..20: mol_type = other DNA
ggattagagttcactgtgag

SEQ ID NO: 36711 - DNA, 20 bp, synthetic construct
  misc_feature 1..20: note = CRISPR gRNA sequence
  source 1..20: mol_type = other DNA
ttagagttcactgtgagtag

SEQ ID NO: 36712 - DNA, 20 bp, synthetic construct
  misc_feature 1..20: note = CRISPR gRNA sequence
  source 1..20: mol_type = other DNA
agttcactgtgagtagcaga

SEQ ID NO: 36713 - DNA, 20 bp, synthetic construct
  misc_feature 1..20: note = CRISPR gRNA sequence
  source 1..20: mol_type = other DNA
tagcagaaagcactaaacaa

SEQ ID NO: 36714 - DNA, 20 bp, synthetic construct
  misc_feature 1..20: note = CRISPR gRNA sequence
  source 1..20: mol_type = other DNA
cagaaagcactaaacaacag

SEQ ID NO: 36715 - DNA, 20 bp, synthetic construct
  misc_feature 1..20: note = CRISPR gRNA sequence
  source 1..20: mol_type = other DNA
ctaaacaacagtggcttaac

SEQ ID NO: 36716 - DNA, 20 bp, synthetic construct
  misc_feature 1..20: note = CRISPR gRNA sequence
  source 1..20: mol_type = other DNA
caacagtggcttaaccagaa

SEQ ID NO: 36717 - DNA, 20 bp, synthetic construct
  misc_feature 1..20: note = CRISPR gRNA sequence
  source 1..20: mol_type = other DNA
cagtggcttaaccagaatgg

SEQ ID NO: 36718 - DNA, 20 bp, synthetic construct
  misc_feature 1..20: note = CRISPR gRNA sequence
  source 1..20: mol_type = other DNA
tgtatttccctgccatgtaa

SEQ ID NO: 36719 - DNA, 20 bp, synthetic construct
  misc_feature 1..20: note = CRISPR gRNA sequence
  source 1..20: mol_type = other DNA
atttccctgccatgtaacag

SEQ ID NO: 36720 - DNA, 20 bp, synthetic construct
  misc_feature 1..20: note = CRISPR gRNA sequence
  source 1..20: mol_type = other DNA
tgccatgtaacagaagtcca

SEQ ID NO: 36721 - DNA, 20 bp, synthetic construct
  misc_feature 1..20: note = CRISPR gRNA sequence
  source 1..20: mol_type = other DNA
atgtaacagaagtccaaagt

SEQ ID NO: 36722 - DNA, 20 bp, synthetic construct
  misc_feature 1..20: note = CRISPR gRNA sequence
  source 1..20: mol_type = other DNA
aacagaagtccaaagtcagt

SEQ ID NO: 36723 - DNA, 20 bp, synthetic construct
  misc_feature 1..20: note = CRISPR gRNA sequence
  source 1..20: mol_type = other DNA
aagtccaaagtcagtgagca

SEQ ID NO: 36724 - DNA, 20 bp, synthetic construct
  misc_feature 1..20: note = CRISPR gRNA sequence
  source 1..20: mol_type = other DNA
agtccaaagtcagtgagcac

SEQ ID NO: 36725 - DNA, 20 bp, synthetic construct
  misc_feature 1..20: note = CRISPR gRNA sequence
  source 1..20: mol_type = other DNA
gtccaaagtcagtgagcaca

SEQ ID NO: 36726 - DNA, 20 bp, synthetic construct
  misc_feature 1..20: note = CRISPR gRNA sequence
  source 1..20: mol_type = other DNA
caaagtcagtgagcacaggg

SEQ ID NO: 36727 - DNA, 20 bp, synthetic construct
  misc_feature 1..20: note = CRISPR gRNA sequence
  source 1..20: mol_type = other DNA
gtcagtgagcacagggcaga

SEQ ID NO: 36728 - DNA, 20 bp, synthetic construct
  misc_feature 1..20: note = CRISPR gRNA sequence
  source 1..20: mol_type = other DNA
tcagtgagcacagggcagat

SEQ ID NO: 36729 - DNA, 20 bp, synthetic construct
  misc_feature 1..20: note = CRISPR gRNA sequence
  source 1..20: mol_type = other DNA
gtgagcacagggcagatggg

SEQ ID NO: 36730 - DNA, 20 bp, synthetic construct
  misc_feature 1..20: note = CRISPR gRNA sequence
  source 1..20: mol_type = other DNA
gctttaccttccaccttcct

SEQ ID NO: 36731 - DNA, 20 bp, synthetic construct
  misc_feature 1..20: note = CRISPR gRNA sequence
  source 1..20: mol_type = other DNA
accttccaccttcctcagta

SEQ ID NO: 36732 - DNA, 20 bp, synthetic construct
  misc_feature 1..20: note = CRISPR gRNA sequence
  source 1..20: mol_type = other DNA
ccttccaccttcctcagtat

SEQ ID NO: 36733 - DNA, 20 bp, synthetic construct
  misc_feature 1..20: note = CRISPR gRNA sequence
  source 1..20: mol_type = other DNA
ttccacctcatgattcaata

SEQ ID NO: 36734 - DNA, 20 bp, synthetic construct
  misc_feature 1..20: note = CRISPR gRNA sequence
  source 1..20: mol_type = other DNA
atgattcaatatggctgccc

SEQ ID NO: 36735 - DNA, 20 bp, synthetic construct
  misc_feature 1..20: note = CRISPR gRNA sequence
  source 1..20: mol_type = other DNA
caatatggctgcccaagatc

SEQ ID NO: 36736 - DNA, 20 bp, synthetic construct
  misc_feature 1..20: note = CRISPR gRNA sequence
  source 1..20: mol_type = other DNA
cagccatcccatcaacaatc

SEQ ID NO: 36737 - DNA, 20 bp, synthetic construct
  misc_feature 1..20: note = CRISPR gRNA sequence
  source 1..20: mol_type = other DNA
cccatcaacaatccagacaa

SEQ ID NO: 36738 - DNA, 20 bp, synthetic construct
  misc_feature 1..20: note = CRISPR gRNA sequence
  source 1..20: mol_type = other DNA
ccatcaacaatccagacaac

SEQ ID NO: 36739 - DNA, 20 bp, synthetic construct
  misc_feature 1..20: note = CRISPR gRNA sequence
  source 1..20: mol_type = other DNA
tcaacaatccagacaacagg

SEQ ID NO: 36740 - DNA, 20 bp, synthetic construct
  misc_feature 1..20: note = CRISPR gRNA sequence
  source 1..20: mol_type = other DNA
caacaatccagacaacagga

SEQ ID NO: 36741 - DNA, 20 bp, synthetic construct
  misc_feature 1..20: note = CRISPR gRNA sequence
  source 1..20: mol_type = other DNA
acaatccagacaacaggaag

SEQ ID NO: 36742 - DNA, 20 bp, synthetic construct
  misc_feature 1..20: note = CRISPR gRNA sequence
  source 1..20: mol_type = other DNA
ccagacaacaggaaggagca

SEQ ID NO: 36743 - DNA, 20 bp, synthetic construct
  misc_feature 1..20: note = CRISPR gRNA sequence
  source 1..20: mol_type = other DNA
gacaacaggaaggagcaaag

SEQ ID NO: 36744 - DNA, 20 bp, synthetic construct
  misc_feature 1..20: note = CRISPR gRNA sequence
  source 1..20: mol_type = other DNA
caggaaggagcaaagaagaa

SEQ ID NO: 36745 - DNA, 20 bp, synthetic construct
  misc_feature 1..20: note = CRISPR gRNA sequence
  source 1..20: mol_type = other DNA
catttctacttacattccac

SEQ ID NO: 36746 - DNA, 20 bp, synthetic construct
  misc_feature 1..20: note = CRISPR gRNA sequence
  source 1..20: mol_type = other DNA
attccactggccaaattaca

SEQ ID NO: 36747 - DNA, 20 bp, synthetic construct
  misc_feature 1..20: note = CRISPR gRNA sequence
  source 1..20: mol_type = other DNA
acatggctacatataactgc

SEQ ID NO: 36748 - DNA, 20 bp, synthetic construct
  misc_feature 1..20: note = CRISPR gRNA sequence
  source 1..20: mol_type = other DNA
catggctacatataactgca

SEQ ID NO: 36749 - DNA, 20 bp, synthetic construct
  misc_feature 1..20: note = CRISPR gRNA sequence
  source 1..20: mol_type = other DNA
atggctacatataactgcaa

SEQ ID NO: 36750 - DNA, 20 bp, synthetic construct
  misc_feature 1..20: note = CRISPR gRNA sequence
  source 1..20: mol_type = other DNA
ggctacatataactgcaagg

SEQ ID NO: 36751 - DNA, 20 bp, synthetic construct
  misc_feature 1..20: note = CRISPR gRNA sequence
  source 1..20: mol_type = other DNA
catataactgcaagggagac

SEQ ID NO: 36752 - DNA, 20 bp, synthetic construct
  misc_feature 1..20: note = CRISPR gRNA sequence
  source 1..20: mol_type = other DNA
atataactgcaagggagact

SEQ ID NO: 36753 - DNA, 20 bp, synthetic construct
  misc_feature 1..20: note = CRISPR gRNA sequence
  source 1..20: mol_type = other DNA
tgggatataataatctattc

SEQ ID NO: 36754 - DNA, 20 bp, synthetic construct
  misc_feature 1..20: note = CRISPR gRNA sequence
  source 1..20: mol_type = other DNA
aataatctattctagatgac

SEQ ID NO: 36755 - DNA, 20 bp, synthetic construct
  misc_feature 1..20: note = CRISPR gRNA sequence
  source 1..20: mol_type = other DNA
taatctattctagatgacca

SEQ ID NO: 36756 - DNA, 20 bp, synthetic construct
  misc_feature 1..20: note = CRISPR gRNA sequence
  source 1..20: mol_type = other DNA
ctagatgaccagagaatatt

SEQ ID NO: 36757 - DNA, 20 bp, synthetic construct
  misc_feature 1..20: note = CRISPR gRNA sequence
  source 1..20: mol_type = other DNA
gatgaccagagaatatttag

SEQ ID NO: 36758 - DNA, 20 bp, synthetic construct
  misc_feature 1..20: note = CRISPR gRNA sequence
  source 1..20: mol_type = other DNA
tatttagtagttctaatact

SEQ ID NO: 36759 - DNA, 20 bp, synthetic construct
  misc_feature 1..20: note = CRISPR gRNA sequence
  source 1..20: mol_type = other DNA
atttagtagttctaatactg

SEQ ID NO: 36760 - DNA, 20 bp, synthetic construct
  misc_feature 1..20: note = CRISPR gRNA sequence
  source 1..20: mol_type = other DNA
tagtagttctaatactgagg

SEQ ID NO: 36761 - DNA, 20 bp, synthetic construct
  misc_feature 1..20: note = CRISPR gRNA sequence
  source 1..20: mol_type = other DNA
tagttctaatactgaggaag

SEQ ID NO: 36762 - DNA, 20 bp, synthetic construct
  misc_feature 1..20: note = CRISPR gRNA sequence
  source 1..20: mol_type = other DNA
agttctaatactgaggaaga

SEQ ID NO: 36763 - DNA, 20 bp, synthetic construct
  misc_feature 1..20: note = CRISPR gRNA sequence
  source 1..20: mol_type = other DNA
gttctaatactgaggaagaa

SEQ ID NO: 36764 - DNA, 20 bp, synthetic construct
  misc_feature 1..20: note = CRISPR gRNA sequence
  source 1..20: mol_type = other DNA
ctaatactgaggaagaaggg

SEQ ID NO: 36765 - DNA, 20 bp, synthetic construct
  misc_feature 1..20: note = CRISPR gRNA sequence
  source 1..20: mol_type = other DNA
actgaggaagaagggaagaa

SEQ ID NO: 36766 - DNA, 20 bp, synthetic construct
  misc_feature 1..20: note = CRISPR gRNA sequence
  source 1..20: mol_type = other DNA
aagaagggaagaacagattt

SEQ ID NO: 36767 - DNA, 20 bp, synthetic construct
  misc_feature 1..20: note = CRISPR gRNA sequence
  source 1..20: mol_type = other DNA
agaagggaagaacagatttt

SEQ ID NO: 36768 - DNA, 20 bp, synthetic construct
  misc_feature 1..20: note = CRISPR gRNA sequence
  source 1..20: mol_type = other DNA
aagggaagaacagattttgg

SEQ ID NO: 36769 - DNA, 20 bp, synthetic construct
  misc_feature 1..20: note = CRISPR gRNA sequence
  source 1..20: mol_type = other DNA
aacagattttgggagacaac

SEQ ID NO: 36770 - DNA, 20 bp, synthetic construct
  misc_feature 1..20: note = CRISPR gRNA sequence
  source 1..20: mol_type = other DNA
caactagttgtctctgccat

SEQ ID NO: 36771 - DNA, 20 bp, synthetic construct
  misc_feature 1..20: note = CRISPR gRNA sequence
  source 1..20: mol_type = other DNA
aactagttgtctctgccatg

SEQ ID NO: 36772 - DNA, 20 bp, synthetic construct
  misc_feature 1..20: note = CRISPR gRNA sequence
  source 1..20: mol_type = other DNA
agttgtctctgccatgaggt

SEQ ID NO: 36773 - DNA, 20 bp, synthetic construct
  misc_feature 1..20: note = CRISPR gRNA sequence
  source 1..20: mol_type = other DNA
tctctgccatgaggttagct

SEQ ID NO: 36774 - DNA, 20 bp, synthetic construct
  misc_feature 1..20: note = CRISPR gRNA sequence
  source 1..20: mol_type = other DNA
ccatgaggttagctcagact

SEQ ID NO: 36775 - DNA, 20 bp, synthetic construct
  misc_feature 1..20: note = CRISPR gRNA sequence
  source 1..20: mol_type = other DNA
atgaggttagctcagactga

SEQ ID NO: 36776 - DNA, 20 bp, synthetic construct
  misc_feature 1..20: note = CRISPR gRNA sequence
  source 1..20: mol_type = other DNA
aggttagctcagactgagag

SEQ ID NO: 36777 - DNA, 20 bp, synthetic construct
  misc_feature 1..20: note = CRISPR gRNA sequence
  source 1..20: mol_type = other DNA
cagactgagagcagcataaa

SEQ ID NO: 36778 - DNA, 20 bp, synthetic construct
  misc_feature 1..20: note = CRISPR gRNA sequence
  source 1..20: mol_type = other DNA
agagcagcataaatggttca

SEQ ID NO: 36779 - DNA, 20 bp, synthetic construct
  misc_feature 1..20: note = CRISPR gRNA sequence
  source 1..20: mol_type = other DNA
cataaatggttcatggaaat

SEQ ID NO: 36780 - DNA, 20 bp, synthetic construct
  misc_feature 1..20: note = CRISPR gRNA sequence
  source 1..20: mol_type = other DNA
tggttcatggaaataagaat

SEQ ID NO: 36781 - DNA, 20 bp, synthetic construct
  misc_feature 1..20: note = CRISPR gRNA sequence
  source 1..20: mol_type = other DNA
gaatgagtaatgcatcctca

SEQ ID NO: 36782 - DNA, 20 bp, synthetic construct
  misc_feature 1..20: note = CRISPR gRNA sequence
  source 1..20: mol_type = other DNA
aatgagtaatgcatcctcac

SEQ ID NO: 36783 - DNA, 20 bp, synthetic construct
  misc_feature 1..20: note = CRISPR gRNA sequence
  source 1..20: mol_type = other DNA
catcctcacgggactgtcca

SEQ ID NO: 36784 - DNA, 20 bp, synthetic construct
  misc_feature 1..20: note = CRISPR gRNA sequence
  source 1..20: mol_type = other DNA
atcctcacgggactgtccac

SEQ ID NO: 36785 - DNA, 20 bp, synthetic construct
  misc_feature 1..20: note = CRISPR gRNA sequence
  source 1..20: mol_type = other DNA
tcctcacgggactgtccaca

SEQ ID NO: 36786 - DNA, 20 bp, synthetic construct
  misc_feature 1..20: note = CRISPR gRNA sequence
  source 1..20: mol_type = other DNA
cctcacgggactgtccacag

SEQ ID NO: 36787 - DNA, 20 bp, synthetic construct
  misc_feature 1..20: note = CRISPR gRNA sequence
  source 1..20: mol_type = other DNA
actgtccacaggggatgaac

SEQ ID NO: 36788 - DNA, 20 bp, synthetic construct
  misc_feature 1..20: note = CRISPR gRNA sequence
  source 1..20: mol_type = other DNA
ggggatgaacaagaccattc

SEQ ID NO: 36789 - DNA, 20 bp, synthetic construct
  misc_feature 1..20: note = CRISPR gRNA sequence
  source 1..20: mol_type = other DNA
ggatgaacaagaccattcca

SEQ ID NO: 36790 - DNA, 20 bp, synthetic construct
  misc_feature 1..20: note = CRISPR gRNA sequence
  source 1..20: mol_type = other DNA
atgaacaagaccattccaga

SEQ ID NO: 36791 - DNA, 20 bp, synthetic construct
  misc_feature 1..20: note = CRISPR gRNA sequence
  source 1..20: mol_type = other DNA
acaagaccattccagagagc

SEQ ID NO: 36792 - DNA, 20 bp, synthetic construct
  misc_feature 1..20: note = CRISPR gRNA sequence
  source 1..20: mol_type = other DNA
caagaccattccagagagcc

SEQ ID NO: 36793 - DNA, 20 bp, synthetic construct
  misc_feature 1..20: note = CRISPR gRNA sequence
  source 1..20: mol_type = other DNA
aagaccattccagagagcca

SEQ ID NO: 36794 - DNA, 20 bp, synthetic construct
  misc_feature 1..20: note = CRISPR gRNA sequence
  source 1..20: mol_type = other DNA
cattccagagagccagggtg

SEQ ID NO: 36795 - DNA, 20 bp, synthetic construct
  misc_feature 1..20: note = CRISPR gRNA sequence
  source 1..20: mol_type = other DNA
attccagagagccagggtgc

SEQ ID NO: 36796 - DNA, 20 bp, synthetic construct
  misc_feature 1..20: note = CRISPR gRNA sequence
  source 1..20: mol_type = other DNA
agccagggtgcaggcacaaa

SEQ ID NO: 36797 - DNA, 20 bp, synthetic construct
  misc_feature 1..20: note = CRISPR gRNA sequence
  source 1..20: mol_type = other DNA
ccagggtgcaggcacaaatg

SEQ ID NO: 36798 - DNA, 20 bp, synthetic construct
  misc_feature 1..20: note = CRISPR gRNA sequence
  source 1..20: mol_type = other DNA
gggtgcaggcacaaatggag

SEQ ID NO: 36799 - DNA, 20 bp, synthetic construct
  misc_feature 1..20: note = CRISPR gRNA sequence
  source 1..20: mol_type = other DNA
ggtgcaggcacaaatggagt

SEQ ID NO: 36800 - DNA, 20 bp, synthetic construct
  misc_feature 1..20: note = CRISPR gRNA sequence
  source 1..20: mol_type = other DNA
gtgcaggcacaaatggagta

SEQ ID NO: 36801 - DNA, 20 bp, synthetic construct
  misc_feature 1..20: note = CRISPR gRNA sequence
  source 1..20: mol_type = other DNA
gcaggcacaaatggagtagg

SEQ ID NO: 36802 - DNA, 20 bp, synthetic construct
  misc_feature 1..20: note = CRISPR gRNA sequence
  source 1..20: mol_type = other DNA
caggcacaaatggagtaggg

SEQ ID NO: 36803 - DNA, 20 bp, synthetic construct
  misc_feature 1..20: note = CRISPR gRNA sequence
  source 1..20: mol_type = other DNA
aggcacaaatggagtaggga

SEQ ID NO: 36804 - DNA, 20 bp, synthetic construct
  misc_feature 1..20: note = CRISPR gRNA sequence
  source 1..20: mol_type = other DNA
ggcacaaatggagtagggag

SEQ ID NO: 36805 - DNA, 20 bp, synthetic construct
  misc_feature 1..20: note = CRISPR gRNA sequence
  source 1..20: mol_type = other DNA
gcacaaatggagtagggagg

SEQ ID NO: 36806 - DNA, 20 bp, synthetic construct
  misc_feature 1..20: note = CRISPR gRNA sequence
  source 1..20: mol_type = other DNA
aatggagtagggagggggtg

SEQ ID NO: 36807 - DNA, 20 bp, synthetic construct
  misc_feature 1..20: note = CRISPR gRNA sequence
  source 1..20: mol_type = other DNA
ggagtagggagggggtgcag

SEQ ID NO: 36808 - DNA, 20 bp, synthetic construct
  misc_feature 1..20: note = CRISPR gRNA sequence
  source 1..20: mol_type = other DNA
gggagggggtgcagaagaaa

SEQ ID NO: 36809 - DNA, 20 bp, synthetic construct
  misc_feature 1..20: note = CRISPR gRNA sequence
  source 1..20: mol_type = other DNA
agaagaaacagactgatctc

SEQ ID NO: 36810 - DNA, 20 bp, synthetic construct
  misc_feature 1..20: note = CRISPR gRNA sequence
  source 1..20: mol_type = other DNA
aagaaacagactgatctctg

SEQ ID NO: 36811 - DNA, 20 bp, synthetic construct
  misc_feature 1..20: note = CRISPR gRNA sequence
  source 1..20: mol_type = other DNA
tgatctctggagctgatccc

SEQ ID NO: 36812 - DNA, 20 bp, synthetic construct
  misc_feature 1..20: note = CRISPR gRNA sequence
  source 1..20: mol_type = other DNA
gatctctggagctgatccct

SEQ ID NO: 36813 - DNA, 20 bp, synthetic construct
  misc_feature 1..20: note = CRISPR gRNA sequence
  source 1..20: mol_type = other DNA
ctctggagctgatccctggg

SEQ ID NO: 36814 - DNA, 20 bp, synthetic construct
  misc_feature 1..20: note = CRISPR gRNA sequence
  source 1..20: mol_type = other DNA
ctggagctgatccctgggca

SEQ ID NO: 36815 - DNA, 20 bp, synthetic construct
  misc_feature 1..20: note = CRISPR gRNA sequence
  source 1..20: mol_type = other DNA
gatccctgggcagagacatc

SEQ ID NO: 36816 - DNA, 20 bp, synthetic construct
  misc_feature 1..20: note = CRISPR gRNA sequence
  source 1..20: mol_type = other DNA
gcagagacatcaagactcca

SEQ ID NO: 36817 - DNA, 20 bp, synthetic construct
  misc_feature 1..20: note = CRISPR gRNA sequence
  source 1..20: mol_type = other DNA
agagacatcaagactccatg

SEQ ID NO: 36818 - DNA, 20 bp, synthetic construct
  misc_feature 1..20: note = CRISPR gRNA sequence
  source 1..20: mol_type = other DNA
agacatcaagactccatgga

SEQ ID NO: 36819 - DNA, 20 bp, synthetic construct
  misc_feature 1..20: note = CRISPR gRNA sequence
  source 1..20: mol_type = other DNA
gacatcaagactccatggag

SEQ ID NO: 36820 - DNA, 20 bp, synthetic construct
  misc_feature 1..20: note = CRISPR gRNA sequence
  source 1..20: mol_type = other DNA
tattttatgtcgctcaaatg

SEQ ID NO: 36821 - DNA, 20 bp, synthetic construct
  misc_feature 1..20: note = CRISPR gRNA sequence
  source 1..20: mol_type = other DNA
attttatgtcgctcaaatgt

SEQ ID NO: 36822 - DNA, 20 bp, synthetic construct
  misc_feature 1..20: note = CRISPR gRNA sequence
  source 1..20: mol_type = other DNA
ttttatgtcgctcaaatgta

SEQ ID NO: 36823 - DNA, 20 bp, synthetic construct
  misc_feature 1..20: note = CRISPR gRNA sequence
  source 1..20: mol_type = other DNA
tgtcgctcaaatgtagggac

SEQ ID NO: 36824 - DNA, 20 bp, synthetic construct
  misc_feature 1..20: note = CRISPR gRNA sequence
  source 1..20: mol_type = other DNA
tcttgactgcttgacttccc

SEQ ID NO: 36825 - DNA, 20 bp, synthetic construct
  misc_feature 1..20: note = CRISPR gRNA sequence
  source 1..20: mol_type = other DNA
atcccccaactcaccttccc

SEQ ID NO: 36826 - DNA, 20 bp, synthetic construct
  misc_feature 1..20: note = CRISPR gRNA sequence
  source 1..20: mol_type = other DNA
tccccagatcaccttccccc

SEQ ID NO: 36827 - DNA, 20 bp, synthetic construct
  misc_feature 1..20: note = CRISPR gRNA sequence
  source 1..20: mol_type = other DNA
gtaccccactcacctgccct

SEQ ID NO: 36828 - DNA, 20 bp, synthetic construct
  misc_feature 1..20: note = CRISPR gRNA sequence
  source 1..20: mol_type = other DNA
taccccactcacctgccctc

SEQ ID NO: 36829 - DNA, 20 bp, synthetic construct
  misc_feature 1..20: note = CRISPR gRNA sequence
  source 1..20: mol_type = other DNA
tctccatctaatcttcctcc

SEQ ID NO: 36830 - DNA, 20 bp, synthetic construct
  misc_feature 1..20: note = CRISPR gRNA sequence
  source 1..20: mol_type = other DNA
cccccaatttgcttgtcctc

SEQ ID NO: 36831 - DNA, 20 bp, synthetic construct
  misc_feature 1..20: note = CRISPR gRNA sequence
  source 1..20: mol_type = other DNA
ttgcttgtcctccagctcac

SEQ ID NO: 36832 - DNA, 20 bp, synthetic construct
  misc_feature 1..20: note = CRISPR gRNA sequence
  source 1..20: mol_type = other DNA
cctccagctcaccggttccc

SEQ ID NO: 36833 - DNA, 20 bp, synthetic construct
  misc_feature 1..20: note = CRISPR gRNA sequence
  source 1..20: mol_type = other DNA
tccccagctcatcttccttc

SEQ ID NO: 36834 - DNA, 20 bp, synthetic construct
  misc_feature 1..20: note = CRISPR gRNA sequence
  source 1..20: mol_type = other DNA
cttccagttcccctgtcccc

SEQ ID NO: 36835 - DNA, 20 bp, synthetic construct
  misc_feature 1..20: note = CRISPR gRNA sequence
  source 1..20: mol_type = other DNA
ccagctcacctgcctgccct

SEQ ID NO: 36836 - DNA, 20 bp, synthetic construct
  misc_feature 1..20: note = CRISPR gRNA sequence
  source 1..20: mol_type = other DNA
ccctcagttcacctgtcccc

SEQ ID NO: 36837 - DNA, 20 bp, synthetic construct
  misc_feature 1..20: note = CRISPR gRNA sequence
  source 1..20: mol_type = other DNA
cccccagttcatcttcctcc

SEQ ID NO: 36838 - DNA, 20 bp, synthetic construct
  misc_feature 1..20: note = CRISPR gRNA sequence
  source 1..20: mol_type = other DNA
ctcctagctcccctgtcccc

SEQ ID NO: 36839 - DNA, 20 bp, synthetic construct
  misc_feature 1..20: note = CRISPR gRNA sequence
  source 1..20: mol_type = other DNA
cccctagctcacctgtgccc

SEQ ID NO: 36840 - DNA, 20 bp, synthetic construct
  misc_feature 1..20: note = CRISPR gRNA sequence
  source 1..20: mol_type = other DNA
gccccagctcccctgtcccc

SEQ ID NO: 36841 - DNA, 20 bp, synthetic construct
  misc_feature 1..20: note = CRISPR gRNA sequence
  source 1..20: mol_type = other DNA
cccccagttcccctgtcccc

SEQ ID NO: 36842 - DNA, 20 bp, synthetic construct
  misc_feature 1..20: note = CRISPR gRNA sequence
  source 1..20: mol_type = other DNA
cccccagctcacctccccct

SEQ ID NO: 36843 - DNA, 20 bp, synthetic construct
  misc_feature 1..20: note = CRISPR gRNA sequence
  source 1..20: mol_type = other DNA
ccctcagctctcctgtcccc

SEQ ID NO: 36844 - DNA, 20 bp, synthetic construct
  misc_feature 1..20: note = CRISPR gRNA sequence
  source 1..20: mol_type = other DNA
tcccccagctcatctgcccc

SEQ ID NO: 36845 - DNA, 20 bp, synthetic construct
  misc_feature 1..20: note = CRISPR gRNA sequence
  source 1..20: mol_type = other DNA
cccccagtttacctgtcccc

SEQ ID NO: 36846 - DNA, 20 bp, synthetic construct
  misc_feature 1..20: note = CRISPR gRNA sequence
  source 1..20: mol_type = other DNA
cccctagctcacctcccccc

SEQ ID NO: 36847 - DNA, 20 bp, synthetic construct
  misc_feature 1..20: note = CRISPR gRNA sequence
  source 1..20: mol_type = other DNA
cccccagtttacctgtcccc

SEQ ID NO: 36848 - DNA, 20 bp, synthetic construct
  misc_feature 1..20: note = CRISPR gRNA sequence
  source 1..20: mol_type = other DNA
tcccccagctcacctccccc

SEQ ID NO: 36849 - DNA, 20 bp, synthetic construct
  misc_feature 1..20: note = CRISPR gRNA sequence
  source 1..20: mol_type = other DNA
cccccagtttgcctgtcccc

SEQ ID NO: 36850 - DNA, 20 bp, synthetic construct
  misc_feature 1..20: note = CRISPR gRNA sequence
  source 1..20: mol_type = other DNA
cccccagctcaactcccccc

SEQ ID NO: 36851 - DNA, 20 bp, synthetic construct
  misc_feature 1..20: note = CRISPR gRNA sequence
  source 1..20: mol_type = other DNA
ccccaagttcccctgtccct

SEQ ID NO: 36852 - DNA, 20 bp, synthetic construct
  misc_feature 1..20: note = CRISPR gRNA sequence
  source 1..20: mol_type = other DNA
tccctcagctcatctgcccc

SEQ ID NO: 36853 - DNA, 20 bp, synthetic construct
  misc_feature 1..20: note = CRISPR gRNA sequence
  source 1..20: mol_type = other DNA
acctatcttccctgtccctc

SEQ ID NO: 36854 - DNA, 20 bp, synthetic construct
  misc_feature 1..20: note = CRISPR gRNA sequence
  source 1..20: mol_type = other DNA
cctatcttccctgtccctcc

SEQ ID NO: 36855 - DNA, 20 bp, synthetic construct
  misc_feature 1..20: note = CRISPR gRNA sequence
  source 1..20: mol_type = other DNA
ctatcttccctgtccctcca

SEQ ID NO: 36856 - DNA, 20 bp, synthetic construct
  misc_feature 1..20: note = CRISPR gRNA sequence
  source 1..20: mol_type = other DNA
cttccctgtccctccagggc

SEQ ID NO: 36857 - DNA, 20 bp, synthetic construct
  misc_feature 1..20: note = CRISPR gRNA sequence
  source 1..20: mol_type = other DNA
cctccagggctggctcctca

SEQ ID NO: 36858 - DNA, 20 bp, synthetic construct
  misc_feature 1..20: note = CRISPR gRNA sequence
  source 1..20: mol_type = other DNA
tggctcctcatggaccccgt

SEQ ID NO: 36859 - DNA, 20 bp, synthetic construct
  misc_feature 1..20: note = CRISPR gRNA sequence
  source 1..20: mol_type = other DNA
tcatggaccccgttggcctc

SEQ ID NO: 36860 - DNA, 20 bp, synthetic construct
  misc_feature 1..20: note = CRISPR gRNA sequence
  source 1..20: mol_type = other DNA
gaccccgttggcctccagct

SEQ ID NO: 36861 - DNA, 20 bp, synthetic construct
  misc_feature 1..20: note = CRISPR gRNA sequence
  source 1..20: mol_type = other DNA
ttggcctccagctcggcaac

SEQ ID NO: 36862 - DNA, 20 bp, synthetic construct
  misc_feature 1..20: note = CRISPR gRNA sequence
  source 1..20: mol_type = other DNA
agctcggcaacaagaacctg

SEQ ID NO: 36863 - DNA, 20 bp, synthetic construct
  misc_feature 1..20: note = CRISPR gRNA sequence
  source 1..20: mol_type = other DNA
ctcggcaacaagaacctgtg

SEQ ID NO: 36864 - DNA, 20 bp, synthetic construct
  misc_feature 1..20: note = CRISPR gRNA sequence
  source 1..20: mol_type = other DNA
aacctgtggagctgtcttgt

SEQ ID NO: 36865 - DNA, 20 bp, synthetic construct
  misc_feature 1..20: note = CRISPR gRNA sequence
  source 1..20: mol_type = other DNA
acctgtggagctgtcttgtg

SEQ ID NO: 36866 - DNA, 20 bp, synthetic construct
  misc_feature 1..20: note = CRISPR gRNA sequence
  source 1..20: mol_type = other DNA
tcttgtgaggctgctcacca

SEQ ID NO: 36867 - DNA, 20 bp, synthetic construct
  misc_feature 1..20: note = CRISPR gRNA sequence
  source 1..20: mol_type = other DNA
gaggctgctcaccaaagacc

SEQ ID NO: 36868 - DNA, 20 bp, synthetic construct
  misc_feature 1..20: note = CRISPR gRNA sequence
  source 1..20: mol_type = other DNA
tgctcaccaaagacccagaa

SEQ ID NO: 36869 - DNA, 20 bp, synthetic construct
  misc_feature 1..20: note = CRISPR gRNA sequence
  source 1..20: mol_type = other DNA
acccagaatggctgaacgcc

SEQ ID NO: 36870 - DNA, 20 bp, synthetic construct
  misc_feature 1..20: note = CRISPR gRNA sequence
  source 1..20: mol_type = other DNA
aatggctgaacgccaagatg

SEQ ID NO: 36871 - DNA, 20 bp, synthetic construct
  misc_feature 1..20: note = CRISPR gRNA sequence
  source 1..20: mol_type = other DNA
gaagttcttcctccccaaca

SEQ ID NO: 36872 - DNA, 20 bp, synthetic construct
  misc_feature 1..20: note = CRISPR gRNA sequence
  source 1..20: mol_type = other DNA
cttcctccccaacacggacc

SEQ ID NO: 36873 - DNA, 20 bp, synthetic construct
  misc_feature 1..20: note = CRISPR gRNA sequence
  source 1..20: mol_type = other DNA
cccaacacggacctggattc

SEQ ID NO: 36874 - DNA, 20 bp, synthetic construct
  misc_feature 1..20: note = CRISPR gRNA sequence
  source 1..20: mol_type = other DNA
ccaacacggacctggattcc

SEQ ID NO: 36875 - DNA, 20 bp, synthetic construct
  misc_feature 1..20: note = CRISPR gRNA sequence
  source 1..20: mol_type = other DNA
cggacctggattccaggaac

SEQ ID NO: 36876 - DNA, 20 bp, synthetic construct
  misc_feature 1..20: note = CRISPR gRNA sequence
  source 1..20: mol_type = other DNA
ggattccaggaacgagacct

SEQ ID NO: 36877 - DNA, 20 bp, synthetic construct
  misc_feature 1..20: note = CRISPR gRNA sequence
  source 1..20: mol_type = other DNA
acgagaccttggaccctgaa

SEQ ID NO: 36878 - DNA, 20 bp, synthetic construct
  misc_feature 1..20: note = CRISPR gRNA sequence
  source 1..20: mol_type = other DNA
gagaccttggaccctgaaca

SEQ ID NO: 36879 - DNA, 20 bp, synthetic construct
  misc_feature 1..20: note = CRISPR gRNA sequence
  source 1..20: mol_type = other DNA
gaccttggaccctgaacaga

SEQ ID NO: 36880 - DNA, 20 bp, synthetic construct
  misc_feature 1..20: note = CRISPR gRNA sequence
  source 1..20: mol_type = other DNA
gagtcatcctgcaactcaac

SEQ ID NO: 36881 - DNA, 20 bp, synthetic construct
  misc_feature 1..20: note = CRISPR gRNA sequence
  source 1..20: mol_type = other DNA
aactcaacaagctgcatgtc

SEQ ID NO: 36882 - DNA, 20 bp, synthetic construct
  misc_feature 1..20: note = CRISPR gRNA sequence
  source 1..20: mol_type = other DNA
actcaacaagctgcatgtcc

SEQ ID NO: 36883 - DNA, 20 bp, synthetic construct
  misc_feature 1..20: note = CRISPR gRNA sequence
  source 1..20: mol_type = other DNA
ctcaacaagctgcatgtcca

SEQ ID NO: 36884 - DNA, 20 bp, synthetic construct
  misc_feature 1..20: note = CRISPR gRNA sequence
  source 1..20: mol_type = other DNA
caagctgcatgtccagggtt

SEQ ID NO: 36885 - DNA, 20 bp, synthetic construct
  misc_feature 1..20: note = CRISPR gRNA sequence
  source 1..20: mol_type = other DNA
atgtccagggttcggacacc

SEQ ID NO: 36886 - DNA, 20 bp, synthetic construct
  misc_feature 1..20: note = CRISPR gRNA sequence
  source 1..20: mol_type = other DNA
tccagggttcggacacctgg

SEQ ID NO: 36887 - DNA, 20 bp, synthetic construct
  misc_feature 1..20: note = CRISPR gRNA sequence
  source 1..20: mol_type = other DNA
tcattcattgtgtgtgcatg

SEQ ID NO: 36888 - DNA, 20 bp, synthetic construct
  misc_feature 1..20: note = CRISPR gRNA sequence
  source 1..20: mol_type = other DNA
tcattgtgtgtgcatgcagc

SEQ ID NO: 36889 - DNA, 20 bp, synthetic construct
  misc_feature 1..20: note = CRISPR gRNA sequence
  source 1..20: mol_type = other DNA
attgtgtgtgcatgcagctg

SEQ ID NO: 36890 - DNA, 20 bp, synthetic construct
  misc_feature 1..20: note = CRISPR gRNA sequence
  source 1..20: mol_type = other DNA
ttgtgtgtgcatgcagctgg

SEQ ID NO: 36891 - DNA, 20 bp, synthetic construct
  misc_feature 1..20: note = CRISPR gRNA sequence
  source 1..20: mol_type = other DNA
catgcagctggaggtgcctc

SEQ ID NO: 36892 - DNA, 20 bp, synthetic construct
  misc_feature 1..20: note = CRISPR gRNA sequence
  source 1..20: mol_type = other DNA
gctggaggtgcctctggacc

SEQ ID NO: 36893 - DNA, 20 bp, synthetic construct
  misc_feature 1..20: note = CRISPR gRNA sequence
  source 1..20: mol_type = other DNA
tggaggtgcctctggacctg

SEQ ID NO: 36894 - DNA, 20 bp, synthetic construct
  misc_feature 1..20: note = CRISPR gRNA sequence
  source 1..20: mol_type = other DNA
ggaggtgcctctggacctgg

SEQ ID NO: 36895 - DNA, 20 bp, synthetic construct
  misc_feature 1..20: note = CRISPR gRNA sequence
  source 1..20: mol_type = other DNA
gacctggaggtgctgctgct

SEQ ID NO: 36896 - DNA, 20 bp, synthetic construct
  misc_feature 1..20: note = CRISPR gRNA sequence
  source 1..20: mol_type = other DNA
gtgctgctgctgagtacttt

SEQ ID NO: 36897 - DNA, 20 bp, synthetic construct
  misc_feature 1..20: note = CRISPR gRNA sequence
  source 1..20: mol_type = other DNA
agtacttttggctatgatga

SEQ ID NO: 36898 - DNA, 20 bp, synthetic construct
  misc_feature 1..20: note = CRISPR gRNA sequence
  source 1..20: mol_type = other DNA
cttttggctatgatgatggt

SEQ ID NO: 36899 - DNA, 20 bp, synthetic construct
  misc_feature 1..20: note = CRISPR gRNA sequence
  source 1..20: mol_type = other DNA
ttttggctatgatgatggta

SEQ ID NO: 36900 - DNA, 20 bp, synthetic construct
  misc_feature 1..20: note = CRISPR gRNA sequence
  source 1..20: mol_type = other DNA
tttggctatgatgatggtaa

SEQ ID NO: 36901 - DNA, 20 bp, synthetic construct
  misc_feature 1..20: note = CRISPR gRNA sequence
  source 1..20: mol_type = other DNA
ggctatgatgatggtaaggg

SEQ ID NO: 36902 - DNA, 20 bp, synthetic construct
  misc_feature 1..20: note = CRISPR gRNA sequence
  source 1..20: mol_type = other DNA
gctatgatgatggtaagggc

SEQ ID NO: 36903 - DNA, 20 bp, synthetic construct
  misc_feature 1..20: note = CRISPR gRNA sequence
  source 1..20: mol_type = other DNA
atgatggtaagggcaggtgt

SEQ ID NO: 36904 - DNA, 20 bp, synthetic construct
  misc_feature 1..20: note = CRISPR gRNA sequence
  source 1..20: mol_type = other DNA
gatggtaagggcaggtgtga

SEQ ID NO: 36905 - DNA, 20 bp, synthetic construct
  misc_feature 1..20: note = CRISPR gRNA sequence
  source 1..20: mol_type = other DNA
gggcaggtgtgagagacgca

SEQ ID NO: 36906 - DNA, 20 bp, synthetic construct
  misc_feature 1..20: note = CRISPR gRNA sequence
  source 1..20: mol_type = other DNA
caggtgtgagagacgcaaag

SEQ ID NO: 36907 - DNA, 20 bp, synthetic construct
  misc_feature 1..20: note = CRISPR gRNA sequence
  source 1..20: mol_type = other DNA
tgtgagagacgcaaagcagc

SEQ ID NO: 36908 - DNA, 20 bp, synthetic construct
  misc_feature 1..20: note = CRISPR gRNA sequence
  source 1..20: mol_type = other DNA
gtgagagacgcaaagcagcc

SEQ ID NO: 36909 - DNA, 20 bp, synthetic construct
  misc_feature 1..20: note = CRISPR gRNA sequence
  source 1..20: mol_type = other DNA
gagacgcaaagcagccgggc

SEQ ID NO: 36910 - DNA, 20 bp, synthetic construct
  misc_feature 1..20: note = CRISPR gRNA sequence
  source 1..20: mol_type = other DNA
ccgggccagtacctgcgtca

SEQ ID NO: 36911 - DNA, 20 bp, synthetic construct
  misc_feature 1..20: note = CRISPR gRNA sequence
  source 1..20: mol_type = other DNA
cgggccagtacctgcgtcat

SEQ ID NO: 36912 - DNA, 20 bp, synthetic construct
  misc_feature 1..20: note = CRISPR gRNA sequence
  source 1..20: mol_type = other DNA
gggccagtacctgcgtcatg

SEQ ID NO: 36913 - DNA, 20 bp, synthetic construct
  misc_feature 1..20: note = CRISPR gRNA sequence
  source 1..20: mol_type = other DNA
gccagtacctgcgtcatggg

SEQ ID NO: 36914 - DNA, 20 bp, synthetic construct
  misc_feature 1..20: note = CRISPR gRNA sequence
  source 1..20: mol_type = other DNA
gtacctgcgtcatggggagc

SEQ ID NO: 36915 - DNA, 20 bp, synthetic construct
  misc_feature 1..20: note = CRISPR gRNA sequence
  source 1..20: mol_type = other DNA
tacctgcgtcatggggagcc

SEQ ID NO: 36916 - DNA, 20 bp, synthetic construct
  misc_feature 1..20: note = CRISPR gRNA sequence
  source 1..20: mol_type = other DNA
cctgcgtcatggggagccgg

SEQ ID NO: 36917 - DNA, 20 bp, synthetic construct
  misc_feature 1..20: note = CRISPR gRNA sequence
  source 1..20: mol_type = other DNA
ctgcgtcatggggagccggg

SEQ ID NO: 36918 - DNA, 20 bp, synthetic construct
  misc_feature 1..20: note = CRISPR gRNA sequence
  source 1..20: mol_type = other DNA
gcgtcatggggagccgggag

SEQ ID NO: 36919 - DNA, 20 bp, synthetic construct
  misc_feature 1..20: note = CRISPR gRNA sequence
  source 1..20: mol_type = other DNA
atggggagccgggaggagcc

SEQ ID NO: 36920 - DNA, 20 bp, synthetic construct
  misc_feature 1..20: note = CRISPR gRNA sequence
  source 1..20: mol_type = other DNA
tggggagccgggaggagccc

SEQ ID NO: 36921 - DNA, 20 bp, synthetic construct
  misc_feature 1..20: note = CRISPR gRNA sequence
  source 1..20: mol_type = other DNA
ggggagccgggaggagccca

SEQ ID NO: 36922 - DNA, 20 bp, synthetic construct
  misc_feature 1..20: note = CRISPR gRNA sequence
  source 1..20: mol_type = other DNA
aggagcccagggacccacct

SEQ ID NO: 36923 - DNA, 20 bp, synthetic construct
  misc_feature 1..20: note = CRISPR gRNA sequence
  source 1..20: mol_type = other DNA
gcccagggacccacctaagt

SEQ ID NO: 36924 - DNA, 20 bp, synthetic construct
  misc_feature 1..20: note = CRISPR gRNA sequence
  source 1..20: mol_type = other DNA
ccagggacccacctaagtca

SEQ ID NO: 36925 - DNA, 20 bp, synthetic construct
  misc_feature 1..20: note = CRISPR gRNA sequence
  source 1..20: mol_type = other DNA
agggacccacctaagtcaga

SEQ ID NO: 36926 - DNA, 20 bp, synthetic construct
  misc_feature 1..20: note = CRISPR gRNA sequence
  source 1..20: mol_type = other DNA
ggacccacctaagtcagaga

SEQ ID NO: 36927 - DNA, 20 bp, synthetic construct
  misc_feature 1..20: note = CRISPR gRNA sequence
  source 1..20: mol_type = other DNA
gacccacctaagtcagagag

SEQ ID NO: 36928 - DNA, 20 bp, synthetic construct
  misc_feature 1..20: note = CRISPR gRNA sequence
  source 1..20: mol_type = other DNA
acccacctaagtcagagaga

SEQ ID NO: 36929 - DNA, 20 bp, synthetic construct
  misc_feature 1..20: note = CRISPR gRNA sequence
  source 1..20: mol_type = other DNA
cctaagtcagagagagggtg

SEQ ID NO: 36930 - DNA, 20 bp, synthetic construct
  misc_feature 1..20: note = CRISPR gRNA sequence
  source 1..20: mol_type = other DNA
gtcagagagagggtgtagcc

SEQ ID NO: 36931 - DNA, 20 bp, synthetic construct
  misc_feature 1..20: note = CRISPR gRNA sequence
  source 1..20: mol_type = other DNA
cgatctcaactctatatttc

SEQ ID NO: 36932 - DNA, 20 bp, synthetic construct
  misc_feature 1..20: note = CRISPR gRNA sequence
  source 1..20: mol_type = other DNA
ctatatttctggacacttcc

SEQ ID NO: 36933 - DNA, 20 bp, synthetic construct
  misc_feature 1..20: note = CRISPR gRNA sequence
  source 1..20: mol_type = other DNA
cctaatgcgcccaaatctgc

SEQ ID NO: 36934 - DNA, 20 bp, synthetic construct
  misc_feature 1..20: note = CRISPR gRNA sequence
  source 1..20: mol_type = other DNA
ctaatgcgcccaaatctgct

SEQ ID NO: 36935 - DNA, 20 bp, synthetic construct
  misc_feature 1..20: note = CRISPR gRNA sequence
  source 1..20: mol_type = other DNA
taatgcgcccaaatctgctg

SEQ ID NO: 36936 - DNA, 20 bp, synthetic construct
  misc_feature 1..20: note = CRISPR gRNA sequence
  source 1..20: mol_type = other DNA
cgcccaaatctgctggggcc

SEQ ID NO: 36937 - DNA, 20 bp, synthetic construct
  misc_feature 1..20: note = CRISPR gRNA sequence
  source 1..20: mol_type = other DNA
cccaaatctgctggggcctg

SEQ ID NO: 36938 - DNA, 20 bp, synthetic construct
  misc_feature 1..20: note = CRISPR gRNA sequence
  source 1..20: mol_type = other DNA
ccaaatctgctggggcctgg

SEQ ID NO: 36939 - DNA, 20 bp, synthetic construct
  misc_feature 1..20: note = CRISPR gRNA sequence
  source 1..20: mol_type = other DNA
ggaggacccctccttctacc

SEQ ID NO: 36940 - DNA, 20 bp, synthetic construct
  misc_feature 1..20: note = CRISPR gRNA sequence
  source 1..20: mol_type = other DNA
ctcgaattgctcgaattgct

SEQ ID NO: 36941 - DNA, 20 bp, synthetic construct
  misc_feature 1..20: note = CRISPR gRNA sequence
  source 1..20: mol_type = other DNA
aattgctgagtgactgcttc

SEQ ID NO: 36942 - DNA, 20 bp, synthetic construct
  misc_feature 1..20: note = CRISPR gRNA sequence
  source 1..20: mol_type = other DNA
tccagccacaaaatcccaca

SEQ ID NO: 36943 - DNA, 20 bp, synthetic construct
  misc_feature 1..20: note = CRISPR gRNA sequence
  source 1..20: mol_type = other DNA
ccacatagcccataatgccc

SEQ ID NO: 36944 - DNA, 20 bp, synthetic construct
  misc_feature 1..20: note = CRISPR gRNA sequence
  source 1..20: mol_type = other DNA
acatagcccataatgcccga

SEQ ID NO: 36945 - DNA, 20 bp, synthetic construct
  misc_feature 1..20: note = CRISPR gRNA sequence
  source 1..20: mol_type = other DNA
gagatttatttcttcttttt

SEQ ID NO: 36946 - DNA, 20 bp, synthetic construct
  misc_feature 1..20: note = CRISPR gRNA sequence
  source 1..20: mol_type = other DNA
atttatttcttcttttttgg

SEQ ID NO: 36947 - DNA, 20 bp, synthetic construct
  misc_feature 1..20: note = CRISPR gRNA sequence
  source 1..20: mol_type = other DNA
tttatttcttcttttttggc

SEQ ID NO: 36948 - DNA, 20 bp, synthetic construct
  misc_feature 1..20: note = CRISPR gRNA sequence
  source 1..20: mol_type = other DNA
ttatttcttcttttttggcg

SEQ ID NO: 36949 - DNA, 20 bp, synthetic construct
  misc_feature 1..20: note = CRISPR gRNA sequence
  source 1..20: mol_type = other DNA
tatttcttcttttttggcgg

SEQ ID NO: 36950 - DNA, 20 bp, synthetic construct
  misc_feature 1..20: note = CRISPR gRNA sequence
  source 1..20: mol_type = other DNA
ttcttcttttttggcggggg

SEQ ID NO: 36951 - DNA, 20 bp, synthetic construct
  misc_feature 1..20: note = CRISPR gRNA sequence
  source 1..20: mol_type = other DNA
tcttcttttttggcgggggt

SEQ ID NO: 36952 - DNA, 20 bp, synthetic construct
  misc_feature 1..20: note = CRISPR gRNA sequence
  source 1..20: mol_type = other DNA
cttcttttttggcgggggtg

SEQ ID NO: 36953 - DNA, 20 bp, synthetic construct
  misc_feature 1..20: note = CRISPR gRNA sequence
  source 1..20: mol_type = other DNA
ttcttttttggcgggggtgg

SEQ ID NO: 36954 - DNA, 20 bp, synthetic construct
  misc_feature 1..20: note = CRISPR gRNA sequence
  source 1..20: mol_type = other DNA
tcttttttggcgggggtggg

SEQ ID NO: 36955 - DNA, 20 bp, synthetic construct
  misc_feature 1..20: note = CRISPR gRNA sequence
  source 1..20: mol_type = other DNA
cttttttggcgggggtgggg

SEQ ID NO: 36956 - DNA, 20 bp, synthetic construct
  misc_feature 1..20: note = CRISPR gRNA sequence
  source 1..20: mol_type = other DNA
ttgtttgttgttgctcttgt

SEQ ID NO: 36957 - DNA, 20 bp, synthetic construct
  misc_feature 1..20: note = CRISPR gRNA sequence
  source 1..20: mol_type = other DNA
tgtttgttgttgctcttgtt

SEQ ID NO: 36958 - DNA, 20 bp, synthetic construct
  misc_feature 1..20: note = CRISPR gRNA sequence
  source 1..20: mol_type = other DNA
tttgtttgttttttattttt

SEQ ID NO: 36959 - DNA, 20 bp, synthetic construct
  misc_feature 1..20: note = CRISPR gRNA sequence
  source 1..20: mol_type = other DNA
ttgttttttatttttgagac

SEQ ID NO: 36960 - DNA, 20 bp, synthetic construct
  misc_feature 1..20: note = CRISPR gRNA sequence
  source 1..20: mol_type = other DNA
tgttttttatttttgagaca

SEQ ID NO: 36961 - DNA, 20 bp, synthetic construct
  misc_feature 1..20: note = CRISPR gRNA sequence
  source 1..20: mol_type = other DNA
caaggtcttgctctgttgcc

SEQ ID NO: 36962 - DNA, 20 bp, synthetic construct
  misc_feature 1..20: note = CRISPR gRNA sequence
  source 1..20: mol_type = other DNA
aaggtcttgctctgttgcct

SEQ ID NO: 36963 - DNA, 20 bp, synthetic construct
  misc_feature 1..20: note = CRISPR gRNA sequence
  source 1..20: mol_type = other DNA
tcttgctctgttgcctaggc

SEQ ID NO: 36964 - DNA, 20 bp, synthetic construct
  misc_feature 1..20: note = CRISPR gRNA sequence
  source 1..20: mol_type = other DNA
ttgctctgttgcctaggctg

SEQ ID NO: 36965 - DNA, 20 bp, synthetic construct
  misc_feature 1..20: note = CRISPR gRNA sequence
  source 1..20: mol_type = other DNA
ctgttgcctaggctggagtg

SEQ ID NO: 36966 - DNA, 20 bp, synthetic construct
  misc_feature 1..20: note = CRISPR gRNA sequence
  source 1..20: mol_type = other DNA
ttgcctaggctggagtgcag

SEQ ID NO: 36967 - DNA, 20 bp, synthetic construct
  misc_feature 1..20: note = CRISPR gRNA sequence
  source 1..20: mol_type = other DNA
ggagtgcagtggcacaatca

SEQ ID NO: 36968 - DNA, 20 bp, synthetic construct
  misc_feature 1..20: note = CRISPR gRNA sequence
  source 1..20: mol_type = other DNA
ggcacaatcatagctcacta

SEQ ID NO: 36969 - DNA, 20 bp, synthetic construct
  misc_feature 1..20: note = CRISPR gRNA sequence
  source 1..20: mol_type = other DNA
ctcactacagcatccaactc

SEQ ID NO: 36970 - DNA, 20 bp, synthetic construct
  misc_feature 1..20: note = CRISPR gRNA sequence
  source 1..20: mol_type = other DNA
tcactacagcatccaactcc

SEQ ID NO: 36971 - DNA, 20 bp, synthetic construct
  misc_feature 1..20: note = CRISPR gRNA sequence
  source 1..20: mol_type = other DNA
cagcatccaactccaggact

SEQ ID NO: 36972 - DNA, 20 bp, synthetic construct
  misc_feature 1..20: note = CRISPR gRNA sequence
  source 1..20: mol_type = other DNA
agcatccaactccaggactc

SEQ ID NO: 36973 - DNA, 20 bp, synthetic construct
  misc_feature 1..20: note = CRISPR gRNA sequence
  source 1..20: mol_type = other DNA
tcaggtgatccttcccactt

SEQ ID NO: 36974 - DNA, 20 bp, synthetic construct
  misc_feature 1..20: note = CRISPR gRNA sequence
  source 1..20: mol_type = other DNA
ccttcccacttcagcctccc

SEQ ID NO: 36975 - DNA, 20 bp, synthetic construct
  misc_feature 1..20: note = CRISPR gRNA sequence
  source 1..20: mol_type = other DNA
tcccacttcagcctcccaag

SEQ ID NO: 36976 - DNA, 20 bp, synthetic construct
  misc_feature 1..20: note = CRISPR gRNA sequence
  source 1..20: mol_type = other DNA
cttcagcctcccaagtagct

SEQ ID NO: 36977 - DNA, 20 bp, synthetic construct
  misc_feature 1..20: note = CRISPR gRNA sequence
  source 1..20: mol_type = other DNA
ctcccaagtagctgagacta

SEQ ID NO: 36978 - DNA, 20 bp, synthetic construct
  misc_feature 1..20: note = CRISPR gRNA sequence
  source 1..20: mol_type = other DNA
ccaagtagctgagactacag

SEQ ID NO: 36979 - DNA, 20 bp, synthetic construct
  misc_feature 1..20: note = CRISPR gRNA sequence
  source 1..20: mol_type = other DNA
ctgagactacagtagaacta

SEQ ID NO: 36980 - DNA, 20 bp, synthetic construct
  misc_feature 1..20: note = CRISPR gRNA sequence
  source 1..20: mol_type = other DNA
tgagactacagtagaactat

SEQ ID NO: 36981 - DNA, 20 bp, synthetic construct
  misc_feature 1..20: note = CRISPR gRNA sequence
  source 1..20: mol_type = other DNA
ataggtgcatgccaccacat

SEQ ID NO: 36982 - DNA, 20 bp, synthetic construct
  misc_feature 1..20: note = CRISPR gRNA sequence
  source 1..20: mol_type = other DNA
taggtgcatgccaccacatt

SEQ ID NO: 36983 - DNA, 20 bp, synthetic construct
  misc_feature 1..20: note = CRISPR gRNA sequence
  source 1..20: mol_type = other DNA
gctaatttttcattcttttg

SEQ ID NO: 36984 - DNA, 20 bp, synthetic construct
  misc_feature 1..20: note = CRISPR gRNA sequence
  source 1..20: mol_type = other DNA
taatttttcattcttttgta

SEQ ID NO: 36985 - DNA, 20 bp, synthetic construct
  misc_feature 1..20: note = CRISPR gRNA sequence
  source 1..20: mol_type = other DNA
ttttcattcttttgtagaga

SEQ ID NO: 36986 - DNA, 20 bp, synthetic construct
  misc_feature 1..20: note = CRISPR gRNA sequence
  source 1..20: mol_type = other DNA
tttcattcttttgtagagac

SEQ ID NO: 36987 - DNA, 20 bp, synthetic construct
  misc_feature 1..20: note = CRISPR gRNA sequence
  source 1..20: mol_type = other DNA
caggacatcactgtgttgcc

SEQ ID NO: 36988 - DNA, 20 bp, synthetic construct
  misc_feature 1..20: note = CRISPR gRNA sequence
  source 1..20: mol_type = other DNA
aggacatcactgtgttgccc

SEQ ID NO: 36989 - DNA, 20 bp, synthetic construct
  misc_feature 1..20: note = CRISPR gRNA sequence
  source 1..20: mol_type = other DNA
catcactgtgttgcccaggc

SEQ ID NO: 36990 - DNA, 20 bp, synthetic construct
  misc_feature 1..20: note = CRISPR gRNA sequence
  source 1..20: mol_type = other DNA
ccaggctggtcttgaactcc

SEQ ID NO: 36991 - DNA, 20 bp, synthetic construct
  misc_feature 1..20: note = CRISPR gRNA sequence
  source 1..20: mol_type = other DNA
ggtcttgaactcctggcctt

SEQ ID NO: 36992 - DNA, 20 bp, synthetic construct
  misc_feature 1..20: note = CRISPR gRNA sequence
  source 1..20: mol_type = other DNA
cttaagtgatcctcctccct

SEQ ID NO: 36993 - DNA, 20 bp, synthetic construct
  misc_feature 1..20: note = CRISPR gRNA sequence
  source 1..20: mol_type = other DNA
cctcctcccttggcctccca

SEQ ID NO: 36994 - DNA, 20 bp, synthetic construct
  misc_feature 1..20: note = CRISPR gRNA sequence
  source 1..20: mol_type = other DNA
cccttggcctcccaaagtgc

SEQ ID NO: 36995 - DNA, 20 bp, synthetic construct
  misc_feature 1..20: note = CRISPR gRNA sequence
  source 1..20: mol_type = other DNA
ccttggcctcccaaagtgct

SEQ ID NO: 36996 - DNA, 20 bp, synthetic construct
  misc_feature 1..20: note = CRISPR gRNA sequence
  source 1..20: mol_type = other DNA
ctcccaaagtgctgggatta

SEQ ID NO: 36997 - DNA, 20 bp, synthetic construct
  misc_feature 1..20: note = CRISPR gRNA sequence
  source 1..20: mol_type = other DNA
agtgctgggattatagatgt

SEQ ID NO: 36998 - DNA, 20 bp, synthetic construct
  misc_feature 1..20: note = CRISPR gRNA sequence
  source 1..20: mol_type = other DNA
tagatgtgagccatcacacc

SEQ ID NO: 36999 - DNA, 20 bp, synthetic construct
  misc_feature 1..20: note = CRISPR gRNA sequence
  source 1..20: mol_type = other DNA
tgtgagccatcacacctggc

SEQ ID NO: 37000 - DNA, 20 bp, synthetic construct
  misc_feature 1..20: note = CRISPR gRNA sequence
  source 1..20: mol_type = other DNA
tgagccatcacacctggcta

SEQ ID NO: 37001 - DNA, 20 bp, synthetic construct
  misc_feature 1..20: note = CRISPR gRNA sequence
  source 1..20: mol_type = other DNA
gagccatcacacctggctag

SEQ ID NO: 37002 - DNA, 20 bp, synthetic construct
  misc_feature 1..20: note = CRISPR gRNA sequence
  source 1..20: mol_type = other DNA
tgtttgtttgttttgcaaca

SEQ ID NO: 37003 - DNA, 20 bp, synthetic construct
  misc_feature 1..20: note = CRISPR gRNA sequence
  source 1..20: mol_type = other DNA
tgtttgttttgcaacatggt

SEQ ID NO: 37004 - DNA, 20 bp, synthetic construct
  misc_feature 1..20: note = CRISPR gRNA sequence
  source 1..20: mol_type = other DNA
ttttgcaacatggtcagaaa

SEQ ID NO: 37005 - DNA, 20 bp, synthetic construct
  misc_feature 1..20: note = CRISPR gRNA sequence
  source 1..20: mol_type = other DNA
aacatggtcagaaacagtga

SEQ ID NO: 37006 - DNA, 20 bp, synthetic construct
  misc_feature 1..20: note = CRISPR gRNA sequence
  source 1..20: mol_type = other DNA
acatggtcagaaacagtgac

SEQ ID NO: 37007 - DNA, 20 bp, synthetic construct
  misc_feature 1..20: note = CRISPR gRNA sequence
  source 1..20: mol_type = other DNA
catggtcagaaacagtgacg

SEQ ID NO: 37008 - DNA, 20 bp, synthetic construct
  misc_feature 1..20: note = CRISPR gRNA sequence
  source 1..20: mol_type = other DNA
tggtcagaaacagtgacggg

SEQ ID NO: 37009 - DNA, 20 bp, synthetic construct
  misc_feature 1..20: note = CRISPR gRNA sequence
  source 1..20: mol_type = other DNA
ttctgccctctactgatccg

SEQ ID NO: 37010 - DNA, 20 bp, synthetic construct
  misc_feature 1..20: note = CRISPR gRNA sequence
  source 1..20: mol_type = other DNA
tctgccctctactgatccgt

SEQ ID NO: 37011 - DNA, 20 bp, synthetic construct
  misc_feature 1..20: note = CRISPR gRNA sequence
  source 1..20: mol_type = other DNA
ctgccctctactgatccgtg

SEQ ID NO: 37012 - DNA, 20 bp, synthetic construct
  misc_feature 1..20: note = CRISPR gRNA sequence
  source 1..20: mol_type = other DNA
actgatccgtggggatttct

SEQ ID NO: 37013 - DNA, 20 bp, synthetic construct
  misc_feature 1..20: note = CRISPR gRNA sequence
  source 1..20: mol_type = other DNA
ctgatccgtggggatttctt

SEQ ID NO: 37014 - DNA, 20 bp, synthetic construct
  misc_feature 1..20: note = CRISPR gRNA sequence
  source 1..20: mol_type = other DNA
ttgggcaccttctgtttgca

SEQ ID NO: 37015 - DNA, 20 bp, synthetic construct
  misc_feature 1..20: note = CRISPR gRNA sequence
  source 1..20: mol_type = other DNA
ccttctgtttgcacagcact

SEQ ID NO: 37016 - DNA, 20 bp, synthetic construct
  misc_feature 1..20: note = CRISPR gRNA sequence
  source 1..20: mol_type = other DNA
cttctgtttgcacagcactg

SEQ ID NO: 37017 - DNA, 20 bp, synthetic construct
  misc_feature 1..20: note = CRISPR gRNA sequence
  source 1..20: mol_type = other DNA
ttctgtttgcacagcactga

SEQ ID NO: 37018 - DNA, 20 bp, synthetic construct
  misc_feature 1..20: note = CRISPR gRNA sequence
  source 1..20: mol_type = other DNA
tctgtttgcacagcactgag

SEQ ID NO: 37019 - DNA, 20 bp, synthetic construct
  misc_feature 1..20: note = CRISPR gRNA sequence
  source 1..20: mol_type = other DNA
cacagcactgaggggaaaca

SEQ ID NO: 37020 - DNA, 20 bp, synthetic construct
  misc_feature 1..20: note = CRISPR gRNA sequence
  source 1..20: mol_type = other DNA
acagcactgaggggaaacac

SEQ ID NO: 37021 - DNA, 20 bp, synthetic construct
  misc_feature 1..20: note = CRISPR gRNA sequence
  source 1..20: mol_type = other DNA
gaggggaaacacaggacatt

SEQ ID NO: 37022 - DNA, 20 bp, synthetic construct
  misc_feature 1..20: note = CRISPR gRNA sequence
  source 1..20: mol_type = other DNA
aggggaaacacaggacattg

SEQ ID NO: 37023 - DNA, 20 bp, synthetic construct
  misc_feature 1..20: note = CRISPR gRNA sequence
  source 1..20: mol_type = other DNA
ggggaaacacaggacattga

SEQ ID NO: 37024 - DNA, 20 bp, synthetic construct
  misc_feature 1..20: note = CRISPR gRNA sequence
  source 1..20: mol_type = other DNA
gggaaacacaggacattgag

SEQ ID NO: 37025 - DNA, 20 bp, synthetic construct
  misc_feature 1..20: note = CRISPR gRNA sequence
  source 1..20: mol_type = other DNA
cacaggacattgaggggcaa

SEQ ID NO: 37026 - DNA, 20 bp, synthetic construct
  misc_feature 1..20: note = CRISPR gRNA sequence
  source 1..20: mol_type = other DNA
ttgaggggcaacagcgtttt

SEQ ID NO: 37027 - DNA, 20 bp, synthetic construct
  misc_feature 1..20: note = CRISPR gRNA sequence
  source 1..20: mol_type = other DNA
gaggggcaacagcgtttttg

SEQ ID NO: 37028 - DNA, 20 bp, synthetic construct
  misc_feature 1..20: note = CRISPR gRNA sequence
  source 1..20: mol_type = other DNA
ggggcaacagcgtttttgga

SEQ ID NO: 37029 - DNA, 20 bp, synthetic construct
  misc_feature 1..20: note = CRISPR gRNA sequence
  source 1..20: mol_type = other DNA
cagcgtttttggagagaaaa

SEQ ID NO: 37030 - DNA, 20 bp, synthetic construct
  misc_feature 1..20: note = CRISPR gRNA sequence
  source 1..20: mol_type = other DNA
agcgtttttggagagaaaat

SEQ ID NO: 37031 - DNA, 20 bp, synthetic construct
  misc_feature 1..20: note = CRISPR gRNA sequence
  source 1..20: mol_type = other DNA
gagaaaatgggaactcactt

SEQ ID NO: 37032 - DNA, 20 bp, synthetic construct
  misc_feature 1..20: note = CRISPR gRNA sequence
  source 1..20: mol_type = other DNA
tcacttaagaaccctacttc

SEQ ID NO: 37033 - DNA, 20 bp, synthetic construct
  misc_feature 1..20: note = CRISPR gRNA sequence
  source 1..20: mol_type = other DNA
cacttaagaaccctacttca

SEQ ID NO: 37034 - DNA, 20 bp, synthetic construct
  misc_feature 1..20: note = CRISPR gRNA sequence
  source 1..20: mol_type = other DNA
ttaagaaccctacttcaagg

SEQ ID NO: 37035 - DNA, 20 bp, synthetic construct
  misc_feature 1..20: note = CRISPR gRNA sequence
  source 1..20: mol_type = other DNA
aagaaccctacttcaaggca

SEQ ID NO: 37036 - DNA, 20 bp, synthetic construct
  misc_feature 1..20: note = CRISPR gRNA sequence
  source 1..20: mol_type = other DNA
ccctacttcaaggcagagtg

SEQ ID NO: 37037 - DNA, 20 bp, synthetic construct
  misc_feature 1..20: note = CRISPR gRNA sequence
  source 1..20: mol_type = other DNA
cctacttcaaggcagagtgt

SEQ ID NO: 37038 - DNA, 20 bp, synthetic construct
  misc_feature 1..20: note = CRISPR gRNA sequence
  source 1..20: mol_type = other DNA
aaggcagagtgtgggaattg

SEQ ID NO: 37039 - DNA, 20 bp, synthetic construct
  misc_feature 1..20: note = CRISPR gRNA sequence
  source 1..20: mol_type = other DNA
aggcagagtgtgggaattgc

SEQ ID NO: 37040 - DNA, 20 bp, synthetic construct
  misc_feature 1..20: note = CRISPR gRNA sequence
  source 1..20: mol_type = other DNA
ggcagagtgtgggaattgcg

SEQ ID NO: 37041 - DNA, 20 bp, synthetic construct
  misc_feature 1..20: note = CRISPR gRNA sequence
  source 1..20: mol_type = other DNA
gcagagtgtgggaattgcgg

SEQ ID NO: 37042 - DNA, 20 bp, synthetic construct
  misc_feature 1..20: note = CRISPR gRNA sequence
  source 1..20: mol_type = other DNA
cagagtgtgggaattgcggg

SEQ ID NO: 37043 - DNA, 20 bp, synthetic construct
  misc_feature 1..20: note = CRISPR gRNA sequence
  source 1..20: mol_type = other DNA
agtgtgggaattgcgggggg

SEQ ID NO: 37044 - DNA, 20 bp, synthetic construct
  misc_feature 1..20: note = CRISPR gRNA sequence
  source 1..20: mol_type = other DNA
gtgtgggaattgcggggggc

SEQ ID NO: 37045 - DNA, 20 bp, synthetic construct
  misc_feature 1..20: note = CRISPR gRNA sequence
  source 1..20: mol_type = other DNA
tgtgggaattgcggggggcg

SEQ ID NO: 37046 - DNA, 20 bp, synthetic construct
  misc_feature 1..20: note = CRISPR gRNA sequence
  source 1..20: mol_type = other DNA
gggaattgcggggggcgggg

SEQ ID NO: 37047 - DNA, 20 bp, synthetic construct
  misc_feature 1..20: note = CRISPR gRNA sequence
  source 1..20: mol_type = other DNA
gcggcgcatgcacatatgtg

SEQ ID NO: 37048 - DNA, 20 bp, synthetic construct
  misc_feature 1..20: note = CRISPR gRNA sequence
  source 1..20: mol_type = other DNA
cacatatgtgcagacatatg

SEQ ID NO: 37049 - DNA, 20 bp, synthetic construct
  misc_feature 1..20: note = CRISPR gRNA sequence
  source 1..20: mol_type = other DNA
cagacatatgcagatacaca

SEQ ID NO: 37050 - DNA, 20 bp, synthetic construct
  misc_feature 1..20: note = CRISPR gRNA sequence
  source 1..20: mol_type = other DNA
acacacagtgcatatacatg

SEQ ID NO: 37051 - DNA, 20 bp, synthetic construct
  misc_feature 1..20: note = CRISPR gRNA sequence
  source 1..20: mol_type = other DNA
cacacagtgcatatacatgt

SEQ ID NO: 37052 - DNA, 20 bp, synthetic construct
  misc_feature 1..20: note = CRISPR gRNA sequence
  source 1..20: mol_type = other DNA
acccatgtacacatgcatgc

SEQ ID NO: 37053 - DNA, 20 bp, synthetic construct
  misc_feature 1..20: note = CRISPR gRNA sequence
  source 1..20: mol_type = other DNA
catatacacacatttctgcc

SEQ ID NO: 37054 - DNA, 20 bp, synthetic construct
  misc_feature 1..20: note = CRISPR gRNA sequence
  source 1..20: mol_type = other DNA
tctgcccagcactgccttca

SEQ ID NO: 37055 - DNA, 20 bp, synthetic construct
  misc_feature 1..20: note = CRISPR gRNA sequence
  source 1..20: mol_type = other DNA
ccaccacattttctccacaa

SEQ ID NO: 37056 - DNA, 20 bp, synthetic construct
  misc_feature 1..20: note = CRISPR gRNA sequence
  source 1..20: mol_type = other DNA
tttctccacaacagataact

SEQ ID NO: 37057 - DNA, 20 bp, synthetic construct
  misc_feature 1..20: note = CRISPR gRNA sequence
  source 1..20: mol_type = other DNA
agataactgagtgttccatt

SEQ ID NO: 37058 - DNA, 20 bp, synthetic construct
  misc_feature 1..20: note = CRISPR gRNA sequence
  source 1..20: mol_type = other DNA
tccatttagttctcccttgc

SEQ ID NO: 37059 - DNA, 20 bp, synthetic construct
  misc_feature 1..20: note = CRISPR gRNA sequence
  source 1..20: mol_type = other DNA
ccatttagttctcccttgct

SEQ ID NO: 37060 - DNA, 20 bp, synthetic construct
  misc_feature 1..20: note = CRISPR gRNA sequence
  source 1..20: mol_type = other DNA
cttgctgggtatctccctgt

SEQ ID NO: 37061 - DNA, 20 bp, synthetic construct
  misc_feature 1..20: note = CRISPR gRNA sequence
  source 1..20: mol_type = other DNA
tgggtatctccctgtgagat

SEQ ID NO: 37062 - DNA, 20 bp, synthetic construct
  misc_feature 1..20: note = CRISPR gRNA sequence
  source 1..20: mol_type = other DNA
ctccctgtgagatgagccct

SEQ ID NO: 37063 - DNA, 20 bp, synthetic construct
  misc_feature 1..20: note = CRISPR gRNA sequence
  source 1..20: mol_type = other DNA
ctgtgagatgagccctgagc

SEQ ID NO: 37064 - DNA, 20 bp, synthetic construct
  misc_feature 1..20: note = CRISPR gRNA sequence
  source 1..20: mol_type = other DNA
tgtgagatgagccctgagcc

SEQ ID NO: 37065 - DNA, 20 bp, synthetic construct
  misc_feature 1..20: note = CRISPR gRNA sequence
  source 1..20: mol_type = other DNA
atgagccctgagccaggcgc

SEQ ID NO: 37066 - DNA, 20 bp, synthetic construct
  misc_feature 1..20: note = CRISPR gRNA sequence
  source 1..20: mol_type = other DNA
tgagccctgagccaggcgcc

SEQ ID NO: 37067 - DNA, 20 bp, synthetic construct
  misc_feature 1..20: note = CRISPR gRNA sequence
  source 1..20: mol_type = other DNA
ccctgagccaggcgccaggc

SEQ ID NO: 37068 - DNA, 20 bp, synthetic construct
  misc_feature 1..20: note = CRISPR gRNA sequence
  source 1..20: mol_type = other DNA
ctgagccaggcgccaggcca

SEQ ID NO: 37069 - DNA, 20 bp, synthetic construct
  misc_feature 1..20: note = CRISPR gRNA sequence
  source 1..20: mol_type = other DNA
gccaggcgccaggccagagc

SEQ ID NO: 37070 - DNA, 20 bp, synthetic construct
  misc_feature 1..20: note = CRISPR gRNA sequence
  source 1..20: mol_type = other DNA
gccaggccagagctggtccc

SEQ ID NO: 37071 - DNA, 20 bp, synthetic construct
  misc_feature 1..20: note = CRISPR gRNA sequence
  source 1..20: mol_type = other DNA
tggtccccagcatccctcga

SEQ ID NO: 37072 - DNA, 20 bp, synthetic construct
  misc_feature 1..20: note = CRISPR gRNA sequence
  source 1..20: mol_type = other DNA
ttatactctcccctctcttg

SEQ ID NO: 37073 - DNA, 20 bp, synthetic construct
  misc_feature 1..20: note = CRISPR gRNA sequence
  source 1..20: mol_type = other DNA
tatactctcccctctcttgc

SEQ ID NO: 37074 - DNA, 20 bp, synthetic construct
  misc_feature 1..20: note = CRISPR gRNA sequence
  source 1..20: mol_type = other DNA
atactctcccctctcttgca

SEQ ID NO: 37075 - DNA, 20 bp, synthetic construct
  misc_feature 1..20: note = CRISPR gRNA sequence
  source 1..20: mol_type = other DNA
ccctctcttgcagggttcac

SEQ ID NO: 37076 - DNA, 20 bp, synthetic construct
  misc_feature 1..20: note = CRISPR gRNA sequence
  source 1..20: mol_type = other DNA
ctcttgcagggttcaccagc

SEQ ID NO: 37077 - DNA, 20 bp, synthetic construct
  misc_feature 1..20: note = CRISPR gRNA sequence
  source 1..20: mol_type = other DNA
tgcagggttcaccagccagc

SEQ ID NO: 37078 - DNA, 20 bp, synthetic construct
  misc_feature 1..20: note = CRISPR gRNA sequence
  source 1..20: mol_type = other DNA
gcagggttcaccagccagct

SEQ ID NO: 37079 - DNA, 20 bp, synthetic construct
  misc_feature 1..20: note = CRISPR gRNA sequence
  source 1..20: mol_type = other DNA
agggttcaccagccagctgg

SEQ ID NO: 37080 - DNA, 20 bp, synthetic construct
  misc_feature 1..20: note = CRISPR gRNA sequence
  source 1..20: mol_type = other DNA
tcaccagccagctgggagct

SEQ ID NO: 37081 - DNA, 20 bp, synthetic construct
  misc_feature 1..20: note = CRISPR gRNA sequence
  source 1..20: mol_type = other DNA
caccagccagctgggagctg

SEQ ID NO: 37082 - DNA, 20 bp, synthetic construct
  misc_feature 1..20: note = CRISPR gRNA sequence
  source 1..20: mol_type = other DNA
accagccagctgggagctga

SEQ ID NO: 37083 - DNA, 20 bp, synthetic construct
  misc_feature 1..20: note = CRISPR gRNA sequence
  source 1..20: mol_type = other DNA
ccagccagctgggagctgag

SEQ ID NO: 37084 - DNA, 20 bp, synthetic construct
  misc_feature 1..20: note = CRISPR gRNA sequence
  source 1..20: mol_type = other DNA
cagctgggagctgaggggaa

SEQ ID NO: 37085 - DNA, 20 bp, synthetic construct
  misc_feature 1..20: note = CRISPR gRNA sequence
  source 1..20: mol_type = other DNA
ggaaaagccaacctgaatct

SEQ ID NO: 37086 - DNA, 20 bp, synthetic construct
  misc_feature 1..20: note = CRISPR gRNA sequence
  source 1..20: mol_type = other DNA
cctgaatctcagctccacca

SEQ ID NO: 37087 - DNA, 20 bp, synthetic construct
  misc_feature 1..20: note = CRISPR gRNA sequence
  source 1..20: mol_type = other DNA
aatctcagctccaccatggt

SEQ ID NO: 37088 - DNA, 20 bp, synthetic construct
  misc_feature 1..20: note = CRISPR gRNA sequence
  source 1..20: mol_type = other DNA
atctcagctccaccatggtg

SEQ ID NO: 37089 - DNA, 20 bp, synthetic construct
  misc_feature 1..20: note = CRISPR gRNA sequence
  source 1..20: mol_type = other DNA
agctccaccatggtgaggac

SEQ ID NO: 37090 - DNA, 20 bp, synthetic construct
  misc_feature 1..20: note = CRISPR gRNA sequence
  source 1..20: mol_type = other DNA
ctccaccatggtgaggactg

SEQ ID NO: 37091 - DNA, 20 bp, synthetic construct
  misc_feature 1..20: note = CRISPR gRNA sequence
  source 1..20: mol_type = other DNA
accatggtgaggactggagt

SEQ ID NO: 37092 - DNA, 20 bp, synthetic construct
  misc_feature 1..20: note = CRISPR gRNA sequence
  source 1..20: mol_type = other DNA
ccatggtgaggactggagtt

SEQ ID NO: 37093 - DNA, 20 bp, synthetic construct
  misc_feature 1..20: note = CRISPR gRNA sequence
  source 1..20: mol_type = other DNA
catggtgaggactggagttg

SEQ ID NO: 37094 - DNA, 20 bp, synthetic construct
  misc_feature 1..20: note = CRISPR gRNA sequence
  source 1..20: mol_type = other DNA
atggtgaggactggagttgg

SEQ ID NO: 37095 - DNA, 20 bp, synthetic construct
  misc_feature 1..20: note = CRISPR gRNA sequence
  source 1..20: mol_type = other DNA
tggtgaggactggagttggg

SEQ ID NO: 37096 - DNA, 20 bp, synthetic construct
  misc_feature 1..20: note = CRISPR gRNA sequence
  source 1..20: mol_type = other DNA
tgaggactggagttgggggg

SEQ ID NO: 37097 - DNA, 20 bp, synthetic construct
  misc_feature 1..20: note = CRISPR gRNA sequence
  source 1..20: mol_type = other DNA
gaggactggagttggggggt

SEQ ID NO: 37098 - DNA, 20 bp, synthetic construct
  misc_feature 1..20: note = CRISPR gRNA sequence
  source 1..20: mol_type = other DNA
gactggagttggggggtggg

SEQ ID NO: 37099 - DNA, 20 bp, synthetic construct
  misc_feature 1..20: note = CRISPR gRNA sequence
  source 1..20: mol_type = other DNA
actggagttggggggtggga

SEQ ID NO: 37100 - DNA, 20 bp, synthetic construct
  misc_feature 1..20: note = CRISPR gRNA sequence
  source 1..20: mol_type = other DNA
ctggagttggggggtgggaa

SEQ ID NO: 37101 - DNA, 20 bp, synthetic construct
  misc_feature 1..20: note = CRISPR gRNA sequence
  source 1..20: mol_type = other DNA
tggagttggggggtgggaag

SEQ ID NO: 37102 - DNA, 20 bp, synthetic construct
  misc_feature 1..20: note = CRISPR gRNA sequence
  source 1..20: mol_type = other DNA
ggagttggggggtgggaagg

SEQ ID NO: 37103 - DNA, 20 bp, synthetic construct
  misc_feature 1..20: note = CRISPR gRNA sequence
  source 1..20: mol_type = other DNA
gttggggggtgggaaggggg

SEQ ID NO: 37104 - DNA, 20 bp, synthetic construct
  misc_feature 1..20: note = CRISPR gRNA sequence
  source 1..20: mol_type = other DNA
gggggtgggaagggggtggt

SEQ ID NO: 37105 - DNA, 20 bp, synthetic construct
  misc_feature 1..20: note = CRISPR gRNA sequence
  source 1..20: mol_type = other DNA
agggggtggtgagcactgtg

SEQ ID NO: 37106 - DNA, 20 bp, synthetic construct
  misc_feature 1..20: note = CRISPR gRNA sequence
  source 1..20: mol_type = other DNA
actgtgaagtccccacttcc

SEQ ID NO: 37107 - DNA, 20 bp, synthetic construct
  misc_feature 1..20: note = CRISPR gRNA sequence
  source 1..20: mol_type = other DNA
tgaagtccccacttccaagc

SEQ ID NO: 37108 - DNA, 20 bp, synthetic construct
  misc_feature 1..20: note = CRISPR gRNA sequence
  source 1..20: mol_type = other DNA
aagtccccacttccaagctg

SEQ ID NO: 37109 - DNA, 20 bp, synthetic construct
  misc_feature 1..20: note = CRISPR gRNA sequence
  source 1..20: mol_type = other DNA
agtccccacttccaagctgg

SEQ ID NO: 37110 - DNA, 20 bp, synthetic construct
  misc_feature 1..20: note = CRISPR gRNA sequence
  source 1..20: mol_type = other DNA
tccccacttccaagctggag

SEQ ID NO: 37111 - DNA, 20 bp, synthetic construct
  misc_feature 1..20: note = CRISPR gRNA sequence
  source 1..20: mol_type = other DNA
ccccacttccaagctggagg

SEQ ID NO: 37112 - DNA, 20 bp, synthetic construct
  misc_feature 1..20: note = CRISPR gRNA sequence
  source 1..20: mol_type = other DNA
ttccaagctggaggaggctg

SEQ ID NO: 37113 - DNA, 20 bp, synthetic construct
  misc_feature 1..20: note = CRISPR gRNA sequence
  source 1..20: mol_type = other DNA
ccaagctggaggaggctgtg

SEQ ID NO: 37114 - DNA, 20 bp, synthetic construct
  misc_feature 1..20: note = CRISPR gRNA sequence
  source 1..20: mol_type = other DNA
caagctggaggaggctgtgg

SEQ ID NO: 37115 - DNA, 20 bp, synthetic construct
  misc_feature 1..20: note = CRISPR gRNA sequence
  source 1..20: mol_type = other DNA
ggaggaggctgtggaggctg

SEQ ID NO: 37116 - DNA, 20 bp, synthetic construct
  misc_feature 1..20: note = CRISPR gRNA sequence
  source 1..20: mol_type = other DNA
ggaggctgtggaggctgtgg

SEQ ID NO: 37117 - DNA, 20 bp, synthetic construct
  misc_feature 1..20: note = CRISPR gRNA sequence
  source 1..20: mol_type = other DNA
gctgtggaggctgtggtggc

SEQ ID NO: 37118 - DNA, 20 bp, synthetic construct
  misc_feature 1..20: note = CRISPR gRNA sequence
  source 1..20: mol_type = other DNA
gaggctgtggtggctggtca

SEQ ID NO: 37119 - DNA, 20 bp, synthetic construct
  misc_feature 1..20: note = CRISPR gRNA sequence
  source 1..20: mol_type = other DNA
ctggtcacagccatttctca

SEQ ID NO: 37120 - DNA, 20 bp, synthetic construct
  misc_feature 1..20: note = CRISPR gRNA sequence
  source 1..20: mol_type = other DNA
tggtcacagccatttctcat

SEQ ID NO: 37121 - DNA, 20 bp, synthetic construct
  misc_feature 1..20: note = CRISPR gRNA sequence
  source 1..20: mol_type = other DNA
tctgtccctgacccatttgc

SEQ ID NO: 37122 - DNA, 20 bp, synthetic construct
  misc_feature 1..20: note = CRISPR gRNA sequence
  source 1..20: mol_type = other DNA
gacccatttgcaagtgtgtc

SEQ ID NO: 37123 - DNA, 20 bp, synthetic construct
  misc_feature 1..20: note = CRISPR gRNA sequence
  source 1..20: mol_type = other DNA
aagcccctaactgtgtctcc

SEQ ID NO: 37124 - DNA, 20 bp, synthetic construct
  misc_feature 1..20: note = CRISPR gRNA sequence
  source 1..20: mol_type = other DNA
cccagccccacctcctcctg

SEQ ID NO: 37125 - DNA, 20 bp, synthetic construct
  misc_feature 1..20: note = CRISPR gRNA sequence
  source 1..20: mol_type = other DNA
ctcctcctgcagtgactttc

SEQ ID NO: 37126 - DNA, 20 bp, synthetic construct
  misc_feature 1..20: note = CRISPR gRNA sequence
  source 1..20: mol_type = other DNA
tcctcctgcagtgactttca

SEQ ID NO: 37127 - DNA, 20 bp, synthetic construct
  misc_feature 1..20: note = CRISPR gRNA sequence
  source 1..20: mol_type = other DNA
tgcagtgactttcaaggctt

SEQ ID NO: 37128 - DNA, 20 bp, synthetic construct
  misc_feature 1..20: note = CRISPR gRNA sequence
  source 1..20: mol_type = other DNA
ttgtcccgttaccaattcta

SEQ ID NO: 37129 - DNA, 20 bp, synthetic construct
  misc_feature 1..20: note = CRISPR gRNA sequence
  source 1..20: mol_type = other DNA
tgtcccgttaccaattctaa

SEQ ID NO: 37130 - DNA, 20 bp, synthetic construct
  misc_feature 1..20: note = CRISPR gRNA sequence
  source 1..20: mol_type = other DNA
gtcccgttaccaattctaaa

SEQ ID NO: 37131 - DNA, 20 bp, synthetic construct
  misc_feature 1..20: note = CRISPR gRNA sequence
  source 1..20: mol_type = other DNA
caattctaaagggtctaacc

SEQ ID NO: 37132 - DNA, 20 bp, synthetic construct
  misc_feature 1..20: note = CRISPR gRNA sequence
  source 1..20: mol_type = other DNA
gggtctaacctggaacccct

SEQ ID NO: 37133 - DNA, 20 bp, synthetic construct
  misc_feature 1..20: note = CRISPR gRNA sequence
  source 1..20: mol_type = other DNA
ggtctaacctggaacccctc

SEQ ID NO: 37134 - DNA, 20 bp, synthetic construct
  misc_feature 1..20: note = CRISPR gRNA sequence
  source 1..20: mol_type = other DNA
ctaacctggaacccctcagg

SEQ ID NO: 37135 - DNA, 20 bp, synthetic construct
  misc_feature 1..20: note = CRISPR gRNA sequence
  source 1..20: mol_type = other DNA
actttcctgcccgcaacccg

SEQ ID NO: 37136 - DNA, 20 bp, synthetic construct
  misc_feature 1..20: note = CRISPR gRNA sequence
  source 1..20: mol_type = other DNA
ctttcctgcccgcaacccgc

SEQ ID NO: 37137 - DNA, 20 bp, synthetic construct
  misc_feature 1..20: note = CRISPR gRNA sequence
  source 1..20: mol_type = other DNA
tttcctgcccgcaacccgca

SEQ ID NO: 37138 - DNA, 20 bp, synthetic construct
  misc_feature 1..20: note = CRISPR gRNA sequence
  source 1..20: mol_type = other DNA
acccgcagggcctcatctcc

SEQ ID NO: 37139 - DNA, 20 bp, synthetic construct
  misc_feature 1..20: note = CRISPR gRNA sequence
  source 1..20: mol_type = other DNA
ggcctcatctcccagcccca

SEQ ID NO: 37140 - DNA, 20 bp, synthetic construct
  misc_feature 1..20: note = CRISPR gRNA sequence
  source 1..20: mol_type = other DNA
atctcccagccccaaagtgt

SEQ ID NO: 37141 - DNA, 20 bp, synthetic construct
  misc_feature 1..20: note = CRISPR gRNA sequence
  source 1..20: mol_type = other DNA
tctcccagccccaaagtgtc

SEQ ID NO: 37142 - DNA, 20 bp, synthetic construct
  misc_feature 1..20: note = CRISPR gRNA sequence
  source 1..20: mol_type = other DNA
ccccaaagtgtcaggcttca

SEQ ID NO: 37143 - DNA, 20 bp, synthetic construct
  misc_feature 1..20: note = CRISPR gRNA sequence
  source 1..20: mol_type = other DNA
cccaaagtgtcaggcttcat

SEQ ID NO: 37144 - DNA, 20 bp, synthetic construct
  misc_feature 1..20: note = CRISPR gRNA sequence
  source 1..20: mol_type = other DNA
ccaaagtgtcaggcttcatg

SEQ ID NO: 37145 - DNA, 20 bp, synthetic construct
  misc_feature 1..20: note = CRISPR gRNA sequence
  source 1..20: mol_type = other DNA
aagtgtcaggcttcatgggg

SEQ ID NO: 37146 - DNA, 20 bp, synthetic construct
  misc_feature 1..20: note = CRISPR gRNA sequence
  source 1..20: mol_type = other DNA
ccctcccgacttgtacacct

SEQ ID NO: 37147 - DNA, 20 bp, synthetic construct
  misc_feature 1..20: note = CRISPR gRNA sequence
  source 1..20: mol_type = other DNA
ttggacttgacactcaccca

SEQ ID NO: 37148 - DNA, 20 bp, synthetic construct
  misc_feature 1..20: note = CRISPR gRNA sequence
  source 1..20: mol_type = other DNA
tcacccacagctgctgtctt

SEQ ID NO: 37149 - DNA, 20 bp, synthetic construct
  misc_feature 1..20: note = CRISPR gRNA sequence
  source 1..20: mol_type = other DNA
cccacagctgctgtcttcag

SEQ ID NO: 37150 - DNA, 20 bp, synthetic construct
  misc_feature 1..20: note = CRISPR gRNA sequence
  source 1..20: mol_type = other DNA
ccacagctgctgtcttcagc

SEQ ID NO: 37151 - DNA, 20 bp, synthetic construct
  misc_feature 1..20: note = CRISPR gRNA sequence
  source 1..20: mol_type = other DNA
cacagctgctgtcttcagcg

SEQ ID NO: 37152 - DNA, 20 bp, synthetic construct
  misc_feature 1..20: note = CRISPR gRNA sequence
  source 1..20: mol_type = other DNA
acagctgctgtcttcagcgg

SEQ ID NO: 37153 - DNA, 20 bp, synthetic construct
  misc_feature 1..20: note = CRISPR gRNA sequence
  source 1..20: mol_type = other DNA
agctgctgtcttcagcgggg

SEQ ID NO: 37154 - DNA, 20 bp, synthetic construct
  misc_feature 1..20: note = CRISPR gRNA sequence
  source 1..20: mol_type = other DNA
gtcttcagcgggggagcctt

SEQ ID NO: 37155 - DNA, 20 bp, synthetic construct
  misc_feature 1..20: note = CRISPR gRNA sequence
  source 1..20: mol_type = other DNA
agcctttggctgattttctg

SEQ ID NO: 37156 - DNA, 20 bp, synthetic construct
  misc_feature 1..20: note = CRISPR gRNA sequence
  source 1..20: mol_type = other DNA
gcctttggctgattttctga

SEQ ID NO: 37157 - DNA, 20 bp, synthetic construct
  misc_feature 1..20: note = CRISPR gRNA sequence
  source 1..20: mol_type = other DNA
ctttggctgattttctgaag

SEQ ID NO: 37158 - DNA, 20 bp, synthetic construct
  misc_feature 1..20: note = CRISPR gRNA sequence
  source 1..20: mol_type = other DNA
gctgattttctgaaggagct

SEQ ID NO: 37159 - DNA, 20 bp, synthetic construct
  misc_feature 1..20: note = CRISPR gRNA sequence
  source 1..20: mol_type = other DNA
gattttctgaaggagctcgg

SEQ ID NO: 37160 - DNA, 20 bp, synthetic construct
  misc_feature 1..20: note = CRISPR gRNA sequence
  source 1..20: mol_type = other DNA
attttctgaaggagctcgga

SEQ ID NO: 37161 - DNA, 20 bp, synthetic construct
  misc_feature 1..20: note = CRISPR gRNA sequence
  source 1..20: mol_type = other DNA
ttttctgaaggagctcggaa

SEQ ID NO: 37162 - DNA, 20 bp, synthetic construct
  misc_feature 1..20: note = CRISPR gRNA sequence
  source 1..20: mol_type = other DNA
ctgaaggagctcggaagggc

SEQ ID NO: 37163 - DNA, 20 bp, synthetic construct
  misc_feature 1..20: note = CRISPR gRNA sequence
  source 1..20: mol_type = other DNA
aatgaccacctactgattcg

SEQ ID NO: 37164 - DNA, 20 bp, synthetic construct
  misc_feature 1..20: note = CRISPR gRNA sequence
  source 1..20: mol_type = other DNA
atgaccacctactgattcgt

SEQ ID NO: 37165 - DNA, 20 bp, synthetic construct
  misc_feature 1..20: note = CRISPR gRNA sequence
  source 1..20: mol_type = other DNA
cgtgggtcacactttcatct

SEQ ID NO: 37166 - DNA, 20 bp, synthetic construct
  misc_feature 1..20: note = CRISPR gRNA sequence
  source 1..20: mol_type = other DNA
tctcagcaccttgatttcta

SEQ ID NO: 37167 - DNA, 20 bp, synthetic construct
  misc_feature 1..20: note = CRISPR gRNA sequence
  source 1..20: mol_type = other DNA
cagcaccttgatttctacag

SEQ ID NO: 37168 - DNA, 20 bp, synthetic construct
  misc_feature 1..20: note = CRISPR gRNA sequence
  source 1..20: mol_type = other DNA
actttacttatcgctgtgca

SEQ ID NO: 37169 - DNA, 20 bp, synthetic construct
  misc_feature 1..20: note = CRISPR gRNA sequence
  source 1..20: mol_type = other DNA
ttacttatcgctgtgcatgg

SEQ ID NO: 37170 - DNA, 20 bp, synthetic construct
  misc_feature 1..20: note = CRISPR gRNA sequence
  source 1..20: mol_type = other DNA
gtgcatggcagtaatgccaa

SEQ ID NO: 37171 - DNA, 20 bp, synthetic construct
  misc_feature 1..20: note = CRISPR gRNA sequence
  source 1..20: mol_type = other DNA
gaaaacccaccctataacct

SEQ ID NO: 37172 - DNA, 20 bp, synthetic construct
  misc_feature 1..20: note = CRISPR gRNA sequence
  source 1..20: mol_type = other DNA
accctataacctcagctccc

SEQ ID NO: 37173 - DNA, 20 bp, synthetic construct
  misc_feature 1..20: note = CRISPR gRNA sequence
  source 1..20: mol_type = other DNA
ccagtgaatcaaaactgtcc

SEQ ID NO: 37174 - DNA, 20 bp, synthetic construct
  misc_feature 1..20: note = CRISPR gRNA sequence
  source 1..20: mol_type = other DNA
atcaaaactgtccaagtccc

SEQ ID NO: 37175 - DNA, 20 bp, synthetic construct
  misc_feature 1..20: note = CRISPR gRNA sequence
  source 1..20: mol_type = other DNA
tgtccaagtccctggtccaa

SEQ ID NO: 37176 - DNA, 20 bp, synthetic construct
  misc_feature 1..20: note = CRISPR gRNA sequence
  source 1..20: mol_type = other DNA
gtccaagtccctggtccaat

SEQ ID NO: 37177 - DNA, 20 bp, synthetic construct
  misc_feature 1..20: note = CRISPR gRNA sequence
  source 1..20: mol_type = other DNA
tccaataggcccgcatcact

SEQ ID NO: 37178 - DNA, 20 bp, synthetic construct
  misc_feature 1..20: note = CRISPR gRNA sequence
  source 1..20: mol_type = other DNA
ataggcccgcatcactgagc

SEQ ID NO: 37179 - DNA, 20 bp, synthetic construct
  misc_feature 1..20: note = CRISPR gRNA sequence
  source 1..20: mol_type = other DNA
gagctggcatcattatctca

SEQ ID NO: 37180 - DNA, 20 bp, synthetic construct
  misc_feature 1..20: note = CRISPR gRNA sequence
  source 1..20: mol_type = other DNA
cattatctcatggctgtaac

SEQ ID NO: 37181 - DNA, 20 bp, synthetic construct
  misc_feature 1..20: note = CRISPR gRNA sequence
  source 1..20: mol_type = other DNA
aaccagatctgattgatatt

SEQ ID NO: 37182 - DNA, 20 bp, synthetic construct
  misc_feature 1..20: note = CRISPR gRNA sequence
  source 1..20: mol_type = other DNA
agatctgattgatatttggc

SEQ ID NO: 37183 - DNA, 20 bp, synthetic construct
  misc_feature 1..20: note = CRISPR gRNA sequence
  source 1..20: mol_type = other DNA
ctgattgatatttggccagt

SEQ ID NO: 37184 - DNA, 20 bp, synthetic construct
  misc_feature 1..20: note = CRISPR gRNA sequence
  source 1..20: mol_type = other DNA
cagtgagtccctttttaata

SEQ ID NO: 37185 - DNA, 20 bp, synthetic construct
  misc_feature 1..20: note = CRISPR gRNA sequence
  source 1..20: mol_type = other DNA
agtgagtccctttttaatat

SEQ ID NO: 37186 - DNA, 20 bp, synthetic construct
  misc_feature 1..20: note = CRISPR gRNA sequence
  source 1..20: mol_type = other DNA
tttttaatataggatttgtt

SEQ ID NO: 37187 - DNA, 20 bp, synthetic construct
  misc_feature 1..20: note = CRISPR gRNA sequence
  source 1..20: mol_type = other DNA
taggatttgttaagatattg

SEQ ID NO: 37188 - DNA, 20 bp, synthetic construct
  misc_feature 1..20: note = CRISPR gRNA sequence
  source 1..20: mol_type = other DNA
atattgaagtgctctcgaac

SEQ ID NO: 37189 - DNA, 20 bp, synthetic construct
  misc_feature 1..20: note = CRISPR gRNA sequence
  source 1..20: mol_type = other DNA
aagtgctctcgaactggttc

SEQ ID NO: 37190 - DNA, 20 bp, synthetic construct
  misc_feature 1..20: note = CRISPR gRNA sequence
  source 1..20: mol_type = other DNA
tcgaactggttccagcctcc

SEQ ID NO: 37191 - DNA, 20 bp, synthetic construct
  misc_feature 1..20: note = CRISPR gRNA sequence
  source 1..20: mol_type = other DNA
actggttccagcctcctagc

SEQ ID NO: 37192 - DNA, 20 bp, synthetic construct
  misc_feature 1..20: note = CRISPR gRNA sequence
  source 1..20: mol_type = other DNA
ttccagcctcctagctggac

SEQ ID NO: 37193 - DNA, 20 bp, synthetic construct
  misc_feature 1..20: note = CRISPR gRNA sequence
  source 1..20: mol_type = other DNA
tccagcctcctagctggaca

SEQ ID NO: 37194 - DNA, 20 bp, synthetic construct
  misc_feature 1..20: note = CRISPR gRNA sequence
  source 1..20: mol_type = other DNA
cagcctcctagctggacaag

SEQ ID NO: 37195 - DNA, 20 bp, synthetic construct
  misc_feature 1..20: note = CRISPR gRNA sequence
  source 1..20: mol_type = other DNA
tcctagctggacaaggagcc

SEQ ID NO: 37196 - DNA, 20 bp, synthetic construct
  misc_feature 1..20: note = CRISPR gRNA sequence
  source 1..20: mol_type = other DNA
cctagctggacaaggagccc

SEQ ID NO: 37197 - DNA, 20 bp, synthetic construct
  misc_feature 1..20: note = CRISPR gRNA sequence
  source 1..20: mol_type = other DNA
ctagctggacaaggagccca

SEQ ID NO: 37198 - DNA, 20 bp, synthetic construct
  misc_feature 1..20: note = CRISPR gRNA sequence
  source 1..20: mol_type = other DNA
aggagcccagggccctgctc

SEQ ID NO: 37199 - DNA, 20 bp, synthetic construct
  misc_feature 1..20: note = CRISPR gRNA sequence
  source 1..20: mol_type = other DNA
ggagcccagggccctgctcc

SEQ ID NO: 37200 - DNA, 20 bp, synthetic construct
  misc_feature 1..20: note = CRISPR gRNA sequence
  source 1..20: mol_type = other DNA
gagcccagggccctgctcca

SEQ ID NO: 37201 - DNA, 20 bp, synthetic construct
  misc_feature 1..20: note = CRISPR gRNA sequence
  source 1..20: mol_type = other DNA
agcccagggccctgctccag

SEQ ID NO: 37202 - DNA, 20 bp, synthetic construct
  misc_feature 1..20: note = CRISPR gRNA sequence
  source 1..20: mol_type = other DNA
gctccaggggctgttcctat

SEQ ID NO: 37203 - DNA, 20 bp, synthetic construct
  misc_feature 1..20: note = CRISPR gRNA sequence
  source 1..20: mol_type = other DNA
ggctgttcctattggtcact

SEQ ID NO: 37204 - DNA, 20 bp, synthetic construct
  misc_feature 1..20: note = CRISPR gRNA sequence
  source 1..20: mol_type = other DNA
ttcctattggtcacttagct

SEQ ID NO: 37205 - DNA, 20 bp, synthetic construct
  misc_feature 1..20: note = CRISPR gRNA sequence
  source 1..20: mol_type = other DNA
ttggtcacttagcttagctg

SEQ ID NO: 37206 - DNA, 20 bp, synthetic construct
  misc_feature 1..20: note = CRISPR gRNA sequence
  source 1..20: mol_type = other DNA
tggtcacttagcttagctgt

SEQ ID NO: 37207 - DNA, 20 bp, synthetic construct
  misc_feature 1..20: note = CRISPR gRNA sequence
  source 1..20: mol_type = other DNA
gtcacttagcttagctgtag

SEQ ID NO: 37208 - DNA, 20 bp, synthetic construct
  misc_feature 1..20: note = CRISPR gRNA sequence
  source 1..20: mol_type = other DNA
tcacttagcttagctgtagg

SEQ ID NO: 37209 - DNA, 20 bp, synthetic construct
  misc_feature 1..20: note = CRISPR gRNA sequence
  source 1..20: mol_type = other DNA
acttcttaaaattctttcct

SEQ ID NO: 37210 - DNA, 20 bp, synthetic construct
  misc_feature 1..20: note = CRISPR gRNA sequence
  source 1..20: mol_type = other DNA
tttctccctcccttcctttc

SEQ ID NO: 37211 - DNA, 20 bp, synthetic construct
  misc_feature 1..20: note = CRISPR gRNA sequence
  source 1..20: mol_type = other DNA
ttctccctcccttcctttct

SEQ ID NO: 37212 - DNA, 20 bp, synthetic construct
  misc_feature 1..20: note = CRISPR gRNA sequence
  source 1..20: mol_type = other DNA
cttcctttctcaaactcttc

SEQ ID NO: 37213 - DNA, 20 bp, synthetic construct
  misc_feature 1..20: note = CRISPR gRNA sequence
  source 1..20: mol_type = other DNA
ctttctcaaactcttccaga

SEQ ID NO: 37214 - DNA, 20 bp, synthetic construct
  misc_feature 1..20: note = CRISPR gRNA sequence
  source 1..20: mol_type = other DNA
tttctcaaactcttccagaa

SEQ ID NO: 37215 - DNA, 20 bp, synthetic construct
  misc_feature 1..20: note = CRISPR gRNA sequence
  source 1..20: mol_type = other DNA
actcttccagaaaggcatta

SEQ ID NO: 37216 - DNA, 20 bp, synthetic construct
  misc_feature 1..20: note = CRISPR gRNA sequence
  source 1..20: mol_type = other DNA
ttgttgaaaatccatacaat

SEQ ID NO: 37217 - DNA, 20 bp, synthetic construct
  misc_feature 1..20: note = CRISPR gRNA sequence
  source 1..20: mol_type = other DNA
gaaaatccatacaatgagac

SEQ ID NO: 37218 - DNA, 20 bp, synthetic construct
  misc_feature 1..20: note = CRISPR gRNA sequence
  source 1..20: mol_type = other DNA
catacaatgagacaagactc

SEQ ID NO: 37219 - DNA, 20 bp, synthetic construct
  misc_feature 1..20: note = CRISPR gRNA sequence
  source 1..20: mol_type = other DNA
acaagactccagaaactatt

SEQ ID NO: 37220 - DNA, 20 bp, synthetic construct
  misc_feature 1..20: note = CRISPR gRNA sequence
  source 1..20: mol_type = other DNA
caagactccagaaactatta

SEQ ID NO: 37221 - DNA, 20 bp, synthetic construct
  misc_feature 1..20: note = CRISPR gRNA sequence
  source 1..20: mol_type = other DNA
aagactccagaaactattaa

SEQ ID NO: 37222 - DNA, 20 bp, synthetic construct
  misc_feature 1..20: note = CRISPR gRNA sequence
  source 1..20: mol_type = other DNA
actccagaaactattaaggg

SEQ ID NO: 37223 - DNA, 20 bp, synthetic construct
  misc_feature 1..20: note = CRISPR gRNA sequence
  source 1..20: mol_type = other DNA
cagaaactattaagggaagt

SEQ ID NO: 37224 - DNA, 20 bp, synthetic construct
  misc_feature 1..20: note = CRISPR gRNA sequence
  source 1..20: mol_type = other DNA
agaaactattaagggaagtg

SEQ ID NO: 37225 - DNA, 20 bp, synthetic construct
  misc_feature 1..20: note = CRISPR gRNA sequence
  source 1..20: mol_type = other DNA
ttaagggaagtgaggaaatg

SEQ ID NO: 37226 - DNA, 20 bp, synthetic construct
  misc_feature 1..20: note = CRISPR gRNA sequence
  source 1..20: mol_type = other DNA
taagggaagtgaggaaatgt

SEQ ID NO: 37227 - DNA, 20 bp, synthetic construct
  misc_feature 1..20: note = CRISPR gRNA sequence
  source 1..20: mol_type = other DNA
agtgaggaaatgtgggtgat

SEQ ID NO: 37228 - DNA, 20 bp, synthetic construct
  misc_feature 1..20: note = CRISPR gRNA sequence
  source 1..20: mol_type = other DNA
aaatgtgggtgataagaaat

SEQ ID NO: 37229 - DNA, 20 bp, synthetic construct
  misc_feature 1..20: note = CRISPR gRNA sequence
  source 1..20: mol_type = other DNA
aatgtgggtgataagaaatc

SEQ ID NO: 37230 - DNA, 20 bp, synthetic construct
  misc_feature 1..20: note = CRISPR gRNA sequence
  source 1..20: mol_type = other DNA
tcgggatgataaaaccctaa

SEQ ID NO: 37231 - DNA, 20 bp, synthetic construct
  misc_feature 1..20: note = CRISPR gRNA sequence
  source 1..20: mol_type = other DNA
gggatgataaaaccctaaca

SEQ ID NO: 37232 - DNA, 20 bp, synthetic construct
  misc_feature 1..20: note = CRISPR gRNA sequence
  source 1..20: mol_type = other DNA
ggatgataaaaccctaacag

SEQ ID NO: 37233 - DNA, 20 bp, synthetic construct
  misc_feature 1..20: note = CRISPR gRNA sequence
  source 1..20: mol_type = other DNA
atgataaaaccctaacagag

SEQ ID NO: 37234 - DNA, 20 bp, synthetic construct
  misc_feature 1..20: note = CRISPR gRNA sequence
  source 1..20: mol_type = other DNA
tgataaaaccctaacagagg

SEQ ID NO: 37235 - DNA, 20 bp, synthetic construct
  misc_feature 1..20: note = CRISPR gRNA sequence
  source 1..20: mol_type = other DNA
gataaaaccctaacagagga

SEQ ID NO: 37236 - DNA, 20 bp, synthetic construct
  misc_feature 1..20: note = CRISPR gRNA sequence
  source 1..20: mol_type = other DNA
taaaaccctaacagaggagg

SEQ ID NO: 37237 - DNA, 20 bp, synthetic construct
  misc_feature 1..20: note = CRISPR gRNA sequence
  source 1..20: mol_type = other DNA
aaaaccctaacagaggaggg

SEQ ID NO: 37238 - DNA, 20 bp, synthetic construct
  misc_feature 1..20: note = CRISPR gRNA sequence
  source 1..20: mol_type = other DNA
ctaacagaggagggaggttg

SEQ ID NO: 37239 - DNA, 20 bp, synthetic construct
  misc_feature 1..20: note = CRISPR gRNA sequence
  source 1..20: mol_type = other DNA
taacagaggagggaggttgc

SEQ ID NO: 37240 - DNA, 20 bp, synthetic construct
  misc_feature 1..20: note = CRISPR gRNA sequence
  source 1..20: mol_type = other DNA
gaggagggaggttgcaggcc

SEQ ID NO: 37241 - DNA, 20 bp, synthetic construct
  misc_feature 1..20: note = CRISPR gRNA sequence
  source 1..20: mol_type = other DNA
gcaggcctggccaaactcac

SEQ ID NO: 37242 - DNA, 20 bp, synthetic construct
  misc_feature 1..20: note = CRISPR gRNA sequence
  source 1..20: mol_type = other DNA
caggcctggccaaactcact

SEQ ID NO: 37243 - DNA, 20 bp, synthetic construct
  misc_feature 1..20: note = CRISPR gRNA sequence
  source 1..20: mol_type = other DNA
aacttcacttatatgaccac

SEQ ID NO: 37244 - DNA, 20 bp, synthetic construct
  misc_feature 1..20: note = CRISPR gRNA sequence
  source 1..20: mol_type = other DNA
ttcacttatatgaccaccgg

SEQ ID NO: 37245 - DNA, 20 bp, synthetic construct
  misc_feature 1..20: note = CRISPR gRNA sequence
  source 1..20: mol_type = other DNA
atgaccaccggcggcttcca

SEQ ID NO: 37246 - DNA, 20 bp, synthetic construct
  misc_feature 1..20: note = CRISPR gRNA sequence
  source 1..20: mol_type = other DNA
gaccaccggcggcttccata

SEQ ID NO: 37247 - DNA, 20 bp, synthetic construct
  misc_feature 1..20: note = CRISPR gRNA sequence
  source 1..20: mol_type = other DNA
ccggcggcttccatagagct

SEQ ID NO: 37248 - DNA, 20 bp, synthetic construct
  misc_feature 1..20: note = CRISPR gRNA sequence
  source 1..20: mol_type = other DNA
agagcttggtccttccctga

SEQ ID NO: 37249 - DNA, 20 bp, synthetic construct
  misc_feature 1..20: note = CRISPR gRNA sequence
  source 1..20: mol_type = other DNA
cttggtccttccctgatgga

SEQ ID NO: 37250 - DNA, 20 bp, synthetic construct
  misc_feature 1..20: note = CRISPR gRNA sequence
  source 1..20: mol_type = other DNA
gtccttccctgatggacaga

SEQ ID NO: 37251 - DNA, 20 bp, synthetic construct
  misc_feature 1..20: note = CRISPR gRNA sequence
  source 1..20: mol_type = other DNA
ctgatggacagatggccatt

SEQ ID NO: 37252 - DNA, 20 bp, synthetic construct
  misc_feature 1..20: note = CRISPR gRNA sequence
  source 1..20: mol_type = other DNA
acagatggccatttagtgct

SEQ ID NO: 37253 - DNA, 20 bp, synthetic construct
  misc_feature 1..20: note = CRISPR gRNA sequence
  source 1..20: mol_type = other DNA
agatggccatttagtgcttg

SEQ ID NO: 37254 - DNA, 20 bp, synthetic construct
  misc_feature 1..20: note = CRISPR gRNA sequence
  source 1..20: mol_type = other DNA
gccatttagtgcttggagct

SEQ ID NO: 37255 - DNA, 20 bp, synthetic construct
  misc_feature 1..20: note = CRISPR gRNA sequence
  source 1..20: mol_type = other DNA
tgcttggagctgagtgtttc

SEQ ID NO: 37256 - DNA, 20 bp, synthetic construct
  misc_feature 1..20: note = CRISPR gRNA sequence
  source 1..20: mol_type = other DNA
gcttggagctgagtgtttct

SEQ ID NO: 37257 - DNA, 20 bp, synthetic construct
  misc_feature 1..20: note = CRISPR gRNA sequence
  source 1..20: mol_type = other DNA
cttggagctgagtgtttctg

SEQ ID NO: 37258 - DNA, 20 bp, synthetic construct
  misc_feature 1..20: note = CRISPR gRNA sequence
  source 1..20: mol_type = other DNA
ttggagctgagtgtttctgg

SEQ ID NO: 37259 - DNA, 20 bp, synthetic construct
  misc_feature 1..20: note = CRISPR gRNA sequence
  source 1..20: mol_type = other DNA
tgagtgtttctgggggctgc

SEQ ID NO: 37260 - DNA, 20 bp, synthetic construct
  misc_feature 1..20: note = CRISPR gRNA sequence
  source 1..20: mol_type = other DNA
ttctgggggctgctggctgt

SEQ ID NO: 37261 - DNA, 20 bp, synthetic construct
  misc_feature 1..20: note = CRISPR gRNA sequence
  source 1..20: mol_type = other DNA
tggccctgcttcctgcatcc

SEQ ID NO: 37262 - DNA, 20 bp, synthetic construct
  misc_feature 1..20: note = CRISPR gRNA sequence
  source 1..20: mol_type = other DNA
cttcctgcatcctggactgc

SEQ ID NO: 37263 - DNA, 20 bp, synthetic construct
  misc_feature 1..20: note = CRISPR gRNA sequence
  source 1..20: mol_type = other DNA
atcctggactgcaagactgc

SEQ ID NO: 37264 - DNA, 20 bp, synthetic construct
  misc_feature 1..20: note = CRISPR gRNA sequence
  source 1..20: mol_type = other DNA
tcctggactgcaagactgcc

SEQ ID NO: 37265 - DNA, 20 bp, synthetic construct
  misc_feature 1..20: note = CRISPR gRNA sequence
  source 1..20: mol_type = other DNA
gactgcaagactgccaggcc

SEQ ID NO: 37266 - DNA, 20 bp, synthetic construct
  misc_feature 1..20: note = CRISPR gRNA sequence
  source 1..20: mol_type = other DNA
ccagaacatccaccttccaa

SEQ ID NO: 37267 - DNA, 20 bp, synthetic construct
  misc_feature 1..20: note = CRISPR gRNA sequence
  source 1..20: mol_type = other DNA
cagaacatccaccttccaat

SEQ ID NO: 37268 - DNA, 20 bp, synthetic construct
  misc_feature 1..20: note = CRISPR gRNA sequence
  source 1..20: mol_type = other DNA
agaacatccaccttccaatg

SEQ ID NO: 37269 - DNA, 20 bp, synthetic construct
  misc_feature 1..20: note = CRISPR gRNA sequence
  source 1..20: mol_type = other DNA
gaacatccaccttccaatgg

SEQ ID NO: 37270 - DNA, 20 bp, synthetic construct
  misc_feature 1..20: note = CRISPR gRNA sequence
  source 1..20: mol_type = other DNA
caccttccaatgggggtgcc

SEQ ID NO: 37271 - DNA, 20 bp, synthetic construct
  misc_feature 1..20: note = CRISPR gRNA sequence
  source 1..20: mol_type = other DNA
cttccaatgggggtgcctag

SEQ ID NO: 37272 - DNA, 20 bp, synthetic construct
  misc_feature 1..20: note = CRISPR gRNA sequence
  source 1..20: mol_type = other DNA
ctagaagtccactctgcaaa

SEQ ID NO: 37273 - DNA, 20 bp, synthetic construct
  misc_feature 1..20: note = CRISPR gRNA sequence
  source 1..20: mol_type = other DNA
gaagtccactctgcaaatag

SEQ ID NO: 37274 - DNA, 20 bp, synthetic construct
  misc_feature 1..20: note = CRISPR gRNA sequence
  source 1..20: mol_type = other DNA
tccactctgcaaatagaagc

SEQ ID NO: 37275 - DNA, 20 bp, synthetic construct
  misc_feature 1..20: note = CRISPR gRNA sequence
  source 1..20: mol_type = other DNA
aatagaagctggtgttgacc

SEQ ID NO: 37276 - DNA, 20 bp, synthetic construct
  misc_feature 1..20: note = CRISPR gRNA sequence
  source 1..20: mol_type = other DNA
ctgcctgctgcctgcctttc

SEQ ID NO: 37277 - DNA, 20 bp, synthetic construct
  misc_feature 1..20: note = CRISPR gRNA sequence
  source 1..20: mol_type = other DNA
gcctttccagtccctgcatg

SEQ ID NO: 37278 - DNA, 20 bp, synthetic construct
  misc_feature 1..20: note = CRISPR gRNA sequence
  source 1..20: mol_type = other DNA
cctttccagtccctgcatgt

SEQ ID NO: 37279 - DNA, 20 bp, synthetic construct
  misc_feature 1..20: note = CRISPR gRNA sequence
  source 1..20: mol_type = other DNA
tccctgcatgtgggtgtact

SEQ ID NO: 37280 - DNA, 20 bp, synthetic construct
  misc_feature 1..20: note = CRISPR gRNA sequence
  source 1..20: mol_type = other DNA
ggctgcctgccacctgtctg

SEQ ID NO: 37281 - DNA, 20 bp, synthetic construct
  misc_feature 1..20: note = CRISPR gRNA sequence
  source 1..20: mol_type = other DNA
cctgccacctgtctgtggac

SEQ ID NO: 37282 - DNA, 20 bp, synthetic construct
  misc_feature 1..20: note = CRISPR gRNA sequence
  source 1..20: mol_type = other DNA
tgccacctgtctgtggactg

SEQ ID NO: 37283 - DNA, 20 bp, synthetic construct
  misc_feature 1..20: note = CRISPR gRNA sequence
  source 1..20: mol_type = other DNA
ctgtggactggagttcccca

SEQ ID NO: 37284 - DNA, 20 bp, synthetic construct
  misc_feature 1..20: note = CRISPR gRNA sequence
  source 1..20: mol_type = other DNA
tgtggactggagttccccaa

SEQ ID NO: 37285 - DNA, 20 bp, synthetic construct
  misc_feature 1..20: note = CRISPR gRNA sequence
  source 1..20: mol_type = other DNA
ctggagttccccaaaggttc

SEQ ID NO: 37286 - DNA, 20 bp, synthetic construct
  misc_feature 1..20: note = CRISPR gRNA sequence
  source 1..20: mol_type = other DNA
tggagttccccaaaggttct

SEQ ID NO: 37287 - DNA, 20 bp, synthetic construct
  misc_feature 1..20: note = CRISPR gRNA sequence
  source 1..20: mol_type = other DNA
aaaggttctgggtaacccct

SEQ ID NO: 37288 - DNA, 20 bp, synthetic construct
  misc_feature 1..20: note = CRISPR gRNA sequence
  source 1..20: mol_type = other DNA
ttctgggtaacccctcagcc

SEQ ID NO: 37289 - DNA, 20 bp, synthetic construct
  misc_feature 1..20: note = CRISPR gRNA sequence
  source 1..20: mol_type = other DNA
aacccctcagcccagatccc

SEQ ID NO: 37290 - DNA, 20 bp, synthetic construct
  misc_feature 1..20: note = CRISPR gRNA sequence
  source 1..20: mol_type = other DNA
caccccttcctttgcttttt

SEQ ID NO: 37291 - DNA, 20 bp, synthetic construct
  misc_feature 1..20: note = CRISPR gRNA sequence
  source 1..20: mol_type = other DNA
accccttcctttgctttttc

SEQ ID NO: 37292 - DNA, 20 bp, synthetic construct
  misc_feature 1..20: note = CRISPR gRNA sequence
  source 1..20: mol_type = other DNA
cctttgctttttcaggcctg

SEQ ID NO: 37293 - DNA, 20 bp, synthetic construct
  misc_feature 1..20: note = CRISPR gRNA sequence
  source 1..20: mol_type = other DNA
caggcctgaagcgcccacat

SEQ ID NO: 37294 - DNA, 20 bp, synthetic construct
  misc_feature 1..20: note = CRISPR gRNA sequence
  source 1..20: mol_type = other DNA
ggcctgaagcgcccacatca

SEQ ID NO: 37295 - DNA, 20 bp, synthetic construct
  misc_feature 1..20: note = CRISPR gRNA sequence
  source 1..20: mol_type = other DNA
aagcgcccacatcagagctg

SEQ ID NO: 37296 - DNA, 20 bp, synthetic construct
  misc_feature 1..20: note = CRISPR gRNA sequence
  source 1..20: mol_type = other DNA
agcgcccacatcagagctgt

SEQ ID NO: 37297 - DNA, 20 bp, synthetic construct
  misc_feature 1..20: note = CRISPR gRNA sequence
  source 1..20: mol_type = other DNA
gctgtgggtcctcaccccgc

SEQ ID NO: 37298 - DNA, 20 bp, synthetic construct
  misc_feature 1..20: note = CRISPR gRNA sequence
  source 1..20: mol_type = other DNA
gtgggtcctcaccccgccgg

SEQ ID NO: 37299 - DNA, 20 bp, synthetic construct
  misc_feature 1..20: note = CRISPR gRNA sequence
  source 1..20: mol_type = other DNA
ggtcctcaccccgccggaag

SEQ ID NO: 37300 - DNA, 20 bp, synthetic construct
  misc_feature 1..20: note = CRISPR gRNA sequence
  source 1..20: mol_type = other DNA
caccccgccggaagcagtgc

SEQ ID NO: 37301 - DNA, 20 bp, synthetic construct
  misc_feature 1..20: note = CRISPR gRNA sequence
  source 1..20: mol_type = other DNA
cccgccggaagcagtgcaag

SEQ ID NO: 37302 - DNA, 20 bp, synthetic construct
  misc_feature 1..20: note = CRISPR gRNA sequence
  source 1..20: mol_type = other DNA
gccggaagcagtgcaagaag

SEQ ID NO: 37303 - DNA, 20 bp, synthetic construct
  misc_feature 1..20: note = CRISPR gRNA sequence
  source 1..20: mol_type = other DNA
ggaagcagtgcaagaagcag

SEQ ID NO: 37304 - DNA, 20 bp, synthetic construct
  misc_feature 1..20: note = CRISPR gRNA sequence
  source 1..20: mol_type = other DNA
gcagtgcaagaagcagcagc

SEQ ID NO: 37305 - DNA, 20 bp, synthetic construct
  misc_feature 1..20: note = CRISPR gRNA sequence
  source 1..20: mol_type = other DNA
cagtgcaagaagcagcagct

SEQ ID NO: 37306 - DNA, 20 bp, synthetic construct
  misc_feature 1..20: note = CRISPR gRNA sequence
  source 1..20: mol_type = other DNA
tgcaagaagcagcagctagg

SEQ ID NO: 37307 - DNA, 20 bp, synthetic construct
  misc_feature 1..20: note = CRISPR gRNA sequence
  source 1..20: mol_type = other DNA
gcaagaagcagcagctaggt

SEQ ID NO: 37308 - DNA, 20 bp, synthetic construct
  misc_feature 1..20: note = CRISPR gRNA sequence
  source 1..20: mol_type = other DNA
agcagcagctaggtgggtac

SEQ ID NO: 37309 - DNA, 20 bp, synthetic construct
  misc_feature 1..20: note = CRISPR gRNA sequence
  source 1..20: mol_type = other DNA
cagctaggtgggtaccagtg

SEQ ID NO: 37310 - DNA, 20 bp, synthetic construct
  misc_feature 1..20: note = CRISPR gRNA sequence
  source 1..20: mol_type = other DNA
agctaggtgggtaccagtgt

SEQ ID NO: 37311 - DNA, 20 bp, synthetic construct
  misc_feature 1..20: note = CRISPR gRNA sequence
  source 1..20: mol_type = other DNA
gctaggtgggtaccagtgtg

SEQ ID NO: 37312 - DNA, 20 bp, synthetic construct
  misc_feature 1..20: note = CRISPR gRNA sequence
  source 1..20: mol_type = other DNA
taggtgggtaccagtgtggg

SEQ ID NO: 37313 - DNA, 20 bp, synthetic construct
  misc_feature 1..20: note = CRISPR gRNA sequence
  source 1..20: mol_type = other DNA
aggtgggtaccagtgtgggg

SEQ ID NO: 37314 - DNA, 20 bp, synthetic construct
  misc_feature 1..20: note = CRISPR gRNA sequence
  source 1..20: mol_type = other DNA
agtgtggggaggaacataaa

SEQ ID NO: 37315 - DNA, 20 bp, synthetic construct
  misc_feature 1..20: note = CRISPR gRNA sequence
  source 1..20: mol_type = other DNA
tgtggggaggaacataaaca

SEQ ID NO: 37316 - DNA, 20 bp, synthetic construct
  misc_feature 1..20: note = CRISPR gRNA sequence
  source 1..20: mol_type = other DNA
tggggaggaacataaacaga

SEQ ID NO: 37317 - DNA, 20 bp, synthetic construct
  misc_feature 1..20: note = CRISPR gRNA sequence
  source 1..20: mol_type = other DNA
gaggaacataaacagagaga

SEQ ID NO: 37318 - DNA, 20 bp, synthetic construct
  misc_feature 1..20: note = CRISPR gRNA sequence
  source 1..20: mol_type = other DNA
aggaacataaacagagagat

SEQ ID NO: 37319 - DNA, 20 bp, synthetic construct
  misc_feature 1..20: note = CRISPR gRNA sequence
  source 1..20: mol_type = other DNA
ggaacataaacagagagatg

SEQ ID NO: 37320 - DNA, 20 bp, synthetic construct
  misc_feature 1..20: note = CRISPR gRNA sequence
  source 1..20: mol_type = other DNA
aacagagagatggggttgcc

SEQ ID NO: 37321 - DNA, 20 bp, synthetic construct
  misc_feature 1..20: note = CRISPR gRNA sequence
  source 1..20: mol_type = other DNA
acagagagatggggttgcct

SEQ ID NO: 37322 - DNA, 20 bp, synthetic construct
  misc_feature 1..20: note = CRISPR gRNA sequence
  source 1..20: mol_type = other DNA
cagagagatggggttgcctg

SEQ ID NO: 37323 - DNA, 20 bp, synthetic construct
  misc_feature 1..20: note = CRISPR gRNA sequence
  source 1..20: mol_type = other DNA
agagagatggggttgcctgg

SEQ ID NO: 37324 - DNA, 20 bp, synthetic construct
  misc_feature 1..20: note = CRISPR gRNA sequence
  source 1..20: mol_type = other DNA
gatggggttgcctgggggcc

SEQ ID NO: 37325 - DNA, 20 bp, synthetic construct
  misc_feature 1..20: note = CRISPR gRNA sequence
  source 1..20: mol_type = other DNA
gttgcctgggggccaagacc

SEQ ID NO: 37326 - DNA, 20 bp, synthetic construct
  misc_feature 1..20: note = CRISPR gRNA sequence
  source 1..20: mol_type = other DNA
gggggccaagacccggaccc

SEQ ID NO: 37327 - DNA, 20 bp, synthetic construct
  misc_feature 1..20: note = CRISPR gRNA sequence
  source 1..20: mol_type = other DNA
ggaccttgtcccctgccaat

SEQ ID NO: 37328 - DNA, 20 bp, synthetic construct
  misc_feature 1..20: note = CRISPR gRNA sequence
  source 1..20: mol_type = other DNA
gtcccctgccaataagcctc

SEQ ID NO: 37329 - DNA, 20 bp, synthetic construct
  misc_feature 1..20: note = CRISPR gRNA sequence
  source 1..20: mol_type = other DNA
cccctgccaataagcctcca

SEQ ID NO: 37330 - DNA, 20 bp, synthetic construct
  misc_feature 1..20: note = CRISPR gRNA sequence
  source 1..20: mol_type = other DNA
ccctgccaataagcctccag

SEQ ID NO: 37331 - DNA, 20 bp, synthetic construct
  misc_feature 1..20: note = CRISPR gRNA sequence
  source 1..20: mol_type = other DNA
ccaataagcctccagaggcc

SEQ ID NO: 37332 - DNA, 20 bp, synthetic construct
  misc_feature 1..20: note = CRISPR gRNA sequence
  source 1..20: mol_type = other DNA
cccagtgactcttgtctcgc

SEQ ID NO: 37333 - DNA, 20 bp, synthetic construct
  misc_feature 1..20: note = CRISPR gRNA sequence
  source 1..20: mol_type = other DNA
actcttgtctcgcaagtttc

SEQ ID NO: 37334 - DNA, 20 bp, synthetic construct
  misc_feature 1..20: note = CRISPR gRNA sequence
  source 1..20: mol_type = other DNA
ctcttgtctcgcaagtttcc

SEQ ID NO: 37335 - DNA, 20 bp, synthetic construct
  misc_feature 1..20: note = CRISPR gRNA sequence
  source 1..20: mol_type = other DNA
cttgtctcgcaagtttccag

SEQ ID NO: 37336 - DNA, 20 bp, synthetic construct
  misc_feature 1..20: note = CRISPR gRNA sequence
  source 1..20: mol_type = other DNA
ctcgcaagtttccaggagaa

SEQ ID NO: 37337 - DNA, 20 bp, synthetic construct
  misc_feature 1..20: note = CRISPR gRNA sequence
  source 1..20: mol_type = other DNA
tcgcaagtttccaggagaaa

SEQ ID NO: 37338 - DNA, 20 bp, synthetic construct
  misc_feature 1..20: note = CRISPR gRNA sequence
  source 1..20: mol_type = other DNA
agtttccaggagaaaaggac

SEQ ID NO: 37339 - DNA, 20 bp, synthetic construct
  misc_feature 1..20: note = CRISPR gRNA sequence
  source 1..20: mol_type = other DNA
tttccaggagaaaaggactg

SEQ ID NO: 37340 - DNA, 20 bp, synthetic construct
  misc_feature 1..20: note = CRISPR gRNA sequence
  source 1..20: mol_type = other DNA
ttccaggagaaaaggactgg

SEQ ID NO: 37341 - DNA, 20 bp, synthetic construct
  misc_feature 1..20: note = CRISPR gRNA sequence
  source 1..20: mol_type = other DNA
aaaggactggaggtcttgca

SEQ ID NO: 37342 - DNA, 20 bp, synthetic construct
  misc_feature 1..20: note = CRISPR gRNA sequence
  source 1..20: mol_type = other DNA
aaggactggaggtcttgcac

SEQ ID NO: 37343 - DNA, 20 bp, synthetic construct
  misc_feature 1..20: note = CRISPR gRNA sequence
  source 1..20: mol_type = other DNA
gactggaggtcttgcacagg

SEQ ID NO: 37344 - DNA, 20 bp, synthetic construct
  misc_feature 1..20: note = CRISPR gRNA sequence
  source 1..20: mol_type = other DNA
ctggaggtcttgcacaggca

SEQ ID NO: 37345 - DNA, 20 bp, synthetic construct
  misc_feature 1..20: note = CRISPR gRNA sequence
  source 1..20: mol_type = other DNA
tggaggtcttgcacaggcag

SEQ ID NO: 37346 - DNA, 20 bp, synthetic construct
  misc_feature 1..20: note = CRISPR gRNA sequence
  source 1..20: mol_type = other DNA
gaggtcttgcacaggcagag

SEQ ID NO: 37347 - DNA, 20 bp, synthetic construct
  misc_feature 1..20: note = CRISPR gRNA sequence
  source 1..20: mol_type = other DNA
ggtcttgcacaggcagagga

SEQ ID NO: 37348 - DNA, 20 bp, synthetic construct
  misc_feature 1..20: note = CRISPR gRNA sequence
  source 1..20: mol_type = other DNA
gtcttgcacaggcagaggag

SEQ ID NO: 37349 - DNA, 20 bp, synthetic construct
  misc_feature 1..20: note = CRISPR gRNA sequence
  source 1..20: mol_type = other DNA
gcacaggcagaggagaggcc

SEQ ID NO: 37350 - DNA, 20 bp, synthetic construct
  misc_feature 1..20: note = CRISPR gRNA sequence
  source 1..20: mol_type = other DNA
cacaggcagaggagaggcct

SEQ ID NO: 37351 - DNA, 20 bp, synthetic construct
  misc_feature 1..20: note = CRISPR gRNA sequence
  source 1..20: mol_type = other DNA
ggcagaggagaggcctgggc

SEQ ID NO: 37352 - DNA, 20 bp, synthetic construct
  misc_feature 1..20: note = CRISPR gRNA sequence
  source 1..20: mol_type = other DNA
agaggagaggcctgggctgg

SEQ ID NO: 37353 - DNA, 20 bp, synthetic construct
  misc_feature 1..20: note = CRISPR gRNA sequence
  source 1..20: mol_type = other DNA
agaggcctgggctggcagcg

SEQ ID NO: 37354 - DNA, 20 bp, synthetic construct
  misc_feature 1..20: note = CRISPR gRNA sequence
  source 1..20: mol_type = other DNA
gaggcctgggctggcagcga

SEQ ID NO: 37355 - DNA, 20 bp, synthetic construct
  misc_feature 1..20: note = CRISPR gRNA sequence
  source 1..20: mol_type = other DNA
aggcctgggctggcagcgaa

SEQ ID NO: 37356 - DNA, 20 bp, synthetic construct
  misc_feature 1..20: note = CRISPR gRNA sequence
  source 1..20: mol_type = other DNA
ggcctgggctggcagcgaag

SEQ ID NO: 37357 - DNA, 20 bp, synthetic construct
  misc_feature 1..20: note = CRISPR gRNA sequence
  source 1..20: mol_type = other DNA
gaaggggctccccacccatc

SEQ ID NO: 37358 - DNA, 20 bp, synthetic construct
  misc_feature 1..20: note = CRISPR gRNA sequence
  source 1..20: mol_type = other DNA
tccccacccatctggctgca

SEQ ID NO: 37359 - DNA, 20 bp, synthetic construct
  misc_feature 1..20: note = CRISPR gRNA sequence
  source 1..20: mol_type = other DNA
ccccacccatctggctgcat

SEQ ID NO: 37360 - DNA, 20 bp, synthetic construct
  misc_feature 1..20: note = CRISPR gRNA sequence
  source 1..20: mol_type = other DNA
cccacccatctggctgcatg

SEQ ID NO: 37361 - DNA, 20 bp, synthetic construct
  misc_feature 1..20: note = CRISPR gRNA sequence
  source 1..20: mol_type = other DNA
gctgcatggggacttctctg

SEQ ID NO: 37362 - DNA, 20 bp, synthetic construct
  misc_feature 1..20: note = CRISPR gRNA sequence
  source 1..20: mol_type = other DNA
tgcatggggacttctctgaa

SEQ ID NO: 37363 - DNA, 20 bp, synthetic construct
  misc_feature 1..20: note = CRISPR gRNA sequence
  source 1..20: mol_type = other DNA
gcatggggacttctctgaag

SEQ ID NO: 37364 - DNA, 20 bp, synthetic construct
  misc_feature 1..20: note = CRISPR gRNA sequence
  source 1..20: mol_type = other DNA
catggggacttctctgaaga

SEQ ID NO: 37365 - DNA, 20 bp, synthetic construct
  misc_feature 1..20: note = CRISPR gRNA sequence
  source 1..20: mol_type = other DNA
ctctgaagagggctccgctg

SEQ ID NO: 37366 - DNA, 20 bp, synthetic construct
  misc_feature 1..20: note = CRISPR gRNA sequence
  source 1..20: mol_type = other DNA
tctgaagagggctccgctga

SEQ ID NO: 37367 - DNA, 20 bp, synthetic construct
  misc_feature 1..20: note = CRISPR gRNA sequence
  source 1..20: mol_type = other DNA
tgaagagggctccgctgaag

SEQ ID NO: 37368 - DNA, 20 bp, synthetic construct
  misc_feature 1..20: note = CRISPR gRNA sequence
  source 1..20: mol_type = other DNA
gagggctccgctgaaggagc

SEQ ID NO: 37369 - DNA, 20 bp, synthetic construct
  misc_feature 1..20: note = CRISPR gRNA sequence
  source 1..20: mol_type = other DNA
ggctccgctgaaggagctgg

SEQ ID NO: 37370 - DNA, 20 bp, synthetic construct
  misc_feature 1..20: note = CRISPR gRNA sequence
  source 1..20: mol_type = other DNA
aaggagctggaagcaccata

SEQ ID NO: 37371 - DNA, 20 bp, synthetic construct
  misc_feature 1..20: note = CRISPR gRNA sequence
  source 1..20: mol_type = other DNA
aggagctggaagcaccatac

SEQ ID NO: 37372 - DNA, 20 bp, synthetic construct
  misc_feature 1..20: note = CRISPR gRNA sequence
  source 1..20: mol_type = other DNA
tggaagcaccatacaggtct

SEQ ID NO: 37373 - DNA, 20 bp, synthetic construct
  misc_feature 1..20: note = CRISPR gRNA sequence
  source 1..20: mol_type = other DNA
caggtctcagcttcgctgtc

SEQ ID NO: 37374 - DNA, 20 bp, synthetic construct
  misc_feature 1..20: note = CRISPR gRNA sequence
  source 1..20: mol_type = other DNA
aggtctcagcttcgctgtcc

SEQ ID NO: 37375 - DNA, 20 bp, synthetic construct
  misc_feature 1..20: note = CRISPR gRNA sequence
  source 1..20: mol_type = other DNA
cttcgctgtccaggcttttc

SEQ ID NO: 37376 - DNA, 20 bp, synthetic construct
  misc_feature 1..20: note = CRISPR gRNA sequence
  source 1..20: mol_type = other DNA
ttcgctgtccaggcttttcc

SEQ ID NO: 37377 - DNA, 20 bp, synthetic construct
  misc_feature 1..20: note = CRISPR gRNA sequence
  source 1..20: mol_type = other DNA
tcgctgtccaggcttttcca

SEQ ID NO: 37378 - DNA, 20 bp, synthetic construct
  misc_feature 1..20: note = CRISPR gRNA sequence
  source 1..20: mol_type = other DNA
ccagggacaccctatgtcct

SEQ ID NO: 37379 - DNA, 20 bp, synthetic construct
  misc_feature 1..20: note = CRISPR gRNA sequence
  source 1..20: mol_type = other DNA
accctatgtcctcagtgttg

SEQ ID NO: 37380 - DNA, 20 bp, synthetic construct
  misc_feature 1..20: note = CRISPR gRNA sequence
  source 1..20: mol_type = other DNA
ccctatgtcctcagtgttga

SEQ ID NO: 37381 - DNA, 20 bp, synthetic construct
  misc_feature 1..20: note = CRISPR gRNA sequence
  source 1..20: mol_type = other DNA
ctatgtcctcagtgttgaag

SEQ ID NO: 37382 - DNA, 20 bp, synthetic construct
  misc_feature 1..20: note = CRISPR gRNA sequence
  source 1..20: mol_type = other DNA
cctcagtgttgaaggagacc

SEQ ID NO: 37383 - DNA, 20 bp, synthetic construct
  misc_feature 1..20: note = CRISPR gRNA sequence
  source 1..20: mol_type = other DNA
ctcagtgttgaaggagaccc

SEQ ID NO: 37384 - DNA, 20 bp, synthetic construct
  misc_feature 1..20: note = CRISPR gRNA sequence
  source 1..20: mol_type = other DNA
tcagtgttgaaggagaccca

SEQ ID NO: 37385 - DNA, 20 bp, synthetic construct
  misc_feature 1..20: note = CRISPR gRNA sequence
  source 1..20: mol_type = other DNA
agtgttgaaggagacccagg

SEQ ID NO: 37386 - DNA, 20 bp, synthetic construct
  misc_feature 1..20: note = CRISPR gRNA sequence
  source 1..20: mol_type = other DNA
gtgttgaaggagacccaggg

SEQ ID NO: 37387 - DNA, 20 bp, synthetic construct
  misc_feature 1..20: note = CRISPR gRNA sequence
  source 1..20: mol_type = other DNA
gttgaaggagacccagggag

SEQ ID NO: 37388 - DNA, 20 bp, synthetic construct
  misc_feature 1..20: note = CRISPR gRNA sequence
  source 1..20: mol_type = other DNA
aggagacccagggaggagac

SEQ ID NO: 37389 - DNA, 20 bp, synthetic construct
  misc_feature 1..20: note = CRISPR gRNA sequence
  source 1..20: mol_type = other DNA
acccagggaggagaccagtt

SEQ ID NO: 37390 - DNA, 20 bp, synthetic construct
  misc_feature 1..20: note = CRISPR gRNA sequence
  source 1..20: mol_type = other DNA
cccagggaggagaccagttt

SEQ ID NO: 37391 - DNA, 20 bp, synthetic construct
  misc_feature 1..20: note = CRISPR gRNA sequence
  source 1..20: mol_type = other DNA
ccagggaggagaccagtttg

SEQ ID NO: 37392 - DNA, 20 bp, synthetic construct
  misc_feature 1..20: note = CRISPR gRNA sequence
  source 1..20: mol_type = other DNA
cagggaggagaccagtttgg

SEQ ID NO: 37393 - DNA, 20 bp, synthetic construct
  misc_feature 1..20: note = CRISPR gRNA sequence
  source 1..20: mol_type = other DNA
gaggagaccagtttgggggt

SEQ ID NO: 37394 - DNA, 20 bp, synthetic construct
  misc_feature 1..20: note = CRISPR gRNA sequence
  source 1..20: mol_type = other DNA
gagaccagtttgggggtgag

SEQ ID NO: 37395 - DNA, 20 bp, synthetic construct
  misc_feature 1..20: note = CRISPR gRNA sequence
  source 1..20: mol_type = other DNA
agaccagtttgggggtgagc

SEQ ID NO: 37396 - DNA, 20 bp, synthetic construct
  misc_feature 1..20: note = CRISPR gRNA sequence
  source 1..20: mol_type = other DNA
gaccagtttgggggtgagca

SEQ ID NO: 37397 - DNA, 20 bp, synthetic construct
  misc_feature 1..20: note = CRISPR gRNA sequence
  source 1..20: mol_type = other DNA
agtttgggggtgagcaggga

SEQ ID NO: 37398 - DNA, 20 bp, synthetic construct
  misc_feature 1..20: note = CRISPR gRNA sequence
  source 1..20: mol_type = other DNA
gtttgggggtgagcagggat

SEQ ID NO: 37399 - DNA, 20 bp, synthetic construct
  misc_feature 1..20: note = CRISPR gRNA sequence
  source 1..20: mol_type = other DNA
tttgggggtgagcagggatg

SEQ ID NO: 37400 - DNA, 20 bp, synthetic construct
  misc_feature 1..20: note = CRISPR gRNA sequence
  source 1..20: mol_type = other DNA
tgggggtgagcagggatggg

SEQ ID NO: 37401 - DNA, 20 bp, synthetic construct
  misc_feature 1..20: note = CRISPR gRNA sequence
  source 1..20: mol_type = other DNA
gggggtgagcagggatgggg

SEQ ID NO: 37402 - DNA, 20 bp, synthetic construct
  misc_feature 1..20: note = CRISPR gRNA sequence
  source 1..20: mol_type = other DNA
ggggtgagcagggatgggga

SEQ ID NO: 37403 - DNA, 20 bp, synthetic construct
  misc_feature 1..20: note = CRISPR gRNA sequence
  source 1..20: mol_type = other DNA
gggtgagcagggatggggag

SEQ ID NO: 37404 - DNA, 20 bp, synthetic construct
  misc_feature 1..20: note = CRISPR gRNA sequence
  source 1..20: mol_type = other DNA
gagcagggatggggaggggt

SEQ ID NO: 37405 - DNA, 20 bp, synthetic construct
  misc_feature 1..20: note = CRISPR gRNA sequence
  source 1..20: mol_type = other DNA
agcagggatggggaggggtg

SEQ ID NO: 37406 - DNA, 20 bp, synthetic construct
  misc_feature 1..20: note = CRISPR gRNA sequence
  source 1..20: mol_type = other DNA
cagggatggggaggggtgag

SEQ ID NO: 37407 - DNA, 20 bp, synthetic construct
  misc_feature 1..20: note = CRISPR gRNA sequence
  source 1..20: mol_type = other DNA
agggatggggaggggtgagg

SEQ ID NO: 37408 - DNA, 20 bp, synthetic construct
  misc_feature 1..20: note = CRISPR gRNA sequence
  source 1..20: mol_type = other DNA
tggggaggggtgaggaggcc

SEQ ID NO: 37409 - DNA, 20 bp, synthetic construct
  misc_feature 1..20: note = CRISPR gRNA sequence
  source 1..20: mol_type = other DNA
ggggaggggtgaggaggcct

SEQ ID NO: 37410 - DNA, 20 bp, synthetic construct
  misc_feature 1..20: note = CRISPR gRNA sequence
  source 1..20: mol_type = other DNA
ggaggggtgaggaggcctgg

SEQ ID NO: 37411 - DNA, 20 bp, synthetic construct
  misc_feature 1..20: note = CRISPR gRNA sequence
  source 1..20: mol_type = other DNA
gaggcctgggagaaaccttc

SEQ ID NO: 37412 - DNA, 20 bp, synthetic construct
  misc_feature 1..20: note = CRISPR gRNA sequence
  source 1..20: mol_type = other DNA
cctgggagaaaccttcaaga

SEQ ID NO: 37413 - DNA, 20 bp, synthetic construct
  misc_feature 1..20: note = CRISPR gRNA sequence
  source 1..20: mol_type = other DNA
tgggagaaaccttcaagaca

SEQ ID NO: 37414 - DNA, 20 bp, synthetic construct
  misc_feature 1..20: note = CRISPR gRNA sequence
  source 1..20: mol_type = other DNA
gggagaaaccttcaagacag

SEQ ID NO: 37415 - DNA, 20 bp, synthetic construct
  misc_feature 1..20: note = CRISPR gRNA sequence
  source 1..20: mol_type = other DNA
aaccttcaagacagaggccc

SEQ ID NO: 37416 - DNA, 20 bp, synthetic construct
  misc_feature 1..20: note = CRISPR gRNA sequence
  source 1..20: mol_type = other DNA
accttcaagacagaggccct

SEQ ID NO: 37417 - DNA, 20 bp, synthetic construct
  misc_feature 1..20: note = CRISPR gRNA sequence
  source 1..20: mol_type = other DNA
ccttcaagacagaggccctg

SEQ ID NO: 37418 - DNA, 20 bp, synthetic construct
  misc_feature 1..20: note = CRISPR gRNA sequence
  source 1..20: mol_type = other DNA
cttcaagacagaggccctgg

SEQ ID NO: 37419 - DNA, 20 bp, synthetic construct
  misc_feature 1..20: note = CRISPR gRNA sequence
  source 1..20: mol_type = other DNA
acagaggccctgggggccca

SEQ ID NO: 37420 - DNA, 20 bp, synthetic construct
  misc_feature 1..20: note = CRISPR gRNA sequence
  source 1..20: mol_type = other DNA
cagaggccctgggggcccat

SEQ ID NO: 37421 - DNA, 20 bp, synthetic construct
  misc_feature 1..20: note = CRISPR gRNA sequence
  source 1..20: mol_type = other DNA
agaggccctgggggcccatg

SEQ ID NO: 37422 - DNA, 20 bp, synthetic construct
  misc_feature 1..20: note = CRISPR gRNA sequence
  source 1..20: mol_type = other DNA
aggccctgggggcccatggg

SEQ ID NO: 37423 - DNA, 20 bp, synthetic construct
  misc_feature 1..20: note = CRISPR gRNA sequence
  source 1..20: mol_type = other DNA
tgggggcccatggggagaca

SEQ ID NO: 37424 - DNA, 20 bp, synthetic construct
  misc_feature 1..20: note = CRISPR gRNA sequence
  source 1..20: mol_type = other DNA
ggggcccatggggagacatg

SEQ ID NO: 37425 - DNA, 20 bp, synthetic construct
  misc_feature 1..20: note = CRISPR gRNA sequence
  source 1..20: mol_type = other DNA
tggggagacatggagctgct

SEQ ID NO: 37426 - DNA, 20 bp, synthetic construct
  misc_feature 1..20: note = CRISPR gRNA sequence
  source 1..20: mol_type = other DNA
ggggagacatggagctgctt

SEQ ID NO: 37427 - DNA, 20 bp, synthetic construct
  misc_feature 1..20: note = CRISPR gRNA sequence
  source 1..20: mol_type = other DNA
gggagacatggagctgctta

SEQ ID NO: 37428 - DNA, 20 bp, synthetic construct
  misc_feature 1..20: note = CRISPR gRNA sequence
  source 1..20: mol_type = other DNA
agacatggagctgcttaggg

SEQ ID NO: 37429 - DNA, 20 bp, synthetic construct
  misc_feature 1..20: note = CRISPR gRNA sequence
  source 1..20: mol_type = other DNA
gacatggagctgcttagggc

SEQ ID NO: 37430 - DNA, 20 bp, synthetic construct
  misc_feature 1..20: note = CRISPR gRNA sequence
  source 1..20: mol_type = other DNA
tggagctgcttagggcaggc

SEQ ID NO: 37431 - DNA, 20 bp, synthetic construct
  misc_feature 1..20: note = CRISPR gRNA sequence
  source 1..20: mol_type = other DNA
ggagctgcttagggcaggcc

SEQ ID NO: 37432 - DNA, 20 bp, synthetic construct
  misc_feature 1..20: note = CRISPR gRNA sequence
  source 1..20: mol_type = other DNA
ctgcttagggcaggccaggc

SEQ ID NO: 37433 - DNA, 20 bp, synthetic construct
  misc_feature 1..20: note = CRISPR gRNA sequence
  source 1..20: mol_type = other DNA
ttagggcaggccaggccagt

SEQ ID NO: 37434 - DNA, 20 bp, synthetic construct
  misc_feature 1..20: note = CRISPR gRNA sequence
  source 1..20: mol_type = other DNA
agggcaggccaggccagtga

SEQ ID NO: 37435 - DNA, 20 bp, synthetic construct
  misc_feature 1..20: note = CRISPR gRNA sequence
  source 1..20: mol_type = other DNA
gcaggccaggccagtgagag

SEQ ID NO: 37436 - DNA, 20 bp, synthetic construct
  misc_feature 1..20: note = CRISPR gRNA sequence
  source 1..20: mol_type = other DNA
gccaggccagtgagagaaga

SEQ ID NO: 37437 - DNA, 20 bp, synthetic construct
  misc_feature 1..20: note = CRISPR gRNA sequence
  source 1..20: mol_type = other DNA
ccaggccagtgagagaagaa

SEQ ID NO: 37438 - DNA, 20 bp, synthetic construct
  misc_feature 1..20: note = CRISPR gRNA sequence
  source 1..20: mol_type = other DNA
caggccagtgagagaagaaa

SEQ ID NO: 37439 - DNA, 20 bp, synthetic construct
  misc_feature 1..20: note = CRISPR gRNA sequence
  source 1..20: mol_type = other DNA
aggccagtgagagaagaaag

SEQ ID NO: 37440 - DNA, 20 bp, synthetic construct
  misc_feature 1..20: note = CRISPR gRNA sequence
  source 1..20: mol_type = other DNA
ggacttctctcattcttgac

SEQ ID NO: 37441 - DNA, 20 bp, synthetic construct
  misc_feature 1..20: note = CRISPR gRNA sequence
  source 1..20: mol_type = other DNA
tctcattcttgaccagttct

SEQ ID NO: 37442 - DNA, 20 bp, synthetic construct
  misc_feature 1..20: note = CRISPR gRNA sequence
  source 1..20: mol_type = other DNA
ttcttgaccagttctcagaa

SEQ ID NO: 37443 - DNA, 20 bp, synthetic construct
  misc_feature 1..20: note = CRISPR gRNA sequence
  source 1..20: mol_type = other DNA
gaatggtcctcgttctccac

SEQ ID NO: 37444 - DNA, 20 bp, synthetic construct
  misc_feature 1..20: note = CRISPR gRNA sequence
  source 1..20: mol_type = other DNA
ccacgagttgtcccactaac

SEQ ID NO: 37445 - DNA, 20 bp, synthetic construct
  misc_feature 1..20: note = CRISPR gRNA sequence
  source 1..20: mol_type = other DNA
acgagttgtcccactaacta

SEQ ID NO: 37446 - DNA, 20 bp, synthetic construct
  misc_feature 1..20: note = CRISPR gRNA sequence
  source 1..20: mol_type = other DNA
gcccccactgctgccaacca

SEQ ID NO: 37447 - DNA, 20 bp, synthetic construct
  misc_feature 1..20: note = CRISPR gRNA sequence
  source 1..20: mol_type = other DNA
ctgccaaccatggctataac

SEQ ID NO: 37448 - DNA, 20 bp, synthetic construct
  misc_feature 1..20: note = CRISPR gRNA sequence
  source 1..20: mol_type = other DNA
gccaaccatggctataacca

SEQ ID NO: 37449 - DNA, 20 bp, synthetic construct
  misc_feature 1..20: note = CRISPR gRNA sequence
  source 1..20: mol_type = other DNA
ccaaccatggctataaccag

SEQ ID NO: 37450 - DNA, 20 bp, synthetic construct
  misc_feature 1..20: note = CRISPR gRNA sequence
  source 1..20: mol_type = other DNA
ggattcacatccgctcaaaa

SEQ ID NO: 37451 - DNA, 20 bp, synthetic construct
  misc_feature 1..20: note = CRISPR gRNA sequence
  source 1..20: mol_type = other DNA
ctcaaaatagttcactacct

SEQ ID NO: 37452 - DNA, 20 bp, synthetic construct
  misc_feature 1..20: note = CRISPR gRNA sequence
  source 1..20: mol_type = other DNA
actaccttggcctttcccca

SEQ ID NO: 37453 - DNA, 20 bp, synthetic construct
  misc_feature 1..20: note = CRISPR gRNA sequence
  source 1..20: mol_type = other DNA
ctaccttggcctttccccat

SEQ ID NO: 37454 - DNA, 20 bp, synthetic construct
  misc_feature 1..20: note = CRISPR gRNA sequence
  source 1..20: mol_type = other DNA
taccttggcctttccccata

SEQ ID NO: 37455 - DNA, 20 bp, synthetic construct
  misc_feature 1..20: note = CRISPR gRNA sequence
  source 1..20: mol_type = other DNA
tccccatagggttcccccaa

SEQ ID NO: 37456 - DNA, 20 bp, synthetic construct
  misc_feature 1..20: note = CRISPR gRNA sequence
  source 1..20: mol_type = other DNA
ccatagggttcccccaaaag

SEQ ID NO: 37457 - DNA, 20 bp, synthetic construct
  misc_feature 1..20: note = CRISPR gRNA sequence
  source 1..20: mol_type = other DNA
ggttcccccaaaagcagccc

SEQ ID NO: 37458 - DNA, 20 bp, synthetic construct
  misc_feature 1..20: note = CRISPR gRNA sequence
  source 1..20: mol_type = other DNA
agcagccccagccctttccc

SEQ ID NO: 37459 - DNA, 20 bp, synthetic construct
  misc_feature 1..20: note = CRISPR gRNA sequence
  source 1..20: mol_type = other DNA
gcagccccagccctttccct

SEQ ID NO: 37460 - DNA, 20 bp, synthetic construct
  misc_feature 1..20: note = CRISPR gRNA sequence
  source 1..20: mol_type = other DNA
gccctttccctgggtcacct

SEQ ID NO: 37461 - DNA, 20 bp, synthetic construct
  misc_feature 1..20: note = CRISPR gRNA sequence
  source 1..20: mol_type = other DNA
cctgagacctctcaatgacc

SEQ ID NO: 37462 - DNA, 20 bp, synthetic construct
  misc_feature 1..20: note = CRISPR gRNA sequence
  source 1..20: mol_type = other DNA
ctgagacctctcaatgaccc

SEQ ID NO: 37463 - DNA, 20 bp, synthetic construct
  misc_feature 1..20: note = CRISPR gRNA sequence
  source 1..20: mol_type = other DNA
ctcaatgacccaggaattaa

SEQ ID NO: 37464 - DNA, 20 bp, synthetic construct
  misc_feature 1..20: note = CRISPR gRNA sequence
  source 1..20: mol_type = other DNA
tcaatgacccaggaattaaa

SEQ ID NO: 37465 - DNA, 20 bp, synthetic construct
  misc_feature 1..20: note = CRISPR gRNA sequence
  source 1..20: mol_type = other DNA
ggaattaaaaggttaacatc

SEQ ID NO: 37466 - DNA, 20 bp, synthetic construct
  misc_feature 1..20: note = CRISPR gRNA sequence
  source 1..20: mol_type = other DNA
aaggttaacatctggcactg

SEQ ID NO: 37467 - DNA, 20 bp, synthetic construct
  misc_feature 1..20: note = CRISPR gRNA sequence
  source 1..20: mol_type = other DNA
aggttaacatctggcactgt

SEQ ID NO: 37468 - DNA, 20 bp, synthetic construct
  misc_feature 1..20: note = CRISPR gRNA sequence
  source 1..20: mol_type = other DNA
ggttaacatctggcactgta

SEQ ID NO: 37469 - DNA, 20 bp, synthetic construct
  misc_feature 1..20: note = CRISPR gRNA sequence
  source 1..20: mol_type = other DNA
gttaacatctggcactgtag

SEQ ID NO: 37470 - DNA, 20 bp, synthetic construct
  misc_feature 1..20: note = CRISPR gRNA sequence
  source 1..20: mol_type = other DNA
catctggcactgtaggggcc

SEQ ID NO: 37471 - DNA, 20 bp, synthetic construct
  misc_feature 1..20: note = CRISPR gRNA sequence
  source 1..20: mol_type = other DNA
ctgtaggggcccagctccca

SEQ ID NO: 37472 - DNA, 20 bp, synthetic construct
  misc_feature 1..20: note = CRISPR gRNA sequence
  source 1..20: mol_type = other DNA
ccagctcccacagttccgat

SEQ ID NO: 37473 - DNA, 20 bp, synthetic construct
  misc_feature 1..20: note = CRISPR gRNA sequence
  source 1..20: mol_type = other DNA
cagttccgatcggtaatgcc

SEQ ID NO: 37474 - DNA, 20 bp, synthetic construct
  misc_feature 1..20: note = CRISPR gRNA sequence
  source 1..20: mol_type = other DNA
agttccgatcggtaatgcct

SEQ ID NO: 37475 - DNA, 20 bp, synthetic construct
  misc_feature 1..20: note = CRISPR gRNA sequence
  source 1..20: mol_type = other DNA
atcggtaatgcctaggccta

SEQ ID NO: 37476 - DNA, 20 bp, synthetic construct
  misc_feature 1..20: note = CRISPR gRNA sequence
  source 1..20: mol_type = other DNA
tcggtaatgcctaggcctac

SEQ ID NO: 37477 - DNA, 20 bp, synthetic construct
  misc_feature 1..20: note = CRISPR gRNA sequence
  source 1..20: mol_type = other DNA
tgcctaggcctacaggttgt

SEQ ID NO: 37478 - DNA, 20 bp, synthetic construct
  misc_feature 1..20: note = CRISPR gRNA sequence
  source 1..20: mol_type = other DNA
aggttgttagtgctcacccc

SEQ ID NO: 37479 - DNA, 20 bp, synthetic construct
  misc_feature 1..20: note = CRISPR gRNA sequence
  source 1..20: mol_type = other DNA
ggttgttagtgctcacccct

SEQ ID NO: 37480 - DNA, 20 bp, synthetic construct
  misc_feature 1..20: note = CRISPR gRNA sequence
  source 1..20: mol_type = other DNA
gtgctcacccctgggcattg

SEQ ID NO: 37481 - DNA, 20 bp, synthetic construct
  misc_feature 1..20: note = CRISPR gRNA sequence
  source 1..20: mol_type = other DNA
gcattgcagaactgaaatat

SEQ ID NO: 37482 - DNA, 20 bp, synthetic construct
  misc_feature 1..20: note = CRISPR gRNA sequence
  source 1..20: mol_type = other DNA
cattgcagaactgaaatatt

SEQ ID NO: 37483 - DNA, 20 bp, synthetic construct
  misc_feature 1..20: note = CRISPR gRNA sequence
  source 1..20: mol_type = other DNA
tgcagaactgaaatattggg

SEQ ID NO: 37484 - DNA, 20 bp, synthetic construct
  misc_feature 1..20: note = CRISPR gRNA sequence
  source 1..20: mol_type = other DNA
cagaactgaaatattgggaa

SEQ ID NO: 37485 - DNA, 20 bp, synthetic construct
  misc_feature 1..20: note = CRISPR gRNA sequence
  source 1..20: mol_type = other DNA
agaactgaaatattgggaag

SEQ ID NO: 37486 - DNA, 20 bp, synthetic construct
  misc_feature 1..20: note = CRISPR gRNA sequence
  source 1..20: mol_type = other DNA
gaaatattgggaagaggcac

SEQ ID NO: 37487 - DNA, 20 bp, synthetic construct
  misc_feature 1..20: note = CRISPR gRNA sequence
  source 1..20: mol_type = other DNA
aaatattgggaagaggcact

SEQ ID NO: 37488 - DNA, 20 bp, synthetic construct
  misc_feature 1..20: note = CRISPR gRNA sequence
  source 1..20: mol_type = other DNA
aatattgggaagaggcactg

SEQ ID NO: 37489 - DNA, 20 bp, synthetic construct
  misc_feature 1..20: note = CRISPR gRNA sequence
  source 1..20: mol_type = other DNA
gggaagaggcactggggatc

SEQ ID NO: 37490 - DNA, 20 bp, synthetic construct
  misc_feature 1..20: note = CRISPR gRNA sequence
  source 1..20: mol_type = other DNA
cactggggatccagatatta

SEQ ID NO: 37491 - DNA, 20 bp, synthetic construct
  misc_feature 1..20: note = CRISPR gRNA sequence
  source 1..20: mol_type = other DNA
ggggatccagatattacaga

SEQ ID NO: 37492 - DNA, 20 bp, synthetic construct
  misc_feature 1..20: note = CRISPR gRNA sequence
  source 1..20: mol_type = other DNA
ggatccagatattacagaaa

SEQ ID NO: 37493 - DNA, 20 bp, synthetic construct
  misc_feature 1..20: note = CRISPR gRNA sequence
  source 1..20: mol_type = other DNA
gatccagatattacagaaag

SEQ ID NO: 37494 - DNA, 20 bp, synthetic construct
  misc_feature 1..20: note = CRISPR gRNA sequence
  source 1..20: mol_type = other DNA
cagaaagaggttgtttcaat

SEQ ID NO: 37495 - DNA, 20 bp, synthetic construct
  misc_feature 1..20: note = CRISPR gRNA sequence
  source 1..20: mol_type = other DNA
tgtttcaataagatattgca

SEQ ID NO: 37496 - DNA, 20 bp, synthetic construct
  misc_feature 1..20: note = CRISPR gRNA sequence
  source 1..20: mol_type = other DNA
ttcaataagatattgcaaag

SEQ ID NO: 37497 - DNA, 20 bp, synthetic construct
  misc_feature 1..20: note = CRISPR gRNA sequence
  source 1..20: mol_type = other DNA
ataagatattgcaaagtagc

SEQ ID NO: 37498 - DNA, 20 bp, synthetic construct
  misc_feature 1..20: note = CRISPR gRNA sequence
  source 1..20: mol_type = other DNA
taagatattgcaaagtagct

SEQ ID NO: 37499 - DNA, 20 bp, synthetic construct
  misc_feature 1..20: note = CRISPR gRNA sequence
  source 1..20: mol_type = other DNA
tattgcaaagtagctgggcg

SEQ ID NO: 37500 - DNA, 20 bp, synthetic construct
  misc_feature 1..20: note = CRISPR gRNA sequence
  source 1..20: mol_type = other DNA
tgcaaagtagctgggcgcgg

SEQ ID NO: 37501 - DNA, 20 bp, synthetic construct
  misc_feature 1..20: note = CRISPR gRNA sequence
  source 1..20: mol_type = other DNA
gtggctcacacctgtaatcc

SEQ ID NO: 37502 - DNA, 20 bp, synthetic construct
  misc_feature 1..20: note = CRISPR gRNA sequence
  source 1..20: mol_type = other DNA
cacctgtaatcccagcactt

SEQ ID NO: 37503 - DNA, 20 bp, synthetic construct
  misc_feature 1..20: note = CRISPR gRNA sequence
  source 1..20: mol_type = other DNA
cctgtaatcccagcactttg

SEQ ID NO: 37504 - DNA, 20 bp, synthetic construct
  misc_feature 1..20: note = CRISPR gRNA sequence
  source 1..20: mol_type = other DNA
ctgtaatcccagcactttgg

SEQ ID NO: 37505 - DNA, 20 bp, synthetic construct
  misc_feature 1..20: note = CRISPR gRNA sequence
  source 1..20: mol_type = other DNA
tgtaatcccagcactttgga

SEQ ID NO: 37506 - DNA, 20 bp, synthetic construct
  misc_feature 1..20: note = CRISPR gRNA sequence
  source 1..20: mol_type = other DNA
tcccagcactttggagggct

SEQ ID NO: 37507 - DNA, 20 bp, synthetic construct
  misc_feature 1..20: note = CRISPR gRNA sequence
  source 1..20: mol_type = other DNA
cccagcactttggagggctg

SEQ ID NO: 37508 - DNA, 20 bp, synthetic construct
  misc_feature 1..20: note = CRISPR gRNA sequence
  source 1..20: mol_type = other DNA
agcactttggagggctgagg

SEQ ID NO: 37509 - DNA, 20 bp, synthetic construct
  misc_feature 1..20: note = CRISPR gRNA sequence
  source 1..20: mol_type = other DNA
gcactttggagggctgaggc

SEQ ID NO: 37510 - DNA, 20 bp, synthetic construct
  misc_feature 1..20: note = CRISPR gRNA sequence
  source 1..20: mol_type = other DNA
ctttggagggctgaggcagg

SEQ ID NO: 37511 - DNA, 20 bp, synthetic construct
  misc_feature 1..20: note = CRISPR gRNA sequence
  source 1..20: mol_type = other DNA
gagggctgaggcaggtggat

SEQ ID NO: 37512 - DNA, 20 bp, synthetic construct
  misc_feature 1..20: note = CRISPR gRNA sequence
  source 1..20: mol_type = other DNA
ctgaggcaggtggatcagtt

SEQ ID NO: 37513 - DNA, 20 bp, synthetic construct
  misc_feature 1..20: note = CRISPR gRNA sequence
  source 1..20: mol_type = other DNA
gcaggtggatcagttgagcc

SEQ ID NO: 37514 - DNA, 20 bp, synthetic construct
  misc_feature 1..20: note = CRISPR gRNA sequence
  source 1..20: mol_type = other DNA
caggtggatcagttgagccc

SEQ ID NO: 37515 - DNA, 20 bp, synthetic construct
  misc_feature 1..20: note = CRISPR gRNA sequence
  source 1..20: mol_type = other DNA
tgagcccaggaattcaatac

SEQ ID NO: 37516 - DNA, 20 bp, synthetic construct
  misc_feature 1..20: note = CRISPR gRNA sequence
  source 1..20: mol_type = other DNA
ccaggaattcaatactagcc

SEQ ID NO: 37517 - DNA, 20 bp, synthetic construct
  misc_feature 1..20: note = CRISPR gRNA sequence
  source 1..20: mol_type = other DNA
tctactaaaaatacaaaaat

SEQ ID NO: 37518 - DNA, 20 bp, synthetic construct
  misc_feature 1..20: note = CRISPR gRNA sequence
  source 1..20: mol_type = other DNA
ctaaaaatacaaaaattagc

SEQ ID NO: 37519 - DNA, 20 bp, synthetic construct
  misc_feature 1..20: note = CRISPR gRNA sequence
  source 1..20: mol_type = other DNA
taaaaatacaaaaattagct

SEQ ID NO: 37520 - DNA, 20 bp, synthetic construct
  misc_feature 1..20: note = CRISPR gRNA sequence
  source 1..20: mol_type = other DNA
atacaaaaattagctgggtg

SEQ ID NO: 37521 - DNA, 20 bp, synthetic construct
  misc_feature 1..20: note = CRISPR gRNA sequence
  source 1..20: mol_type = other DNA
caaaaattagctgggtgtgg

SEQ ID NO: 37522 - DNA, 20 bp, synthetic construct
  misc_feature 1..20: note = CRISPR gRNA sequence
  source 1..20: mol_type = other DNA
ggtgtggtggtgtgcacctg

SEQ ID NO: 37523 - DNA, 20 bp, synthetic construct
  misc_feature 1..20: note = CRISPR gRNA sequence
  source 1..20: mol_type = other DNA
gtggtgtgcacctgtagtcc

SEQ ID NO: 37524 - DNA, 20 bp, synthetic construct
  misc_feature 1..20: note = CRISPR gRNA sequence
  source 1..20: mol_type = other DNA
cacctgtagtcccagctact

SEQ ID NO: 37525 - DNA, 20 bp, synthetic construct
  misc_feature 1..20: note = CRISPR gRNA sequence
  source 1..20: mol_type = other DNA
acctgtagtcccagctactc

SEQ ID NO: 37526 - DNA, 20 bp, synthetic construct
  misc_feature 1..20: note = CRISPR gRNA sequence
  source 1..20: mol_type = other DNA
ctgtagtcccagctactcag

SEQ ID NO: 37527 - DNA, 20 bp, synthetic construct
  misc_feature 1..20: note = CRISPR gRNA sequence
  source 1..20: mol_type = other DNA
tgtagtcccagctactcagg

SEQ ID NO: 37528 - DNA, 20 bp, synthetic construct
  misc_feature 1..20: note = CRISPR gRNA sequence
  source 1..20: mol_type = other DNA
tcccagctactcaggaggct

SEQ ID NO: 37529 - DNA, 20 bp, synthetic construct
  misc_feature 1..20: note = CRISPR gRNA sequence
  source 1..20: mol_type = other DNA
cccagctactcaggaggctg

SEQ ID NO: 37530 - DNA, 20 bp, synthetic construct
  misc_feature 1..20: note = CRISPR gRNA sequence
  source 1..20: mol_type = other DNA
agctactcaggaggctgagg

SEQ ID NO: 37531 - DNA, 20 bp, synthetic construct
  misc_feature 1..20: note = CRISPR gRNA sequence
  source 1..20: mol_type = other DNA
gctactcaggaggctgaggc

SEQ ID NO: 37532 - DNA, 20 bp, synthetic construct
  misc_feature 1..20: note = CRISPR gRNA sequence
  source 1..20: mol_type = other DNA
tactcaggaggctgaggcag

SEQ ID NO: 37533 - DNA, 20 bp, synthetic construct
  misc_feature 1..20: note = CRISPR gRNA sequence
  source 1..20: mol_type = other DNA
actcaggaggctgaggcagg

SEQ ID NO: 37534 - DNA, 20 bp, synthetic construct
  misc_feature 1..20: note = CRISPR gRNA sequence
  source 1..20: mol_type = other DNA
ctgaggcaggaggatcactt

SEQ ID NO: 37535 - DNA, 20 bp, synthetic construct
  misc_feature 1..20: note = CRISPR gRNA sequence
  source 1..20: mol_type = other DNA
gcaggaggatcacttgagac

SEQ ID NO: 37536 - DNA, 20 bp, synthetic construct
  misc_feature 1..20: note = CRISPR gRNA sequence
  source 1..20: mol_type = other DNA
caggaggatcacttgagacc

SEQ ID NO: 37537 - DNA, 20 bp, synthetic construct
  misc_feature 1..20: note = CRISPR gRNA sequence
  source 1..20: mol_type = other DNA
ggaggatcacttgagaccag

SEQ ID NO: 37538 - DNA, 20 bp, synthetic construct
  misc_feature 1..20: note = CRISPR gRNA sequence
  source 1..20: mol_type = other DNA
cacttgagaccaggagtttg

SEQ ID NO: 37539 - DNA, 20 bp, synthetic construct
  misc_feature 1..20: note = CRISPR gRNA sequence
  source 1..20: mol_type = other DNA
agaccaggagtttgcggcta

SEQ ID NO: 37540 - DNA, 20 bp, synthetic construct
  misc_feature 1..20: note = CRISPR gRNA sequence
  source 1..20: mol_type = other DNA
caggagtttgcggctacagt

SEQ ID NO: 37541 - DNA, 20 bp, synthetic construct
  misc_feature 1..20: note = CRISPR gRNA sequence
  source 1..20: mol_type = other DNA
agtttgcggctacagtaagc

SEQ ID NO: 37542 - DNA, 20 bp, synthetic construct
  misc_feature 1..20: note = CRISPR gRNA sequence
  source 1..20: mol_type = other DNA
gtttgcggctacagtaagct

SEQ ID NO: 37543 - DNA, 20 bp, synthetic construct
  misc_feature 1..20: note = CRISPR gRNA sequence
  source 1..20: mol_type = other DNA
ctaggatcgtgccactgcac

SEQ ID NO: 37544 - DNA, 20 bp, synthetic construct
  misc_feature 1..20: note = CRISPR gRNA sequence
  source 1..20: mol_type = other DNA
aggatcgtgccactgcactg

SEQ ID NO: 37545 - DNA, 20 bp, synthetic construct
  misc_feature 1..20: note = CRISPR gRNA sequence
  source 1..20: mol_type = other DNA
cgtgccactgcactggagcc

SEQ ID NO: 37546 - DNA, 20 bp, synthetic construct
  misc_feature 1..20: note = CRISPR gRNA sequence
  source 1..20: mol_type = other DNA
gtgccactgcactggagcct

SEQ ID NO: 37547 - DNA, 20 bp, synthetic construct
  misc_feature 1..20: note = CRISPR gRNA sequence
  source 1..20: mol_type = other DNA
cactgcactggagcctgggc

SEQ ID NO: 37548 - DNA, 20 bp, synthetic construct
  misc_feature 1..20: note = CRISPR gRNA sequence
  source 1..20: mol_type = other DNA
actggagcctgggcaagact

SEQ ID NO: 37549 - DNA, 20 bp, synthetic construct
  misc_feature 1..20: note = CRISPR gRNA sequence
  source 1..20: mol_type = other DNA
caagactgagactctgtctc

SEQ ID NO: 37550 - DNA, 20 bp, synthetic construct
  misc_feature 1..20: note = CRISPR gRNA sequence
  source 1..20: mol_type = other DNA
aagactgagactctgtctct

SEQ ID NO: 37551 - DNA, 20 bp, synthetic construct
  misc_feature 1..20: note = CRISPR gRNA sequence
  source 1..20: mol_type = other DNA
agactctgtctctgggaaaa

SEQ ID NO: 37552 - DNA, 20 bp, synthetic construct
  misc_feature 1..20: note = CRISPR gRNA sequence
  source 1..20: mol_type = other DNA
ctctgggaaaaaagaaaaaa

SEQ ID NO: 37553 - DNA, 20 bp, synthetic construct
  misc_feature 1..20: note = CRISPR gRNA sequence
  source 1..20: mol_type = other DNA
ctgggaaaaaagaaaaaaaa

SEQ ID NO: 37554 - DNA, 20 bp, synthetic construct
  misc_feature 1..20: note = CRISPR gRNA sequence
  source 1..20: mol_type = other DNA
gaaaaaaaagagatgttgca

SEQ ID NO: 37555 - DNA, 20 bp, synthetic construct
  misc_feature 1..20: note = CRISPR gRNA sequence
  source 1..20: mol_type = other DNA
aaaaaaaagagatgttgcaa

SEQ ID NO: 37556 - DNA, 20 bp, synthetic construct
  misc_feature 1..20: note = CRISPR gRNA sequence
  source 1..20: mol_type = other DNA
aaaaaagagatgttgcaaag

SEQ ID NO: 37557 - DNA, 20 bp, synthetic construct
  misc_feature 1..20: note = CRISPR gRNA sequence
  source 1..20: mol_type = other DNA
aaaaagagatgttgcaaagg

SEQ ID NO: 37558 - DNA, 20 bp, synthetic construct
  misc_feature 1..20: note = CRISPR gRNA sequence
  source 1..20: mol_type = other DNA
ttacaccacgtgtactattg

SEQ ID NO: 37559 - DNA, 20 bp, synthetic construct
  misc_feature 1..20: note = CRISPR gRNA sequence
  source 1..20: mol_type = other DNA
ccacgtgtactattgcagaa

SEQ ID NO: 37560 - DNA, 20 bp, synthetic construct
  misc_feature 1..20: note = CRISPR gRNA sequence
  source 1..20: mol_type = other DNA
gtgtactattgcagaatgga

SEQ ID NO: 37561 - DNA, 20 bp, synthetic construct
  misc_feature 1..20: note = CRISPR gRNA sequence
  source 1..20: mol_type = other DNA
ttcccacctgcctgtttaaa

SEQ ID NO: 37562 - DNA, 20 bp, synthetic construct
  misc_feature 1..20: note = CRISPR gRNA sequence
  source 1..20: mol_type = other DNA
ctgcctgtttaaatagctac

SEQ ID NO: 37563 - DNA, 20 bp, synthetic construct
  misc_feature 1..20: note = CRISPR gRNA sequence
  source 1..20: mol_type = other DNA
gcctgtttaaatagctaccg

SEQ ID NO: 37564 - DNA, 20 bp, synthetic construct
  misc_feature 1..20: note = CRISPR gRNA sequence
  source 1..20: mol_type = other DNA
ctgtttaaatagctaccgga

SEQ ID NO: 37565 - DNA, 20 bp, synthetic construct
  misc_feature 1..20: note = CRISPR gRNA sequence
  source 1..20: mol_type = other DNA
ccggagagcctatgctccct

SEQ ID NO: 37566 - DNA, 20 bp, synthetic construct
  misc_feature 1..20: note = CRISPR gRNA sequence
  source 1..20: mol_type = other DNA
cccttagaactgattccttc

SEQ ID NO: 37567 - DNA, 20 bp, synthetic construct
  misc_feature 1..20: note = CRISPR gRNA sequence
  source 1..20: mol_type = other DNA
ttagaactgattccttctgg

SEQ ID NO: 37568 - DNA, 20 bp, synthetic construct
  misc_feature 1..20: note = CRISPR gRNA sequence
  source 1..20: mol_type = other DNA
aactgattccttctggaagt

SEQ ID NO: 37569 - DNA, 20 bp, synthetic construct
  misc_feature 1..20: note = CRISPR gRNA sequence
  source 1..20: mol_type = other DNA
actgattccttctggaagtt

SEQ ID NO: 37570 - DNA, 20 bp, synthetic construct
  misc_feature 1..20: note = CRISPR gRNA sequence
  source 1..20: mol_type = other DNA
ctgattccttctggaagttg

SEQ ID NO: 37571 - DNA, 20 bp, synthetic construct
  misc_feature 1..20: note = CRISPR gRNA sequence
  source 1..20: mol_type = other DNA
attccttctggaagttgggg

SEQ ID NO: 37572 - DNA, 20 bp, synthetic construct
  misc_feature 1..20: note = CRISPR gRNA sequence
  source 1..20: mol_type = other DNA
ttctggaagttggggtggca

SEQ ID NO: 37573 - DNA, 20 bp, synthetic construct
  misc_feature 1..20: note = CRISPR gRNA sequence
  source 1..20: mol_type = other DNA
gggtggcacagatcccccta

SEQ ID NO: 37574 - DNA, 20 bp, synthetic construct
  misc_feature 1..20: note = CRISPR gRNA sequence
  source 1..20: mol_type = other DNA
ccccatcatacatacacatc

SEQ ID NO: 37575 - DNA, 20 bp, synthetic construct
  misc_feature 1..20: note = CRISPR gRNA sequence
  source 1..20: mol_type = other DNA
cccatcatacatacacatct

SEQ ID NO: 37576 - DNA, 20 bp, synthetic construct
  misc_feature 1..20: note = CRISPR gRNA sequence
  source 1..20: mol_type = other DNA
ccatcatacatacacatctg

SEQ ID NO: 37577 - DNA, 20 bp, synthetic construct
  misc_feature 1..20: note = CRISPR gRNA sequence
  source 1..20: mol_type = other DNA
tacatacacatctggggcta

SEQ ID NO: 37578 - DNA, 20 bp, synthetic construct
  misc_feature 1..20: note = CRISPR gRNA sequence
  source 1..20: mol_type = other DNA
acatacacatctggggctac

SEQ ID NO: 37579 - DNA, 20 bp, synthetic construct
  misc_feature 1..20: note = CRISPR gRNA sequence
  source 1..20: mol_type = other DNA
ctggggctacaggctcccaa

SEQ ID NO: 37580 - DNA, 20 bp, synthetic construct
  misc_feature 1..20: note = CRISPR gRNA sequence
  source 1..20: mol_type = other DNA
ggctcccaacagcccaatac

SEQ ID NO: 37581 - DNA, 20 bp, synthetic construct
  misc_feature 1..20: note = CRISPR gRNA sequence
  source 1..20: mol_type = other DNA
gctcccaacagcccaatact

SEQ ID NO: 37582 - DNA, 20 bp, synthetic construct
  misc_feature 1..20: note = CRISPR gRNA sequence
  source 1..20: mol_type = other DNA
ctcccaacagcccaatactg

SEQ ID NO: 37583 - DNA, 20 bp, synthetic construct
  misc_feature 1..20: note = CRISPR gRNA sequence
  source 1..20: mol_type = other DNA
caacagcccaatactggggc

SEQ ID NO: 37584 - DNA, 20 bp, synthetic construct
  misc_feature 1..20: note = CRISPR gRNA sequence
  source 1..20: mol_type = other DNA
cagcccaatactggggcaag

SEQ ID NO: 37585 - DNA, 20 bp, synthetic construct
  misc_feature 1..20: note = CRISPR gRNA sequence
  source 1..20: mol_type = other DNA
atactggggcaagaagacat

SEQ ID NO: 37586 - DNA, 20 bp, synthetic construct
  misc_feature 1..20: note = CRISPR gRNA sequence
  source 1..20: mol_type = other DNA
ctggggcaagaagacatgag

SEQ ID NO: 37587 - DNA, 20 bp, synthetic construct
  misc_feature 1..20: note = CRISPR gRNA sequence
  source 1..20: mol_type = other DNA
ggggcaagaagacatgagca

SEQ ID NO: 37588 - DNA, 20 bp, synthetic construct
  misc_feature 1..20: note = CRISPR gRNA sequence
  source 1..20: mol_type = other DNA
gggcaagaagacatgagcag

SEQ ID NO: 37589 - DNA, 20 bp, synthetic construct
  misc_feature 1..20: note = CRISPR gRNA sequence
  source 1..20: mol_type = other DNA
ggcaagaagacatgagcaga

SEQ ID NO: 37590 - DNA, 20 bp, synthetic construct
  misc_feature 1..20: note = CRISPR gRNA sequence
  source 1..20: mol_type = other DNA
agaagacatgagcagagggc

SEQ ID NO: 37591 - DNA, 20 bp, synthetic construct
  misc_feature 1..20: note = CRISPR gRNA sequence
  source 1..20: mol_type = other DNA
gaagacatgagcagagggcc

SEQ ID NO: 37592 - DNA, 20 bp, synthetic construct
  misc_feature 1..20: note = CRISPR gRNA sequence
  source 1..20: mol_type = other DNA
aagacatgagcagagggccg

SEQ ID NO: 37593 - DNA, 20 bp, synthetic construct
  misc_feature 1..20: note = CRISPR gRNA sequence
  source 1..20: mol_type = other DNA
agacatgagcagagggccgg

SEQ ID NO: 37594 - DNA, 20 bp, synthetic construct
  misc_feature 1..20: note = CRISPR gRNA sequence
  source 1..20: mol_type = other DNA
gacatgagcagagggccggg

SEQ ID NO: 37595 - DNA, 20 bp, synthetic construct
  misc_feature 1..20: note = CRISPR gRNA sequence
  source 1..20: mol_type = other DNA
tgccatgtccctgccccttg

SEQ ID NO: 37596 - DNA, 20 bp, synthetic construct
  misc_feature 1..20: note = CRISPR gRNA sequence
  source 1..20: mol_type = other DNA
ccatgtccctgccccttgca

SEQ ID NO: 37597 - DNA, 20 bp, synthetic construct
  misc_feature 1..20: note = CRISPR gRNA sequence
  source 1..20: mol_type = other DNA
gtccctgccccttgcagagt

SEQ ID NO: 37598 - DNA, 20 bp, synthetic construct
  misc_feature 1..20: note = CRISPR gRNA sequence
  source 1..20: mol_type = other DNA
tgccccttgcagagttggcc

SEQ ID NO: 37599 - DNA, 20 bp, synthetic construct
  misc_feature 1..20: note = CRISPR gRNA sequence
  source 1..20: mol_type = other DNA
cccttgcagagttggccaag

SEQ ID NO: 37600 - DNA, 20 bp, synthetic construct
  misc_feature 1..20: note = CRISPR gRNA sequence
  source 1..20: mol_type = other DNA
agttggccaagaagtacctg

SEQ ID NO: 37601 - DNA, 20 bp, synthetic construct
  misc_feature 1..20: note = CRISPR gRNA sequence
  source 1..20: mol_type = other DNA
agaagtacctgcagctcctg

SEQ ID NO: 37602 - DNA, 20 bp, synthetic construct
  misc_feature 1..20: note = CRISPR gRNA sequence
  source 1..20: mol_type = other DNA
agctcctgcggacctctgcc

SEQ ID NO: 37603 - DNA, 20 bp, synthetic construct
  misc_feature 1..20: note = CRISPR gRNA sequence
  source 1..20: mol_type = other DNA
tcctgcggacctctgcccag

SEQ ID NO: 37604 - DNA, 20 bp, synthetic construct
  misc_feature 1..20: note = CRISPR gRNA sequence
  source 1..20: mol_type = other DNA
acctctgcccagcagcgcta

SEQ ID NO: 37605 - DNA, 20 bp, synthetic construct
  misc_feature 1..20: note = CRISPR gRNA sequence
  source 1..20: mol_type = other DNA
cctctgcccagcagcgctac

SEQ ID NO: 37606 - DNA, 20 bp, synthetic construct
  misc_feature 1..20: note = CRISPR gRNA sequence
  source 1..20: mol_type = other DNA
tctgcccagcagcgctacag

SEQ ID NO: 37607 - DNA, 20 bp, synthetic construct
  misc_feature 1..20: note = CRISPR gRNA sequence
  source 1..20: mol_type = other DNA
cgctacaggagccaaatccc

SEQ ID NO: 37608 - DNA, 20 bp, synthetic construct
  misc_feature 1..20: note = CRISPR gRNA sequence
  source 1..20: mol_type = other DNA
gctacaggagccaaatccct

SEQ ID NO: 37609 - DNA, 20 bp, synthetic construct
  misc_feature 1..20: note = CRISPR gRNA sequence
  source 1..20: mol_type = other DNA
caggagccaaatccctgggt

SEQ ID NO: 37610 - DNA, 20 bp, synthetic construct
  misc_feature 1..20: note = CRISPR gRNA sequence
  source 1..20: mol_type = other DNA
aggagccaaatccctgggtc

SEQ ID NO: 37611 - DNA, 20 bp, synthetic construct
  misc_feature 1..20: note = CRISPR gRNA sequence
  source 1..20: mol_type = other DNA
ggagccaaatccctgggtca

SEQ ID NO: 37612 - DNA, 20 bp, synthetic construct
  misc_feature 1..20: note = CRISPR gRNA sequence
  source 1..20: mol_type = other DNA
gccaaatccctgggtcaggg

SEQ ID NO: 37613 - DNA, 20 bp, synthetic construct
  misc_feature 1..20: note = CRISPR gRNA sequence
  source 1..20: mol_type = other DNA
ggcagccccacgccttccac

SEQ ID NO: 37614 - DNA, 20 bp, synthetic construct
  misc_feature 1..20: note = CRISPR gRNA sequence
  source 1..20: mol_type = other DNA
gcagccccacgccttccacc

SEQ ID NO: 37615 - DNA, 20 bp, synthetic construct
  misc_feature 1..20: note = CRISPR gRNA sequence
  source 1..20: mol_type = other DNA
atgtccctccaatcctgcgc

SEQ ID NO: 37616 - DNA, 20 bp, synthetic construct
  misc_feature 1..20: note = CRISPR gRNA sequence
  source 1..20: mol_type = other DNA
tgtccctccaatcctgcgcc

SEQ ID NO: 37617 - DNA, 20 bp, synthetic construct
  misc_feature 1..20: note = CRISPR gRNA sequence
  source 1..20: mol_type = other DNA
tccaatcctgcgccgggcca

SEQ ID NO: 37618 - DNA, 20 bp, synthetic construct
  misc_feature 1..20: note = CRISPR gRNA sequence
  source 1..20: mol_type = other DNA
gcgccgggccacagcatcct

SEQ ID NO: 37619 - DNA, 20 bp, synthetic construct
  misc_feature 1..20: note = CRISPR gRNA sequence
  source 1..20: mol_type = other DNA
cacagcatccttagacactc

SEQ ID NO: 37620 - DNA, 20 bp, synthetic construct
  misc_feature 1..20: note = CRISPR gRNA sequence
  source 1..20: mol_type = other DNA
cagcatccttagacactccg

SEQ ID NO: 37621 - DNA, 20 bp, synthetic construct
  misc_feature 1..20: note = CRISPR gRNA sequence
  source 1..20: mol_type = other DNA
agcatccttagacactccgg

SEQ ID NO: 37622 - DNA, 20 bp, synthetic construct
  misc_feature 1..20: note = CRISPR gRNA sequence
  source 1..20: mol_type = other DNA
gcatccttagacactccgga

SEQ ID NO: 37623 - DNA, 20 bp, synthetic construct
  misc_feature 1..20: note = CRISPR gRNA sequence
  source 1..20: mol_type = other DNA
catccttagacactccggag

SEQ ID NO: 37624 - DNA, 20 bp, synthetic construct
  misc_feature 1..20: note = CRISPR gRNA sequence
  source 1..20: mol_type = other DNA
atccttagacactccggagg

SEQ ID NO: 37625 - DNA, 20 bp, synthetic construct
  misc_feature 1..20: note = CRISPR gRNA sequence
  source 1..20: mol_type = other DNA
cactccggagggggccatta

SEQ ID NO: 37626 - DNA, 20 bp, synthetic construct
  misc_feature 1..20: note = CRISPR gRNA sequence
  source 1..20: mol_type = other DNA
actccggagggggccattat

SEQ ID NO: 37627 - DNA, 20 bp, synthetic construct
  misc_feature 1..20: note = CRISPR gRNA sequence
  source 1..20: mol_type = other DNA
ctccggagggggccattatg

SEQ ID NO: 37628 - DNA, 20 bp, synthetic construct
  misc_feature 1..20: note = CRISPR gRNA sequence
  source 1..20: mol_type = other DNA
tccggagggggccattatgg

SEQ ID NO: 37629 - DNA, 20 bp, synthetic construct
  misc_feature 1..20: note = CRISPR gRNA sequence
  source 1..20: mol_type = other DNA
gggccattatgggggacgtc

SEQ ID NO: 37630 - DNA, 20 bp, synthetic construct
  misc_feature 1..20: note = CRISPR gRNA sequence
  source 1..20: mol_type = other DNA
ggccattatgggggacgtca

SEQ ID NO: 37631 - DNA, 20 bp, synthetic construct
  misc_feature 1..20: note = CRISPR gRNA sequence
  source 1..20: mol_type = other DNA
cattatgggggacgtcaagg

SEQ ID NO: 37632 - DNA, 20 bp, synthetic construct
  misc_feature 1..20: note = CRISPR gRNA sequence
  source 1..20: mol_type = other DNA
tatgggggacgtcaaggtgg

SEQ ID NO: 37633 - DNA, 20 bp, synthetic construct
  misc_feature 1..20: note = CRISPR gRNA sequence
  source 1..20: mol_type = other DNA
ggggacgtcaaggtggaaga

SEQ ID NO: 37634 - DNA, 20 bp, synthetic construct
  misc_feature 1..20: note = CRISPR gRNA sequence
  source 1..20: mol_type = other DNA
gtggaagatggtgctgacgt

SEQ ID NO: 37635 - DNA, 20 bp, synthetic construct
  misc_feature 1..20: note = CRISPR gRNA sequence
  source 1..20: mol_type = other DNA
tggtgctgacgtgagcatct

SEQ ID NO: 37636 - DNA, 20 bp, synthetic construct
  misc_feature 1..20: note = CRISPR gRNA sequence
  source 1..20: mol_type = other DNA
atctcggacctcttcaacac

SEQ ID NO: 37637 - DNA, 20 bp, synthetic construct
  misc_feature 1..20: note = CRISPR gRNA sequence
  source 1..20: mol_type = other DNA
tctcggacctcttcaacacc

SEQ ID NO: 37638 - DNA, 20 bp, synthetic construct
  misc_feature 1..20: note = CRISPR gRNA sequence
  source 1..20: mol_type = other DNA
ctcggacctcttcaacacca

SEQ ID NO: 37639 - DNA, 20 bp, synthetic construct
  misc_feature 1..20: note = CRISPR gRNA sequence
  source 1..20: mol_type = other DNA
tcttcaacaccagggttaac

SEQ ID NO: 37640 - DNA, 20 bp, synthetic construct
  misc_feature 1..20: note = CRISPR gRNA sequence
  source 1..20: mol_type = other DNA
cttcaacaccagggttaaca

SEQ ID NO: 37641 - DNA, 20 bp, synthetic construct
  misc_feature 1..20: note = CRISPR gRNA sequence
  source 1..20: mol_type = other DNA
ttcaacaccagggttaacaa

SEQ ID NO: 37642 - DNA, 20 bp, synthetic construct
  misc_feature 1..20: note = CRISPR gRNA sequence
  source 1..20: mol_type = other DNA
accagggttaacaagggccc

SEQ ID NO: 37643 - DNA, 20 bp, synthetic construct
  misc_feature 1..20: note = CRISPR gRNA sequence
  source 1..20: mol_type = other DNA
ccagggttaacaagggcccg

SEQ ID NO: 37644 - DNA, 20 bp, synthetic construct
  misc_feature 1..20: note = CRISPR gRNA sequence
  source 1..20: mol_type = other DNA
cagggttaacaagggcccga

SEQ ID NO: 37645 - DNA, 20 bp, synthetic construct
  misc_feature 1..20: note = CRISPR gRNA sequence
  source 1..20: mol_type = other DNA
cccgagggtgaccgtgcttt

SEQ ID NO: 37646 - DNA, 20 bp, synthetic construct
  misc_feature 1..20: note = CRISPR gRNA sequence
  source 1..20: mol_type = other DNA
ccgagggtgaccgtgctttt

SEQ ID NO: 37647 - DNA, 20 bp, synthetic construct
  misc_feature 1..20: note = CRISPR gRNA sequence
  source 1..20: mol_type = other DNA
cgagggtgaccgtgcttttg

SEQ ID NO: 37648 - DNA, 20 bp, synthetic construct
  misc_feature 1..20: note = CRISPR gRNA sequence
  source 1..20: mol_type = other DNA
gggtgaccgtgcttttgggg

SEQ ID NO: 37649 - DNA, 20 bp, synthetic construct
  misc_feature 1..20: note = CRISPR gRNA sequence
  source 1..20: mol_type = other DNA
ggtgaccgtgcttttgggga

SEQ ID NO: 37650 - DNA, 20 bp, synthetic construct
  misc_feature 1..20: note = CRISPR gRNA sequence
  source 1..20: mol_type = other DNA
accgtgcttttggggaaggc

SEQ ID NO: 37651 - DNA, 20 bp, synthetic construct
  misc_feature 1..20: note = CRISPR gRNA sequence
  source 1..20: mol_type = other DNA
gcttttggggaaggctggca

SEQ ID NO: 37652 - DNA, 20 bp, synthetic construct
  misc_feature 1..20: note = CRISPR gRNA sequence
  source 1..20: mol_type = other DNA
cttttggggaaggctggcat

SEQ ID NO: 37653 - DNA, 20 bp, synthetic construct
  misc_feature 1..20: note = CRISPR gRNA sequence
  source 1..20: mol_type = other DNA
tggggaaggctggcatgggc

SEQ ID NO: 37654 - DNA, 20 bp, synthetic construct
  misc_feature 1..20: note = CRISPR gRNA sequence
  source 1..20: mol_type = other DNA
tggcatgggcaagaccacgc

SEQ ID NO: 37655 - DNA, 20 bp, synthetic construct
  misc_feature 1..20: note = CRISPR gRNA sequence
  source 1..20: mol_type = other DNA
gcaagaccacgctggcccac

SEQ ID NO: 37656 - DNA, 20 bp, synthetic construct
  misc_feature 1..20: note = CRISPR gRNA sequence
  source 1..20: mol_type = other DNA
cgctggcccaccggctctgc

SEQ ID NO: 37657 - DNA, 20 bp, synthetic construct
  misc_feature 1..20: note = CRISPR gRNA sequence
  source 1..20: mol_type = other DNA
tggcccaccggctctgccag

SEQ ID NO: 37658 - DNA, 20 bp, synthetic construct
  misc_feature 1..20: note = CRISPR gRNA sequence
  source 1..20: mol_type = other DNA
cccaccggctctgccagaag

SEQ ID NO: 37659 - DNA, 20 bp, synthetic construct
  misc_feature 1..20: note = CRISPR gRNA sequence
  source 1..20: mol_type = other DNA
ccaccggctctgccagaagt

SEQ ID NO: 37660 - DNA, 20 bp, synthetic construct
  misc_feature 1..20: note = CRISPR gRNA sequence
  source 1..20: mol_type = other DNA
ccggctctgccagaagtggg

SEQ ID NO: 37661 - DNA, 20 bp, synthetic construct
  misc_feature 1..20: note = CRISPR gRNA sequence
  source 1..20: mol_type = other DNA
ggctctgccagaagtgggca

SEQ ID NO: 37662 - DNA, 20 bp, synthetic construct
  misc_feature 1..20: note = CRISPR gRNA sequence
  source 1..20: mol_type = other DNA
gctctgccagaagtgggcag

SEQ ID NO: 37663 - DNA, 20 bp, synthetic construct
  misc_feature 1..20: note = CRISPR gRNA sequence
  source 1..20: mol_type = other DNA
ctctgccagaagtgggcaga

SEQ ID NO: 37664 - DNA, 20 bp, synthetic construct
  misc_feature 1..20: note = CRISPR gRNA sequence
  source 1..20: mol_type = other DNA
agggccatctgaactgtttc

SEQ ID NO: 37665 - DNA, 20 bp, synthetic construct
  misc_feature 1..20: note = CRISPR gRNA sequence
  source 1..20: mol_type = other DNA
gggccatctgaactgtttcc

SEQ ID NO: 37666 - DNA, 20 bp, synthetic construct
  misc_feature 1..20: note = CRISPR gRNA sequence
  source 1..20: mol_type = other DNA
tgttcctttttgaattccgc

SEQ ID NO: 37667 - DNA, 20 bp, synthetic construct
  misc_feature 1..20: note = CRISPR gRNA sequence
  source 1..20: mol_type = other DNA
cgccagctcaacttgatcac

SEQ ID NO: 37668 - DNA, 20 bp, synthetic construct
  misc_feature 1..20: note = CRISPR gRNA sequence
  source 1..20: mol_type = other DNA
gccagctcaacttgatcacg

SEQ ID NO: 37669 - DNA, 20 bp, synthetic construct
  misc_feature 1..20: note = CRISPR gRNA sequence
  source 1..20: mol_type = other DNA
cgaggttcctgacaccgtcc

SEQ ID NO: 37670 - DNA, 20 bp, synthetic construct
  misc_feature 1..20: note = CRISPR gRNA sequence
  source 1..20: mol_type = other DNA
ctcctttttgatctgtacct

SEQ ID NO: 37671 - DNA, 20 bp, synthetic construct
  misc_feature 1..20: note = CRISPR gRNA sequence
  source 1..20: mol_type = other DNA
tctgtacctgagccctgaat

SEQ ID NO: 37672 - DNA, 20 bp, synthetic construct
  misc_feature 1..20: note = CRISPR gRNA sequence
  source 1..20: mol_type = other DNA
cggaccacgacactgtcttc

SEQ ID NO: 37673 - DNA, 20 bp, synthetic construct
  misc_feature 1..20: note = CRISPR gRNA sequence
  source 1..20: mol_type = other DNA
cgacactgtcttccagtacc

SEQ ID NO: 37674 - DNA, 20 bp, synthetic construct
  misc_feature 1..20: note = CRISPR gRNA sequence
  source 1..20: mol_type = other DNA
acactgtcttccagtacctg

SEQ ID NO: 37675 - DNA, 20 bp, synthetic construct
  misc_feature 1..20: note = CRISPR gRNA sequence
  source 1..20: mol_type = other DNA
ctgtcttccagtacctggag

SEQ ID NO: 37676 - DNA, 20 bp, synthetic construct
  misc_feature 1..20: note = CRISPR gRNA sequence
  source 1..20: mol_type = other DNA
cctggagaagaacgctgacc

SEQ ID NO: 37677 - DNA, 20 bp, synthetic construct
  misc_feature 1..20: note = CRISPR gRNA sequence
  source 1..20: mol_type = other DNA
caagtcctgctgatctttga

SEQ ID NO: 37678 - DNA, 20 bp, synthetic construct
  misc_feature 1..20: note = CRISPR gRNA sequence
  source 1..20: mol_type = other DNA
aagtcctgctgatctttgat

SEQ ID NO: 37679 - DNA, 20 bp, synthetic construct
  misc_feature 1..20: note = CRISPR gRNA sequence
  source 1..20: mol_type = other DNA
cctgctgatctttgatgggc

SEQ ID NO: 37680 - DNA, 20 bp, synthetic construct
  misc_feature 1..20: note = CRISPR gRNA sequence
  source 1..20: mol_type = other DNA
tgatctttgatgggctagat

SEQ ID NO: 37681 - DNA, 20 bp, synthetic construct
  misc_feature 1..20: note = CRISPR gRNA sequence
  source 1..20: mol_type = other DNA
gatctttgatgggctagatg

SEQ ID NO: 37682 - DNA, 20 bp, synthetic construct
  misc_feature 1..20: note = CRISPR gRNA sequence
  source 1..20: mol_type = other DNA
atgggctagatgaggccctc

SEQ ID NO: 37683 - DNA, 20 bp, synthetic construct
  misc_feature 1..20: note = CRISPR gRNA sequence
  source 1..20: mol_type = other DNA
agatgaggccctccagccta

SEQ ID NO: 37684 - DNA, 20 bp, synthetic construct
  misc_feature 1..20: note = CRISPR gRNA sequence
  source 1..20: mol_type = other DNA
gatgaggccctccagcctat

SEQ ID NO: 37685 - DNA, 20 bp, synthetic construct
  misc_feature 1..20: note = CRISPR gRNA sequence
  source 1..20: mol_type = other DNA
ctccagcctatgggtcctga

SEQ ID NO: 37686 - DNA, 20 bp, synthetic construct
  misc_feature 1..20: note = CRISPR gRNA sequence
  source 1..20: mol_type = other DNA
gcctatgggtcctgatggcc

SEQ ID NO: 37687 - DNA, 20 bp, synthetic construct
  misc_feature 1..20: note = CRISPR gRNA sequence
  source 1..20: mol_type = other DNA
cctatgggtcctgatggccc

SEQ ID NO: 37688 - DNA, 20 bp, synthetic construct
  misc_feature 1..20: note = CRISPR gRNA sequence
  source 1..20: mol_type = other DNA
gggtcctgatggcccaggcc

SEQ ID NO: 37689 - DNA, 20 bp, synthetic construct
  misc_feature 1..20: note = CRISPR gRNA sequence
  source 1..20: mol_type = other DNA
cttttctcccatctctgcaa

SEQ ID NO: 37690 - DNA, 20 bp, synthetic construct
  misc_feature 1..20: note = CRISPR gRNA sequence
  source 1..20: mol_type = other DNA
ttttctcccatctctgcaat

SEQ ID NO: 37691 - DNA, 20 bp, synthetic construct
  misc_feature 1..20: note = CRISPR gRNA sequence
  source 1..20: mol_type = other DNA
tgcaatgggaccctcctgcc

SEQ ID NO: 37692 - DNA, 20 bp, synthetic construct
  misc_feature 1..20: note = CRISPR gRNA sequence
  source 1..20: mol_type = other DNA
ggaccctcctgcctggctgc

SEQ ID NO: 37693 - DNA, 20 bp, synthetic construct
  misc_feature 1..20: note = CRISPR gRNA sequence
  source 1..20: mol_type = other DNA
gaccctcctgcctggctgcc

SEQ ID NO: 37694 - DNA, 20 bp, synthetic construct
  misc_feature 1..20: note = CRISPR gRNA sequence
  source 1..20: mol_type = other DNA
cctgcctggctgccgggtga

SEQ ID NO: 37695 - DNA, 20 bp, synthetic construct
  misc_feature 1..20: note = CRISPR gRNA sequence
  source 1..20: mol_type = other DNA
ggtgatggctacctcccgtc

SEQ ID NO: 37696 - DNA, 20 bp, synthetic construct
  misc_feature 1..20: note = CRISPR gRNA sequence
  source 1..20: mol_type = other DNA
gtgatggctacctcccgtcc

SEQ ID NO: 37697 - DNA, 20 bp, synthetic construct
  misc_feature 1..20: note = CRISPR gRNA sequence
  source 1..20: mol_type = other DNA
tgatggctacctcccgtcca

SEQ ID NO: 37698 - DNA, 20 bp, synthetic construct
  misc_feature 1..20: note = CRISPR gRNA sequence
  source 1..20: mol_type = other DNA
tggctacctcccgtccaggg

SEQ ID NO: 37699 - DNA, 20 bp, synthetic construct
  misc_feature 1..20: note = CRISPR gRNA sequence
  source 1..20: mol_type = other DNA
gctgcctgcctgcctgcctg

SEQ ID NO: 37700 - DNA, 20 bp, synthetic construct
  misc_feature 1..20: note = CRISPR gRNA sequence
  source 1..20: mol_type = other DNA
tgcctgcctgcctgcctgca

SEQ ID NO: 37701 - DNA, 20 bp, synthetic construct
  misc_feature 1..20: note = CRISPR gRNA sequence
  source 1..20: mol_type = other DNA
gcctgcctgcctgcctgcag

SEQ ID NO: 37702 - DNA, 20 bp, synthetic construct
  misc_feature 1..20: note = CRISPR gRNA sequence
  source 1..20: mol_type = other DNA
tgcctgcctgcctgcagagg

SEQ ID NO: 37703 - DNA, 20 bp, synthetic construct
  misc_feature 1..20: note = CRISPR gRNA sequence
  source 1..20: mol_type = other DNA
cctgcctgcagaggcagcca

SEQ ID NO: 37704 - DNA, 20 bp, synthetic construct
  misc_feature 1..20: note = CRISPR gRNA sequence
  source 1..20: mol_type = other DNA
ggcagccatggtccacatgt

SEQ ID NO: 37705 - DNA, 20 bp, synthetic construct
  misc_feature 1..20: note = CRISPR gRNA sequence
  source 1..20: mol_type = other DNA
gcagccatggtccacatgtt

SEQ ID NO: 37706 - DNA, 20 bp, synthetic construct
  misc_feature 1..20: note = CRISPR gRNA sequence
  source 1..20: mol_type = other DNA
gtccacatgttgggctttga

SEQ ID NO: 37707 - DNA, 20 bp, synthetic construct
  misc_feature 1..20: note = CRISPR gRNA sequence
  source 1..20: mol_type = other DNA
tccacatgttgggctttgat

SEQ ID NO: 37708 - DNA, 20 bp, synthetic construct
  misc_feature 1..20: note = CRISPR gRNA sequence
  source 1..20: mol_type = other DNA
tgttgggctttgatgggcca

SEQ ID NO: 37709 - DNA, 20 bp, synthetic construct
  misc_feature 1..20: note = CRISPR gRNA sequence
  source 1..20: mol_type = other DNA
gttgggctttgatgggccac

SEQ ID NO: 37710 - DNA, 20 bp, synthetic construct
  misc_feature 1..20: note = CRISPR gRNA sequence
  source 1..20: mol_type = other DNA
gggctttgatgggccacggg

SEQ ID NO: 37711 - DNA, 20 bp, synthetic construct
  misc_feature 1..20: note = CRISPR gRNA sequence
  source 1..20: mol_type = other DNA
ctttgatgggccacgggtgg

SEQ ID NO: 37712 - DNA, 20 bp, synthetic construct
  misc_feature 1..20: note = CRISPR gRNA sequence
  source 1..20: mol_type = other DNA
gaatatgtgaatcacttctt

SEQ ID NO: 37713 - DNA, 20 bp, synthetic construct
  misc_feature 1..20: note = CRISPR gRNA sequence
  source 1..20: mol_type = other DNA
tgaatcacttcttcagcgcc

SEQ ID NO: 37714 - DNA, 20 bp, synthetic construct
  misc_feature 1..20: note = CRISPR gRNA sequence
  source 1..20: mol_type = other DNA
tcttcagcgcccagccatcg

SEQ ID NO: 37715 - DNA, 20 bp, synthetic construct
  misc_feature 1..20: note = CRISPR gRNA sequence
  source 1..20: mol_type = other DNA
cttcagcgcccagccatcgc

SEQ ID NO: 37716 - DNA, 20 bp, synthetic construct
  misc_feature 1..20: note = CRISPR gRNA sequence
  source 1..20: mol_type = other DNA
tcagcgcccagccatcgcgg

SEQ ID NO: 37717 - DNA, 20 bp, synthetic construct
  misc_feature 1..20: note = CRISPR gRNA sequence
  source 1..20: mol_type = other DNA
cagcgcccagccatcgcggg

SEQ ID NO: 37718 - DNA, 20 bp, synthetic construct
  misc_feature 1..20: note = CRISPR gRNA sequence
  source 1..20: mol_type = other DNA
agcgcccagccatcgcggga

SEQ ID NO: 37719 - DNA, 20 bp, synthetic construct
  misc_feature 1..20: note = CRISPR gRNA sequence
  source 1..20: mol_type = other DNA
gcgcccagccatcgcgggag

SEQ ID NO: 37720 - DNA, 20 bp, synthetic construct
  misc_feature 1..20: note = CRISPR gRNA sequence
  source 1..20: mol_type = other DNA
cgcccagccatcgcgggagg

SEQ ID NO: 37721 - DNA, 20 bp, synthetic construct
  misc_feature 1..20: note = CRISPR gRNA sequence
  source 1..20: mol_type = other DNA
gccatcgcgggagggggccc

SEQ ID NO: 37722 - DNA, 20 bp, synthetic construct
  misc_feature 1..20: note = CRISPR gRNA sequence
  source 1..20: mol_type = other DNA
atcgcgggagggggccctgg

SEQ ID NO: 37723 - DNA, 20 bp, synthetic construct
  misc_feature 1..20: note = CRISPR gRNA sequence
  source 1..20: mol_type = other DNA
cgcgggagggggccctggtg

SEQ ID NO: 37724 - DNA, 20 bp, synthetic construct
  misc_feature 1..20: note = CRISPR gRNA sequence
  source 1..20: mol_type = other DNA
agggggccctggtggagtta

SEQ ID NO: 37725 - DNA, 20 bp, synthetic construct
  misc_feature 1..20: note = CRISPR gRNA sequence
  source 1..20: mol_type = other DNA
ctggtggagttacagacaaa

SEQ ID NO: 37726 - DNA, 20 bp, synthetic construct
  misc_feature 1..20: note = CRISPR gRNA sequence
  source 1..20: mol_type = other DNA
cagacaaatggacgtctccg

SEQ ID NO: 37727 - DNA, 20 bp, synthetic construct
  misc_feature 1..20: note = CRISPR gRNA sequence
  source 1..20: mol_type = other DNA
acgtctccgaagcctgtgtg

SEQ ID NO: 37728 - DNA, 20 bp, synthetic construct
  misc_feature 1..20: note = CRISPR gRNA sequence
  source 1..20: mol_type = other DNA
tgcggtgcccgcactgtgcc

SEQ ID NO: 37729 - DNA, 20 bp, synthetic construct
  misc_feature 1..20: note = CRISPR gRNA sequence
  source 1..20: mol_type = other DNA
tctgcttcctgaccacgccc

SEQ ID NO: 37730 - DNA, 20 bp, synthetic construct
  misc_feature 1..20: note = CRISPR gRNA sequence
  source 1..20: mol_type = other DNA
ctgcttcctgaccacgcccc

SEQ ID NO: 37731 - DNA, 20 bp, synthetic construct
  misc_feature 1..20: note = CRISPR gRNA sequence
  source 1..20: mol_type = other DNA
ttcctgaccacgccccaggc

SEQ ID NO: 37732 - DNA, 20 bp, synthetic construct
  misc_feature 1..20: note = CRISPR gRNA sequence
  source 1..20: mol_type = other DNA
ccacgccccaggccagtctg

SEQ ID NO: 37733 - DNA, 20 bp, synthetic construct
  misc_feature 1..20: note = CRISPR gRNA sequence
  source 1..20: mol_type = other DNA
ccctcctgcccaacatgact

SEQ ID NO: 37734 - DNA, 20 bp, synthetic construct
  misc_feature 1..20: note = CRISPR gRNA sequence
  source 1..20: mol_type = other DNA
acatgactcagctctatatg

SEQ ID NO: 37735 - DNA, 20 bp, synthetic construct
  misc_feature 1..20: note = CRISPR gRNA sequence
  source 1..20: mol_type = other DNA
gactcagctctatatgcaga

SEQ ID NO: 37736 - DNA, 20 bp, synthetic construct
  misc_feature 1..20: note = CRISPR gRNA sequence
  source 1..20: mol_type = other DNA
atgcagatggtgctcgccct

SEQ ID NO: 37737 - DNA, 20 bp, synthetic construct
  misc_feature 1..20: note = CRISPR gRNA sequence
  source 1..20: mol_type = other DNA
gtgctcgccctcagcccccc

SEQ ID NO: 37738 - DNA, 20 bp, synthetic construct
  misc_feature 1..20: note = CRISPR gRNA sequence
  source 1..20: mol_type = other DNA
tgctcgccctcagcccccct

SEQ ID NO: 37739 - DNA, 20 bp, synthetic construct
  misc_feature 1..20: note = CRISPR gRNA sequence
  source 1..20: mol_type = other DNA
cttgcccacctcgtccctac

SEQ ID NO: 37740 - DNA, 20 bp, synthetic construct
  misc_feature 1..20: note = CRISPR gRNA sequence
  source 1..20: mol_type = other DNA
cacctcgtccctactggacc

SEQ ID NO: 37741 - DNA, 20 bp, synthetic construct
  misc_feature 1..20: note = CRISPR gRNA sequence
  source 1..20: mol_type = other DNA
acctcgtccctactggacct

SEQ ID NO: 37742 - DNA, 20 bp, synthetic construct
  misc_feature 1..20: note = CRISPR gRNA sequence
  source 1..20: mol_type = other DNA
cctcgtccctactggacctg

SEQ ID NO: 37743 - DNA, 20 bp, synthetic construct
  misc_feature 1..20: note = CRISPR gRNA sequence
  source 1..20: mol_type = other DNA
ctcgtccctactggacctgg

SEQ ID NO: 37744 - DNA, 20 bp, synthetic construct
  misc_feature 1..20: note = CRISPR gRNA sequence
  source 1..20: mol_type = other DNA
cgtccctactggacctgggg

SEQ ID NO: 37745 - DNA, 20 bp, synthetic construct
  misc_feature 1..20: note = CRISPR gRNA sequence
  source 1..20: mol_type = other DNA
gtccctactggacctggggg

SEQ ID NO: 37746 - DNA, 20 bp, synthetic construct
  misc_feature 1..20: note = CRISPR gRNA sequence
  source 1..20: mol_type = other DNA
cctactggacctgggggagg

SEQ ID NO: 37747 - DNA, 20 bp, synthetic construct
  misc_feature 1..20: note = CRISPR gRNA sequence
  source 1..20: mol_type = other DNA
gacctgggggaggtggccct

SEQ ID NO: 37748 - DNA, 20 bp, synthetic construct
  misc_feature 1..20: note = CRISPR gRNA sequence
  source 1..20: mol_type = other DNA
acctgggggaggtggccctg

SEQ ID NO: 37749 - DNA, 20 bp, synthetic construct
  misc_feature 1..20: note = CRISPR gRNA sequence
  source 1..20: mol_type = other DNA
cctgggggaggtggccctga

SEQ ID NO: 37750 - DNA, 20 bp, synthetic construct
  misc_feature 1..20: note = CRISPR gRNA sequence
  source 1..20: mol_type = other DNA
ctgggggaggtggccctgag

SEQ ID NO: 37751 - DNA, 20 bp, synthetic construct
  misc_feature 1..20: note = CRISPR gRNA sequence
  source 1..20: mol_type = other DNA
ggaggtggccctgaggggcc

SEQ ID NO: 37752 - DNA, 20 bp, synthetic construct
  misc_feature 1..20: note = CRISPR gRNA sequence
  source 1..20: mol_type = other DNA
aggtggccctgaggggcctg

SEQ ID NO: 37753 - DNA, 20 bp, synthetic construct
  misc_feature 1..20: note = CRISPR gRNA sequence
  source 1..20: mol_type = other DNA
ggccctgaggggcctggaga

SEQ ID NO: 37754 - DNA, 20 bp, synthetic construct
  misc_feature 1..20: note = CRISPR gRNA sequence
  source 1..20: mol_type = other DNA
gccctgaggggcctggagac

SEQ ID NO: 37755 - DNA, 20 bp, synthetic construct
  misc_feature 1..20: note = CRISPR gRNA sequence
  source 1..20: mol_type = other DNA
ccctgaggggcctggagaca

SEQ ID NO: 37756 - DNA, 20 bp, synthetic construct
  misc_feature 1..20: note = CRISPR gRNA sequence
  source 1..20: mol_type = other DNA
tgaggggcctggagacaggg

SEQ ID NO: 37757 - DNA, 20 bp, synthetic construct
  misc_feature 1..20: note = CRISPR gRNA sequence
  source 1..20: mol_type = other DNA
gaggggcctggagacaggga

SEQ ID NO: 37758 - DNA, 20 bp, synthetic construct
  misc_feature 1..20: note = CRISPR gRNA sequence
  source 1..20: mol_type = other DNA
gaaggttatcttctatgcaa

SEQ ID NO: 37759 - DNA, 20 bp, synthetic construct
  misc_feature 1..20: note = CRISPR gRNA sequence
  source 1..20: mol_type = other DNA
agatattgctccacccttga

SEQ ID NO: 37760 - DNA, 20 bp, synthetic construct
  misc_feature 1..20: note = CRISPR gRNA sequence
  source 1..20: mol_type = other DNA
gctccacccttgatagcttt

SEQ ID NO: 37761 - DNA, 20 bp, synthetic construct
  misc_feature 1..20: note = CRISPR gRNA sequence
  source 1..20: mol_type = other DNA
ctccacccttgatagctttt

SEQ ID NO: 37762 - DNA, 20 bp, synthetic construct
  misc_feature 1..20: note = CRISPR gRNA sequence
  source 1..20: mol_type = other DNA
tccacccttgatagcttttg

SEQ ID NO: 37763 - DNA, 20 bp, synthetic construct
  misc_feature 1..20: note = CRISPR gRNA sequence
  source 1..20: mol_type = other DNA
atagcttttggggccactca

SEQ ID NO: 37764 - DNA, 20 bp, synthetic construct
  misc_feature 1..20: note = CRISPR gRNA sequence
  source 1..20: mol_type = other DNA
gacttccttctgcgtctgca

SEQ ID NO: 37765 - DNA, 20 bp, synthetic construct
  misc_feature 1..20: note = CRISPR gRNA sequence
  source 1..20: mol_type = other DNA
acttccttctgcgtctgcac

SEQ ID NO: 37766 - DNA, 20 bp, synthetic construct
  misc_feature 1..20: note = CRISPR gRNA sequence
  source 1..20: mol_type = other DNA
ttctgcgtctgcacaggccc

SEQ ID NO: 37767 - DNA, 20 bp, synthetic construct
  misc_feature 1..20: note = CRISPR gRNA sequence
  source 1..20: mol_type = other DNA
tctgcgtctgcacaggccct

SEQ ID NO: 37768 - DNA, 20 bp, synthetic construct
  misc_feature 1..20: note = CRISPR gRNA sequence
  source 1..20: mol_type = other DNA
tctgcacaggccctgggcac

SEQ ID NO: 37769 - DNA, 20 bp, synthetic construct
  misc_feature 1..20: note = CRISPR gRNA sequence
  source 1..20: mol_type = other DNA
gcacaggccctgggcaccag

SEQ ID NO: 37770 - DNA, 20 bp, synthetic construct
  misc_feature 1..20: note = CRISPR gRNA sequence
  source 1..20: mol_type = other DNA
aggccctgggcaccagcaga

SEQ ID NO: 37771 - DNA, 20 bp, synthetic construct
  misc_feature 1..20: note = CRISPR gRNA sequence
  source 1..20: mol_type = other DNA
ggccctgggcaccagcagac

SEQ ID NO: 37772 - DNA, 20 bp, synthetic construct
  misc_feature 1..20: note = CRISPR gRNA sequence
  source 1..20: mol_type = other DNA
ggctatgctttcacccacct

SEQ ID NO: 37773 - DNA, 20 bp, synthetic construct
  misc_feature 1..20: note = CRISPR gRNA sequence
  source 1..20: mol_type = other DNA
ctttcacccacctcagcctg

SEQ ID NO: 37774 - DNA, 20 bp, synthetic construct
  misc_feature 1..20: note = CRISPR gRNA sequence
  source 1..20: mol_type = other DNA
tttcacccacctcagcctgc

SEQ ID NO: 37775 - DNA, 20 bp, synthetic construct
  misc_feature 1..20: note = CRISPR gRNA sequence
  source 1..20: mol_type = other DNA
tcacccacctcagcctgcag

SEQ ID NO: 37776 - DNA, 20 bp, synthetic construct
  misc_feature 1..20: note = CRISPR gRNA sequence
  source 1..20: mol_type = other DNA
tcttgctgccctgcacctga

SEQ ID NO: 37777 - DNA, 20 bp, synthetic construct
  misc_feature 1..20: note = CRISPR gRNA sequence
  source 1..20: mol_type = other DNA
gctgccctgcacctgatggc

SEQ ID NO: 37778 - DNA, 20 bp, synthetic construct
  misc_feature 1..20: note = CRISPR gRNA sequence
  source 1..20: mol_type = other DNA
tgcacctgatggccagcccc

SEQ ID NO: 37779 - DNA, 20 bp, synthetic construct
  misc_feature 1..20: note = CRISPR gRNA sequence
  source 1..20: mol_type = other DNA
gcacctgatggccagcccca

SEQ ID NO: 37780 - DNA, 20 bp, synthetic construct
  misc_feature 1..20: note = CRISPR gRNA sequence
  source 1..20: mol_type = other DNA
ggccagccccaaggtgaaca

SEQ ID NO: 37781 - DNA, 20 bp, synthetic construct
  misc_feature 1..20: note = CRISPR gRNA sequence
  source 1..20: mol_type = other DNA
tgaacaaagacacacttacc

SEQ ID NO: 37782 - DNA, 20 bp, synthetic construct
  misc_feature 1..20: note = CRISPR gRNA sequence
  source 1..20: mol_type = other DNA
atgttaccctccattcccgc

SEQ ID NO: 37783 - DNA, 20 bp, synthetic construct
  misc_feature 1..20: note = CRISPR gRNA sequence
  source 1..20: mol_type = other DNA
tgttaccctccattcccgct

SEQ ID NO: 37784 - DNA, 20 bp, synthetic construct
  misc_feature 1..20: note = CRISPR gRNA sequence
  source 1..20: mol_type = other DNA
ccctccattcccgctgggta

SEQ ID NO: 37785 - DNA, 20 bp, synthetic construct
  misc_feature 1..20: note = CRISPR gRNA sequence
  source 1..20: mol_type = other DNA
tccattcccgctgggtacag

SEQ ID NO: 37786 - DNA, 20 bp, synthetic construct
  misc_feature 1..20: note = CRISPR gRNA sequence
  source 1..20: mol_type = other DNA
ccgctgggtacagcggacca

SEQ ID NO: 37787 - DNA, 20 bp, synthetic construct
  misc_feature 1..20: note = CRISPR gRNA sequence
  source 1..20: mol_type = other DNA
tgggtacagcggaccaaagc

SEQ ID NO: 37788 - DNA, 20 bp, synthetic construct
  misc_feature 1..20: note = CRISPR gRNA sequence
  source 1..20: mol_type = other DNA
acagcggaccaaagctagac

SEQ ID NO: 37789 - DNA, 20 bp, synthetic construct
  misc_feature 1..20: note = CRISPR gRNA sequence
  source 1..20: mol_type = other DNA
cagcggaccaaagctagact

SEQ ID NO: 37790 - DNA, 20 bp, synthetic construct
  misc_feature 1..20: note = CRISPR gRNA sequence
  source 1..20: mol_type = other DNA
caaagctagactgggcctct

SEQ ID NO: 37791 - DNA, 20 bp, synthetic construct
  misc_feature 1..20: note = CRISPR gRNA sequence
  source 1..20: mol_type = other DNA
agaccacctccccaccttcc

SEQ ID NO: 37792 - DNA, 20 bp, synthetic construct
  misc_feature 1..20: note = CRISPR gRNA sequence
  source 1..20: mol_type = other DNA
ccacctccccaccttcctgg

SEQ ID NO: 37793 - DNA, 20 bp, synthetic construct
  misc_feature 1..20: note = CRISPR gRNA sequence
  source 1..20: mol_type = other DNA
cacctccccaccttcctggc

SEQ ID NO: 37794 - DNA, 20 bp, synthetic construct
  misc_feature 1..20: note = CRISPR gRNA sequence
  source 1..20: mol_type = other DNA
ccccaccttcctggcgggcc

SEQ ID NO: 37795 - DNA, 20 bp, synthetic construct
  misc_feature 1..20: note = CRISPR gRNA sequence
  source 1..20: mol_type = other DNA
tgcacctgccgccccttcct

SEQ ID NO: 37796 - DNA, 20 bp, synthetic construct
  misc_feature 1..20: note = CRISPR gRNA sequence
  source 1..20: mol_type = other DNA
ccgccccttccttagccacc

SEQ ID NO: 37797 - DNA, 20 bp, synthetic construct
  misc_feature 1..20: note = CRISPR gRNA sequence
  source 1..20: mol_type = other DNA
ccttccttagccacctggcg

SEQ ID NO: 37798 - DNA, 20 bp, synthetic construct
  misc_feature 1..20: note = CRISPR gRNA sequence
  source 1..20: mol_type = other DNA
cttccttagccacctggcgc

SEQ ID NO: 37799 - DNA, 20 bp, synthetic construct
  misc_feature 1..20: note = CRISPR gRNA sequence
  source 1..20: mol_type = other DNA
ttccttagccacctggcgca

SEQ ID NO: 37800 - DNA, 20 bp, synthetic construct
  misc_feature 1..20: note = CRISPR gRNA sequence
  source 1..20: mol_type = other DNA
gccacctggcgcagggcaat

SEQ ID NO: 37801 - DNA, 20 bp, synthetic construct
  misc_feature 1..20: note = CRISPR gRNA sequence
  source 1..20: mol_type = other DNA
ccacctggcgcagggcaatg

SEQ ID NO: 37802 - DNA, 20 bp, synthetic construct
  misc_feature 1..20: note = CRISPR gRNA sequence
  source 1..20: mol_type = other DNA
gcagggcaatgaggactgtg

SEQ ID NO: 37803 - DNA, 20 bp, synthetic construct
  misc_feature 1..20: note = CRISPR gRNA sequence
  source 1..20: mol_type = other DNA
cagggcaatgaggactgtgt

SEQ ID NO: 37804 - DNA, 20 bp, synthetic construct
  misc_feature 1..20: note = CRISPR gRNA sequence
  source 1..20: mol_type = other DNA
atgaggactgtgtgggtgcc

SEQ ID NO: 37805 - DNA, 20 bp, synthetic construct
  misc_feature 1..20: note = CRISPR gRNA sequence
  source 1..20: mol_type = other DNA
aggactgtgtgggtgccaag

SEQ ID NO: 37806 - DNA, 20 bp, synthetic construct
  misc_feature 1..20: note = CRISPR gRNA sequence
  source 1..20: mol_type = other DNA
ggactgtgtgggtgccaagc

SEQ ID NO: 37807 - DNA, 20 bp, synthetic construct
  misc_feature 1..20: note = CRISPR gRNA sequence
  source 1..20: mol_type = other DNA
gggtgccaagcaggctgctg

SEQ ID NO: 37808 - DNA, 20 bp, synthetic construct
  misc_feature 1..20: note = CRISPR gRNA sequence
  source 1..20: mol_type = other DNA
ccaagcaggctgctgtagtg

SEQ ID NO: 37809 - DNA, 20 bp, synthetic construct
  misc_feature 1..20: note = CRISPR gRNA sequence
  source 1..20: mol_type = other DNA
caagcaggctgctgtagtgc

SEQ ID NO: 37810 - DNA, 20 bp, synthetic construct
  misc_feature 1..20: note = CRISPR gRNA sequence
  source 1..20: mol_type = other DNA
ctgctgtagtgcaggtgttg

SEQ ID NO: 37811 - DNA, 20 bp, synthetic construct
  misc_feature 1..20: note = CRISPR gRNA sequence
  source 1..20: mol_type = other DNA
ctgtagtgcaggtgttgaag

SEQ ID NO: 37812 - DNA, 20 bp, synthetic construct
  misc_feature 1..20: note = CRISPR gRNA sequence
  source 1..20: mol_type = other DNA
agtgcaggtgttgaagaagt

SEQ ID NO: 37813 - DNA, 20 bp, synthetic construct
  misc_feature 1..20: note = CRISPR gRNA sequence
  source 1..20: mol_type = other DNA
tgaagaagttggccacccgc

SEQ ID NO: 37814 - DNA, 20 bp, synthetic construct
  misc_feature 1..20: note = CRISPR gRNA sequence
  source 1..20: mol_type = other DNA
gttggccacccgcaagctca

SEQ ID NO: 37815 - DNA, 20 bp, synthetic construct
  misc_feature 1..20: note = CRISPR gRNA sequence
  source 1..20: mol_type = other DNA
ttggccacccgcaagctcac

SEQ ID NO: 37816 - DNA, 20 bp, synthetic construct
  misc_feature 1..20: note = CRISPR gRNA sequence
  source 1..20: mol_type = other DNA
tggccacccgcaagctcaca

SEQ ID NO: 37817 - DNA, 20 bp, synthetic construct
  misc_feature 1..20: note = CRISPR gRNA sequence
  source 1..20: mol_type = other DNA
cccgcaagctcacagggcca

SEQ ID NO: 37818 - DNA, 20 bp, synthetic construct
  misc_feature 1..20: note = CRISPR gRNA sequence
  source 1..20: mol_type = other DNA
ccgcaagctcacagggccaa

SEQ ID NO: 37819 - DNA, 20 bp, synthetic construct
  misc_feature 1..20: note = CRISPR gRNA sequence
  source 1..20: mol_type = other DNA
gctcacagggccaaaggttg

SEQ ID NO: 37820 - DNA, 20 bp, synthetic construct
  misc_feature 1..20: note = CRISPR gRNA sequence
  source 1..20: mol_type = other DNA
tcacagggccaaaggttgta

SEQ ID NO: 37821 - DNA, 20 bp, synthetic construct
  misc_feature 1..20: note = CRISPR gRNA sequence
  source 1..20: mol_type = other DNA
tgtagagctgtgtcactgtg

SEQ ID NO: 37822 - DNA, 20 bp, synthetic construct
  misc_feature 1..20: note = CRISPR gRNA sequence
  source 1..20: mol_type = other DNA
agctgtgtcactgtgtggat

SEQ ID NO: 37823 - DNA, 20 bp, synthetic construct
  misc_feature 1..20: note = CRISPR gRNA sequence
  source 1..20: mol_type = other DNA
gtcactgtgtggatgagaca

SEQ ID NO: 37824 - DNA, 20 bp, synthetic construct
  misc_feature 1..20: note = CRISPR gRNA sequence
  source 1..20: mol_type = other DNA
tcactgtgtggatgagacac

SEQ ID NO: 37825 - DNA, 20 bp, synthetic construct
  misc_feature 1..20: note = CRISPR gRNA sequence
  source 1..20: mol_type = other DNA
actgtgtggatgagacacag

SEQ ID NO: 37826 - DNA, 20 bp, synthetic construct
  misc_feature 1..20: note = CRISPR gRNA sequence
  source 1..20: mol_type = other DNA
tggatgagacacaggagcct

SEQ ID NO: 37827 - DNA, 20 bp, synthetic construct
  misc_feature 1..20: note = CRISPR gRNA sequence
  source 1..20: mol_type = other DNA
tgagacacaggagcctgagc

SEQ ID NO: 37828 - DNA, 20 bp, synthetic construct
  misc_feature 1..20: note = CRISPR gRNA sequence
  source 1..20: mol_type = other DNA
acacaggagcctgagctggc

SEQ ID NO: 37829 - DNA, 20 bp, synthetic construct
  misc_feature 1..20: note = CRISPR gRNA sequence
  source 1..20: mol_type = other DNA
ctggccagtctcaccgcaca

SEQ ID NO: 37830 - DNA, 20 bp, synthetic construct
  misc_feature 1..20: note = CRISPR gRNA sequence
  source 1..20: mol_type = other DNA
cccactgacctgcaccgacc

SEQ ID NO: 37831 - DNA, 20 bp, synthetic construct
  misc_feature 1..20: note = CRISPR gRNA sequence
  source 1..20: mol_type = other DNA
ggccaccctgaccaacatcc

SEQ ID NO: 37832 - DNA, 20 bp, synthetic construct
  misc_feature 1..20: note = CRISPR gRNA sequence
  source 1..20: mol_type = other DNA
ccaccctgaccaacatccta

SEQ ID NO: 37833 - DNA, 20 bp, synthetic construct
  misc_feature 1..20: note = CRISPR gRNA sequence
  source 1..20: mol_type = other DNA
ctgaccaacatcctagagca

SEQ ID NO: 37834 - DNA, 20 bp, synthetic construct
  misc_feature 1..20: note = CRISPR gRNA sequence
  source 1..20: mol_type = other DNA
tgaccaacatcctagagcac

SEQ ID NO: 37835 - DNA, 20 bp, synthetic construct
  misc_feature 1..20: note = CRISPR gRNA sequence
  source 1..20: mol_type = other DNA
gaccaacatcctagagcaca

SEQ ID NO: 37836 - DNA, 20 bp, synthetic construct
  misc_feature 1..20: note = CRISPR gRNA sequence
  source 1..20: mol_type = other DNA
ccaacatcctagagcacagg

SEQ ID NO: 37837 - DNA, 20 bp, synthetic construct
  misc_feature 1..20: note = CRISPR gRNA sequence
  source 1..20: mol_type = other DNA
caacatcctagagcacaggg

SEQ ID NO: 37838 - DNA, 20 bp, synthetic construct
  misc_feature 1..20: note = CRISPR gRNA sequence
  source 1..20: mol_type = other DNA
cagggaggcccccatccacc

SEQ ID NO: 37839 - DNA, 20 bp, synthetic construct
  misc_feature 1..20: note = CRISPR gRNA sequence
  source 1..20: mol_type = other DNA
cccatccacctggattttga

SEQ ID NO: 37840 - DNA, 20 bp, synthetic construct
  misc_feature 1..20: note = CRISPR gRNA sequence
  source 1..20: mol_type = other DNA
ggattttgatggctgtcccc

SEQ ID NO: 37841 - DNA, 20 bp, synthetic construct
  misc_feature 1..20: note = CRISPR gRNA sequence
  source 1..20: mol_type = other DNA
attttgatggctgtcccctg

SEQ ID NO: 37842 - DNA, 20 bp, synthetic construct
  misc_feature 1..20: note = CRISPR gRNA sequence
  source 1..20: mol_type = other DNA
ccctggagccccactgccct

SEQ ID NO: 37843 - DNA, 20 bp, synthetic construct
  misc_feature 1..20: note = CRISPR gRNA sequence
  source 1..20: mol_type = other DNA
cctggagccccactgccctg

SEQ ID NO: 37844 - DNA, 20 bp, synthetic construct
  misc_feature 1..20: note = CRISPR gRNA sequence
  source 1..20: mol_type = other DNA
gccccactgccctgaggctc

SEQ ID NO: 37845 - DNA, 20 bp, synthetic construct
  misc_feature 1..20: note = CRISPR gRNA sequence
  source 1..20: mol_type = other DNA
ccactgccctgaggctctgg

SEQ ID NO: 37846 - DNA, 20 bp, synthetic construct
  misc_feature 1..20: note = CRISPR gRNA sequence
  source 1..20: mol_type = other DNA
cactgccctgaggctctggt

SEQ ID NO: 37847 - DNA, 20 bp, synthetic construct
  misc_feature 1..20: note = CRISPR gRNA sequence
  source 1..20: mol_type = other DNA
cctgaggctctggtaggctg

SEQ ID NO: 37848 - DNA, 20 bp, synthetic construct
  misc_feature 1..20: note = CRISPR gRNA sequence
  source 1..20: mol_type = other DNA
ctgaggctctggtaggctgt

SEQ ID NO: 37849 - DNA, 20 bp, synthetic construct
  misc_feature 1..20: note = CRISPR gRNA sequence
  source 1..20: mol_type = other DNA
aggctctggtaggctgtggg

SEQ ID NO: 37850 - DNA, 20 bp, synthetic construct
  misc_feature 1..20: note = CRISPR gRNA sequence
  source 1..20: mol_type = other DNA
tctggtaggctgtgggcaga

SEQ ID NO: 37851 - DNA, 20 bp, synthetic construct
  misc_feature 1..20: note = CRISPR gRNA sequence
  source 1..20: mol_type = other DNA
tggtaggctgtgggcagata

SEQ ID NO: 37852 - DNA, 20 bp, synthetic construct
  misc_feature 1..20: note = CRISPR gRNA sequence
  source 1..20: mol_type = other DNA
tgtgggcagatagagaatct

SEQ ID NO: 37853 - DNA, 20 bp, synthetic construct
  misc_feature 1..20: note = CRISPR gRNA sequence
  source 1..20: mol_type = other DNA
gtgggcagatagagaatctc

SEQ ID NO: 37854 - DNA, 20 bp, synthetic construct
  misc_feature 1..20: note = CRISPR gRNA sequence
  source 1..20: mol_type = other DNA
gcagatagagaatctcaggt

SEQ ID NO: 37855 - DNA, 20 bp, synthetic construct
  misc_feature 1..20: note = CRISPR gRNA sequence
  source 1..20: mol_type = other DNA
atagagaatctcaggtgagt

SEQ ID NO: 37856 - DNA, 20 bp, synthetic construct
  misc_feature 1..20: note = CRISPR gRNA sequence
  source 1..20: mol_type = other DNA
agagaatctcaggtgagtaa

SEQ ID NO: 37857 - DNA, 20 bp, synthetic construct
  misc_feature 1..20: note = CRISPR gRNA sequence
  source 1..20: mol_type = other DNA
gaatctcaggtgagtaagag

SEQ ID NO: 37858 - DNA, 20 bp, synthetic construct
  misc_feature 1..20: note = CRISPR gRNA sequence
  source 1..20: mol_type = other DNA
atctcaggtgagtaagagtg

SEQ ID NO: 37859 - DNA, 20 bp, synthetic construct
  misc_feature 1..20: note = CRISPR gRNA sequence
  source 1..20: mol_type = other DNA
tctcaggtgagtaagagtgg

SEQ ID NO: 37860 - DNA, 20 bp, synthetic construct
  misc_feature 1..20: note = CRISPR gRNA sequence
  source 1..20: mol_type = other DNA
tcaggtgagtaagagtggag

SEQ ID NO: 37861 - DNA, 20 bp, synthetic construct
  misc_feature 1..20: note = CRISPR gRNA sequence
  source 1..20: mol_type = other DNA
caggtgagtaagagtggagg

SEQ ID NO: 37862 - DNA, 20 bp, synthetic construct
  misc_feature 1..20: note = CRISPR gRNA sequence
  source 1..20: mol_type = other DNA
gagtaagagtggaggaggac

SEQ ID NO: 37863 - DNA, 20 bp, synthetic construct
  misc_feature 1..20: note = CRISPR gRNA sequence
  source 1..20: mol_type = other DNA
agtaagagtggaggaggacc

SEQ ID NO: 37864 - DNA, 20 bp, synthetic construct
  misc_feature 1..20: note = CRISPR gRNA sequence
  source 1..20: mol_type = other DNA
gtaagagtggaggaggaccg

SEQ ID NO: 37865 - DNA, 20 bp, synthetic construct
  misc_feature 1..20: note = CRISPR gRNA sequence
  source 1..20: mol_type = other DNA
aagagtggaggaggaccggg

SEQ ID NO: 37866 - DNA, 20 bp, synthetic construct
  misc_feature 1..20: note = CRISPR gRNA sequence
  source 1..20: mol_type = other DNA
agagtggaggaggaccgggg

SEQ ID NO: 37867 - DNA, 20 bp, synthetic construct
  misc_feature 1..20: note = CRISPR gRNA sequence
  source 1..20: mol_type = other DNA
gagtggaggaggaccgggga

SEQ ID NO: 37868 - DNA, 20 bp, synthetic construct
  misc_feature 1..20: note = CRISPR gRNA sequence
  source 1..20: mol_type = other DNA
agtggaggaggaccggggag

SEQ ID NO: 37869 - DNA, 20 bp, synthetic construct
  misc_feature 1..20: note = CRISPR gRNA sequence
  source 1..20: mol_type = other DNA
aggaggaccggggaggggat

SEQ ID NO: 37870 - DNA, 20 bp, synthetic construct
  misc_feature 1..20: note = CRISPR gRNA sequence
  source 1..20: mol_type = other DNA
ggaggaccggggaggggatt

SEQ ID NO: 37871 - DNA, 20 bp, synthetic construct
  misc_feature 1..20: note = CRISPR gRNA sequence
  source 1..20: mol_type = other DNA
cggggaggggattgggcttt

SEQ ID NO: 37872 - DNA, 20 bp, synthetic construct
  misc_feature 1..20: note = CRISPR gRNA sequence
  source 1..20: mol_type = other DNA
ggggaggggattgggctttt

SEQ ID NO: 37873 - DNA, 20 bp, synthetic construct
  misc_feature 1..20: note = CRISPR gRNA sequence
  source 1..20: mol_type = other DNA
gggaggggattgggcttttg

SEQ ID NO: 37874 - DNA, 20 bp, synthetic construct
  misc_feature 1..20: note = CRISPR gRNA sequence
  source 1..20: mol_type = other DNA
ggaggggattgggcttttgg

SEQ ID NO: 37875 - DNA, 20 bp, synthetic construct
  misc_feature 1..20: note = CRISPR gRNA sequence
  source 1..20: mol_type = other DNA
aggggattgggcttttgggg

SEQ ID NO: 37876 - DNA, 20 bp, synthetic construct
  misc_feature 1..20: note = CRISPR gRNA sequence
  source 1..20: mol_type = other DNA
ggattgggcttttgggggag

SEQ ID NO: 37877 - DNA, 20 bp, synthetic construct
  misc_feature 1..20: note = CRISPR gRNA sequence
  source 1..20: mol_type = other DNA
attgggcttttgggggagca

SEQ ID NO: 37878 - DNA, 20 bp, synthetic construct
  misc_feature 1..20: note = CRISPR gRNA sequence
  source 1..20: mol_type = other DNA
ttgggcttttgggggagcag

SEQ ID NO: 37879 - DNA, 20 bp, synthetic construct
  misc_feature 1..20: note = CRISPR gRNA sequence
  source 1..20: mol_type = other DNA
ttgggggagcagaggccaac

SEQ ID NO: 37880 - DNA, 20 bp, synthetic construct
  misc_feature 1..20: note = CRISPR gRNA sequence
  source 1..20: mol_type = other DNA
ggagcagaggccaaccagtc

SEQ ID NO: 37881 - DNA, 20 bp, synthetic construct
  misc_feature 1..20: note = CRISPR gRNA sequence
  source 1..20: mol_type = other DNA
cagtctagcaaacctctgcc

SEQ ID NO: 37882 - DNA, 20 bp, synthetic construct
  misc_feature 1..20: note = CRISPR gRNA sequence
  source 1..20: mol_type = other DNA
gtctagcaaacctctgccaa

SEQ ID NO: 37883 - DNA, 20 bp, synthetic construct
  misc_feature 1..20: note = CRISPR gRNA sequence
  source 1..20: mol_type = other DNA
tctagcaaacctctgccaag

SEQ ID NO: 37884 - DNA, 20 bp, synthetic construct
  misc_feature 1..20: note = CRISPR gRNA sequence
  source 1..20: mol_type = other DNA
caaacctctgccaagaggac

SEQ ID NO: 37885 - DNA, 20 bp, synthetic construct
  misc_feature 1..20: note = CRISPR gRNA sequence
  source 1..20: mol_type = other DNA
ctctgccaagaggactggat

SEQ ID NO: 37886 - DNA, 20 bp, synthetic construct
  misc_feature 1..20: note = CRISPR gRNA sequence
  source 1..20: mol_type = other DNA
tggataagaatcttgaatat

SEQ ID NO: 37887 - DNA, 20 bp, synthetic construct
  misc_feature 1..20: note = CRISPR gRNA sequence
  source 1..20: mol_type = other DNA
tcttgaatatcagaacataa

SEQ ID NO: 37888 - DNA, 20 bp, synthetic construct
  misc_feature 1..20: note = CRISPR gRNA sequence
  source 1..20: mol_type = other DNA
aacataatggcctgcaatgc

SEQ ID NO: 37889 - DNA, 20 bp, synthetic construct
  misc_feature 1..20: note = CRISPR gRNA sequence
  source 1..20: mol_type = other DNA
cataatggcctgcaatgcaa

SEQ ID NO: 37890 - DNA, 20 bp, synthetic construct
  misc_feature 1..20: note = CRISPR gRNA sequence
  source 1..20: mol_type = other DNA
taatggcctgcaatgcaaga

SEQ ID NO: 37891 - DNA, 20 bp, synthetic construct
  misc_feature 1..20: note = CRISPR gRNA sequence
  source 1..20: mol_type = other DNA
aatggcctgcaatgcaagag

SEQ ID NO: 37892 - DNA, 20 bp, synthetic construct
  misc_feature 1..20: note = CRISPR gRNA sequence
  source 1..20: mol_type = other DNA
ggcctgcaatgcaagagagg

SEQ ID NO: 37893 - DNA, 20 bp, synthetic construct
  misc_feature 1..20: note = CRISPR gRNA sequence
  source 1..20: mol_type = other DNA
gaggaagctccataccttga

SEQ ID NO: 37894 - DNA, 20 bp, synthetic construct
  misc_feature 1..20: note = CRISPR gRNA sequence
  source 1..20: mol_type = other DNA
aggaagctccataccttgac

SEQ ID NO: 37895 - DNA, 20 bp, synthetic construct
  misc_feature 1..20: note = CRISPR gRNA sequence
  source 1..20: mol_type = other DNA
ccataccttgacaggacctc

SEQ ID NO: 37896 - DNA, 20 bp, synthetic construct
  misc_feature 1..20: note = CRISPR gRNA sequence
  source 1..20: mol_type = other DNA
ataccttgacaggacctctg

SEQ ID NO: 37897 - DNA, 20 bp, synthetic construct
  misc_feature 1..20: note = CRISPR gRNA sequence
  source 1..20: mol_type = other DNA
caggacctctggagtccaaa

SEQ ID NO: 37898 - DNA, 20 bp, synthetic construct
  misc_feature 1..20: note = CRISPR gRNA sequence
  source 1..20: mol_type = other DNA
atggatcctcctcttgtctg

SEQ ID NO: 37899 - DNA, 20 bp, synthetic construct
  misc_feature 1..20: note = CRISPR gRNA sequence
  source 1..20: mol_type = other DNA
ctcctcttgtctgtggtttc

SEQ ID NO: 37900 - DNA, 20 bp, synthetic construct
  misc_feature 1..20: note = CRISPR gRNA sequence
  source 1..20: mol_type = other DNA
gtctgtggtttctggactct

SEQ ID NO: 37901 - DNA, 20 bp, synthetic construct
  misc_feature 1..20: note = CRISPR gRNA sequence
  source 1..20: mol_type = other DNA
ctcagtctctctgtcaatca

SEQ ID NO: 37902 - DNA, 20 bp, synthetic construct
  misc_feature 1..20: note = CRISPR gRNA sequence
  source 1..20: mol_type = other DNA
tcagtctctctgtcaatcat

SEQ ID NO: 37903 - DNA, 20 bp, synthetic construct
  misc_feature 1..20: note = CRISPR gRNA sequence
  source 1..20: mol_type = other DNA
tcaatcatgggctgaaacca

SEQ ID NO: 37904 - DNA, 20 bp, synthetic construct
  misc_feature 1..20: note = CRISPR gRNA sequence
  source 1..20: mol_type = other DNA
atgggctgaaaccacagatc

SEQ ID NO: 37905 - DNA, 20 bp, synthetic construct
  misc_feature 1..20: note = CRISPR gRNA sequence
  source 1..20: mol_type = other DNA
tgggctgaaaccacagatcc

SEQ ID NO: 37906 - DNA, 20 bp, synthetic construct
  misc_feature 1..20: note = CRISPR gRNA sequence
  source 1..20: mol_type = other DNA
ccacagatccaggctgtcta

SEQ ID NO: 37907 - DNA, 20 bp, synthetic construct
  misc_feature 1..20: note = CRISPR gRNA sequence
  source 1..20: mol_type = other DNA
acagatccaggctgtctata

SEQ ID NO: 37908 - DNA, 20 bp, synthetic construct
  misc_feature 1..20: note = CRISPR gRNA sequence
  source 1..20: mol_type = other DNA
cagatccaggctgtctatag

SEQ ID NO: 37909 - DNA, 20 bp, synthetic construct
  misc_feature 1..20: note = CRISPR gRNA sequence
  source 1..20: mol_type = other DNA
tccaggctgtctatagaggc

SEQ ID NO: 37910 - DNA, 20 bp, synthetic construct
  misc_feature 1..20: note = CRISPR gRNA sequence
  source 1..20: mol_type = other DNA
aggctgtctatagaggctgg

SEQ ID NO: 37911 - DNA, 20 bp, synthetic construct
  misc_feature 1..20: note = CRISPR gRNA sequence
  source 1..20: mol_type = other DNA
ctatagaggctggtggactt

SEQ ID NO: 37912 - DNA, 20 bp, synthetic construct
  misc_feature 1..20: note = CRISPR gRNA sequence
  source 1..20: mol_type = other DNA
tatagaggctggtggacttt

SEQ ID NO: 37913 - DNA, 20 bp, synthetic construct
  misc_feature 1..20: note = CRISPR gRNA sequence
  source 1..20: mol_type = other DNA
gaggctggtggactttgggc

SEQ ID NO: 37914 - DNA, 20 bp, synthetic construct
  misc_feature 1..20: note = CRISPR gRNA sequence
  source 1..20: mol_type = other DNA
gtggactttgggcaagtata

SEQ ID NO: 37915 - DNA, 20 bp, synthetic construct
  misc_feature 1..20: note = CRISPR gRNA sequence
  source 1..20: mol_type = other DNA
ggactttgggcaagtatatg

SEQ ID NO: 37916 - DNA, 20 bp, synthetic construct
  misc_feature 1..20: note = CRISPR gRNA sequence
  source 1..20: mol_type = other DNA
gcacacacatgcacactgtc

SEQ ID NO: 37917 - DNA, 20 bp, synthetic construct
  misc_feature 1..20: note = CRISPR gRNA sequence
  source 1..20: mol_type = other DNA
cacacacatgcacactgtct

SEQ ID NO: 37918 - DNA, 20 bp, synthetic construct
  misc_feature 1..20: note = CRISPR gRNA sequence
  source 1..20: mol_type = other DNA
cacatgcacactgtctaggc

SEQ ID NO: 37919 - DNA, 20 bp, synthetic construct
  misc_feature 1..20: note = CRISPR gRNA sequence
  source 1..20: mol_type = other DNA
catgcacactgtctaggcca

SEQ ID NO: 37920 - DNA, 20 bp, synthetic construct
  misc_feature 1..20: note = CRISPR gRNA sequence
  source 1..20: mol_type = other DNA
ctaaaacgaatctgtaacaa

SEQ ID NO: 37921 - DNA, 20 bp, synthetic construct
  misc_feature 1..20: note = CRISPR gRNA sequence
  source 1..20: mol_type = other DNA
gtaacaatagccaactcata

SEQ ID NO: 37922 - DNA, 20 bp, synthetic construct
  misc_feature 1..20: note = CRISPR gRNA sequence
  source 1..20: mol_type = other DNA
ccaactcatatggtcattgc

SEQ ID NO: 37923 - DNA, 20 bp, synthetic construct
  misc_feature 1..20: note = CRISPR gRNA sequence
  source 1..20: mol_type = other DNA
catatggtcattgcaagaat

SEQ ID NO: 37924 - DNA, 20 bp, synthetic construct
  misc_feature 1..20: note = CRISPR gRNA sequence
  source 1..20: mol_type = other DNA
tggtcattgcaagaatgaga

SEQ ID NO: 37925 - DNA, 20 bp, synthetic construct
  misc_feature 1..20: note = CRISPR gRNA sequence
  source 1..20: mol_type = other DNA
ggtcattgcaagaatgagat

SEQ ID NO: 37926 - DNA, 20 bp, synthetic construct
  misc_feature 1..20: note = CRISPR gRNA sequence
  source 1..20: mol_type = other DNA
attgcaagaatgagatggga

SEQ ID NO: 37927 - DNA, 20 bp, synthetic construct
  misc_feature 1..20: note = CRISPR gRNA sequence
  source 1..20: mol_type = other DNA
ggtgcatgaaaaacattttg

SEQ ID NO: 37928 - DNA, 20 bp, synthetic construct
  misc_feature 1..20: note = CRISPR gRNA sequence
  source 1..20: mol_type = other DNA
atgaaaaacattttgtagca

SEQ ID NO: 37929 - DNA, 20 bp, synthetic construct
  misc_feature 1..20: note = CRISPR gRNA sequence
  source 1..20: mol_type = other DNA
acattttgtagcacagtgcc

SEQ ID NO: 37930 - DNA, 20 bp, synthetic construct
  misc_feature 1..20: note = CRISPR gRNA sequence
  source 1..20: mol_type = other DNA
ttgtagcacagtgcctagca

SEQ ID NO: 37931 - DNA, 20 bp, synthetic construct
  misc_feature 1..20: note = CRISPR gRNA sequence
  source 1..20: mol_type = other DNA
gtagcacagtgcctagcaca

SEQ ID NO: 37932 - DNA, 20 bp, synthetic construct
  misc_feature 1..20: note = CRISPR gRNA sequence
  source 1..20: mol_type = other DNA
acagtgcctagcacagagca

SEQ ID NO: 37933 - DNA, 20 bp, synthetic construct
  misc_feature 1..20: note = CRISPR gRNA sequence
  source 1..20: mol_type = other DNA
cagtgcctagcacagagcaa

SEQ ID NO: 37934 - DNA, 20 bp, synthetic construct
  misc_feature 1..20: note = CRISPR gRNA sequence
  source 1..20: mol_type = other DNA
cctagcacagagcaaaggct

SEQ ID NO: 37935 - DNA, 20 bp, synthetic construct
  misc_feature 1..20: note = CRISPR gRNA sequence
  source 1..20: mol_type = other DNA
caaaggctcagtgtgcatat

SEQ ID NO: 37936 - DNA, 20 bp, synthetic construct
  misc_feature 1..20: note = CRISPR gRNA sequence
  source 1..20: mol_type = other DNA
ggctcagtgtgcatattagc

SEQ ID NO: 37937 - DNA, 20 bp, synthetic construct
  misc_feature 1..20: note = CRISPR gRNA sequence
  source 1..20: mol_type = other DNA
ctcagtgtgcatattagcta

SEQ ID NO: 37938 - DNA, 20 bp, synthetic construct
  misc_feature 1..20: note = CRISPR gRNA sequence
  source 1..20: mol_type = other DNA
tgtgcatattagctagagaa

SEQ ID NO: 37939 - DNA, 20 bp, synthetic construct
  misc_feature 1..20: note = CRISPR gRNA sequence
  source 1..20: mol_type = other DNA
gtgcatattagctagagaaa

SEQ ID NO: 37940 - DNA, 20 bp, synthetic construct
  misc_feature 1..20: note = CRISPR gRNA sequence
  source 1..20: mol_type = other DNA
atattagctagagaaaaggc

SEQ ID NO: 37941 - DNA, 20 bp, synthetic construct
  misc_feature 1..20: note = CRISPR gRNA sequence
  source 1..20: mol_type = other DNA
tattagctagagaaaaggct

SEQ ID NO: 37942 - DNA, 20 bp, synthetic construct
  misc_feature 1..20: note = CRISPR gRNA sequence
  source 1..20: mol_type = other DNA
ctagagaaaaggctaggctg

SEQ ID NO: 37943 - DNA, 20 bp, synthetic construct
  misc_feature 1..20: note = CRISPR gRNA sequence
  source 1..20: mol_type = other DNA
aaaaggctaggctgcagtaa

SEQ ID NO: 37944 - DNA, 20 bp, synthetic construct
  misc_feature 1..20: note = CRISPR gRNA sequence
  source 1..20: mol_type = other DNA
aaggctaggctgcagtaaca

SEQ ID NO: 37945 - DNA, 20 bp, synthetic construct
  misc_feature 1..20: note = CRISPR gRNA sequence
  source 1..20: mol_type = other DNA
agaaacctcctccccaaata

SEQ ID NO: 37946 - DNA, 20 bp, synthetic construct
  misc_feature 1..20: note = CRISPR gRNA sequence
  source 1..20: mol_type = other DNA
aacctcctccccaaatacag

SEQ ID NO: 37947 - DNA, 20 bp, synthetic construct
  misc_feature 1..20: note = CRISPR gRNA sequence
  source 1..20: mol_type = other DNA
acctcctccccaaatacagt

SEQ ID NO: 37948 - DNA, 20 bp, synthetic construct
  misc_feature 1..20: note = CRISPR gRNA sequence
  source 1..20: mol_type = other DNA
atacagtaggttaaataatg

SEQ ID NO: 37949 - DNA, 20 bp, synthetic construct
  misc_feature 1..20: note = CRISPR gRNA sequence
  source 1..20: mol_type = other DNA
agaattttatttctctctca

SEQ ID NO: 37950 - DNA, 20 bp, synthetic construct
  misc_feature 1..20: note = CRISPR gRNA sequence
  source 1..20: mol_type = other DNA
attttatttctctctcatgg

SEQ ID NO: 37951 - DNA, 20 bp, synthetic construct
  misc_feature 1..20: note = CRISPR gRNA sequence
  source 1..20: mol_type = other DNA
tttatttctctctcatggaa

SEQ ID NO: 37952 - DNA, 20 bp, synthetic construct
  misc_feature 1..20: note = CRISPR gRNA sequence
  source 1..20: mol_type = other DNA
tttctctctcatggaagagt

SEQ ID NO: 37953 - DNA, 20 bp, synthetic construct
  misc_feature 1..20: note = CRISPR gRNA sequence
  source 1..20: mol_type = other DNA
tctctctcatggaagagtca

SEQ ID NO: 37954 - DNA, 20 bp, synthetic construct
  misc_feature 1..20: note = CRISPR gRNA sequence
  source 1..20: mol_type = other DNA
ctctctcatggaagagtcag

SEQ ID NO: 37955 - DNA, 20 bp, synthetic construct
  misc_feature 1..20: note = CRISPR gRNA sequence
  source 1..20: mol_type = other DNA
tctcatggaagagtcagagg

SEQ ID NO: 37956 - DNA, 20 bp, synthetic construct
  misc_feature 1..20: note = CRISPR gRNA sequence
  source 1..20: mol_type = other DNA
ctcatggaagagtcagaggt

SEQ ID NO: 37957 - DNA, 20 bp, synthetic construct
  misc_feature 1..20: note = CRISPR gRNA sequence
  source 1..20: mol_type = other DNA
atggaagagtcagaggtagg

SEQ ID NO: 37958 - DNA, 20 bp, synthetic construct
  misc_feature 1..20: note = CRISPR gRNA sequence
  source 1..20: mol_type = other DNA
agagtcagaggtaggtggtc

SEQ ID NO: 37959 - DNA, 20 bp, synthetic construct
  misc_feature 1..20: note = CRISPR gRNA sequence
  source 1..20: mol_type = other DNA
gagtcagaggtaggtggtcc

SEQ ID NO: 37960 - DNA, 20 bp, synthetic construct
  misc_feature 1..20: note = CRISPR gRNA sequence
  source 1..20: mol_type = other DNA
cagaggtaggtggtccaggt

SEQ ID NO: 37961 - DNA, 20 bp, synthetic construct
  misc_feature 1..20: note = CRISPR gRNA sequence
  source 1..20: mol_type = other DNA
aggtaggtggtccaggtcag

SEQ ID NO: 37962 - DNA, 20 bp, synthetic construct
  misc_feature 1..20: note = CRISPR gRNA sequence
  source 1..20: mol_type = other DNA
ggtggtccaggtcagtggaa

SEQ ID NO: 37963 - DNA, 20 bp, synthetic construct
  misc_feature 1..20: note = CRISPR gRNA sequence
  source 1..20: mol_type = other DNA
tccaggtcagtggaatggct

SEQ ID NO: 37964 - DNA, 20 bp, synthetic construct
  misc_feature 1..20: note = CRISPR gRNA sequence
  source 1..20: mol_type = other DNA
tggaatggctcagctccacg

SEQ ID NO: 37965 - DNA, 20 bp, synthetic construct
  misc_feature 1..20: note = CRISPR gRNA sequence
  source 1..20: mol_type = other DNA
ctcagctccacgcagtcatg

SEQ ID NO: 37966 - DNA, 20 bp, synthetic construct
  misc_feature 1..20: note = CRISPR gRNA sequence
  source 1..20: mol_type = other DNA
tcagctccacgcagtcatgc

SEQ ID NO: 37967 - DNA, 20 bp, synthetic construct
  misc_feature 1..20: note = CRISPR gRNA sequence
  source 1..20: mol_type = other DNA
cacgcagtcatgcaggtacc

SEQ ID NO: 37968 - DNA, 20 bp, synthetic construct
  misc_feature 1..20: note = CRISPR gRNA sequence
  source 1..20: mol_type = other DNA
acgcagtcatgcaggtaccc

SEQ ID NO: 37969 - DNA, 20 bp, synthetic construct
  misc_feature 1..20: note = CRISPR gRNA sequence
  source 1..20: mol_type = other DNA
attttgctccattatcccct

SEQ ID NO: 37970 - DNA, 20 bp, synthetic construct
  misc_feature 1..20: note = CRISPR gRNA sequence
  source 1..20: mol_type = other DNA
ttttgctccattatcccctt

SEQ ID NO: 37971 - DNA, 20 bp, synthetic construct
  misc_feature 1..20: note = CRISPR gRNA sequence
  source 1..20: mol_type = other DNA
ccttgggaatcctatctgca

SEQ ID NO: 37972 - DNA, 20 bp, synthetic construct
  misc_feature 1..20: note = CRISPR gRNA sequence
  source 1..20: mol_type = other DNA
gaatcctatctgcacagtca

SEQ ID NO: 37973 - DNA, 20 bp, synthetic construct
  misc_feature 1..20: note = CRISPR gRNA sequence
  source 1..20: mol_type = other DNA
gcacagtcaaagctacgtca

SEQ ID NO: 37974 - DNA, 20 bp, synthetic construct
  misc_feature 1..20: note = CRISPR gRNA sequence
  source 1..20: mol_type = other DNA
cacagtcaaagctacgtcat

SEQ ID NO: 37975 - DNA, 20 bp, synthetic construct
  misc_feature 1..20: note = CRISPR gRNA sequence
  source 1..20: mol_type = other DNA
tcatgggtatatctgtgctc

SEQ ID NO: 37976 - DNA, 20 bp, synthetic construct
  misc_feature 1..20: note = CRISPR gRNA sequence
  source 1..20: mol_type = other DNA
ggtatatctgtgctctggct

SEQ ID NO: 37977 - DNA, 20 bp, synthetic construct
  misc_feature 1..20: note = CRISPR gRNA sequence
  source 1..20: mol_type = other DNA
gtatatctgtgctctggctt

SEQ ID NO: 37978 - DNA, 20 bp, synthetic construct
  misc_feature 1..20: note = CRISPR gRNA sequence
  source 1..20: mol_type = other DNA
ctgtgctctggcttgggaac

SEQ ID NO: 37979 - DNA, 20 bp, synthetic construct
  misc_feature 1..20: note = CRISPR gRNA sequence
  source 1..20: mol_type = other DNA
tgtgctctggcttgggaaca

SEQ ID NO: 37980 - DNA, 20 bp, synthetic construct
  misc_feature 1..20: note = CRISPR gRNA sequence
  source 1..20: mol_type = other DNA
ctctggcttgggaacaagga

SEQ ID NO: 37981 - DNA, 20 bp, synthetic construct
  misc_feature 1..20: note = CRISPR gRNA sequence
  source 1..20: mol_type = other DNA
ctggcttgggaacaaggaaa

SEQ ID NO: 37982 - DNA, 20 bp, synthetic construct
  misc_feature 1..20: note = CRISPR gRNA sequence
  source 1..20: mol_type = other DNA
ttgggaacaaggaaagagca

SEQ ID NO: 37983 - DNA, 20 bp, synthetic construct
  misc_feature 1..20: note = CRISPR gRNA sequence
  source 1..20: mol_type = other DNA
gggaacaaggaaagagcatg

SEQ ID NO: 37984 - DNA, 20 bp, synthetic construct
  misc_feature 1..20: note = CRISPR gRNA sequence
  source 1..20: mol_type = other DNA
ggaacaaggaaagagcatgg

SEQ ID NO: 37985 - DNA, 20 bp, synthetic construct
  misc_feature 1..20: note = CRISPR gRNA sequence
  source 1..20: mol_type = other DNA
aggaacatgtcaatgcatta

SEQ ID NO: 37986 - DNA, 20 bp, synthetic construct
  misc_feature 1..20: note = CRISPR gRNA sequence
  source 1..20: mol_type = other DNA
catgtcaatgcattaaagtt

SEQ ID NO: 37987 - DNA, 20 bp, synthetic construct
  misc_feature 1..20: note = CRISPR gRNA sequence
  source 1..20: mol_type = other DNA
ttaaagttcagtcctgaaac

SEQ ID NO: 37988 - DNA, 20 bp, synthetic construct
  misc_feature 1..20: note = CRISPR gRNA sequence
  source 1..20: mol_type = other DNA
taaagttcagtcctgaaact

SEQ ID NO: 37989 - DNA, 20 bp, synthetic construct
  misc_feature 1..20: note = CRISPR gRNA sequence
  source 1..20: mol_type = other DNA
cccttccactcacattccat

SEQ ID NO: 37990 - DNA, 20 bp, synthetic construct
  misc_feature 1..20: note = CRISPR gRNA sequence
  source 1..20: mol_type = other DNA
tccactcacattccattggt

SEQ ID NO: 37991 - DNA, 20 bp, synthetic construct
  misc_feature 1..20: note = CRISPR gRNA sequence
  source 1..20: mol_type = other DNA
acattccattggtgagaaca

SEQ ID NO: 37992 - DNA, 20 bp, synthetic construct
  misc_feature 1..20: note = CRISPR gRNA sequence
  source 1..20: mol_type = other DNA
ttggtgagaacatagtcacc

SEQ ID NO: 37993 - DNA, 20 bp, synthetic construct
  misc_feature 1..20: note = CRISPR gRNA sequence
  source 1..20: mol_type = other DNA
catagtcacctggccacact

SEQ ID NO: 37994 - DNA, 20 bp, synthetic construct
  misc_feature 1..20: note = CRISPR gRNA sequence
  source 1..20: mol_type = other DNA
acctggccacactgagctgc

SEQ ID NO: 37995 - DNA, 20 bp, synthetic construct
  misc_feature 1..20: note = CRISPR gRNA sequence
  source 1..20: mol_type = other DNA
cctggccacactgagctgca

SEQ ID NO: 37996 - DNA, 20 bp, synthetic construct
  misc_feature 1..20: note = CRISPR gRNA sequence
  source 1..20: mol_type = other DNA
ctggccacactgagctgcaa

SEQ ID NO: 37997 - DNA, 20 bp, synthetic construct
  misc_feature 1..20: note = CRISPR gRNA sequence
  source 1..20: mol_type = other DNA
ggccacactgagctgcaagg

SEQ ID NO: 37998 - DNA, 20 bp, synthetic construct
  misc_feature 1..20: note = CRISPR gRNA sequence
  source 1..20: mol_type = other DNA
gccacactgagctgcaaggg

SEQ ID NO: 37999 - DNA, 20 bp, synthetic construct
  misc_feature 1..20: note = CRISPR gRNA sequence
  source 1..20: mol_type = other DNA
cactgagctgcaagggaggc

SEQ ID NO: 38000 - DNA, 20 bp, synthetic construct
  misc_feature 1..20: note = CRISPR gRNA sequence
  source 1..20: mol_type = other DNA
actgagctgcaagggaggct

SEQ ID NO: 38001 - DNA, 20 bp, synthetic construct
  misc_feature 1..20: note = CRISPR gRNA sequence
  source 1..20: mol_type = other DNA
aggctgggaaatgtgatctc

SEQ ID NO: 38002 - DNA, 20 bp, synthetic construct
  misc_feature 1..20: note = CRISPR gRNA sequence
  source 1..20: mol_type = other DNA
tgggaaatgtgatctctggc

SEQ ID NO: 38003 - DNA, 20 bp, synthetic construct
  misc_feature 1..20: note = CRISPR gRNA sequence
  source 1..20: mol_type = other DNA
gggaaatgtgatctctggct

SEQ ID NO: 38004 - DNA, 20 bp, synthetic construct
  misc_feature 1..20: note = CRISPR gRNA sequence
  source 1..20: mol_type = other DNA
ggaaaccatgttcctcatga

SEQ ID NO: 38005 - DNA, 20 bp, synthetic construct
  misc_feature 1..20: note = CRISPR gRNA sequence
  source 1..20: mol_type = other DNA
tcatgatagctctattgctg

SEQ ID NO: 38006 - DNA, 20 bp, synthetic construct
  misc_feature 1..20: note = CRISPR gRNA sequence
  source 1..20: mol_type = other DNA
tagctctattgctgtagatg

SEQ ID NO: 38007 - DNA, 20 bp, synthetic construct
  misc_feature 1..20: note = CRISPR gRNA sequence
  source 1..20: mol_type = other DNA
ctctattgctgtagatgaag

SEQ ID NO: 38008 - DNA, 20 bp, synthetic construct
  misc_feature 1..20: note = CRISPR gRNA sequence
  source 1..20: mol_type = other DNA
ctattgctgtagatgaagtg

SEQ ID NO: 38009 - DNA, 20 bp, synthetic construct
  misc_feature 1..20: note = CRISPR gRNA sequence
  source 1..20: mol_type = other DNA
gctgtagatgaagtggagaa

SEQ ID NO: 38010 - DNA, 20 bp, synthetic construct
  misc_feature 1..20: note = CRISPR gRNA sequence
  source 1..20: mol_type = other DNA
ctgtagatgaagtggagaat

SEQ ID NO: 38011 - DNA, 20 bp, synthetic construct
  misc_feature 1..20: note = CRISPR gRNA sequence
  source 1..20: mol_type = other DNA
atgaagtggagaatgggctt

SEQ ID NO: 38012 - DNA, 20 bp, synthetic construct
  misc_feature 1..20: note = CRISPR gRNA sequence
  source 1..20: mol_type = other DNA
aagtggagaatgggctttgg

SEQ ID NO: 38013 - DNA, 20 bp, synthetic construct
  misc_feature 1..20: note = CRISPR gRNA sequence
  source 1..20: mol_type = other DNA
aatgggctttggtggacgat

SEQ ID NO: 38014 - DNA, 20 bp, synthetic construct
  misc_feature 1..20: note = CRISPR gRNA sequence
  source 1..20: mol_type = other DNA
gggctttggtggacgattag

SEQ ID NO: 38015 - DNA, 20 bp, synthetic construct
  misc_feature 1..20: note = CRISPR gRNA sequence
  source 1..20: mol_type = other DNA
tggtggacgattagaagtct

SEQ ID NO: 38016 - DNA, 20 bp, synthetic construct
  misc_feature 1..20: note = CRISPR gRNA sequence
  source 1..20: mol_type = other DNA
cggccataatatgtatttgt

SEQ ID NO: 38017 - DNA, 20 bp, synthetic construct
  misc_feature 1..20: note = CRISPR gRNA sequence
  source 1..20: mol_type = other DNA
tttgttagtactactgtatt

SEQ ID NO: 38018 - DNA, 20 bp, synthetic construct
  misc_feature 1..20: note = CRISPR gRNA sequence
  source 1..20: mol_type = other DNA
gtattaagccccatctctct

SEQ ID NO: 38019 - DNA, 20 bp, synthetic construct
  misc_feature 1..20: note = CRISPR gRNA sequence
  source 1..20: mol_type = other DNA
tattaagccccatctctctg

SEQ ID NO: 38020 - DNA, 20 bp, synthetic construct
  misc_feature 1..20: note = CRISPR gRNA sequence
  source 1..20: mol_type = other DNA
attaagccccatctctctga

SEQ ID NO: 38021 - DNA, 20 bp, synthetic construct
  misc_feature 1..20: note = CRISPR gRNA sequence
  source 1..20: mol_type = other DNA
ttaagccccatctctctgag

SEQ ID NO: 38022 - DNA, 20 bp, synthetic construct
  misc_feature 1..20: note = CRISPR gRNA sequence
  source 1..20: mol_type = other DNA
gccccatctctctgagggga

SEQ ID NO: 38023 - DNA, 20 bp, synthetic construct
  misc_feature 1..20: note = CRISPR gRNA sequence
  source 1..20: mol_type = other DNA
aggggatggcgatgacttct

SEQ ID NO: 38024 - DNA, 20 bp, synthetic construct
  misc_feature 1..20: note = CRISPR gRNA sequence
  source 1..20: mol_type = other DNA
gatgacttctcagctctgcc

SEQ ID NO: 38025 - DNA, 20 bp, synthetic construct
  misc_feature 1..20: note = CRISPR gRNA sequence
  source 1..20: mol_type = other DNA
tgacacttcgcttcttctta

SEQ ID NO: 38026 - DNA, 20 bp, synthetic construct
  misc_feature 1..20: note = CRISPR gRNA sequence
  source 1..20: mol_type = other DNA
cacttcgcttcttcttatgg

SEQ ID NO: 38027 - DNA, 20 bp, synthetic construct
  misc_feature 1..20: note = CRISPR gRNA sequence
  source 1..20: mol_type = other DNA
cttcttcttatggcagcttt

SEQ ID NO: 38028 - DNA, 20 bp, synthetic construct
  misc_feature 1..20: note = CRISPR gRNA sequence
  source 1..20: mol_type = other DNA
tcttcttatggcagctttaa

SEQ ID NO: 38029 - DNA, 20 bp, synthetic construct
  misc_feature 1..20: note = CRISPR gRNA sequence
  source 1..20: mol_type = other DNA
tcttatggcagctttaagag

SEQ ID NO: 38030 - DNA, 20 bp, synthetic construct
  misc_feature 1..20: note = CRISPR gRNA sequence
  source 1..20: mol_type = other DNA
cttatggcagctttaagagc

SEQ ID NO: 38031 - DNA, 20 bp, synthetic construct
  misc_feature 1..20: note = CRISPR gRNA sequence
  source 1..20: mol_type = other DNA
atggcagctttaagagcagg

SEQ ID NO: 38032 - DNA, 20 bp, synthetic construct
  misc_feature 1..20: note = CRISPR gRNA sequence
  source 1..20: mol_type = other DNA
agctttaagagcaggaagtg

SEQ ID NO: 38033 - DNA, 20 bp, synthetic construct
  misc_feature 1..20: note = CRISPR gRNA sequence
  source 1..20: mol_type = other DNA
gctttaagagcaggaagtgt

SEQ ID NO: 38034 - DNA, 20 bp, synthetic construct
  misc_feature 1..20: note = CRISPR gRNA sequence
  source 1..20: mol_type = other DNA
ctttaagagcaggaagtgtg

SEQ ID NO: 38035 - DNA, 20 bp, synthetic construct
  misc_feature 1..20: note = CRISPR gRNA sequence
  source 1..20: mol_type = other DNA
gaagtgtggggatgcctttg

SEQ ID NO: 38036 - DNA, 20 bp, synthetic construct
  misc_feature 1..20: note = CRISPR gRNA sequence
  source 1..20: mol_type = other DNA
gtgtggggatgcctttgcag

SEQ ID NO: 38037 - DNA, 20 bp, synthetic construct
  misc_feature 1..20: note = CRISPR gRNA sequence
  source 1..20: mol_type = other DNA
gcctttgcagaagccctctc

SEQ ID NO: 38038 - DNA, 20 bp, synthetic construct
  misc_feature 1..20: note = CRISPR gRNA sequence
  source 1..20: mol_type = other DNA
cctttgcagaagccctctcc

SEQ ID NO: 38039 - DNA, 20 bp, synthetic construct
  misc_feature 1..20: note = CRISPR gRNA sequence
  source 1..20: mol_type = other DNA
tttgcagaagccctctccag

SEQ ID NO: 38040 - DNA, 20 bp, synthetic construct
  misc_feature 1..20: note = CRISPR gRNA sequence
  source 1..20: mol_type = other DNA
ctccaggagcttgccgacaa

SEQ ID NO: 38041 - DNA, 20 bp, synthetic construct
  misc_feature 1..20: note = CRISPR gRNA sequence
  source 1..20: mol_type = other DNA
tccaggagcttgccgacaat

SEQ ID NO: 38042 - DNA, 20 bp, synthetic construct
  misc_feature 1..20: note = CRISPR gRNA sequence
  source 1..20: mol_type = other DNA
ccaggagcttgccgacaatg

SEQ ID NO: 38043 - DNA, 20 bp, synthetic construct
  misc_feature 1..20: note = CRISPR gRNA sequence
  source 1..20: mol_type = other DNA
aggagcttgccgacaatggg

SEQ ID NO: 38044 - DNA, 20 bp, synthetic construct
  misc_feature 1..20: note = CRISPR gRNA sequence
  source 1..20: mol_type = other DNA
ggagcttgccgacaatgggg

SEQ ID NO: 38045 - DNA, 20 bp, synthetic construct
  misc_feature 1..20: note = CRISPR gRNA sequence
  source 1..20: mol_type = other DNA
tgccgacaatggggaggctg

SEQ ID NO: 38046 - DNA, 20 bp, synthetic construct
  misc_feature 1..20: note = CRISPR gRNA sequence
  source 1..20: mol_type = other DNA
aatggggaggctgcagatgc

SEQ ID NO: 38047 - DNA, 20 bp, synthetic construct
  misc_feature 1..20: note = CRISPR gRNA sequence
  source 1..20: mol_type = other DNA
atggggaggctgcagatgct

SEQ ID NO: 38048 - DNA, 20 bp, synthetic construct
  misc_feature 1..20: note = CRISPR gRNA sequence
  source 1..20: mol_type = other DNA
tggggaggctgcagatgctg

SEQ ID NO: 38049 - DNA, 20 bp, synthetic construct
  misc_feature 1..20: note = CRISPR gRNA sequence
  source 1..20: mol_type = other DNA
gaggctgcagatgctggggt

SEQ ID NO: 38050 - DNA, 20 bp, synthetic construct
  misc_feature 1..20: note = CRISPR gRNA sequence
  source 1..20: mol_type = other DNA
ctgcagatgctggggtgagc

SEQ ID NO: 38051 - DNA, 20 bp, synthetic construct
  misc_feature 1..20: note = CRISPR gRNA sequence
  source 1..20: mol_type = other DNA
tgcagatgctggggtgagcc

SEQ ID NO: 38052 - DNA, 20 bp, synthetic construct
  misc_feature 1..20: note = CRISPR gRNA sequence
  source 1..20: mol_type = other DNA
tgctggggtgagccaggcct

SEQ ID NO: 38053 - DNA, 20 bp, synthetic construct
  misc_feature 1..20: note = CRISPR gRNA sequence
  source 1..20: mol_type = other DNA
ctggggtgagccaggccttg

SEQ ID NO: 38054 - DNA, 20 bp, synthetic construct
  misc_feature 1..20: note = CRISPR gRNA sequence
  source 1..20: mol_type = other DNA
gtgagccaggccttggagct

SEQ ID NO: 38055 - DNA, 20 bp, synthetic construct
  misc_feature 1..20: note = CRISPR gRNA sequence
  source 1..20: mol_type = other DNA
agccaggccttggagctgag

SEQ ID NO: 38056 - DNA, 20 bp, synthetic construct
  misc_feature 1..20: note = CRISPR gRNA sequence
  source 1..20: mol_type = other DNA
gccaggccttggagctgaga

SEQ ID NO: 38057 - DNA, 20 bp, synthetic construct
  misc_feature 1..20: note = CRISPR gRNA sequence
  source 1..20: mol_type = other DNA
ccaggccttggagctgagaa

SEQ ID NO: 38058 - DNA, 20 bp, synthetic construct
  misc_feature 1..20: note = CRISPR gRNA sequence
  source 1..20: mol_type = other DNA
ttggagctgagaagggtctt

SEQ ID NO: 38059 - DNA, 20 bp, synthetic construct
  misc_feature 1..20: note = CRISPR gRNA sequence
  source 1..20: mol_type = other DNA
agctgagaagggtcttcagc

SEQ ID NO: 38060 - DNA, 20 bp, synthetic construct
  misc_feature 1..20: note = CRISPR gRNA sequence
  source 1..20: mol_type = other DNA
gctgagaagggtcttcagct

SEQ ID NO: 38061 - DNA, 20 bp, synthetic construct
  misc_feature 1..20: note = CRISPR gRNA sequence
  source 1..20: mol_type = other DNA
ctgagaagggtcttcagctg

SEQ ID NO: 38062 - DNA, 20 bp, synthetic construct
  misc_feature 1..20: note = CRISPR gRNA sequence
  source 1..20: mol_type = other DNA
ggtcttcagctggggatgcc

SEQ ID NO: 38063 - DNA, 20 bp, synthetic construct
  misc_feature 1..20: note = CRISPR gRNA sequence
  source 1..20: mol_type = other DNA
ccctctccttaatcctacac

SEQ ID NO: 38064 - DNA, 20 bp, synthetic construct
  misc_feature 1..20: note = CRISPR gRNA sequence
  source 1..20: mol_type = other DNA
cctctccttaatcctacaca

SEQ ID NO: 38065 - DNA, 20 bp, synthetic construct
  misc_feature 1..20: note = CRISPR gRNA sequence
  source 1..20: mol_type = other DNA
ctccttaatcctacacaagg

SEQ ID NO: 38066 - DNA, 20 bp, synthetic construct
  misc_feature 1..20: note = CRISPR gRNA sequence
  source 1..20: mol_type = other DNA
tcctacacaaggcagattcc

SEQ ID NO: 38067 - DNA, 20 bp, synthetic construct
  misc_feature 1..20: note = CRISPR gRNA sequence
  source 1..20: mol_type = other DNA
caccatctttgcttactctg

SEQ ID NO: 38068 - DNA, 20 bp, synthetic construct
  misc_feature 1..20: note = CRISPR gRNA sequence
  source 1..20: mol_type = other DNA
accatctttgcttactctgt

SEQ ID NO: 38069 - DNA, 20 bp, synthetic construct
  misc_feature 1..20: note = CRISPR gRNA sequence
  source 1..20: mol_type = other DNA
tctttgcttactctgtaggt

SEQ ID NO: 38070 - DNA, 20 bp, synthetic construct
  misc_feature 1..20: note = CRISPR gRNA sequence
  source 1..20: mol_type = other DNA
ttgcttactctgtaggttag

SEQ ID NO: 38071 - DNA, 20 bp, synthetic construct
  misc_feature 1..20: note = CRISPR gRNA sequence
  source 1..20: mol_type = other DNA
tgcttactctgtaggttagc

SEQ ID NO: 38072 - DNA, 20 bp, synthetic construct
  misc_feature 1..20: note = CRISPR gRNA sequence
  source 1..20: mol_type = other DNA
ttactctgtaggttagcagg

SEQ ID NO: 38073 - DNA, 20 bp, synthetic construct
  misc_feature 1..20: note = CRISPR gRNA sequence
  source 1..20: mol_type = other DNA
aggaagtaaaatcactgccc

SEQ ID NO: 38074 - DNA, 20 bp, synthetic construct
  misc_feature 1..20: note = CRISPR gRNA sequence
  source 1..20: mol_type = other DNA
ggaagtaaaatcactgcccg

SEQ ID NO: 38075 - DNA, 20 bp, synthetic construct
  misc_feature 1..20: note = CRISPR gRNA sequence
  source 1..20: mol_type = other DNA
aaaatcactgcccgaggcat

SEQ ID NO: 38076 - DNA, 20 bp, synthetic construct
  misc_feature 1..20: note = CRISPR gRNA sequence
  source 1..20: mol_type = other DNA
tgcccgaggcatcagccacc

SEQ ID NO: 38077 - DNA, 20 bp, synthetic construct
  misc_feature 1..20: note = CRISPR gRNA sequence
  source 1..20: mol_type = other DNA
aggcatcagccacctggtga

SEQ ID NO: 38078 - DNA, 20 bp, synthetic construct
  misc_feature 1..20: note = CRISPR gRNA sequence
  source 1..20: mol_type = other DNA
aagctttgcctctctgtcca

SEQ ID NO: 38079 - DNA, 20 bp, synthetic construct
  misc_feature 1..20: note = CRISPR gRNA sequence
  source 1..20: mol_type = other DNA
gcctctctgtccacagctga

SEQ ID NO: 38080 - DNA, 20 bp, synthetic construct
  misc_feature 1..20: note = CRISPR gRNA sequence
  source 1..20: mol_type = other DNA
tctctgtccacagctgaaag

SEQ ID NO: 38081 - DNA, 20 bp, synthetic construct
  misc_feature 1..20: note = CRISPR gRNA sequence
  source 1..20: mol_type = other DNA
tgtccacagctgaaagaagt

SEQ ID NO: 38082 - DNA, 20 bp, synthetic construct
  misc_feature 1..20: note = CRISPR gRNA sequence
  source 1..20: mol_type = other DNA
gtccacagctgaaagaagtc

SEQ ID NO: 38083 - DNA, 20 bp, synthetic construct
  misc_feature 1..20: note = CRISPR gRNA sequence
  source 1..20: mol_type = other DNA
acagctgaaagaagtcaggt

SEQ ID NO: 38084 - DNA, 20 bp, synthetic construct
  misc_feature 1..20: note = CRISPR gRNA sequence
  source 1..20: mol_type = other DNA
gaagtcaggtgagtgatctc

SEQ ID NO: 38085 - DNA, 20 bp, synthetic construct
  misc_feature 1..20: note = CRISPR gRNA sequence
  source 1..20: mol_type = other DNA
aagtcaggtgagtgatctcc

SEQ ID NO: 38086 - DNA, 20 bp, synthetic construct
  misc_feature 1..20: note = CRISPR gRNA sequence
  source 1..20: mol_type = other DNA
gtcaggtgagtgatctccag

SEQ ID NO: 38087 - DNA, 20 bp, synthetic construct
  misc_feature 1..20: note = CRISPR gRNA sequence
  source 1..20: mol_type = other DNA
tcaggtgagtgatctccagg

SEQ ID NO: 38088 - DNA, 20 bp, synthetic construct
  misc_feature 1..20: note = CRISPR gRNA sequence
  source 1..20: mol_type = other DNA
caggtgagtgatctccagga

SEQ ID NO: 38089 - DNA, 20 bp, synthetic construct
  misc_feature 1..20: note = CRISPR gRNA sequence
  source 1..20: mol_type = other DNA
ctccaggagggctcactgac

SEQ ID NO: 38090 - DNA, 20 bp, synthetic construct
  misc_feature 1..20: note = CRISPR gRNA sequence
  source 1..20: mol_type = other DNA
tccaggagggctcactgact

SEQ ID NO: 38091 - DNA, 20 bp, synthetic construct
  misc_feature 1..20: note = CRISPR gRNA sequence
  source 1..20: mol_type = other DNA
ccaggagggctcactgactg

SEQ ID NO: 38092 - DNA, 20 bp, synthetic construct
  misc_feature 1..20: note = CRISPR gRNA sequence
  source 1..20: mol_type = other DNA
aggagggctcactgactggg

SEQ ID NO: 38093 - DNA, 20 bp, synthetic construct
  misc_feature 1..20: note = CRISPR gRNA sequence
  source 1..20: mol_type = other DNA
ggctcactgactggggagat

SEQ ID NO: 38094 - DNA, 20 bp, synthetic construct
  misc_feature 1..20: note = CRISPR gRNA sequence
  source 1..20: mol_type = other DNA
tggggagatgagccactgcc

SEQ ID NO: 38095 - DNA, 20 bp, synthetic construct
  misc_feature 1..20: note = CRISPR gRNA sequence
  source 1..20: mol_type = other DNA
ggggagatgagccactgccc

SEQ ID NO: 38096 - DNA, 20 bp, synthetic construct
  misc_feature 1..20: note = CRISPR gRNA sequence
  source 1..20: mol_type = other DNA
atgagccactgcccaggtcc

SEQ ID NO: 38097 - DNA, 20 bp, synthetic construct
  misc_feature 1..20: note = CRISPR gRNA sequence
  source 1..20: mol_type = other DNA
gagccactgcccaggtccca

SEQ ID NO: 38098 - DNA, 20 bp, synthetic construct
  misc_feature 1..20: note = CRISPR gRNA sequence
  source 1..20: mol_type = other DNA
cccaggtcccagagtccccc

SEQ ID NO: 38099 - DNA, 20 bp, synthetic construct
  misc_feature 1..20: note = CRISPR gRNA sequence
  source 1..20: mol_type = other DNA
ccaggtcccagagtccccct

SEQ ID NO: 38100 - DNA, 20 bp, synthetic construct
  misc_feature 1..20: note = CRISPR gRNA sequence
  source 1..20: mol_type = other DNA
caggtcccagagtccccctg

SEQ ID NO: 38101 - DNA, 20 bp, synthetic construct
  misc_feature 1..20: note = CRISPR gRNA sequence
  source 1..20: mol_type = other DNA
tggggcctgcatgttcctcc

SEQ ID NO: 38102 - DNA, 20 bp, synthetic construct
  misc_feature 1..20: note = CRISPR gRNA sequence
  source 1..20: mol_type = other DNA
catgttcctccaagtctgac

SEQ ID NO: 38103 - DNA, 20 bp, synthetic construct
  misc_feature 1..20: note = CRISPR gRNA sequence
  source 1..20: mol_type = other DNA
gttcctccaagtctgaccag

SEQ ID NO: 38104 - DNA, 20 bp, synthetic construct
  misc_feature 1..20: note = CRISPR gRNA sequence
  source 1..20: mol_type = other DNA
aagtctgaccagtagttttt

SEQ ID NO: 38105 - DNA, 20 bp, synthetic construct
  misc_feature 1..20: note = CRISPR gRNA sequence
  source 1..20: mol_type = other DNA
ctgaccagtagtttttcagt

SEQ ID NO: 38106 - DNA, 20 bp, synthetic construct
  misc_feature 1..20: note = CRISPR gRNA sequence
  source 1..20: mol_type = other DNA
agtagtttttcagtgagacc

SEQ ID NO: 38107 - DNA, 20 bp, synthetic construct
  misc_feature 1..20: note = CRISPR gRNA sequence
  source 1..20: mol_type = other DNA
tagtttttcagtgagaccca

SEQ ID NO: 38108 - DNA, 20 bp, synthetic construct
  misc_feature 1..20: note = CRISPR gRNA sequence
  source 1..20: mol_type = other DNA
gtttttcagtgagacccaga

SEQ ID NO: 38109 - DNA, 20 bp, synthetic construct
  misc_feature 1..20: note = CRISPR gRNA sequence
  source 1..20: mol_type = other DNA
tttttcagtgagacccagag

SEQ ID NO: 38110 - DNA, 20 bp, synthetic construct
  misc_feature 1..20: note = CRISPR gRNA sequence
  source 1..20: mol_type = other DNA
ttttcagtgagacccagaga

SEQ ID NO: 38111 - DNA, 20 bp, synthetic construct
  misc_feature 1..20: note = CRISPR gRNA sequence
  source 1..20: mol_type = other DNA
tcagtgagacccagagaggg

SEQ ID NO: 38112 - DNA, 20 bp, synthetic construct
  misc_feature 1..20: note = CRISPR gRNA sequence
  source 1..20: mol_type = other DNA
cagtgagacccagagaggga

SEQ ID NO: 38113 - DNA, 20 bp, synthetic construct
  misc_feature 1..20: note = CRISPR gRNA sequence
  source 1..20: mol_type = other DNA
gacccagagagggaaggcat

SEQ ID NO: 38114 - DNA, 20 bp, synthetic construct
  misc_feature 1..20: note = CRISPR gRNA sequence
  source 1..20: mol_type = other DNA
gagagggaaggcatcagtcc

SEQ ID NO: 38115 - DNA, 20 bp, synthetic construct
  misc_feature 1..20: note = CRISPR gRNA sequence
  source 1..20: mol_type = other DNA
aaggcatcagtccaagtact

SEQ ID NO: 38116 - DNA, 20 bp, synthetic construct
  misc_feature 1..20: note = CRISPR gRNA sequence
  source 1..20: mol_type = other DNA
gcatcagtccaagtactcag

SEQ ID NO: 38117 - DNA, 20 bp, synthetic construct
  misc_feature 1..20: note = CRISPR gRNA sequence
  source 1..20: mol_type = other DNA
catcagtccaagtactcagt

SEQ ID NO: 38118 - DNA, 20 bp, synthetic construct
  misc_feature 1..20: note = CRISPR gRNA sequence
  source 1..20: mol_type = other DNA
atcagtccaagtactcagta

SEQ ID NO: 38119 - DNA, 20 bp, synthetic construct
  misc_feature 1..20: note = CRISPR gRNA sequence
  source 1..20: mol_type = other DNA
tccaagtactcagtagggct

SEQ ID NO: 38120 - DNA, 20 bp, synthetic construct
  misc_feature 1..20: note = CRISPR gRNA sequence
  source 1..20: mol_type = other DNA
gtagggctgagtccaaaccc

SEQ ID NO: 38121 - DNA, 20 bp, synthetic construct
  misc_feature 1..20: note = CRISPR gRNA sequence
  source 1..20: mol_type = other DNA
tagggctgagtccaaaccca

SEQ ID NO: 38122 - DNA, 20 bp, synthetic construct
  misc_feature 1..20: note = CRISPR gRNA sequence
  source 1..20: mol_type = other DNA
gagtccaaacccaaggctcc

SEQ ID NO: 38123 - DNA, 20 bp, synthetic construct
  misc_feature 1..20: note = CRISPR gRNA sequence
  source 1..20: mol_type = other DNA
gtccaaacccaaggctccca

SEQ ID NO: 38124 - DNA, 20 bp, synthetic construct
  misc_feature 1..20: note = CRISPR gRNA sequence
  source 1..20: mol_type = other DNA
cccaaggctcccagagtccc

SEQ ID NO: 38125 - DNA, 20 bp, synthetic construct
  misc_feature 1..20: note = CRISPR gRNA sequence
  source 1..20: mol_type = other DNA
caaggctcccagagtcccca

SEQ ID NO: 38126 - DNA, 20 bp, synthetic construct
  misc_feature 1..20: note = CRISPR gRNA sequence
  source 1..20: mol_type = other DNA
gctcccagagtccccagagc

SEQ ID NO: 38127 - DNA, 20 bp, synthetic construct
  misc_feature 1..20: note = CRISPR gRNA sequence
  source 1..20: mol_type = other DNA
ctcccagagtccccagagca

SEQ ID NO: 38128 - DNA, 20 bp, synthetic construct
  misc_feature 1..20: note = CRISPR gRNA sequence
  source 1..20: mol_type = other DNA
gcttccttcatctaatattt

SEQ ID NO: 38129 - DNA, 20 bp, synthetic construct
  misc_feature 1..20: note = CRISPR gRNA sequence
  source 1..20: mol_type = other DNA
tctaatattttagactgtct

SEQ ID NO: 38130 - DNA, 20 bp, synthetic construct
  misc_feature 1..20: note = CRISPR gRNA sequence
  source 1..20: mol_type = other DNA
taatattttagactgtcttg

SEQ ID NO: 38131 - DNA, 20 bp, synthetic construct
  misc_feature 1..20: note = CRISPR gRNA sequence
  source 1..20: mol_type = other DNA
aatattttagactgtcttgg

SEQ ID NO: 38132 - DNA, 20 bp, synthetic construct
  misc_feature 1..20: note = CRISPR gRNA sequence
  source 1..20: mol_type = other DNA
tattttagactgtcttggag

SEQ ID NO: 38133 - DNA, 20 bp, synthetic construct
  misc_feature 1..20: note = CRISPR gRNA sequence
  source 1..20: mol_type = other DNA
agactgtcttggaggagcat

SEQ ID NO: 38134 - DNA, 20 bp, synthetic construct
  misc_feature 1..20: note = CRISPR gRNA sequence
  source 1..20: mol_type = other DNA
cttggaggagcatgagtgtt

SEQ ID NO: 38135 - DNA, 20 bp, synthetic construct
  misc_feature 1..20: note = CRISPR gRNA sequence
  source 1..20: mol_type = other DNA
ttggaggagcatgagtgtta

SEQ ID NO: 38136 - DNA, 20 bp, synthetic construct
  misc_feature 1..20: note = CRISPR gRNA sequence
  source 1..20: mol_type = other DNA
cctccctctttctgaaatcc

SEQ ID NO: 38137 - DNA, 20 bp, synthetic construct
  misc_feature 1..20: note = CRISPR gRNA sequence
  source 1..20: mol_type = other DNA
ctccctctttctgaaatccc

SEQ ID NO: 38138 - DNA, 20 bp, synthetic construct
  misc_feature 1..20: note = CRISPR gRNA sequence
  source 1..20: mol_type = other DNA
ccctctttctgaaatcccag

SEQ ID NO: 38139 - DNA, 20 bp, synthetic construct
  misc_feature 1..20: note = CRISPR gRNA sequence
  source 1..20: mol_type = other DNA
tctttctgaaatcccaggag

SEQ ID NO: 38140 - DNA, 20 bp, synthetic construct
  misc_feature 1..20: note = CRISPR gRNA sequence
  source 1..20: mol_type = other DNA
ctttctgaaatcccaggaga

SEQ ID NO: 38141 - DNA, 20 bp, synthetic construct
  misc_feature 1..20: note = CRISPR gRNA sequence
  source 1..20: mol_type = other DNA
tttctgaaatcccaggagaa

SEQ ID NO: 38142 - DNA, 20 bp, synthetic construct
  misc_feature 1..20: note = CRISPR gRNA sequence
  source 1..20: mol_type = other DNA
tgaaatcccaggagaaggga

SEQ ID NO: 38143 - DNA, 20 bp, synthetic construct
  misc_feature 1..20: note = CRISPR gRNA sequence
  source 1..20: mol_type = other DNA
aatcccaggagaagggatag

SEQ ID NO: 38144 - DNA, 20 bp, synthetic construct
  misc_feature 1..20: note = CRISPR gRNA sequence
  source 1..20: mol_type = other DNA
ggagaagggatagcagtgcg

SEQ ID NO: 38145 - DNA, 20 bp, synthetic construct
  misc_feature 1..20: note = CRISPR gRNA sequence
  source 1..20: mol_type = other DNA
gagaagggatagcagtgcgt

SEQ ID NO: 38146 - DNA, 20 bp, synthetic construct
  misc_feature 1..20: note = CRISPR gRNA sequence
  source 1..20: mol_type = other DNA
aagggatagcagtgcgtagg

SEQ ID NO: 38147 - DNA, 20 bp, synthetic construct
  misc_feature 1..20: note = CRISPR gRNA sequence
  source 1..20: mol_type = other DNA
agggatagcagtgcgtaggc

SEQ ID NO: 38148 - DNA, 20 bp, synthetic construct
  misc_feature 1..20: note = CRISPR gRNA sequence
  source 1..20: mol_type = other DNA
agcagtgcgtaggcaggaat

SEQ ID NO: 38149 - DNA, 20 bp, synthetic construct
  misc_feature 1..20: note = CRISPR gRNA sequence
  source 1..20: mol_type = other DNA
gcagtgcgtaggcaggaatc

SEQ ID NO: 38150 - DNA, 20 bp, synthetic construct
  misc_feature 1..20: note = CRISPR gRNA sequence
  source 1..20: mol_type = other DNA
taggcaggaatcaggcactg

SEQ ID NO: 38151 - DNA, 20 bp, synthetic construct
  misc_feature 1..20: note = CRISPR gRNA sequence
  source 1..20: mol_type = other DNA
aggcaggaatcaggcactgt

SEQ ID NO: 38152 - DNA, 20 bp, synthetic construct
  misc_feature 1..20: note = CRISPR gRNA sequence
  source 1..20: mol_type = other DNA
tgggtacacataactacatg

SEQ ID NO: 38153 - DNA, 20 bp, synthetic construct
  misc_feature 1..20: note = CRISPR gRNA sequence
  source 1..20: mol_type = other DNA
cacacatgtctacacttgca

SEQ ID NO: 38154 - DNA, 20 bp, synthetic construct
  misc_feature 1..20: note = CRISPR gRNA sequence
  source 1..20: mol_type = other DNA
acatgtctacacttgcacag

SEQ ID NO: 38155 - DNA, 20 bp, synthetic construct
  misc_feature 1..20: note = CRISPR gRNA sequence
  source 1..20: mol_type = other DNA
tacacttgcacagaagtaca

SEQ ID NO: 38156 - DNA, 20 bp, synthetic construct
  misc_feature 1..20: note = CRISPR gRNA sequence
  source 1..20: mol_type = other DNA
acacttgcacagaagtacac

SEQ ID NO: 38157 - DNA, 20 bp, synthetic construct
  misc_feature 1..20: note = CRISPR gRNA sequence
  source 1..20: mol_type = other DNA
agaagtacacaggcatatgc

SEQ ID NO: 38158 - DNA, 20 bp, synthetic construct
  misc_feature 1..20: note = CRISPR gRNA sequence
  source 1..20: mol_type = other DNA
cacccacacatgcccactca

SEQ ID NO: 38159 - DNA, 20 bp, synthetic construct
  misc_feature 1..20: note = CRISPR gRNA sequence
  source 1..20: mol_type = other DNA
acccacacatgcccactcat

SEQ ID NO: 38160 - DNA, 20 bp, synthetic construct
  misc_feature 1..20: note = CRISPR gRNA sequence
  source 1..20: mol_type = other DNA
cataggtgtgcacatgtatg

SEQ ID NO: 38161 - DNA, 20 bp, synthetic construct
  misc_feature 1..20: note = CRISPR gRNA sequence
  source 1..20: mol_type = other DNA
acatgtacacattttgatgc

SEQ ID NO: 38162 - DNA, 20 bp, synthetic construct
  misc_feature 1..20: note = CRISPR gRNA sequence
  source 1..20: mol_type = other DNA
ccagcacactctaactaact

SEQ ID NO: 38163 - DNA, 20 bp, synthetic construct
  misc_feature 1..20: note = CRISPR gRNA sequence
  source 1..20: mol_type = other DNA
atatactcctgccctgtgtc

SEQ ID NO: 38164 - DNA, 20 bp, synthetic construct
  misc_feature 1..20: note = CRISPR gRNA sequence
  source 1..20: mol_type = other DNA
tatactcctgccctgtgtct

SEQ ID NO: 38165 - DNA, 20 bp, synthetic construct
  misc_feature 1..20: note = CRISPR gRNA sequence
  source 1..20: mol_type = other DNA
cctgccctgtgtctgggact

SEQ ID NO: 38166 - DNA, 20 bp, synthetic construct
  misc_feature 1..20: note = CRISPR gRNA sequence
  source 1..20: mol_type = other DNA
gtgtctgggactcagtacca

SEQ ID NO: 38167 - DNA, 20 bp, synthetic construct
  misc_feature 1..20: note = CRISPR gRNA sequence
  source 1..20: mol_type = other DNA
tgtctgggactcagtaccat

SEQ ID NO: 38168 - DNA, 20 bp, synthetic construct
  misc_feature 1..20: note = CRISPR gRNA sequence
  source 1..20: mol_type = other DNA
gtctgggactcagtaccatg

SEQ ID NO: 38169 - DNA, 20 bp, synthetic construct
  misc_feature 1..20: note = CRISPR gRNA sequence
  source 1..20: mol_type = other DNA
ctgggactcagtaccatggg

SEQ ID NO: 38170 - DNA, 20 bp, synthetic construct
  misc_feature 1..20: note = CRISPR gRNA sequence
  source 1..20: mol_type = other DNA
tgggactcagtaccatgggg

SEQ ID NO: 38171 - DNA, 20 bp, synthetic construct
  misc_feature 1..20: note = CRISPR gRNA sequence
  source 1..20: mol_type = other DNA
ggactcagtaccatggggag

SEQ ID NO: 38172 - DNA, 20 bp, synthetic construct
  misc_feature 1..20: note = CRISPR gRNA sequence
  source 1..20: mol_type = other DNA
ctcagtaccatggggaggag

SEQ ID NO: 38173 - DNA, 20 bp, synthetic construct
  misc_feature 1..20: note = CRISPR gRNA sequence
  source 1..20: mol_type = other DNA
tcagtaccatggggaggagt

SEQ ID NO: 38174 - DNA, 20 bp, synthetic construct
  misc_feature 1..20: note = CRISPR gRNA sequence
  source 1..20: mol_type = other DNA
accatggggaggagtgggac

SEQ ID NO: 38175 - DNA, 20 bp, synthetic construct
  misc_feature 1..20: note = CRISPR gRNA sequence
  source 1..20: mol_type = other DNA
ggaccagtgaccctcctccc

SEQ ID NO: 38176 - DNA, 20 bp, synthetic construct
  misc_feature 1..20: note = CRISPR gRNA sequence
  source 1..20: mol_type = other DNA
ccagtgaccctcctccctgg

SEQ ID NO: 38177 - DNA, 20 bp, synthetic construct
  misc_feature 1..20: note = CRISPR gRNA sequence
  source 1..20: mol_type = other DNA
cctccctggcagaacgctgc

SEQ ID NO: 38178 - DNA, 20 bp, synthetic construct
  misc_feature 1..20: note = CRISPR gRNA sequence
  source 1..20: mol_type = other DNA
cagaacgctgctagtttata

SEQ ID NO: 38179 - DNA, 20 bp, synthetic construct
  misc_feature 1..20: note = CRISPR gRNA sequence
  source 1..20: mol_type = other DNA
tatggcacctttatgacatt

SEQ ID NO: 38180 - DNA, 20 bp, synthetic construct
  misc_feature 1..20: note = CRISPR gRNA sequence
  source 1..20: mol_type = other DNA
tggcacctttatgacattta

SEQ ID NO: 38181 - DNA, 20 bp, synthetic construct
  misc_feature 1..20: note = CRISPR gRNA sequence
  source 1..20: mol_type = other DNA
cacctttatgacatttagag

SEQ ID NO: 38182 - DNA, 20 bp, synthetic construct
  misc_feature 1..20: note = CRISPR gRNA sequence
  source 1..20: mol_type = other DNA
acctttatgacatttagaga

SEQ ID NO: 38183 - DNA, 20 bp, synthetic construct
  misc_feature 1..20: note = CRISPR gRNA sequence
  source 1..20: mol_type = other DNA
aaggcaccacttcatccaca

SEQ ID NO: 38184 - DNA, 20 bp, synthetic construct
  misc_feature 1..20: note = CRISPR gRNA sequence
  source 1..20: mol_type = other DNA
ccacttcatccacacagatg

SEQ ID NO: 38185 - DNA, 20 bp, synthetic construct
  misc_feature 1..20: note = CRISPR gRNA sequence
  source 1..20: mol_type = other DNA
cacagatgcagcctgtcact

SEQ ID NO: 38186 - DNA, 20 bp, synthetic construct
  misc_feature 1..20: note = CRISPR gRNA sequence
  source 1..20: mol_type = other DNA
acagatgcagcctgtcacta

SEQ ID NO: 38187 - DNA, 20 bp, synthetic construct
  misc_feature 1..20: note = CRISPR gRNA sequence
  source 1..20: mol_type = other DNA
tgcagcctgtcactaaggtt

SEQ ID NO: 38188 - DNA, 20 bp, synthetic construct
  misc_feature 1..20: note = CRISPR gRNA sequence
  source 1..20: mol_type = other DNA
actaaggttcagcacttgtt

SEQ ID NO: 38189 - DNA, 20 bp, synthetic construct
  misc_feature 1..20: note = CRISPR gRNA sequence
  source 1..20: mol_type = other DNA
acttgttgagtgaaaataat

SEQ ID NO: 38190 - DNA, 20 bp, synthetic construct
  misc_feature 1..20: note = CRISPR gRNA sequence
  source 1..20: mol_type = other DNA
gttgagtgaaaataataagt

SEQ ID NO: 38191 - DNA, 20 bp, synthetic construct
  misc_feature 1..20: note = CRISPR gRNA sequence
  source 1..20: mol_type = other DNA
gaaaataataagttggacca

SEQ ID NO: 38192 - DNA, 20 bp, synthetic construct
  misc_feature 1..20: note = CRISPR gRNA sequence
  source 1..20: mol_type = other DNA
cacagtccctattgtcgtct

SEQ ID NO: 38193 - DNA, 20 bp, synthetic construct
  misc_feature 1..20: note = CRISPR gRNA sequence
  source 1..20: mol_type = other DNA
gtccctattgtcgtctcggc

SEQ ID NO: 38194 - DNA, 20 bp, synthetic construct
  misc_feature 1..20: note = CRISPR gRNA sequence
  source 1..20: mol_type = other DNA
tccctattgtcgtctcggct

SEQ ID NO: 38195 - DNA, 20 bp, synthetic construct
  misc_feature 1..20: note = CRISPR gRNA sequence
  source 1..20: mol_type = other DNA
ggcatctgtgaaccgtgatt

SEQ ID NO: 38196 - DNA, 20 bp, synthetic construct
  misc_feature 1..20: note = CRISPR gRNA sequence
  source 1..20: mol_type = other DNA
ctgtgaaccgtgattaagcc

SEQ ID NO: 38197 - DNA, 20 bp, synthetic construct
  misc_feature 1..20: note = CRISPR gRNA sequence
  source 1..20: mol_type = other DNA
tgtgaaccgtgattaagcca

SEQ ID NO: 38198 - DNA, 20 bp, synthetic construct
  misc_feature 1..20: note = CRISPR gRNA sequence
  source 1..20: mol_type = other DNA
accgtgattaagccaaggtt

SEQ ID NO: 38199 - DNA, 20 bp, synthetic construct
  misc_feature 1..20: note = CRISPR gRNA sequence
  source 1..20: mol_type = other DNA
gtgattaagccaaggttcag

SEQ ID NO: 38200 - DNA, 20 bp, synthetic construct
  misc_feature 1..20: note = CRISPR gRNA sequence
  source 1..20: mol_type = other DNA
ttgttgacatttttcttccc

SEQ ID NO: 38201 - DNA, 20 bp, synthetic construct
  misc_feature 1..20: note = CRISPR gRNA sequence
  source 1..20: mol_type = other DNA
ttttcttccctggctattga

SEQ ID NO: 38202 - DNA, 20 bp, synthetic construct
  misc_feature 1..20: note = CRISPR gRNA sequence
  source 1..20: mol_type = other DNA
cctcaactcatctgtctccc

SEQ ID NO: 38203 - DNA, 20 bp, synthetic construct
  misc_feature 1..20: note = CRISPR gRNA sequence
  source 1..20: mol_type = other DNA
aactcatctgtctccccagc

SEQ ID NO: 38204 - DNA, 20 bp, synthetic construct
  misc_feature 1..20: note = CRISPR gRNA sequence
  source 1..20: mol_type = other DNA
actcatctgtctccccagct

SEQ ID NO: 38205 - DNA, 20 bp, synthetic construct
  misc_feature 1..20: note = CRISPR gRNA sequence
  source 1..20: mol_type = other DNA
tgtctccccagctaggaacc

SEQ ID NO: 38206 - DNA, 20 bp, synthetic construct
  misc_feature 1..20: note = CRISPR gRNA sequence
  source 1..20: mol_type = other DNA
gtctccccagctaggaaccc

SEQ ID NO: 38207 - DNA, 20 bp, synthetic construct
  misc_feature 1..20: note = CRISPR gRNA sequence
  source 1..20: mol_type = other DNA
ccccagctaggaacccaggc

SEQ ID NO: 38208 - DNA, 20 bp, synthetic construct
  misc_feature 1..20: note = CRISPR gRNA sequence
  source 1..20: mol_type = other DNA
cccagctaggaacccaggca

SEQ ID NO: 38209 - DNA, 20 bp, synthetic construct
  misc_feature 1..20: note = CRISPR gRNA sequence
  source 1..20: mol_type = other DNA
gctaggaacccaggcaaggc

SEQ ID NO: 38210 - DNA, 20 bp, synthetic construct
  misc_feature 1..20: note = CRISPR gRNA sequence
  source 1..20: mol_type = other DNA
aggcaaggctggcttgtgaa

SEQ ID NO: 38211 - DNA, 20 bp, synthetic construct
  misc_feature 1..20: note = CRISPR gRNA sequence
  source 1..20: mol_type = other DNA
ggcaaggctggcttgtgaac

SEQ ID NO: 38212 - DNA, 20 bp, synthetic construct
  misc_feature 1..20: note = CRISPR gRNA sequence
  source 1..20: mol_type = other DNA
aaggctggcttgtgaacagg

SEQ ID NO: 38213 - DNA, 20 bp, synthetic construct
  misc_feature 1..20: note = CRISPR gRNA sequence
  source 1..20: mol_type = other DNA
aggctggcttgtgaacaggt

SEQ ID NO: 38214 - DNA, 20 bp, synthetic construct
  misc_feature 1..20: note = CRISPR gRNA sequence
  source 1..20: mol_type = other DNA
ggctggcttgtgaacaggtg

SEQ ID NO: 38215 - DNA, 20 bp, synthetic construct
  misc_feature 1..20: note = CRISPR gRNA sequence
  source 1..20: mol_type = other DNA
ggcttgtgaacaggtgggga

SEQ ID NO: 38216 - DNA, 20 bp, synthetic construct
  misc_feature 1..20: note = CRISPR gRNA sequence
  source 1..20: mol_type = other DNA
tgtgaacaggtggggaaagt

SEQ ID NO: 38217 - DNA, 20 bp, synthetic construct
  misc_feature 1..20: note = CRISPR gRNA sequence
  source 1..20: mol_type = other DNA
gtgaacaggtggggaaagtg

SEQ ID NO: 38218 - DNA, 20 bp, synthetic construct
  misc_feature 1..20: note = CRISPR gRNA sequence
  source 1..20: mol_type = other DNA
acaggtggggaaagtgaggt

SEQ ID NO: 38219 - DNA, 20 bp, synthetic construct
  misc_feature 1..20: note = CRISPR gRNA sequence
  source 1..20: mol_type = other DNA
aggtggggaaagtgaggtca

SEQ ID NO: 38220 - DNA, 20 bp, synthetic construct
  misc_feature 1..20: note = CRISPR gRNA sequence
  source 1..20: mol_type = other DNA
gtggggaaagtgaggtcaga

SEQ ID NO: 38221 - DNA, 20 bp, synthetic construct
  misc_feature 1..20: note = CRISPR gRNA sequence
  source 1..20: mol_type = other DNA
tggggaaagtgaggtcagag

SEQ ID NO: 38222 - DNA, 20 bp, synthetic construct
  misc_feature 1..20: note = CRISPR gRNA sequence
  source 1..20: mol_type = other DNA
aggtcagagaggaatgcgct

SEQ ID NO: 38223 - DNA, 20 bp, synthetic construct
  misc_feature 1..20: note = CRISPR gRNA sequence
  source 1..20: mol_type = other DNA
agagaggaatgcgcttggct

SEQ ID NO: 38224 - DNA, 20 bp, synthetic construct
  misc_feature 1..20: note = CRISPR gRNA sequence
  source 1..20: mol_type = other DNA
gagaggaatgcgcttggctc

SEQ ID NO: 38225 - DNA, 20 bp, synthetic construct
  misc_feature 1..20: note = CRISPR gRNA sequence
  source 1..20: mol_type = other DNA
agaggaatgcgcttggctca

SEQ ID NO: 38226 - DNA, 20 bp, synthetic construct
  misc_feature 1..20: note = CRISPR gRNA sequence
  source 1..20: mol_type = other DNA
atgcgcttggctcagggctc

SEQ ID NO: 38227 - DNA, 20 bp, synthetic construct
  misc_feature 1..20: note = CRISPR gRNA sequence
  source 1..20: mol_type = other DNA
tgcgcttggctcagggctct

SEQ ID NO: 38228 - DNA, 20 bp, synthetic construct
  misc_feature 1..20: note = CRISPR gRNA sequence
  source 1..20: mol_type = other DNA
cttggctcagggctctgggt

SEQ ID NO: 38229 - DNA, 20 bp, synthetic construct
  misc_feature 1..20: note = CRISPR gRNA sequence
  source 1..20: mol_type = other DNA
gctcagggctctgggtgagt

SEQ ID NO: 38230 - DNA, 20 bp, synthetic construct
  misc_feature 1..20: note = CRISPR gRNA sequence
  source 1..20: mol_type = other DNA
ctcagggctctgggtgagtc

SEQ ID NO: 38231 - DNA, 20 bp, synthetic construct
  misc_feature 1..20: note = CRISPR gRNA sequence
  source 1..20: mol_type = other DNA
tcagggctctgggtgagtca

SEQ ID NO: 38232 - DNA, 20 bp, synthetic construct
  misc_feature 1..20: note = CRISPR gRNA sequence
  source 1..20: mol_type = other DNA
ctctgggtgagtcagggcca

SEQ ID NO: 38233 - DNA, 20 bp, synthetic construct
  misc_feature 1..20: note = CRISPR gRNA sequence
  source 1..20: mol_type = other DNA
ggtgagtcagggccacagcc

SEQ ID NO: 38234 - DNA, 20 bp, synthetic construct
  misc_feature 1..20: note = CRISPR gRNA sequence
  source 1..20: mol_type = other DNA
gtgagtcagggccacagccg

SEQ ID NO: 38235 - DNA, 20 bp, synthetic construct
  misc_feature 1..20: note = CRISPR gRNA sequence
  source 1..20: mol_type = other DNA
gtcagggccacagccgaggc

SEQ ID NO: 38236 - DNA, 20 bp, synthetic construct
  misc_feature 1..20: note = CRISPR gRNA sequence
  source 1..20: mol_type = other DNA
agggccacagccgaggctgg

SEQ ID NO: 38237 - DNA, 20 bp, synthetic construct
  misc_feature 1..20: note = CRISPR gRNA sequence
  source 1..20: mol_type = other DNA
gaggctggaagcgatgtctg

SEQ ID NO: 38238 - DNA, 20 bp, synthetic construct
  misc_feature 1..20: note = CRISPR gRNA sequence
  source 1..20: mol_type = other DNA
aagcgatgtctgcagcgtcc

SEQ ID NO: 38239 - DNA, 20 bp, synthetic construct
  misc_feature 1..20: note = CRISPR gRNA sequence
  source 1..20: mol_type = other DNA
atgtctgcagcgtcccagtc

SEQ ID NO: 38240 - DNA, 20 bp, synthetic construct
  misc_feature 1..20: note = CRISPR gRNA sequence
  source 1..20: mol_type = other DNA
tctagactttactcattgcc

SEQ ID NO: 38241 - DNA, 20 bp, synthetic construct
  misc_feature 1..20: note = CRISPR gRNA sequence
  source 1..20: mol_type = other DNA
ctagactttactcattgcct

SEQ ID NO: 38242 - DNA, 20 bp, synthetic construct
  misc_feature 1..20: note = CRISPR gRNA sequence
  source 1..20: mol_type = other DNA
tagactttactcattgcctg

SEQ ID NO: 38243 - DNA, 20 bp, synthetic construct
  misc_feature 1..20: note = CRISPR gRNA sequence
  source 1..20: mol_type = other DNA
agactttactcattgcctgg

SEQ ID NO: 38244 - DNA, 20 bp, synthetic construct
  misc_feature 1..20: note = CRISPR gRNA sequence
  source 1..20: mol_type = other DNA
gactttactcattgcctggg

SEQ ID NO: 38245 - DNA, 20 bp, synthetic construct
  misc_feature 1..20: note = CRISPR gRNA sequence
  source 1..20: mol_type = other DNA
attgcctggggggcctatcc

SEQ ID NO: 38246 - DNA, 20 bp, synthetic construct
  misc_feature 1..20: note = CRISPR gRNA sequence
  source 1..20: mol_type = other DNA
ttgcctggggggcctatccc

SEQ ID NO: 38247 - DNA, 20 bp, synthetic construct
  misc_feature 1..20: note = CRISPR gRNA sequence
  source 1..20: mol_type = other DNA
ggcctatcccaggcacatcc

SEQ ID NO: 38248 - DNA, 20 bp, synthetic construct
  misc_feature 1..20: note = CRISPR gRNA sequence
  source 1..20: mol_type = other DNA
gcctatcccaggcacatccc

SEQ ID NO: 38249 - DNA, 20 bp, synthetic construct
  misc_feature 1..20: note = CRISPR gRNA sequence
  source 1..20: mol_type = other DNA
cccaggcacatcccaggcat

SEQ ID NO: 38250 - DNA, 20 bp, synthetic construct
  misc_feature 1..20: note = CRISPR gRNA sequence
  source 1..20: mol_type = other DNA
cacatcccaggcataagccc

SEQ ID NO: 38251 - DNA, 20 bp, synthetic construct
  misc_feature 1..20: note = CRISPR gRNA sequence
  source 1..20: mol_type = other DNA
acatcccaggcataagccct

SEQ ID NO: 38252 - DNA, 20 bp, synthetic construct
  misc_feature 1..20: note = CRISPR gRNA sequence
  source 1..20: mol_type = other DNA
atcccaggcataagccctgg

SEQ ID NO: 38253 - DNA, 20 bp, synthetic construct
  misc_feature 1..20: note = CRISPR gRNA sequence
  source 1..20: mol_type = other DNA
ccaggcataagccctgggag

SEQ ID NO: 38254 - DNA, 20 bp, synthetic construct
  misc_feature 1..20: note = CRISPR gRNA sequence
  source 1..20: mol_type = other DNA
caggcataagccctgggagc

SEQ ID NO: 38255 - DNA, 20 bp, synthetic construct
  misc_feature 1..20: note = CRISPR gRNA sequence
  source 1..20: mol_type = other DNA
aggcataagccctgggagca

SEQ ID NO: 38256 - DNA, 20 bp, synthetic construct
  misc_feature 1..20: note = CRISPR gRNA sequence
  source 1..20: mol_type = other DNA
aagccctgggagcagggtgc

SEQ ID NO: 38257 - DNA, 20 bp, synthetic construct
  misc_feature 1..20: note = CRISPR gRNA sequence
  source 1..20: mol_type = other DNA
agccctgggagcagggtgct

SEQ ID NO: 38258 - DNA, 20 bp, synthetic construct
  misc_feature 1..20: note = CRISPR gRNA sequence
  source 1..20: mol_type = other DNA
tctcctcattgtgcctcatg

SEQ ID NO: 38259 - DNA, 20 bp, synthetic construct
  misc_feature 1..20: note = CRISPR gRNA sequence
  source 1..20: mol_type = other DNA
tcctcattgtgcctcatgaa

SEQ ID NO: 38260 - DNA, 20 bp, synthetic construct
  misc_feature 1..20: note = CRISPR gRNA sequence
  source 1..20: mol_type = other DNA
cctcattgtgcctcatgaag

SEQ ID NO: 38261 - DNA, 20 bp, synthetic construct
  misc_feature 1..20: note = CRISPR gRNA sequence
  source 1..20: mol_type = other DNA
gtgcctcatgaagaggccgt

SEQ ID NO: 38262 - DNA, 20 bp, synthetic construct
  misc_feature 1..20: note = CRISPR gRNA sequence
  source 1..20: mol_type = other DNA
gaggccgtcagtctgtcttc

SEQ ID NO: 38263 - DNA, 20 bp, synthetic construct
  misc_feature 1..20: note = CRISPR gRNA sequence
  source 1..20: mol_type = other DNA
gtctgtcttctagatccctt

SEQ ID NO: 38264 - DNA, 20 bp, synthetic construct
  misc_feature 1..20: note = CRISPR gRNA sequence
  source 1..20: mol_type = other DNA
ttctagatcccttgagccgc

SEQ ID NO: 38265 - DNA, 20 bp, synthetic construct
  misc_feature 1..20: note = CRISPR gRNA sequence
  source 1..20: mol_type = other DNA
tctagatcccttgagccgcc

SEQ ID NO: 38266 - DNA, 20 bp, synthetic construct
  misc_feature 1..20: note = CRISPR gRNA sequence
  source 1..20: mol_type = other DNA
gccaggcaaaaacttcccca

SEQ ID NO: 38267 - DNA, 20 bp, synthetic construct
  misc_feature 1..20: note = CRISPR gRNA sequence
  source 1..20: mol_type = other DNA
ccaggcaaaaacttccccat

SEQ ID NO: 38268 - DNA, 20 bp, synthetic construct
  misc_feature 1..20: note = CRISPR gRNA sequence
  source 1..20: mol_type = other DNA
caaaaacttccccataggaa

SEQ ID NO: 38269 - DNA, 20 bp, synthetic construct
  misc_feature 1..20: note = CRISPR gRNA sequence
  source 1..20: mol_type = other DNA
acttccccataggaacagaa

SEQ ID NO: 38270 - DNA, 20 bp, synthetic construct
  misc_feature 1..20: note = CRISPR gRNA sequence
  source 1..20: mol_type = other DNA
ccataggaacagaatagacc

SEQ ID NO: 38271 - DNA, 20 bp, synthetic construct
  misc_feature 1..20: note = CRISPR gRNA sequence
  source 1..20: mol_type = other DNA
aacagaatagacccagaatt

SEQ ID NO: 38272 - DNA, 20 bp, synthetic construct
  misc_feature 1..20: note = CRISPR gRNA sequence
  source 1..20: mol_type = other DNA
acagaatagacccagaattg

SEQ ID NO: 38273 - DNA, 20 bp, synthetic construct
  misc_feature 1..20: note = CRISPR gRNA sequence
  source 1..20: mol_type = other DNA
aatagacccagaattgaggc

SEQ ID NO: 38274 - DNA, 20 bp, synthetic construct
  misc_feature 1..20: note = CRISPR gRNA sequence
  source 1..20: mol_type = other DNA
agacccagaattgaggccag

SEQ ID NO: 38275 - DNA, 20 bp, synthetic construct
  misc_feature 1..20: note = CRISPR gRNA sequence
  source 1..20: mol_type = other DNA
acccagaattgaggccagca

SEQ ID NO: 38276 - DNA, 20 bp, synthetic construct
  misc_feature 1..20: note = CRISPR gRNA sequence
  source 1..20: mol_type = other DNA
cccagaattgaggccagcag

SEQ ID NO: 38277 - DNA, 20 bp, synthetic construct
  misc_feature 1..20: note = CRISPR gRNA sequence
  source 1..20: mol_type = other DNA
ccagaattgaggccagcaga

SEQ ID NO: 38278 - DNA, 20 bp, synthetic construct
  misc_feature 1..20: note = CRISPR gRNA sequence
  source 1..20: mol_type = other DNA
cagcagagggtctttcctcc

SEQ ID NO: 38279 - DNA, 20 bp, synthetic construct
  misc_feature 1..20: note = CRISPR gRNA sequence
  source 1..20: mol_type = other DNA
ttcctcctagccgtgcctgc

SEQ ID NO: 38280 - DNA, 20 bp, synthetic construct
  misc_feature 1..20: note = CRISPR gRNA sequence
  source 1..20: mol_type = other DNA
tagccgtgcctgctggaatc

SEQ ID NO: 38281 - DNA, 20 bp, synthetic construct
  misc_feature 1..20: note = CRISPR gRNA sequence
  source 1..20: mol_type = other DNA
cgtgcctgctggaatccggc

SEQ ID NO: 38282 - DNA, 20 bp, synthetic construct
  misc_feature 1..20: note = CRISPR gRNA sequence
  source 1..20: mol_type = other DNA
gcctgctggaatccggcgag

SEQ ID NO: 38283 - DNA, 20 bp, synthetic construct
  misc_feature 1..20: note = CRISPR gRNA sequence
  source 1..20: mol_type = other DNA
cctgctggaatccggcgagc

SEQ ID NO: 38284 - DNA, 20 bp, synthetic construct
  misc_feature 1..20: note = CRISPR gRNA sequence
  source 1..20: mol_type = other DNA
gaatccggcgagcaggccat

SEQ ID NO: 38285 - DNA, 20 bp, synthetic construct
  misc_feature 1..20: note = CRISPR gRNA sequence
  source 1..20: mol_type = other DNA
agcaggccatcagctctttc

SEQ ID NO: 38286 - DNA, 20 bp, synthetic construct
  misc_feature 1..20: note = CRISPR gRNA sequence
  source 1..20: mol_type = other DNA
gcaggccatcagctctttct

SEQ ID NO: 38287 - DNA, 20 bp, synthetic construct
  misc_feature 1..20: note = CRISPR gRNA sequence
  source 1..20: mol_type = other DNA
ctgtcttatgtctcccacat

SEQ ID NO: 38288 - DNA, 20 bp, synthetic construct
  misc_feature 1..20: note = CRISPR gRNA sequence
  source 1..20: mol_type = other DNA
tgtcttatgtctcccacatg

SEQ ID NO: 38289 - DNA, 20 bp, synthetic construct
  misc_feature 1..20: note = CRISPR gRNA sequence
  source 1..20: mol_type = other DNA
gtcttatgtctcccacatga

SEQ ID NO: 38290 - DNA, 20 bp, synthetic construct
  misc_feature 1..20: note = CRISPR gRNA sequence
  source 1..20: mol_type = other DNA
ttatgtctcccacatgaggg

SEQ ID NO: 38291 - DNA, 20 bp, synthetic construct
  misc_feature 1..20: note = CRISPR gRNA sequence
  source 1..20: mol_type = other DNA
ccatcctgtcacttgctaac

SEQ ID NO: 38292 - DNA, 20 bp, synthetic construct
  misc_feature 1..20: note = CRISPR gRNA sequence
  source 1..20: mol_type = other DNA
catcctgtcacttgctaact

SEQ ID NO: 38293 - DNA, 20 bp, synthetic construct
  misc_feature 1..20: note = CRISPR gRNA sequence
  source 1..20: mol_type = other DNA
atcctgtcacttgctaactg

SEQ ID NO: 38294 - DNA, 20 bp, synthetic construct
  misc_feature 1..20: note = CRISPR gRNA sequence
  source 1..20: mol_type = other DNA
acttgctaactggggcttgc

SEQ ID NO: 38295 - DNA, 20 bp, synthetic construct
  misc_feature 1..20: note = CRISPR gRNA sequence
  source 1..20: mol_type = other DNA
gcttgcaagtgccccaaccc

SEQ ID NO: 38296 - DNA, 20 bp, synthetic construct
  misc_feature 1..20: note = CRISPR gRNA sequence
  source 1..20: mol_type = other DNA
cttgcaagtgccccaacccc

SEQ ID NO: 38297 - DNA, 20 bp, synthetic construct
  misc_feature 1..20: note = CRISPR gRNA sequence
  source 1..20: mol_type = other DNA
ttgcaagtgccccaacccca

SEQ ID NO: 38298 - DNA, 20 bp, synthetic construct
  misc_feature 1..20: note = CRISPR gRNA sequence
  source 1..20: mol_type = other DNA
agtgccccaaccccagggca

SEQ ID NO: 38299 - DNA, 20 bp, synthetic construct
  misc_feature 1..20: note = CRISPR gRNA sequence
  source 1..20: mol_type = other DNA
gtgccccaaccccagggcaa

SEQ ID NO: 38300 - DNA, 20 bp, synthetic construct
  misc_feature 1..20: note = CRISPR gRNA sequence
  source 1..20: mol_type = other DNA
tgccccaaccccagggcaaa

SEQ ID NO: 38301 - DNA, 20 bp, synthetic construct
  misc_feature 1..20: note = CRISPR gRNA sequence
  source 1..20: mol_type = other DNA
caaccccagggcaaagggac

SEQ ID NO: 38302 - DNA, 20 bp, synthetic construct
  misc_feature 1..20: note = CRISPR gRNA sequence
  source 1..20: mol_type = other DNA
aaccccagggcaaagggact

SEQ ID NO: 38303 - DNA, 20 bp, synthetic construct
  misc_feature 1..20: note = CRISPR gRNA sequence
  source 1..20: mol_type = other DNA
agggcaaagggactgggcct

SEQ ID NO: 38304 - DNA, 20 bp, synthetic construct
  misc_feature 1..20: note = CRISPR gRNA sequence
  source 1..20: mol_type = other DNA
actgggccttggtctcctcg

SEQ ID NO: 38305 - DNA, 20 bp, synthetic construct
  misc_feature 1..20: note = CRISPR gRNA sequence
  source 1..20: mol_type = other DNA
cttggtctcctcgcagtttt

SEQ ID NO: 38306 - DNA, 20 bp, synthetic construct
  misc_feature 1..20: note = CRISPR gRNA sequence
  source 1..20: mol_type = other DNA
ttggtctcctcgcagttttc

SEQ ID NO: 38307 - DNA, 20 bp, synthetic construct
  misc_feature 1..20: note = CRISPR gRNA sequence
  source 1..20: mol_type = other DNA
ctcgcagttttcgggacaac

SEQ ID NO: 38308 - DNA, 20 bp, synthetic construct
  misc_feature 1..20: note = CRISPR gRNA sequence
  source 1..20: mol_type = other DNA
agttttcgggacaaccagct

SEQ ID NO: 38309 - DNA, 20 bp, synthetic construct
  misc_feature 1..20: note = CRISPR gRNA sequence
  source 1..20: mol_type = other DNA
gggacaaccagctcagtgac

SEQ ID NO: 38310 - DNA, 20 bp, synthetic construct
  misc_feature 1..20: note = CRISPR gRNA sequence
  source 1..20: mol_type = other DNA
ggacaaccagctcagtgacc

SEQ ID NO: 38311 - DNA, 20 bp, synthetic construct
  misc_feature 1..20: note = CRISPR gRNA sequence
  source 1..20: mol_type = other DNA
caaccagctcagtgaccagg

SEQ ID NO: 38312 - DNA, 20 bp, synthetic construct
  misc_feature 1..20: note = CRISPR gRNA sequence
  source 1..20: mol_type = other DNA
ccaggtggtgctgaacattg

SEQ ID NO: 38313 - DNA, 20 bp, synthetic construct
  misc_feature 1..20: note = CRISPR gRNA sequence
  source 1..20: mol_type = other DNA
aggtggtgctgaacattgtg

SEQ ID NO: 38314 - DNA, 20 bp, synthetic construct
  misc_feature 1..20: note = CRISPR gRNA sequence
  source 1..20: mol_type = other DNA
ggtggtgctgaacattgtgg

SEQ ID NO: 38315 - DNA, 20 bp, synthetic construct
  misc_feature 1..20: note = CRISPR gRNA sequence
  source 1..20: mol_type = other DNA
aggttctccctcacctacca

SEQ ID NO: 38316 - DNA, 20 bp, synthetic construct
  misc_feature 1..20: note = CRISPR gRNA sequence
  source 1..20: mol_type = other DNA
tccctcacctaccacggctc

SEQ ID NO: 38317 - DNA, 20 bp, synthetic construct
  misc_feature 1..20: note = CRISPR gRNA sequence
  source 1..20: mol_type = other DNA
ctcacctaccacggctccgg

SEQ ID NO: 38318 - DNA, 20 bp, synthetic construct
  misc_feature 1..20: note = CRISPR gRNA sequence
  source 1..20: mol_type = other DNA
taccacggctccggaagctt

SEQ ID NO: 38319 - DNA, 20 bp, synthetic construct
  misc_feature 1..20: note = CRISPR gRNA sequence
  source 1..20: mol_type = other DNA
acggctccggaagcttgagt

SEQ ID NO: 38320 - DNA, 20 bp, synthetic construct
  misc_feature 1..20: note = CRISPR gRNA sequence
  source 1..20: mol_type = other DNA
tgatctttccactgcctctg

SEQ ID NO: 38321 - DNA, 20 bp, synthetic construct
  misc_feature 1..20: note = CRISPR gRNA sequence
  source 1..20: mol_type = other DNA
tttccactgcctctgcagcc

SEQ ID NO: 38322 - DNA, 20 bp, synthetic construct
  misc_feature 1..20: note = CRISPR gRNA sequence
  source 1..20: mol_type = other DNA
gattcaccccactcccttgc

SEQ ID NO: 38323 - DNA, 20 bp, synthetic construct
  misc_feature 1..20: note = CRISPR gRNA sequence
  source 1..20: mol_type = other DNA
attcaccccactcccttgca

SEQ ID NO: 38324 - DNA, 20 bp, synthetic construct
  misc_feature 1..20: note = CRISPR gRNA sequence
  source 1..20: mol_type = other DNA
accccactcccttgcaaggc

SEQ ID NO: 38325 - DNA, 20 bp, synthetic construct
  misc_feature 1..20: note = CRISPR gRNA sequence
  source 1..20: mol_type = other DNA
ccccactcccttgcaaggca

SEQ ID NO: 38326 - DNA, 20 bp, synthetic construct
  misc_feature 1..20: note = CRISPR gRNA sequence
  source 1..20: mol_type = other DNA
cactcccttgcaaggcaagg

SEQ ID NO: 38327 - DNA, 20 bp, synthetic construct
  misc_feature 1..20: note = CRISPR gRNA sequence
  source 1..20: mol_type = other DNA
actcccttgcaaggcaagga

SEQ ID NO: 38328 - DNA, 20 bp, synthetic construct
  misc_feature 1..20: note = CRISPR gRNA sequence
  source 1..20: mol_type = other DNA
cttgcaaggcaaggaaggtc

SEQ ID NO: 38329 - DNA, 20 bp, synthetic construct
  misc_feature 1..20: note = CRISPR gRNA sequence
  source 1..20: mol_type = other DNA
ttgcaaggcaaggaaggtct

SEQ ID NO: 38330 - DNA, 20 bp, synthetic construct
  misc_feature 1..20: note = CRISPR gRNA sequence
  source 1..20: mol_type = other DNA
tgcaaggcaaggaaggtctg

SEQ ID NO: 38331 - DNA, 20 bp, synthetic construct
  misc_feature 1..20: note = CRISPR gRNA sequence
  source 1..20: mol_type = other DNA
caaggaaggtctggggcccc

SEQ ID NO: 38332 - DNA, 20 bp, synthetic construct
  misc_feature 1..20: note = CRISPR gRNA sequence
  source 1..20: mol_type = other DNA
aaggaaggtctggggcccct

SEQ ID NO: 38333 - DNA, 20 bp, synthetic construct
  misc_feature 1..20: note = CRISPR gRNA sequence
  source 1..20: mol_type = other DNA
aggaaggtctggggcccctg

SEQ ID NO: 38334 - DNA, 20 bp, synthetic construct
  misc_feature 1..20: note = CRISPR gRNA sequence
  source 1..20: mol_type = other DNA
aaggtctggggcccctgggg

SEQ ID NO: 38335 - DNA, 20 bp, synthetic construct
  misc_feature 1..20: note = CRISPR gRNA sequence
  source 1..20: mol_type = other DNA
aggtctggggcccctggggt

SEQ ID NO: 38336 - DNA, 20 bp, synthetic construct
  misc_feature 1..20: note = CRISPR gRNA sequence
  source 1..20: mol_type = other DNA
ggtctggggcccctggggta

SEQ ID NO: 38337 - DNA, 20 bp, synthetic construct
  misc_feature 1..20: note = CRISPR gRNA sequence
  source 1..20: mol_type = other DNA
gtctggggcccctggggtag

SEQ ID NO: 38338 - DNA, 20 bp, synthetic construct
  misc_feature 1..20: note = CRISPR gRNA sequence
  source 1..20: mol_type = other DNA
acacctttgccacaatcttg

SEQ ID NO: 38339 - DNA, 20 bp, synthetic construct
  misc_feature 1..20: note = CRISPR gRNA sequence
  source 1..20: mol_type = other DNA
ttgccacaatcttgcagcct

SEQ ID NO: 38340 - DNA, 20 bp, synthetic construct
  misc_feature 1..20: note = CRISPR gRNA sequence
  source 1..20: mol_type = other DNA
ccacaatcttgcagcctgag

SEQ ID NO: 38341 - DNA, 20 bp, synthetic construct
  misc_feature 1..20: note = CRISPR gRNA sequence
  source 1..20: mol_type = other DNA
tcttgcagcctgagcagcaa

SEQ ID NO: 38342 - DNA, 20 bp, synthetic construct
  misc_feature 1..20: note = CRISPR gRNA sequence
  source 1..20: mol_type = other DNA
cgtgtcaaccctactctgct

SEQ ID NO: 38343 - DNA, 20 bp, synthetic construct
  misc_feature 1..20: note = CRISPR gRNA sequence
  source 1..20: mol_type = other DNA
tcaaccctactctgcttggc

SEQ ID NO: 38344 - DNA, 20 bp, synthetic construct
  misc_feature 1..20: note = CRISPR gRNA sequence
  source 1..20: mol_type = other DNA
caaccctactctgcttggca

SEQ ID NO: 38345 - DNA, 20 bp, synthetic construct
  misc_feature 1..20: note = CRISPR gRNA sequence
  source 1..20: mol_type = other DNA
aaccctactctgcttggcaa

SEQ ID NO: 38346 - DNA, 20 bp, synthetic construct
  misc_feature 1..20: note = CRISPR gRNA sequence
  source 1..20: mol_type = other DNA
cctactctgcttggcaaggg

SEQ ID NO: 38347 - DNA, 20 bp, synthetic construct
  misc_feature 1..20: note = CRISPR gRNA sequence
  source 1..20: mol_type = other DNA
actctgcttggcaagggtgg

SEQ ID NO: 38348 - DNA, 20 bp, synthetic construct
  misc_feature 1..20: note = CRISPR gRNA sequence
  source 1..20: mol_type = other DNA
gcagtcacgtgtcctaccgt

SEQ ID NO: 38349 - DNA, 20 bp, synthetic construct
  misc_feature 1..20: note = CRISPR gRNA sequence
  source 1..20: mol_type = other DNA
cagtcacgtgtcctaccgtc

SEQ ID NO: 38350 - DNA, 20 bp, synthetic construct
  misc_feature 1..20: note = CRISPR gRNA sequence
  source 1..20: mol_type = other DNA
gtcctaccgtcaggatgctt

SEQ ID NO: 38351 - DNA, 20 bp, synthetic construct
  misc_feature 1..20: note = CRISPR gRNA sequence
  source 1..20: mol_type = other DNA
tcctaccgtcaggatgcttc

SEQ ID NO: 38352 - DNA, 20 bp, synthetic construct
  misc_feature 1..20: note = CRISPR gRNA sequence
  source 1..20: mol_type = other DNA
accgtcaggatgcttcaggc

SEQ ID NO: 38353 - DNA, 20 bp, synthetic construct
  misc_feature 1..20: note = CRISPR gRNA sequence
  source 1..20: mol_type = other DNA
ccgtcaggatgcttcaggcc

SEQ ID NO: 38354 - DNA, 20 bp, synthetic construct
  misc_feature 1..20: note = CRISPR gRNA sequence
  source 1..20: mol_type = other DNA
caggatgcttcaggccaggt

SEQ ID NO: 38355 - DNA, 20 bp, synthetic construct
  misc_feature 1..20: note = CRISPR gRNA sequence
  source 1..20: mol_type = other DNA
gatgcttcaggccaggtgag

SEQ ID NO: 38356 - DNA, 20 bp, synthetic construct
  misc_feature 1..20: note = CRISPR gRNA sequence
  source 1..20: mol_type = other DNA
gcttcaggccaggtgagcag

SEQ ID NO: 38357 - DNA, 20 bp, synthetic construct
  misc_feature 1..20: note = CRISPR gRNA sequence
  source 1..20: mol_type = other DNA
cttcaggccaggtgagcaga

SEQ ID NO: 38358 - DNA, 20 bp, synthetic construct
  misc_feature 1..20: note = CRISPR gRNA sequence
  source 1..20: mol_type = other DNA
aggccaggtgagcagaagga

SEQ ID NO: 38359 - DNA, 20 bp, synthetic construct
  misc_feature 1..20: note = CRISPR gRNA sequence
  source 1..20: mol_type = other DNA
ggccaggtgagcagaaggaa

SEQ ID NO: 38360 - DNA, 20 bp, synthetic construct
  misc_feature 1..20: note = CRISPR gRNA sequence
  source 1..20: mol_type = other DNA
gccaggtgagcagaaggaaa

SEQ ID NO: 38361 - DNA, 20 bp, synthetic construct
  misc_feature 1..20: note = CRISPR gRNA sequence
  source 1..20: mol_type = other DNA
gagcagaaggaaagggatct

SEQ ID NO: 38362 - DNA, 20 bp, synthetic construct
  misc_feature 1..20: note = CRISPR gRNA sequence
  source 1..20: mol_type = other DNA
ggaaagggatcttggcctta

SEQ ID NO: 38363 - DNA, 20 bp, synthetic construct
  misc_feature 1..20: note = CRISPR gRNA sequence
  source 1..20: mol_type = other DNA
gaaagggatcttggccttat

SEQ ID NO: 38364 - DNA, 20 bp, synthetic construct
  misc_feature 1..20: note = CRISPR gRNA sequence
  source 1..20: mol_type = other DNA
atcttggccttatgggcctt

SEQ ID NO: 38365 - DNA, 20 bp, synthetic construct
  misc_feature 1..20: note = CRISPR gRNA sequence
  source 1..20: mol_type = other DNA
ggccttatgggccttgagaa

SEQ ID NO: 38366 - DNA, 20 bp, synthetic construct
  misc_feature 1..20: note = CRISPR gRNA sequence
  source 1..20: mol_type = other DNA
ccttatgggccttgagaaaa

SEQ ID NO: 38367 - DNA, 20 bp, synthetic construct
  misc_feature 1..20: note = CRISPR gRNA sequence
  source 1..20: mol_type = other DNA
cttatgggccttgagaaaag

SEQ ID NO: 38368 - DNA, 20 bp, synthetic construct
  misc_feature 1..20: note = CRISPR gRNA sequence
  source 1..20: mol_type = other DNA
tatgggccttgagaaaagag

SEQ ID NO: 38369 - DNA, 20 bp, synthetic construct
  misc_feature 1..20: note = CRISPR gRNA sequence
  source 1..20: mol_type = other DNA
atgggccttgagaaaagagg

SEQ ID NO: 38370 - DNA, 20 bp, synthetic construct
  misc_feature 1..20: note = CRISPR gRNA sequence
  source 1..20: mol_type = other DNA
tgggccttgagaaaagagga

SEQ ID NO: 38371 - DNA, 20 bp, synthetic construct
  misc_feature 1..20: note = CRISPR gRNA sequence
  source 1..20: mol_type = other DNA
gggccttgagaaaagaggag

SEQ ID NO: 38372 - DNA, 20 bp, synthetic construct
  misc_feature 1..20: note = CRISPR gRNA sequence
  source 1..20: mol_type = other DNA
cttgagaaaagaggagggga

SEQ ID NO: 38373 - DNA, 20 bp, synthetic construct
  misc_feature 1..20: note = CRISPR gRNA sequence
  source 1..20: mol_type = other DNA
gagaaaagaggaggggaaag

SEQ ID NO: 38374 - DNA, 20 bp, synthetic construct
  misc_feature 1..20: note = CRISPR gRNA sequence
  source 1..20: mol_type = other DNA
agaaaagaggaggggaaagt

SEQ ID NO: 38375 - DNA, 20 bp, synthetic construct
  misc_feature 1..20: note = CRISPR gRNA sequence
  source 1..20: mol_type = other DNA
aagaggaggggaaagtggga

SEQ ID NO: 38376 - DNA, 20 bp, synthetic construct
  misc_feature 1..20: note = CRISPR gRNA sequence
  source 1..20: mol_type = other DNA
agaggaggggaaagtgggat

SEQ ID NO: 38377 - DNA, 20 bp, synthetic construct
  misc_feature 1..20: note = CRISPR gRNA sequence
  source 1..20: mol_type = other DNA
ggggaaagtgggatgggaaa

SEQ ID NO: 38378 - DNA, 20 bp, synthetic construct
  misc_feature 1..20: note = CRISPR gRNA sequence
  source 1..20: mol_type = other DNA
ggaaagtgggatgggaaatg

SEQ ID NO: 38379 - DNA, 20 bp, synthetic construct
  misc_feature 1..20: note = CRISPR gRNA sequence
  source 1..20: mol_type = other DNA
gaaagtgggatgggaaatgg

SEQ ID NO: 38380 - DNA, 20 bp, synthetic construct
  misc_feature 1..20: note = CRISPR gRNA sequence
  source 1..20: mol_type = other DNA
aagtgggatgggaaatggag

SEQ ID NO: 38381 - DNA, 20 bp, synthetic construct
  misc_feature 1..20: note = CRISPR gRNA sequence
  source 1..20: mol_type = other DNA
agtgggatgggaaatggagg

SEQ ID NO: 38382 - DNA, 20 bp, synthetic construct
  misc_feature 1..20: note = CRISPR gRNA sequence
  source 1..20: mol_type = other DNA
tggaggaggcccctcgtctg

SEQ ID NO: 38383 - DNA, 20 bp, synthetic construct
  misc_feature 1..20: note = CRISPR gRNA sequence
  source 1..20: mol_type = other DNA
ggaggaggcccctcgtctgc

SEQ ID NO: 38384 - DNA, 20 bp, synthetic construct
  misc_feature 1..20: note = CRISPR gRNA sequence
  source 1..20: mol_type = other DNA
ataccctactgttttactca

SEQ ID NO: 38385 - DNA, 20 bp, synthetic construct
  misc_feature 1..20: note = CRISPR gRNA sequence
  source 1..20: mol_type = other DNA
tttactcacagctttacctt

SEQ ID NO: 38386 - DNA, 20 bp, synthetic construct
  misc_feature 1..20: note = CRISPR gRNA sequence
  source 1..20: mol_type = other DNA
acagctttaccttcagaacc

SEQ ID NO: 38387 - DNA, 20 bp, synthetic construct
  misc_feature 1..20: note = CRISPR gRNA sequence
  source 1..20: mol_type = other DNA
tttaccttcagaacctagct

SEQ ID NO: 38388 - DNA, 20 bp, synthetic construct
  misc_feature 1..20: note = CRISPR gRNA sequence
  source 1..20: mol_type = other DNA
ttaccttcagaacctagctc

SEQ ID NO: 38389 - DNA, 20 bp, synthetic construct
  misc_feature 1..20: note = CRISPR gRNA sequence
  source 1..20: mol_type = other DNA
ttcagaacctagctcaggct

SEQ ID NO: 38390 - DNA, 20 bp, synthetic construct
  misc_feature 1..20: note = CRISPR gRNA sequence
  source 1..20: mol_type = other DNA
cctagctcaggcttggcacc

SEQ ID NO: 38391 - DNA, 20 bp, synthetic construct
  misc_feature 1..20: note = CRISPR gRNA sequence
  source 1..20: mol_type = other DNA
caggcttggcacctggtact

SEQ ID NO: 38392 - DNA, 20 bp, synthetic construct
  misc_feature 1..20: note = CRISPR gRNA sequence
  source 1..20: mol_type = other DNA
cttggtatatattgaattaa

SEQ ID NO: 38393 - DNA, 20 bp, synthetic construct
  misc_feature 1..20: note = CRISPR gRNA sequence
  source 1..20: mol_type = other DNA
gtatatattgaattaatgga

SEQ ID NO: 38394 - DNA, 20 bp, synthetic construct
  misc_feature 1..20: note = CRISPR gRNA sequence
  source 1..20: mol_type = other DNA
tgaattaatggatggatgaa

SEQ ID NO: 38395 - DNA, 20 bp, synthetic construct
  misc_feature 1..20: note = CRISPR gRNA sequence
  source 1..20: mol_type = other DNA
ttaatggatggatgaaaaga

SEQ ID NO: 38396 - DNA, 20 bp, synthetic construct
  misc_feature 1..20: note = CRISPR gRNA sequence
  source 1..20: mol_type = other DNA
tggatgaaaagatggatgta

SEQ ID NO: 38397 - DNA, 20 bp, synthetic construct
  misc_feature 1..20: note = CRISPR gRNA sequence
  source 1..20: mol_type = other DNA
tgaaaagatggatgtatgga

SEQ ID NO: 38398 - DNA, 20 bp, synthetic construct
  misc_feature 1..20: note = CRISPR gRNA sequence
  source 1..20: mol_type = other DNA
aagatggatgtatggatgga

SEQ ID NO: 38399 - DNA, 20 bp, synthetic construct
  misc_feature 1..20: note = CRISPR gRNA sequence
  source 1..20: mol_type = other DNA
tgtatggatggatggctgaa

SEQ ID NO: 38400 - DNA, 20 bp, synthetic construct
  misc_feature 1..20: note = CRISPR gRNA sequence
  source 1..20: mol_type = other DNA
tggatggatggctgaaaaga

SEQ ID NO: 38401 - DNA, 20 bp, synthetic construct
  misc_feature 1..20: note = CRISPR gRNA sequence
  source 1..20: mol_type = other DNA
tggatggctgaaaagatgga

SEQ ID NO: 38402 - DNA, 20 bp, synthetic construct
  misc_feature 1..20: note = CRISPR gRNA sequence
  source 1..20: mol_type = other DNA
ggatggctgaaaagatggat

SEQ ID NO: 38403 - DNA, 20 bp, synthetic construct
  misc_feature 1..20: note = CRISPR gRNA sequence
  source 1..20: mol_type = other DNA
tggctgaaaagatggatggg

SEQ ID NO: 38404 - DNA, 20 bp, synthetic construct
  misc_feature 1..20: note = CRISPR gRNA sequence
  source 1..20: mol_type = other DNA
aagatggatgggtggatgaa

SEQ ID NO: 38405 - DNA, 20 bp, synthetic construct
  misc_feature 1..20: note = CRISPR gRNA sequence
  source 1..20: mol_type = other DNA
tggatgggtggatgaaaaga

SEQ ID NO: 38406 - DNA, 20 bp, synthetic construct
  misc_feature 1..20: note = CRISPR gRNA sequence
  source 1..20: mol_type = other DNA
tgggtggatgaaaagatgga

SEQ ID NO: 38407 - DNA, 20 bp, synthetic construct
  misc_feature 1..20: note = CRISPR gRNA sequence
  source 1..20: mol_type = other DNA
tgaaaagatggatggatgaa

SEQ ID NO: 38408 - DNA, 20 bp, synthetic construct
  misc_feature 1..20: note = CRISPR gRNA sequence
  source 1..20: mol_type = other DNA
aagatggatggatgaatgga

SEQ ID NO: 38409 - DNA, 20 bp, synthetic construct
  misc_feature 1..20: note = CRISPR gRNA sequence
  source 1..20: mol_type = other DNA
tggatgaatggatggctgaa

SEQ ID NO: 38410 - DNA, 20 bp, synthetic construct
  misc_feature 1..20: note = CRISPR gRNA sequence
  source 1..20: mol_type = other DNA
tgaatggatggctgaaaaga

SEQ ID NO: 38411 - DNA, 20 bp, synthetic construct
  misc_feature 1..20: note = CRISPR gRNA sequence
  source 1..20: mol_type = other DNA
tggatggctgaaaagatgga

SEQ ID NO: 38412 - DNA, 20 bp, synthetic construct
  misc_feature 1..20: note = CRISPR gRNA sequence
  source 1..20: mol_type = other DNA
ggatggctgaaaagatggat

SEQ ID NO: 38413 - DNA, 20 bp, synthetic construct
  misc_feature 1..20: note = CRISPR gRNA sequence
  source 1..20: mol_type = other DNA
tggctgaaaagatggatggg

SEQ ID NO: 38414 - DNA, 20 bp, synthetic construct
  misc_feature 1..20: note = CRISPR gRNA sequence
  source 1..20: mol_type = other DNA
aagatggatgggtggatgaa

SEQ ID NO: 38415 - DNA, 20 bp, synthetic construct
  misc_feature 1..20: note = CRISPR gRNA sequence
  source 1..20: mol_type = other DNA
tggatgggtggatgaaaaga

SEQ ID NO: 38416 - DNA, 20 bp, synthetic construct
  misc_feature 1..20: note = CRISPR gRNA sequence
  source 1..20: mol_type = other DNA
tgggtggatgaaaagatgga

SEQ ID NO: 38417 - DNA, 20 bp, synthetic construct
  misc_feature 1..20: note = CRISPR gRNA sequence
  source 1..20: mol_type = other DNA
tggatgaaaagatggatgga

SEQ ID NO: 38418 - DNA, 20 bp, synthetic construct
  misc_feature 1..20: note = CRISPR gRNA sequence
  source 1..20: mol_type = other DNA
tgaaaagatggatggatgga

SEQ ID NO: 38419 - DNA, 20 bp, synthetic construct
  misc_feature 1..20: note = CRISPR gRNA sequence
  source 1..20: mol_type = other DNA
aagatggatggatggatgga

SEQ ID NO: 38420 - DNA, 20 bp, synthetic construct
  misc_feature 1..20: note = CRISPR gRNA sequence
  source 1..20: mol_type = other DNA
tggatggatggatggatgga

SEQ ID NO: 38421 - DNA, 20 bp, synthetic construct
  misc_feature 1..20: note = CRISPR gRNA sequence
  source 1..20: mol_type = other DNA
tggatggatggatggatgga

SEQ ID NO: 38422 - DNA, 20 bp, synthetic construct
  misc_feature 1..20: note = CRISPR gRNA sequence
  source 1..20: mol_type = other DNA
tggatggatggatggctgaa

SEQ ID NO: 38423 - DNA, 20 bp, synthetic construct
  misc_feature 1..20: note = CRISPR gRNA sequence
  source 1..20: mol_type = other DNA
tggatggatggctgaaaaga

SEQ ID NO: 38424 - DNA, 20 bp, synthetic construct
  misc_feature 1..20: note = CRISPR gRNA sequence
  source 1..20: mol_type = other DNA
tggatggctgaaaagatgga

SEQ ID NO: 38425 - DNA, 20 bp, synthetic construct
  misc_feature 1..20: note = CRISPR gRNA sequence
  source 1..20: mol_type = other DNA
ggatggctgaaaagatggat

SEQ ID NO: 38426 - DNA, 20 bp, synthetic construct
  misc_feature 1..20: note = CRISPR gRNA sequence
  source 1..20: mol_type = other DNA
tggctgaaaagatggatggg

SEQ ID NO: 38427 - DNA, 20 bp, synthetic construct
  misc_feature 1..20: note = CRISPR gRNA sequence
  source 1..20: mol_type = other DNA
aagatggatgggtggatgaa

SEQ ID NO: 38428 - DNA, 20 bp, synthetic construct
  misc_feature 1..20: note = CRISPR gRNA sequence
  source 1..20: mol_type = other DNA
tggatgggtggatgaaaaga

SEQ ID NO: 38429 - DNA, 20 bp, synthetic construct
  misc_feature 1..20: note = CRISPR gRNA sequence
  source 1..20: mol_type = other DNA
tgggtggatgaaaagatgga

SEQ ID NO: 38430 - DNA, 20 bp, synthetic construct
  misc_feature 1..20: note = CRISPR gRNA sequence
  source 1..20: mol_type = other DNA
tggatgaaaagatggatgga

SEQ ID NO: 38431 - DNA, 20 bp, synthetic construct
  misc_feature 1..20: note = CRISPR gRNA sequence
  source 1..20: mol_type = other DNA
tgaaaagatggatggatgga

SEQ ID NO: 38432 - DNA, 20 bp, synthetic construct
  misc_feature 1..20: note = CRISPR gRNA sequence
  source 1..20: mol_type = other DNA
aagatggatggatggatgga

SEQ ID NO: 38433 - DNA, 20 bp, synthetic construct
  misc_feature 1..20: note = CRISPR gRNA sequence
  source 1..20: mol_type = other DNA
tggatggatggatggatgga

SEQ ID NO: 38434 - DNA, 20 bp, synthetic construct
  misc_feature 1..20: note = CRISPR gRNA sequence
  source 1..20: mol_type = other DNA
tggatggatggatggatgaa

SEQ ID NO: 38435 - DNA, 20 bp, synthetic construct
  misc_feature 1..20: note = CRISPR gRNA sequence
  source 1..20: mol_type = other DNA
tggatggatggatgaaaaga

SEQ ID NO: 38436 - DNA, 20 bp, synthetic construct
  misc_feature 1..20: note = CRISPR gRNA sequence
  source 1..20: mol_type = other DNA
tggatggatgaaaagatgga

SEQ ID NO: 38437 - DNA, 20 bp, synthetic construct
  misc_feature 1..20: note = CRISPR gRNA sequence
  source 1..20: mol_type = other DNA
ggatggatgaaaagatggat

SEQ ID NO: 38438 - DNA, 20 bp, synthetic construct
  misc_feature 1..20: note = CRISPR gRNA sequence
  source 1..20: mol_type = other DNA
tggatgaaaagatggatggg

SEQ ID NO: 38439 - DNA, 20 bp, synthetic construct
  misc_feature 1..20: note = CRISPR gRNA sequence
  source 1..20: mol_type = other DNA
aagatggatgggtggatgaa

SEQ ID NO: 38440 - DNA, 20 bp, synthetic construct
  misc_feature 1..20: note = CRISPR gRNA sequence
  source 1..20: mol_type = other DNA
tggatgggtggatgaaaaga

SEQ ID NO: 38441 - DNA, 20 bp, synthetic construct
  misc_feature 1..20: note = CRISPR gRNA sequence
  source 1..20: mol_type = other DNA
tgggtggatgaaaagatgga

SEQ ID NO: 38442 - DNA, 20 bp, synthetic construct
  misc_feature 1..20: note = CRISPR gRNA sequence
  source 1..20: mol_type = other DNA
tggatgaaaagatggatgga

SEQ ID NO: 38443 - DNA, 20 bp, synthetic construct
  misc_feature 1..20: note = CRISPR gRNA sequence
  source 1..20: mol_type = other DNA
tgaaaagatggatggatgga

SEQ ID NO: 38444 - DNA, 20 bp, synthetic construct
  misc_feature 1..20: note = CRISPR gRNA sequence
  source 1..20: mol_type = other DNA
aagatggatggatggatgga

SEQ ID NO: 38445 - DNA, 20 bp, synthetic construct
  misc_feature 1..20: note = CRISPR gRNA sequence
  source 1..20: mol_type = other DNA
tggatggatggatggatgga

SEQ ID NO: 38446 - DNA, 20 bp, synthetic construct
  misc_feature 1..20: note = CRISPR gRNA sequence
  source 1..20: mol_type = other DNA
tggatggatggatggatgga

SEQ ID NO: 38447 - DNA, 20 bp, synthetic construct
  misc_feature 1..20: note = CRISPR gRNA sequence
  source 1..20: mol_type = other DNA
tggatggatggaaagattga

SEQ ID NO: 38448 - DNA, 20 bp, synthetic construct
  misc_feature 1..20: note = CRISPR gRNA sequence
  source 1..20: mol_type = other DNA
ggatggatggaaagattgat

SEQ ID NO: 38449 - DNA, 20 bp, synthetic construct
  misc_feature 1..20: note = CRISPR gRNA sequence
  source 1..20: mol_type = other DNA
tggatggaaagattgatggg

SEQ ID NO: 38450 - DNA, 20 bp, synthetic construct
  misc_feature 1..20: note = CRISPR gRNA sequence
  source 1..20: mol_type = other DNA
aagattgatgggtggatgaa

SEQ ID NO: 38451 - DNA, 20 bp, synthetic construct
  misc_feature 1..20: note = CRISPR gRNA sequence
  source 1..20: mol_type = other DNA
tgggtggatgaaaagatgaa

SEQ ID NO: 38452 - DNA, 20 bp, synthetic construct
  misc_feature 1..20: note = CRISPR gRNA sequence
  source 1..20: mol_type = other DNA
tggatgaaaagatgaatgga

SEQ ID NO: 38453 - DNA, 20 bp, synthetic construct
  misc_feature 1..20: note = CRISPR gRNA sequence
  source 1..20: mol_type = other DNA
tgaaaagatgaatggatgga

SEQ ID NO: 38454 - DNA, 20 bp, synthetic construct
  misc_feature 1..20: note = CRISPR gRNA sequence
  source 1..20: mol_type = other DNA
aagatgaatggatggatgga

SEQ ID NO: 38455 - DNA, 20 bp, synthetic construct
  misc_feature 1..20: note = CRISPR gRNA sequence
  source 1..20: mol_type = other DNA
tggatggatggatagatgaa

SEQ ID NO: 38456 - DNA, 20 bp, synthetic construct
  misc_feature 1..20: note = CRISPR gRNA sequence
  source 1..20: mol_type = other DNA
tggatggatagatgaatgga

SEQ ID NO: 38457 - DNA, 20 bp, synthetic construct
  misc_feature 1..20: note = CRISPR gRNA sequence
  source 1..20: mol_type = other DNA
tggatagatgaatggatgga

SEQ ID NO: 38458 - DNA, 20 bp, synthetic construct
  misc_feature 1..20: note = CRISPR gRNA sequence
  source 1..20: mol_type = other DNA
tagatgaatggatggatgga

SEQ ID NO: 38459 - DNA, 20 bp, synthetic construct
  misc_feature 1..20: note = CRISPR gRNA sequence
  source 1..20: mol_type = other DNA
tgaatggatggatggataga

SEQ ID NO: 38460 - DNA, 20 bp, synthetic construct
  misc_feature 1..20: note = CRISPR gRNA sequence
  source 1..20: mol_type = other DNA
tggatggatggatagatggc

SEQ ID NO: 38461 - DNA, 20 bp, synthetic construct
  misc_feature 1..20: note = CRISPR gRNA sequence
  source 1..20: mol_type = other DNA
tggatagatggctagctgaa

SEQ ID NO: 38462 - DNA, 20 bp, synthetic construct
  misc_feature 1..20: note = CRISPR gRNA sequence
  source 1..20: mol_type = other DNA
tagatggctagctgaaaaga

SEQ ID NO: 38463 - DNA, 20 bp, synthetic construct
  misc_feature 1..20: note = CRISPR gRNA sequence
  source 1..20: mol_type = other DNA
tggctagctgaaaagatgga

SEQ ID NO: 38464 - DNA, 20 bp, synthetic construct
  misc_feature 1..20: note = CRISPR gRNA sequence
  source 1..20: mol_type = other DNA
ggctagctgaaaagatggat

SEQ ID NO: 38465 - DNA, 20 bp, synthetic construct
  misc_feature 1..20: note = CRISPR gRNA sequence
  source 1..20: mol_type = other DNA
aagatggataggtgtgtgaa

SEQ ID NO: 38466 - DNA, 20 bp, synthetic construct
  misc_feature 1..20: note = CRISPR gRNA sequence
  source 1..20: mol_type = other DNA
tggataggtgtgtgaaaaga

SEQ ID NO: 38467 - DNA, 20 bp, synthetic construct
  misc_feature 1..20: note = CRISPR gRNA sequence
  source 1..20: mol_type = other DNA
taggtgtgtgaaaagatgga

SEQ ID NO: 38468 - DNA, 20 bp, synthetic construct
  misc_feature 1..20: note = CRISPR gRNA sequence
  source 1..20: mol_type = other DNA
tgtgtgaaaagatggatgga

SEQ ID NO: 38469 - DNA, 20 bp, synthetic construct
  misc_feature 1..20: note = CRISPR gRNA sequence
  source 1..20: mol_type = other DNA
tgaaaagatggatggatgga

SEQ ID NO: 38470 - DNA, 20 bp, synthetic construct
  misc_feature 1..20: note = CRISPR gRNA sequence
  source 1..20: mol_type = other DNA
aagatggatggatggatgga

SEQ ID NO: 38471 - DNA, 20 bp, synthetic construct
  misc_feature 1..20: note = CRISPR gRNA sequence
  source 1..20: mol_type = other DNA
tggatggatggatggatgga

SEQ ID NO: 38472 - DNA, 20 bp, synthetic construct
  misc_feature 1..20: note = CRISPR gRNA sequence
  source 1..20: mol_type = other DNA
tggatggatggatggatgga

SEQ ID NO: 38473 - DNA, 20 bp, synthetic construct
  misc_feature 1..20: note = CRISPR gRNA sequence
  source 1..20: mol_type = other DNA
tggatggatggatggatgga

SEQ ID NO: 38474 - DNA, 20 bp, synthetic construct
  misc_feature 1..20: note = CRISPR gRNA sequence
  source 1..20: mol_type = other DNA
tggatggatggatggatgga

SEQ ID NO: 38475 - DNA, 20 bp, synthetic construct
  misc_feature 1..20: note = CRISPR gRNA sequence
  source 1..20: mol_type = other DNA
tggatggatggatggatgga

SEQ ID NO: 38476 - DNA, 20 bp, synthetic construct
  misc_feature 1..20: note = CRISPR gRNA sequence
  source 1..20: mol_type = other DNA
tggatggatggatggatgga

SEQ ID NO: 38477 - DNA, 20 bp, synthetic construct
  misc_feature 1..20: note = CRISPR gRNA sequence
  source 1..20: mol_type = other DNA
tggatggatggatggatgga

SEQ ID NO: 38478 - DNA, 20 bp, synthetic construct
  misc_feature 1..20: note = CRISPR gRNA sequence
  source 1..20: mol_type = other DNA
gatggatggatggatggatg

SEQ ID NO: 38479 - DNA, 20 bp, synthetic construct
  misc_feature 1..20: note = CRISPR gRNA sequence
  source 1..20: mol_type = other DNA
atggatggatggatggatga

SEQ ID NO: 38480 - DNA, 20 bp, synthetic construct
  misc_feature 1..20: note = CRISPR gRNA sequence
  source 1..20: mol_type = other DNA
ggatggatggatgaaggaat

SEQ ID NO: 38481 - DNA, 20 bp, synthetic construct
  misc_feature 1..20: note = CRISPR gRNA sequence
  source 1..20: mol_type = other DNA
ggatgaaggaatgagtcaac

SEQ ID NO: 38482 - DNA, 20 bp, synthetic construct
  misc_feature 1..20: note = CRISPR gRNA sequence
  source 1..20: mol_type = other DNA
aatgagtcaacaagtctacg

SEQ ID NO: 38483 - DNA, 20 bp, synthetic construct
  misc_feature 1..20: note = CRISPR gRNA sequence
  source 1..20: mol_type = other DNA
gtcaacaagtctacgaagca

SEQ ID NO: 38484 - DNA, 20 bp, synthetic construct
  misc_feature 1..20: note = CRISPR gRNA sequence
  source 1..20: mol_type = other DNA
tcaacaagtctacgaagcac

SEQ ID NO: 38485 - DNA, 20 bp, synthetic construct
  misc_feature 1..20: note = CRISPR gRNA sequence
  source 1..20: mol_type = other DNA
aagtctacgaagcacaggca

SEQ ID NO: 38486 - DNA, 20 bp, synthetic construct
  misc_feature 1..20: note = CRISPR gRNA sequence
  source 1..20: mol_type = other DNA
acgaagcacaggcatagcca

SEQ ID NO: 38487 - DNA, 20 bp, synthetic construct
  misc_feature 1..20: note = CRISPR gRNA sequence
  source 1..20: mol_type = other DNA
cgaagcacaggcatagccaa

SEQ ID NO: 38488 - DNA, 20 bp, synthetic construct
  misc_feature 1..20: note = CRISPR gRNA sequence
  source 1..20: mol_type = other DNA
ggcatagccaaaggaataat

SEQ ID NO: 38489 - DNA, 20 bp, synthetic construct
  misc_feature 1..20: note = CRISPR gRNA sequence
  source 1..20: mol_type = other DNA
tagctgtgtgttgccctcca

SEQ ID NO: 38490 - DNA, 20 bp, synthetic construct
  misc_feature 1..20: note = CRISPR gRNA sequence
  source 1..20: mol_type = other DNA
tccatggtgctgaaccaata

SEQ ID NO: 38491 - DNA, 20 bp, synthetic construct
  misc_feature 1..20: note = CRISPR gRNA sequence
  source 1..20: mol_type = other DNA
tggtgctgaaccaatatagc

SEQ ID NO: 38492 - DNA, 20 bp, synthetic construct
  misc_feature 1..20: note = CRISPR gRNA sequence
  source 1..20: mol_type = other DNA
aatatagccagttttgatca

SEQ ID NO: 38493 - DNA, 20 bp, synthetic construct
  misc_feature 1..20: note = CRISPR gRNA sequence
  source 1..20: mol_type = other DNA
atatagccagttttgatcat

SEQ ID NO: 38494 - DNA, 20 bp, synthetic construct
  misc_feature 1..20: note = CRISPR gRNA sequence
  source 1..20: mol_type = other DNA
tatagccagttttgatcatg

SEQ ID NO: 38495 - DNA, 20 bp, synthetic construct
  misc_feature 1..20: note = CRISPR gRNA sequence
  source 1..20: mol_type = other DNA
agccagttttgatcatgggg

SEQ ID NO: 38496 - DNA, 20 bp, synthetic construct
  misc_feature 1..20: note = CRISPR gRNA sequence
  source 1..20: mol_type = other DNA
gccagttttgatcatggggt

SEQ ID NO: 38497 - DNA, 20 bp, synthetic construct
  misc_feature 1..20: note = CRISPR gRNA sequence
  source 1..20: mol_type = other DNA
gttttgatcatggggtaggt

SEQ ID NO: 38498 - DNA, 20 bp, synthetic construct
  misc_feature 1..20: note = CRISPR gRNA sequence
  source 1..20: mol_type = other DNA
ttttgatcatggggtaggtt

SEQ ID NO: 38499 - DNA, 20 bp, synthetic construct
  misc_feature 1..20: note = CRISPR gRNA sequence
  source 1..20: mol_type = other DNA
aatttctattaaaaaaaatt

SEQ ID NO: 38500 - DNA, 20 bp, synthetic construct
  misc_feature 1..20: note = CRISPR gRNA sequence
  source 1..20: mol_type = other DNA
tctattaaaaaaaattcagc

SEQ ID NO: 38501 - DNA, 20 bp, synthetic construct
  misc_feature 1..20: note = CRISPR gRNA sequence
  source 1..20: mol_type = other DNA
ctattaaaaaaaattcagcc

SEQ ID NO: 38502 - DNA, 20 bp, synthetic construct
  misc_feature 1..20: note = CRISPR gRNA sequence
  source 1..20: mol_type = other DNA
aaaaaaaattcagccgggct

SEQ ID NO: 38503 - DNA, 20 bp, synthetic construct
  misc_feature 1..20: note = CRISPR gRNA sequence
  source 1..20: mol_type = other DNA
aaaaattcagccgggctcag

SEQ ID NO: 38504 - DNA, 20 bp, synthetic construct
  misc_feature 1..20: note = CRISPR gRNA sequence
  source 1..20: mol_type = other DNA
tgcctgtaattccaacactt

SEQ ID NO: 38505 - DNA, 20 bp, synthetic construct
  misc_feature 1..20: note = CRISPR gRNA sequence
  source 1..20: mol_type = other DNA
ctgtaattccaacactttgg

SEQ ID NO: 38506 - DNA, 20 bp, synthetic construct
  misc_feature 1..20: note = CRISPR gRNA sequence
  source 1..20: mol_type = other DNA
tgtaattccaacactttgga

SEQ ID NO: 38507 - DNA, 20 bp, synthetic construct
  misc_feature 1..20: note = CRISPR gRNA sequence
  source 1..20: mol_type = other DNA
ttccaacactttggaaggcc

SEQ ID NO: 38508 - DNA, 20 bp, synthetic construct
  misc_feature 1..20: note = CRISPR gRNA sequence
  source 1..20: mol_type = other DNA
tccaacactttggaaggcca

SEQ ID NO: 38509 - DNA, 20 bp, synthetic construct
  misc_feature 1..20: note = CRISPR gRNA sequence
  source 1..20: mol_type = other DNA
acactttggaaggccaaggc

SEQ ID NO: 38510 - DNA, 20 bp, synthetic construct
  misc_feature 1..20: note = CRISPR gRNA sequence
  source 1..20: mol_type = other DNA
actttggaaggccaaggcaa

SEQ ID NO: 38511 - DNA, 20 bp, synthetic construct
  misc_feature 1..20: note = CRISPR gRNA sequence
  source 1..20: mol_type = other DNA
ctttggaaggccaaggcaag

SEQ ID NO: 38512 - DNA, 20 bp, synthetic construct
  misc_feature 1..20: note = CRISPR gRNA sequence
  source 1..20: mol_type = other DNA
ccaaggcaagaggattactt

SEQ ID NO: 38513 - DNA, 20 bp, synthetic construct
  misc_feature 1..20: note = CRISPR gRNA sequence
  source 1..20: mol_type = other DNA
gcaagaggattacttgagct

SEQ ID NO: 38514 - DNA, 20 bp, synthetic construct
  misc_feature 1..20: note = CRISPR gRNA sequence
  source 1..20: mol_type = other DNA
caagaggattacttgagctc

SEQ ID NO: 38515 - DNA, 20 bp, synthetic construct
  misc_feature 1..20: note = CRISPR gRNA sequence
  source 1..20: mol_type = other DNA
agaggattacttgagctcag

SEQ ID NO: 38516 - DNA, 20 bp, synthetic construct
  misc_feature 1..20: note = CRISPR gRNA sequence
  source 1..20: mol_type = other DNA
ttacttgagctcaggagttc

SEQ ID NO: 38517 - DNA, 20 bp, synthetic construct
  misc_feature 1..20: note = CRISPR gRNA sequence
  source 1..20: mol_type = other DNA
tcaggagttcgagaccaacc

SEQ ID NO: 38518 - DNA, 20 bp, synthetic construct
  misc_feature 1..20: note = CRISPR gRNA sequence
  source 1..20: mol_type = other DNA
caggagttcgagaccaacct

SEQ ID NO: 38519 - DNA, 20 bp, synthetic construct
  misc_feature 1..20: note = CRISPR gRNA sequence
  source 1..20: mol_type = other DNA
cgagaccaacctgggcaaca

SEQ ID NO: 38520 - DNA, 20 bp, synthetic construct
  misc_feature 1..20: note = CRISPR gRNA sequence
  source 1..20: mol_type = other DNA
caaaaaatgaacaaaattaa

SEQ ID NO: 38521 - DNA, 20 bp, synthetic construct
  misc_feature 1..20: note = CRISPR gRNA sequence
  source 1..20: mol_type = other DNA
aaaaaatgaacaaaattaat

SEQ ID NO: 38522 - DNA, 20 bp, synthetic construct
  misc_feature 1..20: note = CRISPR gRNA sequence
  source 1..20: mol_type = other DNA
aaaaatgaacaaaattaatg

SEQ ID NO: 38523 - DNA, 20 bp, synthetic construct
  misc_feature 1..20: note = CRISPR gRNA sequence
  source 1..20: mol_type = other DNA
tgaacaaaattaatggggca

SEQ ID NO: 38524 - DNA, 20 bp, synthetic construct
  misc_feature 1..20: note = CRISPR gRNA sequence
  source 1..20: mol_type = other DNA
acaaaattaatggggcatgg

SEQ ID NO: 38525 - DNA, 20 bp, synthetic construct
  misc_feature 1..20: note = CRISPR gRNA sequence
  source 1..20: mol_type = other DNA
ggcatggtggtgcatgcctg

SEQ ID NO: 38526 - DNA, 20 bp, synthetic construct
  misc_feature 1..20: note = CRISPR gRNA sequence
  source 1..20: mol_type = other DNA
gtggtgcatgcctgtggttc

SEQ ID NO: 38527 - DNA, 20 bp, synthetic construct
  misc_feature 1..20: note = CRISPR gRNA sequence
  source 1..20: mol_type = other DNA
tgcctgtggttccagctatt

SEQ ID NO: 38528 - DNA, 20 bp, synthetic construct
  misc_feature 1..20: note = CRISPR gRNA sequence
  source 1..20: mol_type = other DNA
gcctgtggttccagctattt

SEQ ID NO: 38529 - DNA, 20 bp, synthetic construct
  misc_feature 1..20: note = CRISPR gRNA sequence
  source 1..20: mol_type = other DNA
ctgtggttccagctatttgg

SEQ ID NO: 38530 - DNA, 20 bp, synthetic construct
  misc_feature 1..20: note = CRISPR gRNA sequence
  source 1..20: mol_type = other DNA
tgtggttccagctatttggg

SEQ ID NO: 38531 - DNA, 20 bp, synthetic construct
  misc_feature 1..20: note = CRISPR gRNA sequence
  source 1..20: mol_type = other DNA
ttccagctatttgggaggct

SEQ ID NO: 38532 - DNA, 20 bp, synthetic construct
  misc_feature 1..20: note = CRISPR gRNA sequence
  source 1..20: mol_type = other DNA
tccagctatttgggaggctg

SEQ ID NO: 38533 - DNA, 20 bp, synthetic construct
  misc_feature 1..20: note = CRISPR gRNA sequence
  source 1..20: mol_type = other DNA
agctatttgggaggctgagg

SEQ ID NO: 38534 - DNA, 20 bp, synthetic construct
  misc_feature 1..20: note = CRISPR gRNA sequence
  source 1..20: mol_type = other DNA
gctatttgggaggctgaggt

SEQ ID NO: 38535 - DNA, 20 bp, synthetic construct
  misc_feature 1..20: note = CRISPR gRNA sequence
  source 1..20: mol_type = other DNA
atttgggaggctgaggtggg

SEQ ID NO: 38536 - DNA, 20 bp, synthetic construct
  misc_feature 1..20: note = CRISPR gRNA sequence
  source 1..20: mol_type = other DNA
ctgaggtgggaagattgctt

SEQ ID NO: 38537 - DNA, 20 bp, synthetic construct
  misc_feature 1..20: note = CRISPR gRNA sequence
  source 1..20: mol_type = other DNA
tgggaagattgcttgagccg

SEQ ID NO: 38538 - DNA, 20 bp, synthetic construct
  misc_feature 1..20: note = CRISPR gRNA sequence
  source 1..20: mol_type = other DNA
ggaagattgcttgagccgtg

SEQ ID NO: 38539 - DNA, 20 bp, synthetic construct
  misc_feature 1..20: note = CRISPR gRNA sequence
  source 1..20: mol_type = other DNA
gaagattgcttgagccgtgg

SEQ ID NO: 38540 - DNA, 20 bp, synthetic construct
  misc_feature 1..20: note = CRISPR gRNA sequence
  source 1..20: mol_type = other DNA
ttgcttgagccgtggaggtt

SEQ ID NO: 38541 - DNA, 20 bp, synthetic construct
  misc_feature 1..20: note = CRISPR gRNA sequence
  source 1..20: mol_type = other DNA
tgcttgagccgtggaggttg

SEQ ID NO: 38542 - DNA, 20 bp, synthetic construct
  misc_feature 1..20: note = CRISPR gRNA sequence
  source 1..20: mol_type = other DNA
agccgtggaggttgaggctg

SEQ ID NO: 38543 - DNA, 20 bp, synthetic construct
  misc_feature 1..20: note = CRISPR gRNA sequence
  source 1..20: mol_type = other DNA
gtggaggttgaggctgcagt

SEQ ID NO: 38544 - DNA, 20 bp, synthetic construct
  misc_feature 1..20: note = CRISPR gRNA sequence
  source 1..20: mol_type = other DNA
tggaggttgaggctgcagtg

SEQ ID NO: 38545 - DNA, 20 bp, synthetic construct
  misc_feature 1..20: note = CRISPR gRNA sequence
  source 1..20: mol_type = other DNA
gtgaacacaccactgcactc

SEQ ID NO: 38546 - DNA, 20 bp, synthetic construct
  misc_feature 1..20: note = CRISPR gRNA sequence
  source 1..20: mol_type = other DNA
acaccactgcactccagcct

SEQ ID NO: 38547 - DNA, 20 bp, synthetic construct
  misc_feature 1..20: note = CRISPR gRNA sequence
  source 1..20: mol_type = other DNA
ccactgcactccagcctgag

SEQ ID NO: 38548 - DNA, 20 bp, synthetic construct
  misc_feature 1..20: note = CRISPR gRNA sequence
  source 1..20: mol_type = other DNA
ctgcactccagcctgagtag

SEQ ID NO: 38549 - DNA, 20 bp, synthetic construct
  misc_feature 1..20: note = CRISPR gRNA sequence
  source 1..20: mol_type = other DNA
gcactccagcctgagtagca

SEQ ID NO: 38550 - DNA, 20 bp, synthetic construct
  misc_feature 1..20: note = CRISPR gRNA sequence
  source 1..20: mol_type = other DNA
tccagcctgagtagcagagt

SEQ ID NO: 38551 - DNA, 20 bp, synthetic construct
  misc_feature 1..20: note = CRISPR gRNA sequence
  source 1..20: mol_type = other DNA
atctccatctcaaatttaaa

SEQ ID NO: 38552 - DNA, 20 bp, synthetic construct
  misc_feature 1..20: note = CRISPR gRNA sequence
  source 1..20: mol_type = other DNA
ccatctcaaatttaaaaaga

SEQ ID NO: 38553 - DNA, 20 bp, synthetic construct
  misc_feature 1..20: note = CRISPR gRNA sequence
  source 1..20: mol_type = other DNA
catctcaaatttaaaaagaa

SEQ ID NO: 38554 - DNA, 20 bp, synthetic construct
  misc_feature 1..20: note = CRISPR gRNA sequence
  source 1..20: mol_type = other DNA
gactttttaaaacactcttg

SEQ ID NO: 38555 - DNA, 20 bp, synthetic construct
  misc_feature 1..20: note = CRISPR gRNA sequence
  source 1..20: mol_type = other DNA
actttttaaaacactcttgc

SEQ ID NO: 38556 - DNA, 20 bp, synthetic construct
  misc_feature 1..20: note = CRISPR gRNA sequence
  source 1..20: mol_type = other DNA
acactcttgcaggattcatc

SEQ ID NO: 38557 - DNA, 20 bp, synthetic construct
  misc_feature 1..20: note = CRISPR gRNA sequence
  source 1..20: mol_type = other DNA
cttgcaggattcatcaagca

SEQ ID NO: 38558 - DNA, 20 bp, synthetic construct
  misc_feature 1..20: note = CRISPR gRNA sequence
  source 1..20: mol_type = other DNA
tcatcaagcaaagacataat

SEQ ID NO: 38559 - DNA, 20 bp, synthetic construct
  misc_feature 1..20: note = CRISPR gRNA sequence
  source 1..20: mol_type = other DNA
ctgatttaaaacacttttgc

SEQ ID NO: 38560 - DNA, 20 bp, synthetic construct
  misc_feature 1..20: note = CRISPR gRNA sequence
  source 1..20: mol_type = other DNA
ttccctgtcaattgcaaaat

SEQ ID NO: 38561 - DNA, 20 bp, synthetic construct
  misc_feature 1..20: note = CRISPR gRNA sequence
  source 1..20: mol_type = other DNA
attgcaaaatcagctttatc

SEQ ID NO: 38562 - DNA, 20 bp, synthetic construct
  misc_feature 1..20: note = CRISPR gRNA sequence
  source 1..20: mol_type = other DNA
tatctggatgtttgaacatt

SEQ ID NO: 38563 - DNA, 20 bp, synthetic construct
  misc_feature 1..20: note = CRISPR gRNA sequence
  source 1..20: mol_type = other DNA
atctggatgtttgaacattt

SEQ ID NO: 38564 - DNA, 20 bp, synthetic construct
  misc_feature 1..20: note = CRISPR gRNA sequence
  source 1..20: mol_type = other DNA
tctggatgtttgaacatttg

SEQ ID NO: 38565 - DNA, 20 bp, synthetic construct
  misc_feature 1..20: note = CRISPR gRNA sequence
  source 1..20: mol_type = other DNA
ggatgtttgaacatttgggg

SEQ ID NO: 38566 - DNA, 20 bp, synthetic construct
  misc_feature 1..20: note = CRISPR gRNA sequence
  source 1..20: mol_type = other DNA
tttgaacatttggggcagaa

SEQ ID NO: 38567 - DNA, 20 bp, synthetic construct
  misc_feature 1..20: note = CRISPR gRNA sequence
  source 1..20: mol_type = other DNA
ttgaacatttggggcagaaa

SEQ ID NO: 38568 - DNA, 20 bp, synthetic construct
  misc_feature 1..20: note = CRISPR gRNA sequence
  source 1..20: mol_type = other DNA
tgaacatttggggcagaaaa

SEQ ID NO: 38569 - DNA, 20 bp, synthetic construct
  misc_feature 1..20: note = CRISPR gRNA sequence
  source 1..20: mol_type = other DNA
ggcagaaaagggtgtgcctg

SEQ ID NO: 38570 - DNA, 20 bp, synthetic construct
  misc_feature 1..20: note = CRISPR gRNA sequence
  source 1..20: mol_type = other DNA
agaaaagggtgtgcctgtgg

SEQ ID NO: 38571 - DNA, 20 bp, synthetic construct
  misc_feature 1..20: note = CRISPR gRNA sequence
  source 1..20: mol_type = other DNA
gaaaagggtgtgcctgtggt

SEQ ID NO: 38572 - DNA, 20 bp, synthetic construct
  misc_feature 1..20: note = CRISPR gRNA sequence
  source 1..20: mol_type = other DNA
gcctgtggtgggtgatgtgc

SEQ ID NO: 38573 - DNA, 20 bp, synthetic construct
  misc_feature 1..20: note = CRISPR gRNA sequence
  source 1..20: mol_type = other DNA
gtgggtgatgtgctggtttc

SEQ ID NO: 38574 - DNA, 20 bp, synthetic construct
  misc_feature 1..20: note = CRISPR gRNA sequence
  source 1..20: mol_type = other DNA
atgtgctggtttccagtctc

SEQ ID NO: 38575 - DNA, 20 bp, synthetic construct
  misc_feature 1..20: note = CRISPR gRNA sequence
  source 1..20: mol_type = other DNA
tgtgctggtttccagtctct

SEQ ID NO: 38576 - DNA, 20 bp, synthetic construct
  misc_feature 1..20: note = CRISPR gRNA sequence
  source 1..20: mol_type = other DNA
tttccagtctctgggtttca

SEQ ID NO: 38577 - DNA, 20 bp, synthetic construct
  misc_feature 1..20: note = CRISPR gRNA sequence
  source 1..20: mol_type = other DNA
agtctctgggtttcatggct

SEQ ID NO: 38578 - DNA, 20 bp, synthetic construct
  misc_feature 1..20: note = CRISPR gRNA sequence
  source 1..20: mol_type = other DNA
tggcttggtatctgatcctg

SEQ ID NO: 38579 - DNA, 20 bp, synthetic construct
  misc_feature 1..20: note = CRISPR gRNA sequence
  source 1..20: mol_type = other DNA
ggcttggtatctgatcctgc

SEQ ID NO: 38580 - DNA, 20 bp, synthetic construct
  misc_feature 1..20: note = CRISPR gRNA sequence
  source 1..20: mol_type = other DNA
gcttggtatctgatcctgca

SEQ ID NO: 38581 - DNA, 20 bp, synthetic construct
  misc_feature 1..20: note = CRISPR gRNA sequence
  source 1..20: mol_type = other DNA
ttggtatctgatcctgcagg

SEQ ID NO: 38582 - DNA, 20 bp, synthetic construct
  misc_feature 1..20: note = CRISPR gRNA sequence
  source 1..20: mol_type = other DNA
tggtatctgatcctgcaggg

SEQ ID NO: 38583 - DNA, 20 bp, synthetic construct
  misc_feature 1..20: note = CRISPR gRNA sequence
  source 1..20: mol_type = other DNA
tatctgatcctgcagggagg

SEQ ID NO: 38584 - DNA, 20 bp, synthetic construct
  misc_feature 1..20: note = CRISPR gRNA sequence
  source 1..20: mol_type = other DNA
cttccttctttccccgccca

SEQ ID NO: 38585 - DNA, 20 bp, synthetic construct
  misc_feature 1..20: note = CRISPR gRNA sequence
  source 1..20: mol_type = other DNA
tccttctttccccgcccaca

SEQ ID NO: 38586 - DNA, 20 bp, synthetic construct
  misc_feature 1..20: note = CRISPR gRNA sequence
  source 1..20: mol_type = other DNA
cccgcccacagagacaactg

SEQ ID NO: 38587 - DNA, 20 bp, synthetic construct
  misc_feature 1..20: note = CRISPR gRNA sequence
  source 1..20: mol_type = other DNA
cgcccacagagacaactgca

SEQ ID NO: 38588 - DNA, 20 bp, synthetic construct
  misc_feature 1..20: note = CRISPR gRNA sequence
  source 1..20: mol_type = other DNA
gagacaactgcagagctaca

SEQ ID NO: 38589 - DNA, 20 bp, synthetic construct
  misc_feature 1..20: note = CRISPR gRNA sequence
  source 1..20: mol_type = other DNA
agacaactgcagagctacaa

SEQ ID NO: 38590 - DNA, 20 bp, synthetic construct
  misc_feature 1..20: note = CRISPR gRNA sequence
  source 1..20: mol_type = other DNA
aactgcagagctacaaaggt

SEQ ID NO: 38591 - DNA, 20 bp, synthetic construct
  misc_feature 1..20: note = CRISPR gRNA sequence
  source 1..20: mol_type = other DNA
tgcagagctacaaaggtaag

SEQ ID NO: 38592 - DNA, 20 bp, synthetic construct
  misc_feature 1..20: note = CRISPR gRNA sequence
  source 1..20: mol_type = other DNA
agctacaaaggtaagaagcc

SEQ ID NO: 38593 - DNA, 20 bp, synthetic construct
  misc_feature 1..20: note = CRISPR gRNA sequence
  source 1..20: mol_type = other DNA
ctacaaaggtaagaagccaa

SEQ ID NO: 38594 - DNA, 20 bp, synthetic construct
  misc_feature 1..20: note = CRISPR gRNA sequence
  source 1..20: mol_type = other DNA
tacaaaggtaagaagccaag

SEQ ID NO: 38595 - DNA, 20 bp, synthetic construct
  misc_feature 1..20: note = CRISPR gRNA sequence
  source 1..20: mol_type = other DNA
aaaggtaagaagccaagagg

SEQ ID NO: 38596 - DNA, 20 bp, synthetic construct
  misc_feature 1..20: note = CRISPR gRNA sequence
  source 1..20: mol_type = other DNA
ggtaagaagccaagaggcgg

SEQ ID NO: 38597 - DNA, 20 bp, synthetic construct
  misc_feature 1..20: note = CRISPR gRNA sequence
  source 1..20: mol_type = other DNA
gtaagaagccaagaggcggt

SEQ ID NO: 38598 - DNA, 20 bp, synthetic construct
  misc_feature 1..20: note = CRISPR gRNA sequence
  source 1..20: mol_type = other DNA
aagccaagaggcggtgggcc

SEQ ID NO: 38599 - DNA, 20 bp, synthetic construct
  misc_feature 1..20: note = CRISPR gRNA sequence
  source 1..20: mol_type = other DNA
agccaagaggcggtgggcct

SEQ ID NO: 38600 - DNA, 20 bp, synthetic construct
  misc_feature 1..20: note = CRISPR gRNA sequence
  source 1..20: mol_type = other DNA
gccaagaggcggtgggcctg

SEQ ID NO: 38601 - DNA, 20 bp, synthetic construct
  misc_feature 1..20: note = CRISPR gRNA sequence
  source 1..20: mol_type = other DNA
ggtgggcctggggccatcct

SEQ ID NO: 38602 - DNA, 20 bp, synthetic construct
  misc_feature 1..20: note = CRISPR gRNA sequence
  source 1..20: mol_type = other DNA
gggcctggggccatccttag

SEQ ID NO: 38603 - DNA, 20 bp, synthetic construct
  misc_feature 1..20: note = CRISPR gRNA sequence
  source 1..20: mol_type = other DNA
ggccatccttagaagcaact

SEQ ID NO: 38604 - DNA, 20 bp, synthetic construct
  misc_feature 1..20: note = CRISPR gRNA sequence
  source 1..20: mol_type = other DNA
gccatccttagaagcaactt

SEQ ID NO: 38605 - DNA, 20 bp, synthetic construct
  misc_feature 1..20: note = CRISPR gRNA sequence
  source 1..20: mol_type = other DNA
ccttagaagcaacttgggct

SEQ ID NO: 38606 - DNA, 20 bp, synthetic construct
  misc_feature 1..20: note = CRISPR gRNA sequence
  source 1..20: mol_type = other DNA
cttagaagcaacttgggctc

SEQ ID NO: 38607 - DNA, 20 bp, synthetic construct
  misc_feature 1..20: note = CRISPR gRNA sequence
  source 1..20: mol_type = other DNA
agaagcaacttgggctcagg

SEQ ID NO: 38608 - DNA, 20 bp, synthetic construct
  misc_feature 1..20: note = CRISPR gRNA sequence
  source 1..20: mol_type = other DNA
caacttgggctcaggcagtt

SEQ ID NO: 38609 - DNA, 20 bp, synthetic construct
  misc_feature 1..20: note = CRISPR gRNA sequence
  source 1..20: mol_type = other DNA
aacttgggctcaggcagttg

SEQ ID NO: 38610 - DNA, 20 bp, synthetic construct
  misc_feature 1..20: note = CRISPR gRNA sequence
  source 1..20: mol_type = other DNA
acttgggctcaggcagttga

SEQ ID NO: 38611 - DNA, 20 bp, synthetic construct
  misc_feature 1..20: note = CRISPR gRNA sequence
  source 1..20: mol_type = other DNA
cttgggctcaggcagttgag

SEQ ID NO: 38612 - DNA, 20 bp, synthetic construct
  misc_feature 1..20: note = CRISPR gRNA sequence
  source 1..20: mol_type = other DNA
ggctcaggcagttgagggga

SEQ ID NO: 38613 - DNA, 20 bp, synthetic construct
  misc_feature 1..20: note = CRISPR gRNA sequence
  source 1..20: mol_type = other DNA
gctcaggcagttgaggggaa

SEQ ID NO: 38614 - DNA, 20 bp, synthetic construct
  misc_feature 1..20: note = CRISPR gRNA sequence
  source 1..20: mol_type = other DNA
agttgaggggaaaggtgacc

SEQ ID NO: 38615 - DNA, 20 bp, synthetic construct
  misc_feature 1..20: note = CRISPR gRNA sequence
  source 1..20: mol_type = other DNA
ttgaggggaaaggtgaccaa

SEQ ID NO: 38616 - DNA, 20 bp, synthetic construct
  misc_feature 1..20: note = CRISPR gRNA sequence
  source 1..20: mol_type = other DNA
gggaaaggtgaccaagagac

SEQ ID NO: 38617 - DNA, 20 bp, synthetic construct
  misc_feature 1..20: note = CRISPR gRNA sequence
  source 1..20: mol_type = other DNA
ggaaaggtgaccaagagact

SEQ ID NO: 38618 - DNA, 20 bp, synthetic construct
  misc_feature 1..20: note = CRISPR gRNA sequence
  source 1..20: mol_type = other DNA
aaggtgaccaagagactagg

SEQ ID NO: 38619 - DNA, 20 bp, synthetic construct
  misc_feature 1..20: note = CRISPR gRNA sequence
  source 1..20: mol_type = other DNA
ggtgaccaagagactaggaa

SEQ ID NO: 38620 - DNA, 20 bp, synthetic construct
  misc_feature 1..20: note = CRISPR gRNA sequence
  source 1..20: mol_type = other DNA
accaagagactaggaagagc

SEQ ID NO: 38621 - DNA, 20 bp, synthetic construct
  misc_feature 1..20: note = CRISPR gRNA sequence
  source 1..20: mol_type = other DNA
ccaagagactaggaagagct

SEQ ID NO: 38622 - DNA, 20 bp, synthetic construct
  misc_feature 1..20: note = CRISPR gRNA sequence
  source 1..20: mol_type = other DNA
caagagactaggaagagctg

SEQ ID NO: 38623 - DNA, 20 bp, synthetic construct
  misc_feature 1..20: note = CRISPR gRNA sequence
  source 1..20: mol_type = other DNA
gactaggaagagctggggta

SEQ ID NO: 38624 - DNA, 20 bp, synthetic construct
  misc_feature 1..20: note = CRISPR gRNA sequence
  source 1..20: mol_type = other DNA
actaggaagagctggggtat

SEQ ID NO: 38625 - DNA, 20 bp, synthetic construct
  misc_feature 1..20: note = CRISPR gRNA sequence
  source 1..20: mol_type = other DNA
cttcctgctactgctgcact

SEQ ID NO: 38626 - DNA, 20 bp, synthetic construct
  misc_feature 1..20: note = CRISPR gRNA sequence
  source 1..20: mol_type = other DNA
ttcctgctactgctgcactg

SEQ ID NO: 38627 - DNA, 20 bp, synthetic construct
  misc_feature 1..20: note = CRISPR gRNA sequence
  source 1..20: mol_type = other DNA
ctgaggaatgaattactgct

SEQ ID NO: 38628 - DNA, 20 bp, synthetic construct
  misc_feature 1..20: note = CRISPR gRNA sequence
  source 1..20: mol_type = other DNA
tgaggaatgaattactgctt

SEQ ID NO: 38629 - DNA, 20 bp, synthetic construct
  misc_feature 1..20: note = CRISPR gRNA sequence
  source 1..20: mol_type = other DNA
gaatgaattactgcttaggt

SEQ ID NO: 38630 - DNA, 20 bp, synthetic construct
  misc_feature 1..20: note = CRISPR gRNA sequence
  source 1..20: mol_type = other DNA
aattactgcttaggttggca

SEQ ID NO: 38631 - DNA, 20 bp, synthetic construct
  misc_feature 1..20: note = CRISPR gRNA sequence
  source 1..20: mol_type = other DNA
attactgcttaggttggcaa

SEQ ID NO: 38632 - DNA, 20 bp, synthetic construct
  misc_feature 1..20: note = CRISPR gRNA sequence
  source 1..20: mol_type = other DNA
caaaggattttaacttcctc

SEQ ID NO: 38633 - DNA, 20 bp, synthetic construct
  misc_feature 1..20: note = CRISPR gRNA sequence
  source 1..20: mol_type = other DNA
ttaacttcctctagcgtgtc

SEQ ID NO: 38634 - DNA, 20 bp, synthetic construct
  misc_feature 1..20: note = CRISPR gRNA sequence
  source 1..20: mol_type = other DNA
tagcgtgtccagaccacatc

SEQ ID NO: 38635 - DNA, 20 bp, synthetic construct
  misc_feature 1..20: note = CRISPR gRNA sequence
  source 1..20: mol_type = other DNA
cagaccacatctggtccctg

SEQ ID NO: 38636 - DNA, 20 bp, synthetic construct
  misc_feature 1..20: note = CRISPR gRNA sequence
  source 1..20: mol_type = other DNA
accacatctggtccctgtgg

SEQ ID NO: 38637 - DNA, 20 bp, synthetic construct
  misc_feature 1..20: note = CRISPR gRNA sequence
  source 1..20: mol_type = other DNA
ccacatctggtccctgtgga

SEQ ID NO: 38638 - DNA, 20 bp, synthetic construct
  misc_feature 1..20: note = CRISPR gRNA sequence
  source 1..20: mol_type = other DNA
catctggtccctgtggaagg

SEQ ID NO: 38639 - DNA, 20 bp, synthetic construct
  misc_feature 1..20: note = CRISPR gRNA sequence
  source 1..20: mol_type = other DNA
cctgtggaaggaagcatccc

SEQ ID NO: 38640 - DNA, 20 bp, synthetic construct
  misc_feature 1..20: note = CRISPR gRNA sequence
  source 1..20: mol_type = other DNA
gtggaaggaagcatccccag

SEQ ID NO: 38641 - DNA, 20 bp, synthetic construct
  misc_feature 1..20: note = CRISPR gRNA sequence
  source 1..20: mol_type = other DNA
ggaagcatccccagaagact

SEQ ID NO: 38642 - DNA, 20 bp, synthetic construct
  misc_feature 1..20: note = CRISPR gRNA sequence
  source 1..20: mol_type = other DNA
aagcatccccagaagactca

SEQ ID NO: 38643 - DNA, 20 bp, synthetic construct
  misc_feature 1..20: note = CRISPR gRNA sequence
  source 1..20: mol_type = other DNA
agcatccccagaagactcag

SEQ ID NO: 38644 - DNA, 20 bp, synthetic construct
  misc_feature 1..20: note = CRISPR gRNA sequence
  source 1..20: mol_type = other DNA
atccccagaagactcagagg

SEQ ID NO: 38645 - DNA, 20 bp, synthetic construct
  misc_feature 1..20: note = CRISPR gRNA sequence
  source 1..20: mol_type = other DNA
tccccagaagactcagagga

SEQ ID NO: 38646 - DNA, 20 bp, synthetic construct
  misc_feature 1..20: note = CRISPR gRNA sequence
  source 1..20: mol_type = other DNA
ctcagaggaaggcaaaccct

SEQ ID NO: 38647 - DNA, 20 bp, synthetic construct
  misc_feature 1..20: note = CRISPR gRNA sequence
  source 1..20: mol_type = other DNA
tcagaggaaggcaaaccctt

SEQ ID NO: 38648 - DNA, 20 bp, synthetic construct
  misc_feature 1..20: note = CRISPR gRNA sequence
  source 1..20: mol_type = other DNA
cagaggaaggcaaacccttg

SEQ ID NO: 38649 - DNA, 20 bp, synthetic construct
  misc_feature 1..20: note = CRISPR gRNA sequence
  source 1..20: mol_type = other DNA
gaggaaggcaaacccttggg

SEQ ID NO: 38650 - DNA, 20 bp, synthetic construct
  misc_feature 1..20: note = CRISPR gRNA sequence
  source 1..20: mol_type = other DNA
aaacccttggggagaacata

SEQ ID NO: 38651 - DNA, 20 bp, synthetic construct
  misc_feature 1..20: note = CRISPR gRNA sequence
  source 1..20: mol_type = other DNA
ggagaacataaagatactgt

SEQ ID NO: 38652 - DNA, 20 bp, synthetic construct
  misc_feature 1..20: note = CRISPR gRNA sequence
  source 1..20: mol_type = other DNA
acataaagatactgttagac

SEQ ID NO: 38653 - DNA, 20 bp, synthetic construct
  misc_feature 1..20: note = CRISPR gRNA sequence
  source 1..20: mol_type = other DNA
tactgttagactggcattac

SEQ ID NO: 38654 - DNA, 20 bp, synthetic construct
  misc_feature 1..20: note = CRISPR gRNA sequence
  source 1..20: mol_type = other DNA
gttagactggcattactaga

SEQ ID NO: 38655 - DNA, 20 bp, synthetic construct
  misc_feature 1..20: note = CRISPR gRNA sequence
  source 1..20: mol_type = other DNA
ttactagatggtgaaaactc

SEQ ID NO: 38656 - DNA, 20 bp, synthetic construct
  misc_feature 1..20: note = CRISPR gRNA sequence
  source 1..20: mol_type = other DNA
agatggtgaaaactctggaa

SEQ ID NO: 38657 - DNA, 20 bp, synthetic construct
  misc_feature 1..20: note = CRISPR gRNA sequence
  source 1..20: mol_type = other DNA
aaagcccttacaactgaaaa

SEQ ID NO: 38658 - DNA, 20 bp, synthetic construct
  misc_feature 1..20: note = CRISPR gRNA sequence
  source 1..20: mol_type = other DNA
cccttacaactgaaaaaaga

SEQ ID NO: 38659 - DNA, 20 bp, synthetic construct
  misc_feature 1..20: note = CRISPR gRNA sequence
  source 1..20: mol_type = other DNA
ccttacaactgaaaaaagac

SEQ ID NO: 38660 - DNA, 20 bp, synthetic construct
  misc_feature 1..20: note = CRISPR gRNA sequence
  source 1..20: mol_type = other DNA
cttacaactgaaaaaagaca

SEQ ID NO: 38661 - DNA, 20 bp, synthetic construct
  misc_feature 1..20: note = CRISPR gRNA sequence
  source 1..20: mol_type = other DNA
tacaactgaaaaaagacagg

SEQ ID NO: 38662 - DNA, 20 bp, synthetic construct
  misc_feature 1..20: note = CRISPR gRNA sequence
  source 1..20: mol_type = other DNA
acaactgaaaaaagacaggg

SEQ ID NO: 38663 - DNA, 20 bp, synthetic construct
  misc_feature 1..20: note = CRISPR gRNA sequence
  source 1..20: mol_type = other DNA
caactgaaaaaagacaggga

SEQ ID NO: 38664 - DNA, 20 bp, synthetic construct
  misc_feature 1..20: note = CRISPR gRNA sequence
  source 1..20: mol_type = other DNA
aaagacagggagggcaatta

SEQ ID NO: 38665 - DNA, 20 bp, synthetic construct
  misc_feature 1..20: note = CRISPR gRNA sequence
  source 1..20: mol_type = other DNA
caattatggtacctacatct

SEQ ID NO: 38666 - DNA, 20 bp, synthetic construct
  misc_feature 1..20: note = CRISPR gRNA sequence
  source 1..20: mol_type = other DNA
aattatggtacctacatctt

SEQ ID NO: 38667 - DNA, 20 bp, synthetic construct
  misc_feature 1..20: note = CRISPR gRNA sequence
  source 1..20: mol_type = other DNA
attatggtacctacatctta

SEQ ID NO: 38668 - DNA, 20 bp, synthetic construct
  misc_feature 1..20: note = CRISPR gRNA sequence
  source 1..20: mol_type = other DNA
ctacatcttagggttgttct

SEQ ID NO: 38669 - DNA, 20 bp, synthetic construct
  misc_feature 1..20: note = CRISPR gRNA sequence
  source 1..20: mol_type = other DNA
ggttgttctgagaattaaat

SEQ ID NO: 38670 - DNA, 20 bp, synthetic construct
  misc_feature 1..20: note = CRISPR gRNA sequence
  source 1..20: mol_type = other DNA
ttaaatgagttactacactt

SEQ ID NO: 38671 - DNA, 20 bp, synthetic construct
  misc_feature 1..20: note = CRISPR gRNA sequence
  source 1..20: mol_type = other DNA
taaatgagttactacactta

SEQ ID NO: 38672 - DNA, 20 bp, synthetic construct
  misc_feature 1..20: note = CRISPR gRNA sequence
  source 1..20: mol_type = other DNA
aatgagttactacacttaag

SEQ ID NO: 38673 - DNA, 20 bp, synthetic construct
  misc_feature 1..20: note = CRISPR gRNA sequence
  source 1..20: mol_type = other DNA
gttactacacttaaggagtt

SEQ ID NO: 38674 - DNA, 20 bp, synthetic construct
  misc_feature 1..20: note = CRISPR gRNA sequence
  source 1..20: mol_type = other DNA
tactacacttaaggagttta

SEQ ID NO: 38675 - DNA, 20 bp, synthetic construct
  misc_feature 1..20: note = CRISPR gRNA sequence
  source 1..20: mol_type = other DNA
taaggagtttagagcactgt

SEQ ID NO: 38676 - DNA, 20 bp, synthetic construct
  misc_feature 1..20: note = CRISPR gRNA sequence
  source 1..20: mol_type = other DNA
tttagagcactgttggcatg

SEQ ID NO: 38677 - DNA, 20 bp, synthetic construct
  misc_feature 1..20: note = CRISPR gRNA sequence
  source 1..20: mol_type = other DNA
agagcactgttggcatgcag

SEQ ID NO: 38678 - DNA, 20 bp, synthetic construct
  misc_feature 1..20: note = CRISPR gRNA sequence
  source 1..20: mol_type = other DNA
gagcactgttggcatgcagt

SEQ ID NO: 38679 - DNA, 20 bp, synthetic construct
  misc_feature 1..20: note = CRISPR gRNA sequence
  source 1..20: mol_type = other DNA
cactgttggcatgcagtggg

SEQ ID NO: 38680 - DNA, 20 bp, synthetic construct
  misc_feature 1..20: note = CRISPR gRNA sequence
  source 1..20: mol_type = other DNA
tgcagtgggcagtcaaatgc

SEQ ID NO: 38681 - DNA, 20 bp, synthetic construct
  misc_feature 1..20: note = CRISPR gRNA sequence
  source 1..20: mol_type = other DNA
cagtcaaatgctggctattc

SEQ ID NO: 38682 - DNA, 20 bp, synthetic construct
  misc_feature 1..20: note = CRISPR gRNA sequence
  source 1..20: mol_type = other DNA
ctggctattccagctgtgca

SEQ ID NO: 38683 - DNA, 20 bp, synthetic construct
  misc_feature 1..20: note = CRISPR gRNA sequence
  source 1..20: mol_type = other DNA
ttccagctgtgcatggattc

SEQ ID NO: 38684 - DNA, 20 bp, synthetic construct
  misc_feature 1..20: note = CRISPR gRNA sequence
  source 1..20: mol_type = other DNA
gctgtgcatggattccagct

SEQ ID NO: 38685 - DNA, 20 bp, synthetic construct
  misc_feature 1..20: note = CRISPR gRNA sequence
  source 1..20: mol_type = other DNA
tgcatggattccagcttggc

SEQ ID NO: 38686 - DNA, 20 bp, synthetic construct
  misc_feature 1..20: note = CRISPR gRNA sequence
  source 1..20: mol_type = other DNA
gattccagcttggccagtct

SEQ ID NO: 38687 - DNA, 20 bp, synthetic construct
  misc_feature 1..20: note = CRISPR gRNA sequence
  source 1..20: mol_type = other DNA
ccagcttggccagtcttgga

SEQ ID NO: 38688 - DNA, 20 bp, synthetic construct
  misc_feature 1..20: note = CRISPR gRNA sequence
  source 1..20: mol_type = other DNA
cagcttggccagtcttggat

SEQ ID NO: 38689 - DNA, 20 bp, synthetic construct
  misc_feature 1..20: note = CRISPR gRNA sequence
  source 1..20: mol_type = other DNA
tggccagtcttggatgggct

SEQ ID NO: 38690 - DNA, 20 bp, synthetic construct
  misc_feature 1..20: note = CRISPR gRNA sequence
  source 1..20: mol_type = other DNA
agtcttggatgggctgagaa

SEQ ID NO: 38691 - DNA, 20 bp, synthetic construct
  misc_feature 1..20: note = CRISPR gRNA sequence
  source 1..20: mol_type = other DNA
gtcttggatgggctgagaaa

SEQ ID NO: 38692 - DNA, 20 bp, synthetic construct
  misc_feature 1..20: note = CRISPR gRNA sequence
  source 1..20: mol_type = other DNA
tcttggatgggctgagaaaa

SEQ ID NO: 38693 - DNA, 20 bp, synthetic construct
  misc_feature 1..20: note = CRISPR gRNA sequence
  source 1..20: mol_type = other DNA
ttggatgggctgagaaaagg

SEQ ID NO: 38694 - DNA, 20 bp, synthetic construct
  misc_feature 1..20: note = CRISPR gRNA sequence
  source 1..20: mol_type = other DNA
agggagctgcttttccctaa

SEQ ID NO: 38695 - DNA, 20 bp, synthetic construct
  misc_feature 1..20: note = CRISPR gRNA sequence
  source 1..20: mol_type = other DNA
tctaccacactttgctctcc

SEQ ID NO: 38696 - DNA, 20 bp, synthetic construct
  misc_feature 1..20: note = CRISPR gRNA sequence
  source 1..20: mol_type = other DNA
cacactttgctctcctggct

SEQ ID NO: 38697 - DNA, 20 bp, synthetic construct
  misc_feature 1..20: note = CRISPR gRNA sequence
  source 1..20: mol_type = other DNA
ttgctctcctggctaagact

SEQ ID NO: 38698 - DNA, 20 bp, synthetic construct
  misc_feature 1..20: note = CRISPR gRNA sequence
  source 1..20: mol_type = other DNA
gctctcctggctaagactca

SEQ ID NO: 38699 - DNA, 20 bp, synthetic construct
  misc_feature 1..20: note = CRISPR gRNA sequence
  source 1..20: mol_type = other DNA
tcctggctaagactcagaga

SEQ ID NO: 38700 - DNA, 20 bp, synthetic construct
  misc_feature 1..20: note = CRISPR gRNA sequence
  source 1..20: mol_type = other DNA
acagatgtatgtatgcccct

SEQ ID NO: 38701 - DNA, 20 bp, synthetic construct
  misc_feature 1..20: note = CRISPR gRNA sequence
  source 1..20: mol_type = other DNA
agcaatctctttcccttctc

SEQ ID NO: 38702 - DNA, 20 bp, synthetic construct
  misc_feature 1..20: note = CRISPR gRNA sequence
  source 1..20: mol_type = other DNA
tccttgcttgtataatgacc

SEQ ID NO: 38703 - DNA, 20 bp, synthetic construct
  misc_feature 1..20: note = CRISPR gRNA sequence
  source 1..20: mol_type = other DNA
ttgcttgtataatgacctgg

SEQ ID NO: 38704 - DNA, 20 bp, synthetic construct
  misc_feature 1..20: note = CRISPR gRNA sequence
  source 1..20: mol_type = other DNA
tgtataatgacctggtagtg

SEQ ID NO: 38705 - DNA, 20 bp, synthetic construct
  misc_feature 1..20: note = CRISPR gRNA sequence
  source 1..20: mol_type = other DNA
gtataatgacctggtagtgt

SEQ ID NO: 38706 - DNA, 20 bp, synthetic construct
  misc_feature 1..20: note = CRISPR gRNA sequence
  source 1..20: mol_type = other DNA
tagtgtaggaccaatgttgc

SEQ ID NO: 38707 - DNA, 20 bp, synthetic construct
  misc_feature 1..20: note = CRISPR gRNA sequence
  source 1..20: mol_type = other DNA
agtgtaggaccaatgttgct

SEQ ID NO: 38708 - DNA, 20 bp, synthetic construct
  misc_feature 1..20: note = CRISPR gRNA sequence
  source 1..20: mol_type = other DNA
aggaccaatgttgctgggtg

SEQ ID NO: 38709 - DNA, 20 bp, synthetic construct
  misc_feature 1..20: note = CRISPR gRNA sequence
  source 1..20: mol_type = other DNA
accaatgttgctgggtgcgg

SEQ ID NO: 38710 - DNA, 20 bp, synthetic construct
  misc_feature 1..20: note = CRISPR gRNA sequence
  source 1..20: mol_type = other DNA
gtggctcatgcctgtaatcc

SEQ ID NO: 38711 - DNA, 20 bp, synthetic construct
  misc_feature 1..20: note = CRISPR gRNA sequence
  source 1..20: mol_type = other DNA
tgcctgtaatcctagcactt

SEQ ID NO: 38712 - DNA, 20 bp, synthetic construct
  misc_feature 1..20: note = CRISPR gRNA sequence
  source 1..20: mol_type = other DNA
tcctagcactttggaacgcc

SEQ ID NO: 38713 - DNA, 20 bp, synthetic construct
  misc_feature 1..20: note = CRISPR gRNA sequence
  source 1..20: mol_type = other DNA
cactttggaacgccaagcac

SEQ ID NO: 38714 - DNA, 20 bp, synthetic construct
  misc_feature 1..20: note = CRISPR gRNA sequence
  source 1..20: mol_type = other DNA
gcacgagaatctcttgattc

SEQ ID NO: 38715 - DNA, 20 bp, synthetic construct
  misc_feature 1..20: note = CRISPR gRNA sequence
  source 1..20: mol_type = other DNA
cacgagaatctcttgattcc

SEQ ID NO: 38716 - DNA, 20 bp, synthetic construct
  misc_feature 1..20: note = CRISPR gRNA sequence
  source 1..20: mol_type = other DNA
tctcttgattccaggtgttc

SEQ ID NO: 38717 - DNA, 20 bp, synthetic construct
  misc_feature 1..20: note = CRISPR gRNA sequence
  source 1..20: mol_type = other DNA
tgattccaggtgttcaagac

SEQ ID NO: 38718 - DNA, 20 bp, synthetic construct
  misc_feature 1..20: note = CRISPR gRNA sequence
  source 1..20: mol_type = other DNA
ccaggtgttcaagaccagcc

SEQ ID NO: 38719 - DNA, 20 bp, synthetic construct
  misc_feature 1..20: note = CRISPR gRNA sequence
  source 1..20: mol_type = other DNA
caggtgttcaagaccagcct

SEQ ID NO: 38720 - DNA, 20 bp, synthetic construct
  misc_feature 1..20: note = CRISPR gRNA sequence
  source 1..20: mol_type = other DNA
caagaccagcctgggcaaca

SEQ ID NO: 38721 - DNA, 20 bp, synthetic construct
  misc_feature 1..20: note = CRISPR gRNA sequence
  source 1..20: mol_type = other DNA
accagcctgggcaacatagc

SEQ ID NO: 38722 - DNA, 20 bp, synthetic construct
  misc_feature 1..20: note = CRISPR gRNA sequence
  source 1..20: mol_type = other DNA
gaccccatctctaaaaaaaa

SEQ ID NO: 38723 - DNA, 20 bp, synthetic construct
  misc_feature 1..20: note = CRISPR gRNA sequence
  source 1..20: mol_type = other DNA
accccatctctaaaaaaaaa

SEQ ID NO: 38724 - DNA, 20 bp, synthetic construct
  misc_feature 1..20: note = CRISPR gRNA sequence
  source 1..20: mol_type = other DNA
ccatctctaaaaaaaaaagg

SEQ ID NO: 38725 - DNA, 20 bp, synthetic construct
  misc_feature 1..20: note = CRISPR gRNA sequence
  source 1..20: mol_type = other DNA
catctctaaaaaaaaaaggc

SEQ ID NO: 38726 - DNA, 20 bp, synthetic construct
  misc_feature 1..20: note = CRISPR gRNA sequence
  source 1..20: mol_type = other DNA
ctaaaaaaaaaaggcaggcg

SEQ ID NO: 38727 - DNA, 20 bp, synthetic construct
  misc_feature 1..20: note = CRISPR gRNA sequence
  source 1..20: mol_type = other DNA
aaaaaaaaaggcaggcgtgg

SEQ ID NO: 38728 - DNA, 20 bp, synthetic construct
  misc_feature 1..20: note = CRISPR gRNA sequence
  source 1..20: mol_type = other DNA
ggcgtggtggtgcacacctg

SEQ ID NO: 38729 - DNA, 20 bp, synthetic construct
  misc_feature 1..20: note = CRISPR gRNA sequence
  source 1..20: mol_type = other DNA
gtggtgcacacctgtagtcc

SEQ ID NO: 38730 - DNA, 20 bp, synthetic construct
  misc_feature 1..20: note = CRISPR gRNA sequence
  source 1..20: mol_type = other DNA
acctgtagtcccagctactc

SEQ ID NO: 38731 - DNA, 20 bp, synthetic construct
  misc_feature 1..20: note = CRISPR gRNA sequence
  source 1..20: mol_type = other DNA
gctactcaagatgctgacgt

SEQ ID NO: 38732 - DNA, 20 bp, synthetic construct
  misc_feature 1..20: note = CRISPR gRNA sequence
  source 1..20: mol_type = other DNA
ctactcaagatgctgacgtt

SEQ ID NO: 38733 - DNA, 20 bp, synthetic construct
  misc_feature 1..20: note = CRISPR gRNA sequence
  source 1..20: mol_type = other DNA
actcaagatgctgacgttgg

SEQ ID NO: 38734 - DNA, 20 bp, synthetic construct
  misc_feature 1..20: note = CRISPR gRNA sequence
  source 1..20: mol_type = other DNA
ctcaagatgctgacgttggg

SEQ ID NO: 38735 - DNA, 20 bp, synthetic construct
  misc_feature 1..20: note = CRISPR gRNA sequence
  source 1..20: mol_type = other DNA
tgacgttgggaggatcgctt

SEQ ID NO: 38736 - DNA, 20 bp, synthetic construct
  misc_feature 1..20: note = CRISPR gRNA sequence
  source 1..20: mol_type = other DNA
ttgggaggatcgcttgagcc

SEQ ID NO: 38737 - DNA, 20 bp, synthetic construct
  misc_feature 1..20: note = CRISPR gRNA sequence
  source 1..20: mol_type = other DNA
tgggaggatcgcttgagcct

SEQ ID NO: 38738 - DNA, 20 bp, synthetic construct
  misc_feature 1..20: note = CRISPR gRNA sequence
  source 1..20: mol_type = other DNA
ggaggatcgcttgagcctgg

SEQ ID NO: 38739 - DNA, 20 bp, synthetic construct
  misc_feature 1..20: note = CRISPR gRNA sequence
  source 1..20: mol_type = other DNA
tcgcttgagcctgggagctt

SEQ ID NO: 38740 - DNA, 20 bp, synthetic construct
  misc_feature 1..20: note = CRISPR gRNA sequence
  source 1..20: mol_type = other DNA
atgatcacaccactgtactc

SEQ ID NO: 38741 - DNA, 20 bp, synthetic construct
  misc_feature 1..20: note = CRISPR gRNA sequence
  source 1..20: mol_type = other DNA
cacaccactgtactccagcc

SEQ ID NO: 38742 - DNA, 20 bp, synthetic construct
  misc_feature 1..20: note = CRISPR gRNA sequence
  source 1..20: mol_type = other DNA
acaccactgtactccagcct

SEQ ID NO: 38743 - DNA, 20 bp, synthetic construct
  misc_feature 1..20: note = CRISPR gRNA sequence
  source 1..20: mol_type = other DNA
ctgtactccagcctgggtga

SEQ ID NO: 38744 - DNA, 20 bp, synthetic construct
  misc_feature 1..20: note = CRISPR gRNA sequence
  source 1..20: mol_type = other DNA
gtactccagcctgggtgaca

SEQ ID NO: 38745 - DNA, 20 bp, synthetic construct
  misc_feature 1..20: note = CRISPR gRNA sequence
  source 1..20: mol_type = other DNA
actccagcctgggtgacaga

SEQ ID NO: 38746 - DNA, 20 bp, synthetic construct
  misc_feature 1..20: note = CRISPR gRNA sequence
  source 1..20: mol_type = other DNA
ctccagcctgggtgacagag

SEQ ID NO: 38747 - DNA, 20 bp, synthetic construct
  misc_feature 1..20: note = CRISPR gRNA sequence
  source 1..20: mol_type = other DNA
tccagcctgggtgacagaga

SEQ ID NO: 38748 - DNA, 20 bp, synthetic construct
  misc_feature 1..20: note = CRISPR gRNA sequence
  source 1..20: mol_type = other DNA
tgtctcaaaaaatgacccac

SEQ ID NO: 38749 - DNA, 20 bp, synthetic construct
  misc_feature 1..20: note = CRISPR gRNA sequence
  source 1..20: mol_type = other DNA
gtctcaaaaaatgacccact

SEQ ID NO: 38750 - DNA, 20 bp, synthetic construct
  misc_feature 1..20: note = CRISPR gRNA sequence
  source 1..20: mol_type = other DNA
aaaaaatgacccactaggac

SEQ ID NO: 38751 - DNA, 20 bp, synthetic construct
  misc_feature 1..20: note = CRISPR gRNA sequence
  source 1..20: mol_type = other DNA
cttttccctctaactgctta

SEQ ID NO: 38752 - DNA, 20 bp, synthetic construct
  misc_feature 1..20: note = CRISPR gRNA sequence
  source 1..20: mol_type = other DNA
ctgcttaaagctgtgatgct

SEQ ID NO: 38753 - DNA, 20 bp, synthetic construct
  misc_feature 1..20: note = CRISPR gRNA sequence
  source 1..20: mol_type = other DNA
cttaaagctgtgatgctcag

SEQ ID NO: 38754 - DNA, 20 bp, synthetic construct
  misc_feature 1..20: note = CRISPR gRNA sequence
  source 1..20: mol_type = other DNA
ttaaagctgtgatgctcagt

SEQ ID NO: 38755 - DNA, 20 bp, synthetic construct
  misc_feature 1..20: note = CRISPR gRNA sequence
  source 1..20: mol_type = other DNA
agctgtgatgctcagtagga

SEQ ID NO: 38756 - DNA, 20 bp, synthetic construct
  misc_feature 1..20: note = CRISPR gRNA sequence
  source 1..20: mol_type = other DNA
atgctcagtaggatagccac

SEQ ID NO: 38757 - DNA, 20 bp, synthetic construct
  misc_feature 1..20: note = CRISPR gRNA sequence
  source 1..20: mol_type = other DNA
ggatagccactagccccata

SEQ ID NO: 38758 - DNA, 20 bp, synthetic construct
  misc_feature 1..20: note = CRISPR gRNA sequence
  source 1..20: mol_type = other DNA
aatttaaataaattaaaatt

SEQ ID NO: 38759 - DNA, 20 bp, synthetic construct
  misc_feature 1..20: note = CRISPR gRNA sequence
  source 1..20: mol_type = other DNA
attaagtaaaatgaaatttt

SEQ ID NO: 38760 - DNA, 20 bp, synthetic construct
  misc_feature 1..20: note = CRISPR gRNA sequence
  source 1..20: mol_type = other DNA
aaatgaaattttcagttcat

SEQ ID NO: 38761 - DNA, 20 bp, synthetic construct
  misc_feature 1..20: note = CRISPR gRNA sequence
  source 1..20: mol_type = other DNA
tttcagttcattagtcacat

SEQ ID NO: 38762 - DNA, 20 bp, synthetic construct
  misc_feature 1..20: note = CRISPR gRNA sequence
  source 1..20: mol_type = other DNA
ttagctatatttcaactgct

SEQ ID NO: 38763 - DNA, 20 bp, synthetic construct
  misc_feature 1..20: note = CRISPR gRNA sequence
  source 1..20: mol_type = other DNA
gctatatttcaactgctcag

SEQ ID NO: 38764 - DNA, 20 bp, synthetic construct
  misc_feature 1..20: note = CRISPR gRNA sequence
  source 1..20: mol_type = other DNA
tttcaactgctcagtggcca

SEQ ID NO: 38765 - DNA, 20 bp, synthetic construct
  misc_feature 1..20: note = CRISPR gRNA sequence
  source 1..20: mol_type = other DNA
ttcaactgctcagtggccat

SEQ ID NO: 38766 - DNA, 20 bp, synthetic construct
  misc_feature 1..20: note = CRISPR gRNA sequence
  source 1..20: mol_type = other DNA
aactgctcagtggccatagg

SEQ ID NO: 38767 - DNA, 20 bp, synthetic construct
  misc_feature 1..20: note = CRISPR gRNA sequence
  source 1..20: mol_type = other DNA
gctcagtggccataggtggc

SEQ ID NO: 38768 - DNA, 20 bp, synthetic construct
  misc_feature 1..20: note = CRISPR gRNA sequence
  source 1..20: mol_type = other DNA
cagtggccataggtggctag

SEQ ID NO: 38769 - DNA, 20 bp, synthetic construct
  misc_feature 1..20: note = CRISPR gRNA sequence
  source 1..20: mol_type = other DNA
taggtggctagtggctccca

SEQ ID NO: 38770 - DNA, 20 bp, synthetic construct
  misc_feature 1..20: note = CRISPR gRNA sequence
  source 1..20: mol_type = other DNA
tggctagtggctcccatagc

SEQ ID NO: 38771 - DNA, 20 bp, synthetic construct
  misc_feature 1..20: note = CRISPR gRNA sequence
  source 1..20: mol_type = other DNA
ctagtggctcccatagcaag

SEQ ID NO: 38772 - DNA, 20 bp, synthetic construct
  misc_feature 1..20: note = CRISPR gRNA sequence
  source 1..20: mol_type = other DNA
ggctcccatagcaagtggta

SEQ ID NO: 38773 - DNA, 20 bp, synthetic construct
  misc_feature 1..20: note = CRISPR gRNA sequence
  source 1..20: mol_type = other DNA
atagcaagtggtacagatgc

SEQ ID NO: 38774 - DNA, 20 bp, synthetic construct
  misc_feature 1..20: note = CRISPR gRNA sequence
  source 1..20: mol_type = other DNA
tagcaagtggtacagatgcc

SEQ ID NO: 38775 - DNA, 20 bp, synthetic construct
  misc_feature 1..20: note = CRISPR gRNA sequence
  source 1..20: mol_type = other DNA
ccaggacatttccatcattg

SEQ ID NO: 38776 - DNA, 20 bp, synthetic construct
  misc_feature 1..20: note = CRISPR gRNA sequence
  source 1..20: mol_type = other DNA
gacatttccatcattgcaga

SEQ ID NO: 38777 - DNA, 20 bp, synthetic construct
  misc_feature 1..20: note = CRISPR gRNA sequence
  source 1..20: mol_type = other DNA
ttgcagaaagttctattaaa

SEQ ID NO: 38778 - DNA, 20 bp, synthetic construct
  misc_feature 1..20: note = CRISPR gRNA sequence
  source 1..20: mol_type = other DNA
tgcagaaagttctattaaac

SEQ ID NO: 38779 - DNA, 20 bp, synthetic construct
  misc_feature 1..20: note = CRISPR gRNA sequence
  source 1..20: mol_type = other DNA
gaaagttctattaaacaggc

SEQ ID NO: 38780 - DNA, 20 bp, synthetic construct
  misc_feature 1..20: note = CRISPR gRNA sequence
  source 1..20: mol_type = other DNA
ttctattaaacaggctggca

SEQ ID NO: 38781 - DNA, 20 bp, synthetic construct
  misc_feature 1..20: note = CRISPR gRNA sequence
  source 1..20: mol_type = other DNA
tattaaacaggctggcatgg

SEQ ID NO: 38782 - DNA, 20 bp, synthetic construct
  misc_feature 1..20: note = CRISPR gRNA sequence
  source 1..20: mol_type = other DNA
gtggctcatgtctgtaaccc

SEQ ID NO: 38783 - DNA, 20 bp, synthetic construct
  misc_feature 1..20: note = CRISPR gRNA sequence
  source 1..20: mol_type = other DNA
gtctgtaaccccagcacttt

SEQ ID NO: 38784 - DNA, 20 bp, synthetic construct
  misc_feature 1..20: note = CRISPR gRNA sequence
  source 1..20: mol_type = other DNA
ctgtaaccccagcactttga

SEQ ID NO: 38785 - DNA, 20 bp, synthetic construct
  misc_feature 1..20: note = CRISPR gRNA sequence
  source 1..20: mol_type = other DNA
tgtaaccccagcactttgag

SEQ ID NO: 38786 - DNA, 20 bp, synthetic construct
  misc_feature 1..20: note = CRISPR gRNA sequence
  source 1..20: mol_type = other DNA
ccccagcactttgagaggct

SEQ ID NO: 38787 - DNA, 20 bp, synthetic construct
  misc_feature 1..20: note = CRISPR gRNA sequence
  source 1..20: mol_type = other DNA
cccagcactttgagaggctg

SEQ ID NO: 38788 - DNA, 20 bp, synthetic construct
  misc_feature 1..20: note = CRISPR gRNA sequence
  source 1..20: mol_type = other DNA
ccagcactttgagaggctga

SEQ ID NO: 38789 - DNA, 20 bp, synthetic construct
  misc_feature 1..20: note = CRISPR gRNA sequence
  source 1..20: mol_type = other DNA
cagcactttgagaggctgag

SEQ ID NO: 38790 - DNA, 20 bp, synthetic construct
  misc_feature 1..20: note = CRISPR gRNA sequence
  source 1..20: mol_type = other DNA
agcactttgagaggctgagg

SEQ ID NO: 38791 - DNA, 20 bp, synthetic construct
  misc_feature 1..20: note = CRISPR gRNA sequence
  source 1..20: mol_type = other DNA
actttgagaggctgaggggg

SEQ ID NO: 38792 - DNA, 20 bp, synthetic construct
  misc_feature 1..20: note = CRISPR gRNA sequence
  source 1..20: mol_type = other DNA
ctttgagaggctgagggggc

SEQ ID NO: 38793 - DNA, 20 bp, synthetic construct
  misc_feature 1..20: note = CRISPR gRNA sequence
  source 1..20: mol_type = other DNA
tgagggggcaggatcgcttg

SEQ ID NO: 38794 - DNA, 20 bp, synthetic construct
  misc_feature 1..20: note = CRISPR gRNA sequence
  source 1..20: mol_type = other DNA
ggggcaggatcgcttgaagc

SEQ ID NO: 38795 - DNA, 20 bp, synthetic construct
  misc_feature 1..20: note = CRISPR gRNA sequence
  source 1..20: mol_type = other DNA
gggcaggatcgcttgaagct

SEQ ID NO: 38796 - DNA, 20 bp, synthetic construct
  misc_feature 1..20: note = CRISPR gRNA sequence
  source 1..20: mol_type = other DNA
gcaggatcgcttgaagctag

SEQ ID NO: 38797 - DNA, 20 bp, synthetic construct
  misc_feature 1..20: note = CRISPR gRNA sequence
  source 1..20: mol_type = other DNA
tcgcttgaagctaggagttc

SEQ ID NO: 38798 - DNA, 20 bp, synthetic construct
  misc_feature 1..20: note = CRISPR gRNA sequence
  source 1..20: mol_type = other DNA
tgaagctaggagttcaagac

SEQ ID NO: 38799 - DNA, 20 bp, synthetic construct
  misc_feature 1..20: note = CRISPR gRNA sequence
  source 1..20: mol_type = other DNA
ctaggagttcaagaccagcc

SEQ ID NO: 38800 - DNA, 20 bp, synthetic construct
  misc_feature 1..20: note = CRISPR gRNA sequence
  source 1..20: mol_type = other DNA
taggagttcaagaccagcct

SEQ ID NO: 38801 - DNA, 20 bp, synthetic construct
  misc_feature 1..20: note = CRISPR gRNA sequence
  source 1..20: mol_type = other DNA
caagaccagcctgggcaaca

SEQ ID NO: 38802 - DNA, 20 bp, synthetic construct
  misc_feature 1..20: note = CRISPR gRNA sequence
  source 1..20: mol_type = other DNA
accagcctgggcaacaaagt

SEQ ID NO: 38803 - DNA, 20 bp, synthetic construct
  misc_feature 1..20: note = CRISPR gRNA sequence
  source 1..20: mol_type = other DNA
ctacaaaaaaaaaaaaaaaa

SEQ ID NO: 38804 - DNA, 20 bp, synthetic construct
  misc_feature 1..20: note = CRISPR gRNA sequence
  source 1..20: mol_type = other DNA
aaaaaaaaaaaaaaaatagc

SEQ ID NO: 38805 - DNA, 20 bp, synthetic construct
  misc_feature 1..20: note = CRISPR gRNA sequence
  source 1..20: mol_type = other DNA
aaaaaaaaaaaaaaatagct

SEQ ID NO: 38806 - DNA, 20 bp, synthetic construct
  misc_feature 1..20: note = CRISPR gRNA sequence
  source 1..20: mol_type = other DNA
aaaaaaaaaatagctgggca

SEQ ID NO: 38807 - DNA, 20 bp, synthetic construct
  misc_feature 1..20: note = CRISPR gRNA sequence
  source 1..20: mol_type = other DNA
ggcatggtgattcactccta

SEQ ID NO: 38808 - DNA, 20 bp, synthetic construct
  misc_feature 1..20: note = CRISPR gRNA sequence
  source 1..20: mol_type = other DNA
gtgattcactcctatagtac

SEQ ID NO: 38809 - DNA, 20 bp, synthetic construct
  misc_feature 1..20: note = CRISPR gRNA sequence
  source 1..20: mol_type = other DNA
ctcctatagtaccagttact

SEQ ID NO: 38810 - DNA, 20 bp, synthetic construct
  misc_feature 1..20: note = CRISPR gRNA sequence
  source 1..20: mol_type = other DNA
tcctatagtaccagttactc

SEQ ID NO: 38811 - DNA, 20 bp, synthetic construct
  misc_feature 1..20: note = CRISPR gRNA sequence
  source 1..20: mol_type = other DNA
tatagtaccagttactcagg

SEQ ID NO: 38812 - DNA, 20 bp, synthetic construct
  misc_feature 1..20: note = CRISPR gRNA sequence
  source 1..20: mol_type = other DNA
taccagttactcaggaagcc

SEQ ID NO: 38813 - DNA, 20 bp, synthetic construct
  misc_feature 1..20: note = CRISPR gRNA sequence
  source 1..20: mol_type = other DNA
accagttactcaggaagcca

SEQ ID NO: 38814 - DNA, 20 bp, synthetic construct
  misc_feature 1..20: note = CRISPR gRNA sequence
  source 1..20: mol_type = other DNA
agttactcaggaagccaagg

SEQ ID NO: 38815 - DNA, 20 bp, synthetic construct
  misc_feature 1..20: note = CRISPR gRNA sequence
  source 1..20: mol_type = other DNA
gttactcaggaagccaaggt

SEQ ID NO: 38816 - DNA, 20 bp, synthetic construct
  misc_feature 1..20: note = CRISPR gRNA sequence
  source 1..20: mol_type = other DNA
tactcaggaagccaaggtgg

SEQ ID NO: 38817 - DNA, 20 bp, synthetic construct
  misc_feature 1..20: note = CRISPR gRNA sequence
  source 1..20: mol_type = other DNA
actcaggaagccaaggtggg

SEQ ID NO: 38818 - DNA, 20 bp, synthetic construct
  misc_feature 1..20: note = CRISPR gRNA sequence
  source 1..20: mol_type = other DNA
ccaaggtgggaggatcactt

SEQ ID NO: 38819 - DNA, 20 bp, synthetic construct
  misc_feature 1..20: note = CRISPR gRNA sequence
  source 1..20: mol_type = other DNA
gtgggaggatcacttgagcc

SEQ ID NO: 38820 - DNA, 20 bp, synthetic construct
  misc_feature 1..20: note = CRISPR gRNA sequence
  source 1..20: mol_type = other DNA
tgggaggatcacttgagccc

SEQ ID NO: 38821 - DNA, 20 bp, synthetic construct
  misc_feature 1..20: note = CRISPR gRNA sequence
  source 1..20: mol_type = other DNA
ggaggatcacttgagcccag

SEQ ID NO: 38822 - DNA, 20 bp, synthetic construct
  misc_feature 1..20: note = CRISPR gRNA sequence
  source 1..20: mol_type = other DNA
tcacttgagcccaggagttt

SEQ ID NO: 38823 - DNA, 20 bp, synthetic construct
  misc_feature 1..20: note = CRISPR gRNA sequence
  source 1..20: mol_type = other DNA
cacttgagcccaggagtttg

SEQ ID NO: 38824 - DNA, 20 bp, synthetic construct
  misc_feature 1..20: note = CRISPR gRNA sequence
  source 1..20: mol_type = other DNA
agcccaggagtttgaggctg

SEQ ID NO: 38825 - DNA, 20 bp, synthetic construct
  misc_feature 1..20: note = CRISPR gRNA sequence
  source 1..20: mol_type = other DNA
agtttgaggctgcagtgaac

SEQ ID NO: 38826 - DNA, 20 bp, synthetic construct
  misc_feature 1..20: note = CRISPR gRNA sequence
  source 1..20: mol_type = other DNA
gtttgaggctgcagtgaact

SEQ ID NO: 38827 - DNA, 20 bp, synthetic construct
  misc_feature 1..20: note = CRISPR gRNA sequence
  source 1..20: mol_type = other DNA
gaggctgcagtgaactggga

SEQ ID NO: 38828 - DNA, 20 bp, synthetic construct
  misc_feature 1..20: note = CRISPR gRNA sequence
  source 1..20: mol_type = other DNA
ggctgcagtgaactgggata

SEQ ID NO: 38829 - DNA, 20 bp, synthetic construct
  misc_feature 1..20: note = CRISPR gRNA sequence
  source 1..20: mol_type = other DNA
gggatagagccactgcactc

SEQ ID NO: 38830 - DNA, 20 bp, synthetic construct
  misc_feature 1..20: note = CRISPR gRNA sequence
  source 1..20: mol_type = other DNA
agagccactgcactccagct

SEQ ID NO: 38831 - DNA, 20 bp, synthetic construct
  misc_feature 1..20: note = CRISPR gRNA sequence
  source 1..20: mol_type = other DNA
gagccactgcactccagctt

SEQ ID NO: 38832 - DNA, 20 bp, synthetic construct
  misc_feature 1..20: note = CRISPR gRNA sequence
  source 1..20: mol_type = other DNA
agccactgcactccagcttg

SEQ ID NO: 38833 - DNA, 20 bp, synthetic construct
  misc_feature 1..20: note = CRISPR gRNA sequence
  source 1..20: mol_type = other DNA
tgcactccagcttggggact

SEQ ID NO: 38834 - DNA, 20 bp, synthetic construct
  misc_feature 1..20: note = CRISPR gRNA sequence
  source 1..20: mol_type = other DNA
actccagcttggggactgag

SEQ ID NO: 38835 - DNA, 20 bp, synthetic construct
  misc_feature 1..20: note = CRISPR gRNA sequence
  source 1..20: mol_type = other DNA
ctccagcttggggactgagt

SEQ ID NO: 38836 - DNA, 20 bp, synthetic construct
  misc_feature 1..20: note = CRISPR gRNA sequence
  source 1..20: mol_type = other DNA
tgtctctaaaaaaaaaaaaa

SEQ ID NO: 38837 - DNA, 20 bp, synthetic construct
  misc_feature 1..20: note = CRISPR gRNA sequence
  source 1..20: mol_type = other DNA
tctaaaaaaaaaaaaatggt

SEQ ID NO: 38838 - DNA, 20 bp, synthetic construct
  misc_feature 1..20: note = CRISPR gRNA sequence
  source 1..20: mol_type = other DNA
atggttagcaccaatccaaa

SEQ ID NO: 38839 - DNA, 20 bp, synthetic construct
  misc_feature 1..20: note = CRISPR gRNA sequence
  source 1..20: mol_type = other DNA
tccaaaaagtctgtgaaacc

SEQ ID NO: 38840 - DNA, 20 bp, synthetic construct
  misc_feature 1..20: note = CRISPR gRNA sequence
  source 1..20: mol_type = other DNA
aaacctggctcatgatgtcc

SEQ ID NO: 38841 - DNA, 20 bp, synthetic construct
  misc_feature 1..20: note = CRISPR gRNA sequence
  source 1..20: mol_type = other DNA
tgcatcccctaacgctccct

SEQ ID NO: 38842 - DNA, 20 bp, synthetic construct
  misc_feature 1..20: note = CRISPR gRNA sequence
  source 1..20: mol_type = other DNA
cccctaacgctccctcagcc

SEQ ID NO: 38843 - DNA, 20 bp, synthetic construct
  misc_feature 1..20: note = CRISPR gRNA sequence
  source 1..20: mol_type = other DNA
ctaacgctccctcagcccag

SEQ ID NO: 38844 - DNA, 20 bp, synthetic construct
  misc_feature 1..20: note = CRISPR gRNA sequence
  source 1..20: mol_type = other DNA
taacgctccctcagcccagt

SEQ ID NO: 38845 - DNA, 20 bp, synthetic construct
  misc_feature 1..20: note = CRISPR gRNA sequence
  source 1..20: mol_type = other DNA
acgctccctcagcccagtgg

SEQ ID NO: 38846 - DNA, 20 bp, synthetic construct
  misc_feature 1..20: note = CRISPR gRNA sequence
  source 1..20: mol_type = other DNA
gctccctcagcccagtggga

SEQ ID NO: 38847 - DNA, 20 bp, synthetic construct
  misc_feature 1..20: note = CRISPR gRNA sequence
  source 1..20: mol_type = other DNA
tccctcagcccagtgggaga

SEQ ID NO: 38848 - DNA, 20 bp, synthetic construct
  misc_feature 1..20: note = CRISPR gRNA sequence
  source 1..20: mol_type = other DNA
gcccagtgggagagagtctg

SEQ ID NO: 38849 - DNA, 20 bp, synthetic construct
  misc_feature 1..20: note = CRISPR gRNA sequence
  source 1..20: mol_type = other DNA
agagagtctgtggtttacca

SEQ ID NO: 38850 - DNA, 20 bp, synthetic construct
  misc_feature 1..20: note = CRISPR gRNA sequence
  source 1..20: mol_type = other DNA
gtctgtggtttaccatagcc

SEQ ID NO: 38851 - DNA, 20 bp, synthetic construct
  misc_feature 1..20: note = CRISPR gRNA sequence
  source 1..20: mol_type = other DNA
tagcctggactcactgcata

SEQ ID NO: 38852 - DNA, 20 bp, synthetic construct
  misc_feature 1..20: note = CRISPR gRNA sequence
  source 1..20: mol_type = other DNA
gctcctcgccttctgaacca

SEQ ID NO: 38853 - DNA, 20 bp, synthetic construct
  misc_feature 1..20: note = CRISPR gRNA sequence
  source 1..20: mol_type = other DNA
ctcgccttctgaaccacaga

SEQ ID NO: 38854 - DNA, 20 bp, synthetic construct
  misc_feature 1..20: note = CRISPR gRNA sequence
  source 1..20: mol_type = other DNA
acagacagcacatccacaaa

SEQ ID NO: 38855 - DNA, 20 bp, synthetic construct
  misc_feature 1..20: note = CRISPR gRNA sequence
  source 1..20: mol_type = other DNA
agacagcacatccacaaatg

SEQ ID NO: 38856 - DNA, 20 bp, synthetic construct
  misc_feature 1..20: note = CRISPR gRNA sequence
  source 1..20: mol_type = other DNA
gaccatcacatcatcgacaa

SEQ ID NO: 38857 - DNA, 20 bp, synthetic construct
  misc_feature 1..20: note = CRISPR gRNA sequence
  source 1..20: mol_type = other DNA
catcacatcatcgacaatag

SEQ ID NO: 38858 - DNA, 20 bp, synthetic construct
  misc_feature 1..20: note = CRISPR gRNA sequence
  source 1..20: mol_type = other DNA
cttcgattttacacctatgc

SEQ ID NO: 38859 - DNA, 20 bp, synthetic construct
  misc_feature 1..20: note = CRISPR gRNA sequence
  source 1..20: mol_type = other DNA
ttcgattttacacctatgct

SEQ ID NO: 38860 - DNA, 20 bp, synthetic construct
  misc_feature 1..20: note = CRISPR gRNA sequence
  source 1..20: mol_type = other DNA
ttacacctatgctgggtact

SEQ ID NO: 38861 - DNA, 20 bp, synthetic construct
  misc_feature 1..20: note = CRISPR gRNA sequence
  source 1..20: mol_type = other DNA
cattgtctcattcaatcctt

SEQ ID NO: 38862 - DNA, 20 bp, synthetic construct
  misc_feature 1..20: note = CRISPR gRNA sequence
  source 1..20: mol_type = other DNA
attgtctcattcaatccttc

SEQ ID NO: 38863 - DNA, 20 bp, synthetic construct
  misc_feature 1..20: note = CRISPR gRNA sequence
  source 1..20: mol_type = other DNA
tccttcaggtacctatgtgc

SEQ ID NO: 38864 - DNA, 20 bp, synthetic construct
  misc_feature 1..20: note = CRISPR gRNA sequence
  source 1..20: mol_type = other DNA
ctagatgttgtcatccgttt

SEQ ID NO: 38865 - DNA, 20 bp, synthetic construct
  misc_feature 1..20: note = CRISPR gRNA sequence
  source 1..20: mol_type = other DNA
tgttgtcatccgttttagaa

SEQ ID NO: 38866 - DNA, 20 bp, synthetic construct
  misc_feature 1..20: note = CRISPR gRNA sequence
  source 1..20: mol_type = other DNA
ttgtcatccgttttagaaaa

SEQ ID NO: 38867 - DNA, 20 bp, synthetic construct
  misc_feature 1..20: note = CRISPR gRNA sequence
  source 1..20: mol_type = other DNA
atccgttttagaaaagagaa

SEQ ID NO: 38868 - DNA, 20 bp, synthetic construct
  misc_feature 1..20: note = CRISPR gRNA sequence
  source 1..20: mol_type = other DNA
tccgttttagaaaagagaaa

SEQ ID NO: 38869 - DNA, 20 bp, synthetic construct
  misc_feature 1..20: note = CRISPR gRNA sequence
  source 1..20: mol_type = other DNA
ccgttttagaaaagagaaaa

SEQ ID NO: 38870 - DNA, 20 bp, synthetic construct
  misc_feature 1..20: note = CRISPR gRNA sequence
  source 1..20: mol_type = other DNA
gttttagaaaagagaaaagg

SEQ ID NO: 38871 - DNA, 20 bp, synthetic construct
  misc_feature 1..20: note = CRISPR gRNA sequence
  source 1..20: mol_type = other DNA
agagaaaagggagccgactg

SEQ ID NO: 38872 - DNA, 20 bp, synthetic construct
  misc_feature 1..20: note = CRISPR gRNA sequence
  source 1..20: mol_type = other DNA
ccgactgcagtgatttgccc

SEQ ID NO: 38873 - DNA, 20 bp, synthetic construct
  misc_feature 1..20: note = CRISPR gRNA sequence
  source 1..20: mol_type = other DNA
cgactgcagtgatttgccca

SEQ ID NO: 38874 - DNA, 20 bp, synthetic construct
  misc_feature 1..20: note = CRISPR gRNA sequence
  source 1..20: mol_type = other DNA
gtgatttgcccaaggccaca

SEQ ID NO: 38875 - DNA, 20 bp, synthetic construct
  misc_feature 1..20: note = CRISPR gRNA sequence
  source 1..20: mol_type = other DNA
caaggccacatggctataca

SEQ ID NO: 38876 - DNA, 20 bp, synthetic construct
  misc_feature 1..20: note = CRISPR gRNA sequence
  source 1..20: mol_type = other DNA
ggccacatggctatacatgg

SEQ ID NO: 38877 - DNA, 20 bp, synthetic construct
  misc_feature 1..20: note = CRISPR gRNA sequence
  source 1..20: mol_type = other DNA
ccacatggctatacatggca

SEQ ID NO: 38878 - DNA, 20 bp, synthetic construct
  misc_feature 1..20: note = CRISPR gRNA sequence
  source 1..20: mol_type = other DNA
gcagagccaaaatttgaata

SEQ ID NO: 38879 - DNA, 20 bp, synthetic construct
  misc_feature 1..20: note = CRISPR gRNA sequence
  source 1..20: mol_type = other DNA
cagagccaaaatttgaataa

SEQ ID NO: 38880 - DNA, 20 bp, synthetic construct
  misc_feature 1..20: note = CRISPR gRNA sequence
  source 1..20: mol_type = other DNA
gctctgctgaatcacatctt

SEQ ID NO: 38881 - DNA, 20 bp, synthetic construct
  misc_feature 1..20: note = CRISPR gRNA sequence
  source 1..20: mol_type = other DNA
atcacatcttgagcatctgc

SEQ ID NO: 38882 - DNA, 20 bp, synthetic construct
  misc_feature 1..20: note = CRISPR gRNA sequence
  source 1..20: mol_type = other DNA
acatcttgagcatctgcaag

SEQ ID NO: 38883 - DNA, 20 bp, synthetic construct
  misc_feature 1..20: note = CRISPR gRNA sequence
  source 1..20: mol_type = other DNA
cctttgttaccgactcactt

SEQ ID NO: 38884 - DNA, 20 bp, synthetic construct
  misc_feature 1..20: note = CRISPR gRNA sequence
  source 1..20: mol_type = other DNA
ctttgttaccgactcacttt

SEQ ID NO: 38885 - DNA, 20 bp, synthetic construct
  misc_feature 1..20: note = CRISPR gRNA sequence
  source 1..20: mol_type = other DNA
actcactttgggttgtgctt

SEQ ID NO: 38886 - DNA, 20 bp, synthetic construct
  misc_feature 1..20: note = CRISPR gRNA sequence
  source 1..20: mol_type = other DNA
ctcactttgggttgtgcttc

SEQ ID NO: 38887 - DNA, 20 bp, synthetic construct
  misc_feature 1..20: note = CRISPR gRNA sequence
  source 1..20: mol_type = other DNA
tcactttgggttgtgcttca

SEQ ID NO: 38888 - DNA, 20 bp, synthetic construct
  misc_feature 1..20: note = CRISPR gRNA sequence
  source 1..20: mol_type = other DNA
gggttgtgcttcagggtctt

SEQ ID NO: 38889 - DNA, 20 bp, synthetic construct
  misc_feature 1..20: note = CRISPR gRNA sequence
  source 1..20: mol_type = other DNA
gcttcagggtcttcagcctc

SEQ ID NO: 38890 - DNA, 20 bp, synthetic construct
  misc_feature 1..20: note = CRISPR gRNA sequence
  source 1..20: mol_type = other DNA
tcagggtcttcagcctctag

SEQ ID NO: 38891 - DNA, 20 bp, synthetic construct
  misc_feature 1..20: note = CRISPR gRNA sequence
  source 1..20: mol_type = other DNA
gtcttcagcctctagaagcc

SEQ ID NO: 38892 - DNA, 20 bp, synthetic construct
  misc_feature 1..20: note = CRISPR gRNA sequence
  source 1..20: mol_type = other DNA
tcttcagcctctagaagcca

SEQ ID NO: 38893 - DNA, 20 bp, synthetic construct
  misc_feature 1..20: note = CRISPR gRNA sequence
  source 1..20: mol_type = other DNA
cagcctctagaagccaagga

SEQ ID NO: 38894 - DNA, 20 bp, synthetic construct
  misc_feature 1..20: note = CRISPR gRNA sequence
  source 1..20: mol_type = other DNA
gcctctagaagccaaggaaa

SEQ ID NO: 38895 - DNA, 20 bp, synthetic construct
  misc_feature 1..20: note = CRISPR gRNA sequence
  source 1..20: mol_type = other DNA
cctctagaagccaaggaaag

SEQ ID NO: 38896 - DNA, 20 bp, synthetic construct
  misc_feature 1..20: note = CRISPR gRNA sequence
  source 1..20: mol_type = other DNA
aggaaagaggcttgatccac

SEQ ID NO: 38897 - DNA, 20 bp, synthetic construct
  misc_feature 1..20: note = CRISPR gRNA sequence
  source 1..20: mol_type = other DNA
ggaaagaggcttgatccacc

SEQ ID NO: 38898 - DNA, 20 bp, synthetic construct
  misc_feature 1..20: note = CRISPR gRNA sequence
  source 1..20: mol_type = other DNA
aggcttgatccaccaggccc

SEQ ID NO: 38899 - DNA, 20 bp, synthetic construct
  misc_feature 1..20: note = CRISPR gRNA sequence
  source 1..20: mol_type = other DNA
ccaccaggccctagatgcct

SEQ ID NO: 38900 - DNA, 20 bp, synthetic construct
  misc_feature 1..20: note = CRISPR gRNA sequence
  source 1..20: mol_type = other DNA
aggccctagatgcctgagcc

SEQ ID NO: 38901 - DNA, 20 bp, synthetic construct
  misc_feature 1..20: note = CRISPR gRNA sequence
  source 1..20: mol_type = other DNA
ggccctagatgcctgagccc

SEQ ID NO: 38902 - DNA, 20 bp, synthetic construct
  misc_feature 1..20: note = CRISPR gRNA sequence
  source 1..20: mol_type = other DNA
aatgcttgatttgttcttgc

SEQ ID NO: 38903 - DNA, 20 bp, synthetic construct
  misc_feature 1..20: note = CRISPR gRNA sequence
  source 1..20: mol_type = other DNA
tgcttgatttgttcttgcca

SEQ ID NO: 38904 - DNA, 20 bp, synthetic construct
  misc_feature 1..20: note = CRISPR gRNA sequence
  source 1..20: mol_type = other DNA
atttgttcttgccagagctc

SEQ ID NO: 38905 - DNA, 20 bp, synthetic construct
  misc_feature 1..20: note = CRISPR gRNA sequence
  source 1..20: mol_type = other DNA
ttgccagagctccagacctg

SEQ ID NO: 38906 - DNA, 20 bp, synthetic construct
  misc_feature 1..20: note = CRISPR gRNA sequence
  source 1..20: mol_type = other DNA
tgccagagctccagacctgc

SEQ ID NO: 38907 - DNA, 20 bp, synthetic construct
  misc_feature 1..20: note = CRISPR gRNA sequence
  source 1..20: mol_type = other DNA
agagctccagacctgcagga

SEQ ID NO: 38908 - DNA, 20 bp, synthetic construct
  misc_feature 1..20: note = CRISPR gRNA sequence
  source 1..20: mol_type = other DNA
ccagacctgcaggaaagtga

SEQ ID NO: 38909 - DNA, 20 bp, synthetic construct
  misc_feature 1..20: note = CRISPR gRNA sequence
  source 1..20: mol_type = other DNA
acctgcaggaaagtgacggc

SEQ ID NO: 38910 - DNA, 20 bp, synthetic construct
  misc_feature 1..20: note = CRISPR gRNA sequence
  source 1..20: mol_type = other DNA
ctgcaggaaagtgacggcca

SEQ ID NO: 38911 - DNA, 20 bp, synthetic construct
  misc_feature 1..20: note = CRISPR gRNA sequence
  source 1..20: mol_type = other DNA
tgcaggaaagtgacggccag

SEQ ID NO: 38912 - DNA, 20 bp, synthetic construct
  misc_feature 1..20: note = CRISPR gRNA sequence
  source 1..20: mol_type = other DNA
ggaaagtgacggccagagga

SEQ ID NO: 38913 - DNA, 20 bp, synthetic construct
  misc_feature 1..20: note = CRISPR gRNA sequence
  source 1..20: mol_type = other DNA
gaaagtgacggccagaggaa

SEQ ID NO: 38914 - DNA, 20 bp, synthetic construct
  misc_feature 1..20: note = CRISPR gRNA sequence
  source 1..20: mol_type = other DNA
aaagtgacggccagaggaaa

SEQ ID NO: 38915 - DNA, 20 bp, synthetic construct
  misc_feature 1..20: note = CRISPR gRNA sequence
  source 1..20: mol_type = other DNA
aagtgacggccagaggaaag

SEQ ID NO: 38916 - DNA, 20 bp, synthetic construct
  misc_feature 1..20: note = CRISPR gRNA sequence
  source 1..20: mol_type = other DNA
acggccagaggaaaggggct

SEQ ID NO: 38917 - DNA, 20 bp, synthetic construct
  misc_feature 1..20: note = CRISPR gRNA sequence
  source 1..20: mol_type = other DNA
ggccagaggaaaggggctca

SEQ ID NO: 38918 - DNA, 20 bp, synthetic construct
  misc_feature 1..20: note = CRISPR gRNA sequence
  source 1..20: mol_type = other DNA
cagaggaaaggggctcagag

SEQ ID NO: 38919 - DNA, 20 bp, synthetic construct
  misc_feature 1..20: note = CRISPR gRNA sequence
  source 1..20: mol_type = other DNA
aggaaaggggctcagagcag

SEQ ID NO: 38920 - DNA, 20 bp, synthetic construct
  misc_feature 1..20: note = CRISPR gRNA sequence
  source 1..20: mol_type = other DNA
cagagcagaagcttgacgct

SEQ ID NO: 38921 - DNA, 20 bp, synthetic construct
  misc_feature 1..20: note = CRISPR gRNA sequence
  source 1..20: mol_type = other DNA
agagcagaagcttgacgctc

SEQ ID NO: 38922 - DNA, 20 bp, synthetic construct
  misc_feature 1..20: note = CRISPR gRNA sequence
  source 1..20: mol_type = other DNA
agcttgacgctcaggtacct

SEQ ID NO: 38923 - DNA, 20 bp, synthetic construct
  misc_feature 1..20: note = CRISPR gRNA sequence
  source 1..20: mol_type = other DNA
cttgacgctcaggtaccttg

SEQ ID NO: 38924 - DNA, 20 bp, synthetic construct
  misc_feature 1..20: note = CRISPR gRNA sequence
  source 1..20: mol_type = other DNA
ttgacgctcaggtaccttgg

SEQ ID NO: 38925 - DNA, 20 bp, synthetic construct
  misc_feature 1..20: note = CRISPR gRNA sequence
  source 1..20: mol_type = other DNA
tgacgctcaggtaccttgga

SEQ ID NO: 38926 - DNA, 20 bp, synthetic construct
  misc_feature 1..20: note = CRISPR gRNA sequence
  source 1..20: mol_type = other DNA
cttggagggatctattgcct

SEQ ID NO: 38927 - DNA, 20 bp, synthetic construct
  misc_feature 1..20: note = CRISPR gRNA sequence
  source 1..20: mol_type = other DNA
ttggagggatctattgcctt

SEQ ID NO: 38928 - DNA, 20 bp, synthetic construct
  misc_feature 1..20: note = CRISPR gRNA sequence
  source 1..20: mol_type = other DNA
ggagggatctattgccttag

SEQ ID NO: 38929 - DNA, 20 bp, synthetic construct
  misc_feature 1..20: note = CRISPR gRNA sequence
  source 1..20: mol_type = other DNA
agggatctattgccttagga

SEQ ID NO: 38930 - DNA, 20 bp, synthetic construct
  misc_feature 1..20: note = CRISPR gRNA sequence
  source 1..20: mol_type = other DNA
gggatctattgccttaggag

SEQ ID NO: 38931 - DNA, 20 bp, synthetic construct
  misc_feature 1..20: note = CRISPR gRNA sequence
  source 1..20: mol_type = other DNA
ggatctattgccttaggaga

SEQ ID NO: 38932 - DNA, 20 bp, synthetic construct
  misc_feature 1..20: note = CRISPR gRNA sequence
  source 1..20: mol_type = other DNA
cttaggagagggatatgata

SEQ ID NO: 38933 - DNA, 20 bp, synthetic construct
  misc_feature 1..20: note = CRISPR gRNA sequence
  source 1..20: mol_type = other DNA
ttaggagagggatatgatat

SEQ ID NO: 38934 - DNA, 20 bp, synthetic construct
  misc_feature 1..20: note = CRISPR gRNA sequence
  source 1..20: mol_type = other DNA
taggagagggatatgatatg

SEQ ID NO: 38935 - DNA, 20 bp, synthetic construct
  misc_feature 1..20: note = CRISPR gRNA sequence
  source 1..20: mol_type = other DNA
aggagagggatatgatatgg

SEQ ID NO: 38936 - DNA, 20 bp, synthetic construct
  misc_feature 1..20: note = CRISPR gRNA sequence
  source 1..20: mol_type = other DNA
gagggatatgatatggggga

SEQ ID NO: 38937 - DNA, 20 bp, synthetic construct
  misc_feature 1..20: note = CRISPR gRNA sequence
  source 1..20: mol_type = other DNA
tatgatatgggggaaagtcc

SEQ ID NO: 38938 - DNA, 20 bp, synthetic construct
  misc_feature 1..20: note = CRISPR gRNA sequence
  source 1..20: mol_type = other DNA
atgatatgggggaaagtccg

SEQ ID NO: 38939 - DNA, 20 bp, synthetic construct
  misc_feature 1..20: note = CRISPR gRNA sequence
  source 1..20: mol_type = other DNA
tatgggggaaagtccgaggc

SEQ ID NO: 38940 - DNA, 20 bp, synthetic construct
  misc_feature 1..20: note = CRISPR gRNA sequence
  source 1..20: mol_type = other DNA
atgggggaaagtccgaggca

SEQ ID NO: 38941 - DNA, 20 bp, synthetic construct
  misc_feature 1..20: note = CRISPR gRNA sequence
  source 1..20: mol_type = other DNA
tgggggaaagtccgaggcaa

SEQ ID NO: 38942 - DNA, 20 bp, synthetic construct
  misc_feature 1..20: note = CRISPR gRNA sequence
  source 1..20: mol_type = other DNA
ggggaaagtccgaggcaagg

SEQ ID NO: 38943 - DNA, 20 bp, synthetic construct
  misc_feature 1..20: note = CRISPR gRNA sequence
  source 1..20: mol_type = other DNA
ggaaagtccgaggcaaggga

SEQ ID NO: 38944 - DNA, 20 bp, synthetic construct
  misc_feature 1..20: note = CRISPR gRNA sequence
  source 1..20: mol_type = other DNA
aagtccgaggcaagggagag

SEQ ID NO: 38945 - DNA, 20 bp, synthetic construct
  misc_feature 1..20: note = CRISPR gRNA sequence
  source 1..20: mol_type = other DNA
agtccgaggcaagggagagc

SEQ ID NO: 38946 - DNA, 20 bp, synthetic construct
  misc_feature 1..20: note = CRISPR gRNA sequence
  source 1..20: mol_type = other DNA
gtccgaggcaagggagagca

SEQ ID NO: 38947 - DNA, 20 bp, synthetic construct
  misc_feature 1..20: note = CRISPR gRNA sequence
  source 1..20: mol_type = other DNA
tccgaggcaagggagagcag

SEQ ID NO: 38948 - DNA, 20 bp, synthetic construct
  misc_feature 1..20: note = CRISPR gRNA sequence
  source 1..20: mol_type = other DNA
gaggcaagggagagcagggg

SEQ ID NO: 38949 - DNA, 20 bp, synthetic construct
  misc_feature 1..20: note = CRISPR gRNA sequence
  source 1..20: mol_type = other DNA
aggcaagggagagcaggggc

SEQ ID NO: 38950 - DNA, 20 bp, synthetic construct
  misc_feature 1..20: note = CRISPR gRNA sequence
  source 1..20: mol_type = other DNA
ggcaagggagagcaggggca

SEQ ID NO: 38951 - DNA, 20 bp, synthetic construct
  misc_feature 1..20: note = CRISPR gRNA sequence
  source 1..20: mol_type = other DNA
caagggagagcaggggcagg

SEQ ID NO: 38952 - DNA, 20 bp, synthetic construct
  misc_feature 1..20: note = CRISPR gRNA sequence
  source 1..20: mol_type = other DNA
aagggagagcaggggcaggg

SEQ ID NO: 38953 - DNA, 20 bp, synthetic construct
  misc_feature 1..20: note = CRISPR gRNA sequence
  source 1..20: mol_type = other DNA
gagcaggggcagggaggata

SEQ ID NO: 38954 - DNA, 20 bp, synthetic construct
  misc_feature 1..20: note = CRISPR gRNA sequence
  source 1..20: mol_type = other DNA
agcaggggcagggaggataa

SEQ ID NO: 38955 - DNA, 20 bp, synthetic construct
  misc_feature 1..20: note = CRISPR gRNA sequence
  source 1..20: mol_type = other DNA
gcaggggcagggaggataaa

SEQ ID NO: 38956 - DNA, 20 bp, synthetic construct
  misc_feature 1..20: note = CRISPR gRNA sequence
  source 1..20: mol_type = other DNA
ggcagggaggataaagggaa

SEQ ID NO: 38957 - DNA, 20 bp, synthetic construct
  misc_feature 1..20: note = CRISPR gRNA sequence
  source 1..20: mol_type = other DNA
agggaggataaagggaaaag

SEQ ID NO: 38958 - DNA, 20 bp, synthetic construct
  misc_feature 1..20: note = CRISPR gRNA sequence
  source 1..20: mol_type = other DNA
ggataaagggaaaagcagat

SEQ ID NO: 38959 - DNA, 20 bp, synthetic construct
  misc_feature 1..20: note = CRISPR gRNA sequence
  source 1..20: mol_type = other DNA
gataaagggaaaagcagatg

SEQ ID NO: 38960 - DNA, 20 bp, synthetic construct
  misc_feature 1..20: note = CRISPR gRNA sequence
  source 1..20: mol_type = other DNA
ataaagggaaaagcagatga

SEQ ID NO: 38961 - DNA, 20 bp, synthetic construct
  misc_feature 1..20: note = CRISPR gRNA sequence
  source 1..20: mol_type = other DNA
agggaaaagcagatgaggga

SEQ ID NO: 38962 - DNA, 20 bp, synthetic construct
  misc_feature 1..20: note = CRISPR gRNA sequence
  source 1..20: mol_type = other DNA
gggaaaagcagatgagggac

SEQ ID NO: 38963 - DNA, 20 bp, synthetic construct
  misc_feature 1..20: note = CRISPR gRNA sequence
  source 1..20: mol_type = other DNA
ggaaaagcagatgagggaca

SEQ ID NO: 38964 - DNA, 20 bp, synthetic construct
  misc_feature 1..20: note = CRISPR gRNA sequence
  source 1..20: mol_type = other DNA
aagcagatgagggacaggga

SEQ ID NO: 38965 - DNA, 20 bp, synthetic construct
  misc_feature 1..20: note = CRISPR gRNA sequence
  source 1..20: mol_type = other DNA
agcagatgagggacagggaa

SEQ ID NO: 38966 - DNA, 20 bp, synthetic construct
  misc_feature 1..20: note = CRISPR gRNA sequence
  source 1..20: mol_type = other DNA
atgagggacagggaaaggat

SEQ ID NO: 38967 - DNA, 20 bp, synthetic construct
  misc_feature 1..20: note = CRISPR gRNA sequence
  source 1..20: mol_type = other DNA
gggacagggaaaggattagc

SEQ ID NO: 38968 - DNA, 20 bp, synthetic construct
  misc_feature 1..20: note = CRISPR gRNA sequence
  source 1..20: mol_type = other DNA
ggacagggaaaggattagcc

SEQ ID NO: 38969 - DNA, 20 bp, synthetic construct
  misc_feature 1..20: note = CRISPR gRNA sequence
  source 1..20: mol_type = other DNA
gggaaaggattagccgggtg

SEQ ID NO: 38970 - DNA, 20 bp, synthetic construct
  misc_feature 1..20: note = CRISPR gRNA sequence
  source 1..20: mol_type = other DNA
gccgggtgtggtgcccatcc

SEQ ID NO: 38971 - DNA, 20 bp, synthetic construct
  misc_feature 1..20: note = CRISPR gRNA sequence
  source 1..20: mol_type = other DNA
ggtgtggtgcccatcctgga

SEQ ID NO: 38972 - DNA, 20 bp, synthetic construct
  misc_feature 1..20: note = CRISPR gRNA sequence
  source 1..20: mol_type = other DNA
ccatcctggatagcccatcc

SEQ ID NO: 38973 - DNA, 20 bp, synthetic construct
  misc_feature 1..20: note = CRISPR gRNA sequence
  source 1..20: mol_type = other DNA
tagcccatcctggcttgaat

SEQ ID NO: 38974 - DNA, 20 bp, synthetic construct
  misc_feature 1..20: note = CRISPR gRNA sequence
  source 1..20: mol_type = other DNA
agcccatcctggcttgaata

SEQ ID NO: 38975 - DNA, 20 bp, synthetic construct
  misc_feature 1..20: note = CRISPR gRNA sequence
  source 1..20: mol_type = other DNA
cccatcctggcttgaataag

SEQ ID NO: 38976 - DNA, 20 bp, synthetic construct
  misc_feature 1..20: note = CRISPR gRNA sequence
  source 1..20: mol_type = other DNA
agcatctgtcataataacaa

SEQ ID NO: 38977 - DNA, 20 bp, synthetic construct
  misc_feature 1..20: note = CRISPR gRNA sequence
  source 1..20: mol_type = other DNA
taacaatagctgcaacttaa

SEQ ID NO: 38978 - DNA, 20 bp, synthetic construct
  misc_feature 1..20: note = CRISPR gRNA sequence
  source 1..20: mol_type = other DNA
tagctgcaacttaatggaac

SEQ ID NO: 38979 - DNA, 20 bp, synthetic construct
  misc_feature 1..20: note = CRISPR gRNA sequence
  source 1..20: mol_type = other DNA
ggaaccggctatctatatgc

SEQ ID NO: 38980 - DNA, 20 bp, synthetic construct
  misc_feature 1..20: note = CRISPR gRNA sequence
  source 1..20: mol_type = other DNA
gaaccggctatctatatgcc

SEQ ID NO: 38981 - DNA, 20 bp, synthetic construct
  misc_feature 1..20: note = CRISPR gRNA sequence
  source 1..20: mol_type = other DNA
ctatatgccgggcattgcac

SEQ ID NO: 38982 - DNA, 20 bp, synthetic construct
  misc_feature 1..20: note = CRISPR gRNA sequence
  source 1..20: mol_type = other DNA
ttacctcactgtaattcctt

SEQ ID NO: 38983 - DNA, 20 bp, synthetic construct
  misc_feature 1..20: note = CRISPR gRNA sequence
  source 1..20: mol_type = other DNA
attcctttagaatctctgtg

SEQ ID NO: 38984 - DNA, 20 bp, synthetic construct
  misc_feature 1..20: note = CRISPR gRNA sequence
  source 1..20: mol_type = other DNA
acacattattattccccttt

SEQ ID NO: 38985 - DNA, 20 bp, synthetic construct
  misc_feature 1..20: note = CRISPR gRNA sequence
  source 1..20: mol_type = other DNA
cacattattattcccctttg

SEQ ID NO: 38986 - DNA, 20 bp, synthetic construct
  misc_feature 1..20: note = CRISPR gRNA sequence
  source 1..20: mol_type = other DNA
acattattattcccctttga

SEQ ID NO: 38987 - DNA, 20 bp, synthetic construct
  misc_feature 1..20: note = CRISPR gRNA sequence
  source 1..20: mol_type = other DNA
attattattcccctttgagg

SEQ ID NO: 38988 - DNA, 20 bp, synthetic construct
  misc_feature 1..20: note = CRISPR gRNA sequence
  source 1..20: mol_type = other DNA
ttattattcccctttgaggg

SEQ ID NO: 38989 - DNA, 20 bp, synthetic construct
  misc_feature 1..20: note = CRISPR gRNA sequence
  source 1..20: mol_type = other DNA
attattcccctttgagggag

SEQ ID NO: 38990 - DNA, 20 bp, synthetic construct
  misc_feature 1..20: note = CRISPR gRNA sequence
  source 1..20: mol_type = other DNA
ttattcccctttgagggagg

SEQ ID NO: 38991 - DNA, 20 bp, synthetic construct
  misc_feature 1..20: note = CRISPR gRNA sequence
  source 1..20: mol_type = other DNA
ctttgagggaggaggaaact

SEQ ID NO: 38992 - DNA, 20 bp, synthetic construct
  misc_feature 1..20: note = CRISPR gRNA sequence
  source 1..20: mol_type = other DNA
gggaggaggaaactgagtct

SEQ ID NO: 38993 - DNA, 20 bp, synthetic construct
  misc_feature 1..20: note = CRISPR gRNA sequence
  source 1..20: mol_type = other DNA
ggaggaaactgagtctcaga

SEQ ID NO: 38994 - DNA, 20 bp, synthetic construct
  misc_feature 1..20: note = CRISPR gRNA sequence
  source 1..20: mol_type = other DNA
gaggaaactgagtctcagac

SEQ ID NO: 38995 - DNA, 20 bp, synthetic construct
  misc_feature 1..20: note = CRISPR gRNA sequence
  source 1..20: mol_type = other DNA
aactgagtctcagacaggtt

SEQ ID NO: 38996 - DNA, 20 bp, synthetic construct
  misc_feature 1..20: note = CRISPR gRNA sequence
  source 1..20: mol_type = other DNA
acaggttaagtcccttgctc

SEQ ID NO: 38997 - DNA, 20 bp, synthetic construct
  misc_feature 1..20: note = CRISPR gRNA sequence
  source 1..20: mol_type = other DNA
gtcccttgctcaagatcacc

SEQ ID NO: 38998 - DNA, 20 bp, synthetic construct
  misc_feature 1..20: note = CRISPR gRNA sequence
  source 1..20: mol_type = other DNA
ctcaagatcacccagctact

SEQ ID NO: 38999 - DNA, 20 bp, synthetic construct
  misc_feature 1..20: note = CRISPR gRNA sequence
  source 1..20: mol_type = other DNA
caagatcacccagctactaa

SEQ ID NO: 39000 - DNA, 20 bp, synthetic construct
  misc_feature 1..20: note = CRISPR gRNA sequence
  source 1..20: mol_type = other DNA
aagatcacccagctactaag

SEQ ID NO: 39001 - DNA, 20 bp, synthetic construct
  misc_feature 1..20: note = CRISPR gRNA sequence
  source 1..20: mol_type = other DNA
cacccagctactaagaggtg

SEQ ID NO: 39002 - DNA, 20 bp, synthetic construct
  misc_feature 1..20: note = CRISPR gRNA sequence
  source 1..20: mol_type = other DNA
cagctactaagaggtgtggc

SEQ ID NO: 39003 - DNA, 20 bp, synthetic construct
  misc_feature 1..20: note = CRISPR gRNA sequence
  source 1..20: mol_type = other DNA
agctactaagaggtgtggct

SEQ ID NO: 39004 - DNA, 20 bp, synthetic construct
  misc_feature 1..20: note = CRISPR gRNA sequence
  source 1..20: mol_type = other DNA
ctaagaggtgtggctaggat

SEQ ID NO: 39005 - DNA, 20 bp, synthetic construct
  misc_feature 1..20: note = CRISPR gRNA sequence
  source 1..20: mol_type = other DNA
ggtgtggctaggattagacc

SEQ ID NO: 39006 - DNA, 20 bp, synthetic construct
  misc_feature 1..20: note = CRISPR gRNA sequence
  source 1..20: mol_type = other DNA
gtgtggctaggattagaccc

SEQ ID NO: 39007 - DNA, 20 bp, synthetic construct
  misc_feature 1..20: note = CRISPR gRNA sequence
  source 1..20: mol_type = other DNA
taggattagacccaggtctg

SEQ ID NO: 39008 - DNA, 20 bp, synthetic construct
  misc_feature 1..20: note = CRISPR gRNA sequence
  source 1..20: mol_type = other DNA
aggattagacccaggtctgt

SEQ ID NO: 39009 - DNA, 20 bp, synthetic construct
  misc_feature 1..20: note = CRISPR gRNA sequence
  source 1..20: mol_type = other DNA
tgtgggccccctgactcccc

SEQ ID NO: 39010 - DNA, 20 bp, synthetic construct
  misc_feature 1..20: note = CRISPR gRNA sequence
  source 1..20: mol_type = other DNA
ccccctgactcccccagcat

SEQ ID NO: 39011 - DNA, 20 bp, synthetic construct
  misc_feature 1..20: note = CRISPR gRNA sequence
  source 1..20: mol_type = other DNA
cctgactcccccagcattgg

SEQ ID NO: 39012 - DNA, 20 bp, synthetic construct
  misc_feature 1..20: note = CRISPR gRNA sequence
  source 1..20: mol_type = other DNA
actcccccagcattggaagc

SEQ ID NO: 39013 - DNA, 20 bp, synthetic construct
  misc_feature 1..20: note = CRISPR gRNA sequence
  source 1..20: mol_type = other DNA
tcccccagcattggaagctg

SEQ ID NO: 39014 - DNA, 20 bp, synthetic construct
  misc_feature 1..20: note = CRISPR gRNA sequence
  source 1..20: mol_type = other DNA
cccccagcattggaagctgg

SEQ ID NO: 39015 - DNA, 20 bp, synthetic construct
  misc_feature 1..20: note = CRISPR gRNA sequence
  source 1..20: mol_type = other DNA
ccccagcattggaagctgga

SEQ ID NO: 39016 - DNA, 20 bp, synthetic construct
  misc_feature 1..20: note = CRISPR gRNA sequence
  source 1..20: mol_type = other DNA
cccagcattggaagctggag

SEQ ID NO: 39017 - DNA, 20 bp, synthetic construct
  misc_feature 1..20: note = CRISPR gRNA sequence
  source 1..20: mol_type = other DNA
attggaagctggaggggcca

SEQ ID NO: 39018 - DNA, 20 bp, synthetic construct
  misc_feature 1..20: note = CRISPR gRNA sequence
  source 1..20: mol_type = other DNA
tggaagctggaggggccatg

SEQ ID NO: 39019 - DNA, 20 bp, synthetic construct
  misc_feature 1..20: note = CRISPR gRNA sequence
  source 1..20: mol_type = other DNA
aagctggaggggccatggag

SEQ ID NO: 39020 - DNA, 20 bp, synthetic construct
  misc_feature 1..20: note = CRISPR gRNA sequence
  source 1..20: mol_type = other DNA
agctggaggggccatggagt

SEQ ID NO: 39021 - DNA, 20 bp, synthetic construct
  misc_feature 1..20: note = CRISPR gRNA sequence
  source 1..20: mol_type = other DNA
gctggaggggccatggagta

SEQ ID NO: 39022 - DNA, 20 bp, synthetic construct
  misc_feature 1..20: note = CRISPR gRNA sequence
  source 1..20: mol_type = other DNA
ctggaggggccatggagtag

SEQ ID NO: 39023 - DNA, 20 bp, synthetic construct
  misc_feature 1..20: note = CRISPR gRNA sequence
  source 1..20: mol_type = other DNA
gagtaggggctgtttgccct

SEQ ID NO: 39024 - DNA, 20 bp, synthetic construct
  misc_feature 1..20: note = CRISPR gRNA sequence
  source 1..20: mol_type = other DNA
tctgtcccccactcctaccc

SEQ ID NO: 39025 - DNA, 20 bp, synthetic construct
  misc_feature 1..20: note = CRISPR gRNA sequence
  source 1..20: mol_type = other DNA
ctgtcccccactcctaccca

SEQ ID NO: 39026 - DNA, 20 bp, synthetic construct
  misc_feature 1..20: note = CRISPR gRNA sequence
  source 1..20: mol_type = other DNA
cccactcctacccaaggctg

SEQ ID NO: 39027 - DNA, 20 bp, synthetic construct
  misc_feature 1..20: note = CRISPR gRNA sequence
  source 1..20: mol_type = other DNA
actcctacccaaggctgcag

SEQ ID NO: 39028 - DNA, 20 bp, synthetic construct
  misc_feature 1..20: note = CRISPR gRNA sequence
  source 1..20: mol_type = other DNA
acccaaggctgcagaagtgt

SEQ ID NO: 39029 - DNA, 20 bp, synthetic construct
  misc_feature 1..20: note = CRISPR gRNA sequence
  source 1..20: mol_type = other DNA
ggctgcagaagtgtcagctc

SEQ ID NO: 39030 - DNA, 20 bp, synthetic construct
  misc_feature 1..20: note = CRISPR gRNA sequence
  source 1..20: mol_type = other DNA
gctgcagaagtgtcagctcc

SEQ ID NO: 39031 - DNA, 20 bp, synthetic construct
  misc_feature 1..20: note = CRISPR gRNA sequence
  source 1..20: mol_type = other DNA
tcagctccaggtccacgatg

SEQ ID NO: 39032 - DNA, 20 bp, synthetic construct
  misc_feature 1..20: note = CRISPR gRNA sequence
  source 1..20: mol_type = other DNA
agctccaggtccacgatgcg

SEQ ID NO: 39033 - DNA, 20 bp, synthetic construct
  misc_feature 1..20: note = CRISPR gRNA sequence
  source 1..20: mol_type = other DNA
gctccaggtccacgatgcgg

SEQ ID NO: 39034 - DNA, 20 bp, synthetic construct
  misc_feature 1..20: note = CRISPR gRNA sequence
  source 1..20: mol_type = other DNA
ccacgatgcggaggccctca

SEQ ID NO: 39035 - DNA, 20 bp, synthetic construct
  misc_feature 1..20: note = CRISPR gRNA sequence
  source 1..20: mol_type = other DNA
aggccctcatagccctgctc

SEQ ID NO: 39036 - DNA, 20 bp, synthetic construct
  misc_feature 1..20: note = CRISPR gRNA sequence
  source 1..20: mol_type = other DNA
ggccctcatagccctgctcc

SEQ ID NO: 39037 - DNA, 20 bp, synthetic construct
  misc_feature 1..20: note = CRISPR gRNA sequence
  source 1..20: mol_type = other DNA
cctcatagccctgctccagg

SEQ ID NO: 39038 - DNA, 20 bp, synthetic construct
  misc_feature 1..20: note = CRISPR gRNA sequence
  source 1..20: mol_type = other DNA
ctcatagccctgctccagga

SEQ ID NO: 39039 - DNA, 20 bp, synthetic construct
  misc_feature 1..20: note = CRISPR gRNA sequence
  source 1..20: mol_type = other DNA
gctccaggaaggccctcacc

SEQ ID NO: 39040 - DNA, 20 bp, synthetic construct
  misc_feature 1..20: note = CRISPR gRNA sequence
  source 1..20: mol_type = other DNA
tccaggaaggccctcacctg

SEQ ID NO: 39041 - DNA, 20 bp, synthetic construct
  misc_feature 1..20: note = CRISPR gRNA sequence
  source 1..20: mol_type = other DNA
ccaggaaggccctcacctgg

SEQ ID NO: 39042 - DNA, 20 bp, synthetic construct
  misc_feature 1..20: note = CRISPR gRNA sequence
  source 1..20: mol_type = other DNA
ggaaggccctcacctggagg

SEQ ID NO: 39043 - DNA, 20 bp, synthetic construct
  misc_feature 1..20: note = CRISPR gRNA sequence
  source 1..20: mol_type = other DNA
aggccctcacctggaggaag

SEQ ID NO: 39044 - DNA, 20 bp, synthetic construct
  misc_feature 1..20: note = CRISPR gRNA sequence
  source 1..20: mol_type = other DNA
gccctcacctggaggaagtg

SEQ ID NO: 39045 - DNA, 20 bp, synthetic construct
  misc_feature 1..20: note = CRISPR gRNA sequence
  source 1..20: mol_type = other DNA
tcacctggaggaagtggagt

SEQ ID NO: 39046 - DNA, 20 bp, synthetic construct
  misc_feature 1..20: note = CRISPR gRNA sequence
  source 1..20: mol_type = other DNA
aggaagtggagtgagtatca

SEQ ID NO: 39047 - DNA, 20 bp, synthetic construct
  misc_feature 1..20: note = CRISPR gRNA sequence
  source 1..20: mol_type = other DNA
ggaagtggagtgagtatcac

SEQ ID NO: 39048 - DNA, 20 bp, synthetic construct
  misc_feature 1..20: note = CRISPR gRNA sequence
  source 1..20: mol_type = other DNA
agtggagtgagtatcacggg

SEQ ID NO: 39049 - DNA, 20 bp, synthetic construct
  misc_feature 1..20: note = CRISPR gRNA sequence
  source 1..20: mol_type = other DNA
gtgagtatcacgggaagccc

SEQ ID NO: 39050 - DNA, 20 bp, synthetic construct
  misc_feature 1..20: note = CRISPR gRNA sequence
  source 1..20: mol_type = other DNA
tatcacgggaagccctggcg

SEQ ID NO: 39051 - DNA, 20 bp, synthetic construct
  misc_feature 1..20: note = CRISPR gRNA sequence
  source 1..20: mol_type = other DNA
atcacgggaagccctggcgt

SEQ ID NO: 39052 - DNA, 20 bp, synthetic construct
  misc_feature 1..20: note = CRISPR gRNA sequence
  source 1..20: mol_type = other DNA
cacgggaagccctggcgtag

SEQ ID NO: 39053 - DNA, 20 bp, synthetic construct
  misc_feature 1..20: note = CRISPR gRNA sequence
  source 1..20: mol_type = other DNA
ggaagccctggcgtaggagc

SEQ ID NO: 39054 - DNA, 20 bp, synthetic construct
  misc_feature 1..20: note = CRISPR gRNA sequence
  source 1..20: mol_type = other DNA
gaagccctggcgtaggagcc

SEQ ID NO: 39055 - DNA, 20 bp, synthetic construct
  misc_feature 1..20: note = CRISPR gRNA sequence
  source 1..20: mol_type = other DNA
ccctggcgtaggagccagga

SEQ ID NO: 39056 - DNA, 20 bp, synthetic construct
  misc_feature 1..20: note = CRISPR gRNA sequence
  source 1..20: mol_type = other DNA
cctggcgtaggagccaggaa

SEQ ID NO: 39057 - DNA, 20 bp, synthetic construct
  misc_feature 1..20: note = CRISPR gRNA sequence
  source 1..20: mol_type = other DNA
tggcgtaggagccaggaaag

SEQ ID NO: 39058 - DNA, 20 bp, synthetic construct
  misc_feature 1..20: note = CRISPR gRNA sequence
  source 1..20: mol_type = other DNA
ggcgtaggagccaggaaagg

SEQ ID NO: 39059 - DNA, 20 bp, synthetic construct
  misc_feature 1..20: note = CRISPR gRNA sequence
  source 1..20: mol_type = other DNA
taggagccaggaaaggaggt

SEQ ID NO: 39060 - DNA, 20 bp, synthetic construct
  misc_feature 1..20: note = CRISPR gRNA sequence
  source 1..20: mol_type = other DNA
ggagccaggaaaggaggttg

SEQ ID NO: 39061 - DNA, 20 bp, synthetic construct
  misc_feature 1..20: note = CRISPR gRNA sequence
  source 1..20: mol_type = other DNA
agccaggaaaggaggttgga

SEQ ID NO: 39062 - DNA, 20 bp, synthetic construct
  misc_feature 1..20: note = CRISPR gRNA sequence
  source 1..20: mol_type = other DNA
gccaggaaaggaggttggag

SEQ ID NO: 39063 - DNA, 20 bp, synthetic construct
  misc_feature 1..20: note = CRISPR gRNA sequence
  source 1..20: mol_type = other DNA
ccaggaaaggaggttggaga

SEQ ID NO: 39064 - DNA, 20 bp, synthetic construct
  misc_feature 1..20: note = CRISPR gRNA sequence
  source 1..20: mol_type = other DNA
ggaaaggaggttggagaggg

SEQ ID NO: 39065 - DNA, 20 bp, synthetic construct
  misc_feature 1..20: note = CRISPR gRNA sequence
  source 1..20: mol_type = other DNA
gaaaggaggttggagagggt

SEQ ID NO: 39066 - DNA, 20 bp, synthetic construct
  misc_feature 1..20: note = CRISPR gRNA sequence
  source 1..20: mol_type = other DNA
aggaggttggagagggtggg

SEQ ID NO: 39067 - DNA, 20 bp, synthetic construct
  misc_feature 1..20: note = CRISPR gRNA sequence
  source 1..20: mol_type = other DNA
ggaggttggagagggtgggc

SEQ ID NO: 39068 - DNA, 20 bp, synthetic construct
  misc_feature 1..20: note = CRISPR gRNA sequence
  source 1..20: mol_type = other DNA
gaggttggagagggtgggca

SEQ ID NO: 39069 - DNA, 20 bp, synthetic construct
  misc_feature 1..20: note = CRISPR gRNA sequence
  source 1..20: mol_type = other DNA
ggtgggcagggcctcgcctt

SEQ ID NO: 39070 - DNA, 20 bp, synthetic construct
  misc_feature 1..20: note = CRISPR gRNA sequence
  source 1..20: mol_type = other DNA
gtgggcagggcctcgccttt

SEQ ID NO: 39071 - DNA, 20 bp, synthetic construct
  misc_feature 1..20: note = CRISPR gRNA sequence
  source 1..20: mol_type = other DNA
ggcagggcctcgcctttggg

SEQ ID NO: 39072 - DNA, 20 bp, synthetic construct
  misc_feature 1..20: note = CRISPR gRNA sequence
  source 1..20: mol_type = other DNA
gcagggcctcgcctttgggt

SEQ ID NO: 39073 - DNA, 20 bp, synthetic construct
  misc_feature 1..20: note = CRISPR gRNA sequence
  source 1..20: mol_type = other DNA
gggcctcgcctttgggtggg

SEQ ID NO: 39074 - DNA, 20 bp, synthetic construct
  misc_feature 1..20: note = CRISPR gRNA sequence
  source 1..20: mol_type = other DNA
tcgcctttgggtgggtggtg

SEQ ID NO: 39075 - DNA, 20 bp, synthetic construct
  misc_feature 1..20: note = CRISPR gRNA sequence
  source 1..20: mol_type = other DNA
cgcctttgggtgggtggtgt

SEQ ID NO: 39076 - DNA, 20 bp, synthetic construct
  misc_feature 1..20: note = CRISPR gRNA sequence
  source 1..20: mol_type = other DNA
gcctttgggtgggtggtgtg

SEQ ID NO: 39077 - DNA, 20 bp, synthetic construct
  misc_feature 1..20: note = CRISPR gRNA sequence
  source 1..20: mol_type = other DNA
cctttgggtgggtggtgtgg

SEQ ID NO: 39078 - DNA, 20 bp, synthetic construct
  misc_feature 1..20: note = CRISPR gRNA sequence
  source 1..20: mol_type = other DNA
tttgggtgggtggtgtgggg

SEQ ID NO: 39079 - DNA, 20 bp, synthetic construct
  misc_feature 1..20: note = CRISPR gRNA sequence
  source 1..20: mol_type = other DNA
ttgggtgggtggtgtggggg

SEQ ID NO: 39080 - DNA, 20 bp, synthetic construct
  misc_feature 1..20: note = CRISPR gRNA sequence
  source 1..20: mol_type = other DNA
tgggtgggtggtgtggggga

SEQ ID NO: 39081 - DNA, 20 bp, synthetic construct
  misc_feature 1..20: note = CRISPR gRNA sequence
  source 1..20: mol_type = other DNA
gggtgggtggtgtgggggag

SEQ ID NO: 39082 - DNA, 20 bp, synthetic construct
  misc_feature 1..20: note = CRISPR gRNA sequence
  source 1..20: mol_type = other DNA
gaggggcatgctgcctcatg

SEQ ID NO: 39083 - DNA, 20 bp, synthetic construct
  misc_feature 1..20: note = CRISPR gRNA sequence
  source 1..20: mol_type = other DNA
atgctgcctcatgaagaatt

SEQ ID NO: 39084 - DNA, 20 bp, synthetic construct
  misc_feature 1..20: note = CRISPR gRNA sequence
  source 1..20: mol_type = other DNA
tgctgcctcatgaagaattt

SEQ ID NO: 39085 - DNA, 20 bp, synthetic construct
  misc_feature 1..20: note = CRISPR gRNA sequence
  source 1..20: mol_type = other DNA
gctgcctcatgaagaatttg

SEQ ID NO: 39086 - DNA, 20 bp, synthetic construct
  misc_feature 1..20: note = CRISPR gRNA sequence
  source 1..20: mol_type = other DNA
ctgcctcatgaagaatttgg

SEQ ID NO: 39087 - DNA, 20 bp, synthetic construct
  misc_feature 1..20: note = CRISPR gRNA sequence
  source 1..20: mol_type = other DNA
catgaagaatttgggggaat

SEQ ID NO: 39088 - DNA, 20 bp, synthetic construct
  misc_feature 1..20: note = CRISPR gRNA sequence
  source 1..20: mol_type = other DNA
ggggaatcagatcattgtaa

SEQ ID NO: 39089 - DNA, 20 bp, synthetic construct
  misc_feature 1..20: note = CRISPR gRNA sequence
  source 1..20: mol_type = other DNA
ttgtaacagctgctactatt

SEQ ID NO: 39090 - DNA, 20 bp, synthetic construct
  misc_feature 1..20: note = CRISPR gRNA sequence
  source 1..20: mol_type = other DNA
ctactattcagcacttgtcc

SEQ ID NO: 39091 - DNA, 20 bp, synthetic construct
  misc_feature 1..20: note = CRISPR gRNA sequence
  source 1..20: mol_type = other DNA
tactattcagcacttgtccc

SEQ ID NO: 39092 - DNA, 20 bp, synthetic construct
  misc_feature 1..20: note = CRISPR gRNA sequence
  source 1..20: mol_type = other DNA
attcagcacttgtcccgggt

SEQ ID NO: 39093 - DNA, 20 bp, synthetic construct
  misc_feature 1..20: note = CRISPR gRNA sequence
  source 1..20: mol_type = other DNA
ttcagcacttgtcccgggtc

SEQ ID NO: 39094 - DNA, 20 bp, synthetic construct
  misc_feature 1..20: note = CRISPR gRNA sequence
  source 1..20: mol_type = other DNA
tcccgggtcaggtgctgtgc

SEQ ID NO: 39095 - DNA, 20 bp, synthetic construct
  misc_feature 1..20: note = CRISPR gRNA sequence
  source 1..20: mol_type = other DNA
cccgggtcaggtgctgtgct

SEQ ID NO: 39096 - DNA, 20 bp, synthetic construct
  misc_feature 1..20: note = CRISPR gRNA sequence
  source 1..20: mol_type = other DNA
ccgggtcaggtgctgtgcta

SEQ ID NO: 39097 - DNA, 20 bp, synthetic construct
  misc_feature 1..20: note = CRISPR gRNA sequence
  source 1..20: mol_type = other DNA
tcctcacatctctgtgatgt

SEQ ID NO: 39098 - DNA, 20 bp, synthetic construct
  misc_feature 1..20: note = CRISPR gRNA sequence
  source 1..20: mol_type = other DNA
ctgttactgtcctcatttta

SEQ ID NO: 39099 - DNA, 20 bp, synthetic construct
  misc_feature 1..20: note = CRISPR gRNA sequence
  source 1..20: mol_type = other DNA
gttactgtcctcattttata

SEQ ID NO: 39100 - DNA, 20 bp, synthetic construct
  misc_feature 1..20: note = CRISPR gRNA sequence
  source 1..20: mol_type = other DNA
ttactgtcctcattttatag

SEQ ID NO: 39101 - DNA, 20 bp, synthetic construct
  misc_feature 1..20: note = CRISPR gRNA sequence
  source 1..20: mol_type = other DNA
actgtcctcattttatagag

SEQ ID NO: 39102 - DNA, 20 bp, synthetic construct
  misc_feature 1..20: note = CRISPR gRNA sequence
  source 1..20: mol_type = other DNA
ctgtcctcattttatagagg

SEQ ID NO: 39103 - DNA, 20 bp, synthetic construct
  misc_feature 1..20: note = CRISPR gRNA sequence
  source 1..20: mol_type = other DNA
tcctcattttatagaggagg

SEQ ID NO: 39104 - DNA, 20 bp, synthetic construct
  misc_feature 1..20: note = CRISPR gRNA sequence
  source 1..20: mol_type = other DNA
attttatagaggaggaagtt

SEQ ID NO: 39105 - DNA, 20 bp, synthetic construct
  misc_feature 1..20: note = CRISPR gRNA sequence
  source 1..20: mol_type = other DNA
tagaggaggaagttaagctg

SEQ ID NO: 39106 - DNA, 20 bp, synthetic construct
  misc_feature 1..20: note = CRISPR gRNA sequence
  source 1..20: mol_type = other DNA
ggaggaagttaagctgcaga

SEQ ID NO: 39107 - DNA, 20 bp, synthetic construct
  misc_feature 1..20: note = CRISPR gRNA sequence
  source 1..20: mol_type = other DNA
gcagaaagataaacttgctc

SEQ ID NO: 39108 - DNA, 20 bp, synthetic construct
  misc_feature 1..20: note = CRISPR gRNA sequence
  source 1..20: mol_type = other DNA
cagaaagataaacttgctca

SEQ ID NO: 39109 - DNA, 20 bp, synthetic construct
  misc_feature 1..20: note = CRISPR gRNA sequence
  source 1..20: mol_type = other DNA
taaacttgctcaaggccaca

SEQ ID NO: 39110 - DNA, 20 bp, synthetic construct
  misc_feature 1..20: note = CRISPR gRNA sequence
  source 1..20: mol_type = other DNA
aaacttgctcaaggccacac

SEQ ID NO: 39111 - DNA, 20 bp, synthetic construct
  misc_feature 1..20: note = CRISPR gRNA sequence
  source 1..20: mol_type = other DNA
cttgctcaaggccacacagg

SEQ ID NO: 39112 - DNA, 20 bp, synthetic construct
  misc_feature 1..20: note = CRISPR gRNA sequence
  source 1..20: mol_type = other DNA
ttgctcaaggccacacaggt

SEQ ID NO: 39113 - DNA, 20 bp, synthetic construct
  misc_feature 1..20: note = CRISPR gRNA sequence
  source 1..20: mol_type = other DNA
ctcaaggccacacaggtagg

SEQ ID NO: 39114 - DNA, 20 bp, synthetic construct
  misc_feature 1..20: note = CRISPR gRNA sequence
  source 1..20: mol_type = other DNA
caaggccacacaggtaggaa

SEQ ID NO: 39115 - DNA, 20 bp, synthetic construct
  misc_feature 1..20: note = CRISPR gRNA sequence
  source 1..20: mol_type = other DNA
ccacacaggtaggaagagtc

SEQ ID NO: 39116 - DNA, 20 bp, synthetic construct
  misc_feature 1..20: note = CRISPR gRNA sequence
  source 1..20: mol_type = other DNA
cacacaggtaggaagagtct

SEQ ID NO: 39117 - DNA, 20 bp, synthetic construct
  misc_feature 1..20: note = CRISPR gRNA sequence
  source 1..20: mol_type = other DNA
caggtaggaagagtctaggc

SEQ ID NO: 39118 - DNA, 20 bp, synthetic construct
  misc_feature 1..20: note = CRISPR gRNA sequence
  source 1..20: mol_type = other DNA
aggtaggaagagtctaggct

SEQ ID NO: 39119 - DNA, 20 bp, synthetic construct
  misc_feature 1..20: note = CRISPR gRNA sequence
  source 1..20: mol_type = other DNA
ggtaggaagagtctaggcta

SEQ ID NO: 39120 - DNA, 20 bp, synthetic construct
  misc_feature 1..20: note = CRISPR gRNA sequence
  source 1..20: mol_type = other DNA
aagagtctaggctagggttc

SEQ ID NO: 39121 - DNA, 20 bp, synthetic construct
  misc_feature 1..20: note = CRISPR gRNA sequence
  source 1..20: mol_type = other DNA
tctaggctagggttcaagcc

SEQ ID NO: 39122 - DNA, 20 bp, synthetic construct
  misc_feature 1..20: note = CRISPR gRNA sequence
  source 1..20: mol_type = other DNA
ggctagggttcaagcccaga

SEQ ID NO: 39123 - DNA, 20 bp, synthetic construct
  misc_feature 1..20: note = CRISPR gRNA sequence
  source 1..20: mol_type = other DNA
gggttcaagcccagacagtc

SEQ ID NO: 39124 - DNA, 20 bp, synthetic construct
  misc_feature 1..20: note = CRISPR gRNA sequence
  source 1..20: mol_type = other DNA
agcccagacagtctggctcg

SEQ ID NO: 39125 - DNA, 20 bp, synthetic construct
  misc_feature 1..20: note = CRISPR gRNA sequence
  source 1..20: mol_type = other DNA
ccactgctacctctcttgct

SEQ ID NO: 39126 - DNA, 20 bp, synthetic construct
  misc_feature 1..20: note = CRISPR gRNA sequence
  source 1..20: mol_type = other DNA
ctctcttgctgagatctgcc

SEQ ID NO: 39127 - DNA, 20 bp, synthetic construct
  misc_feature 1..20: note = CRISPR gRNA sequence
  source 1..20: mol_type = other DNA
tcttgctgagatctgccaag

SEQ ID NO: 39128 - DNA, 20 bp, synthetic construct
  misc_feature 1..20: note = CRISPR gRNA sequence
  source 1..20: mol_type = other DNA
agtagaaaccccaccacacc

SEQ ID NO: 39129 - DNA, 20 bp, synthetic construct
  misc_feature 1..20: note = CRISPR gRNA sequence
  source 1..20: mol_type = other DNA
gtagaaaccccaccacacct

SEQ ID NO: 39130 - DNA, 20 bp, synthetic construct
  misc_feature 1..20: note = CRISPR gRNA sequence
  source 1..20: mol_type = other DNA
tgggtctgccttccaaacca

SEQ ID NO: 39131 - DNA, 20 bp, synthetic construct
  misc_feature 1..20: note = CRISPR gRNA sequence
  source 1..20: mol_type = other DNA
ccttccaaaccacagtccct

SEQ ID NO: 39132 - DNA, 20 bp, synthetic construct
  misc_feature 1..20: note = CRISPR gRNA sequence
  source 1..20: mol_type = other DNA
cttccaaaccacagtccctc

SEQ ID NO: 39133 - DNA, 20 bp, synthetic construct
  misc_feature 1..20: note = CRISPR gRNA sequence
  source 1..20: mol_type = other DNA
ttccaaaccacagtccctca

SEQ ID NO: 39134 - DNA, 20 bp, synthetic construct
  misc_feature 1..20: note = CRISPR gRNA sequence
  source 1..20: mol_type = other DNA
cacccccttcatccttctcc

SEQ ID NO: 39135 - DNA, 20 bp, synthetic construct
  misc_feature 1..20: note = CRISPR gRNA sequence
  source 1..20: mol_type = other DNA
cccccttcatccttctccca

SEQ ID NO: 39136 - DNA, 20 bp, synthetic construct
  misc_feature 1..20: note = CRISPR gRNA sequence
  source 1..20: mol_type = other DNA
ccttcatccttctcccagag

SEQ ID NO: 39137 - DNA, 20 bp, synthetic construct
  misc_feature 1..20: note = CRISPR gRNA sequence
  source 1..20: mol_type = other DNA
ttcatccttctcccagagta

SEQ ID NO: 39138 - DNA, 20 bp, synthetic construct
  misc_feature 1..20: note = CRISPR gRNA sequence
  source 1..20: mol_type = other DNA
atccttctcccagagtagag

SEQ ID NO: 39139 - DNA, 20 bp, synthetic construct
  misc_feature 1..20: note = CRISPR gRNA sequence
  source 1..20: mol_type = other DNA
tccttctcccagagtagagt

SEQ ID NO: 39140 - DNA, 20 bp, synthetic construct
  misc_feature 1..20: note = CRISPR gRNA sequence
  source 1..20: mol_type = other DNA
gtgggataaccttctctttt

SEQ ID NO: 39141 - DNA, 20 bp, synthetic construct
  misc_feature 1..20: note = CRISPR gRNA sequence
  source 1..20: mol_type = other DNA
tgggataaccttctcttttc

SEQ ID NO: 39142 - DNA, 20 bp, synthetic construct
  misc_feature 1..20: note = CRISPR gRNA sequence
  source 1..20: mol_type = other DNA
ataaccttctcttttcggga

SEQ ID NO: 39143 - DNA, 20 bp, synthetic construct
  misc_feature 1..20: note = CRISPR gRNA sequence
  source 1..20: mol_type = other DNA
aaccttctcttttcgggatg

SEQ ID NO: 39144 - DNA, 20 bp, synthetic construct
  misc_feature 1..20: note = CRISPR gRNA sequence
  source 1..20: mol_type = other DNA
tcgggatggagaaattccca

SEQ ID NO: 39145 - DNA, 20 bp, synthetic construct
  misc_feature 1..20: note = CRISPR gRNA sequence
  source 1..20: mol_type = other DNA
ggagaaattcccatggcgtc

SEQ ID NO: 39146 - DNA, 20 bp, synthetic construct
  misc_feature 1..20: note = CRISPR gRNA sequence
  source 1..20: mol_type = other DNA
ttcccatggcgtccagcccc

SEQ ID NO: 39147 - DNA, 20 bp, synthetic construct
  misc_feature 1..20: note = CRISPR gRNA sequence
  source 1..20: mol_type = other DNA
tggcgtccagcccctggctg

SEQ ID NO: 39148 - DNA, 20 bp, synthetic construct
  misc_feature 1..20: note = CRISPR gRNA sequence
  source 1..20: mol_type = other DNA
agcccctggctgaagccaat

SEQ ID NO: 39149 - DNA, 20 bp, synthetic construct
  misc_feature 1..20: note = CRISPR gRNA sequence
  source 1..20: mol_type = other DNA
cccctggctgaagccaataa

SEQ ID NO: 39150 - DNA, 20 bp, synthetic construct
  misc_feature 1..20: note = CRISPR gRNA sequence
  source 1..20: mol_type = other DNA
ctggctgaagccaataagag

SEQ ID NO: 39151 - DNA, 20 bp, synthetic construct
  misc_feature 1..20: note = CRISPR gRNA sequence
  source 1..20: mol_type = other DNA
aagccaataagagtagtgct

SEQ ID NO: 39152 - DNA, 20 bp, synthetic construct
  misc_feature 1..20: note = CRISPR gRNA sequence
  source 1..20: mol_type = other DNA
agccaataagagtagtgctt

SEQ ID NO: 39153 - DNA, 20 bp, synthetic construct
  misc_feature 1..20: note = CRISPR gRNA sequence
  source 1..20: mol_type = other DNA
gccaataagagtagtgcttg

SEQ ID NO: 39154 - DNA, 20 bp, synthetic construct
  misc_feature 1..20: note = CRISPR gRNA sequence
  source 1..20: mol_type = other DNA
ataagagtagtgcttgggga

SEQ ID NO: 39155 - DNA, 20 bp, synthetic construct
  misc_feature 1..20: note = CRISPR gRNA sequence
  source 1..20: mol_type = other DNA
gagtagtgcttggggatgga

SEQ ID NO: 39156 - DNA, 20 bp, synthetic construct
  misc_feature 1..20: note = CRISPR gRNA sequence
  source 1..20: mol_type = other DNA
gtagtgcttggggatggacg

SEQ ID NO: 39157 - DNA, 20 bp, synthetic construct
  misc_feature 1..20: note = CRISPR gRNA sequence
  source 1..20: mol_type = other DNA
tagtgcttggggatggacgg

SEQ ID NO: 39158 - DNA, 20 bp, synthetic construct
  misc_feature 1..20: note = CRISPR gRNA sequence
  source 1..20: mol_type = other DNA
cggaggctctgtcacgaccc

SEQ ID NO: 39159 - DNA, 20 bp, synthetic construct
  misc_feature 1..20: note = CRISPR gRNA sequence
  source 1..20: mol_type = other DNA
ggaggctctgtcacgaccct

SEQ ID NO: 39160 - DNA, 20 bp, synthetic construct
  misc_feature 1..20: note = CRISPR gRNA sequence
  source 1..20: mol_type = other DNA
aggctctgtcacgaccctag

SEQ ID NO: 39161 - DNA, 20 bp, synthetic construct
  misc_feature 1..20: note = CRISPR gRNA sequence
  source 1..20: mol_type = other DNA
ggctctgtcacgaccctagg

SEQ ID NO: 39162 - DNA, 20 bp, synthetic construct
  misc_feature 1..20: note = CRISPR gRNA sequence
  source 1..20: mol_type = other DNA
gctctgtcacgaccctagga

SEQ ID NO: 39163 - DNA, 20 bp, synthetic construct
  misc_feature 1..20: note = CRISPR gRNA sequence
  source 1..20: mol_type = other DNA
ctctgtcacgaccctaggag

SEQ ID NO: 39164 - DNA, 20 bp, synthetic construct
  misc_feature 1..20: note = CRISPR gRNA sequence
  source 1..20: mol_type = other DNA
ccctaggaggggcgcccctc

SEQ ID NO: 39165 - DNA, 20 bp, synthetic construct
  misc_feature 1..20: note = CRISPR gRNA sequence
  source 1..20: mol_type = other DNA
cctaggaggggcgcccctcc

SEQ ID NO: 39166 - DNA, 20 bp, synthetic construct
  misc_feature 1..20: note = CRISPR gRNA sequence
  source 1..20: mol_type = other DNA
cgcccctccaggaaacctcc

SEQ ID NO: 39167 - DNA, 20 bp, synthetic construct
  misc_feature 1..20: note = CRISPR gRNA sequence
  source 1..20: mol_type = other DNA
gaaacctccaagtgaacatg

SEQ ID NO: 39168 - DNA, 20 bp, synthetic construct
  misc_feature 1..20: note = CRISPR gRNA sequence
  source 1..20: mol_type = other DNA
aaacctccaagtgaacatga

SEQ ID NO: 39169 - DNA, 20 bp, synthetic construct
  misc_feature 1..20: note = CRISPR gRNA sequence
  source 1..20: mol_type = other DNA
cctccaagtgaacatgaagg

SEQ ID NO: 39170 - DNA, 20 bp, synthetic construct
  misc_feature 1..20: note = CRISPR gRNA sequence
  source 1..20: mol_type = other DNA
gtgaacatgaaggcagatga

SEQ ID NO: 39171 - DNA, 20 bp, synthetic construct
  misc_feature 1..20: note = CRISPR gRNA sequence
  source 1..20: mol_type = other DNA
gaaggcagatgatggaacgc

SEQ ID NO: 39172 - DNA, 20 bp, synthetic construct
  misc_feature 1..20: note = CRISPR gRNA sequence
  source 1..20: mol_type = other DNA
aaggcagatgatggaacgcc

SEQ ID NO: 39173 - DNA, 20 bp, synthetic construct
  misc_feature 1..20: note = CRISPR gRNA sequence
  source 1..20: mol_type = other DNA
tggaacgccaggatgtgttc

SEQ ID NO: 39174 - DNA, 20 bp, synthetic construct
  misc_feature 1..20: note = CRISPR gRNA sequence
  source 1..20: mol_type = other DNA
ggaacgccaggatgtgttct

SEQ ID NO: 39175 - DNA, 20 bp, synthetic construct
  misc_feature 1..20: note = CRISPR gRNA sequence
  source 1..20: mol_type = other DNA
gccaggatgtgttctgggtc

SEQ ID NO: 39176 - DNA, 20 bp, synthetic construct
  misc_feature 1..20: note = CRISPR gRNA sequence
  source 1..20: mol_type = other DNA
aggatgtgttctgggtcgag

SEQ ID NO: 39177 - DNA, 20 bp, synthetic construct
  misc_feature 1..20: note = CRISPR gRNA sequence
  source 1..20: mol_type = other DNA
tgggtcgagtggccccacct

SEQ ID NO: 39178 - DNA, 20 bp, synthetic construct
  misc_feature 1..20: note = CRISPR gRNA sequence
  source 1..20: mol_type = other DNA
gggtcgagtggccccacctc

SEQ ID NO: 39179 - DNA, 20 bp, synthetic construct
  misc_feature 1..20: note = CRISPR gRNA sequence
  source 1..20: mol_type = other DNA
ggtcgagtggccccacctca

SEQ ID NO: 39180 - DNA, 20 bp, synthetic construct
  misc_feature 1..20: note = CRISPR gRNA sequence
  source 1..20: mol_type = other DNA
gagtggccccacctcagggt

SEQ ID NO: 39181 - DNA, 20 bp, synthetic construct
  misc_feature 1..20: note = CRISPR gRNA sequence
  source 1..20: mol_type = other DNA
ggccccacctcagggtaaga

SEQ ID NO: 39182 - DNA, 20 bp, synthetic construct
  misc_feature 1..20: note = CRISPR gRNA sequence
  source 1..20: mol_type = other DNA
ccacctcagggtaagacgga

SEQ ID NO: 39183 - DNA, 20 bp, synthetic construct
  misc_feature 1..20: note = CRISPR gRNA sequence
  source 1..20: mol_type = other DNA
cacctcagggtaagacggat

SEQ ID NO: 39184 - DNA, 20 bp, synthetic construct
  misc_feature 1..20: note = CRISPR gRNA sequence
  source 1..20: mol_type = other DNA
acctcagggtaagacggata

SEQ ID NO: 39185 - DNA, 20 bp, synthetic construct
  misc_feature 1..20: note = CRISPR gRNA sequence
  source 1..20: mol_type = other DNA
cctcagggtaagacggatag

SEQ ID NO: 39186 - DNA, 20 bp, synthetic construct
  misc_feature 1..20: note = CRISPR gRNA sequence
  source 1..20: mol_type = other DNA
agggtaagacggataggggt

SEQ ID NO: 39187 - DNA, 20 bp, synthetic construct
  misc_feature 1..20: note = CRISPR gRNA sequence
  source 1..20: mol_type = other DNA
gggtaagacggataggggtg

SEQ ID NO: 39188 - DNA, 20 bp, synthetic construct
  misc_feature 1..20: note = CRISPR gRNA sequence
  source 1..20: mol_type = other DNA
ggtaagacggataggggtga

SEQ ID NO: 39189 - DNA, 20 bp, synthetic construct
  misc_feature 1..20: note = CRISPR gRNA sequence
  source 1..20: mol_type = other DNA
gataggggtgagggttgtcg

SEQ ID NO: 39190 - DNA, 20 bp, synthetic construct
  misc_feature 1..20: note = CRISPR gRNA sequence
  source 1..20: mol_type = other DNA
tggtgatcacctcttgatcc

SEQ ID NO: 39191 - DNA, 20 bp, synthetic construct
  misc_feature 1..20: note = CRISPR gRNA sequence
  source 1..20: mol_type = other DNA
gatcctggacctcgtcccat

SEQ ID NO: 39192 - DNA, 20 bp, synthetic construct
  misc_feature 1..20: note = CRISPR gRNA sequence
  source 1..20: mol_type = other DNA
atcctggacctcgtcccatt

SEQ ID NO: 39193 - DNA, 20 bp, synthetic construct
  misc_feature 1..20: note = CRISPR gRNA sequence
  source 1..20: mol_type = other DNA
cctggacctcgtcccattgg

SEQ ID NO: 39194 - DNA, 20 bp, synthetic construct
  misc_feature 1..20: note = CRISPR gRNA sequence
  source 1..20: mol_type = other DNA
cctcgtcccattgggagaac

SEQ ID NO: 39195 - DNA, 20 bp, synthetic construct
  misc_feature 1..20: note = CRISPR gRNA sequence
  source 1..20: mol_type = other DNA
ctcgtcccattgggagaacc

SEQ ID NO: 39196 - DNA, 20 bp, synthetic construct
  misc_feature 1..20: note = CRISPR gRNA sequence
  source 1..20: mol_type = other DNA
tcccattgggagaaccagga

SEQ ID NO: 39197 - DNA, 20 bp, synthetic construct
  misc_feature 1..20: note = CRISPR gRNA sequence
  source 1..20: mol_type = other DNA
tgggagaaccaggacagaat

SEQ ID NO: 39198 - DNA, 20 bp, synthetic construct
  misc_feature 1..20: note = CRISPR gRNA sequence
  source 1..20: mol_type = other DNA
gagaaccaggacagaattag

SEQ ID NO: 39199 - DNA, 20 bp, synthetic construct
  misc_feature 1..20: note = CRISPR gRNA sequence
  source 1..20: mol_type = other DNA
agaaccaggacagaattaga

SEQ ID NO: 39200 - DNA, 20 bp, synthetic construct
  misc_feature 1..20: note = CRISPR gRNA sequence
  source 1..20: mol_type = other DNA
accaggacagaattagaagg

SEQ ID NO: 39201 - DNA, 20 bp, synthetic construct
  misc_feature 1..20: note = CRISPR gRNA sequence
  source 1..20: mol_type = other DNA
ttagaaggtggttttttaac

SEQ ID NO: 39202 - DNA, 20 bp, synthetic construct
  misc_feature 1..20: note = CRISPR gRNA sequence
  source 1..20: mol_type = other DNA
cacacttctacctgcctcac

SEQ ID NO: 39203 - DNA, 20 bp, synthetic construct
  misc_feature 1..20: note = CRISPR gRNA sequence
  source 1..20: mol_type = other DNA
ctacctgcctcaccagcact

SEQ ID NO: 39204 - DNA, 20 bp, synthetic construct
  misc_feature 1..20: note = CRISPR gRNA sequence
  source 1..20: mol_type = other DNA
cactgagcatgcccctcccc

SEQ ID NO: 39205 - DNA, 20 bp, synthetic construct
  misc_feature 1..20: note = CRISPR gRNA sequence
  source 1..20: mol_type = other DNA
tccccgagtgccatcacctg

SEQ ID NO: 39206 - DNA, 20 bp, synthetic construct
  misc_feature 1..20: note = CRISPR gRNA sequence
  source 1..20: mol_type = other DNA
ccgagtgccatcacctgcag

SEQ ID NO: 39207 - DNA, 20 bp, synthetic construct
  misc_feature 1..20: note = CRISPR gRNA sequence
  source 1..20: mol_type = other DNA
agtgccatcacctgcagaag

SEQ ID NO: 39208 - DNA, 20 bp, synthetic construct
  misc_feature 1..20: note = CRISPR gRNA sequence
  source 1..20: mol_type = other DNA
aagcagccccatcacccgcc

SEQ ID NO: 39209 - DNA, 20 bp, synthetic construct
  misc_feature 1..20: note = CRISPR gRNA sequence
  source 1..20: mol_type = other DNA
ccatcacccgcctggttacg

SEQ ID NO: 39210 - DNA, 20 bp, synthetic construct
  misc_feature 1..20: note = CRISPR gRNA sequence
  source 1..20: mol_type = other DNA
ctggttacgcagccacctcc

SEQ ID NO: 39211 - DNA, 20 bp, synthetic construct
  misc_feature 1..20: note = CRISPR gRNA sequence
  source 1..20: mol_type = other DNA
ccttgcccttctcccacatt

SEQ ID NO: 39212 - DNA, 20 bp, synthetic construct
  misc_feature 1..20: note = CRISPR gRNA sequence
  source 1..20: mol_type = other DNA
tctcccacatttagtccctc

SEQ ID NO: 39213 - DNA, 20 bp, synthetic construct
  misc_feature 1..20: note = CRISPR gRNA sequence
  source 1..20: mol_type = other DNA
ccacatttagtccctccaga

SEQ ID NO: 39214 - DNA, 20 bp, synthetic construct
  misc_feature 1..20: note = CRISPR gRNA sequence
  source 1..20: mol_type = other DNA
gtccctccagatggacctac

SEQ ID NO: 39215 - DNA, 20 bp, synthetic construct
  misc_feature 1..20: note = CRISPR gRNA sequence
  source 1..20: mol_type = other DNA
cctccagatggacctactgg

SEQ ID NO: 39216 - DNA, 20 bp, synthetic construct
  misc_feature 1..20: note = CRISPR gRNA sequence
  source 1..20: mol_type = other DNA
cctcttttcctccacctttc

SEQ ID NO: 39217 - DNA, 20 bp, synthetic construct
  misc_feature 1..20: note = CRISPR gRNA sequence
  source 1..20: mol_type = other DNA
acccaccctcatctcttacc

SEQ ID NO: 39218 - DNA, 20 bp, synthetic construct
  misc_feature 1..20: note = CRISPR gRNA sequence
  source 1..20: mol_type = other DNA
cctcgccttgccttccttgc

SEQ ID NO: 39219 - DNA, 20 bp, synthetic construct
  misc_feature 1..20: note = CRISPR gRNA sequence
  source 1..20: mol_type = other DNA
tggcttccctgctttcaccc

SEQ ID NO: 39220 - DNA, 20 bp, synthetic construct
  misc_feature 1..20: note = CRISPR gRNA sequence
  source 1..20: mol_type = other DNA
tcaccctggccacttccacc

SEQ ID NO: 39221 - DNA, 20 bp, synthetic construct
  misc_feature 1..20: note = CRISPR gRNA sequence
  source 1..20: mol_type = other DNA
ccctggccacttccacctgg

SEQ ID NO: 39222 - DNA, 20 bp, synthetic construct
  misc_feature 1..20: note = CRISPR gRNA sequence
  source 1..20: mol_type = other DNA
ctggccacttccacctggca

SEQ ID NO: 39223 - DNA, 20 bp, synthetic construct
  misc_feature 1..20: note = CRISPR gRNA sequence
  source 1..20: mol_type = other DNA
ggccacttccacctggcaga

SEQ ID NO: 39224 - DNA, 20 bp, synthetic construct
  misc_feature 1..20: note = CRISPR gRNA sequence
  source 1..20: mol_type = other DNA
cacttccacctggcagagag

SEQ ID NO: 39225 - DNA, 20 bp, synthetic construct
  misc_feature 1..20: note = CRISPR gRNA sequence
  source 1..20: mol_type = other DNA
cttcactccttcccactgct

SEQ ID NO: 39226 - DNA, 20 bp, synthetic construct
  misc_feature 1..20: note = CRISPR gRNA sequence
  source 1..20: mol_type = other DNA
ttcactccttcccactgctc

SEQ ID NO: 39227 - DNA, 20 bp, synthetic construct
  misc_feature 1..20: note = CRISPR gRNA sequence
  source 1..20: mol_type = other DNA
aaacccacattctaaactcc

SEQ ID NO: 39228 - DNA, 20 bp, synthetic construct
  misc_feature 1..20: note = CRISPR gRNA sequence
  source 1..20: mol_type = other DNA
aacccacattctaaactccc

SEQ ID NO: 39229 - DNA, 20 bp, synthetic construct
  misc_feature 1..20: note = CRISPR gRNA sequence
  source 1..20: mol_type = other DNA
ccacattctaaactcccagg

SEQ ID NO: 39230 - DNA, 20 bp, synthetic construct
  misc_feature 1..20: note = CRISPR gRNA sequence
  source 1..20: mol_type = other DNA
ttctaaactcccaggtggtc

SEQ ID NO: 39231 - DNA, 20 bp, synthetic construct
  misc_feature 1..20: note = CRISPR gRNA sequence
  source 1..20: mol_type = other DNA
gtggtccagaaccctgcccc

SEQ ID NO: 39232 - DNA, 20 bp, synthetic construct
  misc_feature 1..20: note = CRISPR gRNA sequence
  source 1..20: mol_type = other DNA
cttccactcaatctccaatc

SEQ ID NO: 39233 - DNA, 20 bp, synthetic construct
  misc_feature 1..20: note = CRISPR gRNA sequence
  source 1..20: mol_type = other DNA
aatctccaatccagacacac

SEQ ID NO: 39234 - DNA, 20 bp, synthetic construct
  misc_feature 1..20: note = CRISPR gRNA sequence
  source 1..20: mol_type = other DNA
cagacacactggctctcttt

SEQ ID NO: 39235 - DNA, 20 bp, synthetic construct
  misc_feature 1..20: note = CRISPR gRNA sequence
  source 1..20: mol_type = other DNA
agacacactggctctctttc

SEQ ID NO: 39236 - DNA, 20 bp, synthetic construct
  misc_feature 1..20: note = CRISPR gRNA sequence
  source 1..20: mol_type = other DNA
tcctcatatgtgttatgcca

SEQ ID NO: 39237 - DNA, 20 bp, synthetic construct
  misc_feature 1..20: note = CRISPR gRNA sequence
  source 1..20: mol_type = other DNA
cctcatatgtgttatgccac

SEQ ID NO: 39238 - DNA, 20 bp, synthetic construct
  misc_feature 1..20: note = CRISPR gRNA sequence
  source 1..20: mol_type = other DNA
ctcatatgtgttatgccaca

SEQ ID NO: 39239 - DNA, 20 bp, synthetic construct
  misc_feature 1..20: note = CRISPR gRNA sequence
  source 1..20: mol_type = other DNA
gaatgtactgcttctaccac

SEQ ID NO: 39240 - DNA, 20 bp, synthetic construct
  misc_feature 1..20: note = CRISPR gRNA sequence
  source 1..20: mol_type = other DNA
aatgtactgcttctaccacc

SEQ ID NO: 39241 - DNA, 20 bp, synthetic construct
  misc_feature 1..20: note = CRISPR gRNA sequence
  source 1..20: mol_type = other DNA
ccttttacctactgaactcc

SEQ ID NO: 39242 - DNA, 20 bp, synthetic construct
  misc_feature 1..20: note = CRISPR gRNA sequence
  source 1..20: mol_type = other DNA
tactgaactcccagttattt

SEQ ID NO: 39243 - DNA, 20 bp, synthetic construct
  misc_feature 1..20: note = CRISPR gRNA sequence
  source 1..20: mol_type = other DNA
gaactcccagttatttcagc

SEQ ID NO: 39244 - DNA, 20 bp, synthetic construct
  misc_feature 1..20: note = CRISPR gRNA sequence
  source 1..20: mol_type = other DNA
ctcccagttatttcagcaag

SEQ ID NO: 39245 - DNA, 20 bp, synthetic construct
  misc_feature 1..20: note = CRISPR gRNA sequence
  source 1..20: mol_type = other DNA
gttatttcagcaagtagctt

SEQ ID NO: 39246 - DNA, 20 bp, synthetic construct
  misc_feature 1..20: note = CRISPR gRNA sequence
  source 1..20: mol_type = other DNA
aagtagcttaagcaacaaat

SEQ ID NO: 39247 - DNA, 20 bp, synthetic construct
  misc_feature 1..20: note = CRISPR gRNA sequence
  source 1..20: mol_type = other DNA
aataagccatccccgactcc

SEQ ID NO: 39248 - DNA, 20 bp, synthetic construct
  misc_feature 1..20: note = CRISPR gRNA sequence
  source 1..20: mol_type = other DNA
gccatccccgactcccagac

SEQ ID NO: 39249 - DNA, 20 bp, synthetic construct
  misc_feature 1..20: note = CRISPR gRNA sequence
  source 1..20: mol_type = other DNA
ccatccccgactcccagact

SEQ ID NO: 39250 - DNA, 20 bp, synthetic construct
  misc_feature 1..20: note = CRISPR gRNA sequence
  source 1..20: mol_type = other DNA
ccccgactcccagactaggt

SEQ ID NO: 39251 - DNA, 20 bp, synthetic construct
  misc_feature 1..20: note = CRISPR gRNA sequence
  source 1..20: mol_type = other DNA
cagatgcccccataatcatg

SEQ ID NO: 39252 - DNA, 20 bp, synthetic construct
  misc_feature 1..20: note = CRISPR gRNA sequence
  source 1..20: mol_type = other DNA
atcatgaagtttatcacaaa

SEQ ID NO: 39253 - DNA, 20 bp, synthetic construct
  misc_feature 1..20: note = CRISPR gRNA sequence
  source 1..20: mol_type = other DNA
aaaagcaattatgtaacttg

SEQ ID NO: 39254 - DNA, 20 bp, synthetic construct
  misc_feature 1..20: note = CRISPR gRNA sequence
  source 1..20: mol_type = other DNA
attatgtaacttgcagcata

SEQ ID NO: 39255 - DNA, 20 bp, synthetic construct
  misc_feature 1..20: note = CRISPR gRNA sequence
  source 1..20: mol_type = other DNA
ttatgtaacttgcagcataa

SEQ ID NO: 39256 - DNA, 20 bp, synthetic construct
  misc_feature 1..20: note = CRISPR gRNA sequence
  source 1..20: mol_type = other DNA
tgtaacttgcagcataaagg

SEQ ID NO: 39257 - DNA, 20 bp, synthetic construct
  misc_feature 1..20: note = CRISPR gRNA sequence
  source 1..20: mol_type = other DNA
taacttgcagcataaaggaa

SEQ ID NO: 39258 - DNA, 20 bp, synthetic construct
  misc_feature 1..20: note = CRISPR gRNA sequence
  source 1..20: mol_type = other DNA
tgcagcataaaggaagagtt

SEQ ID NO: 39259 - DNA, 20 bp, synthetic construct
  misc_feature 1..20: note = CRISPR gRNA sequence
  source 1..20: mol_type = other DNA
gcagcataaaggaagagttg

SEQ ID NO: 39260 - DNA, 20 bp, synthetic construct
  misc_feature 1..20: note = CRISPR gRNA sequence
  source 1..20: mol_type = other DNA
cagcataaaggaagagttga

SEQ ID NO: 39261 - DNA, 20 bp, synthetic construct
  misc_feature 1..20: note = CRISPR gRNA sequence
  source 1..20: mol_type = other DNA
cataaaggaagagttgaggg

SEQ ID NO: 39262 - DNA, 20 bp, synthetic construct
  misc_feature 1..20: note = CRISPR gRNA sequence
  source 1..20: mol_type = other DNA
ataaaggaagagttgagggt

SEQ ID NO: 39263 - DNA, 20 bp, synthetic construct
  misc_feature 1..20: note = CRISPR gRNA sequence
  source 1..20: mol_type = other DNA
taaaggaagagttgagggtg

SEQ ID NO: 39264 - DNA, 20 bp, synthetic construct
  misc_feature 1..20: note = CRISPR gRNA sequence
  source 1..20: mol_type = other DNA
gagttgagggtggggccttg

SEQ ID NO: 39265 - DNA, 20 bp, synthetic construct
  misc_feature 1..20: note = CRISPR gRNA sequence
  source 1..20: mol_type = other DNA
agttgagggtggggccttga

SEQ ID NO: 39266 - DNA, 20 bp, synthetic construct
  misc_feature 1..20: note = CRISPR gRNA sequence
  source 1..20: mol_type = other DNA
tgagggtggggccttgaagg

SEQ ID NO: 39267 - DNA, 20 bp, synthetic construct
  misc_feature 1..20: note = CRISPR gRNA sequence
  source 1..20: mol_type = other DNA
gagggtggggccttgaaggc

SEQ ID NO: 39268 - DNA, 20 bp, synthetic construct
  misc_feature 1..20: note = CRISPR gRNA sequence
  source 1..20: mol_type = other DNA
ggccttgaaggcaggctgcc

SEQ ID NO: 39269 - DNA, 20 bp, synthetic construct
  misc_feature 1..20: note = CRISPR gRNA sequence
  source 1..20: mol_type = other DNA
gccttgaaggcaggctgcct

SEQ ID NO: 39270 - DNA, 20 bp, synthetic construct
  misc_feature 1..20: note = CRISPR gRNA sequence
  source 1..20: mol_type = other DNA
aggctgcctgggttcaaatc

SEQ ID NO: 39271 - DNA, 20 bp, synthetic construct
  misc_feature 1..20: note = CRISPR gRNA sequence
  source 1..20: mol_type = other DNA
ggctgcctgggttcaaatcc

SEQ ID NO: 39272 - DNA, 20 bp, synthetic construct
  misc_feature 1..20: note = CRISPR gRNA sequence
  source 1..20: mol_type = other DNA
tcaaatccaggttctccctc

SEQ ID NO: 39273 - DNA, 20 bp, synthetic construct
  misc_feature 1..20: note = CRISPR gRNA sequence
  source 1..20: mol_type = other DNA
atccaggttctccctcgagc

SEQ ID NO: 39274 - DNA, 20 bp, synthetic construct
  misc_feature 1..20: note = CRISPR gRNA sequence
  source 1..20: mol_type = other DNA
cacttaaccactctgcactt

SEQ ID NO: 39275 - DNA, 20 bp, synthetic construct
  misc_feature 1..20: note = CRISPR gRNA sequence
  source 1..20: mol_type = other DNA
ctgcacttgagtttactcat

SEQ ID NO: 39276 - DNA, 20 bp, synthetic construct
  misc_feature 1..20: note = CRISPR gRNA sequence
  source 1..20: mol_type = other DNA
acttgagtttactcatcagt

SEQ ID NO: 39277 - DNA, 20 bp, synthetic construct
  misc_feature 1..20: note = CRISPR gRNA sequence
  source 1..20: mol_type = other DNA
cttgagtttactcatcagta

SEQ ID NO: 39278 - DNA, 20 bp, synthetic construct
  misc_feature 1..20: note = CRISPR gRNA sequence
  source 1..20: mol_type = other DNA
agtttactcatcagtaaggt

SEQ ID NO: 39279 - DNA, 20 bp, synthetic construct
  misc_feature 1..20: note = CRISPR gRNA sequence
  source 1..20: mol_type = other DNA
gtttactcatcagtaaggtg

SEQ ID NO: 39280 - DNA, 20 bp, synthetic construct
  misc_feature 1..20: note = CRISPR gRNA sequence
  source 1..20: mol_type = other DNA
cagtaaggtgaggataatta

SEQ ID NO: 39281 - DNA, 20 bp, synthetic construct
  misc_feature 1..20: note = CRISPR gRNA sequence
  source 1..20: mol_type = other DNA
aattacagtgcccacgtcat

SEQ ID NO: 39282 - DNA, 20 bp, synthetic construct
  misc_feature 1..20: note = CRISPR gRNA sequence
  source 1..20: mol_type = other DNA
gcccacgtcatcggcactat

SEQ ID NO: 39283 - DNA, 20 bp, synthetic construct
  misc_feature 1..20: note = CRISPR gRNA sequence
  source 1..20: mol_type = other DNA
cccacgtcatcggcactatg

SEQ ID NO: 39284 - DNA, 20 bp, synthetic construct
  misc_feature 1..20: note = CRISPR gRNA sequence
  source 1..20: mol_type = other DNA
tcggcactatgaggatgaaa

SEQ ID NO: 39285 - DNA, 20 bp, synthetic construct
  misc_feature 1..20: note = CRISPR gRNA sequence
  source 1..20: mol_type = other DNA
cggcactatgaggatgaaat

SEQ ID NO: 39286 - DNA, 20 bp, synthetic construct
  misc_feature 1..20: note = CRISPR gRNA sequence
  source 1..20: mol_type = other DNA
atgaggatgaaataggccaa

SEQ ID NO: 39287 - DNA, 20 bp, synthetic construct
  misc_feature 1..20: note = CRISPR gRNA sequence
  source 1..20: mol_type = other DNA
atgaaataggccaatagtca

SEQ ID NO: 39288 - DNA, 20 bp, synthetic construct
  misc_feature 1..20: note = CRISPR gRNA sequence
  source 1..20: mol_type = other DNA
aaataggccaatagtcatag

SEQ ID NO: 39289 - DNA, 20 bp, synthetic construct
  misc_feature 1..20: note = CRISPR gRNA sequence
  source 1..20: mol_type = other DNA
ccaatagtcatagaagaacc

SEQ ID NO: 39290 - DNA, 20 bp, synthetic construct
  misc_feature 1..20: note = CRISPR gRNA sequence
  source 1..20: mol_type = other DNA
caatagtcatagaagaacct

SEQ ID NO: 39291 - DNA, 20 bp, synthetic construct
  misc_feature 1..20: note = CRISPR gRNA sequence
  source 1..20: mol_type = other DNA
agaagaacctaggatgttgc

SEQ ID NO: 39292 - DNA, 20 bp, synthetic construct
  misc_feature 1..20: note = CRISPR gRNA sequence
  source 1..20: mol_type = other DNA
gaagaacctaggatgttgcc

SEQ ID NO: 39293 - DNA, 20 bp, synthetic construct
  misc_feature 1..20: note = CRISPR gRNA sequence
  source 1..20: mol_type = other DNA
ctaggatgttgccaggcatg

SEQ ID NO: 39294 - DNA, 20 bp, synthetic construct
  misc_feature 1..20: note = CRISPR gRNA sequence
  source 1..20: mol_type = other DNA
atgttgccaggcatgtggta

SEQ ID NO: 39295 - DNA, 20 bp, synthetic construct
  misc_feature 1..20: note = CRISPR gRNA sequence
  source 1..20: mol_type = other DNA
gttgccaggcatgtggtatg

SEQ ID NO: 39296 - DNA, 20 bp, synthetic construct
  misc_feature 1..20: note = CRISPR gRNA sequence
  source 1..20: mol_type = other DNA
ggtatggagtctgtcgattt

SEQ ID NO: 39297 - DNA, 20 bp, synthetic construct
  misc_feature 1..20: note = CRISPR gRNA sequence
  source 1..20: mol_type = other DNA
tgtcgatttcagttattatc

SEQ ID NO: 39298 - DNA, 20 bp, synthetic construct
  misc_feature 1..20: note = CRISPR gRNA sequence
  source 1..20: mol_type = other DNA
gtcgatttcagttattatca

SEQ ID NO: 39299 - DNA, 20 bp, synthetic construct
  misc_feature 1..20: note = CRISPR gRNA sequence
  source 1..20: mol_type = other DNA
tattatcaaggttcattcct

SEQ ID NO: 39300 - DNA, 20 bp, synthetic construct
  misc_feature 1..20: note = CRISPR gRNA sequence
  source 1..20: mol_type = other DNA
ttatcaaggttcattcctga

SEQ ID NO: 39301 - DNA, 20 bp, synthetic construct
  misc_feature 1..20: note = CRISPR gRNA sequence
  source 1..20: mol_type = other DNA
tgagagtgacactttgacta

SEQ ID NO: 39302 - DNA, 20 bp, synthetic construct
  misc_feature 1..20: note = CRISPR gRNA sequence
  source 1..20: mol_type = other DNA
agtgacactttgactaaagt

SEQ ID NO: 39303 - DNA, 20 bp, synthetic construct
  misc_feature 1..20: note = CRISPR gRNA sequence
  source 1..20: mol_type = other DNA
cactttgactaaagttagca

SEQ ID NO: 39304 - DNA, 20 bp, synthetic construct
  misc_feature 1..20: note = CRISPR gRNA sequence
  source 1..20: mol_type = other DNA
actttgactaaagttagcaa

SEQ ID NO: 39305 - DNA, 20 bp, synthetic construct
  misc_feature 1..20: note = CRISPR gRNA sequence
  source 1..20: mol_type = other DNA
tttgactaaagttagcaaag

SEQ ID NO: 39306 - DNA, 20 bp, synthetic construct
  misc_feature 1..20: note = CRISPR gRNA sequence
  source 1..20: mol_type = other DNA
ttgactaaagttagcaaagg

SEQ ID NO: 39307 - DNA, 20 bp, synthetic construct
  misc_feature 1..20: note = CRISPR gRNA sequence
  source 1..20: mol_type = other DNA
gactaaagttagcaaaggag

SEQ ID NO: 39308 - DNA, 20 bp, synthetic construct
  misc_feature 1..20: note = CRISPR gRNA sequence
  source 1..20: mol_type = other DNA
aaagttagcaaaggaggagt

SEQ ID NO: 39309 - DNA, 20 bp, synthetic construct
  misc_feature 1..20: note = CRISPR gRNA sequence
  source 1..20: mol_type = other DNA
agcaaaggaggagtaagtga

SEQ ID NO: 39310 - DNA, 20 bp, synthetic construct
  misc_feature 1..20: note = CRISPR gRNA sequence
  source 1..20: mol_type = other DNA
gcaaaggaggagtaagtgat

SEQ ID NO: 39311 - DNA, 20 bp, synthetic construct
  misc_feature 1..20: note = CRISPR gRNA sequence
  source 1..20: mol_type = other DNA
caaaggaggagtaagtgatg

SEQ ID NO: 39312 - DNA, 20 bp, synthetic construct
  misc_feature 1..20: note = CRISPR gRNA sequence
  source 1..20: mol_type = other DNA
aggagtaagtgatggggatt

SEQ ID NO: 39313 - DNA, 20 bp, synthetic construct
  misc_feature 1..20: note = CRISPR gRNA sequence
  source 1..20: mol_type = other DNA
ggagtaagtgatggggattg

SEQ ID NO: 39314 - DNA, 20 bp, synthetic construct
  misc_feature 1..20: note = CRISPR gRNA sequence
  source 1..20: mol_type = other DNA
gagtaagtgatggggattga

SEQ ID NO: 39315 - DNA, 20 bp, synthetic construct
  misc_feature 1..20: note = CRISPR gRNA sequence
  source 1..20: mol_type = other DNA
gtaagtgatggggattgagg

SEQ ID NO: 39316 - DNA, 20 bp, synthetic construct
  misc_feature 1..20: note = CRISPR gRNA sequence
  source 1..20: mol_type = other DNA
taagtgatggggattgaggg

SEQ ID NO: 39317 - DNA, 20 bp, synthetic construct
  misc_feature 1..20: note = CRISPR gRNA sequence
  source 1..20: mol_type = other DNA
tggggattgagggaggactc

SEQ ID NO: 39318 - DNA, 20 bp, synthetic construct
  misc_feature 1..20: note = CRISPR gRNA sequence
  source 1..20: mol_type = other DNA
aggactccagccccacaata

SEQ ID NO: 39319 - DNA, 20 bp, synthetic construct
  misc_feature 1..20: note = CRISPR gRNA sequence
  source 1..20: mol_type = other DNA
agccccacaatacagtgcat

SEQ ID NO: 39320 - DNA, 20 bp, synthetic construct
  misc_feature 1..20: note = CRISPR gRNA sequence
  source 1..20: mol_type = other DNA
gccccacaatacagtgcatt

SEQ ID NO: 39321 - DNA, 20 bp, synthetic construct
  misc_feature 1..20: note = CRISPR gRNA sequence
  source 1..20: mol_type = other DNA
gtgcattgggccccccgtct

SEQ ID NO: 39322 - DNA, 20 bp, synthetic construct
  misc_feature 1..20: note = CRISPR gRNA sequence
  source 1..20: mol_type = other DNA
ggccccccgtctcagcctct

SEQ ID NO: 39323 - DNA, 20 bp, synthetic construct
  misc_feature 1..20: note = CRISPR gRNA sequence
  source 1..20: mol_type = other DNA
gccccccgtctcagcctctc

SEQ ID NO: 39324 - DNA, 20 bp, synthetic construct
  misc_feature 1..20: note = CRISPR gRNA sequence
  source 1..20: mol_type = other DNA
ccccccgtctcagcctctca

SEQ ID NO: 39325 - DNA, 20 bp, synthetic construct
  misc_feature 1..20: note = CRISPR gRNA sequence
  source 1..20: mol_type = other DNA
gtctcagcctctcagggaac

SEQ ID NO: 39326 - DNA, 20 bp, synthetic construct
  misc_feature 1..20: note = CRISPR gRNA sequence
  source 1..20: mol_type = other DNA
cagcctctcagggaaccagc

SEQ ID NO: 39327 - DNA, 20 bp, synthetic construct
  misc_feature 1..20: note = CRISPR gRNA sequence
  source 1..20: mol_type = other DNA
cctctcagggaaccagctgg

SEQ ID NO: 39328 - DNA, 20 bp, synthetic construct
  misc_feature 1..20: note = CRISPR gRNA sequence
  source 1..20: mol_type = other DNA
agggaaccagctggaagatg

SEQ ID NO: 39329 - DNA, 20 bp, synthetic construct
  misc_feature 1..20: note = CRISPR gRNA sequence
  source 1..20: mol_type = other DNA
gggaaccagctggaagatga

SEQ ID NO: 39330 - DNA, 20 bp, synthetic construct
  misc_feature 1..20: note = CRISPR gRNA sequence
  source 1..20: mol_type = other DNA
agctggaagatgaaggctgt

SEQ ID NO: 39331 - DNA, 20 bp, synthetic construct
  misc_feature 1..20: note = CRISPR gRNA sequence
  source 1..20: mol_type = other DNA
agatgaaggctgtcggctga

SEQ ID NO: 39332 - DNA, 20 bp, synthetic construct
  misc_feature 1..20: note = CRISPR gRNA sequence
  source 1..20: mol_type = other DNA
tgaaggctgtcggctgatgg

SEQ ID NO: 39333 - DNA, 20 bp, synthetic construct
  misc_feature 1..20: note = CRISPR gRNA sequence
  source 1..20: mol_type = other DNA
aaggctgtcggctgatggca

SEQ ID NO: 39334 - DNA, 20 bp, synthetic construct
  misc_feature 1..20: note = CRISPR gRNA sequence
  source 1..20: mol_type = other DNA
aggctgtcggctgatggcag

SEQ ID NO: 39335 - DNA, 20 bp, synthetic construct
  misc_feature 1..20: note = CRISPR gRNA sequence
  source 1..20: mol_type = other DNA
tgatggcagaggctgcatcc

SEQ ID NO: 39336 - DNA, 20 bp, synthetic construct
  misc_feature 1..20: note = CRISPR gRNA sequence
  source 1..20: mol_type = other DNA
gcatcccagctgcacatcgc

SEQ ID NO: 39337 - DNA, 20 bp, synthetic construct
  misc_feature 1..20: note = CRISPR gRNA sequence
  source 1..20: mol_type = other DNA
catcccagctgcacatcgcc

SEQ ID NO: 39338 - DNA, 20 bp, synthetic construct
  misc_feature 1..20: note = CRISPR gRNA sequence
  source 1..20: mol_type = other DNA
cccagctgcacatcgccagg

SEQ ID NO: 39339 - DNA, 20 bp, synthetic construct
  misc_feature 1..20: note = CRISPR gRNA sequence
  source 1..20: mol_type = other DNA
gctgcacatcgccaggaagc

SEQ ID NO: 39340 - DNA, 20 bp, synthetic construct
  misc_feature 1..20: note = CRISPR gRNA sequence
  source 1..20: mol_type = other DNA
tgcacatcgccaggaagctg

SEQ ID NO: 39341 - DNA, 20 bp, synthetic construct
  misc_feature 1..20: note = CRISPR gRNA sequence
  source 1..20: mol_type = other DNA
catcgccaggaagctggagt

SEQ ID NO: 39342 - DNA, 20 bp, synthetic construct
  misc_feature 1..20: note = CRISPR gRNA sequence
  source 1..20: mol_type = other DNA
tgagttgtccaccccaccgc

SEQ ID NO: 39343 - DNA, 20 bp, synthetic construct
  misc_feature 1..20: note = CRISPR gRNA sequence
  source 1..20: mol_type = other DNA
gagttgtccaccccaccgct

SEQ ID NO: 39344 - DNA, 20 bp, synthetic construct
  misc_feature 1..20: note = CRISPR gRNA sequence
  source 1..20: mol_type = other DNA
tccaccccaccgctgggtac

SEQ ID NO: 39345 - DNA, 20 bp, synthetic construct
  misc_feature 1..20: note = CRISPR gRNA sequence
  source 1..20: mol_type = other DNA
ccaccccaccgctgggtacc

SEQ ID NO: 39346 - DNA, 20 bp, synthetic construct
  misc_feature 1..20: note = CRISPR gRNA sequence
  source 1..20: mol_type = other DNA
caccccaccgctgggtacca

SEQ ID NO: 39347 - DNA, 20 bp, synthetic construct
  misc_feature 1..20: note = CRISPR gRNA sequence
  source 1..20: mol_type = other DNA
cccaccgctgggtaccaggg

SEQ ID NO: 39348 - DNA, 20 bp, synthetic construct
  misc_feature 1..20: note = CRISPR gRNA sequence
  source 1..20: mol_type = other DNA
ccaccgctgggtaccaggga

SEQ ID NO: 39349 - DNA, 20 bp, synthetic construct
  misc_feature 1..20: note = CRISPR gRNA sequence
  source 1..20: mol_type = other DNA
gggtaccagggaaggccctg

SEQ ID NO: 39350 - DNA, 20 bp, synthetic construct
  misc_feature 1..20: note = CRISPR gRNA sequence
  source 1..20: mol_type = other DNA
gtaccagggaaggccctgta

SEQ ID NO: 39351 - DNA, 20 bp, synthetic construct
  misc_feature 1..20: note = CRISPR gRNA sequence
  source 1..20: mol_type = other DNA
gggaaggccctgtagagccc

SEQ ID NO: 39352 - DNA, 20 bp, synthetic construct
  misc_feature 1..20: note = CRISPR gRNA sequence
  source 1..20: mol_type = other DNA
ggaaggccctgtagagcccc

SEQ ID NO: 39353 - DNA, 20 bp, synthetic construct
  misc_feature 1..20: note = CRISPR gRNA sequence
  source 1..20: mol_type = other DNA
aaggccctgtagagccccag

SEQ ID NO: 39354 - DNA, 20 bp, synthetic construct
  misc_feature 1..20: note = CRISPR gRNA sequence
  source 1..20: mol_type = other DNA
aggccctgtagagccccagg

SEQ ID NO: 39355 - DNA, 20 bp, synthetic construct
  misc_feature 1..20: note = CRISPR gRNA sequence
  source 1..20: mol_type = other DNA
gaggtccccgtgttcgtaat

SEQ ID NO: 39356 - DNA, 20 bp, synthetic construct
  misc_feature 1..20: note = CRISPR gRNA sequence
  source 1..20: mol_type = other DNA
gtccccgtgttcgtaatcag

SEQ ID NO: 39357 - DNA, 20 bp, synthetic construct
  misc_feature 1..20: note = CRISPR gRNA sequence
  source 1..20: mol_type = other DNA
ccgtgttcgtaatcagcagt

SEQ ID NO: 39358 - DNA, 20 bp, synthetic construct
  misc_feature 1..20: note = CRISPR gRNA sequence
  source 1..20: mol_type = other DNA
cgtgttcgtaatcagcagta

SEQ ID NO: 39359 - DNA, 20 bp, synthetic construct
  misc_feature 1..20: note = CRISPR gRNA sequence
  source 1..20: mol_type = other DNA
gtgttcgtaatcagcagtaa

SEQ ID NO: 39360 - DNA, 20 bp, synthetic construct
  misc_feature 1..20: note = CRISPR gRNA sequence
  source 1..20: mol_type = other DNA
cccctgcttcctcccaactc

SEQ ID NO: 39361 - DNA, 20 bp, synthetic construct
  misc_feature 1..20: note = CRISPR gRNA sequence
  source 1..20: mol_type = other DNA
gcttcctcccaactccagca

SEQ ID NO: 39362 - DNA, 20 bp, synthetic construct
  misc_feature 1..20: note = CRISPR gRNA sequence
  source 1..20: mol_type = other DNA
ctcccaactccagcaaagtc

SEQ ID NO: 39363 - DNA, 20 bp, synthetic construct
  misc_feature 1..20: note = CRISPR gRNA sequence
  source 1..20: mol_type = other DNA
caactccagcaaagtcaaga

SEQ ID NO: 39364 - DNA, 20 bp, synthetic construct
  misc_feature 1..20: note = CRISPR gRNA sequence
  source 1..20: mol_type = other DNA
ccatgccttgccttcacctc

SEQ ID NO: 39365 - DNA, 20 bp, synthetic construct
  misc_feature 1..20: note = CRISPR gRNA sequence
  source 1..20: mol_type = other DNA
cttgccttcacctccggcat

SEQ ID NO: 39366 - DNA, 20 bp, synthetic construct
  misc_feature 1..20: note = CRISPR gRNA sequence
  source 1..20: mol_type = other DNA
tccggcatgagccactgtct

SEQ ID NO: 39367 - DNA, 20 bp, synthetic construct
  misc_feature 1..20: note = CRISPR gRNA sequence
  source 1..20: mol_type = other DNA
actgtcttagtccaatcatc

SEQ ID NO: 39368 - DNA, 20 bp, synthetic construct
  misc_feature 1..20: note = CRISPR gRNA sequence
  source 1..20: mol_type = other DNA
aaaatgcgttcattatacat

SEQ ID NO: 39369 - DNA, 20 bp, synthetic construct
  misc_feature 1..20: note = CRISPR gRNA sequence
  source 1..20: mol_type = other DNA
atgcgttcattatacatcag

SEQ ID NO: 39370 - DNA, 20 bp, synthetic construct
  misc_feature 1..20: note = CRISPR gRNA sequence
  source 1..20: mol_type = other DNA
tgcattccaattcatctttg

SEQ ID NO: 39371 - DNA, 20 bp, synthetic construct
  misc_feature 1..20: note = CRISPR gRNA sequence
  source 1..20: mol_type = other DNA
attcatctttgtagctgccc

SEQ ID NO: 39372 - DNA, 20 bp, synthetic construct
  misc_feature 1..20: note = CRISPR gRNA sequence
  source 1..20: mol_type = other DNA
tcatctttgtagctgccctg

SEQ ID NO: 39373 - DNA, 20 bp, synthetic construct
  misc_feature 1..20: note = CRISPR gRNA sequence
  source 1..20: mol_type = other DNA
tttgtagctgccctggagca

SEQ ID NO: 39374 - DNA, 20 bp, synthetic construct
  misc_feature 1..20: note = CRISPR gRNA sequence
  source 1..20: mol_type = other DNA
gtagctgccctggagcacgg

SEQ ID NO: 39375 - DNA, 20 bp, synthetic construct
  misc_feature 1..20: note = CRISPR gRNA sequence
  source 1..20: mol_type = other DNA
tagctgccctggagcacggt

SEQ ID NO: 39376 - DNA, 20 bp, synthetic construct
  misc_feature 1..20: note = CRISPR gRNA sequence
  source 1..20: mol_type = other DNA
agctgccctggagcacggtg

SEQ ID NO: 39377 - DNA, 20 bp, synthetic construct
  misc_feature 1..20: note = CRISPR gRNA sequence
  source 1..20: mol_type = other DNA
tgccctggagcacggtgggg

SEQ ID NO: 39378 - DNA, 20 bp, synthetic construct
  misc_feature 1..20: note = CRISPR gRNA sequence
  source 1..20: mol_type = other DNA
gccctggagcacggtggggt

SEQ ID NO: 39379 - DNA, 20 bp, synthetic construct
  misc_feature 1..20: note = CRISPR gRNA sequence
  source 1..20: mol_type = other DNA
ccctggagcacggtggggtg

SEQ ID NO: 39380 - DNA, 20 bp, synthetic construct
  misc_feature 1..20: note = CRISPR gRNA sequence
  source 1..20: mol_type = other DNA
ggtggggtggggtgttgcac

SEQ ID NO: 39381 - DNA, 20 bp, synthetic construct
  misc_feature 1..20: note = CRISPR gRNA sequence
  source 1..20: mol_type = other DNA
gtggggtggggtgttgcact

SEQ ID NO: 39382 - DNA, 20 bp, synthetic construct
  misc_feature 1..20: note = CRISPR gRNA sequence
  source 1..20: mol_type = other DNA
tggggtggggtgttgcactg

SEQ ID NO: 39383 - DNA, 20 bp, synthetic construct
  misc_feature 1..20: note = CRISPR gRNA sequence
  source 1..20: mol_type = other DNA
gggtggggtgttgcactggg

SEQ ID NO: 39384 - DNA, 20 bp, synthetic construct
  misc_feature 1..20: note = CRISPR gRNA sequence
  source 1..20: mol_type = other DNA
ggtggggtgttgcactgggg

SEQ ID NO: 39385 - DNA, 20 bp, synthetic construct
  misc_feature 1..20: note = CRISPR gRNA sequence
  source 1..20: mol_type = other DNA
gtgttgcactggggaggtgt

SEQ ID NO: 39386 - DNA, 20 bp, synthetic construct
  misc_feature 1..20: note = CRISPR gRNA sequence
  source 1..20: mol_type = other DNA
tgttgcactggggaggtgtc

SEQ ID NO: 39387 - DNA, 20 bp, synthetic construct
  misc_feature 1..20: note = CRISPR gRNA sequence
  source 1..20: mol_type = other DNA
gttgcactggggaggtgtca

SEQ ID NO: 39388 - DNA, 20 bp, synthetic construct
  misc_feature 1..20: note = CRISPR gRNA sequence
  source 1..20: mol_type = other DNA
gcactggggaggtgtcaggg

SEQ ID NO: 39389 - DNA, 20 bp, synthetic construct
  misc_feature 1..20: note = CRISPR gRNA sequence
  source 1..20: mol_type = other DNA
cactggggaggtgtcagggt

SEQ ID NO: 39390 - DNA, 20 bp, synthetic construct
  misc_feature 1..20: note = CRISPR gRNA sequence
  source 1..20: mol_type = other DNA
tggggaggtgtcagggtggg

SEQ ID NO: 39391 - DNA, 20 bp, synthetic construct
  misc_feature 1..20: note = CRISPR gRNA sequence
  source 1..20: mol_type = other DNA
ggggaggtgtcagggtgggt

SEQ ID NO: 39392 - DNA, 20 bp, synthetic construct
  misc_feature 1..20: note = CRISPR gRNA sequence
  source 1..20: mol_type = other DNA
gtgggtgggatgttgcactg

SEQ ID NO: 39393 - DNA, 20 bp, synthetic construct
  misc_feature 1..20: note = CRISPR gRNA sequence
  source 1..20: mol_type = other DNA
gggtgggatgttgcactgtg

SEQ ID NO: 39394 - DNA, 20 bp, synthetic construct
  misc_feature 1..20: note = CRISPR gRNA sequence
  source 1..20: mol_type = other DNA
ggtgggatgttgcactgtgg

SEQ ID NO: 39395 - DNA, 20 bp, synthetic construct
  misc_feature 1..20: note = CRISPR gRNA sequence
  source 1..20: mol_type = other DNA
gcactgtggaggtgtcatgc

SEQ ID NO: 39396 - DNA, 20 bp, synthetic construct
  misc_feature 1..20: note = CRISPR gRNA sequence
  source 1..20: mol_type = other DNA
cactgtggaggtgtcatgct

SEQ ID NO: 39397 - DNA, 20 bp, synthetic construct
  misc_feature 1..20: note = CRISPR gRNA sequence
  source 1..20: mol_type = other DNA
actgtggaggtgtcatgctg

SEQ ID NO: 39398 - DNA, 20 bp, synthetic construct
  misc_feature 1..20: note = CRISPR gRNA sequence
  source 1..20: mol_type = other DNA
gaggtgtcatgctggggtgc

SEQ ID NO: 39399 - DNA, 20 bp, synthetic construct
  misc_feature 1..20: note = CRISPR gRNA sequence
  source 1..20: mol_type = other DNA
aggtgtcatgctggggtgct

SEQ ID NO: 39400 - DNA, 20 bp, synthetic construct
  misc_feature 1..20: note = CRISPR gRNA sequence
  source 1..20: mol_type = other DNA
ggtgtcatgctggggtgcta

SEQ ID NO: 39401 - DNA, 20 bp, synthetic construct
  misc_feature 1..20: note = CRISPR gRNA sequence
  source 1..20: mol_type = other DNA
gtcatgctggggtgctaggg

SEQ ID NO: 39402 - DNA, 20 bp, synthetic construct
  misc_feature 1..20: note = CRISPR gRNA sequence
  source 1..20: mol_type = other DNA
tcatgctggggtgctagggt

SEQ ID NO: 39403 - DNA, 20 bp, synthetic construct
  misc_feature 1..20: note = CRISPR gRNA sequence
  source 1..20: mol_type = other DNA
catgctggggtgctagggta

SEQ ID NO: 39404 - DNA, 20 bp, synthetic construct
  misc_feature 1..20: note = CRISPR gRNA sequence
  source 1..20: mol_type = other DNA
tgctggggtgctagggtagg

SEQ ID NO: 39405 - DNA, 20 bp, synthetic construct
  misc_feature 1..20: note = CRISPR gRNA sequence
  source 1..20: mol_type = other DNA
tggggtgctagggtagggag

SEQ ID NO: 39406 - DNA, 20 bp, synthetic construct
  misc_feature 1..20: note = CRISPR gRNA sequence
  source 1..20: mol_type = other DNA
tagggagtggtgtgttcctg

SEQ ID NO: 39407 - DNA, 20 bp, synthetic construct
  misc_feature 1..20: note = CRISPR gRNA sequence
  source 1..20: mol_type = other DNA
agggagtggtgtgttcctgt

SEQ ID NO: 39408 - DNA, 20 bp, synthetic construct
  misc_feature 1..20: note = CRISPR gRNA sequence
  source 1..20: mol_type = other DNA
gggagtggtgtgttcctgtg

SEQ ID NO: 39409 - DNA, 20 bp, synthetic construct
  misc_feature 1..20: note = CRISPR gRNA sequence
  source 1..20: mol_type = other DNA
ttcctgtggggatacactgt

SEQ ID NO: 39410 - DNA, 20 bp, synthetic construct
  misc_feature 1..20: note = CRISPR gRNA sequence
  source 1..20: mol_type = other DNA
tcctgtggggatacactgtt

SEQ ID NO: 39411 - DNA, 20 bp, synthetic construct
  misc_feature 1..20: note = CRISPR gRNA sequence
  source 1..20: mol_type = other DNA
cctgtggggatacactgttg

SEQ ID NO: 39412 - DNA, 20 bp, synthetic construct
  misc_feature 1..20: note = CRISPR gRNA sequence
  source 1..20: mol_type = other DNA
tggggatacactgttggggt

SEQ ID NO: 39413 - DNA, 20 bp, synthetic construct
  misc_feature 1..20: note = CRISPR gRNA sequence
  source 1..20: mol_type = other DNA
ggggatacactgttggggtg

SEQ ID NO: 39414 - DNA, 20 bp, synthetic construct
  misc_feature 1..20: note = CRISPR gRNA sequence
  source 1..20: mol_type = other DNA
gggatacactgttggggtga

SEQ ID NO: 39415 - DNA, 20 bp, synthetic construct
  misc_feature 1..20: note = CRISPR gRNA sequence
  source 1..20: mol_type = other DNA
ggatacactgttggggtgag

SEQ ID NO: 39416 - DNA, 20 bp, synthetic construct
  misc_feature 1..20: note = CRISPR gRNA sequence
  source 1..20: mol_type = other DNA
tacactgttggggtgagggg

SEQ ID NO: 39417 - DNA, 20 bp, synthetic construct
  misc_feature 1..20: note = CRISPR gRNA sequence
  source 1..20: mol_type = other DNA
ctgttggggtgaggggtggt

SEQ ID NO: 39418 - DNA, 20 bp, synthetic construct
  misc_feature 1..20: note = CRISPR gRNA sequence
  source 1..20: mol_type = other DNA
tggggtgaggggtggtgaga

SEQ ID NO: 39419 - DNA, 20 bp, synthetic construct
  misc_feature 1..20: note = CRISPR gRNA sequence
  source 1..20: mol_type = other DNA
gtgaggggtggtgagatgga

SEQ ID NO: 39420 - DNA, 20 bp, synthetic construct
  misc_feature 1..20: note = CRISPR gRNA sequence
  source 1..20: mol_type = other DNA
tgaggggtggtgagatggaa

SEQ ID NO: 39421 - DNA, 20 bp, synthetic construct
  misc_feature 1..20: note = CRISPR gRNA sequence
  source 1..20: mol_type = other DNA
ggggtggtgagatggaaagg

SEQ ID NO: 39422 - DNA, 20 bp, synthetic construct
  misc_feature 1..20: note = CRISPR gRNA sequence
  source 1..20: mol_type = other DNA
gggtggtgagatggaaaggt

SEQ ID NO: 39423 - DNA, 20 bp, synthetic construct
  misc_feature 1..20: note = CRISPR gRNA sequence
  source 1..20: mol_type = other DNA
gagatggaaaggtaggctat

SEQ ID NO: 39424 - DNA, 20 bp, synthetic construct
  misc_feature 1..20: note = CRISPR gRNA sequence
  source 1..20: mol_type = other DNA
agatggaaaggtaggctatt

SEQ ID NO: 39425 - DNA, 20 bp, synthetic construct
  misc_feature 1..20: note = CRISPR gRNA sequence
  source 1..20: mol_type = other DNA
aaggtaggctattaggctgc

SEQ ID NO: 39426 - DNA, 20 bp, synthetic construct
  misc_feature 1..20: note = CRISPR gRNA sequence
  source 1..20: mol_type = other DNA
aggtaggctattaggctgct

SEQ ID NO: 39427 - DNA, 20 bp, synthetic construct
  misc_feature 1..20: note = CRISPR gRNA sequence
  source 1..20: mol_type = other DNA
ttaggctgctgggtgtgctg

SEQ ID NO: 39428 - DNA, 20 bp, synthetic construct
  misc_feature 1..20: note = CRISPR gRNA sequence
  source 1..20: mol_type = other DNA
gggtgtgctgtggtgttgca

SEQ ID NO: 39429 - DNA, 20 bp, synthetic construct
  misc_feature 1..20: note = CRISPR gRNA sequence
  source 1..20: mol_type = other DNA
ggtgtgctgtggtgttgcat

SEQ ID NO: 39430 - DNA, 20 bp, synthetic construct
  misc_feature 1..20: note = CRISPR gRNA sequence
  source 1..20: mol_type = other DNA
gtgtgctgtggtgttgcatg

SEQ ID NO: 39431 - DNA, 20 bp, synthetic construct
  misc_feature 1..20: note = CRISPR gRNA sequence
  source 1..20: mol_type = other DNA
gctgtggtgttgcatggggt

SEQ ID NO: 39432 - DNA, 20 bp, synthetic construct
  misc_feature 1..20: note = CRISPR gRNA sequence
  source 1..20: mol_type = other DNA
ctgtggtgttgcatggggtg

SEQ ID NO: 39433 - DNA, 20 bp, synthetic construct
  misc_feature 1..20: note = CRISPR gRNA sequence
  source 1..20: mol_type = other DNA
tgtggtgttgcatggggtga

SEQ ID NO: 39434 - DNA, 20 bp, synthetic construct
  misc_feature 1..20: note = CRISPR gRNA sequence
  source 1..20: mol_type = other DNA
catggggtgagggtgatgtt

SEQ ID NO: 39435 - DNA, 20 bp, synthetic construct
  misc_feature 1..20: note = CRISPR gRNA sequence
  source 1..20: mol_type = other DNA
atggggtgagggtgatgttt

SEQ ID NO: 39436 - DNA, 20 bp, synthetic construct
  misc_feature 1..20: note = CRISPR gRNA sequence
  source 1..20: mol_type = other DNA
gggtgagggtgatgtttggg

SEQ ID NO: 39437 - DNA, 20 bp, synthetic construct
  misc_feature 1..20: note = CRISPR gRNA sequence
  source 1..20: mol_type = other DNA
ggtgagggtgatgtttgggt

SEQ ID NO: 39438 - DNA, 20 bp, synthetic construct
  misc_feature 1..20: note = CRISPR gRNA sequence
  source 1..20: mol_type = other DNA
gtgagggtgatgtttgggtg

SEQ ID NO: 39439 - DNA, 20 bp, synthetic construct
  misc_feature 1..20: note = CRISPR gRNA sequence
  source 1..20: mol_type = other DNA
tgagggtgatgtttgggtgg

SEQ ID NO: 39440 - DNA, 20 bp, synthetic construct
  misc_feature 1..20: note = CRISPR gRNA sequence
  source 1..20: mol_type = other DNA
atgtttgggtgggggtgtct

SEQ ID NO: 39441 - DNA, 20 bp, synthetic construct
  misc_feature 1..20: note = CRISPR gRNA sequence
  source 1..20: mol_type = other DNA
tgtttgggtgggggtgtctt

SEQ ID NO: 39442 - DNA, 20 bp, synthetic construct
  misc_feature 1..20: note = CRISPR gRNA sequence
  source 1..20: mol_type = other DNA
gtttgggtgggggtgtcttg

SEQ ID NO: 39443 - DNA, 20 bp, synthetic construct
  misc_feature 1..20: note = CRISPR gRNA sequence
  source 1..20: mol_type = other DNA
tttgggtgggggtgtcttgg

SEQ ID NO: 39444 - DNA, 20 bp, synthetic construct
  misc_feature 1..20: note = CRISPR gRNA sequence
  source 1..20: mol_type = other DNA
tgggggtgtcttgggggtct

SEQ ID NO: 39445 - DNA, 20 bp, synthetic construct
  misc_feature 1..20: note = CRISPR gRNA sequence
  source 1..20: mol_type = other DNA
gggggtgtcttgggggtctt

SEQ ID NO: 39446 - DNA, 20 bp, synthetic construct
  misc_feature 1..20: note = CRISPR gRNA sequence
  source 1..20: mol_type = other DNA
gtcttgggggtcttaggatc

SEQ ID NO: 39447 - DNA, 20 bp, synthetic construct
  misc_feature 1..20: note = CRISPR gRNA sequence
  source 1..20: mol_type = other DNA
gggggtcttaggatcaagtg

SEQ ID NO: 39448 - DNA, 20 bp, synthetic construct
  misc_feature 1..20: note = CRISPR gRNA sequence
  source 1..20: mol_type = other DNA
ggggtcttaggatcaagtgt

SEQ ID NO: 39449 - DNA, 20 bp, synthetic construct
  misc_feature 1..20: note = CRISPR gRNA sequence
  source 1..20: mol_type = other DNA
tcttaggatcaagtgtgggt

SEQ ID NO: 39450 - DNA, 20 bp, synthetic construct
  misc_feature 1..20: note = CRISPR gRNA sequence
  source 1..20: mol_type = other DNA
cttaggatcaagtgtgggtc

SEQ ID NO: 39451 - DNA, 20 bp, synthetic construct
  misc_feature 1..20: note = CRISPR gRNA sequence
  source 1..20: mol_type = other DNA
gatcaagtgtgggtcgggtt

SEQ ID NO: 39452 - DNA, 20 bp, synthetic construct
  misc_feature 1..20: note = CRISPR gRNA sequence
  source 1..20: mol_type = other DNA
atcaagtgtgggtcgggttt

SEQ ID NO: 39453 - DNA, 20 bp, synthetic construct
  misc_feature 1..20: note = CRISPR gRNA sequence
  source 1..20: mol_type = other DNA
tcaagtgtgggtcgggtttg

SEQ ID NO: 39454 - DNA, 20 bp, synthetic construct
  misc_feature 1..20: note = CRISPR gRNA sequence
  source 1..20: mol_type = other DNA
aagtgtgggtcgggtttggg

SEQ ID NO: 39455 - DNA, 20 bp, synthetic construct
  misc_feature 1..20: note = CRISPR gRNA sequence
  source 1..20: mol_type = other DNA
ggtcgggtttggggagtgtt

SEQ ID NO: 39456 - DNA, 20 bp, synthetic construct
  misc_feature 1..20: note = CRISPR gRNA sequence
  source 1..20: mol_type = other DNA
ggtttggggagtgttgagat

SEQ ID NO: 39457 - DNA, 20 bp, synthetic construct
  misc_feature 1..20: note = CRISPR gRNA sequence
  source 1..20: mol_type = other DNA
gtttggggagtgttgagatt

SEQ ID NO: 39458 - DNA, 20 bp, synthetic construct
  misc_feature 1..20: note = CRISPR gRNA sequence
  source 1..20: mol_type = other DNA
tggggagtgttgagattggg

SEQ ID NO: 39459 - DNA, 20 bp, synthetic construct
  misc_feature 1..20: note = CRISPR gRNA sequence
  source 1..20: mol_type = other DNA
ggagtgttgagattgggtag

SEQ ID NO: 39460 - DNA, 20 bp, synthetic construct
  misc_feature 1..20: note = CRISPR gRNA sequence
  source 1..20: mol_type = other DNA
gtgttgagattgggtagcag

SEQ ID NO: 39461 - DNA, 20 bp, synthetic construct
  misc_feature 1..20: note = CRISPR gRNA sequence
  source 1..20: mol_type = other DNA
gagattgggtagcagtggtt

SEQ ID NO: 39462 - DNA, 20 bp, synthetic construct
  misc_feature 1..20: note = CRISPR gRNA sequence
  source 1..20: mol_type = other DNA
agattgggtagcagtggttt

SEQ ID NO: 39463 - DNA, 20 bp, synthetic construct
  misc_feature 1..20: note = CRISPR gRNA sequence
  source 1..20: mol_type = other DNA
gattgggtagcagtggtttg

SEQ ID NO: 39464 - DNA, 20 bp, synthetic construct
  misc_feature 1..20: note = CRISPR gRNA sequence
  source 1..20: mol_type = other DNA
gtagcagtggtttggggcct

SEQ ID NO: 39465 - DNA, 20 bp, synthetic construct
  misc_feature 1..20: note = CRISPR gRNA sequence
  source 1..20: mol_type = other DNA
gtggtttggggcctcagctt

SEQ ID NO: 39466 - DNA, 20 bp, synthetic construct
  misc_feature 1..20: note = CRISPR gRNA sequence
  source 1..20: mol_type = other DNA
tcaatcttcgctctgtcact

SEQ ID NO: 39467 - DNA, 20 bp, synthetic construct
  misc_feature 1..20: note = CRISPR gRNA sequence
  source 1..20: mol_type = other DNA
atcttcgctctgtcacttag

SEQ ID NO: 39468 - DNA, 20 bp, synthetic construct
  misc_feature 1..20: note = CRISPR gRNA sequence
  source 1..20: mol_type = other DNA
acttagtagcattgtgaacc

SEQ ID NO: 39469 - DNA, 20 bp, synthetic construct
  misc_feature 1..20: note = CRISPR gRNA sequence
  source 1..20: mol_type = other DNA
cttagtagcattgtgaacct

SEQ ID NO: 39470 - DNA, 20 bp, synthetic construct
  misc_feature 1..20: note = CRISPR gRNA sequence
  source 1..20: mol_type = other DNA
gtagcattgtgaacctggga

SEQ ID NO: 39471 - DNA, 20 bp, synthetic construct
  misc_feature 1..20: note = CRISPR gRNA sequence
  source 1..20: mol_type = other DNA
ggaaagtaattgaatgtctc

SEQ ID NO: 39472 - DNA, 20 bp, synthetic construct
  misc_feature 1..20: note = CRISPR gRNA sequence
  source 1..20: mol_type = other DNA
gaaagtaattgaatgtctct

SEQ ID NO: 39473 - DNA, 20 bp, synthetic construct
  misc_feature 1..20: note = CRISPR gRNA sequence
  source 1..20: mol_type = other DNA
aattgaatgtctctgggcct

SEQ ID NO: 39474 - DNA, 20 bp, synthetic construct
  misc_feature 1..20: note = CRISPR gRNA sequence
  source 1..20: mol_type = other DNA
tcggtttcccctctgtaaaa

SEQ ID NO: 39475 - DNA, 20 bp, synthetic construct
  misc_feature 1..20: note = CRISPR gRNA sequence
  source 1..20: mol_type = other DNA
cggtttcccctctgtaaaat

SEQ ID NO: 39476 - DNA, 20 bp, synthetic construct
  misc_feature 1..20: note = CRISPR gRNA sequence
  source 1..20: mol_type = other DNA
catgaaaccatatatgtaca

SEQ ID NO: 39477 - DNA, 20 bp, synthetic construct
  misc_feature 1..20: note = CRISPR gRNA sequence
  source 1..20: mol_type = other DNA
tatgtacaaagccttttgta

SEQ ID NO: 39478 - DNA, 20 bp, synthetic construct
  misc_feature 1..20: note = CRISPR gRNA sequence
  source 1..20: mol_type = other DNA
tgtacaaagccttttgtaca

SEQ ID NO: 39479 - DNA, 20 bp, synthetic construct
  misc_feature 1..20: note = CRISPR gRNA sequence
  source 1..20: mol_type = other DNA
aaagccttttgtacagagtc

SEQ ID NO: 39480 - DNA, 20 bp, synthetic construct
  misc_feature 1..20: note = CRISPR gRNA sequence
  source 1..20: mol_type = other DNA
cttttgtacagagtctggta

SEQ ID NO: 39481 - DNA, 20 bp, synthetic construct
  misc_feature 1..20: note = CRISPR gRNA sequence
  source 1..20: mol_type = other DNA
tgtacagagtctggtatagt

SEQ ID NO: 39482 - DNA, 20 bp, synthetic construct
  misc_feature 1..20: note = CRISPR gRNA sequence
  source 1..20: mol_type = other DNA
gtacagagtctggtatagtc

SEQ ID NO: 39483 - DNA, 20 bp, synthetic construct
  misc_feature 1..20: note = CRISPR gRNA sequence
  source 1..20: mol_type = other DNA
tacagagtctggtatagtca

SEQ ID NO: 39484 - DNA, 20 bp, synthetic construct
  misc_feature 1..20: note = CRISPR gRNA sequence
  source 1..20: mol_type = other DNA
agtctggtatagtcagggct

SEQ ID NO: 39485 - DNA, 20 bp, synthetic construct
  misc_feature 1..20: note = CRISPR gRNA sequence
  source 1..20: mol_type = other DNA
tatagtcagggctcagaaaa

SEQ ID NO: 39486 - DNA, 20 bp, synthetic construct
  misc_feature 1..20: note = CRISPR gRNA sequence
  source 1..20: mol_type = other DNA
agtcagggctcagaaaatgg

SEQ ID NO: 39487 - DNA, 20 bp, synthetic construct
  misc_feature 1..20: note = CRISPR gRNA sequence
  source 1..20: mol_type = other DNA
agaaaatggtggttatttta

SEQ ID NO: 39488 - DNA, 20 bp, synthetic construct
  misc_feature 1..20: note = CRISPR gRNA sequence
  source 1..20: mol_type = other DNA
atggtggttattttacagat

SEQ ID NO: 39489 - DNA, 20 bp, synthetic construct
  misc_feature 1..20: note = CRISPR gRNA sequence
  source 1..20: mol_type = other DNA
tattttacagatgagaaaac

SEQ ID NO: 39490 - DNA, 20 bp, synthetic construct
  misc_feature 1..20: note = CRISPR gRNA sequence
  source 1..20: mol_type = other DNA
attttacagatgagaaaact

SEQ ID NO: 39491 - DNA, 20 bp, synthetic construct
  misc_feature 1..20: note = CRISPR gRNA sequence
  source 1..20: mol_type = other DNA
ttttacagatgagaaaactg

SEQ ID NO: 39492 - DNA, 20 bp, synthetic construct
  misc_feature 1..20: note = CRISPR gRNA sequence
  source 1..20: mol_type = other DNA
tttacagatgagaaaactgg

SEQ ID NO: 39493 - DNA, 20 bp, synthetic construct
  misc_feature 1..20: note = CRISPR gRNA sequence
  source 1..20: mol_type = other DNA
cagatgagaaaactgggggt

SEQ ID NO: 39494 - DNA, 20 bp, synthetic construct
  misc_feature 1..20: note = CRISPR gRNA sequence
  source 1..20: mol_type = other DNA
gatgagaaaactgggggtca

SEQ ID NO: 39495 - DNA, 20 bp, synthetic construct
  misc_feature 1..20: note = CRISPR gRNA sequence
  source 1..20: mol_type = other DNA
tgagaaaactgggggtcaga

SEQ ID NO: 39496 - DNA, 20 bp, synthetic construct
  misc_feature 1..20: note = CRISPR gRNA sequence
  source 1..20: mol_type = other DNA
gagaaaactgggggtcagag

SEQ ID NO: 39497 - DNA, 20 bp, synthetic construct
  misc_feature 1..20: note = CRISPR gRNA sequence
  source 1..20: mol_type = other DNA
gtcagagaggtgaaaacact

SEQ ID NO: 39498 - DNA, 20 bp, synthetic construct
  misc_feature 1..20: note = CRISPR gRNA sequence
  source 1..20: mol_type = other DNA
aacactgagttcttgctgtc

SEQ ID NO: 39499 - DNA, 20 bp, synthetic construct
  misc_feature 1..20: note = CRISPR gRNA sequence
  source 1..20: mol_type = other DNA
ctgagttcttgctgtcaagc

SEQ ID NO: 39500 - DNA, 20 bp, synthetic construct
  misc_feature 1..20: note = CRISPR gRNA sequence
  source 1..20: mol_type = other DNA
ggacaactttattttccaaa

SEQ ID NO: 39501 - DNA, 20 bp, synthetic construct
  misc_feature 1..20: note = CRISPR gRNA sequence
  source 1..20: mol_type = other DNA
gacaactttattttccaaat

SEQ ID NO: 39502 - DNA, 20 bp, synthetic construct
  misc_feature 1..20: note = CRISPR gRNA sequence
  source 1..20: mol_type = other DNA
actttattttccaaatggga

SEQ ID NO: 39503 - DNA, 20 bp, synthetic construct
  misc_feature 1..20: note = CRISPR gRNA sequence
  source 1..20: mol_type = other DNA
ctttattttccaaatgggat

SEQ ID NO: 39504 - DNA, 20 bp, synthetic construct
  misc_feature 1..20: note = CRISPR gRNA sequence
  source 1..20: mol_type = other DNA
tttattttccaaatgggatg

SEQ ID NO: 39505 - DNA, 20 bp, synthetic construct
  misc_feature 1..20: note = CRISPR gRNA sequence
  source 1..20: mol_type = other DNA
ttattttccaaatgggatgg

SEQ ID NO: 39506 - DNA, 20 bp, synthetic construct
  misc_feature 1..20: note = CRISPR gRNA sequence
  source 1..20: mol_type = other DNA
tgggggtgtcatgcattttt

SEQ ID NO: 39507 - DNA, 20 bp, synthetic construct
  misc_feature 1..20: note = CRISPR gRNA sequence
  source 1..20: mol_type = other DNA
tttggcttactcacacgcac

SEQ ID NO: 39508 - DNA, 20 bp, synthetic construct
  misc_feature 1..20: note = CRISPR gRNA sequence
  source 1..20: mol_type = other DNA
cacacgcaccagaatccttt

SEQ ID NO: 39509 - DNA, 20 bp, synthetic construct
  misc_feature 1..20: note = CRISPR gRNA sequence
  source 1..20: mol_type = other DNA
cagaatcctttgagatcccc

SEQ ID NO: 39510 - DNA, 20 bp, synthetic construct
  misc_feature 1..20: note = CRISPR gRNA sequence
  source 1..20: mol_type = other DNA
atcctttgagatcccctggc

SEQ ID NO: 39511 - DNA, 20 bp, synthetic construct
  misc_feature 1..20: note = CRISPR gRNA sequence
  source 1..20: mol_type = other DNA
tcctttgagatcccctggca

SEQ ID NO: 39512 - DNA, 20 bp, synthetic construct
  misc_feature 1..20: note = CRISPR gRNA sequence
  source 1..20: mol_type = other DNA
cctttgagatcccctggcaa

SEQ ID NO: 39513 - DNA, 20 bp, synthetic construct
  misc_feature 1..20: note = CRISPR gRNA sequence
  source 1..20: mol_type = other DNA
agatcccctggcaagggacc

SEQ ID NO: 39514 - DNA, 20 bp, synthetic construct
  misc_feature 1..20: note = CRISPR gRNA sequence
  source 1..20: mol_type = other DNA
gatcccctggcaagggacct

SEQ ID NO: 39515 - DNA, 20 bp, synthetic construct
  misc_feature 1..20: note = CRISPR gRNA sequence
  source 1..20: mol_type = other DNA
ggcaagggacctaggacatc

SEQ ID NO: 39516 - DNA, 20 bp, synthetic construct
  misc_feature 1..20: note = CRISPR gRNA sequence
  source 1..20: mol_type = other DNA
gcaagggacctaggacatcc

SEQ ID NO: 39517 - DNA, 20 bp, synthetic construct
  misc_feature 1..20: note = CRISPR gRNA sequence
  source 1..20: mol_type = other DNA
aagggacctaggacatccag

SEQ ID NO: 39518 - DNA, 20 bp, synthetic construct
  misc_feature 1..20: note = CRISPR gRNA sequence
  source 1..20: mol_type = other DNA
cctaggacatccaggagtga

SEQ ID NO: 39519 - DNA, 20 bp, synthetic construct
  misc_feature 1..20: note = CRISPR gRNA sequence
  source 1..20: mol_type = other DNA
ggacatccaggagtgacagc

SEQ ID NO: 39520 - DNA, 20 bp, synthetic construct
  misc_feature 1..20: note = CRISPR gRNA sequence
  source 1..20: mol_type = other DNA
atccaggagtgacagccagc

SEQ ID NO: 39521 - DNA, 20 bp, synthetic construct
  misc_feature 1..20: note = CRISPR gRNA sequence
  source 1..20: mol_type = other DNA
gtgacagccagcaagctgct

SEQ ID NO: 39522 - DNA, 20 bp, synthetic construct
  misc_feature 1..20: note = CRISPR gRNA sequence
  source 1..20: mol_type = other DNA
gccagcaagctgctgagcca

SEQ ID NO: 39523 - DNA, 20 bp, synthetic construct
  misc_feature 1..20: note = CRISPR gRNA sequence
  source 1..20: mol_type = other DNA
ccagcaagctgctgagccac

SEQ ID NO: 39524 - DNA, 20 bp, synthetic construct
  misc_feature 1..20: note = CRISPR gRNA sequence
  source 1..20: mol_type = other DNA
cagcaagctgctgagccaca

SEQ ID NO: 39525 - DNA, 20 bp, synthetic construct
  misc_feature 1..20: note = CRISPR gRNA sequence
  source 1..20: mol_type = other DNA
gcaagctgctgagccacagg

SEQ ID NO: 39526 - DNA, 20 bp, synthetic construct
  misc_feature 1..20: note = CRISPR gRNA sequence
  source 1..20: mol_type = other DNA
caagctgctgagccacaggg

SEQ ID NO: 39527 - DNA, 20 bp, synthetic construct
  misc_feature 1..20: note = CRISPR gRNA sequence
  source 1..20: mol_type = other DNA
aagctgctgagccacaggga

SEQ ID NO: 39528 - DNA, 20 bp, synthetic construct
  misc_feature 1..20: note = CRISPR gRNA sequence
  source 1..20: mol_type = other DNA
agctgctgagccacagggag

SEQ ID NO: 39529 - DNA, 20 bp, synthetic construct
  misc_feature 1..20: note = CRISPR gRNA sequence
  source 1..20: mol_type = other DNA
gctgagccacagggaggggc

SEQ ID NO: 39530 - DNA, 20 bp, synthetic construct
  misc_feature 1..20: note = CRISPR gRNA sequence
  source 1..20: mol_type = other DNA
tgagccacagggaggggcta

SEQ ID NO: 39531 - DNA, 20 bp, synthetic construct
  misc_feature 1..20: note = CRISPR gRNA sequence
  source 1..20: mol_type = other DNA
ccacagggaggggctagagc

SEQ ID NO: 39532 - DNA, 20 bp, synthetic construct
  misc_feature 1..20: note = CRISPR gRNA sequence
  source 1..20: mol_type = other DNA
agggaggggctagagctggc

SEQ ID NO: 39533 - DNA, 20 bp, synthetic construct
  misc_feature 1..20: note = CRISPR gRNA sequence
  source 1..20: mol_type = other DNA
gggaggggctagagctggct

SEQ ID NO: 39534 - DNA, 20 bp, synthetic construct
  misc_feature 1..20: note = CRISPR gRNA sequence
  source 1..20: mol_type = other DNA
ggaggggctagagctggctg

SEQ ID NO: 39535 - DNA, 20 bp, synthetic construct
  misc_feature 1..20: note = CRISPR gRNA sequence
  source 1..20: mol_type = other DNA
gggctagagctggctggggc

SEQ ID NO: 39536 - DNA, 20 bp, synthetic construct
  misc_feature 1..20: note = CRISPR gRNA sequence
  source 1..20: mol_type = other DNA
ggctagagctggctggggct

SEQ ID NO: 39537 - DNA, 20 bp, synthetic construct
  misc_feature 1..20: note = CRISPR gRNA sequence
  source 1..20: mol_type = other DNA
ctggctggggctgggtacct

SEQ ID NO: 39538 - DNA, 20 bp, synthetic construct
  misc_feature 1..20: note = CRISPR gRNA sequence
  source 1..20: mol_type = other DNA
gtacctcagccacatgccaa

SEQ ID NO: 39539 - DNA, 20 bp, synthetic construct
  misc_feature 1..20: note = CRISPR gRNA sequence
  source 1..20: mol_type = other DNA
ctgccttctcctgctctcca

SEQ ID NO: 39540 - DNA, 20 bp, synthetic construct
  misc_feature 1..20: note = CRISPR gRNA sequence
  source 1..20: mol_type = other DNA
tctcctgctctccacagcct

SEQ ID NO: 39541 - DNA, 20 bp, synthetic construct
  misc_feature 1..20: note = CRISPR gRNA sequence
  source 1..20: mol_type = other DNA
ctccacagcctcagtaacaa

SEQ ID NO: 39542 - DNA, 20 bp, synthetic construct
  misc_feature 1..20: note = CRISPR gRNA sequence
  source 1..20: mol_type = other DNA
tccacagcctcagtaacaac

SEQ ID NO: 39543 - DNA, 20 bp, synthetic construct
  misc_feature 1..20: note = CRISPR gRNA sequence
  source 1..20: mol_type = other DNA
cagtaacaacgggctttctg

SEQ ID NO: 39544 - DNA, 20 bp, synthetic construct
  misc_feature 1..20: note = CRISPR gRNA sequence
  source 1..20: mol_type = other DNA
aacaacgggctttctgtggc

SEQ ID NO: 39545 - DNA, 20 bp, synthetic construct
  misc_feature 1..20: note = CRISPR gRNA sequence
  source 1..20: mol_type = other DNA
acaacgggctttctgtggcc

SEQ ID NO: 39546 - DNA, 20 bp, synthetic construct
  misc_feature 1..20: note = CRISPR gRNA sequence
  source 1..20: mol_type = other DNA
caacgggctttctgtggccg

SEQ ID NO: 39547 - DNA, 20 bp, synthetic construct
  misc_feature 1..20: note = CRISPR gRNA sequence
  source 1..20: mol_type = other DNA
gccggggtgcattgtgtgct

SEQ ID NO: 39548 - DNA, 20 bp, synthetic construct
  misc_feature 1..20: note = CRISPR gRNA sequence
  source 1..20: mol_type = other DNA
ccggggtgcattgtgtgctg

SEQ ID NO: 39549 - DNA, 20 bp, synthetic construct
  misc_feature 1..20: note = CRISPR gRNA sequence
  source 1..20: mol_type = other DNA
cggggtgcattgtgtgctga

SEQ ID NO: 39550 - DNA, 20 bp, synthetic construct
  misc_feature 1..20: note = CRISPR gRNA sequence
  source 1..20: mol_type = other DNA
cattgtgtgctgagggccgt

SEQ ID NO: 39551 - DNA, 20 bp, synthetic construct
  misc_feature 1..20: note = CRISPR gRNA sequence
  source 1..20: mol_type = other DNA
tgagggccgtgagtgcgtgc

SEQ ID NO: 39552 - DNA, 20 bp, synthetic construct
  misc_feature 1..20: note = CRISPR gRNA sequence
  source 1..20: mol_type = other DNA
cgtgagtgcgtgctggaccc

SEQ ID NO: 39553 - DNA, 20 bp, synthetic construct
  misc_feature 1..20: note = CRISPR gRNA sequence
  source 1..20: mol_type = other DNA
gagtgcgtgctggaccctgg

SEQ ID NO: 39554 - DNA, 20 bp, synthetic construct
  misc_feature 1..20: note = CRISPR gRNA sequence
  source 1..20: mol_type = other DNA
gtgcgtgctggaccctggca

SEQ ID NO: 39555 - DNA, 20 bp, synthetic construct
  misc_feature 1..20: note = CRISPR gRNA sequence
  source 1..20: mol_type = other DNA
accctggcagagctgcacat

SEQ ID NO: 39556 - DNA, 20 bp, synthetic construct
  misc_feature 1..20: note = CRISPR gRNA sequence
  source 1..20: mol_type = other DNA
ccctggcagagctgcacatc

SEQ ID NO: 39557 - DNA, 20 bp, synthetic construct
  misc_feature 1..20: note = CRISPR gRNA sequence
  source 1..20: mol_type = other DNA
tggcagagctgcacatcagg

SEQ ID NO: 39558 - DNA, 20 bp, synthetic construct
  misc_feature 1..20: note = CRISPR gRNA sequence
  source 1..20: mol_type = other DNA
ggcagagctgcacatcaggt

SEQ ID NO: 39559 - DNA, 20 bp, synthetic construct
  misc_feature 1..20: note = CRISPR gRNA sequence
  source 1..20: mol_type = other DNA
cagagctgcacatcaggtgg

SEQ ID NO: 39560 - DNA, 20 bp, synthetic construct
  misc_feature 1..20: note = CRISPR gRNA sequence
  source 1..20: mol_type = other DNA
acatcaggtgggagctccct

SEQ ID NO: 39561 - DNA, 20 bp, synthetic construct
  misc_feature 1..20: note = CRISPR gRNA sequence
  source 1..20: mol_type = other DNA
gtgggagctccctcagacca

SEQ ID NO: 39562 - DNA, 20 bp, synthetic construct
  misc_feature 1..20: note = CRISPR gRNA sequence
  source 1..20: mol_type = other DNA
cccccatcatgctctctctg

SEQ ID NO: 39563 - DNA, 20 bp, synthetic construct
  misc_feature 1..20: note = CRISPR gRNA sequence
  source 1..20: mol_type = other DNA
catgctctctctgaagccct

SEQ ID NO: 39564 - DNA, 20 bp, synthetic construct
  misc_feature 1..20: note = CRISPR gRNA sequence
  source 1..20: mol_type = other DNA
gaagcccttggaattccttc

SEQ ID NO: 39565 - DNA, 20 bp, synthetic construct
  misc_feature 1..20: note = CRISPR gRNA sequence
  source 1..20: mol_type = other DNA
aagcccttggaattccttct

SEQ ID NO: 39566 - DNA, 20 bp, synthetic construct
  misc_feature 1..20: note = CRISPR gRNA sequence
  source 1..20: mol_type = other DNA
cttggaattccttctgggcc

SEQ ID NO: 39567 - DNA, 20 bp, synthetic construct
  misc_feature 1..20: note = CRISPR gRNA sequence
  source 1..20: mol_type = other DNA
ttggaattccttctgggccc

SEQ ID NO: 39568 - DNA, 20 bp, synthetic construct
  misc_feature 1..20: note = CRISPR gRNA sequence
  source 1..20: mol_type = other DNA
ttccttctgggcccaggcct

SEQ ID NO: 39569 - DNA, 20 bp, synthetic construct
  misc_feature 1..20: note = CRISPR gRNA sequence
  source 1..20: mol_type = other DNA
tccttctgggcccaggcctt

SEQ ID NO: 39570 - DNA, 20 bp, synthetic construct
  misc_feature 1..20: note = CRISPR gRNA sequence
  source 1..20: mol_type = other DNA
tctgggcccaggccttggga

SEQ ID NO: 39571 - DNA, 20 bp, synthetic construct
  misc_feature 1..20: note = CRISPR gRNA sequence
  source 1..20: mol_type = other DNA
ctgggcccaggccttgggac

SEQ ID NO: 39572 - DNA, 20 bp, synthetic construct
  misc_feature 1..20: note = CRISPR gRNA sequence
  source 1..20: mol_type = other DNA
ggcccaggccttgggacggg

SEQ ID NO: 39573 - DNA, 20 bp, synthetic construct
  misc_feature 1..20: note = CRISPR gRNA sequence
  source 1..20: mol_type = other DNA
ccaggccttgggacgggcag

SEQ ID NO: 39574 - DNA, 20 bp, synthetic construct
  misc_feature 1..20: note = CRISPR gRNA sequence
  source 1..20: mol_type = other DNA
gatgctgctgctgtcccacc

SEQ ID NO: 39575 - DNA, 20 bp, synthetic construct
  misc_feature 1..20: note = CRISPR gRNA sequence
  source 1..20: mol_type = other DNA
gtcccacccagaccccgtta

SEQ ID NO: 39576 - DNA, 20 bp, synthetic construct
  misc_feature 1..20: note = CRISPR gRNA sequence
  source 1..20: mol_type = other DNA
cacccagaccccgttacagc

SEQ ID NO: 39577 - DNA, 20 bp, synthetic construct
  misc_feature 1..20: note = CRISPR gRNA sequence
  source 1..20: mol_type = other DNA
acagccggcacccctcttcc

SEQ ID NO: 39578 - DNA, 20 bp, synthetic construct
  misc_feature 1..20: note = CRISPR gRNA sequence
  source 1..20: mol_type = other DNA
acccctcttcctagctgctg

SEQ ID NO: 39579 - DNA, 20 bp, synthetic construct
  misc_feature 1..20: note = CRISPR gRNA sequence
  source 1..20: mol_type = other DNA
cttcctagctgctgtggata

SEQ ID NO: 39580 - DNA, 20 bp, synthetic construct
  misc_feature 1..20: note = CRISPR gRNA sequence
  source 1..20: mol_type = other DNA
ttcctagctgctgtggatat

SEQ ID NO: 39581 - DNA, 20 bp, synthetic construct
  misc_feature 1..20: note = CRISPR gRNA sequence
  source 1..20: mol_type = other DNA
ctgtggatataggctgctca

SEQ ID NO: 39582 - DNA, 20 bp, synthetic construct
  misc_feature 1..20: note = CRISPR gRNA sequence
  source 1..20: mol_type = other DNA
ctgctcatggtttatacctc

SEQ ID NO: 39583 - DNA, 20 bp, synthetic construct
  misc_feature 1..20: note = CRISPR gRNA sequence
  source 1..20: mol_type = other DNA
gctcatggtttatacctctg

SEQ ID NO: 39584 - DNA, 20 bp, synthetic construct
  misc_feature 1..20: note = CRISPR gRNA sequence
  source 1..20: mol_type = other DNA
tacctctggagaactaccct

SEQ ID NO: 39585 - DNA, 20 bp, synthetic construct
  misc_feature 1..20: note = CRISPR gRNA sequence
  source 1..20: mol_type = other DNA
gagaactacccttggctgat

SEQ ID NO: 39586 - DNA, 20 bp, synthetic construct
  misc_feature 1..20: note = CRISPR gRNA sequence
  source 1..20: mol_type = other DNA
tacccttggctgataagaac

SEQ ID NO: 39587 - DNA, 20 bp, synthetic construct
  misc_feature 1..20: note = CRISPR gRNA sequence
  source 1..20: mol_type = other DNA
cccttggctgataagaacca

SEQ ID NO: 39588 - DNA, 20 bp, synthetic construct
  misc_feature 1..20: note = CRISPR gRNA sequence
  source 1..20: mol_type = other DNA
tgataagaaccagagacgcc

SEQ ID NO: 39589 - DNA, 20 bp, synthetic construct
  misc_feature 1..20: note = CRISPR gRNA sequence
  source 1..20: mol_type = other DNA
taagaaccagagacgcctgg

SEQ ID NO: 39590 - DNA, 20 bp, synthetic construct
  misc_feature 1..20: note = CRISPR gRNA sequence
  source 1..20: mol_type = other DNA
aagaaccagagacgcctggc

SEQ ID NO: 39591 - DNA, 20 bp, synthetic construct
  misc_feature 1..20: note = CRISPR gRNA sequence
  source 1..20: mol_type = other DNA
agaaccagagacgcctggca

SEQ ID NO: 39592 - DNA, 20 bp, synthetic construct
  misc_feature 1..20: note = CRISPR gRNA sequence
  source 1..20: mol_type = other DNA
acccccactttcccctaacc

SEQ ID NO: 39593 - DNA, 20 bp, synthetic construct
  misc_feature 1..20: note = CRISPR gRNA sequence
  source 1..20: mol_type = other DNA
ccccactttcccctaaccta

SEQ ID NO: 39594 - DNA, 20 bp, synthetic construct
  misc_feature 1..20: note = CRISPR gRNA sequence
  source 1..20: mol_type = other DNA
cactttcccctaacctagag

SEQ ID NO: 39595 - DNA, 20 bp, synthetic construct
  misc_feature 1..20: note = CRISPR gRNA sequence
  source 1..20: mol_type = other DNA
taacctagagtggccaatga

SEQ ID NO: 39596 - DNA, 20 bp, synthetic construct
  misc_feature 1..20: note = CRISPR gRNA sequence
  source 1..20: mol_type = other DNA
acctagagtggccaatgaca

SEQ ID NO: 39597 - DNA, 20 bp, synthetic construct
  misc_feature 1..20: note = CRISPR gRNA sequence
  source 1..20: mol_type = other DNA
cctagagtggccaatgacag

SEQ ID NO: 39598 - DNA, 20 bp, synthetic construct
  misc_feature 1..20: note = CRISPR gRNA sequence
  source 1..20: mol_type = other DNA
agagtggccaatgacagagg

SEQ ID NO: 39599 - DNA, 20 bp, synthetic construct
  misc_feature 1..20: note = CRISPR gRNA sequence
  source 1..20: mol_type = other DNA
agtggccaatgacagaggca

SEQ ID NO: 39600 - DNA, 20 bp, synthetic construct
  misc_feature 1..20: note = CRISPR gRNA sequence
  source 1..20: mol_type = other DNA
gtggccaatgacagaggcag

SEQ ID NO: 39601 - DNA, 20 bp, synthetic construct
  misc_feature 1..20: note = CRISPR gRNA sequence
  source 1..20: mol_type = other DNA
tggccaatgacagaggcaga

SEQ ID NO: 39602 - DNA, 20 bp, synthetic construct
  misc_feature 1..20: note = CRISPR gRNA sequence
  source 1..20: mol_type = other DNA
aggcagagggcacaactctc

SEQ ID NO: 39603 - DNA, 20 bp, synthetic construct
  misc_feature 1..20: note = CRISPR gRNA sequence
  source 1..20: mol_type = other DNA
actctccagcccaaactctc

SEQ ID NO: 39604 - DNA, 20 bp, synthetic construct
  misc_feature 1..20: note = CRISPR gRNA sequence
  source 1..20: mol_type = other DNA
ctccagcccaaactctccag

SEQ ID NO: 39605 - DNA, 20 bp, synthetic construct
  misc_feature 1..20: note = CRISPR gRNA sequence
  source 1..20: mol_type = other DNA
tccagcccaaactctccagt

SEQ ID NO: 39606 - DNA, 20 bp, synthetic construct
  misc_feature 1..20: note = CRISPR gRNA sequence
  source 1..20: mol_type = other DNA
ccaaactctccagtgggaca

SEQ ID NO: 39607 - DNA, 20 bp, synthetic construct
  misc_feature 1..20: note = CRISPR gRNA sequence
  source 1..20: mol_type = other DNA
tccagtgggacaaagctccc

SEQ ID NO: 39608 - DNA, 20 bp, synthetic construct
  misc_feature 1..20: note = CRISPR gRNA sequence
  source 1..20: mol_type = other DNA
ccagtgggacaaagctccct

SEQ ID NO: 39609 - DNA, 20 bp, synthetic construct
  misc_feature 1..20: note = CRISPR gRNA sequence
  source 1..20: mol_type = other DNA
agtgggacaaagctccctgg

SEQ ID NO: 39610 - DNA, 20 bp, synthetic construct
  misc_feature 1..20: note = CRISPR gRNA sequence
  source 1..20: mol_type = other DNA
gacaaagctccctgggagac

SEQ ID NO: 39611 - DNA, 20 bp, synthetic construct
  misc_feature 1..20: note = CRISPR gRNA sequence
  source 1..20: mol_type = other DNA
acaaagctccctgggagact

SEQ ID NO: 39612 - DNA, 20 bp, synthetic construct
  misc_feature 1..20: note = CRISPR gRNA sequence
  source 1..20: mol_type = other DNA
gctccctgggagactaggcc

SEQ ID NO: 39613 - DNA, 20 bp, synthetic construct
  misc_feature 1..20: note = CRISPR gRNA sequence
  source 1..20: mol_type = other DNA
ctccctgggagactaggcca

SEQ ID NO: 39614 - DNA, 20 bp, synthetic construct
  misc_feature 1..20: note = CRISPR gRNA sequence
  source 1..20: mol_type = other DNA
ggccaaggacttgctccgtt

SEQ ID NO: 39615 - DNA, 20 bp, synthetic construct
  misc_feature 1..20: note = CRISPR gRNA sequence
  source 1..20: mol_type = other DNA
ttgctccgtttggcttccct

SEQ ID NO: 39616 - DNA, 20 bp, synthetic construct
  misc_feature 1..20: note = CRISPR gRNA sequence
  source 1..20: mol_type = other DNA
agtcccttactgtttctcct

SEQ ID NO: 39617 - DNA, 20 bp, synthetic construct
  misc_feature 1..20: note = CRISPR gRNA sequence
  source 1..20: mol_type = other DNA
tcccttactgtttctcctga

SEQ ID NO: 39618 - DNA, 20 bp, synthetic construct
  misc_feature 1..20: note = CRISPR gRNA sequence
  source 1..20: mol_type = other DNA
cttactgtttctcctgagag

SEQ ID NO: 39619 - DNA, 20 bp, synthetic construct
  misc_feature 1..20: note = CRISPR gRNA sequence
  source 1..20: mol_type = other DNA
ttctcctgagagcagaccgt

SEQ ID NO: 39620 - DNA, 20 bp, synthetic construct
  misc_feature 1..20: note = CRISPR gRNA sequence
  source 1..20: mol_type = other DNA
tcatgatgtgcgcaactgac

SEQ ID NO: 39621 - DNA, 20 bp, synthetic construct
  misc_feature 1..20: note = CRISPR gRNA sequence
  source 1..20: mol_type = other DNA
gcgaccccctaccccactca

SEQ ID NO: 39622 - DNA, 20 bp, synthetic construct
  misc_feature 1..20: note = CRISPR gRNA sequence
  source 1..20: mol_type = other DNA
ccctaccccactcacagacc

SEQ ID NO: 39623 - DNA, 20 bp, synthetic construct
  misc_feature 1..20: note = CRISPR gRNA sequence
  source 1..20: mol_type = other DNA
cctaccccactcacagaccc

SEQ ID NO: 39624 - DNA, 20 bp, synthetic construct
  misc_feature 1..20: note = CRISPR gRNA sequence
  source 1..20: mol_type = other DNA
acagacccaggctctgccac

SEQ ID NO: 39625 - DNA, 20 bp, synthetic construct
  misc_feature 1..20: note = CRISPR gRNA sequence
  source 1..20: mol_type = other DNA
cagacccaggctctgccact

SEQ ID NO: 39626 - DNA, 20 bp, synthetic construct
  misc_feature 1..20: note = CRISPR gRNA sequence
  source 1..20: mol_type = other DNA
agacccaggctctgccacta

SEQ ID NO: 39627 - DNA, 20 bp, synthetic construct
  misc_feature 1..20: note = CRISPR gRNA sequence
  source 1..20: mol_type = other DNA
gaacccaatcctatttctgt

SEQ ID NO: 39628 - DNA, 20 bp, synthetic construct
  misc_feature 1..20: note = CRISPR gRNA sequence
  source 1..20: mol_type = other DNA
tttctgtaagtctcgccgtt

SEQ ID NO: 39629 - DNA, 20 bp, synthetic construct
  misc_feature 1..20: note = CRISPR gRNA sequence
  source 1..20: mol_type = other DNA
gtaagtctcgccgttgagta

SEQ ID NO: 39630 - DNA, 20 bp, synthetic construct
  misc_feature 1..20: note = CRISPR gRNA sequence
  source 1..20: mol_type = other DNA
taagtctcgccgttgagtat

SEQ ID NO: 39631 - DNA, 20 bp, synthetic construct
  misc_feature 1..20: note = CRISPR gRNA sequence
  source 1..20: mol_type = other DNA
aagtctcgccgttgagtatg

SEQ ID NO: 39632 - DNA, 20 bp, synthetic construct
  misc_feature 1..20: note = CRISPR gRNA sequence
  source 1..20: mol_type = other DNA
gtctcgccgttgagtatggg

SEQ ID NO: 39633 - DNA, 20 bp, synthetic construct
  misc_feature 1..20: note = CRISPR gRNA sequence
  source 1..20: mol_type = other DNA
tctcgccgttgagtatgggg

SEQ ID NO: 39634 - DNA, 20 bp, synthetic construct
  misc_feature 1..20: note = CRISPR gRNA sequence
  source 1..20: mol_type = other DNA
gccgttgagtatggggaggt

SEQ ID NO: 39635 - DNA, 20 bp, synthetic construct
  misc_feature 1..20: note = CRISPR gRNA sequence
  source 1..20: mol_type = other DNA
ccgttgagtatggggaggtg

SEQ ID NO: 39636 - DNA, 20 bp, synthetic construct
  misc_feature 1..20: note = CRISPR gRNA sequence
  source 1..20: mol_type = other DNA
tgagtatggggaggtgagga

SEQ ID NO: 39637 - DNA, 20 bp, synthetic construct
  misc_feature 1..20: note = CRISPR gRNA sequence
  source 1..20: mol_type = other DNA
gatgatgattaatgtcaact

SEQ ID NO: 39638 - DNA, 20 bp, synthetic construct
  misc_feature 1..20: note = CRISPR gRNA sequence
  source 1..20: mol_type = other DNA
atgtcaactcagttcccact

SEQ ID NO: 39639 - DNA, 20 bp, synthetic construct
  misc_feature 1..20: note = CRISPR gRNA sequence
  source 1..20: mol_type = other DNA
gtcaactcagttcccactcg

SEQ ID NO: 39640 - DNA, 20 bp, synthetic construct
  misc_feature 1..20: note = CRISPR gRNA sequence
  source 1..20: mol_type = other DNA
tcaactcagttcccactcgg

SEQ ID NO: 39641 - DNA, 20 bp, synthetic construct
  misc_feature 1..20: note = CRISPR gRNA sequence
  source 1..20: mol_type = other DNA
ctcagttcccactcggagga

SEQ ID NO: 39642 - DNA, 20 bp, synthetic construct
  misc_feature 1..20: note = CRISPR gRNA sequence
  source 1..20: mol_type = other DNA
ggaaagcctcattctcaacc

SEQ ID NO: 39643 - DNA, 20 bp, synthetic construct
  misc_feature 1..20: note = CRISPR gRNA sequence
  source 1..20: mol_type = other DNA
aagcctcattctcaacccag

SEQ ID NO: 39644 - DNA, 20 bp, synthetic construct
  misc_feature 1..20: note = CRISPR gRNA sequence
  source 1..20: mol_type = other DNA
agcctcattctcaacccagt

SEQ ID NO: 39645 - DNA, 20 bp, synthetic construct
  misc_feature 1..20: note = CRISPR gRNA sequence
  source 1..20: mol_type = other DNA
gcctcattctcaacccagta

SEQ ID NO: 39646 - DNA, 20 bp, synthetic construct
  misc_feature 1..20: note = CRISPR gRNA sequence
  source 1..20: mol_type = other DNA
tcattctcaacccagtaggg

SEQ ID NO: 39647 - DNA, 20 bp, synthetic construct
  misc_feature 1..20: note = CRISPR gRNA sequence
  source 1..20: mol_type = other DNA
ccctgctttaaacacccctc

SEQ ID NO: 39648 - DNA, 20 bp, synthetic construct
  misc_feature 1..20: note = CRISPR gRNA sequence
  source 1..20: mol_type = other DNA
cctgctttaaacacccctca

SEQ ID NO: 39649 - DNA, 20 bp, synthetic construct
  misc_feature 1..20: note = CRISPR gRNA sequence
  source 1..20: mol_type = other DNA
ctgctttaaacacccctcaa

SEQ ID NO: 39650 - DNA, 20 bp, synthetic construct
  misc_feature 1..20: note = CRISPR gRNA sequence
  source 1..20: mol_type = other DNA
gctttaaacacccctcaagg

SEQ ID NO: 39651 - DNA, 20 bp, synthetic construct
  misc_feature 1..20: note = CRISPR gRNA sequence
  source 1..20: mol_type = other DNA
ctttaaacacccctcaaggg

SEQ ID NO: 39652 - DNA, 20 bp, synthetic construct
  misc_feature 1..20: note = CRISPR gRNA sequence
  source 1..20: mol_type = other DNA
ttaaacacccctcaagggag

SEQ ID NO: 39653 - DNA, 20 bp, synthetic construct
  misc_feature 1..20: note = CRISPR gRNA sequence
  source 1..20: mol_type = other DNA
aaacacccctcaagggagga

SEQ ID NO: 39654 - DNA, 20 bp, synthetic construct
  misc_feature 1..20: note = CRISPR gRNA sequence
  source 1..20: mol_type = other DNA
aacacccctcaagggaggag

SEQ ID NO: 39655 - DNA, 20 bp, synthetic construct
  misc_feature 1..20: note = CRISPR gRNA sequence
  source 1..20: mol_type = other DNA
acacccctcaagggaggaga

SEQ ID NO: 39656 - DNA, 20 bp, synthetic construct
  misc_feature 1..20: note = CRISPR gRNA sequence
  source 1..20: mol_type = other DNA
agggaaaccgattcacccaa

SEQ ID NO: 39657 - DNA, 20 bp, synthetic construct
  misc_feature 1..20: note = CRISPR gRNA sequence
  source 1..20: mol_type = other DNA
gggaaaccgattcacccaaa

SEQ ID NO: 39658 - DNA, 20 bp, synthetic construct
  misc_feature 1..20: note = CRISPR gRNA sequence
  source 1..20: mol_type = other DNA
aaaccgattcacccaaaagg

SEQ ID NO: 39659 - DNA, 20 bp, synthetic construct
  misc_feature 1..20: note = CRISPR gRNA sequence
  source 1..20: mol_type = other DNA
gattcacccaaaaggtagat

SEQ ID NO: 39660 - DNA, 20 bp, synthetic construct
  misc_feature 1..20: note = CRISPR gRNA sequence
  source 1..20: mol_type = other DNA
attcacccaaaaggtagatt

SEQ ID NO: 39661 - DNA, 20 bp, synthetic construct
  misc_feature 1..20: note = CRISPR gRNA sequence
  source 1..20: mol_type = other DNA
ttcacccaaaaggtagatta

SEQ ID NO: 39662 - DNA, 20 bp, synthetic construct
  misc_feature 1..20: note = CRISPR gRNA sequence
  source 1..20: mol_type = other DNA
tcacccaaaaggtagattag

SEQ ID NO: 39663 - DNA, 20 bp, synthetic construct
  misc_feature 1..20: note = CRISPR gRNA sequence
  source 1..20: mol_type = other DNA
aaaggtagattaggggacct

SEQ ID NO: 39664 - DNA, 20 bp, synthetic construct
  misc_feature 1..20: note = CRISPR gRNA sequence
  source 1..20: mol_type = other DNA
ctgtatatgatgattcaata

SEQ ID NO: 39665 - DNA, 20 bp, synthetic construct
  misc_feature 1..20: note = CRISPR gRNA sequence
  source 1..20: mol_type = other DNA
tgtatatgatgattcaataa

SEQ ID NO: 39666 - DNA, 20 bp, synthetic construct
  misc_feature 1..20: note = CRISPR gRNA sequence
  source 1..20: mol_type = other DNA
gtatatgatgattcaataaa

SEQ ID NO: 39667 - DNA, 20 bp, synthetic construct
  misc_feature 1..20: note = CRISPR gRNA sequence
  source 1..20: mol_type = other DNA
atgattcaataaagggtccc

SEQ ID NO: 39668 - DNA, 20 bp, synthetic construct
  misc_feature 1..20: note = CRISPR gRNA sequence
  source 1..20: mol_type = other DNA
aagggtccctagtgcattcc

SEQ ID NO: 39669 - DNA, 20 bp, synthetic construct
  misc_feature 1..20: note = CRISPR gRNA sequence
  source 1..20: mol_type = other DNA
agcgatgccctgttcacttc

SEQ ID NO: 39670 - DNA, 20 bp, synthetic construct
  misc_feature 1..20: note = CRISPR gRNA sequence
  source 1..20: mol_type = other DNA
gcgatgccctgttcacttcc

SEQ ID NO: 39671 - DNA, 20 bp, synthetic construct
  misc_feature 1..20: note = CRISPR gRNA sequence
  source 1..20: mol_type = other DNA
cacgattgtgcaaacacatt

SEQ ID NO: 39672 - DNA, 20 bp, synthetic construct
  misc_feature 1..20: note = CRISPR gRNA sequence
  source 1..20: mol_type = other DNA
tgtgcaaacacatttagctg

SEQ ID NO: 39673 - DNA, 20 bp, synthetic construct
  misc_feature 1..20: note = CRISPR gRNA sequence
  source 1..20: mol_type = other DNA
gtgcaaacacatttagctgt

SEQ ID NO: 39674 - DNA, 20 bp, synthetic construct
  misc_feature 1..20: note = CRISPR gRNA sequence
  source 1..20: mol_type = other DNA
tgcaaacacatttagctgta

SEQ ID NO: 39675 - DNA, 20 bp, synthetic construct
  misc_feature 1..20: note = CRISPR gRNA sequence
  source 1..20: mol_type = other DNA
agctgtagggatgttcacct

SEQ ID NO: 39676 - DNA, 20 bp, synthetic construct
  misc_feature 1..20: note = CRISPR gRNA sequence
  source 1..20: mol_type = other DNA
agggatgttcacctcagtat

SEQ ID NO: 39677 - DNA, 20 bp, synthetic construct
  misc_feature 1..20: note = CRISPR gRNA sequence
  source 1..20: mol_type = other DNA
cacctcagtattggttataa

SEQ ID NO: 39678 - DNA, 20 bp, synthetic construct
  misc_feature 1..20: note = CRISPR gRNA sequence
  source 1..20: mol_type = other DNA
acctcagtattggttataat

SEQ ID NO: 39679 - DNA, 20 bp, synthetic construct
  misc_feature 1..20: note = CRISPR gRNA sequence
  source 1..20: mol_type = other DNA
tggttataataggaaaaaaa

SEQ ID NO: 39680 - DNA, 20 bp, synthetic construct
  misc_feature 1..20: note = CRISPR gRNA sequence
  source 1..20: mol_type = other DNA
aataggaaaaaaaaagaaaa

SEQ ID NO: 39681 - DNA, 20 bp, synthetic construct
  misc_feature 1..20: note = CRISPR gRNA sequence
  source 1..20: mol_type = other DNA
ggaaaaaaaaagaaaatagc

SEQ ID NO: 39682 - DNA, 20 bp, synthetic construct
  misc_feature 1..20: note = CRISPR gRNA sequence
  source 1..20: mol_type = other DNA
aatagctggaatgtttaacc

SEQ ID NO: 39683 - DNA, 20 bp, synthetic construct
  misc_feature 1..20: note = CRISPR gRNA sequence
  source 1..20: mol_type = other DNA
atagctggaatgtttaaccg

SEQ ID NO: 39684 - DNA, 20 bp, synthetic construct
  misc_feature 1..20: note = CRISPR gRNA sequence
  source 1..20: mol_type = other DNA
tagctggaatgtttaaccga

SEQ ID NO: 39685 - DNA, 20 bp, synthetic construct
  misc_feature 1..20: note = CRISPR gRNA sequence
  source 1..20: mol_type = other DNA
aatgtttaaccgagggatat

SEQ ID NO: 39686 - DNA, 20 bp, synthetic construct
  misc_feature 1..20: note = CRISPR gRNA sequence
  source 1..20: mol_type = other DNA
tttaaccgagggatattagt

SEQ ID NO: 39687 - DNA, 20 bp, synthetic construct
  misc_feature 1..20: note = CRISPR gRNA sequence
  source 1..20: mol_type = other DNA
cgagggatattagttagact

SEQ ID NO: 39688 - DNA, 20 bp, synthetic construct
  misc_feature 1..20: note = CRISPR gRNA sequence
  source 1..20: mol_type = other DNA
tagttagactaagttacttc

SEQ ID NO: 39689 - DNA, 20 bp, synthetic construct
  misc_feature 1..20: note = CRISPR gRNA sequence
  source 1..20: mol_type = other DNA
gttagactaagttacttcca

SEQ ID NO: 39690 - DNA, 20 bp, synthetic construct
  misc_feature 1..20: note = CRISPR gRNA sequence
  source 1..20: mol_type = other DNA
tagactaagttacttccaga

SEQ ID NO: 39691 - DNA, 20 bp, synthetic construct
  misc_feature 1..20: note = CRISPR gRNA sequence
  source 1..20: mol_type = other DNA
agttacttccagagagaact

SEQ ID NO: 39692 - DNA, 20 bp, synthetic construct
  misc_feature 1..20: note = CRISPR gRNA sequence
  source 1..20: mol_type = other DNA
tacttccagagagaactcag

SEQ ID NO: 39693 - DNA, 20 bp, synthetic construct
  misc_feature 1..20: note = CRISPR gRNA sequence
  source 1..20: mol_type = other DNA
gagagaactcagtggaacca

SEQ ID NO: 39694 - DNA, 20 bp, synthetic construct
  misc_feature 1..20: note = CRISPR gRNA sequence
  source 1..20: mol_type = other DNA
tagaaaaaaaaatgataata

SEQ ID NO: 39695 - DNA, 20 bp, synthetic construct
  misc_feature 1..20: note = CRISPR gRNA sequence
  source 1..20: mol_type = other DNA
agaaaaaaaaatgataatat

SEQ ID NO: 39696 - DNA, 20 bp, synthetic construct
  misc_feature 1..20: note = CRISPR gRNA sequence
  source 1..20: mol_type = other DNA
aaaaaatgataatataggtg

SEQ ID NO: 39697 - DNA, 20 bp, synthetic construct
  misc_feature 1..20: note = CRISPR gRNA sequence
  source 1..20: mol_type = other DNA
atataggtgcagtttcaata

SEQ ID NO: 39698 - DNA, 20 bp, synthetic construct
  misc_feature 1..20: note = CRISPR gRNA sequence
  source 1..20: mol_type = other DNA
ataggtgcagtttcaatatg

SEQ ID NO: 39699 - DNA, 20 bp, synthetic construct
  misc_feature 1..20: note = CRISPR gRNA sequence
  source 1..20: mol_type = other DNA
taggtgcagtttcaatatgg

SEQ ID NO: 39700 - DNA, 20 bp, synthetic construct
  misc_feature 1..20: note = CRISPR gRNA sequence
  source 1..20: mol_type = other DNA
aggtgcagtttcaatatgga

SEQ ID NO: 39701 - DNA, 20 bp, synthetic construct
  misc_feature 1..20: note = CRISPR gRNA sequence
  source 1..20: mol_type = other DNA
ggtgcagtttcaatatggag

SEQ ID NO: 39702 - DNA, 20 bp, synthetic construct
  misc_feature 1..20: note = CRISPR gRNA sequence
  source 1..20: mol_type = other DNA
gtttcaatatggaggggtga

SEQ ID NO: 39703 - DNA, 20 bp, synthetic construct
  misc_feature 1..20: note = CRISPR gRNA sequence
  source 1..20: mol_type = other DNA
tttcaatatggaggggtgac

SEQ ID NO: 39704 - DNA, 20 bp, synthetic construct
  misc_feature 1..20: note = CRISPR gRNA sequence
  source 1..20: mol_type = other DNA
ttcaatatggaggggtgacg

SEQ ID NO: 39705 - DNA, 20 bp, synthetic construct
  misc_feature 1..20: note = CRISPR gRNA sequence
  source 1..20: mol_type = other DNA
caatatggaggggtgacggg

SEQ ID NO: 39706 - DNA, 20 bp, synthetic construct
  misc_feature 1..20: note = CRISPR gRNA sequence
  source 1..20: mol_type = other DNA
aggggtgacggggagttatt

SEQ ID NO: 39707 - DNA, 20 bp, synthetic construct
  misc_feature 1..20: note = CRISPR gRNA sequence
  source 1..20: mol_type = other DNA
ggagttattaagtaaacata

SEQ ID NO: 39708 - DNA, 20 bp, synthetic construct
  misc_feature 1..20: note = CRISPR gRNA sequence
  source 1..20: mol_type = other DNA
taaacataaagaaatttctt

SEQ ID NO: 39709 - DNA, 20 bp, synthetic construct
  misc_feature 1..20: note = CRISPR gRNA sequence
  source 1..20: mol_type = other DNA
aacataaagaaatttcttta

SEQ ID NO: 39710 - DNA, 20 bp, synthetic construct
  misc_feature 1..20: note = CRISPR gRNA sequence
  source 1..20: mol_type = other DNA
taaagaaatttctttagaga

SEQ ID NO: 39711 - DNA, 20 bp, synthetic construct
  misc_feature 1..20: note = CRISPR gRNA sequence
  source 1..20: mol_type = other DNA
aaagaaatttctttagagac

SEQ ID NO: 39712 - DNA, 20 bp, synthetic construct
  misc_feature 1..20: note = CRISPR gRNA sequence
  source 1..20: mol_type = other DNA
caggatcttgctctgttacc

SEQ ID NO: 39713 - DNA, 20 bp, synthetic construct
  misc_feature 1..20: note = CRISPR gRNA sequence
  source 1..20: mol_type = other DNA
aggatcttgctctgttacca

SEQ ID NO: 39714 - DNA, 20 bp, synthetic construct
  misc_feature 1..20: note = CRISPR gRNA sequence
  source 1..20: mol_type = other DNA
tcttgctctgttaccaaggc

SEQ ID NO: 39715 - DNA, 20 bp, synthetic construct
  misc_feature 1..20: note = CRISPR gRNA sequence
  source 1..20: mol_type = other DNA
ttgctctgttaccaaggctg

SEQ ID NO: 39716 - DNA, 20 bp, synthetic construct
  misc_feature 1..20: note = CRISPR gRNA sequence
  source 1..20: mol_type = other DNA
ctgttaccaaggctggagta

SEQ ID NO: 39717 - DNA, 20 bp, synthetic construct
  misc_feature 1..20: note = CRISPR gRNA sequence
  source 1..20: mol_type = other DNA
ggagtacagtgacacaatca

SEQ ID NO: 39718 - DNA, 20 bp, synthetic construct
  misc_feature 1..20: note = CRISPR gRNA sequence
  source 1..20: mol_type = other DNA
tcactgtaacctccaaatcc

SEQ ID NO: 39719 - DNA, 20 bp, synthetic construct
  misc_feature 1..20: note = CRISPR gRNA sequence
  source 1..20: mol_type = other DNA
cactgtaacctccaaatcct

SEQ ID NO: 39720 - DNA, 20 bp, synthetic construct
  misc_feature 1..20: note = CRISPR gRNA sequence
  source 1..20: mol_type = other DNA
taacctccaaatcctgggct

SEQ ID NO: 39721 - DNA, 20 bp, synthetic construct
  misc_feature 1..20: note = CRISPR gRNA sequence
  source 1..20: mol_type = other DNA
gctcagcaatccatctctct

SEQ ID NO: 39722 - DNA, 20 bp, synthetic construct
  misc_feature 1..20: note = CRISPR gRNA sequence
  source 1..20: mol_type = other DNA
ccatctctcttagtctccca

SEQ ID NO: 39723 - DNA, 20 bp, synthetic construct
  misc_feature 1..20: note = CRISPR gRNA sequence
  source 1..20: mol_type = other DNA
ctcttagtctcccaaagtgc

SEQ ID NO: 39724 - DNA, 20 bp, synthetic construct
  misc_feature 1..20: note = CRISPR gRNA sequence
  source 1..20: mol_type = other DNA
tcttagtctcccaaagtgct

SEQ ID NO: 39725 - DNA, 20 bp, synthetic construct
  misc_feature 1..20: note = CRISPR gRNA sequence
  source 1..20: mol_type = other DNA
ctcccaaagtgctgggatta

SEQ ID NO: 39726 - DNA, 20 bp, synthetic construct
  misc_feature 1..20: note = CRISPR gRNA sequence
  source 1..20: mol_type = other DNA
agtgctgggattacagtcat

SEQ ID NO: 39727 - DNA, 20 bp, synthetic construct
  misc_feature 1..20: note = CRISPR gRNA sequence
  source 1..20: mol_type = other DNA
cagtcatgagtcactatgcc

SEQ ID NO: 39728 - DNA, 20 bp, synthetic construct
  misc_feature 1..20: note = CRISPR gRNA sequence
  source 1..20: mol_type = other DNA
ctggcaattttttttatttt

SEQ ID NO: 39729 - DNA, 20 bp, synthetic construct
  misc_feature 1..20: note = CRISPR gRNA sequence
  source 1..20: mol_type = other DNA
gcaattttttttatttttag

SEQ ID NO: 39730 - DNA, 20 bp, synthetic construct
  misc_feature 1..20: note = CRISPR gRNA sequence
  source 1..20: mol_type = other DNA
aattttttttatttttagta

SEQ ID NO: 39731 - DNA, 20 bp, synthetic construct
  misc_feature 1..20: note = CRISPR gRNA sequence
  source 1..20: mol_type = other DNA
ttttttttatttttagtaga

SEQ ID NO: 39732 - DNA, 20 bp, synthetic construct
  misc_feature 1..20: note = CRISPR gRNA sequence
  source 1..20: mol_type = other DNA
ttttttatttttagtagaga

SEQ ID NO: 39733 - DNA, 20 bp, synthetic construct
  misc_feature 1..20: note = CRISPR gRNA sequence
  source 1..20: mol_type = other DNA
tttttatttttagtagagag

SEQ ID NO: 39734 - DNA, 20 bp, synthetic construct
  misc_feature 1..20: note = CRISPR gRNA sequence
  source 1..20: mol_type = other DNA
ttttatttttagtagagaga

SEQ ID NO: 39735 - DNA, 20 bp, synthetic construct
  misc_feature 1..20: note = CRISPR gRNA sequence
  source 1..20: mol_type = other DNA
gagggtcttgctatattgac

SEQ ID NO: 39736 - DNA, 20 bp, synthetic construct
  misc_feature 1..20: note = CRISPR gRNA sequence
  source 1..20: mol_type = other DNA
agggtcttgctatattgacc

SEQ ID NO: 39737 - DNA, 20 bp, synthetic construct
  misc_feature 1..20: note = CRISPR gRNA sequence
  source 1..20: mol_type = other DNA
caggctgttctcaaactccc

SEQ ID NO: 39738 - DNA, 20 bp, synthetic construct
  misc_feature 1..20: note = CRISPR gRNA sequence
  source 1..20: mol_type = other DNA
ctcatgtgatcctcctgccc

SEQ ID NO: 39739 - DNA, 20 bp, synthetic construct
  misc_feature 1..20: note = CRISPR gRNA sequence
  source 1..20: mol_type = other DNA
cctcctgccctggcctccca

SEQ ID NO: 39740 - DNA, 20 bp, synthetic construct
  misc_feature 1..20: note = CRISPR gRNA sequence
  source 1..20: mol_type = other DNA
tcctgccctggcctcccaaa

SEQ ID NO: 39741 - DNA, 20 bp, synthetic construct
  misc_feature 1..20: note = CRISPR gRNA sequence
  source 1..20: mol_type = other DNA
gccctggcctcccaaagagc

SEQ ID NO: 39742 - DNA, 20 bp, synthetic construct
  misc_feature 1..20: note = CRISPR gRNA sequence
  source 1..20: mol_type = other DNA
ccctggcctcccaaagagca

SEQ ID NO: 39743 - DNA, 20 bp, synthetic construct
  misc_feature 1..20: note = CRISPR gRNA sequence
  source 1..20: mol_type = other DNA
ctcccaaagagcaaggatta

SEQ ID NO: 39744 - DNA, 20 bp, synthetic construct
  misc_feature 1..20: note = CRISPR gRNA sequence
  source 1..20: mol_type = other DNA
tcccaaagagcaaggattat

SEQ ID NO: 39745 - DNA, 20 bp, synthetic construct
  misc_feature 1..20: note = CRISPR gRNA sequence
  source 1..20: mol_type = other DNA
ataggtatgaaccactgcac

SEQ ID NO: 39746 - DNA, 20 bp, synthetic construct
  misc_feature 1..20: note = CRISPR gRNA sequence
  source 1..20: mol_type = other DNA
taggtatgaaccactgcacc

SEQ ID NO: 39747 - DNA, 20 bp, synthetic construct
  misc_feature 1..20: note = CRISPR gRNA sequence
  source 1..20: mol_type = other DNA
attttaactcattatcttaa

SEQ ID NO: 39748 - DNA, 20 bp, synthetic construct
  misc_feature 1..20: note = CRISPR gRNA sequence
  source 1..20: mol_type = other DNA
attatcttaaaagattataa

SEQ ID NO: 39749 - DNA, 20 bp, synthetic construct
  misc_feature 1..20: note = CRISPR gRNA sequence
  source 1..20: mol_type = other DNA
gattataaaagattataata

SEQ ID NO: 39750 - DNA, 20 bp, synthetic construct
  misc_feature 1..20: note = CRISPR gRNA sequence
  source 1..20: mol_type = other DNA
agattataataaagcttttc

SEQ ID NO: 39751 - DNA, 20 bp, synthetic construct
  misc_feature 1..20: note = CRISPR gRNA sequence
  source 1..20: mol_type = other DNA
aagcttttcaagatatgcaa

SEQ ID NO: 39752 - DNA, 20 bp, synthetic construct
  misc_feature 1..20: note = CRISPR gRNA sequence
  source 1..20: mol_type = other DNA
cttttcaagatatgcaatgg

SEQ ID NO: 39753 - DNA, 20 bp, synthetic construct
  misc_feature 1..20: note = CRISPR gRNA sequence
  source 1..20: mol_type = other DNA
tcaagatatgcaatggcaga

SEQ ID NO: 39754 - DNA, 20 bp, synthetic construct
  misc_feature 1..20: note = CRISPR gRNA sequence
  source 1..20: mol_type = other DNA
atatgcaatggcagaaagaa

SEQ ID NO: 39755 - DNA, 20 bp, synthetic construct
  misc_feature 1..20: note = CRISPR gRNA sequence
  source 1..20: mol_type = other DNA
gcagaaagaatggtataatc

SEQ ID NO: 39756 - DNA, 20 bp, synthetic construct
  misc_feature 1..20: note = CRISPR gRNA sequence
  source 1..20: mol_type = other DNA
cagaaagaatggtataatct

SEQ ID NO: 39757 - DNA, 20 bp, synthetic construct
  misc_feature 1..20: note = CRISPR gRNA sequence
  source 1..20: mol_type = other DNA
aagaatggtataatctgggc

SEQ ID NO: 39758 - DNA, 20 bp, synthetic construct
  misc_feature 1..20: note = CRISPR gRNA sequence
  source 1..20: mol_type = other DNA
agaatggtataatctgggcc

SEQ ID NO: 39759 - DNA, 20 bp, synthetic construct
  misc_feature 1..20: note = CRISPR gRNA sequence
  source 1..20: mol_type = other DNA
ataatctgggccaggtgctg

SEQ ID NO: 39760 - DNA, 20 bp, synthetic construct
  misc_feature 1..20: note = CRISPR gRNA sequence
  source 1..20: mol_type = other DNA
tgtggctcatgctgtaaacc

SEQ ID NO: 39761 - DNA, 20 bp, synthetic construct
  misc_feature 1..20: note = CRISPR gRNA sequence
  source 1..20: mol_type = other DNA
atgctgtaaacccagcactt

SEQ ID NO: 39762 - DNA, 20 bp, synthetic construct
  misc_feature 1..20: note = CRISPR gRNA sequence
  source 1..20: mol_type = other DNA
tgctgtaaacccagcacttt

SEQ ID NO: 39763 - DNA, 20 bp, synthetic construct
  misc_feature 1..20: note = CRISPR gRNA sequence
  source 1..20: mol_type = other DNA
ctgtaaacccagcactttgg

SEQ ID NO: 39764 - DNA, 20 bp, synthetic construct
  misc_feature 1..20: note = CRISPR gRNA sequence
  source 1..20: mol_type = other DNA
tgtaaacccagcactttggg

SEQ ID NO: 39765 - DNA, 20 bp, synthetic construct
  misc_feature 1..20: note = CRISPR gRNA sequence
  source 1..20: mol_type = other DNA
acccagcactttgggaggct

SEQ ID NO: 39766 - DNA, 20 bp, synthetic construct
  misc_feature 1..20: note = CRISPR gRNA sequence
  source 1..20: mol_type = other DNA
cccagcactttgggaggctg

SEQ ID NO: 39767 - DNA, 20 bp, synthetic construct
  misc_feature 1..20: note = CRISPR gRNA sequence
  source 1..20: mol_type = other DNA
agcactttgggaggctgagg

SEQ ID NO: 39768 - DNA, 20 bp, synthetic construct
  misc_feature 1..20: note = CRISPR gRNA sequence
  source 1..20: mol_type = other DNA
gcactttgggaggctgaggc

SEQ ID NO: 39769 - DNA, 20 bp, synthetic construct
  misc_feature 1..20: note = CRISPR gRNA sequence
  source 1..20: mol_type = other DNA
cactttgggaggctgaggca

SEQ ID NO: 39770 - DNA, 20 bp, synthetic construct
  misc_feature 1..20: note = CRISPR gRNA sequence
  source 1..20: mol_type = other DNA
actttgggaggctgaggcag

SEQ ID NO: 39771 - DNA, 20 bp, synthetic construct
  misc_feature 1..20: note = CRISPR gRNA sequence
  source 1..20: mol_type = other DNA
ctttgggaggctgaggcagg

SEQ ID NO: 39772 - DNA, 20 bp, synthetic construct
  misc_feature 1..20: note = CRISPR gRNA sequence
  source 1..20: mol_type = other DNA
ctgaggcagggggatcacct

SEQ ID NO: 39773 - DNA, 20 bp, synthetic construct
  misc_feature 1..20: note = CRISPR gRNA sequence
  source 1..20: mol_type = other DNA
tgaggcagggggatcacctg

SEQ ID NO: 39774 - DNA, 20 bp, synthetic construct
  misc_feature 1..20: note = CRISPR gRNA sequence
  source 1..20: mol_type = other DNA
gcagggggatcacctgaggt

SEQ ID NO: 39775 - DNA, 20 bp, synthetic construct
  misc_feature 1..20: note = CRISPR gRNA sequence
  source 1..20: mol_type = other DNA
cagggggatcacctgaggtc

SEQ ID NO: 39776 - DNA, 20 bp, synthetic construct
  misc_feature 1..20: note = CRISPR gRNA sequence
  source 1..20: mol_type = other DNA
gggggatcacctgaggtcag

SEQ ID NO: 39777 - DNA, 20 bp, synthetic construct
  misc_feature 1..20: note = CRISPR gRNA sequence
  source 1..20: mol_type = other DNA
tcacctgaggtcaggagttc

SEQ ID NO: 39778 - DNA, 20 bp, synthetic construct
  misc_feature 1..20: note = CRISPR gRNA sequence
  source 1..20: mol_type = other DNA
tgaggtcaggagttcaagac

SEQ ID NO: 39779 - DNA, 20 bp, synthetic construct
  misc_feature 1..20: note = CRISPR gRNA sequence
  source 1..20: mol_type = other DNA
tcaggagttcaagaccagcc

SEQ ID NO: 39780 - DNA, 20 bp, synthetic construct
  misc_feature 1..20: note = CRISPR gRNA sequence
  source 1..20: mol_type = other DNA
ttcaagaccagcctggccaa

SEQ ID NO: 39781 - DNA, 20 bp, synthetic construct
  misc_feature 1..20: note = CRISPR gRNA sequence
  source 1..20: mol_type = other DNA
tcaagaccagcctggccaat

SEQ ID NO: 39782 - DNA, 20 bp, synthetic construct
  misc_feature 1..20: note = CRISPR gRNA sequence
  source 1..20: mol_type = other DNA
tctactaaaaatacaaaaac

SEQ ID NO: 39783 - DNA, 20 bp, synthetic construct
  misc_feature 1..20: note = CRISPR gRNA sequence
  source 1..20: mol_type = other DNA
ctaaaaatacaaaaactagc

SEQ ID NO: 39784 - DNA, 20 bp, synthetic construct
  misc_feature 1..20: note = CRISPR gRNA sequence
  source 1..20: mol_type = other DNA
taaaaatacaaaaactagct

SEQ ID NO: 39785 - DNA, 20 bp, synthetic construct
  misc_feature 1..20: note = CRISPR gRNA sequence
  source 1..20: mol_type = other DNA
atacaaaaactagctgggca

SEQ ID NO: 39786 - DNA, 20 bp, synthetic construct
  misc_feature 1..20: note = CRISPR gRNA sequence
  source 1..20: mol_type = other DNA
caaaaactagctgggcatgg

SEQ ID NO: 39787 - DNA, 20 bp, synthetic construct
  misc_feature 1..20: note = CRISPR gRNA sequence
  source 1..20: mol_type = other DNA
gtggcgtgcacctgtaattc

SEQ ID NO: 39788 - DNA, 20 bp, synthetic construct
  misc_feature 1..20: note = CRISPR gRNA sequence
  source 1..20: mol_type = other DNA
cacctgtaattccagctact

SEQ ID NO: 39789 - DNA, 20 bp, synthetic construct
  misc_feature 1..20: note = CRISPR gRNA sequence
  source 1..20: mol_type = other DNA
acctgtaattccagctactc

SEQ ID NO: 39790 - DNA, 20 bp, synthetic construct
  misc_feature 1..20: note = CRISPR gRNA sequence
  source 1..20: mol_type = other DNA
ctgtaattccagctactcag

SEQ ID NO: 39791 - DNA, 20 bp, synthetic construct
  misc_feature 1..20: note = CRISPR gRNA sequence
  source 1..20: mol_type = other DNA
tgtaattccagctactcagg

SEQ ID NO: 39792 - DNA, 20 bp, synthetic construct
  misc_feature 1..20: note = CRISPR gRNA sequence
  source 1..20: mol_type = other DNA
ttccagctactcaggaggct

SEQ ID NO: 39793 - DNA, 20 bp, synthetic construct
  misc_feature 1..20: note = CRISPR gRNA sequence
  source 1..20: mol_type = other DNA
tccagctactcaggaggctg

SEQ ID NO: 39794 - DNA, 20 bp, synthetic construct
  misc_feature 1..20: note = CRISPR gRNA sequence
  source 1..20: mol_type = other DNA
agctactcaggaggctgagg

SEQ ID NO: 39795 - DNA, 20 bp, synthetic construct
  misc_feature 1..20: note = CRISPR gRNA sequence
  source 1..20: mol_type = other DNA
gctactcaggaggctgaggc

SEQ ID NO: 39796 - DNA, 20 bp, synthetic construct
  misc_feature 1..20: note = CRISPR gRNA sequence
  source 1..20: mol_type = other DNA
tactcaggaggctgaggcag

SEQ ID NO: 39797 - DNA, 20 bp, synthetic construct
  misc_feature 1..20: note = CRISPR gRNA sequence
  source 1..20: mol_type = other DNA
ggctgaggcaggagaatcgc

SEQ ID NO: 39798 - DNA, 20 bp, synthetic construct
  misc_feature 1..20: note = CRISPR gRNA sequence
  source 1..20: mol_type = other DNA
gcaggagaatcgctggaacc

SEQ ID NO: 39799 - DNA, 20 bp, synthetic construct
  misc_feature 1..20: note = CRISPR gRNA sequence
  source 1..20: mol_type = other DNA
caggagaatcgctggaacct

SEQ ID NO: 39800 - DNA, 20 bp, synthetic construct
  misc_feature 1..20: note = CRISPR gRNA sequence
  source 1..20: mol_type = other DNA
ggagaatcgctggaacctgg

SEQ ID NO: 39801 - DNA, 20 bp, synthetic construct
  misc_feature 1..20: note = CRISPR gRNA sequence
  source 1..20: mol_type = other DNA
gagaatcgctggaacctggg

SEQ ID NO: 39802 - DNA, 20 bp, synthetic construct
  misc_feature 1..20: note = CRISPR gRNA sequence
  source 1..20: mol_type = other DNA
aatcgctggaacctgggagg

SEQ ID NO: 39803 - DNA, 20 bp, synthetic construct
  misc_feature 1..20: note = CRISPR gRNA sequence
  source 1..20: mol_type = other DNA
tcgctggaacctgggaggcg

SEQ ID NO: 39804 - DNA, 20 bp, synthetic construct
  misc_feature 1..20: note = CRISPR gRNA sequence
  source 1..20: mol_type = other DNA
cgctggaacctgggaggcgg

SEQ ID NO: 39805 - DNA, 20 bp, synthetic construct
  misc_feature 1..20: note = CRISPR gRNA sequence
  source 1..20: mol_type = other DNA
aacctgggaggcggaggttg

SEQ ID NO: 39806 - DNA, 20 bp, synthetic construct
  misc_feature 1..20: note = CRISPR gRNA sequence
  source 1..20: mol_type = other DNA
tgggaggcggaggttgcagt

SEQ ID NO: 39807 - DNA, 20 bp, synthetic construct
  misc_feature 1..20: note = CRISPR gRNA sequence
  source 1..20: mol_type = other DNA
ggcggaggttgcagtgagcc

SEQ ID NO: 39808 - DNA, 20 bp, synthetic construct
  misc_feature 1..20: note = CRISPR gRNA sequence
  source 1..20: mol_type = other DNA
gagatcatgccactgcactc

SEQ ID NO: 39809 - DNA, 20 bp, synthetic construct
  misc_feature 1..20: note = CRISPR gRNA sequence
  source 1..20: mol_type = other DNA
catgccactgcactccagcc

SEQ ID NO: 39810 - DNA, 20 bp, synthetic construct
  misc_feature 1..20: note = CRISPR gRNA sequence
  source 1..20: mol_type = other DNA
atgccactgcactccagcct

SEQ ID NO: 39811 - DNA, 20 bp, synthetic construct
  misc_feature 1..20: note = CRISPR gRNA sequence
  source 1..20: mol_type = other DNA
gccactgcactccagcctgg

SEQ ID NO: 39812 - DNA, 20 bp, synthetic construct
  misc_feature 1..20: note = CRISPR gRNA sequence
  source 1..20: mol_type = other DNA
ctgcactccagcctgggaga

SEQ ID NO: 39813 - DNA, 20 bp, synthetic construct
  misc_feature 1..20: note = CRISPR gRNA sequence
  source 1..20: mol_type = other DNA
gcactccagcctgggagaca

SEQ ID NO: 39814 - DNA, 20 bp, synthetic construct
  misc_feature 1..20: note = CRISPR gRNA sequence
  source 1..20: mol_type = other DNA
tccagcctgggagacagagc

SEQ ID NO: 39815 - DNA, 20 bp, synthetic construct
  misc_feature 1..20: note = CRISPR gRNA sequence
  source 1..20: mol_type = other DNA
attaaaaaaaaaaaaaaaaa

SEQ ID NO: 39816 - DNA, 20 bp, synthetic construct
  misc_feature 1..20: note = CRISPR gRNA sequence
  source 1..20: mol_type = other DNA
taaaaaaaaaaaaaaaaaaa

SEQ ID NO: 39817 - DNA, 20 bp, synthetic construct
  misc_feature 1..20: note = CRISPR gRNA sequence
  source 1..20: mol_type = other DNA
aaaaaaaaaaaaaaaaaaga

SEQ ID NO: 39818 - DNA, 20 bp, synthetic construct
  misc_feature 1..20: note = CRISPR gRNA sequence
  source 1..20: mol_type = other DNA
aaaaaaaaaaaaaaaagaga

SEQ ID NO: 39819 - DNA, 20 bp, synthetic construct
  misc_feature 1..20: note = CRISPR gRNA sequence
  source 1..20: mol_type = other DNA
aaaaaaaaaaagagagagca

SEQ ID NO: 39820 - DNA, 20 bp, synthetic construct
  misc_feature 1..20: note = CRISPR gRNA sequence
  source 1..20: mol_type = other DNA
tgttcccatcaataatgatc

SEQ ID NO: 39821 - DNA, 20 bp, synthetic construct
  misc_feature 1..20: note = CRISPR gRNA sequence
  source 1..20: mol_type = other DNA
ttatttgtcatccctgcttc

SEQ ID NO: 39822 - DNA, 20 bp, synthetic construct
  misc_feature 1..20: note = CRISPR gRNA sequence
  source 1..20: mol_type = other DNA
ttaaaaaactaatgtttaaa

SEQ ID NO: 39823 - DNA, 20 bp, synthetic construct
  misc_feature 1..20: note = CRISPR gRNA sequence
  source 1..20: mol_type = other DNA
aaaaaactaatgtttaaaaa

SEQ ID NO: 39824 - DNA, 20 bp, synthetic construct
  misc_feature 1..20: note = CRISPR gRNA sequence
  source 1..20: mol_type = other DNA
atgtttaaaaagagaatcta

SEQ ID NO: 39825 - DNA, 20 bp, synthetic construct
  misc_feature 1..20: note = CRISPR gRNA sequence
  source 1..20: mol_type = other DNA
taaaacaaaaattattgcac

SEQ ID NO: 39826 - DNA, 20 bp, synthetic construct
  misc_feature 1..20: note = CRISPR gRNA sequence
  source 1..20: mol_type = other DNA
aaaattattgcactagaaaa

SEQ ID NO: 39827 - DNA, 20 bp, synthetic construct
  misc_feature 1..20: note = CRISPR gRNA sequence
  source 1..20: mol_type = other DNA
attattgcactagaaaatgg

SEQ ID NO: 39828 - DNA, 20 bp, synthetic construct
  misc_feature 1..20: note = CRISPR gRNA sequence
  source 1..20: mol_type = other DNA
ttattgcactagaaaatgga

SEQ ID NO: 39829 - DNA, 20 bp, synthetic construct
  misc_feature 1..20: note = CRISPR gRNA sequence
  source 1..20: mol_type = other DNA
actagaaaatggaaggtttg

SEQ ID NO: 39830 - DNA, 20 bp, synthetic construct
  misc_feature 1..20: note = CRISPR gRNA sequence
  source 1..20: mol_type = other DNA
ctagaaaatggaaggtttga

SEQ ID NO: 39831 - DNA, 20 bp, synthetic construct
  misc_feature 1..20: note = CRISPR gRNA sequence
  source 1..20: mol_type = other DNA
ggtttgaaggactcactcca

SEQ ID NO: 39832 - DNA, 20 bp, synthetic construct
  misc_feature 1..20: note = CRISPR gRNA sequence
  source 1..20: mol_type = other DNA
gtttgaaggactcactccaa

SEQ ID NO: 39833 - DNA, 20 bp, synthetic construct
  misc_feature 1..20: note = CRISPR gRNA sequence
  source 1..20: mol_type = other DNA
ggactcactccaaaggttac

SEQ ID NO: 39834 - DNA, 20 bp, synthetic construct
  misc_feature 1..20: note = CRISPR gRNA sequence
  source 1..20: mol_type = other DNA
gactcactccaaaggttacc

SEQ ID NO: 39835 - DNA, 20 bp, synthetic construct
  misc_feature 1..20: note = CRISPR gRNA sequence
  source 1..20: mol_type = other DNA
actcactccaaaggttacca

SEQ ID NO: 39836 - DNA, 20 bp, synthetic construct
  misc_feature 1..20: note = CRISPR gRNA sequence
  source 1..20: mol_type = other DNA
ctcactccaaaggttaccag

SEQ ID NO: 39837 - DNA, 20 bp, synthetic construct
  misc_feature 1..20: note = CRISPR gRNA sequence
  source 1..20: mol_type = other DNA
gggtaatccacacatacttt

SEQ ID NO: 39838 - DNA, 20 bp, synthetic construct
  misc_feature 1..20: note = CRISPR gRNA sequence
  source 1..20: mol_type = other DNA
atccacacatactttgagca

SEQ ID NO: 39839 - DNA, 20 bp, synthetic construct
  misc_feature 1..20: note = CRISPR gRNA sequence
  source 1..20: mol_type = other DNA
acacatactttgagcacaga

SEQ ID NO: 39840 - DNA, 20 bp, synthetic construct
  misc_feature 1..20: note = CRISPR gRNA sequence
  source 1..20: mol_type = other DNA
agcacagacagaacactgac

SEQ ID NO: 39841 - DNA, 20 bp, synthetic construct
  misc_feature 1..20: note = CRISPR gRNA sequence
  source 1..20: mol_type = other DNA
acagacagaacactgactag

SEQ ID NO: 39842 - DNA, 20 bp, synthetic construct
  misc_feature 1..20: note = CRISPR gRNA sequence
  source 1..20: mol_type = other DNA
agacagaacactgactagca

SEQ ID NO: 39843 - DNA, 20 bp, synthetic construct
  misc_feature 1..20: note = CRISPR gRNA sequence
  source 1..20: mol_type = other DNA
acagaacactgactagcaga

SEQ ID NO: 39844 - DNA, 20 bp, synthetic construct
  misc_feature 1..20: note = CRISPR gRNA sequence
  source 1..20: mol_type = other DNA
agaacactgactagcagaga

SEQ ID NO: 39845 - DNA, 20 bp, synthetic construct
  misc_feature 1..20: note = CRISPR gRNA sequence
  source 1..20: mol_type = other DNA
gaacactgactagcagagag

SEQ ID NO: 39846 - DNA, 20 bp, synthetic construct
  misc_feature 1..20: note = CRISPR gRNA sequence
  source 1..20: mol_type = other DNA
aacactgactagcagagaga

SEQ ID NO: 39847 - DNA, 20 bp, synthetic construct
  misc_feature 1..20: note = CRISPR gRNA sequence
  source 1..20: mol_type = other DNA
acactgactagcagagagag

SEQ ID NO: 39848 - DNA, 20 bp, synthetic construct
  misc_feature 1..20: note = CRISPR gRNA sequence
  source 1..20: mol_type = other DNA
actagcagagagaggggttt

SEQ ID NO: 39849 - DNA, 20 bp, synthetic construct
  misc_feature 1..20: note = CRISPR gRNA sequence
  source 1..20: mol_type = other DNA
cagagagaggggtttcagtc

SEQ ID NO: 39850 - DNA, 20 bp, synthetic construct
  misc_feature 1..20: note = CRISPR gRNA sequence
  source 1..20: mol_type = other DNA
agagagaggggtttcagtct

SEQ ID NO: 39851 - DNA, 20 bp, synthetic construct
  misc_feature 1..20: note = CRISPR gRNA sequence
  source 1..20: mol_type = other DNA
gagagaggggtttcagtctg

SEQ ID NO: 39852 - DNA, 20 bp, synthetic construct
  misc_feature 1..20: note = CRISPR gRNA sequence
  source 1..20: mol_type = other DNA
gggtttcagtctggggctaa

SEQ ID NO: 39853 - DNA, 20 bp, synthetic construct
  misc_feature 1..20: note = CRISPR gRNA sequence
  source 1..20: mol_type = other DNA
gtttcagtctggggctaaaa

SEQ ID NO: 39854 - DNA, 20 bp, synthetic construct
  misc_feature 1..20: note = CRISPR gRNA sequence
  source 1..20: mol_type = other DNA
ttcagtctggggctaaaaga

SEQ ID NO: 39855 - DNA, 20 bp, synthetic construct
  misc_feature 1..20: note = CRISPR gRNA sequence
  source 1..20: mol_type = other DNA
tggggctaaaagagagaaca

SEQ ID NO: 39856 - DNA, 20 bp, synthetic construct
  misc_feature 1..20: note = CRISPR gRNA sequence
  source 1..20: mol_type = other DNA
cacagaatttgttttctttt

SEQ ID NO: 39857 - DNA, 20 bp, synthetic construct
  misc_feature 1..20: note = CRISPR gRNA sequence
  source 1..20: mol_type = other DNA
tgttttcttttaagacttgc

SEQ ID NO: 39858 - DNA, 20 bp, synthetic construct
  misc_feature 1..20: note = CRISPR gRNA sequence
  source 1..20: mol_type = other DNA
gttttcttttaagacttgcc

SEQ ID NO: 39859 - DNA, 20 bp, synthetic construct
  misc_feature 1..20: note = CRISPR gRNA sequence
  source 1..20: mol_type = other DNA
ttttaagacttgccaggaaa

SEQ ID NO: 39860 - DNA, 20 bp, synthetic construct
  misc_feature 1..20: note = CRISPR gRNA sequence
  source 1..20: mol_type = other DNA
tttaagacttgccaggaaat

SEQ ID NO: 39861 - DNA, 20 bp, synthetic construct
  misc_feature 1..20: note = CRISPR gRNA sequence
  source 1..20: mol_type = other DNA
ttaagacttgccaggaaatg

SEQ ID NO: 39862 - DNA, 20 bp, synthetic construct
  misc_feature 1..20: note = CRISPR gRNA sequence
  source 1..20: mol_type = other DNA
gccaggaaatggggcttact

SEQ ID NO: 39863 - DNA, 20 bp, synthetic construct
  misc_feature 1..20: note = CRISPR gRNA sequence
  source 1..20: mol_type = other DNA
ccaggaaatggggcttactt

SEQ ID NO: 39864 - DNA, 20 bp, synthetic construct
  misc_feature 1..20: note = CRISPR gRNA sequence
  source 1..20: mol_type = other DNA
aatggggcttacttaggcaa

SEQ ID NO: 39865 - DNA, 20 bp, synthetic construct
  misc_feature 1..20: note = CRISPR gRNA sequence
  source 1..20: mol_type = other DNA
atacatttgtgaaatatctg

SEQ ID NO: 39866 - DNA, 20 bp, synthetic construct
  misc_feature 1..20: note = CRISPR gRNA sequence
  source 1..20: mol_type = other DNA
catttgtgaaatatctgtgg

SEQ ID NO: 39867 - DNA, 20 bp, synthetic construct
  misc_feature 1..20: note = CRISPR gRNA sequence
  source 1..20: mol_type = other DNA
tgtgaaatatctgtggtaga

SEQ ID NO: 39868 - DNA, 20 bp, synthetic construct
  misc_feature 1..20: note = CRISPR gRNA sequence
  source 1..20: mol_type = other DNA
tatctgtggtagaaagattt

SEQ ID NO: 39869 - DNA, 20 bp, synthetic construct
  misc_feature 1..20: note = CRISPR gRNA sequence
  source 1..20: mol_type = other DNA
gaaagatttcagccctccaa

SEQ ID NO: 39870 - DNA, 20 bp, synthetic construct
  misc_feature 1..20: note = CRISPR gRNA sequence
  source 1..20: mol_type = other DNA
atttcagccctccaaaagct

SEQ ID NO: 39871 - DNA, 20 bp, synthetic construct
  misc_feature 1..20: note = CRISPR gRNA sequence
  source 1..20: mol_type = other DNA
ttcagccctccaaaagctca

SEQ ID NO: 39872 - DNA, 20 bp, synthetic construct
  misc_feature 1..20: note = CRISPR gRNA sequence
  source 1..20: mol_type = other DNA
tcagccctccaaaagctcag

SEQ ID NO: 39873 - DNA, 20 bp, synthetic construct
  misc_feature 1..20: note = CRISPR gRNA sequence
  source 1..20: mol_type = other DNA
gccctccaaaagctcagagg

SEQ ID NO: 39874 - DNA, 20 bp, synthetic construct
  misc_feature 1..20: note = CRISPR gRNA sequence
  source 1..20: mol_type = other DNA
tccaaaagctcagaggaagt

SEQ ID NO: 39875 - DNA, 20 bp, synthetic construct
  misc_feature 1..20: note = CRISPR gRNA sequence
  source 1..20: mol_type = other DNA
caaaagctcagaggaagtca

SEQ ID NO: 39876 - DNA, 20 bp, synthetic construct
  misc_feature 1..20: note = CRISPR gRNA sequence
  source 1..20: mol_type = other DNA
aaaagctcagaggaagtcag

SEQ ID NO: 39877 - DNA, 20 bp, synthetic construct
  misc_feature 1..20: note = CRISPR gRNA sequence
  source 1..20: mol_type = other DNA
aaagctcagaggaagtcaga

SEQ ID NO: 39878 - DNA, 20 bp, synthetic construct
  misc_feature 1..20: note = CRISPR gRNA sequence
  source 1..20: mol_type = other DNA
aagctcagaggaagtcagag

SEQ ID NO: 39879 - DNA, 20 bp, synthetic construct
  misc_feature 1..20: note = CRISPR gRNA sequence
  source 1..20: mol_type = other DNA
gctcagaggaagtcagaggg

SEQ ID NO: 39880 - DNA, 20 bp, synthetic construct
  misc_feature 1..20: note = CRISPR gRNA sequence
  source 1..20: mol_type = other DNA
agaggaagtcagaggggagt

SEQ ID NO: 39881 - DNA, 20 bp, synthetic construct
  misc_feature 1..20: note = CRISPR gRNA sequence
  source 1..20: mol_type = other DNA
aggaagtcagaggggagtca

SEQ ID NO: 39882 - DNA, 20 bp, synthetic construct
  misc_feature 1..20: note = CRISPR gRNA sequence
  source 1..20: mol_type = other DNA
ggaagtcagaggggagtcag

SEQ ID NO: 39883 - DNA, 20 bp, synthetic construct
  misc_feature 1..20: note = CRISPR gRNA sequence
  source 1..20: mol_type = other DNA
agtcagaggggagtcagagg

SEQ ID NO: 39884 - DNA, 20 bp, synthetic construct
  misc_feature 1..20: note = CRISPR gRNA sequence
  source 1..20: mol_type = other DNA
cagaggggagtcagaggaag

SEQ ID NO: 39885 - DNA, 20 bp, synthetic construct
  misc_feature 1..20: note = CRISPR gRNA sequence
  source 1..20: mol_type = other DNA
ggagtcagaggaagtggctg

SEQ ID NO: 39886 - DNA, 20 bp, synthetic construct
  misc_feature 1..20: note = CRISPR gRNA sequence
  source 1..20: mol_type = other DNA
tcagaggaagtggctgcagc

SEQ ID NO: 39887 - DNA, 20 bp, synthetic construct
  misc_feature 1..20: note = CRISPR gRNA sequence
  source 1..20: mol_type = other DNA
agaggaagtggctgcagctg

SEQ ID NO: 39888 - DNA, 20 bp, synthetic construct
  misc_feature 1..20: note = CRISPR gRNA sequence
  source 1..20: mol_type = other DNA
gaggaagtggctgcagctgg

SEQ ID NO: 39889 - DNA, 20 bp, synthetic construct
  misc_feature 1..20: note = CRISPR gRNA sequence
  source 1..20: mol_type = other DNA
gaagtggctgcagctggagg

SEQ ID NO: 39890 - DNA, 20 bp, synthetic construct
  misc_feature 1..20: note = CRISPR gRNA sequence
  source 1..20: mol_type = other DNA
aagtggctgcagctggaggc

SEQ ID NO: 39891 - DNA, 20 bp, synthetic construct
  misc_feature 1..20: note = CRISPR gRNA sequence
  source 1..20: mol_type = other DNA
agtggctgcagctggaggca

SEQ ID NO: 39892 - DNA, 20 bp, synthetic construct
  misc_feature 1..20: note = CRISPR gRNA sequence
  source 1..20: mol_type = other DNA
gtggctgcagctggaggcag

SEQ ID NO: 39893 - DNA, 20 bp, synthetic construct
  misc_feature 1..20: note = CRISPR gRNA sequence
  source 1..20: mol_type = other DNA
tggctgcagctggaggcagg

SEQ ID NO: 39894 - DNA, 20 bp, synthetic construct
  misc_feature 1..20: note = CRISPR gRNA sequence
  source 1..20: mol_type = other DNA
tgcagctggaggcaggggga

SEQ ID NO: 39895 - DNA, 20 bp, synthetic construct
  misc_feature 1..20: note = CRISPR gRNA sequence
  source 1..20: mol_type = other DNA
gaggcagggggatggaactt

SEQ ID NO: 39896 - DNA, 20 bp, synthetic construct
  misc_feature 1..20: note = CRISPR gRNA sequence
  source 1..20: mol_type = other DNA
ggcagggggatggaacttga

SEQ ID NO: 39897 - DNA, 20 bp, synthetic construct
  misc_feature 1..20: note = CRISPR gRNA sequence
  source 1..20: mol_type = other DNA
gcagggggatggaacttgag

SEQ ID NO: 39898 - DNA, 20 bp, synthetic construct
  misc_feature 1..20: note = CRISPR gRNA sequence
  source 1..20: mol_type = other DNA
tggaacttgagaggtcctcc

SEQ ID NO: 39899 - DNA, 20 bp, synthetic construct
  misc_feature 1..20: note = CRISPR gRNA sequence
  source 1..20: mol_type = other DNA
ggaacttgagaggtcctccc

SEQ ID NO: 39900 - DNA, 20 bp, synthetic construct
  misc_feature 1..20: note = CRISPR gRNA sequence
  source 1..20: mol_type = other DNA
cttgagaggtcctcccgggc

SEQ ID NO: 39901 - DNA, 20 bp, synthetic construct
  misc_feature 1..20: note = CRISPR gRNA sequence
  source 1..20: mol_type = other DNA
ttgagaggtcctcccgggcc

SEQ ID NO: 39902 - DNA, 20 bp, synthetic construct
  misc_feature 1..20: note = CRISPR gRNA sequence
  source 1..20: mol_type = other DNA
tgagaggtcctcccgggcca

SEQ ID NO: 39903 - DNA, 20 bp, synthetic construct
  misc_feature 1..20: note = CRISPR gRNA sequence
  source 1..20: mol_type = other DNA
gagaggtcctcccgggccag

SEQ ID NO: 39904 - DNA, 20 bp, synthetic construct
  misc_feature 1..20: note = CRISPR gRNA sequence
  source 1..20: mol_type = other DNA
cctcccgggccaggggtaaa

SEQ ID NO: 39905 - DNA, 20 bp, synthetic construct
  misc_feature 1..20: note = CRISPR gRNA sequence
  source 1..20: mol_type = other DNA
gggccaggggtaaaaagtga

SEQ ID NO: 39906 - DNA, 20 bp, synthetic construct
  misc_feature 1..20: note = CRISPR gRNA sequence
  source 1..20: mol_type = other DNA
ggccaggggtaaaaagtgac

SEQ ID NO: 39907 - DNA, 20 bp, synthetic construct
  misc_feature 1..20: note = CRISPR gRNA sequence
  source 1..20: mol_type = other DNA
aggggtaaaaagtgacaggc

SEQ ID NO: 39908 - DNA, 20 bp, synthetic construct
  misc_feature 1..20: note = CRISPR gRNA sequence
  source 1..20: mol_type = other DNA
ggggtaaaaagtgacaggcc

SEQ ID NO: 39909 - DNA, 20 bp, synthetic construct
  misc_feature 1..20: note = CRISPR gRNA sequence
  source 1..20: mol_type = other DNA
aaaaagtgacaggccgggca

SEQ ID NO: 39910 - DNA, 20 bp, synthetic construct
  misc_feature 1..20: note = CRISPR gRNA sequence
  source 1..20: mol_type = other DNA
aagtgacaggccgggcacgg

SEQ ID NO: 39911 - DNA, 20 bp, synthetic construct
  misc_feature 1..20: note = CRISPR gRNA sequence
  source 1..20: mol_type = other DNA
gtggctcacacctatcatcc

SEQ ID NO: 39912 - DNA, 20 bp, synthetic construct
  misc_feature 1..20: note = CRISPR gRNA sequence
  source 1..20: mol_type = other DNA
cacctatcatcccagcactt

SEQ ID NO: 39913 - DNA, 20 bp, synthetic construct
  misc_feature 1..20: note = CRISPR gRNA sequence
  source 1..20: mol_type = other DNA
acctatcatcccagcacttt

SEQ ID NO: 39914 - DNA, 20 bp, synthetic construct
  misc_feature 1..20: note = CRISPR gRNA sequence
  source 1..20: mol_type = other DNA
tatcatcccagcactttggg

SEQ ID NO: 39915 - DNA, 20 bp, synthetic construct
  misc_feature 1..20: note = CRISPR gRNA sequence
  source 1..20: mol_type = other DNA
tcccagcactttgggaagca

SEQ ID NO: 39916 - DNA, 20 bp, synthetic construct
  misc_feature 1..20: note = CRISPR gRNA sequence
  source 1..20: mol_type = other DNA
cccagcactttgggaagcaa

SEQ ID NO: 39917 - DNA, 20 bp, synthetic construct
  misc_feature 1..20: note = CRISPR gRNA sequence
  source 1..20: mol_type = other DNA
agcactttgggaagcaaagg

SEQ ID NO: 39918 - DNA, 20 bp, synthetic construct
  misc_feature 1..20: note = CRISPR gRNA sequence
  source 1..20: mol_type = other DNA
gcactttgggaagcaaaggt

SEQ ID NO: 39919 - DNA, 20 bp, synthetic construct
  misc_feature 1..20: note = CRISPR gRNA sequence
  source 1..20: mol_type = other DNA
actttgggaagcaaaggtgg

SEQ ID NO: 39920 - DNA, 20 bp, synthetic construct
  misc_feature 1..20: note = CRISPR gRNA sequence
  source 1..20: mol_type = other DNA
ctttgggaagcaaaggtggg

SEQ ID NO: 39921 - DNA, 20 bp, synthetic construct
  misc_feature 1..20: note = CRISPR gRNA sequence
  source 1..20: mol_type = other DNA
caaaggtgggaggatcacct

SEQ ID NO: 39922 - DNA, 20 bp, synthetic construct
  misc_feature 1..20: note = CRISPR gRNA sequence
  source 1..20: mol_type = other DNA
gtgggaggatcacctgagcc

SEQ ID NO: 39923 - DNA, 20 bp, synthetic construct
  misc_feature 1..20: note = CRISPR gRNA sequence
  source 1..20: mol_type = other DNA
ggaggatcacctgagcccag

SEQ ID NO: 39924 - DNA, 20 bp, synthetic construct
  misc_feature 1..20: note = CRISPR gRNA sequence
  source 1..20: mol_type = other DNA
tcacctgagcccagaagttc

SEQ ID NO: 39925 - DNA, 20 bp, synthetic construct
  misc_feature 1..20: note = CRISPR gRNA sequence
  source 1..20: mol_type = other DNA
tgagcccagaagttcgagac

SEQ ID NO: 39926 - DNA, 20 bp, synthetic construct
  misc_feature 1..20: note = CRISPR gRNA sequence
  source 1..20: mol_type = other DNA
agcccagaagttcgagacca

SEQ ID NO: 39927 - DNA, 20 bp, synthetic construct
  misc_feature 1..20: note = CRISPR gRNA sequence
  source 1..20: mol_type = other DNA
ccagaagttcgagaccagag

SEQ ID NO: 39928 - DNA, 20 bp, synthetic construct
  misc_feature 1..20: note = CRISPR gRNA sequence
  source 1..20: mol_type = other DNA
cgagaccagagtagacaaca

SEQ ID NO: 39929 - DNA, 20 bp, synthetic construct
  misc_feature 1..20: note = CRISPR gRNA sequence
  source 1..20: mol_type = other DNA
tacatacttttttttttaat

SEQ ID NO: 39930 - DNA, 20 bp, synthetic construct
  misc_feature 1..20: note = CRISPR gRNA sequence
  source 1..20: mol_type = other DNA
tacttttttttttaattagc

SEQ ID NO: 39931 - DNA, 20 bp, synthetic construct
  misc_feature 1..20: note = CRISPR gRNA sequence
  source 1..20: mol_type = other DNA
acttttttttttaattagct

SEQ ID NO: 39932 - DNA, 20 bp, synthetic construct
  misc_feature 1..20: note = CRISPR gRNA sequence
  source 1..20: mol_type = other DNA
ttttaattagctgggcctga

SEQ ID NO: 39933 - DNA, 20 bp, synthetic construct
  misc_feature 1..20: note = CRISPR gRNA sequence
  source 1..20: mol_type = other DNA
ttagctgggcctgatggcac

SEQ ID NO: 39934 - DNA, 20 bp, synthetic construct
  misc_feature 1..20: note = CRISPR gRNA sequence
  source 1..20: mol_type = other DNA
atggcacaagcctgtaatcc

SEQ ID NO: 39935 - DNA, 20 bp, synthetic construct
  misc_feature 1..20: note = CRISPR gRNA sequence
  source 1..20: mol_type = other DNA
agcctgtaatcccagctact

SEQ ID NO: 39936 - DNA, 20 bp, synthetic construct
  misc_feature 1..20: note = CRISPR gRNA sequence
  source 1..20: mol_type = other DNA
gcctgtaatcccagctactc

SEQ ID NO: 39937 - DNA, 20 bp, synthetic construct
  misc_feature 1..20: note = CRISPR gRNA sequence
  source 1..20: mol_type = other DNA
ctgtaatcccagctactcag

SEQ ID NO: 39938 - DNA, 20 bp, synthetic construct
  misc_feature 1..20: note = CRISPR gRNA sequence
  source 1..20: mol_type = other DNA
tgtaatcccagctactcagg

SEQ ID NO: 39939 - DNA, 20 bp, synthetic construct
  misc_feature 1..20: note = CRISPR gRNA sequence
  source 1..20: mol_type = other DNA
cccagctactcaggaggctg

SEQ ID NO: 39940 - DNA, 20 bp, synthetic construct
  misc_feature 1..20: note = CRISPR gRNA sequence
  source 1..20: mol_type = other DNA
agctactcaggaggctgaag

SEQ ID NO: 39941 - DNA, 20 bp, synthetic construct
  misc_feature 1..20: note = CRISPR gRNA sequence
  source 1..20: mol_type = other DNA
gctactcaggaggctgaagt

SEQ ID NO: 39942 - DNA, 20 bp, synthetic construct
  misc_feature 1..20: note = CRISPR gRNA sequence
  source 1..20: mol_type = other DNA
tactcaggaggctgaagtgg

SEQ ID NO: 39943 - DNA, 20 bp, synthetic construct
  misc_feature 1..20: note = CRISPR gRNA sequence
  source 1..20: mol_type = other DNA
actcaggaggctgaagtggg

SEQ ID NO: 39944 - DNA, 20 bp, synthetic construct
  misc_feature 1..20: note = CRISPR gRNA sequence
  source 1..20: mol_type = other DNA
ctgaagtgggaggattgctt

SEQ ID NO: 39945 - DNA, 20 bp, synthetic construct
  misc_feature 1..20: note = CRISPR gRNA sequence
  source 1..20: mol_type = other DNA
gtgggaggattgcttgagcc

SEQ ID NO: 39946 - DNA, 20 bp, synthetic construct
  misc_feature 1..20: note = CRISPR gRNA sequence
  source 1..20: mol_type = other DNA
tgggaggattgcttgagccc

SEQ ID NO: 39947 - DNA, 20 bp, synthetic construct
  misc_feature 1..20: note = CRISPR gRNA sequence
  source 1..20: mol_type = other DNA
ggaggattgcttgagcccag

SEQ ID NO: 39948 - DNA, 20 bp, synthetic construct
  misc_feature 1..20: note = CRISPR gRNA sequence
  source 1..20: mol_type = other DNA
gaggattgcttgagcccagg

SEQ ID NO: 39949 - DNA, 20 bp, synthetic construct
  misc_feature 1..20: note = CRISPR gRNA sequence
  source 1..20: mol_type = other DNA
gattgcttgagcccaggagg

SEQ ID NO: 39950 - DNA, 20 bp, synthetic construct
  misc_feature 1..20: note = CRISPR gRNA sequence
  source 1..20: mol_type = other DNA
ttgcttgagcccaggaggtg

SEQ ID NO: 39951 - DNA, 20 bp, synthetic construct
  misc_feature 1..20: note = CRISPR gRNA sequence
  source 1..20: mol_type = other DNA
tgcttgagcccaggaggtgg

SEQ ID NO: 39952 - DNA, 20 bp, synthetic construct
  misc_feature 1..20: note = CRISPR gRNA sequence
  source 1..20: mol_type = other DNA
agcccaggaggtggaggctt

SEQ ID NO: 39953 - DNA, 20 bp, synthetic construct
  misc_feature 1..20: note = CRISPR gRNA sequence
  source 1..20: mol_type = other DNA
caggaggtggaggcttcagt

SEQ ID NO: 39954 - DNA, 20 bp, synthetic construct
  misc_feature 1..20: note = CRISPR gRNA sequence
  source 1..20: mol_type = other DNA
atgattgcaccactgcacac

SEQ ID NO: 39955 - DNA, 20 bp, synthetic construct
  misc_feature 1..20: note = CRISPR gRNA sequence
  source 1..20: mol_type = other DNA
tgcaccactgcacaccagct

SEQ ID NO: 39956 - DNA, 20 bp, synthetic construct
  misc_feature 1..20: note = CRISPR gRNA sequence
  source 1..20: mol_type = other DNA
gcaccactgcacaccagctt

SEQ ID NO: 39957 - DNA, 20 bp, synthetic construct
  misc_feature 1..20: note = CRISPR gRNA sequence
  source 1..20: mol_type = other DNA
ctgcacaccagcttgggcaa

SEQ ID NO: 39958 - DNA, 20 bp, synthetic construct
  misc_feature 1..20: note = CRISPR gRNA sequence
  source 1..20: mol_type = other DNA
accagcttgggcaacagact

SEQ ID NO: 39959 - DNA, 20 bp, synthetic construct
  misc_feature 1..20: note = CRISPR gRNA sequence
  source 1..20: mol_type = other DNA
gactgagaccttctctcaaa

SEQ ID NO: 39960 - DNA, 20 bp, synthetic construct
  misc_feature 1..20: note = CRISPR gRNA sequence
  source 1..20: mol_type = other DNA
gaccttctctcaaaaagaaa

SEQ ID NO: 39961 - DNA, 20 bp, synthetic construct
  misc_feature 1..20: note = CRISPR gRNA sequence
  source 1..20: mol_type = other DNA
ctctcaaaaagaaatagtaa

SEQ ID NO: 39962 - DNA, 20 bp, synthetic construct
  misc_feature 1..20: note = CRISPR gRNA sequence
  source 1..20: mol_type = other DNA
tctcaaaaagaaatagtaac

SEQ ID NO: 39963 - DNA, 20 bp, synthetic construct
  misc_feature 1..20: note = CRISPR gRNA sequence
  source 1..20: mol_type = other DNA
ctcaaaaagaaatagtaaca

SEQ ID NO: 39964 - DNA, 20 bp, synthetic construct
  misc_feature 1..20: note = CRISPR gRNA sequence
  source 1..20: mol_type = other DNA
caaaaagaaatagtaacagg

SEQ ID NO: 39965 - DNA, 20 bp, synthetic construct
  misc_feature 1..20: note = CRISPR gRNA sequence
  source 1..20: mol_type = other DNA
tcacccctcttttgtcttca

SEQ ID NO: 39966 - DNA, 20 bp, synthetic construct
  misc_feature 1..20: note = CRISPR gRNA sequence
  source 1..20: mol_type = other DNA
tcttttgtcttcacagcctg

SEQ ID NO: 39967 - DNA, 20 bp, synthetic construct
  misc_feature 1..20: note = CRISPR gRNA sequence
  source 1..20: mol_type = other DNA
ctgtgatcttcatgtttgcc

SEQ ID NO: 39968 - DNA, 20 bp, synthetic construct
  misc_feature 1..20: note = CRISPR gRNA sequence
  source 1..20: mol_type = other DNA
tgtgatcttcatgtttgccc

SEQ ID NO: 39969 - DNA, 20 bp, synthetic construct
  misc_feature 1..20: note = CRISPR gRNA sequence
  source 1..20: mol_type = other DNA
tgatcttcatgtttgcccag

SEQ ID NO: 39970 - DNA, 20 bp, synthetic construct
  misc_feature 1..20: note = CRISPR gRNA sequence
  source 1..20: mol_type = other DNA
cttcatgtttgcccaggagc

SEQ ID NO: 39971 - DNA, 20 bp, synthetic construct
  misc_feature 1..20: note = CRISPR gRNA sequence
  source 1..20: mol_type = other DNA
tcatgtttgcccaggagcca

SEQ ID NO: 39972 - DNA, 20 bp, synthetic construct
  misc_feature 1..20: note = CRISPR gRNA sequence
  source 1..20: mol_type = other DNA
catgtttgcccaggagccag

SEQ ID NO: 39973 - DNA, 20 bp, synthetic construct
  misc_feature 1..20: note = CRISPR gRNA sequence
  source 1..20: mol_type = other DNA
tgtttgcccaggagccagag

SEQ ID NO: 39974 - DNA, 20 bp, synthetic construct
  misc_feature 1..20: note = CRISPR gRNA sequence
  source 1..20: mol_type = other DNA
ttgcccaggagccagaggag

SEQ ID NO: 39975 - DNA, 20 bp, synthetic construct
  misc_feature 1..20: note = CRISPR gRNA sequence
  source 1..20: mol_type = other DNA
cccaggagccagaggagcag

SEQ ID NO: 39976 - DNA, 20 bp, synthetic construct
  misc_feature 1..20: note = CRISPR gRNA sequence
  source 1..20: mol_type = other DNA
ccaggagccagaggagcaga

SEQ ID NO: 39977 - DNA, 20 bp, synthetic construct
  misc_feature 1..20: note = CRISPR gRNA sequence
  source 1..20: mol_type = other DNA
caggagccagaggagcagaa

SEQ ID NO: 39978 - DNA, 20 bp, synthetic construct
  misc_feature 1..20: note = CRISPR gRNA sequence
  source 1..20: mol_type = other DNA
aggagccagaggagcagaag

SEQ ID NO: 39979 - DNA, 20 bp, synthetic construct
  misc_feature 1..20: note = CRISPR gRNA sequence
  source 1..20: mol_type = other DNA
cagaggagcagaaggggccc

SEQ ID NO: 39980 - DNA, 20 bp, synthetic construct
  misc_feature 1..20: note = CRISPR gRNA sequence
  source 1..20: mol_type = other DNA
agaggagcagaaggggcccc

SEQ ID NO: 39981 - DNA, 20 bp, synthetic construct
  misc_feature 1..20: note = CRISPR gRNA sequence
  source 1..20: mol_type = other DNA
aggagcagaaggggccccag

SEQ ID NO: 39982 - DNA, 20 bp, synthetic construct
  misc_feature 1..20: note = CRISPR gRNA sequence
  source 1..20: mol_type = other DNA
gagcagaaggggccccagga

SEQ ID NO: 39983 - DNA, 20 bp, synthetic construct
  misc_feature 1..20: note = CRISPR gRNA sequence
  source 1..20: mol_type = other DNA
agcagaaggggccccaggag

SEQ ID NO: 39984 - DNA, 20 bp, synthetic construct
  misc_feature 1..20: note = CRISPR gRNA sequence
  source 1..20: mol_type = other DNA
agaaggggccccaggagagg

SEQ ID NO: 39985 - DNA, 20 bp, synthetic construct
  misc_feature 1..20: note = CRISPR gRNA sequence
  source 1..20: mol_type = other DNA
gaaggggccccaggagaggt

SEQ ID NO: 39986 - DNA, 20 bp, synthetic construct
  misc_feature 1..20: note = CRISPR gRNA sequence
  source 1..20: mol_type = other DNA
aaggggccccaggagaggta

SEQ ID NO: 39987 - DNA, 20 bp, synthetic construct
  misc_feature 1..20: note = CRISPR gRNA sequence
  source 1..20: mol_type = other DNA
tttcaccccaactccatgct

SEQ ID NO: 39988 - DNA, 20 bp, synthetic construct
  misc_feature 1..20: note = CRISPR gRNA sequence
  source 1..20: mol_type = other DNA
accccaactccatgctcagt

SEQ ID NO: 39989 - DNA, 20 bp, synthetic construct
  misc_feature 1..20: note = CRISPR gRNA sequence
  source 1..20: mol_type = other DNA
ccccaactccatgctcagtc

SEQ ID NO: 39990 - DNA, 20 bp, synthetic construct
  misc_feature 1..20: note = CRISPR gRNA sequence
  source 1..20: mol_type = other DNA
cccaactccatgctcagtca

SEQ ID NO: 39991 - DNA, 20 bp, synthetic construct
  misc_feature 1..20: note = CRISPR gRNA sequence
  source 1..20: mol_type = other DNA
attcccctctctaccctcca

SEQ ID NO: 39992 - DNA, 20 bp, synthetic construct
  misc_feature 1..20: note = CRISPR gRNA sequence
  source 1..20: mol_type = other DNA
ccctctctaccctccacagc
